United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 119

SEQ ID NO: 231239 - DNA, 3987 bp, Artificial Sequence
  Description of Artificial Sequence: Synthetic coding sequence
atggagagcagagaccccgctcagcctatgagccccggtgaagcaacccagtcgggagcgaggccggctgataggtatggattacttaagcattctagagagtttctcgacttcttctgggatattgcgaagcccgaacaggagactagactggccgctacagagaagctgctggaatacttacgaggcaggcctaagggatctgagatgaaatatgcactaaagcgcctgatcacagggctgggcgtcggcagggagacagcacggccttgctattcactcgcactggcacagctgctgcagtcgtttgaggacctgcctctatgtagtatcctgcagcagattcaggagaaatatgacctgcatcaagtgaaaaaagcgatgctgagaccagcacttttcgccaacttgtttggggtgttggcactctttcaaagtggtcgcctggtcaaggaccaggaagcactgatgaagtccgtgaagctgctccaggctcttgctcagtaccaaaaccatctgcaggagcagccccgaaaggcccttgtggacatcctttcagaagtgagcaaggccaccttgcaggagatcctgccagaggttctgaaagcagacctcaacatcatcctttcttcacccgagcaactagaactcttcctgctggcacagcagaaggtgccaagcaaactgaagaaacttgtggggagcgtcaacctgttcagcgatgagaatgtcccccgtctggtgaatgtgcttaagatggcggcaagctctgttaagaaagatcggaagctgcctgccattgcactggacctgctgcgcctggcactgaaggaggacaagtttcccagattctggaaagaggttgttgaacaaggcttactcaaaatgcagttttggccagcgagctatttgtgcttccgcctattgggcgcagcactccctctcttgactaaggagcagctgcacctggtgatgcagggcgatgttattaggcactatggggagcatgtttgcaccgcaaagttgcctaagcaatttaaattcgctcctgaaatggacgactacgtgggaacctttctcgaagggtgccaagacgatcctgaaaggcaactcgctgtgctcgtggctttctctagtgtgacaaaccagggactgccggtgacgccgacattctggcgcgtggtgcggttcctatccccacccgcactgcagggatacgtggcctggctgcgcgctatgttcttacagcccgatctcgactcactcgtagacttctctacgaataaccagaagaaggctcaggatagctcacttcatatgccagaaagagccgtattccgcttacgaaagtggattattttccgacttgtgagcatagtcgacagccttcacctggaaatggaggaggctttaactgagcaggtcgccaggttttgtctcttccactcgttcttcgtgaccaagaaacctacaagccagatacctgaaaccaagcatcctttcagtttccctcttgagaatcaggcaagagaagccgtttcgagtgccttctttagcctgctacagacattaagcacacagtttaaacaggccccaggacagacccagggaggccagccttggacctatcacctggttcaattcgcggacctgctcttgaatcatagtcacaatgttactacggtgaccccgttcaccgcccaacagagacaggcctgggatcgaatgcttcaaacgctaaaagagctggaggcccattctgcggaagccagagcggcagctttccagcatttactgttgctcgtaggtattcacttgctgaagtccccagcagaaagctgcgacttgctgggggatattcagacttgcatccgtaaaagtcttggcgaaaagcctagacgaagtcgcaccaaaacaatcgatccacaggagcccccttgggtggaggttctggtcgagattctgctggccctacttgcccagccctcccacctcatgaggcaggttgcacgctcagtgtttggacatatttgtagccacctgaccccaagggccctgcaacttattttggatgtgctgaatccggagactagtgaagacgaaaacgaccgcgtagtggtgaccgacgattccgacgaaaggcgtctgaagggtgccgaggacaaaagcgaagagggagaggacaataggtcatccgaaagcgaggaagagtctgagggagaggagtcagaagaggaagaacgggacggtgacgtggatcagggtttccgagaacaactgatgaccgtattacaggccggaaaggctctgggaggggaggattcagaaaatgaggaagagctgggagatgaggcgatgatggctttagatcagtctcttgcctctctgtttgctgagcaaaagttaaggatacaggctcgccgagacgaaaagaataaactgcagaaggagaaggccctgcggcgagatttccagatcagggtccttgacttagtcgaggtcctcgtgaccaaacaaccagagaacgcacttgtgcttgagctgctggaacccctcttgagtatcatcagaaggagcctgcgatcttcctcgtccaagcaggagcaggacctgttgcacaaaactgccagaatcttcactcatcatctgtgtagggccaggcggtattgccatgacttgggcgaacgcgctggggcactccatgcacaggtcgagagactggtgcagcaagcaggtaggcagcctgactcaccaactgctctctaccacttcaatgcatctctgtacctcttgagggtgctgaaggggaatacggccgagggctgtgtgcacgaaacccaggaaaagcaaaaggctggcaccgacccctcgcatatgccaaccgggcctcaggccgcttcctgtctcgatctcaatctggtgacccgggtatacagcactgccctgagcagctttctcacaaagcgcaacagcccactcacggttccgatgtttctgtcactgttctcccgccaccctgttctctgccaaagccttctgccaattttggtccaacacataaccggcccagtgcgtcctaggcaccaagcgtgcctcttactgcagaaaacactcagcatgcgcgaggtacggtcttgtttcgaagacccagaatggaagcagttaatgggacaggtgctggctaaagtgacggagaacctcagagtcttaggggaggctcagacaaaggcgcagcaccagcaggcccttagcagtctggaactgctgaatgtcctatttcggacctgcaaacacgagaagctgacccttgacctgacggttctgttaggcgtgttgcaaggtcagcagcagagcctgcagcaaggggcacattccacggggagtagccgactccatgacctgtattggcaggccatgaaaacgcttggggtacagcgcccaaagcttgaaaagaaggatgccaaggaaattccttccgctactcaaagcccaataagcaaaaagaggaagaagaaggggtttctccccgaaaccaagaagcgtaagaaacgaaaaagcgaggacggcacccctgcggaggatggcacacccgctgcaacggggggaagtcagcccccttccatgggcaggaaaaaacgcaacaggactaaagcaaaggttccagctcaggccaacggcacccctacaacaaagagcccggctcctggcgctccaacacggagccctagcaccccggctaagtcccctaagctccagaaaaaaaatcagaagccttcacaggtgaacggtgcacctggcagtcctacagaaccggctgggcagaagcaacaccagaaagcgttgcccaaaaaaggtgtactgggcaagagtcctctctccgctttggcacggaaaaaggcaagactgtctctcgtgatcagaagtccatctctcttgcaaagtggcgctaaaaaaaaggcccaagttaggaaagccggaaaaccgtag

SEQ ID NO: 231240 - DNA, 3999 bp, Artificial Sequence
  Description of Artificial Sequence: Synthetic coding sequence
atggagtctagggaccctgcacagcccatgagccccggtgaagcgacacaaagtggcgctaggccagcagataggtatggtctgctgaaacatagcagagagttcctcgattttttctgggacatcgccaagccagagcaggagacgaggctggctgccacagagaaattactggagtacctgagaggcagacctaaaggctcagagatgaaatacgccctgaagaggctcatcactggactgggagtggggagagaaacggcccgaccatgctacagcctggctttggctcaactcttgcagtctttcgaggacttgcctctgtgctcgatcctacaacagatccaggagaagtacgacctgcaccaggtcaaaaaggccatgctgagaccagcattattcgccaatttattcggcgttctcgccctgttccagtcaggacgtttggtgaaggaccaggaggctttgatgaagtctgtaaaactactgcaggctctggcccagtatcagaaccacctccaggagcagcccagaaaggccctggtggacatcctgagcgaggtttccaaagccacccttcaggagattttaccagaagtgcttaaagctgatcttaatataattttgagttcacccgagcagctcgagctgttcctgctcgcacagcagaaggtgccctccaagctgaagaagctagttggcagcgtgaatcttttctcagacgagaacgttcctaggctcgtcaatgtgctgaagatggcagcaagctctgtaaagaaggatcggaaactcccagcaatcgccctggacctcttgaggctggcactaaaggaggacaagttcccgaggttttggaaggaggttgtggagcagggtttactgaaaatgcagttctggcccgcttcttatctgtgttttcggttgttgggtgcggcactcccattgttaaccaaggaacagctgcatctggttatgcaaggtgatgttatcagacactacggggaacacgtttgcacagccaagctgcccaagcagtttaaatttgctccagagatggacgactacgtggggacgttcctggagggctgtcaagacgaccctgagcgtcagctggccgtactagtcgcgttctcctctgtgactaaccaggggctgcccgttacaccaactttctggcgggtagtgcgctttctgtcgccaccagctctgcagggttacgtcgcctggctccgcgctatgttcctgcagcctgacctggacagcttagtggatttctccacgaacaaccagaagaaggctcaggattcctcccttcatatgccagagcgggcagtttttcggttgcgtaagtggatcatcttccgcttagtttctatcgtggactctctgcacctcgagatggaggaggccttaaccgagcaggtggcccgattttgcttgttccatagttttttcgtaaccaaaaaacctacttctcagatcccagaaacaaaacaccctttctcctttcccctcgaaaatcaagcccgagaagcagtgagcagcgcattcttctccctcttgcagactctaagtacgcagtttaaacaggcccctggccaaacgcaggggggtcagccctggacgtaccacctggtgcagtttgctgacctcctgctcaaccacagccataacgtaaccaccgtcacccccttcaccgcgcaacaacggcaggcgtgggaccgcatgctccagactttgaaggaactggaagcacactcagctgaggcccgtgcggctgcctttcagcatctgcttttactggtgggaatacacctgttaaagtcacccgcagagtcatgcgatcttcttggggacatccagacctgcattagaaaatcactcggagagaaacctcggaggtcccggaccaagactatagacccacaggaaccgccatgggtagaagtcctggttgagatcctgctggcactcttagcccaacctagtcacttgatgcgacaggtagcgagatcagtcttcggccacatctgttctcaccttacccccagggctctccagctgatcctggacgtgctcaatcctgaaacctccgaagatgagaacgatagagtcgtggtgactgacgacagcgacgaacgcagacttaaaggcgctgaagacaagtctgaagaaggcgaggataatcgctcttccgagtcagaggaagaatcggaaggcgaggagtcagaagaagaggaacgagacggtgacgtagaccaggggttcagagaacagcttatgacagtacttcaggctggcaaggccttggggggagaagacagtgagaacgaagaagagttgggcgatgaggctatgatggccctggaccagtcactcgcgagcctttttgctgagcaaaagctgcgaattcaggccaggcgggatgagaagaataaattgcaaaaggaaaaagcactgcggagggatttccagatccgtgtcctcgatctggtggaggtgttggtaacgaagcagccagaaaatgctctggttctagagcttctcgagccgctgctctcaatcatccggaggagtctgcgttctagcagctccaagcaagaacaggatctcttacacaagactgcccgaatctttacacaccacttatgccgcgcacggcgatattgtcatgacctgggtgagagagccggagcattgcacgcacaggtcgaacggttggttcagcaggcagggcgacagcccgactctcccactgctttatatcacttcaacgcctcactgtatttacttcgtgtgttaaaaggaaatactgccgagggatgcgtccacgagactcaggaaaaacagaaggcaggaacagatccaagccacatgccgaccggtccccaggccgcttcatgcctggacctgaacctcgtgacaagagtttattcaactgccctgtcatcattcctgacgaagcgcaatagtccactgaccgttccgatgtttctgagccttttcagtaggcacccagtcctatgtcagagtttactcccgattttagttcagcatattacaggtccagttcggcctagacaccaggcgtgcctgctgctccagaagactctttccatgcgcgaggtgagatcctgttttgaagacccagaatggaagcaattaatgggacaggttctcgctaaagtcaccgaaaatctcagggtgctgggcgaagcccagaccaaagcccagcatcagcaggcacttagcagtctggagctacttaatgttctgtttcgaacatgtaagcacgaaaagctaacgcttgacttgacggtgctgctgggagtgctgcaggggcagcagcagagcctgcagcagggagctcatagtacagggagcagtcgtctgcatgatctgtactggcaggccatgaaaactctgggtgtgcagagacccaagcttgagaagaaggacgcaaaggagatcccatcagctactcagagtcctatctccaaaaaacggaagaagaaggggttcctgccggaaacaaagaagcgcaaaaagaggaagagcgaggatgggactccagcagaagacggaaccccagccgcaacagggggttcacaacctccctctatggggaggaaaaaacggaaccggaccaaggcaaaagttcctgctcaggccaacggtacacctactactaagagtcctgctcctggcgcacctactcggagcccatcaaccccggctaaatcacccaagctgcaaaagaagaatcaaaaaccctcacaagtgaacggcgcacctggatcacccactgagcctgcagggcagaaacagcaccagaaagcattgccaaagaaaggtgtcctcggtaagagtccgctgagcgccttggctagaaagaaagctaggctctccttagtgatccgcagcccttcactgctgcagtctggtgccaagaagaaagcacaaaccttgagatttacaatttcttctagcaaaaagtag

SEQ ID NO: 231241 - DNA, 1812 bp, Artificial Sequence
  Description of Artificial Sequence: Synthetic coding sequence
atggaatcacgagatccggctcaacctatgtccccaggcgaagccacccagagcggggcaaggccagccgatcgctacggcctgctcaaacactccagagaatttcttgattttttctgggatatcgccaaaccagagcaggaaacaagactggccgctacagagaagttactggagtatcttcgagggagacccaaaggttccgagatgaagtacgccctgaaacgcttgatcacaggcctgggtgttggccgagagactgcacgcccatgctattcactggctctggcacaactgctgcagagcttcgaagacctgcccctgtgcagcatcttacagcaaatacaagaaaagtacgacctgcaccaggtaaagaaagccatgctccgacctgcgctctttgcgaacctattcggtgtactcgcgctcttccagagcggccgtctggtaaaagaccaagaggcactgatgaagtctgtaaagttgctgcaggcccttgcccagtatcagaatcatttgcaagaacagccacgcaaagcccttgtggatattctctcagaggtgtctaaagctacgctgcaagaaatcttgcctgaagtgctgaaggccgacttaaacatcatcctgtcttcccctgaacagttggagctcttcctgctcgcccagcagaaagttccctcgaagcttaaaaagctcgtcggttcagtcaatttgttttccgatgaaaacgtcccgagactggtgaacgtgctgaaaatggccgcaagctcagtaaagaaagaccgtaagctcccggcaatcgctctggatcttctgcgtctggcacttaaggaggacaaattcccgaggttttggaaggaggttgtagaacagggcttgttgaaaatgcaattctggccagcaagctacctatgtttcaggctgctcggagcagcactgcctctgctgacaaaagagcaactgcacctggtgatgcagggcgatgtgataaggcattatggagaacacgtgtgcacagcgaagctccccaaacagtttaaattcgcacctgaaatggatgactacgtcggtaccttcctcgagggctgtcaggatgatccagaacgccagctcgcagtgctggtggccttctcttctgtgaccaatcagggcctgccagtgaccccgacattttggcgtgtggtgaggttcctctccccccctgcactccagggctatgtggcctggctgcgggctatgttcctgcagcctgaccttgacagccttgtcgattttagcactaataatcaaaaaaaggctcaagatagcagtttgcatatgcccgaaagggctgtttttaggcttaggaagtggataatctttcgtctggtgtccatcgtggacagcctgcatttagagatggaagaagctttgacggagcaagtagcaaggttctgcctgttccatagcttttttgtcacaaagaaacctacatcgcagataccggaaactaaaccacaggagagaagcgaggggcctgcccagcctcctcatgcacccggaggcccagagaggccaaaactcgagaagaaagacgcaaaggagattccctcagccgaggatgggacacctgcagccaccggaggatctcagcccccaagcatggggcgtaagaagagaaatcgcaccaaggccaaggtgccggcacaggccaatggaacgcccaccaccaaatcgcctgcgccaggtgcccctacacggtcaccatccaccccagccaagagtccaaagctgcaaaaaaaggctcaagttcggaaagccggaaagccctag

SEQ ID NO: 231242 - DNA, 2487 bp, Artificial Sequence
  Description of Artificial Sequence: Synthetic coding sequence
atggccgcagaggaggccgacgtcgatatcgagggggatgtcgtggctgctgcgggtgctcagccaggttcaggggagaacaccgcctccgttctgcagaaagaccactacctggatagtagctggcgcaccgagaatggcttgataccatggacccttgataacacaatatcagaagagaatagagcagtcatcgagaaaatgttgctcgaggaagagtactatctgtcaaagaagtcacagccagaaaaggtgtggctggaccagaaggaagacgacaagaagtatatgaaaagcctacagaagacggccaagattatggtgcactcacccacaaaaccagctagttattcagtgaagtggactatcgaagagaaagaactttttgagcagggacttgccaaattcggacgccgttggactaagattagcaagctgataggatctcgcaccgtgttgcaagtgaaatcctatgccaggcaatattttaagaacaaggtgaaatgcggcctggacaaagaaacacctaatcagaagacgggacacaatctacaagtgaagaacgaagataaaggcactaaggcctggaccccctcctgtctgaggggcagggctgaccctaacctaaatgccgtcaaaatcgagaagctaagtgacgatgaagaagtcgatatcactgacgaagttgatgagttatcttcccagacaccgcagaagaacagttcctccgatcttcttctggattttcccaatagcaaaatgcatgagacgaatcagggcgagttcataacctcagactcacaggaagccctcttcagcaagtcctcacgcggatgcttacaaaacgaaaaacaggatgagaccctgtctagctctgagatcacactgtggaccgagaagcagtcgaatggggacaaaaagtctatagaactcaatgatcaaaagttcaacgagctgatcaagaactgcaataagcacgacgggagaggaataatagtagatgccaggcagctcccaagtcctgaaccgtgtgaaatacaaaagaatcttaacgataacgaaatgcttttccatagctgccaaatggtcgaagagtcacatgaagaagaggagttgaaaccaccagaacaggagatcgaaattgatagaaacatcatccaggaagaggaaaagcaggctatcccagagttctttgaaggacggcaagctaagactcctgaaagatatcttaagattagaaactacatccttgaccagtgggaaatatgcaaaccaaagtacctaaataagacttctgtgagacccggtctgaaaaattgcggcgatgttaactgtattggaagaatccatacttacctggaactcattggcgcaattaatttcggatgtgagcaggcagtgtacaacaggcctcagactgttgataaggtgcgcattcgggataggaaagacgcggtcgaggcgtaccagctggcacagcgcctgcagtctatgcgaacccggaggcgcagggtgcgggacccatggggaaactggtgcgacgcaaaggatctcgaagggcagacctttgaacatctcagtgccgaggaactggcgaagaggcgcgaagaagagaaggggcgacccgtaaaatctttgaaggtgccaaggcccacgaaatcatcttttgaccccttccaacttattccttgtaatttcttctccgaagaaaagcaggagcctttccaagtgaaagtggcgagcgaggcccttctgattatggatcttcatgctcacgtgagtatggctgaagtcattggcctgctcggaggaaggtactctgaggtagacaaagtggtggaggtctgtgctgcagagccatgtaatagcctgtctaccggcctgcagtgtgagatggaccctgtgtcccaaacgcaggcatccgaaaccctcgcagttagggggttttccgtcattgggtggtatcactcacaccctgctttcgaccctaatccctctctgagggacatcgatacacaggcaaaataccaaagctacttcagtcgtggcggagccaaattcattggcatgatcgtgagtccgtacaacagaaataatcctcttccatattcccagattacttgcctcgtgatctcagaggagatctcacccgatgggtcataccgactgccctacaagtttgaggtccagcaaatgttggaggaaccccaatggggactggttttcgaaaagaccaggtggatcatcgaaaagtatcgcctcagtcacagctccgtccctatggataagatcttcagaagggatagtgacctaacctgtctgcagaagctacttgagtgcatgcggaaaaccctcagtaaagtgaccaattgcttcatggccgaggagtttctgacagaaattgaaaacctgtttttatctaactataagagcaatcaggagaatggcgtgacagaagagaactgtacaaaggaactcctgatgtag

SEQ ID NO: 231243 - DNA, 843 bp, Artificial Sequence
  Description of Artificial Sequence: Synthetic coding sequence
atgccaaagaaggcaaaaccaaccggctccgggaaagaggaggggccagcaccatgtaagcaaatgaagctggaggccgctggtgggccatccgcccttaacttcgatagccccagtagtctttttgaatcactgataagcccaataaaaacagaaacattcttcaaagaattctgggagcaaaagcctctgctgatccagcgcgacgaccctgcccttgcaacttactacggcagtctgttcaagctgactgatctcaaaagcctttgcagcagaggcatgtactacggaagagatgtcaatgtgtgccggtgcgtgaatggaaaaaagaaggtgctaaacaaggatggcaaggctcattttctccaacttcgcaaggatttcgatcagaagagggctacaatccagttccatcaaccccagcggttcaaggacgagctgtggcgaatccaagagaagttggagtgctactttgggagcctcgttggcagcaacgtttatattacacctgccggaagccagggacttcctccccactacgacgatgtcgaagttttcatactccagttggagggggagaaacattggaggctgtaccatcctaccgttcccctcgcaagggagtactccgtcgaagctgaagaaagaatcggccgaccagtgcatgagttcatgctgaagcctggagatctactctacttccccaggggaacaatccaccaggccgataccccagctggattagcccacagcacccacgtgacaattagtacctatcagaacaatgacgccggagccaggatgcgtcggtgcgacctgcgcgcaatcgccccacagaaatag

SEQ ID NO: 231244 - DNA, 1398 bp, Artificial Sequence
  Description of Artificial Sequence: Synthetic coding sequence
atgccaaaaaaggccaagcccactggctcaggcaaggaagaaggaccagcaccttgtaaacagatgaagcttgaggccgcaggcggtccgtcagccctcaatttcgacagcccttcctcgcttttcgaaagcctgatttcccccattaaaacagaaactttcttcaaggagttctgggagcagaagccattactgattcagcgggatgatcctgccctagctacatattatggaagcctgttcaagttgacagacctgaaatcactttgcagccgcggtatgtattacggccgagatgtgaacgtgtgcagatgtgttaacgggaaaaagaaggtgctgaataaggatggaaaagcacattttctgcagcttaggaaggattttgaccagaagcgcgctaccattcagttccatcagcctcagcggtttaaggatgagttatggcgaattcaagaaaaattggaatgttactttggcagtcttgttggctccaatgtgtatattacccctgccggttcacagggccttccccctcactacgatgatgtggaggtgttcatactgcagttggaaggagaaaaacactggcggctgtaccaccctaccgtccccctagcccgtgagtatagcgtggaagccgaggaaagaatcggacggcctgtgcatgagttcatgctgaaaccgggtgacctgttgtactttcctcggggaacaatacaccaagcggatacacctgcgggtctagcccattctacacacgtaacaatcagtacctaccagaataattcctggggtgactttcttttggataccatctccgggctggtattcgacacggcaaaggaagatgtggaactgcgaaccggcatccccaggcagcttctactgcaggtggagtcaacaacggtcgcaacccgcagactctcgggctttctccgaacattggccgatagattggaaggcaccaaggaactgttgtccagcgacatgaagaaggactttataatgcacagactgccgccttattctgccggagacggggcagaactgtcaaccccaggagggaagctccccagactggactctgtggtgcggttgcagtttaaggaccacatcgtccttactgtccttcccgaccaggatcagtctgatgaagcccaggagaaaatggtatatatctatcactctttaaaaaactcaagggagacccacatgatgggcaacgaggaggaaacagagtttcacggcttacgtttccccctctcccacctggacgccctgaaacagatttggaattcccctgcaattagcgtgaaagatctgaaactgacgacagacgaggaaaaggagtctctggtactaagcctgtggaccgaatgcctgatccaggtggtttag

SEQ ID NO: 231245 - DNA, 1395 bp, Artificial Sequence
  Description of Artificial Sequence: Synthetic coding sequence
atgccaaagaaggccaagccaaccgggtccggcaaggaagaaggccctgccccatgtaagcaaatgaaactggaggcggcagggggtccatctgcactgaactttgatagcccctcctcactgttcgagtctctgatctcccctataaagacagaaaccttcttcaaagaattttgggagcagaaacctctgctcattcagagagatgatccagcactggctacttattacgggtctctatttaagctgactgaccttaaaagcctttgctctcgaggaatgtactatggtagagatgttaacgtgtgccggtgcgtgaacggtaaaaaaaaggtacttaacaaggatggaaaagcacacttcctgcagctgcgaaaggacttcgatcagaagagagctaccattcaatttcatcagccccaacgctttaaagacgaactgtggcgaatccaggaaaagctcgagtgttatttcggttctctggtggggagcaacgtctatatcacgcccgctggtagccagggactgccgcctcactacgacgatgtagaggtctttatcctgcagctggagggagaaaaacattggagactttaccacccaaccgtacctcttgccagggagtattccgtagaggccgaggagcgtattggtagacctgtgcatgaattcatgctcaaacctggtgatctgctgtattttccccgtgggaccattcatcaggcggatacgcccgcaggactggcgcactcaacacatgtaacaatttcgacataccagaacaactcatggggagacttcctcctcgacaccattagtgggctggtgtttgacacagctaaagaagatgtggagcttagaacaggcatccccagacagctgcttctggtggaaagtaccactgtggctacccgaaggcttagcgggtttctgcgaacactcgcagacaggttggaaggcacaaaggaactactgtctagcgatatgaagaaagattttattatgcatcgattacctccgtatagtgccggagatggggctgagctgtctacccccggaggaaaacttccaaggttagacagtgtggtacgcctacaattcaaagaccatatcgtgttgacagtactgccggatcaagaccagtcagatgaggctcaagaaaaaatggtgtacatctatcacagcctaaagaacagtcgtgaaacgcacatgatgggaaatgaagaagagacggagtttcacggcctgagattcccactgagtcatctggatgctctgaagcagatttggaattcgcctgccatttcggtcaaggatcttaagctaacaactgacgaggagaaagaaagtctggtgctgtctttatggaccgagtgcctcatacaggttgtatag

SEQ ID NO: 231246 - DNA, 1398 bp, Artificial Sequence
  Description of Artificial Sequence: Synthetic coding sequence
atgcctaaaaaagctaagccgaccggttctgggaaggaagaaggacccgctccatgcaagcagatgaagttagaggcagctggtgggccaagtgctttgaatttcgactctccctctagcttatttgagagtctgatttccccgatcaagacggagacctttttcaaggagttttgggagcagaaaccactcttaattcagcgcgatgatccagccctcgctacgtattatggctcgctgtttaaactgaccgatctgaaatcactatgttcccgaggtatgtactatggacgagacgtgaatgtgtgtcggtgcgttaacgggaagaaaaaagtgctgaacaaggacgggaaagcccattttctccagctgaggaaggattttgaccagaagagggccaccatccagtttcatcaaccccagcggttcaaggacgaactgtggaggatccaggaaaaattagaatgctactttggcagtctcgttggaagcaatgtgtatataacccctgctggtagccagggtctgccccctcattatgacgacgtggaagttttcattctgcagctggagggggaaaagcactggaggctgtaccatcctacggtgccactggccagagagtacagcgtggaagccgaagaacgcatcggcagacctgtgcatgagtttatgctcaaacctggcgacctgctctatttccccagagggaccatccaccaagctgatacccccgcaggtctggcccactctactcatgtaactatttctacctaccagaataactcctggggcgatttcttactcgatactatctctggactggttttcgacaccgccaaagaggacgtggaattgaggactgggatccccaggcagctcctattacaggtggaatctactaccgttgctactcgacgcctgagtgggtttctcaggaccctggccgaccgcttagaaggcactaaagaactgcttagtagcgatatgaagaaagattttattatgcacagacttcccccatactctgctggtgacggggcagagctgagcactcctggaggcaagctgcctcgcctggactcagtggtgcggctacagttcaaggatcacattgtcctcactgtgcttccagatcaggatcagtcagacgaagctcaggagaagatggtttacatctatcactccctgaaaaactcgcgggaaacacatatgatggggaatgaagaagagaccgaatttcacgggttaaggttccccctgtcccacctggacgcacttaaacagatctggaactcaccggcaattagcgtcaaagacttgaaacttacgacagacgaggagaaggaatccctggtgctttcattgtggacggagtgtctaattcaggtggtgtag

SEQ ID NO: 231247 - DNA, 636 bp, Artificial Sequence
  Description of Artificial Sequence: Synthetic coding sequence
atgcttctccaagtgccatgcaatagttggggggacttcctgctggacaccattagcggactggtcttcgacactgccaaggaggatgttgaacttcgcaccggaatccccaggcaactgttgctccaggtggaaagcactactgtggcaactagacgcttaagtgggttcctgcgcactctcgccgaccgtctggaaggcactaaagaacttctctcatctgatatgaaaaaggattttatcatgcataggctgccaccctactcggctggcgacggagccgagttaagcacccccggaggtaagctgccgaggctggacagcgtggttaggttacagtttaaagatcacatagtgctgaccgtgctgccggatcaggaccagtctgacgaagcacaagaaaagatggtttacatctatcatagtctgaagaattcccgggaaactcacatgatggggaatgaagaggagacagagtttcatggcctccgctttcctttgagtcacctggatgccctgaagcagatctggaacagccccgctataagtgtcaaagatttgaagctgacgacggacgaagaaaaggaatccctcgtgcttagcctttggaccgaatgtcttattcaagtggtgtag

SEQ ID NO: 231248 - DNA, 339 bp, Artificial Sequence
  Description of Artificial Sequence: Synthetic coding sequence
atgcctaaaaaggctaaacctactggaagcgggaaggaagaggggccagccccttgtaagcagatgaagctggaggcagcagggggtccatcagccctgaactttgactccccttcgtccctgttcgaatccctaatctcccccatcaagacagagactttctttaaagaattttgggagcaaaagcccctgttgattcaacgggatgaccctgccttggctacttactatggaagtctttttaaactgaccgacctgaagagcctttgcagcaggggcatgtattacggccgagatgtgaacgtttgcagatgtgtcaacggaaaaaagaaggtgtag

SEQ ID NO: 231249 - DNA, 459 bp, Artificial Sequence
  Description of Artificial Sequence: Synthetic coding sequence
atggggcctccttctctgcattcacccacgccgtcactggggcctctgggggcattagtgctgagcagccagcatactagccccgatagctgtaaatctccctggacgctgaaagccgttcgcgcagcgaggcaggccgctgacttcaccctcaaagtggaggtggagtgcagctccctccaggaggcagtccaggcggctgaggcaggggctgacttagttcttctagacaatttcaagcccgaggaacttcaccctactgcgacggtcctcaaagcacagtttcccagcgttgccgtggaagctagtggtggcattaccctggacaacctgccccaattctgcgggccacacattgacgtaatttccatgggcatgcttacacaagcagccccagctctggacttttccttgaaactgtttgccaaggaagtagcccctgttccaaagattcactag

SEQ ID NO: 231250 - DNA, 1434 bp, Artificial Sequence
  Description of Artificial Sequence: Synthetic coding sequence
atgttccctgtcttcccgtgcacactgctggccccacctttcccagtgctcggtctggacagtagaggcgttggagggttgatgaacagcttccctcccccacagggccacgctcagaatccactgcaggtgggggctgagctccagtcccggttctttgcttcccagggctgcgcgcagagcccgttccaggctgcgccagcacctccgcctacaccccaggctcccgctgccgagcctcttcaggtggacctgctccctgttctcgccgctgcacaggaaagcgctgctgccgctgctgctgcagcagccgctgcagccgcagtggcggcagcccctcctgcccctgccgcagccagcacagtcgatacagctgctctgaagcagccgcctgcccctccacctccccctcccccagtcagtgcgcctgccgctgaagccgctcctcctgcatccgccgcaacgatcgccgcagctgctgccaccgctgtggtcgcgccaaccagcaccgtcgccgttgctcctgtggcctcagcgctagagaaaaaaacaaagagtaagggcccttatatttgcgcgctgtgtgcaaaagagttcaagaatggatataacctgcggagacacgaggcaatccatactggggctaaggctggacgtgtgcctagcggagcaatgaaaatgcccacaatggtgcctctgtcgttgctgtccgtgcctcagctatcaggagccggaggagggggaggtgaggccggagctggcggaggcgctgcagcagtggccgcaggcggagtggttaccaccacagctagcggtaaaaggatccgcaagaaccacgcatgtgagatgtgtggcaaggcattccgagatgtataccacttgaaccggcacaagctctctcactccgatgagaagccataccagtgccctgtgtgccagcagcgttttaagagaaaggatagaatgagctaccacgtccggtcacatgatggagcagtccacaaaccttacaattgtagccattgtgggaaatcgttttcccgccctgaccacttgaatagccacgtccgccaggttcacagtaccgagcgcccttttaagtgtgaaaagtgtgaggccgcttttgcaaccaaggaccgccttcgggcacatacagtgagacacgaggagaaagtgccctgccatgtctgcggtaaaatgctgtctagtgcatacatctctgaccacatgaaagtccactcacaaggcccacatcacgtgtgcgaattgtgcaataagggcacaggggaggtctgcccgatggccgcagctgctgccgcagccgctgctgccgctgccgcagcagtggctgctccccctaccgctgtgggctcactgagcggtgctgagggggtcccagtgtcttcacagcctttaccaagtcaaccttggtag

SEQ ID NO: 231251 - DNA, 759 bp, Artificial Sequence
  Description of Artificial Sequence: Synthetic coding sequence
atgaagatgccgacaatggtgcccttgtccctactgtccgtcccacagttatcaggtgccggtggagggggtggggaagctggggcaggcggaggcgctgctgcggtggccgctggaggggtggttacaaccactgcatccggaaagcgaattaggaaaaaccatgcttgtgagatgtgtggaaaggcatttagagatgtgtatcatttgaaccgacataaattgtctcattccgacgagaagccctatcagtgcccggtgtgccagcagcgcttcaagagaaaagaccgaatgagctaccacgtcagatcccaccggagatgtgctaaaccatacaactgcagccattgcggaaaatcattcagccgaccagaccatctcaacagccatgtgcggcaagtgcatagcacagagcggccattcaaatgcgaaaaatgcgaagccgcttttgcgaccaaggacaggctccgcgcacacaccgtcagacacgaagagaaagtgccttgtcacgtatgtgggaaaatgcttagcagtgcatatattagcgaccatatgaaggtccactctcaggggccacatcacgtatgcgaactctgtaataagggtaccggcgaggtgtgcccaatggccgcagccgctgctgcagctgcagccgcagccgctgccgcagtggcagccccacctaccgccgtgggctcgctgtccggagccgaaggcgtcccagtttcatctcagcccttaccctcacagccatggtag

SEQ ID NO: 231252 - DNA, 1365 bp, Artificial Sequence
  Description of Artificial Sequence: Synthetic coding sequence
atggatcccagtaattggtcaagctttattttccagggtcacgctcagaacccgctccaggtaggcgcagaactgcaatcccgattcttcgcctcccagggatgcgcccagtctcctttccaagctgcaccagctcctcctcctacacctcaagccccagcagcggagccattacaggtcgacctcctccccgtcttggccgcagcccaagaaagtgctgctgcagccgcagctgccgctgccgctgctgccgctgtcgctgcggcaccacctgcacctgctgctgcttctacggtagataccgcggctctgaaacagccgccagcaccacccccaccgccaccaccagtcagcgcccctgccgctgaagccgctcctccagctagtgccgcaaccatcgcagccgctgctgcaacagccgtagtagcgccaaccagtacggtcgctgttgccccagtcgcaagcgcactggagaaaaaaaccaaatcaaaaggtccctatatttgtgccctctgcgcgaaggagttcaagaacggttataacttgagaagacacgaagccatccataccggtgcgaaggcaggcagggttccttcaggtgccatgaagatgcctacgatggtaccactttctctgctgtccgtaccccaactgtcaggggcagggggaggcggaggcgaggctggcgctgggggaggtgcagccgcagtggccgctggaggtgttgtcactacgacagcgagtggaaagaggatccgcaaaaaccatgcttgcgagatgtgtgggaaggcttttcgcgatgtttatcatttgaacaggcacaagctgagccacagcgatgagaagccttaccagtgtccagtctgtcagcagaggttcaaacggaaagatcgcatgtcctaccacgttaggagccacgatggagcggtgcacaagccatacaattgctctcactgtggaaagtcattttcacgccctgatcacctgaactctcacgtccggcaggttcactccaccgagcggccttttaagtgcgagaagtgcgaggcggcttttgccaccaaagaccgcctccgagcccatacagtacgccacgaggagaaagtgccttgtcacgtgtgcggcaaaatgctctctagcgcttatatcagtgaccacatgaaggttcatagtcagggtccacatcacgtttgcgagctgtgcaacaagggcaccggagaagtctgtcctatggctgccgcagcggctgcagccgcagctgctgccgcagcggctgtggctgctccccctactgctgtgggctcactttccggggcagagggcgtgcccgtctcctctcagcctttgccttctcagccatggtag

SEQ ID NO: 231253 - DNA, 2955 bp, Artificial Sequence
  Description of Artificial Sequence: Synthetic coding sequence
atgagagcacctgctagaggcacaggctgctgtggacgcagcgggggtagatggctagcgggagctgcccagcccaggtgtctttgggctggcggagcagggcagcgatttatggtgcctggaggcaccatgaagtccctgaaaaaagatagccgtctgcgaatcacacccacccgtttgctggaggcaagcgagaatgtcaaggagaaaaaaagggctaagggcccagagcagcctaccccaaccatccaagaggaacccgagccagtttccaatgtactccaaggcgatgacattctggctcttgctattaaaaaggaggaccttaaggaacagcatattccaagactcactgagaaagaggacaagagagtgatcactcaaaaattcatcatcaggaaactcaagcctatggatccgcgaagaaaggtgtgccatctggtggcgaggcctgctaaccctgatgaagctactaaaccactggattattccgggccaggggattcattcgatggatcagaccaaattctgcctcatcatatactgggcagcctacaggacttcaaacgcatcgcgttggcacgagggaacacacaactcgccgaacgtattcccacaagcccctgtttgatgaccctgatttcagccgagggagagagcaagcaaaaagcccctaaggaggagaagcgaccaccttgggctccccctccgcaacacaacttcttaaaaaattggcaacggaataccgcgctgcgtaaaaagcagcaagaggccttgtctgaacacttgaagaagcccgtcagtgaactgctgatgcataccggggaaacttaccggcgtatacaagaggaaagggagttgattgattgcactctcccaacgaggcgggaccgaaagagttgggaaaatagtggcttttggagcagactggagtatctgggggatgagatgacgggcctggtaatgacgaaaactaagacacagcgaggtctaatggagccgatcacacacatccgtaaaccacattcaattagagtagagacagggcttcctgcccagagagacgcctcctaccgctacacgtgggacagatcactgttcctcatctataggcgcaaagagctccagaggatcatggaggagttggattttagccagcaagacatagacggcctcgaggtcgtgggcaaaggatggccatttagcgcagtgaccgtagaggattacactgtgtttgagaggtcccaggggagcagctcagaggacacggcttacctgggcactttagcctcatcctctgacgtgagtatgcccatcctggggcctagcctactgttctgcggtaagcccgcatgctggatcagggggtcaaacccacaagataaacgccaggttggaatagctgctcacctgaccttcgaaacattagaaggagagaaaactagttcagaactgaccgttgtgaataatggcacagtggccatttggtacgactggagacgccagcatcagcccgacacttttcaggacctcaagaagaatagaatgcagagattttactttgacaatagagagggcgtcatcctgccaggagagattaagacgtttacctttttctttaaatccctcactgccggtgtgttccgggaattttgggaatttcggacgcacccaaccctactaggcggagctatccttcaagttaatctgcacgctgtgagcttgactcaagacgtgtttgaagacgaaaggaaggtgcttgagtccaaacttacagcacacgaagcggtcaccgtggtgagagaagtcctacaggagctccttatgggagtcctcactcccgaacgtaccccctctcccgtggatgcctatctgaccgaggaagacttattcagacacagaaaccctcccctgcactacgaacatcaggtggtgcagtctcttcatcagctgtggaggcagtatatgaccttgccggcaaaggctgaagaagcaagacccggagacaaagagcacgtttcacccatcgccactgagaaggcctctgtaaatgctgaactgctcccgaggtttaggtcccctatctccgagactcaggttccacgtcccgagaatgaagctctgagagagagcggatcccaaaaggccagagtgggtaccaaaagcccgcagagaaaatcaatcatggaagaaatcctggttgaggagtcacccgacgtggatagcacgaagagcccctgggagcccgacgggttgcctttattagagtggaacttatgcctggaggactttcgtaaggccgtcatggtgctgcccgacgaaaatcaccgcgaggacgccttgatgcggcttaacaaagccgctctggaactctgtcagaaacccaggcccttgcagtctaacctcctccaccaaatgtgtctccaactctggagagacgtcatcgattcactggtcgggcacagtatgtggctgaggtctgttctcggcctgcccgagaaagagacaatttatctgaacgtcccggaggagcaagatcaaaaatccccgcctattatggaagtgaaggtccctgttggcaaagccggaaaagaagagaggaaaggagccgcacaggagaagaaacagctgggcattaaggataaggaggataaaaaaggtgccaagcttttgggcaaggaggatcgtccaaactccaagaaacacaaggctaaggacgacaagaaggttattaaaagcgcctcccaggatagattctcactggaagacccgacgccagatataatactcagtagccaagaaccgatcgatcctctggttatggggaaatatacacaatctctccattcagaggtgcgcggattactcgatactctggtgaccgatcttatggtgctggcggacgagctatcacccatcaaaaatgtggaggaagcactcagactgtgccgatag

SEQ ID NO: 231254 - DNA, 2829 bp, Artificial Sequence
  Description of Artificial Sequence: Synthetic coding sequence
atggtgcctgggggtacaatgaagtcattgaagaaggattcgcgattgagaattacacccaccagattattagaagctagtgagaacgtgaaggaaaagaagcgggcaaagggtccagagcagcctacacccactatccaggaggagccagaacccgtcagtaacgtgctgcagggtgacgatatattggcattagcaatcaaaaaagaggacctcaaggagcaacacatccccagattgaccgagaaagaggataaacgggtgatcactcagaagtttatcattagaaaactgaagcctatggatccacggaggaaggtctgtcacctggtggcaagacccgcaaacccggacgaagcgacaaagcccctagattatagtggcccaggggacagctttgatggatctgatcaaatactgccacaccatatcctgggatcacttcaggactttaagaggatcgccctggccaggggaaacacgcagctcgccgagcggatccctaccagcccctgcctgatgacactcatatccgcagaaggagagtcaaagcaaaaggcacctaaggaagaaaaacgtcccccatgggcccctccgcctcagcacaacttcttgaaaaattggcagcgtaataccgccttgaggaaaaagcaacaggaggcactttccgagcacctgaaaaagccagtgtcagagctactgatgcataccggggaaacatataggcgcattcaggaggagcgtgaactaatcgattgcaccctgcccaccagacgtgatcggaaaagttgggaaaattccggtttctggagcagactcgagtatctgggagacgaaatgacaggcctcgtgatgacaaaaaccaagacacagagagggcttatggaacccattacgcatattaggaagccacattccattagggtggaaacaggtttaccagcccagcgcgacgccagttaccgatatacctgggatagatcactgtttctaatttaccgcaggaaggaactgcaacgtattatggaagagctggacttctctcagcaggatattgatggactagaagtcgtcggtaaagggtggcccttttctgctgtgactgtggaagattatacggtctttgagaggtcccaggggagctcttctgaggacactgcatacctgggcaccctggcaagctccagcgatgtgagcatgcccattcttggaccctcgttgcttttttgtggcaaacccgcatgctggatcagaggttccaaccctcaagataagagacaagtgggtatcgccgctcacctgaccttcgagaccttagagggagagaagacaagctccgagttaactgtagtgaataacggtactgttgccatttggtacgactggcggcgacaacatcagcctgatacctttcaggacctgaagaagaacagaatgcaaaggttctactttgataatagggagggcgttatattgcctggagagataaagaccttcaccttcttcttcaaatcactgaccgcgggtgtcttccgagagttttgggaatttcgtactcacccgacactcttgggcggtgcaattctgcaggttaaccttcacgcagtaagcctgactcaggatgttttcgaggatgaaaggaaggtactcgaaagtaaactgacagcccatgaggctgtcaccgtggttcgggaggttctgcaagaactcctcatgggagtcctgactcccgagcgtacccctagtcccgtggacgcttatctgaccgaggaagatctgttcaggcatcgaaatccacccttgcactatgagcaccaggtagtgcagtccctgcatcagctgtggagacagtatatgaccctccctgcaaaggccgaggaagcacggcctggagacaaagaacatgtcagtccaatcgccactgagaaggcatctgttaacgcagaattgctgcctcgctttcggtctcctatttccgaaacccaggtgccgcgacccgaaaatgaggccttgcgtgagtccggcagccagaaggccagggtggggaccaagagtccccagagaaagagcattatggaagaaatcctggtggaggaatcccctgatgtcgactctacaaaatctccttgggagccagacgggctgcctttattagagtggaacctgtgcctcgaggacttcagaaaggccgtgatggtcctccccgatgaaaatcaccgggaggatgctctgatgaggctgaacaaggcggctttagaactctgtcaaaaaccccgtcccttgcaaagcaatcttctgcaccagatgtgtttacagctgtggcgtgatgtgatcgattctctggtgggccattctatgtggttgcggtccgtgctgggtttaccagaaaaggaaactatatatctgaacgtgcccgaagagcaggatcagaagagccctcccataatggaggtaaaagtgcccgtcggaaaagcagggaaggaagagcgaaaaggagccgctcaggagaagaagcagctggggattaaagataaggaagacaagaagggggctaagcttcttggaaaggaagatagaccgaattccaagaaacacaaggctaaggatgataagaaggtcataaaatcagcatcccaggatcgattctccttggaagatccgactcctgacattatcctctcttcgcaagagccaatagaccccctggtgatgggaaagtacacgcagagtctccatagcgaggtacatcctgggagatgcgttccatgggagaataccatgcagggagcattcccatctacgactcgttgcgggggttcatgtctgtag

SEQ ID NO: 231255 - DNA, 1992 bp, Artificial Sequence
  Description of Artificial Sequence: Synthetic coding sequence
cgaagccggggagctgaagcaacagagtccaaactttcaggtggattcaggtggacccagaaaacaagtccgactcagggggatagcgctatcactcattccctctacaggatgattttcctgaccgctctgccccttttttggatcatgatatctgcttcacgagggggtcattggggcgcttggatgccctcctccatttccgcgttcgaaggcacttgcgtttcgatcccttgtcgctttgactttccagacgagctgaggcctgctgtggtacatggggtctggtactttaattctccataccctaagaactatcccccagtggtgtttaagtcaagaacgcaagttgtccacgagtcctttcaggggagatcccgcctcttgggagatctgggcctgcgaaattgcaccctgctactctcaaacgtttcccctgaactcggcggtaaatattattttcgcggtgacctaggcggatacaaccaatacacattttccgaacactccgtgttggacatagtgaatacaccaaacattgtagtgcccccagaggtggttgccggaaccgaggtcgaggtcagttgcatggtgcctgataattgcccagaactgagacccgaactgtcctggctgggccacgaagggcttggggagccagccgtgctcggtagactgcgtgaggacgaaggcacctgggtgcaggtgagcttactccatttcgtgcccacgagggaggccaatggacacaggttgggatgtcaagcttccttcccgaacaccactctccagttcgaaggttacgcctcaatggatgtcaagtatcctcccgtgatcgtcgaaatgaactcttctgtcgaggctatagaggggtctcacgtgagtttgctgtgtggcgctgacagcaatcccccaccgttactgacgtggatgcgagatggaacggtcctgcgcgaagcagtagctgagagtctcctcctcgaattggaggaggtaacacctgccgaggatggcgtttatgcttgtctggctgagaacgcatacggccaggataataggactgtgggactctcagttatgtatgcaccctggaagccaaccgtaaacggcacgatggtagccgtagaaggcgagactgtttccatcttgtgttctactcagtccaacccagatccaatcctgacaatttttaaagagaaacagatcctaagcaccgtaatatacgaatcggaactgcaactggagctccctgctgtgtccccagaggacgatggtgagtactggtgcgtggcagaaaatcagtatggccaaagagcaacagcttttaatctttcagtagagtttgcaccagtcctgcttctggaaagccattgtgcggctgcccgtgacactgtacaatgtctatgtgtggtgaagtccaatcctgagccttctgtcgcctttgagctgccatctaggaacgtgactgttaacgaaagcgaacgggagtttgtgtatagtgagcgatcaggtctcgtgctgaccagtattctcaccttgcggggacaggcgcaggctccacctagagtcatatgtacggccagaaatctttacggggcaaagagcttggagcttcccttccagggcgcacacagacttatgtgggccaagataggcccagtgggagctgtcgtggccttcgcaatccttatcgccatcgtttgttatatcacacagacccggagaaaaaagaacgtgacggagagccctagcttttctgccggtgataacccccctgtgctcttctcaagcgatttccgcattagcggagctccagagaaatatgagtcggaacgaaggttaggcagtgaacggagacttcttggactccgaggagaaccaccagagctggacctcagttactcccatagcgatctgggaaagcgaccaacgaaagattcgtacactcttaccgaggaattggcggagtacgcagagattcgggtcaagtag

SEQ ID NO: 231256 - DNA, 1749 bp, Artificial Sequence
  Description of Artificial Sequence: Synthetic coding sequence
atgatttttcttacagccttgcctctattctggatcatgatctctgccagtcggggtggacattggggggcttggatgccatcttctatcagtgcttttgaagggacatgcgttagcattccatgcagattcgattttcctgatgaacttagacctgccgttgtgcacggggtgtggtattttaacagtccatatccaaagaattatccgcctgtagtctttaaatcaagaacacaggtggttcacgagagctttcagggaagatcccgcctgctgggagacttagggctccggaactgtacccttctactgagcaacgtttcccctgagcttggcggtaaatactacttccgaggagatctgggtggatacaaccagtatacattttcagaacactccgtgcttgatattgtgaatacaccaaatattgttgtgcctcccgaggtggtggcgggaactgaggtggaagtgtcttgcatggtgcctgacaattgccctgaattaaggccagaattaagttggcttgggcacgagggtctcggggagcccgctgtactcggacggcttcgagaagacgagggaacctgggtgcaggtgagcctgctccactttgtgccgacgagagaagcaaatggccatcggttaggatgtcaggcaagcttccccaataccacactgcagttcgagggctatgcgagcatggacgttaagtacccgcctgtgatagtcgagatgaacagttccgtcgaagcaattgaaggctcccatgtctcactgctgtgcggtgccgatagcaatccccctcccctgttgacttggatgcgagatggaacagtcctacgtgaggcagtggccgagtcactcctgctagaactcgaggaagtgaccccagccgaggacggcgtgtacgcctgcttggctgagaatgcttatggtcaggataaccgtaccgtgggcctgagtgtaatgtacgccccttggaagccaactgtcaacggcaccatggtggccgtagaaggagaaacagtgtccattctatgttctacccaatctaatccggaccccattttgaccattttcaaagaaaaacagatactgtctaccgtgatttatgagagtgaactccaactggagctgcccgcagtcagcccagaggacgacggagagtattggtgtgtcgctgagaaccaatacgggcagcgggctacagccttcaacctgagtgttgaatttgccccagtgctcctattggagagtcattgtgcggcagcaagggacaccgtgcagtgcctctgtgtagtgaaaagtaaccctgaacccagtgttgcatttgaactccccagccgcaacgttactgtcaatgagtctgaacgtgagtttgtatatagtgagcgcagcgggctggtcctgactagcatcctgacactgcgcggacaggcccaggccccacccagagttatttgcaccgcccgaaacctgtacggagctaaaagccttgagttgccctttcagggggcacatcgtcttatgtgggcaaagatcggccctgtcggtgccgtggttgccttcgccatattaatagctattgtgtgctatattacacagacacgccgaaaaaagaatgtgactgaaagtcctagtttttctgccggtgacaacccaccggtgctcttcagttccgacttcagaatctcaggagcgccagagaagtatgagtcgaaggaggtgtcaacactcgagagtcactag

SEQ ID NO: 231257 - DNA, 1881 bp, Artificial Sequence
  Description of Artificial Sequence: Synthetic coding sequence
atgatattcctcacagcactgccattgttctggatcatgattagcgcttcacgcggtgggcactggggtgcctggatgccttctagcatttccgccttcgagggtacatgcgtgtcaatcccatgccgttttgactttcctgacgaactgcgcccagcggttgtgcacggagtctggtatttcaatagtccctatccaaaaaactatcctcccgtggttttcaaatcccggacacaggtagtccacgagtccttccaaggccgaagcagactcctgggcgacctcggtctgaggaactgtactctccttctcagcaacgtatcacctgaactcggcggtaaatattacttccgtggggatctcggtggctataatcagtacacgttctcagagcacagtgtcctggatatcgtgaatacaccgaatatcgtggtgccccctgaagtcgtggctggcacggaggtggaggtatcttgtatggtccctgacaattgcccagaactacgccctgaacttagttggctgggacacgaaggcctcggtgaaccagcggtgctcggcaggctgagggaagacgaaggaacctgggtacaagtctcactgctccatttcgtgcccactagggaggctaacgggcatcgtctggggtgccaggcgtcctttcccaatactacgcttcaatttgaagggtatgcttccatggatgttaaatacccccctgtgattgtggaaatgaacagtagcgtggaagccatcgagggtagtcacgtctcgttgctctgtggtgcagatagcaacccacctccactgctgacatggatgagagacgggaccgtattacgggaggctgtggctgagtctctgctcctggaactggaagaagtcacccccgctgaagacggggtctatgcctgcctagccgaaaacgcgtacggccaagacaaccgaacagtaggcctgtctgtcatgtacgctccgtggaaaccaacagtgaatggcactatggtggccgtggagggcgagactgtctctatcctctgcagtactcagagcaatccggaccctatattaaccatattcaaggaaaaacaaatcctgagcacagtgatttacgagtctgagctacagctcgagctgcctgcagtctcaccagaagatgatggtgaatactggtgcgtggccgaaaatcagtacggccagcgtgccactgcctttaacctgtcggtggagttcgctcccgtgctgctcctggaaagccactgtgcggctgccagggacacggtgcagtgtctgtgcgtggtgaagtctaatcccgagccctcagtggcattcgagctgcctagcagaaacgtgactgtgaacgagagcgaacgcgagttcgtgtattccgagaggtccggcctggtactcacatccattctcacattgcgaggtcaagcccaggcaccaccaagggtgatctgcaccgcaaggaacctgtacggcgctaagtcactcgagctcccattccagggcgcacatcggcttatgtgggcaaaaatcggtccagtgggcgctgtggtcgctttcgctattctgatcgcaatcgtgtgttatatcactcagaccagacgtaagaaaaatgttaccgaatcaccctctttttccgccggtgataacccccctgtcctgttttcaagcgatttccggatcagcggtgccccagaaaagtacgagagtgagaggcggctcggctctgaaaggaggctgctgggattaagaggtgaaccccctgaactggatctgtcctatagccactcagacctgggcaagagaccaacaaaggattcatacactctgactgaggagctcgcagagtacgcagagatacgggttaaatag

SEQ ID NO: 231258 - DNA, 1806 bp, Artificial Sequence
  Description of Artificial Sequence: Synthetic coding sequence
atgcccagctcgatttctgcctttgagggcacctgcgttagtatcccctgtagattcgatttcccagacgaactgagaccggctgtggtgcacggagtctggtactttaattcgccatacccaaagaactaccccccagtcgtgttcaaatcacgcacacaggtggtccatgagtcctttcagggaaggagtagactgcttggcgatcttggtcttaggaattgcacactcctgctgtcaaacgtttcaccagaactgggcggtaaatactacttcaggggtgatctgggtggatacaatcagtacacttttagcgaacacagcgtactggatatcgtgaatactcctaatatcgtggttccccctgaggtagtggcagggactgaggtggaggtctcctgtatggtgccagacaattgtccggagctgcgccctgaattgtcttggctaggacatgagggtctgggcgagccggctgtactcgggagacttcgggaggatgagggcacatgggtgcaggtgagcctcctgcacttcgttccgaccagagaagctaatggccatcgactcggctgccaggccagctttcctaatactacactgcagttcgaagggtatgccagcatggatgtaaagtatcctcccgtgatcgtcgaaatgaattctagtgtcgaggccatagagggatcccatgtttcccttctgtgcggagctgactctaaccctcccccattgctcacctggatgagagacgggacggtgctacgcgaggctgtggcagagagtctgctgctcgagctagaagaagttacgccagctgaggacggcgtctacgcttgtctggccgagaacgcttatggccaggacaacagaaccgtgggcctcagtgtcatgtacgcaccttggaagcctactgttaacggcaccatggtcgctgtggaaggcgagactgtgagtatcctgtgctcaacacagagcaatccagaccccatccttacaatttttaaggagaagcagatcttatccaccgttatatacgagagtgagctccaactggagctgccagccgtctctcctgaggatgatggagaatattggtgcgttgccgaaaatcagtacggccagagagccaccgcatttaatctgagtgttgaattcgcaccggttttgttactggaatcgcattgcgccgcagctcgtgacactgtccagtgcctctgcgtggtgaaatccaacccagaacctagcgtcgccttcgaacttccttccaggaacgttaccgttaacgagtccgagcgggagtttgtctattccgaacgcagtggactggtactcacatcaattttgacgctacggggtcaagcccaggcaccacctagagttatttgcactgcgaggaacctatacggagccaaatccctggagctgcctttccaaggtgcccacagattaatgtgggcaaaaattggccctgttggggcagtggtggccttcgctatccttattgccattgtgtgttatatcacacagacgagaaggaagaagaacgttacggagagtccaagtttttctgcaggtgacaacccaccagtactgttctcctctgatttccgtatttccggcgcacccgagaagtatgagtcagaaagaagactgggtagcgagcggagacttttgggactgaggggcgaaccccctgagctggacctgagctactcgcatagcgacctcggaaagcggccaactaaggattcgtataccttgactgaagagctggcagagtatgccgaaattagagtgaagtag

SEQ ID NO: 231259 - DNA, 915 bp, Artificial Sequence
  Description of Artificial Sequence: Synthetic coding sequence
atgggaaatcatgcaggaaagagagagctcaacgctgagaaagcttccactaactctgagactaatcgcggagaatctgagaagaagagaaacctcggagaactcagcagaaccaccagtgaggataacgaagtgtttggtgaagcagatgccaaccaaaacaacggaactagttctcaagacacagcagtgacagattctaagcgcactgccgatccgaagaatgcttggcaagatgcgcacccagctgacccaggctcccggcctcacctgatcaggctgtttagtagagacgccccaggacgggaggacaataccttcaaagacagaccatcggagagcgatgaactccaaactattcaggaagatagtgcagcaacctctgaatccctggatgtgatggccagccagaagaggcctagccagaggcacgggagcaagtacctggccacagccagcactatggaccacgcccgacacggatttctgccaaggcatcgcgacacaggcatcctggactccataggcaggtttttcggcggagaccgtggtgcgccaaaaagaggttcaggaaaagactcccatcatccagctaggaccgcccattatggatcactgcctcagaagagtcacggacggacgcaggacgaaaatccggtcgttcacttctttaaaaatatcgtgacccccaggacacccccaccatctcagggtaaagggcgtggccttagtttatcccggttctcatggggggctgaaggacagaggcctgggttcggttacggaggacgggcaagcgactacaagtccgctcacaaaggattcaaaggcgtggacgcccaaggaaccctatctaagatcttcaaactgggcggacgcgatagccggtctggctcgccaatggcccgacggtag

SEQ ID NO: 231260 - DNA, 561 bp, Artificial Sequence
  Description of Artificial Sequence: Synthetic coding sequence
atggcatcacaaaaacgtccctcacagagacacggatctaaatacttggctacagcttctactatggaccatgccaggcacgggtttctgcctagacatcgagacaccggcattttagacagtatcggacggtttttcggcggagataggggggcacccaaaaggggtagtggtaaagtgccctggttaaaacccggaagatcccctttgcctagtcacgctcggtcccagccgggtctgtgtaacatgtataaggattctcatcaccctgcgaggacagcccactacgggtcactgcctcagaagtctcatggcagaactcaggatgagaaccctgtggttcacttttttaagaatatcgtgactcccagaacaccacctccatctcagggtaagggcgcagaggggcagcgaccgggatttgggtacggcggaagagcttctgactacaaatctgctcacaagggctttaaaggcgtggatgcccaggggacactgtccaagatcttcaagctcgggggaagggatagtcgtagtgggagccccatggctagacggtag

SEQ ID NO: 231261 - DNA, 594 bp, Artificial Sequence
  Description of Artificial Sequence: Synthetic coding sequence
atggcctcacaaaagcgcccatctcagagacacggctctaagtacctcgcaaccgcaagtaccatggatcacgcccgacatggcttcctgcctcggcaccgggatactgggatactggactctatcgggaggttctttgggggtgacaggggtgcgccaaaacgaggatccgggaaagtaccctggcttaaacctgggaggtcccctcttccttcccatgcccgaagtcaaccgggtctttgcaacatgtacaaagactcccaccacccagctaggacggctcattacggctcccttccacagaagtcacacggtaggacccaggatgaaaatcccgtggtacatttcttcaaaaacatcgttacccctaggaccccccctccctcccagggtaaggggcgaggtctgagcctgagccgattttcttggggggctgagggtcaacgaccgggatttggctatggtggcagagcctctgattacaaaagcgcacacaagggatttaagggagtggacgcccagggcaccctcagcaagatctttaagttgggcggtagagacagtcgcagcggtagtcccatggcgaggcgctag

SEQ ID NO: 231262 - DNA, 594 bp, Artificial Sequence
  Description of Artificial Sequence: Synthetic coding sequence
atggggaatcatgctggcaagcgtgaacttaatgcggaaaaggcctctacaaactccgaaaccaatagaggtgaaagcgagaagaaacggaacctaggcgaattgtcccgcacaactagcgaggacaatgaagtgttcggcgaggccgatgccaatcagaataacgggactagctcccaggacaccgctgtgacagactctaagcgaacagcggaccccaaaaacgcgtggcaggatgcccaccccgcagaccccggtagccgaccccaccttatccgtctttttagccgagacgcacctggtcgggaggataacacctttaaggacagaccatctgaaagtgatgagctgcaaaccattcaggaggatagtgctgcgacttctgagtcgctagatgttatggctagtcaaaaacgcccttctcaacggcacggatccaaatacctggccaccgcatccaccatggatcacgctagacatgggttcctgccaagacatagggatacggggatactcgattcaattgggcgatttttcgggggagatcgcggagccccaaagcgtgggagtgggaaggttagctcagaagaatag

SEQ ID NO: 231263 - DNA, 594 bp, Artificial Sequence
  Description of Artificial Sequence: Synthetic coding sequence
atgggcaaccacgccggtaaaagagaactcaatgctgaaaaagcgagtaccaactctgaaaccaacaggggggagtccgagaagaaacgcaacttgggcgagctgagtaggaccactagtgaggacaatgaagtctttggggaagctgatgctaaccagaacaacggcaccagttctcaggacacagccgtcacagacagcaagcgtacggccgaccccaagaacgcctggcaggatgcacatccagcggatccaggctcacgccctcacctgatcagacttttttctcgggacgcccctgggagggaggacaacaccttcaaagacagaccttccgagagcgatgaactccagacaatccaggaagattccgcagcaaccagcgagtcgctcgatgtcatggcatctcagaaaaggccgagtcaaagacatggatcaaaatacttggccacagcctctactatggatcacgcaagacacgggttcctgccccgtcaccgagataccggtatattggacagtattggaaggttcttcgggggagatagaggagcccctaaaaggggttcaggtaaggtgtcgtcagaagagtag

SEQ ID NO: 231264 - DNA, 483 bp, Artificial Sequence
  Description of Artificial Sequence: Synthetic coding sequence
atggcctcgcagaagcggccttctcagcgacatggctcgaaatacctggctactgcttcaacaatggatcatgcacgtcacgggtttcttcctcggcaccgcgatactggaattctcgattcaattggaagattcttcggaggggaccggggagccccaaaaagaggatctggaaaagatagtcaccatccagccaggacagcccactacggctctctcccccagaaatcgcacggacgcacccaggacgaaaaccctgtagttcacttctttaaaaacatcgttacccctaggactcctcccccttcccaaggaaaaggcgcagagggacagcggccaggctttggctacgggggacgagcttcggactacaagagcgcccataagggttttaaaggtgtagacgcgcaagggactctgtctaagatattcaagctgggcggaagagattctagaagcggatctcccatggcaaggcgttag

SEQ ID NO: 231265 - DNA, 516 bp, Artificial Sequence
  Description of Artificial Sequence: Synthetic coding sequence
atggcctcacagaaaaggcctagtcagcgtcatggatctaagtacctggccactgcctccaccatggaccacgctcgtcacggctttctgccgcgtcaccgcgacaccggcatactggactccataggcagatttttcggtggggacaggggggcaccaaagcgcggttctgggaaagactcccatcatccagccaggaccgctcactatggctcactccctcagaagtcccacggtaggactcaagacgagaacccggtggtgcatttcttcaagaacatcgtcacacccaggacaccacctcctagccagggaaagggtcggggtctttcactttctcggttttcctggggcgctgagggccagaggccgggattcggatatgggggaagggcatctgattataagtctgcacataaaggattcaagggagtggatgcccaggggaccttaagcaagatatttaaactgggcggaagagattctcgctccggatctcctatggcacgccgatag

SEQ ID NO: 231266 - DNA, 261 bp, Artificial Sequence
  Description of Artificial Sequence: Synthetic coding sequence
atggccagccagaaaagaccttcacagcgacacggatcgaaatatctggctaccgccagcacaatggatcacgcaaggcatgggtttctgcctcgtcacagagatactggcatcctagattccatcggcaggttttttggcggtgatcggggtgccccaaaacgcggttccggaaaagattcccatcatcccgcaaggactgcacattacggcagcctgccgcagaaatcccacggaagaacacaggacgagaatccgtag

SEQ ID NO: 231267 - DNA, 888 bp, Artificial Sequence
  Description of Artificial Sequence: Synthetic coding sequence
atggcaagtctgtcgagaccctccctgccttcatgtctgtgctcatttttgctcctgcttctactgcaagtcagctcatcgtacgcaggacagttccgagtaatcggccctagacatccaattcgtgcactcgtcggcgacgaagtagagctgccctgccgcatttcacctgggaagaatgctactggtatggaggtgggctggtaccgcccacccttcagccgtgtggttcatttatacaggaacgggaaggatcaagacggagaccaggctcccgaatatagggggaggacggagttgttaaaagatgccatcggagaaggaaaggttacattgcggataaggaatgtcaggttcagcgacgaggggggttttacctgcttcttcagagatcattcataccaagaagaagccgctatggagttgaaggtggaagatccgttttactgggtgtcccccggagtgctggtgctccttgccgtcctacctgtgctgctgcttcaaattaccgtgggcttagtttttctgtgccttcagtacaggctgcgcggaaagttacgggctgagatcgagaatctgcaccgtacctttgacccccactttctgagggtgccctgctggaagataaccctgttcgttatcgtgcccgtcttggggccactcgtggcgttgataatctgttataattggctgcatcgacgactggcaggtcagttcttagaggagctccggaaatttagctcgttgtgctacaagcagaggataaagtctcaagaaagagagacagaggcaacacgaggcagagggggactgctccgtgaccatatccctagaggaaaggaggaactggagtcccttgggggtgggaaaaccccccctggcagatag

SEQ ID NO: 231268 - DNA, 642 bp, Artificial Sequence
  Description of Artificial Sequence: Synthetic coding sequence
atggcctccttatcaaggcctagcctgccatcatgcctgtgctccttcctgctgctcctgctcctgcaagtctcgtcatcttatgcagggcaatttagagttataggccctcgccatccaatccgagcactggtgggagacgaagtcgaactgccttgtcggatctcgcccggtaagaatgcgactggaatggaggtgggatggtatcgacctccttttagtcgcgtggttcacctgtataggaacgggaaggatcaagacggcgatcaggccccagagtatcggggacgcacagaattattaaaagatgctattggtgaagggaaggtgacccttcgaattagaaatgtgcggttttctgacgagggaggattcacctgcttttttcgtgaccactcgtaccaagaggaggccgctatggaacttaaggtggaagaccctttttactgggtgtctcctggcgtgctcgtgctgctcgctgtcctccccgtgctgcttctccaaattacagtcgggctggtgtttctttgtctgcagtataggctgagggggaaactgcgcgctgagattgaaaatttacatagaacttttgggcagttcctggaagaattgctgtttcatctcgaagccctgtccggctag

SEQ ID NO: 231269 - DNA, 396 bp, Artificial Sequence
  Description of Artificial Sequence: Synthetic coding sequence
atggccagtttgagccgacctagcctgccgtcctgcctatgctcgttcctacttttgctcctcctgcaggtgtcctcatcgtatgcggaccccttctattgggtatcaccaggagttctggtgctccttgccgtcttgcccgtcctcttactgcaaataaccgtagggttaatcttcctttgcctccaataccgtctcaggggtaagctgagggccgagatagaaaatctgcacagaaccttcgatcctcactttctaagggtaccctgctggaagatcacactcttcgtcatcgtgcccgtgctgggccctctcgttgccctgataatttgctataactggctgcatcgcagactggccggacagttcctggaagaattgcgcaacccgttctag

SEQ ID NO: 231270 - DNA, 621 bp, Artificial Sequence
  Description of Artificial Sequence: Synthetic coding sequence
atggctagtctctccaggccaagcttaccgtcctgtctttgctccttcctgctcttgctgctacttcaagttagctcatcatatgcgggtcaatttagggtaattgggcctaggcatcctatacgagccttagtgggagatgaagtagaactgccatgccgcatctcgccgggaaagaacgccaccggtatggaggtggggtggtaccggcctccgttttctagggtcgtgcatctctaccgtaacggaaaggaccaggatggggatcaggcccctgaataccgtggcagaacagagcttctcaaagatgctatcggcgagggcaaggtgacattaagaatacgaaatgtgagatttagcgacgagggcggatttacctgcttctttcgcgatcattcctatcaggaggaagccgctatggagttgaaggtggaggaccctttctattgggtgtcccctggggtgttagtgttactggcggttctgccagttcttctgctccagatcacagtgggtcttatctttctctgcctacaatataggttaagaggtaaactacgggctgagatcgagaacctgcatcgcacctttgtgttccatctggaggcgctgtccggctag

SEQ ID NO: 231271 - DNA, 759 bp, Artificial Sequence
  Description of Artificial Sequence: Synthetic coding sequence
atggcttcgttgtccagaccttccctgccctcctgtctttgttcgtttctgctactgttgcttctccaggtgtcaagtagctatgcaggccagttccgagtaattggcccacgacatcctatacgtgctcttgtcggggacgaggttgagttgccttgccgcatttccccgggaaaaaacgccacgggtatggaggtcggatggtatcgaccacctttcagtcgagtggtgcatctctaccgtaacggtaaagatcaggacggggaccaggctcctgagtatcgcggacggaccgaactgctgaaggatgccatcggggaggggaaagtgactctgcgaatccgcaacgtgaggttctcagacgagggtggcttcacatgctttttcagggatcatagctatcaggaggaggccgcaatggaactcaaggttgaggaccctttttattgggttagccccggagttctggtactgctagcagtattgcctgtgctgttactgcagataacagtaggactgatatttctttgccttcagtaccggctgcggggaaaattgcgagccgagattgagaacctgcaccggaccttcgacccacattttctcagggtgccctgctggaaaataacactctttgtgattgttcctgtccttggtccattggtagcactgattatatgttacaactggctgcaccggagactcgcgggacagtttctcgaggagctactgttccatctggaggccctgagcgggtag

SEQ ID NO: 231272 - DNA, 516 bp, Artificial Sequence
  Description of Artificial Sequence: Synthetic coding sequence
atggcatctttgagcagacccagtctgcctagctgtctgtgtagctttctgctgctgttgcttctacaggtgtcctcttcttatgcgggacagttcagagtgataggacccaggcaccccataagggcgctggtgggcgatgaagtagagctgccctgcaggatctcccccggaaagaatgctaccgggatggaagtaggctggtatcgccctcccttctccagagtggtccacctgtaccggaacggcaaggatcaggacggtgatcaagcgcctgagtaccgcggtaggacggaattgttgaaggacgctattggcgaggggaaagtgaccctgcggattcggaatgttagattctcagatgaaggcggattcacatgttttttcagagatcactcttaccaagaagaggcggctatggaactaaaagtggaggtcagccacagcgtgacccaggattggctgcagtggcacgatcacggtagcctgcaaccaccccctccacgcctcaagtag

SEQ ID NO: 231273 - DNA, 744 bp, Artificial Sequence
  Description of Artificial Sequence: Synthetic coding sequence
atggctagcctgagccggccttccttgccgagttgtttgtgctcatttctcctgctgctgctcctccaggtctcgagctcttacgcgggacagtttcgggtgataggtccccgacacccaattcgcgcactggtcggggacgaagtggaactgccatgccgcatttcacccggaaagaatgcgaccggcatggaggttggatggtatcgcccacctttctctagggttgtgcatctttacagaaacgggaaggaccaggatggcgaccaggccccagaatacagaggccgtacagaactgttaaaagacgctatcggcgaaggtaaagtgactctgcgcatccggaacgtcagatttagcgacgaaggcggatttacgtgctttttcagagatcacagctaccaagaggaagcagccatggaacttaaagtggaagatcccttttattgggttagcccgggagtgctggtgcttttggcagtgctacccgtgctgctccttcaaattactgtagggttgatattcctgtgcctccagtaccgcttaaggggcaagctccgggctgaaattgaaaacctgcatcgaaccttcgaccctcactttctgagagttccttgctggaaaattacccttttcgtcattgtgcccgtcctcggcccactggtggctttgattatctgctacaattggctgcacagaagactggcgggtcagtttctcgaggaactacgcaatcctttttag

SEQ ID NO: 231274 - DNA, 396 bp, Artificial Sequence
  Description of Artificial Sequence: Synthetic coding sequence
atggctagtctcagccgtccctctttgccatcatgtctttgctccttcctgctgcttttgctacttcaggtgagttcaagctacgcagatcctttctactgggttagccctggagtcctggttctcctggccgtccttcccgtgctgcttttacagattactgttggactggtctttctatgcctacaataccgcctccgaggcaaactgcgggctgagatagagaatttgcatcgtacctttgatccgcatttcctcagagtcccctgttggaagattacactctttgtgattgtgcccgtcctcgggcctcttgtcgccctcattatctgctataattggttgcacagaaggctcgcaggacagttcctggaggagcttcggaatcccttttag

SEQ ID NO: 231275 - DNA, 744 bp, Artificial Sequence
  Description of Artificial Sequence: Synthetic coding sequence
atggccagtctgagccgccctagtctcccgtcgtgcctgtgctcattcctcctgttgctcctgctgcaagtctcaagttcatacgccggtcagtttcgagtgattgggccacggcaccccatcagggctttagtcggagacgaggtcgagctcccctgtaggatctctcctggcaagaacgcaaccggcatggaagtgggatggtatagacctcccttcagccgtgttgtccatttgtacagaaacggcaaggaccaggatggggaccaggctcctgaataccggggaaggacagagctcttgaaggacgcgatcggagagggtaaagtgactctgaggatccggaacgttagatttagcgatgaagggggtttcacttgcttctttcgcgatcactcctaccaggaggaagccgctatggagttaaaggtcgaggatcccttctactgggtctctcctggcgtgctcgtactgctggcggtgcttccagtgctgctcctacagatcacagtggggctcgtgttcctttgtctgcagtataggcttaggggaaaactccgcgctgaaattgaaaatttacatcgaaccttcgacccccattttctgagggtgccctgctggaagatcaccctatttgtcatcgtgccagtcttaggccctttggtggctttgatcatctgctacaattggctccataggcgcctagcaggacaatttttggaggagctgcgcaacccattctag

SEQ ID NO: 231276 - DNA, 744 bp, Artificial Sequence
  Description of Artificial Sequence: Synthetic coding sequence
atggcttcattgtctcgccctagcctccccagctgtctatgctctttcctgctgttgctgctcctgcaggtctcaagctcctacgccggacagttcagggtcatcggtcccaggcatcccatcagagcgctcgtgggggacgaggtggagctcccctgtaggatcagtccgggtaaaaatgccacagggatggaggtaggatggtataggccacctttcagtagagtcgtgcacctgtatcgaaatggcaaggatcaggatggtgaccaagcccctgagtatagagggagaacagagctcctgaaagacgccataggtgaaggcaaagtgacacttagaatccggaatgtaagattctccgatgagggcggttttacctgcttctttagagaccactcctatcaggaggaggcagccatggaactgaaggtcgaggaccctttctactgggtatctccaggggttttagtgctgctggctgtcttaccagtcttgcttttgcagatcacagtgggcctggtgttcttgtgcctgcagtacagactgcgaggaaagctgcgtgccgagatcgaaaatcttcaccggactttcgacccccatttcctgcgcgtgccctgctggaaaatcactctgtttgtaattgtccccgtattgggccctctggtggccctgatcatatgttataattggctgcatcggaggttagctggccagttccttgaggaactaagaaatccattttag

SEQ ID NO: 231277 - DNA, 690 bp, Artificial Sequence
  Description of Artificial Sequence: Synthetic coding sequence
atggctagtctgagcaggccttcgctacctagctgcctgtgctcttttttgctgttgctcttgctccaggtctcctccagctacgctggccagttcagggtgatcgggcctcgtcacccaatccgagccctggtaggcgacgaggtggagctcccctgccgaatttctcctggcaagaatgctaccggaatggaggttgggtggtatcggccaccctttagtcgggtagtgcacctgtatagaaacggaaaagaccaggacggcgatcaggccccagaatatcgcggaagaacagagctattgaaggacgcaatcggtgagggaaaagttacactgcgcattaggaacgtgcgatttagcgacgaggggggtttcacatgcttctttcgcgaccattcctaccaggaggaagccgcaatggagctgaaggtggaggacccattctattgggtgagcccgggagtgcttgttttgcttgcggtcctgcccgtcctgctgcttcaaatcaccgttgggctggtctttctctgcctgcaatataggcttagggggaagctccgcgcagaaatagaaaatttgcatcgcaccttcgagtcgttcggcgtactgggaccacaggtgaaagaaccaaagaagactggacagttcctggaagaacttttattccacctggaagcgctatctgggtag

SEQ ID NO: 231278 - DNA, 642 bp, Artificial Sequence
  Description of Artificial Sequence: Synthetic coding sequence
atggcgagtctcagtcgccctagtctaccaagttgcttgtgctctttcctgctgctactcctcctccaggtatcttcatcatacgccggtcagtttagggtcattgggccaagacaccccattcgggctctggtgggcgatgaggtggagctaccctgccgaatatcccctggcaaaaacgcaactggaatggaagtggggtggtaccgtccacctttctcacgcgtggtccacctgtaccggaacggcaaagaccaagatggtgatcaggccccagagtatcgcggaagaactgaactcctgaaagacgcaattggggagggaaaggtgaccctgagaatacgtaacgttcgcttttctgatgagggcggtttcacgtgtttctttagagaccacagttatcaggaggaagccgctatggagctcaaagtcgaggatcccttctactgggtctctcccggagtcctggtcctgctggcggtcctgccagtgttgcttctgcagataactgttgggctcatctttctctgtctgcagtatcgcctgagagggaaattgcgggctgagatagaaaacctgcaccggaccttcgggcagttcctcgaagaactgctgtttcacctggaggccctgagcggctag

SEQ ID NO: 231279 - DNA, 675 bp, Artificial Sequence
  Description of Artificial Sequence: Synthetic coding sequence
atggcctcactgtcacgtcccagcctaccttcttgcctttgttcatttctactgcttctgctcctgcaggtctcttcctcctacgccggtcagttcagggtgattggacctcggcacccaattcgcgcattagttggggacgaagttgagctgccttgcagaatctcccccggaaaaaacgcaactgggatggaggtgggttggtacagaccccctttctcacgagtggttcatctgtaccgaaatggcaaggaccaggacggagaccaagcccctgagtacagagggagaactgagctcttgaaggatgcaatcggagagggaaaagtcacgcttcgtatccggaacgttcgcttctcggacgaaggcggattcacctgctttttccgcgaccactcgtaccaggaggaggccgcaatggaactaaaagtggaagacccattctattgggtgtcacccggagtgctcgtcctcctagctgtgctcccagtcttattgctgcagatcaccgtcgggctaatcttcctttgtttgcagtatcgactgcgtggcaaactccgcgcagaaatagaaaacctgcatagaacattcgagagttttggagtgctggggccacaggtcaaggaacccaagaagaccggacagttcctcgaagagttgcgcaatcctttttag

SEQ ID NO: 231280 - DNA, 675 bp, Artificial Sequence
  Description of Artificial Sequence: Synthetic coding sequence
atggcgtctttgagtcgcccttcgcttccttcttgtctctgtagcttcctcttgcttctcctgctgcaagtgtcaagctcatacgctggccagttccgggtaattggcccacggcacccaattagggcacttgtgggcgatgaagtggaactgccatgcaggatctcaccgggaaagaatgctacaggcatggaggtgggctggtatagacccccttttagcagagtggtgcatttatacaggaatgggaaggatcaggatggggatcaggcaccagagtataggggcaggaccgaattgttaaaagatgcgattggcgagggaaaggtcaccctgcgcatccggaacgtgcggttcagcgacgagggaggtttcacttgttttttccgggaccactcttatcaggaggaggccgctatggaacttaaggtggaagatccattttactgggtgtctcctggcgtgctggtactgctagccgttctacctgtcctgttgctgcaaataaccctaggcttggtctttctctgcctccagtacaggctgcggggtaagctgagagccgagatcgagaaccttcaccgcaccttcgagtcatttggggtcttaggccctcaggttaaagagcctaaaaaaacaggtcaattcctggaggaacttagaaaccccttctag

SEQ ID NO: 231281 - DNA, 690 bp, Artificial Sequence
  Description of Artificial Sequence: Synthetic coding sequence
atggccagcctgagccgcccaagcctccccagttgtctgtgctcatttctcctcctactgctgctgcaggtctctagctcatatgccggacaatttcgggtgattggtcctcggcatcctattagggccctggtaggagacgaagtcgagttgccatgtcgcatcagtcccggaaagaatgcaacaggaatggaggtcggctggtataggcctcccttctcaagagtcgtgcacctctatagaaacggtaaggaccaggacggcgaccaggcccctgaatacagaggcaggacggaactcctgaaggatgcaattggcgaggggaaggtaacgctgaggattcgcaacgttcggttctctgacgagggaggttttacctgtttctttcgggaccactcttatcaggaggaggctgcgatggaactgaaagtggaggatcctttttactgggtaagtccaggggtgctagtgctcctcgccgtcctgcccgttctcctcctgcagattactgtgggtttagtttttctgtgtctccaataccgtctgcggggaaaactgcgcgctgagatagagaatcttcatcggaccttcgaatcatttggtgtgcttggtcctcaggtcaaagagcctaagaagacaggccagttcttggaggagttgctctttcatctggaggccttaagtggctag

SEQ ID NO: 231282 - DNA, 642 bp, Artificial Sequence
  Description of Artificial Sequence: Synthetic coding sequence
atggcgtctttgtcgcggcctagccttccctcatgcttatgcagttttctgctgctgctcttgctccaagtatccagtagttacgctggccagtttcgggtgatcggtcccaggcatcccattagggcattggtgggcgatgaggtcgaacttccatgccggataagtcccggaaaaaacgccactggaatggaggtcggctggtacagaccacccttttcacgggtcgtgcacctgtataggaatggaaaggatcaggacggcgaccaggcaccggagtatagaggcaggaccgaattattaaaggatgccataggagagggcaaagtgacgcttcgaatacggaacgtgagattcagcgatgaggggggattcacatgcttctttcgcgatcactcctaccaggaagaagcggctatggaactcaaggtggaggatccattttactgggtgtctccaggcgtgctggtgctacttgccgttttaccagttcttcttctgcaaattaccgtgggcctcgtctttctgtgtctgcagtacaggttgcgcggaaaactcagagctgagatcgaaaatttgcacaggacatttgggcagttcctcgaggagctgctgttccacttagaggcactgtccgggtag

SEQ ID NO: 231283 - DNA, 540 bp, Artificial Sequence
  Description of Artificial Sequence: Synthetic coding sequence
tgacagtttcgagtgatcggccctcgtcatccaatccgcgctctcgtgggggacgaagtggaactaccttgccgcataagcccagggaaaaacgcgactggcatggaggtgggctggtaccgaccacctttctctcgcgtagtccacctgtatagaaacgggaaggatcaggatggagatcaagcccctgagtaccgaggcagaaccgaactgctgaaggatgccatcggagaaggaaaagtcacgctgcgaatccgtaacgtgaggtttagcgatgaaggcggttttacctgttttttcagagaccattcatatcaagaagaggccgctatggaactaaaagtagaagaccccttctactgggttagccccggagtgttggtcttgctggctgtgctacccgtcctgctgctccagattaccgtcgggctggtcttcctatgtctacagtacagactcaggggcaagcttagagctgaaatcgagaatctccacaggaccttcggccagttcctggaggagctgcgaaaccccttttag

SEQ ID NO: 231284 - DNA, 396 bp, Artificial Sequence
  Description of Artificial Sequence: Synthetic coding sequence
atggcctccctttctcggccatccctccccagctgcctctgtagcttcctgctcctcctgttgctgcaggtgagtagcagttacgctgatccattttattgggttagtccaggcgtgctagtccttctggccgtgctgcccgtcctcctgctccagattaccgtgggcctcgttttcctgtgcttgcagtacaggctccggggaaagttgagggcagaaatcgaaaacctgcatcgcacttttgacccccactttctgcgggtcccctgttggaagatcaccctgttcgtgatcgtgccggtactgggaccattggtggctttaataatatgctataactggctccaccggagattagccggtcagtttttggaggagctgagaaacccattttag

SEQ ID NO: 231285 - DNA, 615 bp, Artificial Sequence
  Description of Artificial Sequence: Synthetic coding sequence
tctctaagccgacctagtctgccctcatgtctgtgttcatttcttctgttactgctactgcaggtgtcttcatcctatgcaggccagttcagagttattggccctaggcacccaatccgagccttggtgggcgacgaagttgagttaccatgccgcatttcaccaggtaaaaatgctaccggtatggaggttggttggtacaggcctcccttctctcgggtggtccatctttatcggaacgggaaggaccaggacggtgatcaggctccggagtacaggggacggacagagctactcaaggatgcaataggtgagggtaaggtaacattaagaattcggaatgtgaggtttagcgacgaggggggatttacctgcttctttagagatcacagctaccaggaggaagccgcaatggaacttaaggttgaggatcccttctattgggtaagccctggcgtactggtgcttctggccgttctcccggtcctgctgctgcagataaccgtaggtctcgtattcctgtgcttacagtaccgcttacggggaaaactgcgggctgagatcgagaacctccaccggactttcgtcttccatctcgaggccctttcaggatag

SEQ ID NO: 231286 - DNA, 396 bp, Artificial Sequence
  Description of Artificial Sequence: Synthetic coding sequence
atggcctccctgagtcgcccttctctaccatcttgcctttgttctttcctgcttttactcctcttacaggtttcttcaagctatgctgatcctttctactgggtgtctcctggcgttctggtgttattagccgtcctcccagtcctgctcctccaaatcacgctcggcctggtcttcctctgcctgcagtataggctgagaggtaaattgcgcgcagagatcgaaaatctccaccggacatttgatccccacttcctgagagtgccctgctggaagattactttgttcgtcatagtacctgtcctgggaccactggtggcactgattatctgttacaactggttgcaccggcgactagctggccaattcctggaggagctgcggaatccgttttag

SEQ ID NO: 231287 - DNA, 675 bp, Artificial Sequence
  Description of Artificial Sequence: Synthetic coding sequence
atggcgtccctctctcgcccatcactcccgagctgtctatgttctttcctgttgctgttattgctccaagtgtccagctcttacgcaggacagttccgagtcataggacccaggcaccctattcgcgcattggtaggagacgaagtggagctcccatgccgtatctccccaggaaagaacgccaccgggatggaggtaggctggtatcggccaccattctcaagagtggtccacttataccgcaatggcaaagaccaggatggcgaccaggcgcctgaatatcgaggtagaaccgaactgttgaaggatgcaattggtgaaggtaaagtgactcttcgcatccgaaacgtcagattttctgacgaaggtgggtttacctgtttcttccgtgaccactcttaccaagaggaagccgctatggaattaaaagtggaagacccattctactgggtttcccccggagtcctcgtactgctggcagtgctgcccgtcttgctcctgcagattacagtgggtctggtgtttctttgccttcaatacagactgagaggcaagcttagagccgaaatagagaacctccatagaacttttgagtccttcggcgttctgggcccacaggttaaggaaccaaaaaaaaccggtcaatttttagaagagctccggaaccctttttag

SEQ ID NO: 231288 - DNA, 675 bp, Artificial Sequence
  Description of Artificial Sequence: Synthetic coding sequence
atggcctccctgtcgaggccaagtctccctagctgcctatgcagttttttgttgttgctgctgttacaagtttcttcttcttatgctggccagttcagagttattggccctcggcatcctattagagccttagtgggagacgaggtagagctcccgtgtcggattagtcccggaaaaaacgcaaccggcatggaagtcgggtggtacagacctcccttcagtagagtcgttcacctctaccggaatggtaaggaccaggacggggatcaggcacccgaatatcgaggacgtactgagctcctgaaggacgcgatcggcgaaggcaaggttaccctccgcattcgaaatgtcagattcagcgatgaaggtggctttacatgcttctttagggaccattcctatcaagaggaggcggctatggaactcaaggttgaggaccctttctactgggttagcccaggggtcctggtgctgctggcagttcttcccgtgctacttctccagataaccgttggcctggtgttcctgtgcctgcagtatagactcagaggcaagctccgggcagaaatagaaaatctgcatcggaccttcgagtctttcggagtacttggtccacaggtgaaggagcccaagaaaaccggtcaattccttgaggagctcaggaacccattttag

SEQ ID NO: 231289 - DNA, 675 bp, Artificial Sequence
  Description of Artificial Sequence: Synthetic coding sequence
atggcgtcactttccagaccttccctcccctcctgcctgtgctcttttctcctccttttactgctgcaagtgtccagctcctacgccggacaatttcgggtgattggacccagacatccaatccgcgctctggtaggagacgaagttgagctgccttgccggatttccccaggaaagaatgctacaggcatggaagtcggttggtaccgaccacccttctctcgcgtggtgcacctgtaccgcaacggtaaagatcaggacggtgaccaggcccctgaatacaggggtagaacagagcttctgaaggacgcaatcggagaaggcaaggttaccctgcgcatcaggaatgtccgattcagtgacgaggggggattcacctgcttcttccgcgatcacagttaccaggaagaggctgccatggagctgaaggtcgaagacccattctactgggtttctcctggggtactggtcctgctggcagtgctgcccgttctccttctacagattacagttgggctggtgtttctgtgcttgcagtatcgtctccggggaaagctgcgcgctgagattgagaacctgcacagaacctttgagagttttggagtcctaggccctcaggtgaaagaaccaaagaagactggccagtttttggaggagctgagaaaccctttttag

SEQ ID NO: 231290 - DNA, 759 bp, Artificial Sequence
  Description of Artificial Sequence: Synthetic coding sequence
atggccagcctttctcgacctagtttgcctagttgcctctgcagtttcctgctcttactcctgttgcaagtgtccagttcttatgccggtcagttccgcgtgattggacccagacatccgataagggccttggtgggggacgaggtggagctcccctgtaggatctctccaggcaagaacgccaccggaatggaggtgggatggtaccggccaccattttcccgcgttgtacacctctatcggaacggaaaggatcaggatggagatcaggccccagaataccgtggacggaccgaattgctgaaagacgctatcggcgaaggcaaggtcacattaagaatacgcaacgtgagattctcagacgaagggggttttacttgcttctttagggatcacagctaccaggaggaggcagcaatggagctaaaagtggaagaccccttctattgggtgtccccgggtgttcttgtgctgttggccgttttgcctgtcttgctgttacagatcacagttggcttagtgtttttatgcctgcagtatcgactgcggggaaaacttagagcggaaatagagaatctgcacagaacattcgatcctcacttcttgcgtgttccctgctggaaaattaccttgtttgtcattgtccccgtccttggacctctggttgcgctcattatctgctataactggctgcacaggcggttggcaggacagttcctcgaggagcttctgtttcatctagaagccctgagcggatag

SEQ ID NO: 231291 - DNA, 744 bp, Artificial Sequence
  Description of Artificial Sequence: Synthetic coding sequence
atggcatccttgtcccggcctagtctgccctcttgtctatgcagcttcctacttctgctccttctgcaggtttcctcttcatatgccggacagtttagggtgataggtccaaggcatcccattagagctctggtcggcgatgaagtcgagcttccttgccgcatctcgcctggaaagaacgccacggggatggaggtggggtggtacagacccccattttctcgggtggtacacctgtaccgtaacggaaaagatcaggatggcgatcaagcacctgaataccgaggcaggacagaactcctgaaggacgccattggagaaggcaaggtcacactgcgcatcaggaacgtgaggttcagtgatgaggggggatttacttgtttcttccgggaccatagctatcaggaggaagctgccatggagctaaaagtagaggatcctttctattgggttagcccaggcgtgttggtgttgctcgcggttcttcccgtactgctgctacagatcacagtcggactggtgttcctttgtctccagtatcgcctacggggaaagctgagagccgagatcgagaacctccacagaacattcgatcctcattttctgagagtgccatgctggaagatcactttgttcgtaattgtgcccgtcttgggccctctagttgccctcatcatatgctataattggctccacagaagactggctggacagttcttggaggaattgagaaaccccttctag

SEQ ID NO: 231292 - DNA, 540 bp, Artificial Sequence
  Description of Artificial Sequence: Synthetic coding sequence
tgacaatttagagtaattgggccacgacaccccattcgcgcactggtgggagacgaggtggaactcccctgccgtatttcaccaggaaagaacgcaaccggtatggaagttggctggtatcgcccacccttctctcgtgtagtgcatctgtataggaacgggaaagatcaagacggcgaccaggcccctgaatataggggacggactgaactcctgaaggatgccatcggcgaaggtaaagtcaccctccggattcggaatgtacgatttagtgacgaaggcggatttacatgttttttcagagatcactcctatcaagaggaagctgccatggagttaaaagtggaggatccgttctactgggtttctcccggtgtgctggtactgttggctgtacttccagtcctgctcttacagatcaccgtgggcctggtgttcttgtgcctgcaatatcgtcttcggggaaagctgcgtgccgaaatcgaaaatctccaccgcactttcggacagttcttggaggagctcagaaatcccttctag

SEQ ID NO: 231293 - DNA, 540 bp, Artificial Sequence
  Description of Artificial Sequence: Synthetic coding sequence
taacagttcagagtgattggacccaggcacccaatccgcgctctcgtgggggatgaagtggagttgccatgccgcattagccccggaaagaacgctactggcatggaagttggttggtataggcctccttttagccgcgtggtgcacctgtatcgaaacgggaaggaccaagacggagaccaggctcccgaataccgcggaaggactgagcttctgaaagatgccatcggagaagggaaggtaacccttcgcattcggaacgtgcggttctccgacgaagggggttttacatgcttttttagggatcacagttatcaggaggaagccgctatggagttgaaagtggaagacccgttttactgggtctccccaggggttttagtgttgctggcagtcttgcccgtgctcctgctgcagattacagtgggcctggtttttctatgtcttcaatataggttgcggggtaagctgcgcgcagagattgaaaaccttcacaggacttttggccaattccttgaggagctacgaaatcccttctag

SEQ ID NO: 231294 - DNA, 759 bp, Artificial Sequence
  Description of Artificial Sequence: Synthetic coding sequence
atggcttctctgtccagacctagtctgccttcatgtctgtgctcattccttctgttactcctactccaggtctcctcttcatatgccggacagttccgagtcatcgggcctagacatccaatccgagcactggtaggtgacgaagtggagctcccttgccgaataagtccagggaaaaacgccaccggaatggaggtgggctggtaccgcccacctttctcacgagttgttcatctgtataggaatgggaaagatcaggacggagatcaggctcctgaataccggggacggacagagcttctcaaagacgctatcggggagggtaaggttactctgcggatacggaacgttcgtttttctgatgaaggcggattcacctgtttctttcgcgatcacagctatcaggaagaagccgctatggaactaaaagtcgaagatccgttttattgggtcagccccggtgtcctggtcctcctggctgtgctgcccgttctgctgctacagatcacagttggactggtattcctgtgtctacagtacaggttacggggaaagcttagagctgagattgaaaacctgcacaggacattcgacccgcactttttaagagtaccctgctggaagatcaccctgtttgtgatcgtccccgtgctcggtcctttggttgctctcattatctgctataactggctgcatcgcaggttggctggtcaattcttggaggagctgctgtttcacttagaagctctctctggctag

SEQ ID NO: 231295 - DNA, 690 bp, Artificial Sequence
  Description of Artificial Sequence: Synthetic coding sequence
atggcttccctcagtagaccttccttaccatcatgtttatgcagtttcctcttgctgctcttgctgcaagtttcgtcctcctatgcaggccaatttcgcgtaattggtcctcggcatccaataagagcactggtgggcgacgaagtagagttgccctgtagaatttcgcctggtaagaacgccacggggatggaagtcggatggtaccgcccaccattctctcgagtggtgcatctctacagaaatggcaaagaccaagacggcgatcaggcacctgagtaccgtggtagaacagaactgctaaaagatgcaattggagaggggaaggtcaccctgagaattcggaacgttcgcttttccgacgaagggggttttacttgcttctttcgtgatcactcctaccaggaagaagctgctatggagctaaaggtggaagatccgttttactgggtcagtcctggggtactcgtgctgctggccgtcctaccagtcctcctactccagattactgtggggctggtgtttctgtgcttgcagtaccgcctgcggggtaagttgcgtgcagagatcgaaaatctccatcgaacgttcgagagctttggcgtcctgggaccgcaggtaaaggagcccaagaagacaggacagtttctcgaagaactcttgtttcacctggaggcgctatcaggctag

SEQ ID NO: 231296 - DNA, 888 bp, Artificial Sequence
  Description of Artificial Sequence: Synthetic coding sequence
atggctagtttgtctcgcccaagcctacctagctgtttatgctcgtttctgctgctgcttctgctacaggtctcgagttcttatgctgggcagttccgggtgatcggacccagacacccgatacgtgccctagtgggcgatgaggtagagttgccctgtcggatctccccaggaaagaacgccacgggtatggaggttggatggtaccggcctccctttagcagggtggtccacctgtacaggaatggtaaggaccaggacggtgatcaggccccagaatacagggggcgaactgagcttcttaaagacgcaataggcgaaggcaaggtgacactccgtatccgcaatgtcaggttcagcgacgagggcggatttacctgcttcttcagggatcacagttaccaggaggaagctgccatggaactgaaagtggaggatcccttctactgggtctctcctggggtactcgtgctgcttgctgtcttgcccgttctcctcctccaaatcacagttggccttgtattcctatgcctccaatatcgccttagggggaaacttagagcggagatcgagaatcttcaccgtaccttcgaccctcattttttaagagtgccatgttggaaaatcacactctttgtcattgtccccgtcctagggccacttgtggcactgattatttgctataattggctgcatcgcagactggctggccaatttttggaagaacttcgcaaattctcatctctgtgttataagcaaagaattaaaagtcaggagcgagagactgaggccacccgcggtaggggcggactgctaagagatcacattccacggggtaaggaagagctcgagtcattgggagggggtaaaaccccacccggaaggtag

SEQ ID NO: 231297 - DNA, 642 bp, Artificial Sequence
  Description of Artificial Sequence: Synthetic coding sequence
atggcatcactgtctcggccatctttgccgtcttgcctttgtagtttcctgttactgttactcttgcaggtcagttcttcctacgccggtcagttcagagtcataggtcccaggcaccctatcagggccttagtgggggacgaggtggagctgccttgtagaataagcccaggcaagaacgctactggtatggaggtcgggtggtacaggcccccttttagccgagtggtgcatctttatcgcaatggaaaggaccaagatggagaccaggctcccgagtaccggggtagaactgaactactcaaggatgctatcggagagggtaaggtgaccttgcgcattaggaatgttcggttcagcgacgaggggggttttacctgttttttcagggaccatagttaccaagaagaggcggctatggaactgaaagtcgaagacccattttactgggtgagcccaggtgtgctcgtgctgctcgccgttctccccgtcctgttactccagataactgtcggcctggtattcttatgcctccagtataggctgaggggaaagctcagagccgagattgaaaacttacaccggacctttggccagtttcttgaggagctcctgtttcacttggaggctttatctgggtag

SEQ ID NO: 231298 - DNA, 759 bp, Artificial Sequence
  Description of Artificial Sequence: Synthetic coding sequence
atggcaagcctgagtcggccttctctgccatcatgtttgtgttcttttctactgctccttctcttacaggtgtcaagcagctacgcaggccagttccgcgtaatcggtccacggcaccctatccgggcactggtgggggacgaagtggagctgccttgtagaattagtccaggaaaaaatgccacagggatggaggtcgggtggtataggcctccattttcgagggtggtgcatctgtataggaacgggaaagatcaggatggcgaccaggcccctgagtacaggggcaggactgaactgctgaaggatgctattggcgagggcaaggttactcttagaatccggaatgtccgcttttctgatgaaggcggatttacttgcttttttagagatcattcataccaagaggaagcagccatggagctaaaggtggaggaccctttctattgggtgagtccaggcgtgctagtgctactagccgtcctgcctgtccttttgctgcaaattaccgttggcttggtctttctttgtctacagtaccggttacgcggtaaactgagggcagagattgaaaaccttcacagaacatttgacccgcatttcctgcgggtgccttgctggaaaatcaccttgttcgtgatagtcccagtcctcggccctctggtcgctctaatcatatgttacaattggctacataggaggctggctgggcaattcctggaggaactgttgtttcacctcgaggcattgagcggctag

SEQ ID NO: 231299 - DNA, 540 bp, Artificial Sequence
  Description of Artificial Sequence: Synthetic coding sequence
tgacagttccgcgttatcggcccacgccaccctatacgggctcttgtgggtgacgaggttgaactcccttgccgaattagcccgggaaagaatgctacaggtatggaagtgggctggtatcgaccaccattctccagagtggttcacctgtatagaaacggcaaagaccaagacggcgatcaagcacctgaatacagaggaagaaccgagttgctaaaggacgcaataggtgaggggaaagtgactcttcgcatccgcaacgtgcgttttagcgacgaagggggatttacgtgcttcttcagggatcactcatatcaagaggaggcagccatggaactgaaggtggaggaccccttctactgggtgtctcctggggtgctcgtacttctggccgttctgcccgtccttttactgcaaatcacagtcgggctggtcttcctttgtctgcagtaccggctcagaggcaagctgcgtgcagagattgagaacctccaccgcacatttggccagttcctggaagaactcaggaatcccttttag

SEQ ID NO: 231300 - DNA, 888 bp, Artificial Sequence
  Description of Artificial Sequence: Synthetic coding sequence
atggcaagcctttctcgccctagtctgccttcttgcctgtgctcgtttctcctgctgctcctgctgcaggtgtctagctcctacgcaggccagtttcgggtgattggacccaggcatcctattagagcattggtgggagacgaagtggagctgccttgtagaatctcccctggtaaaaacgcaaccggaatggaggtcggctggtatcggccacctttttcccgtgttgtgcatttgtatcgcaacggcaaggaccaggatggggatcaggccccagagtatcgcggacggaccgagctcttaaaggacgccatcggagaagggaaagttacactccgtataaggaacgtgcggtttagtgacgaaggcggtttcacttgcttctttagggaccacagctatcaagaggaagctgccatggagctgaaagtggaggaccccttctactgggtgtcacccggtgttctggttctgcttgctgttctcccggtactcctgcttcagatcaccgttgggctggtctttctttgcctacagtaccgcctccgtggcaaactacgcgctgagattgaaaatctgcaccggaccttcgacccccactttctgcgtgtgccgtgctggaagatcacactgtttgtgatagttccggtgcttgggcctttagtggcactaattatttgctacaattggcttcaccgacgcctcgcgggacaatttctggaagagctacgcaagtttagtagcctgtgctacaaacagcggatcaagagccaggaaagggagactgaagccacgcgaggccgaggcggattactgagagaccacattcccaggggtaaggaggagctcgaatcactcggagggggaaagacacctccgggaagatag

SEQ ID NO: 231301 - DNA, 888 bp, Artificial Sequence
  Description of Artificial Sequence: Synthetic coding sequence
atggcctctctgtcgcgcccttcattaccctcctgcttgtgttcatttttgctcctactgctgctgcaggtgagctcttcgtacgccggacagttcagagtaatcggacccagacaccctatccgtgccttggtcggtgatgaggtggagctgccctgccgtatttcccctgggaagaacgccaccgggatggaggttggctggtacagacctccttttagcagggtggtgcatctgtatcgcaacggaaaggatcaagatggcgatcaggcacccgagtaccgtggcagaacagagctattgaaagatgctatcggcgaaggcaaggttaccctcagaatccgcaatgtccggttctcagacgaaggtggtttcacttgttttttcagggatcacagctatcaagaggaggcagcaatggagttaaaagtggaagatccgttctattgggtgtcgcctggagtcctggtgttgctggcagtgctgccagtgctgctgctccagatcaccgtggggctcgtcttcttatgcttgcagtatcgactgagaggaaagttgagagccgagatagagaacttgcacagaactttcgatcctcatttcctccgggtgccttgctggaagataacactgttcgttatcgtgccagtgctgggtcccctggtcgctctcattatttgctacaactggctgcaccggcgattagccggtcagtttctggaggaattacggaagttctcatcactatgctataaacaacggatcaagagtcaagagagagaaaccgaggccacccgcggacgtgggggattgctgcgcgatcatataccacgagggaaagaagaattagaatcactgggaggcggaaagacaccccctgggaggtag

SEQ ID NO: 231302 - DNA, 396 bp, Artificial Sequence
  Description of Artificial Sequence: Synthetic coding sequence
atggccagcctctcacggccatccctcccttcctgcctgtgttcttttctgttacttctgctgctgcaggtcagcagctcctacgctgacccattttattgggttagtcccggtgtgctcgtgttgcttgccgtactgccagttctgctccttcaaatcacggtcgggctggttttcttatgtctgcagtacagattgaggggtaagctccgcgcagagattgagaatctgcaccggacttttgacccccactttctacgggtgccttgttggaaaataactttatttgtgatcgtgccagtgctgggacccttagtggcactgataatatgctacaactggttgcatagaaggctggccggtcagttcctggaagaactaaggaaccccttctag

SEQ ID NO: 231303 - DNA, 759 bp, Artificial Sequence
  Description of Artificial Sequence: Synthetic coding sequence
atggccagcttgtctagaccatctttacctagttgcctgtgcagtttcctcttgctgctcttattgcaggtgagcagcagctacgctggacagtttcgagtaattggcccacgccatcccatcagggctttggtgggcgatgaggtagagctgccctgccggatctctccaggcaaaaacgccacaggaatggaggttggctggtatagacctcccttttcacgggtcgtgcacctgtaccggaatggaaaggatcaagatggtgatcaggcacccgagtaccgcggaagaaccgagttactcaaggacgcaattggggaaggtaaagtgacactcaggatccgaaatgtgcggttttccgacgagggtgggttcacctgcttcttccgtgaccacagctaccaagaggaagcggcaatggagctaaaggtcgaggacccattttattgggtgtctccaggcgttctcgtgctgctggcagtcttacccgtgctgctgctccagattaccgttggtctggtgttcctgtgcctccagtatagattgcgcggaaagcttcgggcagaaattgaaaatctgcacagaacatttgaccctcatttcctccgagtcccttgttggaagatcaccctgttcgtgattgtaccagtgctgggacctctcgttgctctcatcatatgttataactggcttcatagacgcctggcaggtcaattcctggaggagctgttgtttcacttagaggctcttagcggctag

SEQ ID NO: 231304 - DNA, 744 bp, Artificial Sequence
  Description of Artificial Sequence: Synthetic coding sequence
atggccagcctgtcccgaccatccctgcccagctgtctgtgttctttcctgttgcttctcctcttacaggtctcatcatcctacgcaggtcagtttcgagtgatcggcccacgccatcccattcgcgctttggttggcgacgaggtcgaattgccttgcaggatttccccaggaaagaatgccacaggaatggaagtgggctggtaccgaccccctttctcccgtgtggtgcatctgtataggaacggcaaggaccaggatggggatcaggcaccagagtacagaggcaggacggagctgcttaaggacgccataggggaaggcaaggtcaccctcaggatcaggaatgtgcggtttagtgacgaaggtgggtttacctgctttttcagggaccactcatatcaagaggaggctgcaatggaactgaaggtcgaggatccattttattgggtttcccctggagtgttggtactcttggccgtattgcccgtactcctgctgcagattacggtcggactggtctttctctgtctgcagtacagactccggggtaagctgagggccgaaattgaaaatctgcaccggacctttgacccccacttcctgagagtgccctgttggaagattactttgttcgttattgtgcccgtccttggacctttagtggcccttatcatctgctacaattggctgcatagaagacttgccggacagttcctggaggagctgcgtaaccctttttag

SEQ ID NO: 231305 - DNA, 615 bp, Artificial Sequence
  Description of Artificial Sequence: Synthetic coding sequence
tccttatcaaggcctagtctgcccagttgtctgtgcagcttcctactacttttgctcctgcaagtctcttcttcttacgctggacaatttagggtcattggtccccgacatcctatccgggcactggttggagacgaagtggagctcccatgccgaatctctcctggcaaaaacgccacgggcatggaggtcggctggtacagacctcccttctcgcgcgttgtgcacctgtatcggaatggtaaagatcaggacggcgatcaggctccagagtaccggggtagaacagagctcctgaaggatgccataggagagggaaaggtgacgctacgtatccggaatgtgagattcagcgacgaggggggatttacatgcttcttccgggaccactcctaccaagaagaagccgctatggagctgaaagtggaggatcccttttattgggtctcacccggtgtgctagtgctgctggcggttctccctgtgcttctcttacaaatcactgtagggctcgtcttcctatgtttgcagtacagattgagaggtaagctccgggcagaaattgaaaatcttcacaggacctttgttttccatcttgaagcgttgtccggctag

SEQ ID NO: 231306 - DNA, 888 bp, Artificial Sequence
  Description of Artificial Sequence: Synthetic coding sequence
atggcttcacttagtaggccaagtctgcccagctgcctgtgctcatttttgctgttactgctcctgcaggtttcaagtagttacgccggtcagtttcgggtgatcggaccgaggcaccctattcgtgctcttgtcggagacgaggtggagctcccgtgcagaatctctccaggaaagaatgcaacaggcatggaggtggggtggtacaggccaccctttagccgtgttgtccatctgtacagaaacggcaaggaccaggacggtgaccaggccccagagtacagaggacgtacagaattgttaaaggacgccataggcgaggggaaagtgactctgcgtataagaaacgtgcgattttctgacgaaggcggttttacttgctttttccgcgaccatagctaccaggaggaggctgctatggagctgaaagtggaggacccattctactgggtgtcaccaggcgtgctcgtgctcctggccgtgctcccagttctgctgctccagatcaccctgggcctggtcttcctttgtctgcagtaccggctacgaggcaaactgagagctgaaatagagaacctgcaccgcaccttcgacccccacttcctgagagtcccttgttggaagataacgctctttgtgatagttccagtgctcggtccgctagttgccctgattatctgctacaattggctgcacagaagacttgccggtcaattcctagaagagttgaggaaattttcaagcctctgctacaagcaacgcattaagagccaggagcgagagactgaggctacccggggaaggggaggcttgcttagagatcacattccacgtggcaaggaggagcttgagtccctgggaggcggaaaaacacccccaggacggtag

SEQ ID NO: 231307 - DNA, 690 bp, Artificial Sequence
  Description of Artificial Sequence: Synthetic coding sequence
atggcaagtctcagccggccttccctgccgtcatgcctgtgttccttcttgctcctgcttttactccaagtctcttcatcttacgctggacagtttagggttattggacccagacacccaatacgagctctcgtaggagacgaggtcgagttaccctgtcggatctctcccggaaaaaatgcaaccgggatggaggtcggttggtatcggcctcctttcagccgagtagtgcacctatacagaaacggcaaggatcaggacggggatcaggctcccgagtaccggggacgcaccgagctgctcaaagatgccattggggaagggaaggtcacgctccgaatccggaacgtgcgtttctccgacgaaggagggttcacatgtttttttagagatcatagctaccaagaggaagcggcaatggagctaaaggtagaggatccgttctactgggtgagcccgggagtgctcgtgctactcgcggtcctccctgtccttctccttcagatcacagttggtttggtgttcctatgtctacagtatagattgaggggcaaactgcgcgctgagatcgaaaaccttcatcggaccttcgagtcttttggtgtgctgggtccacaagtgaaagaacccaaaaaaactggccagttccttgaggagttgctgttccatcttgaggcactgagcggatag

SEQ ID NO: 231308 - DNA, 396 bp, Artificial Sequence
  Description of Artificial Sequence: Synthetic coding sequence
atggcatcacttagcaggccgtccctgccttcttgtctctgtagtttcttattactgttgctactgcaagtttcctcaagttatgccgatcccttttactgggtttcgcccggagtgctggtgttgctcgccgtactgccggtgctgctacttcagattacagtaggccttgtattcttgtgcctccagtaccggctgcgcggaaagctcagggctgaaatcgaaaacctacatagaaccttcgacccacattttctaagggttccatgctggaaaatcactcttttcgtcatcgtgcccgtactgggtccactagtcgccctcattatctgttataattggctccaccgcaggttagcaggccagtttctggaagaattacggaatcctttttag

SEQ ID NO: 231309 - DNA, 540 bp, Artificial Sequence
  Description of Artificial Sequence: Synthetic coding sequence
tagcagtttcgagtgatcggccctcggcatcctatccgggctctggtgggagacgaggtcgagctgccttgtagaatctctcccggaaagaacgccaccggcatggaggtgggctggtaccgacccccatttagtcgggttgtgcatctatatagaaacggaaaggaccaggacggagaccaggcacccgaatataggggcagaacggagcttctgaaagacgccatcggggaagggaaggtcaccctgcgcattcgtaatgtgagattttcagatgagggaggctttacttgtttcttccgggaccatagctaccaagaggaagcagctatggaacttaaagttgaggaccccttttattgggtatctccgggagttctcgtgcttcttgccgtcctcccagtcttattgttgcagatcacattgggtttggtttttttatgtttgcaataccgcttacgcggaaagctgagagccgaaatcgaaaacctgcatagaaccttcggtcagtttctggaagagctgagaaatcccttctag

SEQ ID NO: 231310 - DNA, 627 bp, Artificial Sequence
  Description of Artificial Sequence: Synthetic coding sequence
atggcatccctctctaggccctctttgccctcctgcctatgctcctttcttttacttttgcttcttcaggtgtcttcgtcatatgctggccaatttcgtgtgatcggtcctcgccatcccattagagctttagtaggggacgaagtcgagcttccttgccggatctcaccaggcaagaacgctactggcatggaggtgggctggtatcgcccaccatttagcagagtcgttcatttatatcgcaatggaaaggaccaggacggcgaccaagccccagaataccgcggtagaaccgaattactgaaggacgctattggagagggtaaagtcaccctgcggataaggaatgtgcggttctctgatgaagggggattcacatgtttcttccgcgaccatagttaccaggaggaggccgctatggagcttaaagtggaagaccctttctattgggtgtcccctggcgttctggtcctgctggctgtgctgcccgttttgctcctacagataaccgttggcctaatcttcctttgtctccagtacagactgcgtgggaaactgcgggctgaaatagagaatctgcatagaacatttggtcagtttcttgaggagctgcggaaccccttctag

SEQ ID NO: 231311 - DNA, 744 bp, Artificial Sequence
  Description of Artificial Sequence: Synthetic coding sequence
atggcatccctgtcgcgaccctctctgccctcctgcctgtgttcctttctcctcttactgcttcttcaagtatcttcaagctacgctgggcagtttagggtaattgggccaaggcaccccatccgggcactcgtgggagacgaagtcgaactaccgtgtaggatcagtccaggcaagaacgccaccgggatggaggtggggtggtaccgaccccctttttcacgggttgttcacttatatagaaatggaaaagaccaagacggcgaccaggcaccagaatataggggcagaacagagctgctgaaggacgcaataggggaggggaaagtaactctgaggatccgaaacgtccggttttctgacgagggcggattcacttgctttttccgggaccattcatatcaggaagaggccgctatggagctgaaagtggaagatccgttctattgggtaagccccggagtgcttgtgctgttggctgtgctgccagttctgctccttcagattactgtgggcttggtattcctgtgcttacagtaccgcctgcgaggaaagcttcgggcagaaatcgagaatttacaccgcaccttcgaccctcacttcctcagagtgccttgctggaagattaccctcttcgttatcgttccagttttagggcctctggtggctttaattatatgctacaattggcttcatagaagactggcaggccagtttcttgaggagttaaggaaccctttctag

SEQ ID NO: 231312 - DNA, 396 bp, Artificial Sequence
  Description of Artificial Sequence: Synthetic coding sequence
atggcaagcttatcacggccaagtctcccatcctgtttgtgttcctttctccttcttctcctgctgcaggtgtcaagtagttacgctgacccattctactgggtgagtcccggtgtgttggtcctgctggcagtcctcccggtgctcttgctgcaaatcacagttggcctggtgtttctgtgcctacagtataggttgcgtgggaaactgcgagcggagatagagaatttgcaccgcactttcgaccctcactttctgcgtgttccatgttggaaaatcacactgttcgtaattgtgcctgtgctgggccctctagtcgcgctgatcatatgctataattggttacataggaggctggcgggacagttccttgaagagttaaggaacccattttag

SEQ ID NO: 231313 - DNA, 642 bp, Artificial Sequence
  Description of Artificial Sequence: Synthetic coding sequence
atggcctctttatctagaccctctctgccctcttgcctgtgttcttttctcctcctgctcctgctgcaggtgtcctcgagttacgccggtcaattcagagtcatcggccctcggcacccgatacgcgctttagtcggcgacgaggtggagctgccctgcagaatctcccctggcaaaaacgccacgggcatggaagtcggctggtaccgccctcccttctccagggtagtccatctgtacagaaatggaaaagaccaagacggtgaccaggctccggagtacaggggaaggacagagcttcttaaggacgccatcggcgagggcaaggtgactctgcgcatccgaaacgtccgattttcagatgagggtggattcacctgcttcttccgtgaccactcttaccaggaagaagccgcaatggaactgaaggtggaagaccccttctattgggtaagccctggtgtgcttgtgctgctggcggttctcccagtgctgcttttacagattactgtgggcctggttttcctgtgcctgcagtaccgcctgcgcggaaaacttcgcgcagagattgagaacctccaccgtacgtttggtcagtttcttgaagagctgctgtttcatctcgaagcgctgagcggctag

SEQ ID NO: 231314 - DNA, 615 bp, Artificial Sequence
  Description of Artificial Sequence: Synthetic coding sequence
tccctgagtcgaccatctctccccagctgcctttgcagtttcttgctgctgctgctgctgcaggtctcctccagttatgctgggcagtttagggtgatagggcctaggcatccaatccgggctctggtaggggatgaggttgaactgccttgccgcatctcgcctggtaaaaatgccaccgggatggaggttggctggtaccgcccaccttttagccgggtggtgcacttgtataggaacggtaaagaccaggatggggatcaggctcctgaatacagagggaggacggagctcctaaaagatgccataggcgaggggaaagttacccttcggatacgaaacgttaggttttcagatgaaggcggttttacctgcttctttagagatcattcttatcaggaagaggctgccatggagctaaaagtcgaagatcctttctactgggtgagccccggagtgctagttctcctggccgtgctgcccgtgttactgctgcagataaccctcgggttggtgttcctgtgcttgcaataccgcctgagagggaagctgagagcggaaattgaaaatctgcataggacctttgtttttcacctcgaggctctgtcggggtag

SEQ ID NO: 231315 - DNA, 675 bp, Artificial Sequence
  Description of Artificial Sequence: Synthetic coding sequence
atggctagcctaagcaggcccagtctgcctagttgcttatgctcatttcttcttttactgttgctccaggtgtcgagctcctatgctggacagttcagggtcatcgggcctaggcacccaattagggccctggttggcgacgaagtggaactaccctgccggattagtccgggaaagaacgctactggcatggaggttggatggtaccgaccgccattctcaagagtcgtacacctgtaccgcaatggaaaagaccaagacggtgatcaggcccctgagtacagaggcagaacagagctgttgaaggacgcgatcggagaaggtaaggtcacactcaggataagaaatgtccgcttcagtgacgagggcggattcacatgcttcttccgggaccactcatatcaagaagaggccgcaatggaactgaaggtggaagatccattttactgggtaagccccggagtcctcgtgctgttggccgtactgcccgtgctgctgctgcaaatcacagtgggcctcgtatttctatgcctccaatacagattgcggggaaagctcagagcagagatagagaacctccaccggacgttcgaaagcttcggagtccttggaccacaggtgaaggaacccaagaaaactggccagtttcttgaagaactgcgcaatccattctag

SEQ ID NO: 231316 - DNA, 690 bp, Artificial Sequence
  Description of Artificial Sequence: Synthetic coding sequence
atggcgtccctctcccggccttcccttccaagttgtctctgtagcttcctgctgctgctgctgctgcaggtaagcagcagttacgctgggcagttcagggtaatcgggccaaggcatccaatccgagctcttgtgggagatgaagtggaactaccatgtcgtattagtccgggaaaaaatgctacagggatggaagtggggtggtataggccccctttttcacgagtcgttcacctgtataggaacgggaaagatcaggatggagaccaggctcccgagtacagaggcaggacggaactgctaaaggatgccatcggagaaggaaaagtcaccctacgcatccgcaatgtgcggtttagtgatgaagggggtttcacttgcttcttccgtgatcatagttaccaggaggaagctgctatggaattgaaagttgaggaccccttctactgggtgagccccggagtgctggtccttctggccgtactccccgtgctgcttctgcagataactgtcgggttagtgtttctgtgtcttcagtacaggcttcgcggaaaacttagagccgagatcgagaacctgcaccgcactttcgagagtttcggcgtcctgggtccacaagtgaaggagccaaagaaaactgggcaatttttggaggagctcctctttcacctggaggccttaagcgggtag

SEQ ID NO: 231317 - DNA, 888 bp, Artificial Sequence
  Description of Artificial Sequence: Synthetic coding sequence
atggccagtctcagtagaccctcgttaccatcatgtttatgtagtttcctcctcctcctgctgcttcaggtgagctcttcttatgccggtcagtttagagtaatcggccctaggcatccaatacgggctttggtcggagacgaggtggagctgccatgtcggatctcccccggtaaaaatgcaacaggtatggaagtggggtggtaccggcctcccttttcgagggtggtgcacctgtaccggaacggaaaagaccaggatggcgatcaagcccctgaatatcggggaaggaccgaactgctgaaagatgctattggggagggcaaagtgaccttgaggatcaggaatgtgaggttctccgacgaaggaggattcacctgtttctttcgcgaccattcatatcaggaggaggcagcaatggaactgaaggtggaagatcctttctattgggttagtcccggagtgctggtgcttctcgcagttctgcctgtgttactcctgcaaattaccgtgggcttggtgtttctctgcctgcaatataggctccgtggcaaactgcgggcagaaatcgagaacctgcatcggaccttcgaccctcacttcctcagagtgccttgttggaagattaccctattcgtgatcgtgccggtattaggcccactcgttgctcttataatctgttataattggttgcacaggagacttgccggtcagtttctcgaggagctgaggaagttttcctccctctgttacaaacagaggataaagtcacaagagcgtgagaccgaggccactcgaggcaggggtggcttactccgcgaccacatccccaggggcaaagaggagctggagagcctgggcggaggcaagactccccctggccgttag

SEQ ID NO: 231318 - DNA, 540 bp, Artificial Sequence
  Description of Artificial Sequence: Synthetic coding sequence
tgacagttcagggtgataggtcctaggcatcctatcagggccttagtaggagatgaggtggagttaccctgtagaatttcccccggaaagaacgccaccggtatggaagtgggatggtatagaccccctttctctcgagttgtgcatttgtaccgtaatggtaaagaccaggatggcgaccaagctcctgaataccgagggaggaccgagcttctgaaagatgccatcggagagggcaaggtcactctacgcatcagaaatgtccgctttagcgacgaaggcggattcacatgcttttttcgagatcacagctaccaggaggaggctgccatggaattaaaagtggaggaccctttttactgggtgtcaccgggtgtgcttgttttgctcgccgtgttacccgttctgctcctgcagatcactgtgggcctcgtatttttgtgcctccagtaccggctcagggggaagcttagagccgagatcgaaaatctgcataggacctttggacagttcctggaggagctgagaaaccctttctag

SEQ ID NO: 231319 - DNA, 642 bp, Artificial Sequence
  Description of Artificial Sequence: Synthetic coding sequence
atggctagcctcagccggcctagcctcccctcttgtctctgcagctttttgctgctgttactgctgcaggtcagctctagctacgcaggccagtttcgggttattggcccacgacaccccattagagccctcgtcggcgatgaggtggagctgccctgtagaattagtccaggaaagaatgccactgggatggaggtgggatggtacagaccccctttttccagagtagtccacctatataggaatggaaaggaccaggacggagaccaggccccagagtaccggggacggacagaactactgaaggacgcaatcggagagggaaaggtcacactccggatccgtaatgtccgcttctcggacgaaggtggattcacatgcttcttccgagaccattcttaccaggaagaggccgcaatggaactaaaagttgaggatccgttttactgggtgagtcccggtgtcctggtgttacttgccgtgctgcccgtgttactgctgcagattacagtcgggctggtgtttctgtgtctgcagtaccgactgcggggaaaactcagggccgagattgagaatcttcatagaacatttggccagttcctcgaggaacttctgttccaccttgaggctttgtccggctag

SEQ ID NO: 231320 - DNA, 759 bp, Artificial Sequence
  Description of Artificial Sequence: Synthetic coding sequence
atggcaagcctctcccggccttcattgccgtcttgtttgtgcagtttcctgctcctactgttgcttcaggtatcatcaagctatgcaggacagttccgcgtcatcgggcctaggcatccaatcagagctctggtcggggatgaggtcgaattaccatgtaggatcagccctggtaaaaacgccactggcatggaagtaggctggtaccgccctccgttcagcagggtggtgcatctataccgcaacggaaaagaccaggatggggatcaggctcctgaatatcggggtcggaccgagctgttgaaggacgccattggagaggggaaggtcaccctgaggattcgcaatgtacgtttctctgacgagggcggattcacctgcttctttagggatcattcatatcaggaggaggccgcaatggagctcaaagtggaggaccctttttattgggtctcacccggtgtactggtacttttggccgttttgccagtgctgcttctgcagatcaccgtcggcctggttttcctttgtctgcaataccgtctgcgtggcaagctccgggcagaaatcgagaacctccataggacattcgacccccacttcctcagagtgccgtgctggaaaatcaccctgtttgttattgttcccgtcttgggtcccctcgtggccttgattatttgctataactggctccaccgcaggctagccggacagttcctggaggagcttctgtttcacttagaggccttgtccgggtag

SEQ ID NO: 231321 - DNA, 642 bp, Artificial Sequence
  Description of Artificial Sequence: Synthetic coding sequence
atggcgtctctgtctaggccgtcccttccaagttgtctttgtagcttcctgcttttgctgctactgcaggtctcctcctcttacgccggacagttccgagttattgggcctcgccaccctattcgggcattggttggtgacgaggttgaactgccctgtcggatatccccaggaaaaaatgctacaggaatggaggtgggctggtatcgccctccgttttctcgtgtggtgcacctttatagaaacggtaaggaccaggacggggatcaggcacctgagtaccgcggaaggactgaactgctgaaagacgcgattggcgagggaaaagtgactctacgtattcgaaatgtcaggttttccgatgaggggggattcacatgcttttttagagaccatagctaccaggaggaagcggctatggaactgaaagtggaagatcctttttattgggtgagcccgggagttctcgtattgcttgcggtccttcctgttctgttgctgcagatcactgtaggattggtgtttctgtgcttacagtacaggctgcgcggaaagctgagggccgaaatcgagaatttacacaggacatttggtcagtttctggaggaactcttgtttcacctggaagccctgtccggttag

SEQ ID NO: 231322 - DNA, 675 bp, Artificial Sequence
  Description of Artificial Sequence: Synthetic coding sequence
atggctagcttatccaggccttctttgccatcttgcctttgttctttcctccttctgctccttctgcaagtgtcatcgagttatgctggacaattccgtgtgataggaccacgccaccccattcgcgcacttgtgggggacgaagttgagctgccctgcagaatatcaccgggaaagaacgccacagggatggaagtaggatggtatagacccccttttagcagagtcgtacatctctaccgtaatggcaaagatcaggatggtgaccaggctcccgagtaccgcggacgcaccgaactgctgaaagatgccattggagaaggcaaggttaccctgaggatccgtaatgttcgattctccgacgagggtgggttcacttgttttttcagagatcatagctatcaggaggaagcagccatggagttgaaggtggaggacccgttctactgggtgtcccctggggttctggtcctactggcagtcttgcccgtgctactgctgcagatcactgtcgggctggtctttctctgtctgcagtacaggttgcgaggaaagctgcgggcagagatcgaaaaccttcacaggacgttcgaatcttttggagtactaggaccgcaggtcaaggaacctaaaaagactggacaattcttagaggagctgagaaatccgttttag

SEQ ID NO: 231323 - DNA, 615 bp, Artificial Sequence
  Description of Artificial Sequence: Synthetic coding sequence
agccttagccggcctagcttaccttcctgtctatgctcctttctcctgcttctcctgctgcaggtctcatcatcatacgccggacaattcagagtgatcggtccccgacatccgatcagagccttggtgggtgacgaggttgagttgccttgcagaatttctccaggcaagaatgctacgggcatggaagtcggatggtaccgccctcctttttcacgagtggtccacttgtatagaaatgggaaagaccaggacggcgaccaagcgccagagtataggggacgcactgagttactgaaggatgccatcggagagggaaaagtcactctgagaattaggaatgtgaggttcagcgacgagggcggtttcacgtgtttttttagagatcacagttatcaagaagaagccgcaatggagctcaaagtggaagatccattctactgggtttcgccaggggtgcttgttcttttagccgtgcttcccgtgctgctgctacagatcacggtgggactggtgtttctgtgtttacagtatagattgcggggaaagctgagagcagaaattgagaacttgcatcgcacctttgtcttccaccttgaagcactgtcagggtag

SEQ ID NO: 231324 - DNA, 675 bp, Artificial Sequence
  Description of Artificial Sequence: Synthetic coding sequence
atggcgagcctatctagaccttcattaccctcgtgtctctgtagcttcctgctccttctgttgttgcaagtaagcagttcctatgccggtcagttcagggtgatcgggcctcgtcaccccataagagcacttgtgggagatgaagtggaactgccatgccgcatcagccctggaaaaaatgcaaccggtatggaagtcgggtggtatcgccctccgttctcccgagtggtccatctgtacagaaatggcaaagatcaggacggcgaccaggcccctgagtatcgcggacgaaccgagcttctgaaagacgctattggcgaggggaaggtgactctgaggatcagaaatgtgcgctttagtgatgagggcggatttacatgctttttccgtgaccattcctatcaagaggaagccgctatggagctaaaagttgaagacccattctactgggtttccccgggagtccttgtccttctcgcagtgttacctgtgctactgcttcagatcacggtcggcctggtgttcctctgcctgcagtaccgcttgcggggtaaactgcgcgctgaaatcgaaaacctgcaccgcacctttgagtcctttggggttctcggaccgcaggttaaagagcctaaaaaaactgggcagttccttgaagagctgcgcaatccgttttag

SEQ ID NO: 231325 - DNA, 759 bp, Artificial Sequence
  Description of Artificial Sequence: Synthetic coding sequence
atggcatccctgagccgccctagcctgccaagttgcctgtgctcattcctcctcctgttactactgcaggtttctagcagttacgctggccagttccgagttataggtcccagacacccaatccgagcactggtgggcgatgaagtagaacttccatgtcggatctcgccgggaaagaacgctactggtatggaggtcggctggtatcgccctcccttttcccgcgtcgtgcacctttatagaaacgggaaggaccaggatggcgatcaagcaccggaataccgagggcgaacagaactgctgaaagacgctatcggggagggcaaagttacgttgaggatccggaacgtgcgcttttcagacgagggcggattcacatgttttttcagggaccattcatatcaggaggaggccgcaatggagctcaaagtggaagatccgttttattgggtgtctccgggtgtcctggtactcttggcagtgctcccagttctcctgctgcagattacggttgggctggtatttctctgcctgcagtacagactgcggggtaaattgcgtgccgaaatcgaaaacctgcaccggactttcgacccacacttcctccgcgttccctgctggaagataactctgtttgttatcgtgcccgttttgggacctctggttgcactgatcatatgttataactggctgcatagacgcttagctggccagttcctagaggagctactgttccaccttgaggctctgtccggctag

SEQ ID NO: 231326 - DNA, 744 bp, Artificial Sequence
  Description of Artificial Sequence: Synthetic coding sequence
atggcgagcctctcccgtccaagtctgccttcctgtctttgtagctttctccttttgttgctgctacaagtttcatcctcctatgccggtcagttcagagtcatcggcccaaggcaccctatcagggcacttgtgggcgatgaagtggaactcccatgcaggattagccccggtaagaatgccaccggcatggaggtgggttggtatagaccccctttttctcgcgtggtgcatttgtataggaatggcaaggatcaggacggcgaccaggctcccgagtatcgcggtagaacagagttactcaaggacgccatcggtgaaggtaaggtgacgctccgtattcgcaatgtccgctttagcgatgagggaggttttacttgcttcttccgtgatcattcttaccaggaagaggcagctatggagttgaaagtcgaagatcccttctactgggtgtcacccggtgtgttagtgttactcgccgtattaccggtcctcctgctccagatcactgtgggcctggtttttttgtgtttgcaatataggctgaggggtaaactgagagcagagatcgaaaacctgcaccgcaccttcgacccccactttctgcgggtcccttgctggaagataactttatttgtgatcgtgcctgttttgggcccactggtcgccttaattatttgttacaattggctgcatcgtcggctggcagggcagtttcttgaggaactgcggaatccgttctag

SEQ ID NO: 231327 - DNA, 615 bp, Artificial Sequence
  Description of Artificial Sequence: Synthetic coding sequence
tcgctgtcacgacccagcctcccctcctgcctgtgcagctttctccttctgctgctgttgcaggtgagcagttcctatgccggacagtttcgagtgatcggtcccaggcatcccattcgcgctctggtcggggatgaagttgagctgccctgtcgaatttcccccggtaaaaacgcaactggcatggaagtaggatggtatcgcccacccttcagtcgcgtcgttcacctgtatagaaacggtaaagatcaggacggcgatcaagcccctgagtacagagggagaaccgagctgcttaaagatgcaatcggtgagggcaaggtgacactacgcattcgcaacgtgcgcttttccgatgaagggggtttcacctgtttcttccgcgaccattcttaccaagaggaggctgcaatggaattaaaggtggaagatcccttttattgggtatctcccggagttctcgtgctgttagccgttctacctgtcctgttgcttcagatcacggtaggcctggttttcttatgtttacagtaccgcctccgaggtaaactcagggccgagatagagaacctgcaccgcacatttgtgttccacctcgaagcactgtcaggctag

SEQ ID NO: 231328 - DNA, 888 bp, Artificial Sequence
  Description of Artificial Sequence: Synthetic coding sequence
atggcaagcctgagtaggcctagtctcccgagttgcctgtgcagctttctcttgctcttgctgctgcaggtatcctcaagctacgctggccagttccgagttattggccctcgtcacccaattcgcgctctggtaggcgatgaagtggaactgccatgtaggatttcacctggcaagaatgctaccggcatggaggtgggctggtacaggcccccttttagtcgcgtggtgcatctgtacagaaatgggaaggaccaagacggcgatcaggctccggagtacaggggcaggactgaactgttgaaggacgcaattggggaggggaaagtcacgctgagaattcgtaatgtccgattttctgacgaaggcggattcacctgcttcttcagggatcactcctaccaggaggaggccgctatggaattgaaggttgaggatcctttttattgggtatcaccaggtgttctagtgctcctggcggtactgcccgtgcttctgctgcaaataaccgttggcctcgtctttctctgcctgcaatacagactccgcggaaaactgcgggcagagatcgaaaacttgcaccgtacttttgatccccacttcctcagagtgccctgttggaagattaccttgttcgtgatcgtcccggtgcttggaccactggtagccttaatcatctgctataactggctgcaccgtcgcctcgccggacaattcctcgaggagctgcgcaaattctcatctctctgctacaaacagaggatcaaatcgcaagaacgggaaacagaagccactcgaggcagaggtggactgcttcgggaccacattcccagaggaaaagaggagcttgagtctctgggaggaggcaaaacgcccccaggccgatag

SEQ ID NO: 231329 - DNA, 759 bp, Artificial Sequence
  Description of Artificial Sequence: Synthetic coding sequence
atggccagcctctcccggcctagcttaccatcatgcctgtgctcattccttctacttctcctgcttcaagtctcatcttcatatgccggacagttccgtgtcattggcccaaggcatccgataagggcactcgtgggagacgaagtggaactgccatgtcgcatatcgccaggcaaaaacgctacgggcatggaagtgggctggtacagaccacccttctctcgcgttgtgcacttgtacagaaatggtaaggaccaggatggggaccaggcaccagagtaccgcggacgtacagagctacttaaggacgctatcggcgaagggaaggtaacactcaggatcaggaacgtacgattttccgatgaagggggattcacatgtttttttagggatcactcctaccaggaagaggccgcaatggagctgaaagtcgaggaccccttctattgggtgagcccaggagtcctcgtgttattggctgtgctcccggtgctgctgctgcagattaccctgggactcgtctttctctgcttacagtatcggctacggggtaagctgcgcgctgaaattgagaatctccatcgcacctttgatccccacttcttacgggtcccctgctggaaaatcacattgtttgtgatcgtgcccgtgctggggccacttgttgcgctgattatctgttacaactggctgcataggcggctggccggacagtttttggaggaacttttgttccacctggaggcactgtctggttag

SEQ ID NO: 231330 - DNA, 540 bp, Artificial Sequence
  Description of Artificial Sequence: Synthetic coding sequence
taacaatttagggtgatcgggcctaggcatcccatccgcgcactggtcggagacgaagtcgaacttccgtgtcggatatcaccaggcaaaaacgcaaccggaatggaggtgggttggtatcggcctcctttctcccgcgtggtccacctgtaccgcaatgggaaggaccaggatggcgatcaggcgccagaataccgaggaaggaccgagctcctgaaagatgcgattggggaaggaaaggtcaccctcaggatccgtaacgtcaggtttagcgacgaaggaggctttacctgcttttttcgggaccatagttatcaagaggaggctgccatggaactgaaagttgaagaccctttttactgggtttcgcccggtgttttggttctactagctgtgcttcctgtgttgctgttgcagattacggttggtctggtcttcttgtgcctgcaatatcggttaagaggaaagctgcgggcagagatcgaaaatctgcaccggacattcggccagttcctggaggaactccggaatcctttttag

SEQ ID NO: 231331 - DNA, 396 bp, Artificial Sequence
  Description of Artificial Sequence: Synthetic coding sequence
atggcttctcttagtcgccctagcttgccaagctgtctctgttcttttctgctccttctgttactccaagtgtcgtcatcctatgccgatcccttctactgggtaagcccaggagtactagtgctcttggccgttctgccagttctactgctccagatcactgtgggattggtctttttgtgccttcagtataggctaagggggaagctgcgcgctgaaatcgagaaccttcacagaacatttgacccccatttcctgcgcgtaccttgttggaaaatcaccctgtttgttatcgtgcctgtgctagggcctctggtcgccctgattatatgctacaactggcttcatcgtcggctggctggacagttcctcgaagaactaagaaaccccttttag

SEQ ID NO: 231332 - DNA, 744 bp, Artificial Sequence
  Description of Artificial Sequence: Synthetic coding sequence
atggcctcactctcacgaccgagcttgcctagctgcttgtgctccttcctcctcctccttttgttgcaagtgtcttcttcttacgctggacagtttagagtcatcggtcccagacaccccatacgggctctcgtgggggatgaggtcgagctcccctgtcgtataagcccaggaaagaacgctacgggcatggaggtcggctggtatcggccacccttctctagagtggtgcacttatacagaaacgggaaggaccaggatggggaccaagcgccagagtaccggggtcgcaccgagttgcttaaagacgccatcggtgaagggaaggtgactcttcggatacgcaatgtgcgattctcggatgagggagggttcacttgctttttcagggatcatagctatcaggaggaggcggctatggagttgaaagtcgaggatcccttttactgggtgtctcccggagttttggtcctgcttgccgtcctgccagtgctgttgttgcagataacccttggcctcgtgtttctttgcctccagtacagacttcggggtaaactgagagccgagatagaaaatctgcatcgcacattcgacccacattttctgcgcgtgccttgttggaagattacactgttcgtgatagtccctgttctgggcccacttgtggcactgataatctgttacaattggctgcatcggagactggcaggccagttcctcgaagaactacggaatcccttttag

SEQ ID NO: 231333 - DNA, 642 bp, Artificial Sequence
  Description of Artificial Sequence: Synthetic coding sequence
atggcctccttgagcagaccttccctgcccagctgcctgtgcagcttcctcctcttgttactactgcaagtttcatcctcttatgccggtcaatttagagtcatcggcccacggcatcctatccgggctttggtcggcgatgaagtggagctcccctgccgcatctcccctggaaaaaacgcaactggcatggaggtgggatggtaccgacctcctttcagtagggtggtgcacttgtaccgtaatggtaaagaccaggacggggatcaggcccctgagtatcgcggacggacagagctgctgaaagacgccattggagagggtaaggtgaccttgaggatccgaaacgttaggttctccgatgaggggggttttacttgcttcttcagggatcatagttaccaagaagaagcggctatggaactgaaggttgaggacccattctattgggtctctcctggcgtgttggtcctgctggcggttcttcctgtgctcctcttgcaaatcactctggggctcgtcttcctctgcctgcaatatagactccggggaaagctgcgggctgagattgagaacctccaccggaccttcggccagtttctggaagagctgctctttcaccttgaggccttgtccggctag

SEQ ID NO: 231334 - DNA, 615 bp, Artificial Sequence
  Description of Artificial Sequence: Synthetic coding sequence
agtctttccaggccctctcttccgagctgtctctgcagcttcttgttactgttgttactccaagtgtccagttcgtacgctgggcagtttcgggtgattgggccacgccatcctattcgagctcttgtcggggacgaagtggaattgccttgcagaattagccccggtaagaacgcaactggcatggaagtgggctggtaccggcctcctttcagccgagttgtccatttgtaccgtaacggaaaggaccaggacggggaccaggctcctgagtaccgaggccgtacagagctgctgaaagacgccatcggcgaggggaaagtcaccctccggattcgcaacgtgcgctttagcgacgagggcggtttcacctgttttttccgggaccactcctaccaagaggaggcagcaatggagctaaaggtggaggatccattttactgggtttcgccaggtgtgcttgtcttactcgcggttctccctgtgctgctgctccagattaccgtgggcctggtgtttctctgccttcagtatcggctgagaggcaagctgcgcgcagagatcgaaaacttgcatcgcacatttgttttccatctggaagccttaagcggctag

SEQ ID NO: 231335 - DNA, 690 bp, Artificial Sequence
  Description of Artificial Sequence: Synthetic coding sequence
atggcctccctgagtagacccagcctcccatcttgtctgtgcagctttctgctgctgctcctcctgcaggtgtcctcctcttacgctggccaatttcgggttatcggcccaagacaccctatcagagctctggtgggagacgaggttgaactgccgtgtaggatctcacccggaaaaaacgctacagggatggaggtgggatggtacagacctccttttagtcgtgtggtccacctctacaggaatgggaaagaccaggacggagaccaggcccctgagtacagagggcgtaccgagttgctgaaggatgccatcggggaaggtaaggtgaccttacggatacggaatgtcaggttttcagatgaagggggtttcacctgcttcttcagggaccatagttaccaagaggaggctgcaatggagctgaaggttgaggatcctttttattgggtgtccccaggtgtattggtgctgctcgccgttctgcccgtgctcttgctgcagatcacggtcggtctcgtctttctgtgccttcagtacaggctgagagggaagctgcgcgcagaaatcgaaaacctccatagaaccttcgaatccttcggtgtgctaggccctcaggtcaaggaaccgaaaaagactggacagttcttggaggagctcctgttccacctagaggccctgtctgggtag

SEQ ID NO: 231336 - DNA, 615 bp, Artificial Sequence
  Description of Artificial Sequence: Synthetic coding sequence
tccctatctaggccctccttgccctcatgtctttgttcctttctattgttactcctcttacaggtgtcctcttcctacgccggtcagtttcgcgttattggacccagacacccaattagagcgcttgtgggtgacgaagtcgagctgccctgtagaatctctcccggtaagaacgcaacgggaatggaggtcggttggtacagaccacccttcagtagggtggtgcatctttacaggaatggcaaggatcaggatggcgatcaggcacccgagtataggggccgtactgagctgttgaaggatgccattggggaggggaaggttactctgcgcatccggaacgttagattttcagacgaaggcggatttacttgcttctttcgggaccactcttaccaggaggaggccgctatggagctgaaagtggaagaccctttctactgggtatcgcctggcgttctcgtgctgctggcagttctgcctgtgctgctgcttcagatcaccgttgggttagtgtttctttgccttcagtaccgtcttagaggcaagcttcgcgcagagatagaaaacctgcacagaacatttgttttccacctggaggctttgtctgggtag

SEQ ID NO: 231337 - DNA, 690 bp, Artificial Sequence
  Description of Artificial Sequence: Synthetic coding sequence
atggcatcactgtctaggccttcgcttccttcttgtctctgtagttttttgcttcttttgctgttgcaggtgtccagcagctatgccggtcagttcagagtgataggtcctagacaccccatcagagccctggtgggagacgaggtggagctcccatgccggatttcccctgggaagaatgccaccggtatggaggtgggctggtacagaccccctttttcaagagttgtgcacctttaccggaatggaaaggatcaggatggtgaccaggctcccgaatataggggaaggacggagttactgaaggatgctattggggaggggaaggtaactttacgcattcggaacgtgagattcagcgatgaagggggattcacgtgcttcttcagagaccattcatatcaagaggaggctgctatggagctgaaggtcgaggatccgttctattgggtctcaccaggagtcttagtcctcctggcagtgctgccagtcctcctgctgcaaataacgctcgggctggtctttctttgtctccagtaccggttgcgtggaaaactgagagcggagatcgagaacctacacagaacctttgagagctttggagtcctgggccctcaagtgaaagaacccaaaaagactgggcagttccttgaggagctactgtttcacctggaggccctgtctggatag

SEQ ID NO: 231338 - DNA, 690 bp, Artificial Sequence
  Description of Artificial Sequence: Synthetic coding sequence
atggcaagtttatcaaggccctccctgccttcctgcctgtgttcctttctccttttgctgctgctacaggtaagctcgtcgtacgccggtcagtttagagtcatcgggccacggcatccaatcagggcattggttggcgacgaggtggagctgccctgtcggatttcaccaggcaaaaacgccaccggcatggaagtcggatggtaccggcctcctttttctagggtggtccatctctatagaaatggcaaggaccaggatggcgatcaggccccagagtatagggggcgtacagaactgctgaaggatgccatcggagagggtaaagtgacactgcggattcggaatgttaggttttccgacgaagggggattcacttgcttctttcgggaccatagctatcaggaagaagctgcaatggagttgaaggtagaggaccctttttattgggttagccccggagtactcgtcctcttggccgttctgccagtccttttgctccagattactgttggcctgatattcttatgtctccaatacagattaagaggtaaactaagggccgaaattgaaaacctgcacagaacgtttgagtcattcggtgtgctcggtccccaggtaaaggaaccaaaaaaaacggggcaattcttggaagagctgctgtttcatctggaagcattgtccggttag

SEQ ID NO: 231339 - DNA, 516 bp, Artificial Sequence
  Description of Artificial Sequence: Synthetic coding sequence
atggcctctctttcccgcccttcattaccatcctgcctgtgcagctttctgctgcttttgctcctgcaggttagtagtagctatgccggacagtttagagtcatcggaccacgccaccctatacgagccctggtgggcgatgaagttgaacttccttgtcgcatcagcccaggcaaaaacgccacggggatggaggttggctggtaccgccctccctttagtagggtggtgcatctgtatagaaatggcaaggaccaagacggagaccaagcgcctgaatatagaggacgcaccgaactcctgaaagatgccattggggaggggaaagtgactctgaggattaggaacgtccgtttctctgatgaggggggatttacctgtttttttagagaccactcttaccaggaggaggccgctatggagttgaaggtagaggtgagccattccgtcactcaagattggcttcagtggcacgatcatggctccctacagccacccccacccagactgaaatag

SEQ ID NO: 231340 - DNA, 534 bp, Artificial Sequence
  Description of Artificial Sequence: Synthetic coding sequence
atgtcacacatcagttgggaggaacgttaccggaacggcaaggatcaggatggcgaccaggcaccagagtataggggacgtaccgagctgctcaaggatgccattggtgagggtaaagtcacgcttcgtattaggaatgtaaggttctcagatgaggggggatttacttgcttttttagagaccactcctaccaggaggaagccgcaatggagcttaaagtggaggatccattttactgggttagtcccggtgtgctagtgttgcttgccgttttgccagtgctgcttctgcaaataactgttggtctggtcttcctttgcttgcagtataggcttcggggaaagctccgagcagaaatcgaaaatctgcacagaacttttgaccctcattttctcagagtgccctgctggaagattacactatttgttattgtgccggttctaggccctttagtggcgttgatcatttgttataactggttacacaggcggctggcaggtcaattcctggaagagttgcgaaatccattttag

SEQ ID NO: 231341 - DNA, 174 bp, Artificial Sequence
  Description of Artificial Sequence: Synthetic coding sequence
atggcttctttgagcagaccgtctctgccctcctgtttatgttcctttctactgctgctgctgttgcaggtctccagctcttacgccggtctggtggctgtggctcgctcttggctgatagccgcatctacctctcaggcacaagttatcctgttgacccaaccactagaatag

SEQ ID NO: 231342 - DNA, 627 bp, Artificial Sequence
  Description of Artificial Sequence: Synthetic coding sequence
atggcctcgctctcccggccatccctccctagctgtctgtgcagcttcctgctgttgctcttgctccaggtatcttcttcttatgccggacagttcagggtgatcggaccaaggcaccctatccgggctctggtgggtgatgaagtggaattgccttgtcgcatatcacccggaaaaaatgcaaccggtatggaagtcggatggtaccggccaccgttctcccgcgtggtgcacctgtacaggaacggcaaggatcaggatggtgaccaggcccctgaatacagaggccgtacagaactgctgaaggatgccatcggagaagggaaggtcacactgcggatacgcaatgtgcggttctctgacgagggcggtttcacttgctttttcagagaccacagttaccaagaggaggcggcaatggaactcaaagtggaggatcccttttattgggtatctcccggagtgctcgtactgctagcggtactgcctgtccttctcctccagatcaccgtcggactggtgttcctgtgccttcagtataggttacgaggtaaactgagggccgagatcgaaaacctgcaccggacctttggccagttcctagaagagttacgcaatcccttctag

SEQ ID NO: 231343 - DNA, 516 bp, Artificial Sequence
  Description of Artificial Sequence: Synthetic coding sequence
atggccagcctcagccggcctagcctgccctcttgcctgtgctcttttctgttgttgctactgctccaagtttcttctagttatgccggacagttccgcgtcataggccctcggcatccaatccgggcactggtgggggatgaagtcgagctgccctgcagaataagccccggtaaaaacgcaactgggatggaggtcggctggtaccgccctcccttcagtcgcgtcgtacacttgtacaggaacggtaaggaccaggatggcgatcaggccccagagtataggggcaggaccgagctcctcaaagatgctatcggcgaaggcaaggtgacgcttaggatccggaacgttcgattctccgacgaaggtggctttacatgctttttccgggaccactcatatcaggaagaagcggctatggaactgaaagtggaagtctctcatagtgtgacccaagactggcttcaatggcatgatcatggcagcctccagcctcccccaccaaggttgaagtag

SEQ ID NO: 231344 - DNA, 516 bp, Artificial Sequence
  Description of Artificial Sequence: Synthetic coding sequence
atggctagtttatcaagaccttctctgccttcttgcttatgtagcttccttctcctgcttttactacaagtttcaagttcctacgctggtcagttccgtgtgataggccctaggcaccctatccgggcactagtcggcgacgaggtcgagttgccttgtcggatttcccctgggaagaatgctactgggatggaagtgggctggtatcgcccacctttttctcgcgtggtgcacctctaccgcaatggcaaggatcaggatggtgatcaggcgccagaatatcggggacgaacggagctgctcaaggacgctataggcgagggcaaggttacactgagaattcgtaatgtccggttctctgacgaagggggattcacctgcttttttagagaccactcttaccaagaagaggccgctatggaattgaaggtggaagtatcccactctgtgacacaagactggcttcagtggcatgatcatggctctctgcagccgcctccacccagactgaagtag

SEQ ID NO: 231345 - DNA, 621 bp, Artificial Sequence
  Description of Artificial Sequence: Synthetic coding sequence
atggcgtccttgagccggccttctctgccctcttgtctgtgctcttttctgctacttctgctgctacaagtgtcctcctcatatgcaggtcagttcagagtgataggtccaagacatcctattagagcccttgtgggtgatgaggtggagctcccttgcaggatatctccgggaaagaacgctacggggatggaagtgggctggtacagaccccctttcagccgcgtggtccacttgtatcgtaacgggaaggatcaggacggagatcaggcccctgagtataggggacgaaccgaactcttgaaggacgcgattggggagggaaaggtgactttgcgaataaggaatgtgaggttttctgacgaggggggattcacatgttttttccgtgaccattcatatcaggaagaagcagctatggaactaaaagtcgaagatcctttttattgggttagccccggagtcctagtcctattagccgtgctgcccgttttgctcctccaaattaccgttggattggtctttctttgtcttcagtacagactccgcggaaagctgagagctgaaattgagaacctgcaccggacctttgttttccacttggaggcactatcgggttag

SEQ ID NO: 231346 - DNA, 627 bp, Artificial Sequence
  Description of Artificial Sequence: Synthetic coding sequence
atggcctctctgagccgcccttctttgccgagttgtttgtgctcattcctgctgctccttctcctgcaggtttcatcctcatacgctggccaattcagagtcattggccctcgacatcccatccgggcactcgtcggcgatgaagtggaactgccctgtcggatctcaccaggcaagaatgctaccggcatggaggtcggctggtaccgaccacccttttcccgcgttgtacacctgtacagaaatggtaaagaccaggacggtgatcaagcccctgaatacagaggaagaacggagctcctgaaggatgccattggagagggtaaggtgactctccggatccggaatgttcgcttctccgacgaaggtggcttcacttgcttcttccgggaccacagctaccaggaagaggcagctatggagctgaaggtggaagatcccttttattgggtgagccctggggtgttagttttgctcgccgtgttgcctgtcctgcttctgcagattacagtcggcctggtgtttctgtgcttacagtaccggctccgcggtaagcttcgcgctgagattgaaaatcttcacagaacattcggacagtttcttgaggagctgcggaatcctttttag

SEQ ID NO: 231347 - DNA, 621 bp, Artificial Sequence
  Description of Artificial Sequence: Synthetic coding sequence
atggccagtctgtccaggccctctttaccatcttgcctgtgtagcttcctgttgcttctgttgcttcaagtgtcatcctcttacgctgggcaatttcgcgtgattgggcctcgccaccctatccgggcacttgttggagacgaagttgaactgccatgtcggataagcccaggcaaaaacgctacgggcatggaggttggctggtacagacctcctttctctcgagttgtccacctctatcggaatggcaaggaccaggatggagatcaggcccctgaatataggggccgaactgagctgttgaaggacgcgattggggagggaaaggtgaccctgaggatccgcaatgtgcgcttcagcgacgaggggggattcacctgtttcttcagggaccactcctatcaggaagaagccgcaatggagcttaaggtggaggatcctttctactgggtatcccctggcgtgctcgtgctgctcgccgttttacctgtccttctgctgcagattacagttggtctggttttcctatgtctacagtaccgactccgaggcaagctgcgcgctgaaattgaaaatcttcacagaacgtttgtgtttcaccttgaagccctgagcggctag

SEQ ID NO: 231348 - DNA, 534 bp, Artificial Sequence
  Description of Artificial Sequence: Synthetic coding sequence
atgtcacacatttcctgggaggaacggtaccggaacggcaaagaccaggacggggatcaggctcctgagtatagaggaagaacagaattgttgaaggacgcaattggggaaggcaaagtgacactgcggatcagaaacgtgagattctcagatgaaggcggattcacatgcttttttcgagatcattcataccaggaggaggccgctatggaattaaaggtggaagatcccttctattgggtgtcacctggggtgcttgtcctgttggccgtgctgccagtcctgctgctgcagataacggtgggtctggtgttcctgtgtctccagtacaggctgcgcggaaaactacgagccgagattgagaatttgcatagaaccttcgacccgcacttcctgcgggtgccttgctggaaaataactctgttcgtcatcgtgcctgtgttgggaccccttgtggcgcttatcatctgctacaattggctgcatagacgcctggccggacagttcctggaggagctgcggaatcccttctag

SEQ ID NO: 231349 - DNA, 621 bp, Artificial Sequence
  Description of Artificial Sequence: Synthetic coding sequence
atggcctcacttagcaggcctagcctcccttcctgcctgtgctcctttctgcttctgcttctcttacaggtgagctccagctatgccggtcagttccgagtgattggccctagacaccccatacgggcactggtcggcgatgaggttgagttgccgtgtaggattagtcctggaaagaacgcaactgggatggaggtgggctggtataggcccccattcagtcgagtggtgcacctgtatcgaaacggcaaggatcaggatggggaccaggcaccagagtaccggggaaggaccgaactgctgaaggacgccataggagaggggaaagtgaccctgcgaattcggaatgttcgcttcagtgatgaaggtggtttcacctgcttcttccgagaccattcttaccaggaggaggcagccatggagctcaaagtcgaggacccattttattgggtgtctccgggagtgctcgtgctcctggccgtgctgcctgtgctgctgctccagataactgttggcctggtgtttctgtgcctgcagtatcgcctgagggggaagctcagagccgagatagaaaatctgcaccggacctttgtgtttcacctagaagccctaagtgggtag

SEQ ID NO: 231350 - DNA, 621 bp, Artificial Sequence
  Description of Artificial Sequence: Synthetic coding sequence
atggcaagcctgagccgccctagtctcccatcatgtctatgcagcttcctcctcttgctgctgcttcaagtgtcgagttcatacgccggacagttcagggtaattggcccacgccaccccattagggctctcgtgggcgacgaggtggagttaccttgccgcatctctccgggtaagaacgccactggcatggaggtgggttggtaccgtcccccattctctcgtgtggtgcacctgtatagaaatggcaaggaccaggatggcgaccaggcccctgaatataggggacggaccgagcttttaaaggacgccataggcgaaggcaaagtaacactgcgaatccgcaatgttcgattctccgatgagggcggattcacatgcttctttagggaccactcgtatcaggaggaggccgcaatggaactcaaagtggaggatcctttctattgggtctctccgggtgtactggtgctcctggctgtgctgcctgtcctcctgctgcagattacagtgggactcgtgttcttatgtctccagtataggctgagggggaaacttcgagcagagatcgagaacctgcaccgtaccttcgtgttccacttggaggccctgtccggctag

SEQ ID NO: 231351 - DNA, 534 bp, Artificial Sequence
  Description of Artificial Sequence: Synthetic coding sequence
atgtctcatatcagttgggaggagaggtatcgcaacggtaaagatcaggacggtgatcaggcccctgaataccgcggaaggaccgagctcctgaaggacgccattggagaggggaaggtcacattgcgaatccgaaatgtgcgcttcagtgacgaggggggatttacttgcttttttcgtgaccactcataccaggaggaggccgcaatggagttgaaagtcgaggatccgttttactgggttagccctggcgtgttagtcctgcttgccgtgcttccggtgctcttgctacagattaccgttgggctggtctttttgtgcctgcagtacaggttgcggggaaagttaagagctgagatagaaaatctgcatcggacttttgatcctcacttcttgcgggtgccttgctggaaaattaccctgttcgtgattgtccccgtgctcggcccactggtcgctctaatcatatgctacaattggttgcacaggcgcctcgccggacaatttctggaggagcttagaaatccattctag

SEQ ID NO: 231352 - DNA, 621 bp, Artificial Sequence
  Description of Artificial Sequence: Synthetic coding sequence
atggcaagtcttagtaggcccagtctgccctcttgcctgtgtagcttcctgctgctgctgctgctgcaggtgagcagttcttatgctggacagttcagagtgataggcccacgacaccctatacgcgcactcgtgggagacgaggtggaattaccttgtagaatctcacccggtaaaaatgcaactgggatggaggtcggatggtataggcccccattttcacgggtggtacatttgtaccggaacggcaaggatcaggacggggatcaagcaccagaataccggggacggaccgagctgctgaaagatgcaatcggggaaggcaaggtgaccctgcgcatcaggaacgtgcggttcagtgacgagggaggtttcacctgtttctttagagaccatagttatcaggaggaggctgcaatggagctgaaggtagaggatcccttctattgggtgtccccaggagtactggtactgctagccgtcctcccggtattgctgcttcaaattaccgtcggtctggtctttctgtgcctgcagtatagactgagagggaaactgcgcgcagagatagagaatctacataggaccttcgttttccaccttgaggctctatcagggtag

SEQ ID NO: 231353 - DNA, 174 bp, Artificial Sequence
  Description of Artificial Sequence: Synthetic coding sequence
atggcctccctatctcgcccatctttaccatcctgcctgtgctccttcctgctactgctgttattgcaggtatcaagctcatatgccggactggtggccgtcgccagaagctggttaattgctgcgtcgactagccaggcacaggttattctgctgacacagccactggaatag

SEQ ID NO: 231354 - DNA, 621 bp, Artificial Sequence
  Description of Artificial Sequence: Synthetic coding sequence
atggcctccctgagtaggccaagtttgccatcctgcctctgctctttcctgctgctgttactgctgcaggtcagtagttcctacgctggtcagtttcgggtgattggtccacgacatccaatcagggcccttgtgggcgatgaagtggaactgccctgcaggatcagtccaggaaagaacgccaccggaatggaggtcggctggtaccggccaccattctcacgggtggttcatctgtaccgaaatggcaaagaccaggatggagaccaggccccagaatacagaggacgtaccgagctcctgaaagatgccatcggcgaaggtaaagtcacacttcgaattcgcaatgtgcggtttagtgatgaggggggttttacctgcttcttccgcgaccactcttatcaggaagaggcggcaatggagctgaaggtggaggacccattttactgggtgagcccaggggtgctggtgctgctggccgttctcccagtgctgctgctgcagataacagtcgggctagtatttttatgcctgcagtaccgcctgcggggaaagctgcgcgctgaaatagagaacctgcaccgcaccttcgtatttcacctggaagcattgtcagggtag

SEQ ID NO: 231355 - DNA, 516 bp, Artificial Sequence
  Description of Artificial Sequence: Synthetic coding sequence
atggcgtccctgtcccggcctagcttgccaagttgtctttgcagttttcttttattgttactcttacaggtttccagcagttatgccggacagtttcgcgtgattggacccagacacccgatacgggctttagtcggagatgaagtggagctgccttgtagaatttcccctggcaagaatgccaccgggatggaggtgggctggtacagaccaccctttagtagggttgtgcatctgtaccgaaatgggaaggaccaagatggcgatcaggcacccgaatacagagggaggacagagcttttgaaagatgccatcggtgaaggtaaggtgaccctccgcatccgcaatgtcaggttcagtgacgagggagggtttacttgcttcttccgcgatcacagctaccaggaggaagcagccatggagctcaaggtggaggtatctcatagcgtcacccaggactggttgcagtggcacgaccatggatctctgcagcctcctcctcccagactgaaatag

SEQ ID NO: 231356 - DNA, 621 bp, Artificial Sequence
  Description of Artificial Sequence: Synthetic coding sequence
atggcttcacttagccggccttctctccccagctgcctgtgcagctttctcctgctcctgctcctacaggtgtcaagcagctacgcaggccaattcagagtaattggtcccagacatcctatcagggcattggttggggacgaagtggagctaccatgtcggatctcacctggcaaaaacgccacaggcatggaagtgggatggtacagacctccttttagtcgtgtagtgcacctttatagaaacggaaaggatcaggatggggaccaagcaccagagtacagaggacgcactgagctgctcaaagacgcaattggcgaggggaaagtgaccctgcgtatccggaatgtcaggttttctgatgaaggtggctttacgtgcttcttccgcgatcatagttaccaagaggaagccgctatggagctgaaagtggaggatcccttttactgggtgtcccccggagtcctcgttttgctggccgttctgcctgtcttactcttgcagattactttgggcttggtttttctctgcctccagtatcgattgcgcggaaagctcagggccgaaatagagaatctgcatcgaacattcgtttttcacctggaagccctgagtggatag

SEQ ID NO: 231357 - DNA, 516 bp, Artificial Sequence
  Description of Artificial Sequence: Synthetic coding sequence
atggcatcactgtcgcggccttctctgcccagctgcctctgctctttcttgctactgttgttactccaggtgtcctcctcttacgcgggacagtttagagttattgggcctcggcacccaattagagcgctggtgggcgacgaggtcgagttgccctgtcgcatctccccgggtaagaatgcgacaggcatggaagtcgggtggtacaggcccccatttagtcgggttgtgcatctttacagaaacggcaaggaccaggatggggatcaggcgcctgaataccggggacggactgaactgttaaaggatgccattggtgagggcaaagtgactctgcgtattaggaacgtgcgcttttcagacgagggcggatttacatgcttttttcgcgatcactcctaccaggaagaggccgctatggaattaaaggtcgaggtgagccattcggtgacacaggactggcttcagtggcatgaccacggttcacttcaaccccctccacccaggctgaagtag

SEQ ID NO: 231358 - DNA, 516 bp, Artificial Sequence
  Description of Artificial Sequence: Synthetic coding sequence
atggcctcgctgagccggccatcattgccctcttgcctttgctcttttcttctccttcttcttctgcaggtgagcagttcatacgccggtcagttccgcgtgataggccctcgccacccaatacgtgccctggtgggagacgaggttgaactgccatgtaggatctctccgggaaaaaacgccacgggcatggaagttgggtggtaccgccctcccttttctagagttgttcacttgtaccggaatggcaaagatcaggatggtgaccaagcccctgagtacaggggacggaccgagctgctcaaagatgctattggggaggggaaagttactttgcgaattcgcaacgtgcgcttcagcgatgagggtggatttacgtgtttctttcgagatcactcctatcaggaggaggcagccatggagctcaaggtcgaagtgtcccactctgtgacccaggattggctgcagtggcatgaccacggcagcctgcaaccaccaccacctcggctgaagtag

SEQ ID NO: 231359 - DNA, 627 bp, Artificial Sequence
  Description of Artificial Sequence: Synthetic coding sequence
atggccagcctgagccgcccttccctcccgtcctgcctttgttcctttctattgctccttttactccaagtgtctagctcgtatgccggtcaatttcgtgtgatcggcccacggcaccccattcgggctctggtgggcgatgaggtggagttaccttgtagaatctcaccgggtaagaatgctactggtatggaggtcgggtggtaccggccaccgttctctagagtcgtgcatttgtatcggaatgggaaagaccaggacggcgatcaggctccggagtatcgtggccgaacagaactgctgaaggacgctattggagaaggtaaagtcacgcttcgtatcagaaacgttcgcttttctgacgaaggaggattcacctgcttctttagagatcactcctaccaggaagaagccgcaatggagctaaaagttgaagaccccttctactgggtgtcccccggagtgctggtcctgttagctgtgttgccagtgttgctcttacagatcacggtgggactggtttttctctgtcttcagtatcgtctaagaggaaagctgcgcgctgagatcgaaaacctgcaccgtacctttgggcagttcttggaagagctgcgaaacccattctag

SEQ ID NO: 231360 - DNA, 174 bp, Artificial Sequence
  Description of Artificial Sequence: Synthetic coding sequence
atggcttcgttgtctcggccaagtctcccatcttgtctctgttcattcctcctcctgctcctcctccaggtgtcttccagctacgccggactcgtggctgtagcaaggagctggctgatcgctgcatcaacaagtcaggctcaggtgatcctcctaacacagcccctggagtag

SEQ ID NO: 231361 - DNA, 627 bp, Artificial Sequence
  Description of Artificial Sequence: Synthetic coding sequence
atggcatccttgtctagaccatcactaccttcttgtttgtgcagtttcttgctcctcttactgttgcaagtgtcctcaagctatgcaggccagtttcgtgtcatcggcccacgccaccccattcgcgctctggtgggtgacgaagttgagttgccttgtcgaatctcacctgggaagaatgccactggaatggaggtgggttggtatcgacccccattttcaagggtggtgcacttatatcgaaacggcaaagaccaggatggagaccaagctccggaatatcggggtagaacagagctgctaaaggacgccataggtgaaggcaaggttacgctcaggattaggaatgtcaggtttagcgatgaggggggatttacatgcttctttcgcgaccactcataccaggaagaggctgccatggagctgaaagttgaagatcctttctactgggtctcgccaggcgtattagtcctgttggccgtattgccagtgctgctgctccagatcaccgtgggactggtgttcctgtgtctgcagtaccgacttcgagggaagctgcgggcagagattgagaaccttcacagaacatttgggcagttcctcgaagagctcagaaaccctttctag

SEQ ID NO: 231362 - DNA, 174 bp, Artificial Sequence
  Description of Artificial Sequence: Synthetic coding sequence
atggctagtctttcgcggccatccctgccatcatgcctctgtagttttctgctactgcttcttcttcaggtgtcctcctcttacgctggtctggtggccgtggctcggtcatggctcattgctgcatccacaagtcaggctcaggtcatcttattgacgcagcctttggagtag

SEQ ID NO: 231363 - DNA, 534 bp, Artificial Sequence
  Description of Artificial Sequence: Synthetic coding sequence
atgtctcatatctcttgggaagaacgctacaggaacggcaaggaccaggacggagaccaggcacctgaatatcggggacgaactgagctgctcaaggacgctattggcgaaggtaaagtcaccctgcgtattcgcaatgtcaggttctccgacgagggaggttttacctgcttcttccgagatcatagctaccaggaggaagctgctatggagctcaaggtggaagacccattctattgggtgtcacctggcgtcctcgttttgctggctgtgctgcctgtccttcttctgcaaattacagttggtctcgttttcctttgcctgcagtaccgcctccgcggaaagttgcgcgctgagatcgagaaccttcaccgtaccttcgatcctcacttcctaagggtgccttgttggaagatcacactgtttgtgattgttcctgtgctaggacccttggtagcgttgattatttgctacaattggctgcatcgcaggctcgccggtcagtttctggaggagctacgtaatcccttttag

SEQ ID NO: 231364 - DNA, 516 bp, Artificial Sequence
  Description of Artificial Sequence: Synthetic coding sequence
atggctagtctcagtagaccaagcctgccatcttgcctgtgcagcttccttctcctccttctgttacaagtgtcgtcgtcgtatgccggacagttccgtgtcatcggacctcgccaccccattagggctcttgtaggagacgaagtcgagctcccttgtcggatttcccctggcaaaaatgctacaggtatggaagtgggctggtacaggcctccgttttctagagtcgtgcatctgtacagaaatggcaaggatcaggacggggatcaggccccagagtatagaggacgcactgaactcttgaaggatgccatcggtgaaggcaaggtcactttgcggatccggaacgtccgcttcagcgatgaaggcggttttacctgctttttcagggaccactcttatcaagaggaagcagccatggaactcaaggtagaggtgtcacactccgtgactcaggactggctacagtggcatgaccatggcagccttcagccccctccccctcgcctgaaatag

SEQ ID NO: 231365 - DNA, 534 bp, Artificial Sequence
  Description of Artificial Sequence: Synthetic coding sequence
atgtctcatatttcatgggaggagagatatcggaacgggaaagaccaggacggtgaccaagcacccgaatacagaggcagaactgagttactgaaggacgccataggggaaggtaaggtgaccttgcggatccggaacgttaggttttccgatgaggggggtttcacctgcttcttccgggatcactcctaccaggaggaggccgctatggagctgaaagtggaagacccgttctattgggtatccccgggagttctagtgttactggctgttcttccagtactcttgctacagattaccctgggactcgtgtttttgtgtctgcagtatcgcctacgcggaaaactccgagccgagatagagaacctccatcgcacatttgatcctcactttttacgtgtgccttgttggaaaatcacgctcttcgtgatcgtgccagtgctcggaccactcgtggcccttataatctgctataattggttgcataggcgcctggccggtcagttcctggaagagttgaggaacccattttag

SEQ ID NO: 231366 - DNA, 627 bp, Artificial Sequence
  Description of Artificial Sequence: Synthetic coding sequence
atggcatcactcagccgtccatccttaccctcatgcttgtgtagtttcttactcctactgttgctgcaggtatcatcctcatatgcgggtcaattccgggtgattggcccacgccatccaattagggctcttgtcggcgacgaggtggagctgccatgtaggatatctccaggcaagaacgccaccggcatggaggttggatggtatagacccccattcagccgggtcgtgcacctgtatcgaaacgggaaggatcaagacggggatcaggcccctgagtatcgagggagaaccgagctgcttaaagatgcaatcggtgaaggaaaagtcacacttaggatccgcaatgtgcggttctccgacgaaggtggttttacttgtttcttccgcgaccactcctaccaagaggaggccgctatggaactgaaggtggaagacccgttttattgggtctcacctggagtcctagtgcttctggcagtcctgcccgtgcttctgctgcaaattaccgtaggtctagtcttcttgtgtttgcagtatagacttcggggaaagctgagagctgagattgagaaccttcacaggacgtttggacaatttctcgaagagctgcggaatccattttag

SEQ ID NO: 231367 - DNA, 174 bp, Artificial Sequence
  Description of Artificial Sequence: Synthetic coding sequence
atggcgtctctgagccggccttccttgcccagctgcctctgcagcttcctgctgctgttgctgctgcaggtgagcagtagttatgccggattagtcgccgtagcacggagttggttaattgccgctagcacttctcaggctcaggtgattttgctcacacagcccctggagtag

SEQ ID NO: 231368 - DNA, 174 bp, Artificial Sequence
  Description of Artificial Sequence: Synthetic coding sequence
atggcttcactgagcagaccatccctcccctcttgcctctgttccttcctgcttctacttctgttgcaggtttcgtcatcttacgccggtctcgtggcggttgccagaagctggctgattgccgcttccacaagtcaggcacaggtgatcctgctcacgcagccgcttgagtag

SEQ ID NO: 231369 - DNA, 534 bp, Artificial Sequence
  Description of Artificial Sequence: Synthetic coding sequence
atgtcacatataagctgggaggagagatatagaaacggcaaagatcaagatggtgaccaggcccctgaatacaggggaaggacagaactgctcaaggatgccattggggagggaaaagtgactctacggattcggaatgtgcgcttcagcgatgagggcggatttacttgcttttttcgtgaccattcctaccaagaagaggctgctatggagcttaaggtcgaggaccctttttattgggtgagccctggcgtgctggtacttctggctgtgctgcccgtactcctacttcagatcacagtcgggctggtgtttttatgcctgcagtaccgcttgcggggtaaactgcgtgccgaaattgaaaacttgcatcggaccttcgaccctcacttcctgagggtgccttgctggaaaattactctttttgtgatcgtgcccgttttggggccactggtggcactgattatatgctataactggctccataggagattggcgggacagttccttgaggagctgaggaatccgttctag

SEQ ID NO: 231370 - DNA, 516 bp, Artificial Sequence
  Description of Artificial Sequence: Synthetic coding sequence
atggccagtctgtctcggccttccctaccttcttgcttgtgctctttcttgcttctgcttcttttacaagtgtcttcttcttacgccggacagttcagagtcattgggcctcgccatcccatcagggcacttgttggagatgaagtggagcttccctgtcgaatttcccccggaaagaatgcaaccgggatggaggtcggttggtaccgtcctcctttttctcgcgtagtgcacctataccgcaacggtaaggaccaggacggagaccaggccccagagtaccgcggacggaccgaattgctgaaagacgctatcggcgaaggcaaggtcaccttaagaatcaggaacgtgagattcagcgatgagggcggatttacgtgtttcttccgcgatcactcttatcaggaagaagctgccatggagctcaaagtagaggtgagccattccgtcactcaagattggttgcagtggcacgatcatggcagcctacagccccctccgcctcggctcaaatag

SEQ ID NO: 231371 - DNA, 534 bp, Artificial Sequence
  Description of Artificial Sequence: Synthetic coding sequence
atgagccacattagttgggaggaacgctacaggaacggcaaagatcaggatggagatcaggccccagagtacagaggtagaactgaactgctaaaagacgcaatcggagagggaaaggtgacacttcggatcaggaacgtgcgattttccgacgagggcggttttacatgcttttttcgggatcattcttaccaggaagaggcagccatggagctcaaggtcgaggacccattctactgggtctctcctggcgttttggtgctgctggccgtcctacccgtcttgctgcttcagattaccgtgggcctggtctttctgtgcctccaataccggctacgtggcaagctgcgtgcagagattgagaacctgcataggacctttgacccccactttctcagggtgccttgttggaagataaccctttttgttattgtgccggtgttggggcctctcgtggctctgatcatctgctacaactggcttcacaggcgactggccggtcagttccttgaagagctaagaaaccctttttag

SEQ ID NO: 231372 - DNA, 174 bp, Artificial Sequence
  Description of Artificial Sequence: Synthetic coding sequence
atggcctctctctctaggcctagcctgccctcttgcctgtgtagctttctgctgctgctgctgctgcaggtcagcagcagttatgctggcctcgttgccgtcgctcggtcgtggctcattgccgcatctaccagtcaagcccaagtgatactcttaacccagcctctagagtag

SEQ ID NO: 231373 - DNA, 627 bp, Artificial Sequence
  Description of Artificial Sequence: Synthetic coding sequence
atggcatctctgagtcgcccttcgttgccatcatgtttatgctcctttctactgcttctgctgcttcaggtcagctcaagttacgctggacagttccgtgtcataggcccaagacaccctatcagggcattggtgggcgacgaagtggagcttccgtgccggatctcaccaggcaagaatgcaacaggcatggaggtggggtggtaccgaccccctttttccagagtggtgcatctgtatcgcaatggaaaagaccaggacggggatcaggccccagagtataggggacgcaccgagcttctgaaggacgcaattggcgaggggaaggttactctgaggatacggaatgtgaggttctcagacgagggtggttttacatgcttctttcgcgatcacagttatcaagaagaggccgcaatggagttaaaagtggaggatcctttttattgggtctctcctggggtcctggtcctcctggccgttctaccagtgcttctgttacagattacggtcggactggtcttcctctgtctgcagtaccggctccgaggcaagctcagagctgaaatagaaaatctgcatcgaactttcggtcagttcctggaggaattacggaacccgttctag

SEQ ID NO: 231374 - DNA, 327 bp, Artificial Sequence
  Description of Artificial Sequence: Synthetic coding sequence
atggccagcctaagtagaccttccttgccgagttgtctgtgctcgtttctgttattactgctgctccaggtgtcctccagctacgctgatcctttttactgggtctcaccaggcgtgcttgtgctcctggccgtgctgcccgtcttgctgttacagattaccgtgggactgattttcctgtgcttgcagtaccgacttcgtgggaagcttagggcggaaatcgagaaccttcatcgaacctttgaatcttttggagtactggggccacaggtgaaagaacctaaaaaaaccggccaattcctggaagagctaagaaatcctttttag

SEQ ID NO: 231375 - DNA, 753 bp, Artificial Sequence
  Description of Artificial Sequence: Synthetic coding sequence
atggcgccaggtgctccaagcagctcacccagcccgatcctcgcagtgctgctgttttcttcactggtgttgagccctgctcaggctatcgtcgtctatacagatcgagaagtgcatggcgctgttggatcaagggtaacactccactgcagtttctggtcttcagagtgggtgagtgacgacatttcttttacttggcgttaccagcctgaagggggtcgggacgcaatctccatctttcattatgcaaaggggcagccctacatagacgaggtgggcacgtttaaggagcgaatccagtgggtgggagatcccagatggaaggatggcagcattgtgattcacaatctggattattcagacaacggcacttttacatgcgacgtgaaaaacccacctgacattgtgggcaaaacgagtcaggttacactgtatgtgtttgaaaaggttcccacgaggtatggggtcgtgctgggagcagtgataggcggagtactgggagtcgtacttctattactgttactcttctacgtggtgagatactgctggctgaggagacaagcggctctccagagacgcctgtcagccatggagaaggggaagctgcataaacccggtaaggacgcgagcaagcgcggaagacagacacccgttctgtatcagtgctggaccaccgcagaggcaccaaaactctctgtgaggcgtaggccaagaggatggggctcgctggcccgtatccggaacagcggatag

SEQ ID NO: 231376 - DNA, 777 bp, Artificial Sequence
  Description of Artificial Sequence: Synthetic coding sequence
atgttacgcgcacccgcaccggctcccgctatggccccaggagccccttcttctagtcccagccccatcctggcagtcctactgttcagctctctggtgctgtctcccgctcaagcgatcgtggtttatacggatagagaggtgcacggggctgtcgggtctagggtaactcttcactgctctttttggagtagcgagtgggtatctgatgacatttcttttacatggcggtatcaacccgagggaggacgcgatgctatttctatttttcactatgccaaggggcagccttatatcgacgaggtcggcactttcaaggaacggattcagtgggtgggagatcctagatggaaggacggatctattgtgatacacaacctcgattactcggataatggcacatttacctgcgatgttaaaaatccaccagacatagtaggaaaaacttcccaggtcacactttatgtgtttgagaaggtgccaacacggtacggagttgtgctcggtgccgtaatcgggggagtattgggtgtggtgctactgttgctattactgttctacgtcgttcgctactgctggctgcgtagacaggccgctctacaaaggcgattgtctgccatggagaaggggaaattacataagccaggtaaagatgcctctaagagaggcagacagacacccgtactgtatgcgatgcttgatcattctcgatcaacaaaagcagtcagcgagaagaaggccaagggactcggcgagtcgcggaaagataaaaagtag

SEQ ID NO: 231377 - DNA, 747 bp, Artificial Sequence
  Description of Artificial Sequence: Synthetic coding sequence
atggcccctggcgctccctctagcagtcccagtccgatcctggccgttttactattttcatctctggtgctttcacccgcacaggcaattgtggtctatacagatcgcgaggttcacggagccgtcggaagtcgggtcacgctgcattgttccttctggtctagcgagtgggtgtcagacgacatcagcttcacttggaggtatcagcccgaaggcggtcgggacgcaatctcaatatttcactatgccaagggacagccttatatcgacgaggtcggaacatttaaagaaagaatccagtgggtgggcgatccccgttggaaggatggctctatagtgattcacaacctcgactactccgataacgggacttttacctgtgatgtgaaaaatcctcctgacatcgtggggaaaacttcccaggtaactctctatgtattcgaaaaggttcccacccgatacggtgtggttctgggtgccgttatcggcggagtgctcggtgtggtgctactacttctcctgctgttctacgtcgtaagatattgctggctgcggaggcaggctgccctgcagagaaggttgtcagcaatggaaaaggggaaactacacaagccaggaaaggacgcgagcaagagaggtcgccagacccctgtactgtatgccatgctcgaccactctcgatcaaccaaggcagtgagtgaaaagaaggctaagggactaggggagtctcggaaggacaaaaaatag

SEQ ID NO: 231378 - DNA, 747 bp, Artificial Sequence
  Description of Artificial Sequence: Synthetic coding sequence
atggccccaggtgctcccagttctagtccatctcccatactggccgtgttgctcttctcatcactggtgctgtctcctgcccaagccatcgtggtgtacactgaccgggaagtgcatggggcagttggcagccgcgttactctccactgttccttctggagttcggaatgggtgtcggatgatattagttttacatggaggtatcagcccgaagggggaagggacgcgatctcaatattccattatgccaaaggacagccatacatagatgaggtgggcacattcaaagagcgtattcagtgggtcggcgacccacggtggaaagacggcagcattgtgattcacaacctggactactccgacaatggcacgtttacatgtgacgtgaaaaatccacccgacattgtcggaaaaacatcacaggtgactctgtatgtgtttgaaaaagtcccaactagatatggggtggtcctgggagcagtcatcgggggagtgctgggtgtggtgctcctgctcttattattgttttacgtggttaggtattgttggttacggaggcaggctgcactgcagcgccgtctgtccgctatggagaaaggtaaacttcacaagccaggcaaagacgcctctaaaagaggaaggcagactcccgtgctgtacgcgatgcttgaccactcccgcagtacaaaggctgtcagcgaaaagaaggcaaagggcctgggtgagtctagaaaagacaagaagtag

SEQ ID NO: 231379 - DNA, 648 bp, Artificial Sequence
  Description of Artificial Sequence: Synthetic coding sequence
atgtacggcaaaagcagcacgcgcgctgtgctattgctgttgggaatacaactgaccgccctgtggccgattgcagctgtggagatctacacctccagggtgctggaggcagtgaacggaactgatgcccgtcttaaatgcacctttagcagcttcgctcctgtgggcgacgctctgaccgttacatggaacttcaggccactggatggcggaccagagcagtttgtgttctactaccacattgaccctttccagcctatgtccggcagatttaaggatcgggtgagttgggacgggaaccctgagaggtacgatgcctccatcctgctatggaagctccagtttgatgacaacggaacctacacctgtcaggttaagaatcctccagatgttgacggagtcattggtgagatacgcctgtctgttgtccacaccgttcgtttcagtgaaatccactttcttgcattggcaattggaagtgcttgtgccctcatgattataatcgtaatagtggtggttctcttccagcactaccggaagaaaaggtgggcagagagggcccacaaggtagtggagatcaaaagcaaagaagaagagagacttaaccaggaaaaaaaggtgagtgtgtacctcgaagacactgattag

SEQ ID NO: 231380 - DNA, 648 bp, Artificial Sequence
  Description of Artificial Sequence: Synthetic coding sequence
atgtacggaaagtcctcaacgcgggctgttctgctcctgctgggtatacagctgacagccctatggcctatcgctgcggtggagatttataccagtcgagtgttggaggctgtcaacggcacggatgccagacttaaatgtaccttcagctccttcgctcccgtgggagatgcactcactgtgacatggaatttccgcccactggatggcggtccagagcagttcgtgttttactaccacattgatccgtttcagccaatgagcggaaggttcaaggaccgggtctcatgggatggcaatcctgagagatatgatgcttctatcctgctgtggaaattgcaatttgacgataatgggacctacacctgtcaggtgaagaacccacccgacgtggatggcgtaatcggtgagattcggctctcggtggtgcatacggtcaggtttagcgaaatccactttctggctttagccatcggctcagcttgtgccctaatgattatcattgtcattgtggtcgtgctgttccagcactatcggaaaaagaggtgggctgaacgcgctcacaaggtcgtggagatcaagagtaaggaggaagagaggcttaaccaggagaagaaagttagtgtgtatcttgaagacaccgattag

SEQ ID NO: 231381 - DNA, 708 bp, Artificial Sequence
  Description of Artificial Sequence: Synthetic coding sequence
atgcagcagaggggtgcagcaggttcgagaggatgcgctctcttccccttactcggggttctcttcttccagggggtctacatagttttctcactggagatcagagctgacgcgcatgtaagggggtatgtcggggaaaaaatcaaacttaagtgtaccttcaagagcacctctgacgttacagacaagttgactattgactggacatacagacctcccagttccagccacacggtgagcatatttcattatcagtcctttcagtatccaacaactgccggtaccttccgcgatcggattagttgggtcggcaatgtctataagggggacgcatctatatcaataagtaaccctacaatcaaggacaatggaacctttagctgcgccgttaagaacccccctgacgtccaccacaatatccccatgacagaactgacagtgactgaacggggttttggcacaatgctcagctctgtcgcgttactgtctatccttgtgtttgtaccctctgccgtggtggtggccctgctgctggttcggatgggaagaaaggcggcagggctaaagaaacgatcacgaagcggctacaagaaaagttccatcgaggtcagcgacgataccgaccaagaggaggaggaagcatgtatggctaggctttgtgtgagatgcgcagagtgtctggacagcgattatgaggagacttactag

SEQ ID NO: 231382 - DNA, 672 bp, Artificial Sequence
  Description of Artificial Sequence: Synthetic coding sequence
atgcagcaaaggggcgcagctggctcaagaggatgcgccctcttccctctgctcggggttctgttcttccaggatgcgcacgtgagaggctatgtcggggaaaagatcaagctgaaatgtaccttcaaaagtacgagcgatgttaccgacaaactgacaatcgattggacctaccggccaccttcttcctcgcataccgtctcaatctttcactaccaaagtttccaataccccacgacggcaggaacctttcgtgatcgcatatcatgggtcgggaacgtatacaagggagacgcatctatctcgatctcaaatcccaccataaaggataatggcaccttctcttgcgcggtgaagaacccccctgacgtccaccataacatccctatgactgaacttaccgtaaccgagagaggtttcggaaccatgctgagtagtgtggccctgctgagcatcttggtgttcgtgccaagcgcagtggtggtggcactccttctcgtgaggatgggtcgaaaggccgcaggcctcaagaagcggtctcgaagcggctacaaaaagtcctccattgaggtgtccgacgacacagaccaagaggaagaagaggcatgcatggccaggctgtgcgtgcgctgtgctgagtgcctggatagcgattacgaagaaacctattag

SEQ ID NO: 231383 - DNA, 3366 bp, Artificial Sequence
  Description of Artificial Sequence: Synthetic coding sequence
atgtctctggagaacgaggacaaaagggccagaaccaggtcgaaggccctgcgcggtcctcctgagactaccgcggctgacctgtcgtgccctaccccagggtgcactgggtcaggccacgtccggggaaaatactcgaggcatcgtagccttcagtcttgcccactcgcaaagaaaaggaaactggaaggcgctgaggccgagcacctagtctcgaagcgcaagtcccacccactaaaactggccttggatgagggctacggggtggactcagatggaagcgaagacacagaagtcaaggacgcctcggtctcagatgagagcgaaggcacattggagggcgctgaggctgagacttctggacaggatgagattcataggcccgagacagcagaaggtcggtctcctgtgaaaagccattttggtagcaatcctattggctctgccacagcttcctcaaaaggctcctatagctcataccagggtataatcgccacaagcctgttgaatctgggccagattgccgaggaaacattagtggaggaggatctgggccaagctgcgaaacctggccctgggatcgtgcacctgttgcaggaagccgcagaaggagctgctagcgaagaaggagagaaggggcttttcatacagccggaggacgctgaagaagtcgttgaggtgacgacagaacgatctcaggatttgtgcccccagagtttggaagatgccgcttctgaagaatcttccaagcagaaaggtattctgtctcatgaagaggaagatgaagaggaagaagaggaggaagaagaggaggaagaagacgaagaggaggaagaggaagaggaggaggaggaggaagaagaggaggaggaagaggaagaagaagaagaagaagaggaagaagaggaagaggaggaagcggcacctgacgtgatttttcaggaagacacttcacatacctccgcccagaaagccccagagctacgcggacctgaatctccctcccctaagcccgaatatagcgtaatcgtagaggtgcgttcagacgatgacaaagacgaggatacccacagtagaaagagcaccgtgaccgatgaaagtgagatgcaggacatgatgacccgaggcaaccttggattactggaacaggctattgccctcaaggctgaacaggtcaggacagtctgcgagcctggctgcccccctgctgaacagtcccagttaggcctgggggagccaggtaaggcagctaagcccctggacaccgtcaggaagagctattactcgaaggatccatcacgggcagaaaagagagagattaaatgcccaacccctggttgtgacggtacggggcatgtcacaggtctctacccccaccataggtctctcagcggctgccctcacaaggaccgcatccctccggaaatcttagccatgcacgagaacgtgttgaagtgtcctactcctggatgtacgggacaaggacacgtcaactctaacagaaatactcaccgtagtctgagtgggtgccccattgccgctgctgagaagctggcaaaatcacacgaaaagcaacagcctcaaactggagacccctccaaaagcagttccaatagcgatagaatcttgaggcccatgtgcttcgtgaagcagctcgaagtgcccccatacgggagctaccgccctaacgtagctcccgcaaccccccgagcgaatcttgcaaaagaacttgaaaaattttctaaggtgacattcgactacgcttccttcgacgctcaggtgttcggcaagcgcatgttagccccaaagatccagaccagcgagacgtctccgaaggctttccagtgctttgactattctcaggacgctgaggcggctcatatggctgctacagcgatattaaaccttagtacacgctgttgggagatgccggagaacctgtccactaaaccccaggacctgcctagcaagtccgtggacatcgaggtggacgagaacggcaccttagatctgtcgatgcacaagcacaggaagagggagaatgcctttccctcttcaagcagctgttcatctagccccggtgtcaagtctccagatgcctctcagagacactcctctacatctgctcccagctcaagcatgacgagcccgcagtcctctcaggctagcagacaggacgaatgggatcggcctctggactacacgaagccttctagactccgcgaggaggagcccgaggaaagcgaacccgcagctcactcatttgccagctctgaggccgacgaccaggaagtctccgaggaaaacttcgaggaacggaagtatccaggtgaagtgacattaaccaattttaaacttaagtttctgtctaaagatatcaagaaagaattgctcacatgccctacccctgggtgcgacggatcaggacatatcacagggaactacgcctcccacagatccctctctggttgccccctcgctgataagtcattacgcaatcttatggcggcacattccgccgatttaaagtgtcccaccccaggctgtgacgggagcggacacatcacaggaaactacgcgagtcatcggtccctgtccggttgcccccgtgccaagaaaagcggagtgaaggtggcgccaaccaaagacgacaaggaggacccagaactaatgaagtgccccgttccagggtgcgtgggcctgggccatatttcgggaaaatatgcaagtcatcgctccgcgagcggttgccctttagccgctcgccgacagaaggagggttcacttaatggatcttccttctcctggaagtctctgaagaatgagggtcctacttgccctaccccaggatgcgacgggtccggacacgctaacggttcttttcttacccatagaagtctcagcggatgccctcgagcgacctttgccggtaaaaaggggaagttaagcggggatgaggtgctttcgcccaaatttaaaacaagtgacgtactcgagaatgatgaggagattaagcaattgaaccaggaaatcagggacctgaacgaatctaatagtgagatggaagccgctatggtgcaattgcagagccagatcagctcaatggagaaaaacctaaaaaatatagaggaggaaaataagctcattgaagagcagaacgaggctctgttcctcgagctctcaggcctttcacaggctctaattcagtccctggccaatattcgcctcccccacatggaaccaatttgtgaacagaacttcgatgcttacgtgtctactctcacagacatgtatagcaaccaggatccggagaacaaagacttattggagagtattaagcaggcagtgaggggaatccaggtctag

SEQ ID NO: 231384 - DNA, 1776 bp, Artificial Sequence
  Description of Artificial Sequence: Synthetic coding sequence
atgagtttggaaaatgaagacaagcgggctcggactaggtctaaggccctgcgaggcccacccgagaccacagcggcagatctcagctgtcccaccccgggatgtacgggcagcggtcacgtgcgtggtaagtactcgcgccaccgcagcctacagagctgtcccctggcaaagaagcgtaaattagagggcgcagaagccgaacatctcgtgtccaagagaaaatcacacccactaaagttagctcttgatgaaggttacggagttgactcagatggcagcgaggatacagaggtgaaagacgcatccgtcagcgatgagagtgagggcaccctcgaaggggctgaagccgagacatcagggcaagacgaaattcacagaccggaaacagccgaagacccaagcagagccgagaaaagagaaataaaatgtccaacacctgggtgcgacggcaccggccatgttaccggcctctatccacatcatcgaagtctgagtggctgccctcataaggaccgcatccctccagaaattctggcgatgcatgagaatgtgctgaagtgtcccacccccggttgtactggccaggggcacgtcaactcaaacaggaacacccatcggagtcttagcggatgccccatcgccgcagccgaaaagctcgcgaagtctcacgagaagcagcaacctcagactggggaccctagcaaatcctcttcaaactctgaccgcatattacgaccaatgtgttttgtgaagcaactggaggtacctccctacgggtcctacaggcctaatgtggcacccgcaacaccccgtgccaatctggctaaagagctggagaaatttagcaaggtgacctttgattacgcatccttcgatgctcaggtgttcgggaaacggatgctggcaccgaagattcaaacatctgagacctcacccaaagccttccagtgttttgattacagccaggacgccgaggccgctcacatggcagcgaccgcaattctgaacctttccacccgatgttgggaaatgcccgagaatctgtctacgaagccccaggacctgccttcgaagtccgtcgacattgaggtcgacgaaaatggcactctcgatttaagcatgcacaagcaccgaaagagggaaaacgctttcccctccagttcttcctgctcctctagcccaggagtgaagtctccggatgcttcccagagacacagctccacgtctgctccgtcttctagcatgacttcaccacagtcttcgcaggcatcccgccaggatgagtgggacagacctctcgactataccaaaccgtcacgtctccgcgaggaagagcccgaagagtccgagcccgcagcccactctttcgccagctctgaggctgatgatcaggaagtttccgaggaaaatttcgaagagcggaagtaccctggcgaggtcactttaaccaacttcaagctgaaatttctctccaaggatatcaagaaggaactgctgacgtgcccaacgcccggttgtgatggatcagggcatatcaccggaaactacgcctctcataggagatgtcctaccccaggctgtgacggtagcgggcatataactggaaattacgcctctcatagatctctgtccggatgtccccgagccaaaaaatcgggtgtaaaggtggcaccaacaaaggacgacaaggaagatcctgagttgatgaagtacgtgggtccttgctggctatttcattgcatagcggaattacggttcagctgcgtgctgtag

SEQ ID NO: 231385 - DNA, 3447 bp, Artificial Sequence
  Description of Artificial Sequence: Synthetic coding sequence
atgagcctcgaaaatgaggataaaagagctcggacgagaagcaaagccctgcggggaccaccagaaacaaccgctgctgacctatcttgcccaacacccggttgcactggaagcgggcacgtgcgaggtaaatatagccgacataggagcctgcagtcatgtccgctggctaaaaagagaaagctggagggtgccgaggccgaacatctggtgtcgaaacggaagagccacccactcaaactcgccttggatgagggatatggcgtggatagcgatggctcggaagacaccgaggtgaaagacgcctccgtgagcgacgaatctgagggcactctagaaggtgccgaggccgaaactagcggccaggacgagattcatcggcctgagacggcagaggggagatccccagtcaagtcccattttgggtctaatcccattgggtcagctacagcaagcagtaagggctcctacagctcttatcagggtattattgccactagtctgctcaatctcgggcagattgcggaggaaacacttgtcgaagaggacttagggcaggcagctaaacctgggccagggattgtccatctgttgcaggaggccgctgaaggtgcggcatccgaagaaggggagaagggcctgttcatccagcccgaagacgcggaagaggtggtcgaagtgacgactgaaagatcacaggatctatgcccccagtctttggaagacgccgcatcggaggaaagtagtaagcagaaggggatcctgagtcacgaggaggaagacgaagaggaggaagaggaggaggaggaagaagaagaagatgaggaagaagaagaggaggaagaggaagaggaagaggaagaggaagaagaggaagaggaagaggaggaggaagaagaggaggaagaggaagaagaggctgccccagatgtcatattccaggaagatacaagtcacacttccgcccaaaaagcccctgaactgcggggtccagaaagtccaagccccaagcctgaatattccgtcatcgtcgaggttcggtccgacgatgacaaagatgaagacacccacagccgtaagtcaacagtgaccgacgagtccgaaatgcaggatatgatgacccgcggaaacctcgggctcctcgaacaggctatcgccctgaaagccgagcaggtgcgaaccgtatgcgagcccggatgcccccctgccgagcagtcccagctgggactgggagaaccaggaaaggccgcaaaaccacttgacactgtgcggaaatcctattacagcaaggatccttcccgagcagagaaacgcgagatcaagtgtcccaccccgggttgcgacggcaccggccatgtaaccggactgtatccccatcaccgcagtctgtccggatgtccccataaagacaggattccccctgagatcctggccatgcatgagaacgtgctcaagtgtccaaccccgggatgtacaggacagggacacgtaaactcgaaccggaacacacataggtctctatccgggtgccccatagcagctgcggagaaactggccaagtcccatgaaaaacagcagccccagacaggcgacccatcaaaatcttccagtaactcagacagaattctgaggccaatgtgcttcgtgaagcagttggaggtgccgccatatggctcataccggccaaatgtcgcgcctgctacccctcgagccaatctagccaaggagcttgagaagttctctaaggttaccttcgattacgcgagtttcgacgcacaagttttcggaaaacgcatgttggcccctaagatccagacatcagaaacctctcccaaagcctttcagtctaagcctttccctaaggcctcttcaccacgccactccccttccagctcatacgtgcgatctaccagctccagctctgccggatttgattatagccaggatgccgaagccgcacatatggctgcgactgcgatcttgaacttgtccaccagatgctgggaaatgcccgaaaacctgagcactaaaccgcaagacctgccctccaaaagtgtcgatatcgaagtcgatgaaaatggtactctggacctgtctatgcataagcacaggaaaagggaaaatgccttccctagcagttctagctgtagctcatccccaggcgtcaagtctcccgatgcatctcaacggcattcttctacctctgccccttccagctcaatgactagcccacagtcctcgcaagcatcaagacaggacgagtgggatagaccactggactatacaaagccctctagactacgtgaggaggagcctgaggaaagcgagcccgcagcccactcatttgccagctcggaagcagacgatcaggaagtgtccgaggagaacttcgaggagcgaaaataccctggagaagtgaccctgacaaacttcaagctgaagttcctgtcgaaggacatcaaaaaggagcttcttacatgcccgaccccgggttgcgatggatcgggccatattactggaaattacgcatcgcaccgcagcttatcaggttgccctctcgccgacaaatctcttcggaatctcatggccgctcacagtgccgacctgaaatgcccgacaccagggtgcgatgggtcagggcatatcaccgggaactacgcttcccacagaagtttgagcggatgtcccagagcaaagaaaagtggagtgaaggtcgcgccaaccaaggacgataaggaggatcccgagctgatgaaatgtccagtgcccggatgtgtaggtttagggcacatcagcgggaagtatgcgagtcataggagcgcctctgggtgccctctggcagccagaagacagaaggagggttctctcaatggatcatcctttagctggaagagtctcaaaaatgagggccctacttgccctactcccggatgcgacgggtccggtcacgcaaatggatcctttttgacccatcggagtctgtcaggatgtcctcgagctacattcgctggaaagaaaggaaagttgtctggcgacgaagtcctgagccctaaattcaaaacttctgatgtcctagagaacgatgaggaaatcaagcagttaaaccaggaaatacgtgacctgaacgaatccaactcagagatggaggctgccatggtgcaacttcagagccaaatctcatctatggagaaaaacctgaaaaatattgaagaggagaacaagctgattgaggaacaaaacgaggctctgtttctggaactcagtgggctgtcccaggcactcattcagtcccttgccaacatcaggctccctcatatggaacctatctgcgaacagaattttgacgcgtatgtctcaactctgactgacatgtactcaaatcaggatccggagaataaagatcttctagagtctattaagcaggctgtcaggggcattcaagtctag

SEQ ID NO: 231386 - DNA, 3399 bp, Artificial Sequence
  Description of Artificial Sequence: Synthetic coding sequence
atggaagtcgataccgaggaaaagcggcatcggacgcggagcaaaggggttagagtgccggtcgagcctgcgatccaagaacttttttcttgtcctacccccggatgcgatggatccggccatgtcagcggaaaatatgcccgacacaggagtgtgtatgggtgtcctcttgccaagaaacgcaagacgcaggataagcagccccaggagcctgccccaaagaggaaacctttcgccgtgaaagctgattcctcgtccgtggatgaatgtgacgactccgatggcacagaagatatggatgagaaggaggaagatgaggaagaggaagaagaggaagaagaagaaaatgaagaccaccaaatgaattgtcataacactcggatcatgcaggacacagagaaagacgacaacaataatgatgaatatgataattacgatgagctggtcgctaaaagcctgttgaacctggggaagattgcagaggatgctgcataccgggcacgaacggaatccgagatgaattctaacacatctaactcactggaggatgacagtgataagaacgagaatctcgggagaaaatccgagctgagtctggatcttgattcagacgttgtaagagagactgtcgactctttgaaactgctggctcaaggacacggcgtagttctgagcgagaacatgaacgaccggaactacgccgactctatgtctcagcaagattcacgcaacatgaactatgtcatgctcggaaagcctatgaacaacgggttgatggagaagatggttgaggaatctgatgaggaagtctgtttatcatctctagagtgcctcagaaatcaatgcttcgacctcgctcgcaaactgagtgaaactaacccccaggaacgcaatccacagcagaacatgaacatcagacagcatgttcgacctgaggaggactttccgggacgaacgcctgatcggaattatagtgatatgctgaatctcatgcggttggaagagcagctctctcctcggagtagggtctttgcgagctgtgccaaggaggatggttgtcatgagagagatgacgacaccacttctgttaatagcgaccgctcagaggaagtgttcgatatgactaagggtaacctcacactcttagagaaggccatcgcactagaaaccgagcgggcaaaagccatgagggagaagatggctatggaggcgggtaggcgagacaacatgcggtcttacgaggaccagtcccctcggcagttgccgggtgaagaccgcaaacccaaatcatccgattcccacgtgaagaagccctattacgacccatcacgcaccgagaaaaaggagagtaagtgtccgacacccggttgcgatggcactggacacgttacaggcctgtacccacatcaccggtcactgagcggttgtccacacaaggacagagtcccgcctgaaatcctggccatgcacgaaagtgtgcttaaatgccccactcccggatgcactggacgcggacacgtgaacagtaacaggaactcgcaccggagcctgtctggatgccccatcgccgctgctgaaaagttagctaaagcccaggagaaacaccagagctgtgacgtgagcaagagcagccaggcgtcagatcgggttctccgcccaatgtgttttgtgaagcagttagaaatcccacagtacggctacaggaacaacgtgcctacaacaactccacgatccaacctggcgaaagagctcgagaagtactcgaaaacgtcctttgaatataacagctacgacaaccatacttatggcaagagggctatagctcctaaggtgcagacgagagacattagccctaagggttatgatgacgcgaagcgctactgcaaagacccttctccaagcagcagctccacaagctcttacgccccatcatcttccagcaacctgagttgtggcggaggcagttcggcttctagtacttgttcaaagtcgagcttcgattatacccatgacatggaagcagctcatatggccgcaacagccatattaaatctcagcactcggtgccgcgagatgcctcagaacctgtcaaccaagccacaggacctgtgtgctacacgcaatcctgacatggaagtggatgaaaacggcacacttgatttgagcatgaacaagcagcggcctcgcgactcgtgctgtcctatcctgaccccccttgagccgatgtccccccagcagcaggctgtgatgaataatagatgttttcaactgggtgagggtgattgctgggacctgccagtcgactacacgaagatgaaaccgaggcgtatcgatgaagacgagtcaaaggacattactcccgaggacctagaccccttccaggaggccctggaggagcgcagatacccaggggaggtgaccattcccagtcccaaaccgaagtacccacagtgtaaggagagtaagaaggatcttattaccttgtccgggtgcccacttgcagataagtctatacggtcaatgctggctaccagcagccaggagcttaagtgtcccacacccggttgcgatggctccggacatatcactggtaattacgcctctcaccgatcgcttagcggttgcccaagagctaagaaaagcggaatcaggatcgcgcagagcaaggaagataaggaggaccaagagccaattcggtgcccagtgcccggatgtgatggccagggccacatcacaggtaagtatgcctcccataggtccgcctcaggttgcccgctcgcagccaaaaggcagaaagatgggtacctaaacgggtcgcaattttcatggaaatccgtgaagacagaggggatgtcatgtccgacccctggctgtgacgggagcggccatgtgagcggaagctttttgactcacagatccctctccggatgtccgagggctacctccgccatgaaaaaagccaaattgagcggggaacaaatgctaaccatcaagcaacgcgcttctaacggcattgaaaatgatgaagaaatcaagcagttggatgaggaaataaaagagttgaacgaaagtaactcccaaatggaggccgatatgatcaagctccgcacacagattacaactatggagtctaacttgaagactattgaggaagagaataaggtcatcgaacagcagaacgagtcattgcttcacgagctcgccaacctttcccagtccttgatccacagtctcgcgaacatccagcttcctcacatggacccaatcaacgagcagaatttcgacgcgtacgttactaccctcactgaaatgtatactaaccaggatcgataccagagtccagagaataaagccctactcgagaatattaagcaggcggtaaggggcatacaggtatag

SEQ ID NO: 231387 - DNA, 3561 bp, Artificial Sequence
  Description of Artificial Sequence: Synthetic coding sequence
atggaagttgacactgaagagaagagacataggacacggtctaaaggggtacgagtgcccgtcgagcccgcaatccaggagctcttctcctgcccgacgcctggctgtgacggatccggtcacgtttctggaaagtacgctagacatagatcagtctacggttgtcccctcgccaagaagagaaaaacccaggataagcaacctcaggaaccggctcccaaacgcaagccgttcgcagttaaggccgattcctctagcgtggacgagtgcgacgattccgacggcaccgaggatatggacgagaaggaagaggatgagggggaagaatatagtgaggataacgacgaaccaggggatgaggacgaagaggatgaagagggtgaccgcgaagaggaagaggaaattgaagaggaggatgaggacgacgacgaggatggagaggacgtcgaagacgaggaggaagaggaggaggaagaggaagaagaggaggaggaagaagagaacgaggatcatcagatgaattgccataacactcggataatgcaggacacagaaaaggatgacaacaacaacgacgaatatgacaattatgacgaactcgttgcaaaatccttgttgaatttaggtaaaatcgccgaagatgctgcctaccgcgcaagaaccgaatctgagatgaatagcaacaccagtaatagcctggaggatgattccgataagaatgaaaatctgggaaggaaatctgagttatcgctggacttagatagcgacgtggtgagagaaaccgttgattccttgaagttattagcccaggggcacggagtggtgctcagcgagaacatgaatgataggaattacgctgacagcatgtcacagcaggattcaaggaacatgaactacgtgatgcttggtaagcctatgaacaatggacttatggaaaagatggttgaggagtcagatgaagaggtctgcttatcctcactcgagtgcctgcggaaccagtgttttgatctggctaggaagctgtctgagacaaaccctcaggaaaggaacccgcagcagaacatgaacatccgacagcatgtccggccagaagaagacttcccagggagaacccctgatcgcaattattcggacatgctcaacttgatgcgactcgaggagcaattatcacctcgcagtagggtgtttgcatcttgcgcaaaggaggacggttgccacgaaagggatgatgatactaccagtgtcaactccgaccgatcagaagaggtgttcgacatgacaaagggaaacttgaccctgcttgaaaaggctattgccctggagaccgagcgggctaaggccatgcgcgagaaaatggctatggaggctggcaggagggacaatatgaggagctacgaggatcaatcaccccgtcagctgccaggcgaagatcgcaagccaaagtccagcgactcacacgtgaaaaaaccatattacggcaaagatccgagccgtaccgagaagaaggagtccaagtgccctacgcctggttgtgacggcaccggccacgttaccggcctgtatccacatcacagatccctctccgggtgccctcacaaagatagagtgccccctgagatcctggctatgcacgaaagtgtcctaaaatgtccgacacctggatgtacggggagaggtcacgtgaactcaaacaggaattctcataggtcgttgagcggatgccctatcgcagccgcagagaaacttgcgaaagcccaggaaaaacatcagagctgcgacgtgtctaaatctagccaagcgtcagatagggtcttaagaccaatgtgcttcgtgaaacaactggagattccacaatatgggtaccgcaacaatgtcccgacaacaaccccaaggagcaatctggcaaaagagctcgagaaatatagtaagacctcgttcgagtataactcttacgacaatcacacttatgggaaacgagctattgcgccaaaggtgcaaacccgggatatatctcctaaaggatacgatgatgcgaaaagatactgcaaggatccttctccctcctcttcatcgacctctagctacgcaccatcatccagctctaacctgagttgtgggggtggctcctccgcatccagcacctgctcgaaaagcagctttgactacacccacgatatggaagccgctcatatggcagccacggccatcctgaacctgtctaccagatgtcgcgagatgccccagaacttgagcacaaagcctcaggacctgtgtgctaccaggaatcccgatatggaagtggacgaaaacggaacacttgacctttctatgaataagcagaggccgagggattcttgttgtcccattctgaccccactagaacctatgtctcctcagcaacaggccgtgatgaataataggtgctttcagctgggagagggggactgctgggacttaccggtcgactacacaaagatgaaaccccgaagaatcgacgaggatgaaagcaaagacatcacacccgaagatctggacccgtttcaagaggcccttgaggagcgccgataccccggagaggtgaccatcccttctccgaaacccaagtaccctcagtgtaaagagagcaagaaggatctcatcacactgagtgggtgcccgctcgccgataaatctatcagatccatgctcgctactagctctcaggagctcaagtgtccaacccccggttgcgatggatccggacatatcaccggcaactatgcaagtcacaggagcttgtcaggttgcccccgagcgaaaaaatccggaatccgtatagcacagtccaaggaggacaaggaagaccaagagcctataaggtgtccagtcccaggatgtgacgggcagggccatatcaccgggaagtacgcgtctcaccggagcgcatctggctgccccctggcagccaaacgacagaaagacggctatctgaatgggtctcagttctcatggaagtccgtgaaaactgagggtatgtcttgccctacacctggatgcgatggttcaggtcatgtgtccgggagcttcctgactcatcgaagcctgagcggctgtcctagagctacctctgccatgaaaaaagccaaacttagcggcgaacagatgcttaccattaaacagcgcgcttctaacgggattgagaacgatgaagaaatcaagcagctggatgaggagattaaagagctcaatgagtccaactctcaaatggaagccgatatgatcaaactacgcacccaaatcaccactatggagtcaaacttgaagactattgaagaggaaaataaggtgatcgaacaacagaatgagtccctgctgcacgaactggcgaatctgtctcagtctctgatccacagcctagccaacatacaactgccacatatggatccgatcaacgagcaaaactttgatgcatacgtaaccacccttacagagatgtacacaaaccaagatagataccagagtcctgagaataaagcactcctggagaacatcaagcaagccgtgcggggtatccaggtgtag

SEQ ID NO: 231388 - DNA, 555 bp, Artificial Sequence
  Description of Artificial Sequence: Synthetic coding sequence
atgtcatgccctactcctgggtgtgacggctcaggccatgtttctggctcatttttgacccataggtcactctcaggatgccctagggctactagtgctatgaagaaggccaagctgagtggagagcaaatgctgaccattaagcagcgggcaagcaacggaattgaaaacgacgaagaaataaagcagttagacgaagaaataaaggagcttaatgagtctaacagtcagatggaagcagacatgatcaaactgcgaacacaggtcactatcactaccatggagagtaacctcaaaacgatagaggaagaaaataaagtcatcgaacagcagaatgagagtttactccatgagctcgccaatctgtcgcagtcactgatccactctttggctaacatccagctaccccatatggaccctattaatgaacaaaattttgatgcctatgtcactacacttacggagatgtacacaaaccaggataggtaccaatcccccgagaacaaagctttacttgagaacatcaagcaagccgttcgcggtatccaggtgtag

SEQ ID NO: 231389 - DNA, 3555 bp, Artificial Sequence
  Description of Artificial Sequence: Synthetic coding sequence
atggaggtcgacacagaagagaaacgacaccgcactaggagtaagggagtcagggtccctgttgaaccagctattcaggagcttttctcctgtccaacacctggctgcgatggctcgggccacgttagcggcaagtacgcgcgacataggagcgtgtatggatgtccccttgccaaaaagagaaagactcaggacaaacaaccacaggagccagcccctaagaggaagccctttgccgtcaaggccgacagctccagcgtggacgagtgtgacgacagcgacggaactgaggatatggatgagaaagaggaagacgagggcgaggagtactccgaagataacgacgaaccaggggatgaggatgaggaagacgaggagggggaccgcgaggaagaggaggagattgaggaagaggatgaggatgatgacgaggacggggaggatgtggaagacgaggaagaggaagaggaggaggaggaggaggaagaggaggaagaggagaatgaggaccaccagatgaattgccacaacacccggattatgcaggacactgaaaaggacgataataacaacgacgagtacgacaactatgatgagctggttgccaagagcctgctgaatctggggaagatcgcagaggacgccgcttatagagccaggaccgagtctgaaatgaacagtaacactagcaatagtctggaagacgactcagacaaaaacgaaaatctgggtaggaaaagcgaactgtctcttgaccttgattcggacgtggtccgcgagaccgtggactcattaaaactactggctcagggacatggcgtggtgctgtccgagaatatgaacgaccgaaattacgccgactctatgtctcaacaggattcccgcaatatgaactatgtgatgcttgggaaacccatgaacaatggactcatggagaagatggtcgaggaatcagacgaggaagtttgtctgtcctctctcgagtgcttgcgcaaccagtgttttgaccttgcacgcaaactcagtgagaccaatcctcaggagcgtaacccccagcagaacatgaatattcgccagcatgtacgaccagaagaggactttcccggtcggacccccgaccggaactattccgatatgcttaacctcatgcggctggaggagcagttgtcacctcggtcccgggtctttgccagttgcgcaaaggaagacggatgccacgagcgagatgatgacaccacatctgtgaacagcgatagatcagaggaagttttcgatatgaccaagggcaacctaactctgctagagaaagctattgcattagaaacagagcgtgctaaagctatgcgggagaagatggcaatggaggcagggcgtcgggacaatatgaggagttacgaggatcagtccccccgtcagttaccaggtgaagaccgaaagccaaagtcttcagacagtcacgtcaagaaaccatattacgacccgagtcggaccgaaaagaaagagagcaaatgccctacgcctggctgtgacggtactgggcacgtgacaggtctttacccccaccatcgaagcctttcgggctgccctcataaagaccgggtgcctcccgagatcctggcgatgcacgagtccgttctgaagtgcccaacacccggatgcaccggccgtggtcacgtgaattccaataggaattcacacaggtcattaagcgggtgtccgattgcagccgcagagaaactggccaaggctcaggagaaacaccagtcttgtgatgtctccaagtcatcacaggcttctgaccgtgttcttcgtcctatgtgtttcgtgaaacagctggagattccacagtacggttatagaaacaacgttccaactacaacacctaggagcaatctggccaaagagctagagaaatactccaaaacctcttttgagtataacagttacgacaaccatacctacggcaaacgagccatcgcccctaaagtgcagacaagagacatctcccccaaagggtatgatgatgcaaagagatactgtaaagacccctctccatcctcttcttctacgtcttcatatgctcctagctcctcttctaaccttagttgcggagggggtagttcagcatcgagcacctgttctaagtcatccttcgattacactcatgatatggaggctgcccacatggcagccaccgccattcttaatctgagtactaggtgtcgagaaatgcctcaaaatctctcgacaaagccacaggatttatgtgccaccaggaacccggatatggaggtcgacgaaaatggtacactggatttgtcaatgaacaagcagcggccacgggacagttgctgccctattctgacgcctcttgagcctatgtccccacagcagcaggcagtgatgaacaacagatgcttccagctcggcgagggcgactgctgggaccttcccgtcgactataccaaaatgaaaccaagacgaattgacgaggacgagagcaaagatattaccccagaagatttagatccctttcaggaagcactggaagagcggagataccccggtgaagtgacaataccatcccctaagccaaaatatccccaatgcaaagagagcaagaaggatctgattacactttcgggctgtcctttggctgacaagagtatcagaagcatgctggccacctccagtcaggagctgaagtgtccaacgccagggtgcgatgggagcggtcatattacgggtaattatgcctctcaccgtagtttgagcgggtgtcctcgggcaaagaagtcggggattcggattgctcagagcaaagaggataaggaagatcaggaacctatacgttgtccagttcccggttgcgacggccaggggcacatcacaggaaagtatgctagtcatcgcagtgcctcgggctgcccgctggccgcaaagcgacaaaaagatgggtacctcaatggctcccagttctcttggaagagcgtcaaaaccgaaggtatgtcttgtcccactccaggatgcgacggctccgggcatgtctctggaagctttctgacacaccggagcttatcaggctgtccacgggctacctccgcgatgaagaaagcaaaactaagtggagagcaaatgcttaccattaagcagcgagccagcaacggcatagagaatgacgaagaaatcaaacagctcgacgaagaaatcaaagaactgaacgaaagcaatagccagatggaggctgatatgatcaagttaagaacccagattacaaccatggagtccaatctgaaaacaatcgaagaggagaataaagtcatcgagcagcagaatgagagtctcctgcacgagctggcaaatcttagtcagagcctcatccacagtctggccaatatccagctccctcacatggatcccataaatgaacagaacttcgatgcgtacgtgaccacgctaacagagatgtatacgaatcaagacaggtaccaaagcccggagaataaagccctgctcgagaatatcaagcaggccgtgagagggatccaagtctag

SEQ ID NO: 231390 - DNA, 552 bp, Artificial Sequence
  Description of Artificial Sequence: Synthetic coding sequence
atgagccagaaacctgctaaagagggcccacggctttcaaaaaaccagaagtactccgaacacttttcaatccactgttgtcctccctttacatttctcaattctaagaaagagatagtagacagaaaatactccatatgcaagtctgggtgtttctaccaaaagaaggaggaggactggatttgctgcgcctgccaaaagaccaggacctcccgcagggctaagagtccccaacgtcccaagcagcagcccgctgccccacccgcagtagtgcgggcaccggctaagcctcggtcccctcctcgaagcgaacggcagccacgctctccccctagatccgagagacagcctagatcgcctcctcgatctgaaagacagcctcggagtccaccaaggtccgaaaggcaacctcgcccaagacccgaggtcagaccacctcctgctaagcagcggccacctcagaagtcaaagcagcaaccacggagtagtccactgagaggccctggggcttcacgaggtggctcccctgttaaagcatccaggttttggtag

SEQ ID NO: 231391 - DNA, 246 bp, Artificial Sequence
  Description of Artificial Sequence: Synthetic coding sequence
atgagccaaaaacccgctaaggaaggcccacggctgtcgaagaaccagaaatattccgaacacttttctattcattgctgcccccctttcaccttcttaaactcgaagaaggaaatcgtagaccgcaaatactcgatctgtaaatcggggtgcttttaccagaaaaaggaggaggactggatatgttgtgcatgccagaagacgcgcctgaagaggaagattcggcctacaccgaaaaaaaagtag

SEQ ID NO: 231392 - DNA, 246 bp, Artificial Sequence
  Description of Artificial Sequence: Synthetic coding sequence
atgagtcaaaagccggctaaggaaggtccacgcttgtctaagaaccagaaatatagtgaacactttagcattcactgctgtccaccgtttacctttcttaattctaagaaagaaatagtagatcgtaaatattcgatatgcaaatcagggtgtttttaccagaaaaaggaagaggactggatctgttgtgcttgccagaagacgcgcctcaaaagaaaaataaggcccacgcctaaaaaaaagtag

SEQ ID NO: 231393 - DNA, 246 bp, Artificial Sequence
  Description of Artificial Sequence: Synthetic coding sequence
atgtcacaaaagcccgcaaaggaaggccctagacttagtaagaatcagaaatactcggagcacttcagcatccactgttgccctccattcacctttttgaattccaagaaagagattgttgatagaaaatacagtatctgcaaaagcggctgcttctaccagaagaaggaggaagactggatttgctgtgcctgccaaaagacacgtttaaaacgaaagattcgacctacccctaagaagaagtag

SEQ ID NO: 231394 - DNA, 552 bp, Artificial Sequence
  Description of Artificial Sequence: Synthetic coding sequence
atgtctcaaaaaccagccaaggaggggccaagattgagtaaaaaccagaaatactctgaacactttagcatccattgttgcccaccattcaccttcctaaactccaaaaaagagatcgttgatcggaagtattccatctgtaagtcaggctgtttttatcaaaaaaaggaagaggactggatctgctgcgcttgtcagaaaaccaggacgtctagacgcgctaaatccccgcagcgtcccaaacagcagcctgccgcaccaccagctgtggtccgcgctccagccaagccccgttctcctccccgttcagaacgccaacccaggtctccccctcgaagcgaaaggcaaccacggagcccaccccgttctgaaaggcagccacgttccccaccccgaagcgaaagacagcccaggccccgtcctgaggtgcgtcctcctcccgcaaaacagcgtccccctcaaaaatctaaacagcagcctcgttcctcaccgctccgcggtcccggtgcttcaaggggagggagtcccgttaaagcctctcgattttggtag

SEQ ID NO: 231395 - DNA, 552 bp, Artificial Sequence
  Description of Artificial Sequence: Synthetic coding sequence
atgtcacagaaaccggctaaggagggaccacgcctgtctaaaaaccaaaaatactccgagcacttctccattcactgctgccccccatttaccttccttaacagtaagaaagaaattgtagatcggaaatacagcatctgcaagtctggctgtttttatcagaaaaaagaggaggattggatttgttgtgcctgccagaagacaaggactagccgcagagccaaatcccctcagagacccaaacagcagccagccgctcccccagccgtggtgagggcccctgcaaagcctaggagcccccctcgtagcgagcgacaaccgcgaagccctccaaggtccgagcggcagccacggtcaccaccgcgatccgagcggcagcctcgttctccacctcggtctgagcgccagccaaggcctaggcctgaggtacgcccacctccagcgaagcagcgccctcctcaaaagagcaaacagcaacctcgttcatcccccctcagaggcccaggagcgagccgcggaggaagccccgtcaaagctagccggttctggtag

SEQ ID NO: 231396 - DNA, 246 bp, Artificial Sequence
  Description of Artificial Sequence: Synthetic coding sequence
atgtcccaaaagcctgcgaaagagggccctcgcctgtctaagaaccagaagtactcagaacacttttccattcattgctgtcctcctttcacctttttgaatagcaaaaaggagatagtggacagaaagtattctatctgcaaaagcggctgcttctaccaaaagaaggaagaagactggatctgctgtgcttgccagaaaacccgtcttaaaaggaagatacgtccgacacctaaaaagaagtag

SEQ ID NO: 231397 - DNA, 552 bp, Artificial Sequence
  Description of Artificial Sequence: Synthetic coding sequence
atgagccagaaacctgctaaggagggtccacggctgtctaagaatcagaagtactcggagcatttttccattcattgttgtccacctttcacattcctgaacagcaagaaggagatcgtggatcgcaagtatagtatttgtaagtcagggtgcttttaccaaaagaaagaggaagactggatatgttgtgcgtgccagaagactagaacgagtaggcgggcaaagagcccccaacgcccaaagcagcaaccggctgcaccacctgccgtcgtccgcgcaccagcaaagcctagatctccgccacgaagcgaaagacaacctcggtcaccccctcgtagcgagcgacagccacgatcaccacccagaagtgaaagacaacctcgtagcccccctagaagtgaacgccagccccgaccgaggcctgaagtcaggccccctcctgccaaacagcgcccaccgcagaagagcaagcagcaacctagatcatcccccctgagggggcctggagcttctaggggaggctcaccggttaaggcttcccggttttggtag

SEQ ID NO: 231398 - DNA, 246 bp, Artificial Sequence
  Description of Artificial Sequence: Synthetic coding sequence
atgtcccagaaacccgctaaggagggcccacggctatccaagaaccagaaatattctgaacatttctcaatccattgttgtcccccattcacatttctaaatagcaagaaggaaatcgttgatcggaaatactctatatgcaaatccggttgtttctaccagaaaaaggaagaggattggatttgttgtgcctgccagaagacccgcttaaaacgcaaaatccggccaactcctaaaaaaaagtag

SEQ ID NO: 231399 - DNA, 177 bp, Artificial Sequence
  Description of Artificial Sequence: Synthetic coding sequence
atgagtcagaagccggctaaagaaggtcctcggctgtctaaaaaccagaagtattccgagcacttcagtattcactgttgtcctccctttacttttctgaacagcaaaaaggagatagtcgaccgcaagtattctatatgtaaaagcgggtgtttttatcaaaagaaggaagagtag

SEQ ID NO: 231400 - DNA, 423 bp, Artificial Sequence
  Description of Artificial Sequence: Synthetic coding sequence
atgctacaggccgcagactttatagagcggacagagacggcgggagagctctctcggggactgattggagtgctgtctagccagatttcatggtgcctgctgaacgtgaacctgtcaaaactgcctactcgcttgcaacgcctcagttgttcagtgctaaattcaagtcccgctatgcggggaggcgcaagagggagaccgcagctgacattggagagacctctgcgtcctggatgccggttgcattcatgtagcgaggcagagaaggggggatttgtccgtcgtaaagagatcatactgttcccaccttgcgaggatccagcgcgagggtggctgtctgcaaatccagggagagagccatcccctggaatctgttggcacctcaatctaggactgccttccctgcacaattgtgaggagtag

SEQ ID NO: 231401 - DNA, 816 bp, Artificial Sequence
  Description of Artificial Sequence: Synthetic coding sequence
atgtttggtctcaagagaaacgcggtaattggcctcaatttgtattgcgggggagcaggcttgggtgctggctccggcggtgccacaagacccggtggtcgtctgctggccaccgaaaaagaggctagcgccagaagggaaatcgggggaggggaagcgggagcagtaattggcggaagtgccggagccagcccaccatctactctgacccctgactctcgtagggtggccagacctccgcctataggcgcagaggtacccgacgtgaccgccacgcccgctagactactgttcttcgccccaacaaggagggctgccccactcgaggagatggaagcacctgcagctgatgctataatgtccccggaggaggaactggacggttatgagccagagccattggggaaaagacctgcagttctacccctgctggagctggtcggagagtctggaaataacacttcaacagacggctcactgccgagcacccctcccccagccgaagaagaggaagacgaactgtacagacagtccttggagatcatcagtagatatctgcgcgagcaagccaccggcgctaaggacactaagcccatgggccgtagtggcgcaaccagccgcaaggctttagaaacactgagacgagtcggtgacggcgttcagcggaatcacgagaccgcattccagggctgggtgtgcggggtgttgccatgtcgcggtccacggagatggcatcaggaatgcgcggctggtttttgccggtgttgttggtccagatcatggttcggcatctccaacaaaatcgcactcttgtag

SEQ ID NO: 231402 - DNA, 1053 bp, Artificial Sequence
  Description of Artificial Sequence: Synthetic coding sequence
atgttcggcctgaagagaaatgccgtgatcggactgaacctgtactgcggaggcgcagggctgggcgctggatcgggaggagcgacacgccctggcggtcgactcctggctaccgaaaaagaggctagcgccagacgggaaatcggcggaggggaggctggcgctgtaattgggggatccgcgggtgcctctcctccttcaacactgaccccagacagccggagggtggcacgacccccacccattggtgccgaggtacctgatgtgacagctactcctgctaggctgcttttctttgctccaacacgcagagccgctccccttgaggaaatggaagcacccgcagcagacgctattatgtcccctgaagaagaattggatgggtacgagccagagcccctcggaaaacgacctgcggtgttgcccctcctggaattggttggcgaaagtggcaataatacctcgaccgacggatcgttgccaagcactccaccacccgcagaggaagaagaagatgagctgtaccggcaatctctggagatcatatctcgatacttgcgagaacaggcaaccggagcgaaggacacgaagccaatgggcagaagcggcgctacgagccgcaaagcattggagaccctgcggcgagtcggagatggcgttcagaggaaccacgagacggcctttcaggggatgctccgcaaactggatataaaaaacgaggacgacgtgaagtcgctaagtagggtgatgattcacgtgttctccgacggagtgactaattggggcagaatagtcaccctcatctcgttcggcgcattcgttgcgaagcatctcaagactattaaccaggaatcatgtattgaaccgctggcggaaagtatcacagatgtgctcgtgagaaccaagagagattggctggtgaagcagaggggctgggatggcttcgtggagtttttccacgtagaggacctcgagggagggatcaggaacgttctcctcgccttcgcaggtgtggccggagtaggggcaggactcgcctaccttattcgatag

SEQ ID NO: 231403 - DNA, 840 bp, Artificial Sequence
  Description of Artificial Sequence: Synthetic coding sequence
atgttcggtctgaagagaaatgctgtgattggcctgaacctgtactgtgggggtgccggactaggcgctggatcagggggagctacgaggcctggcggtaggcttctggcgactgaaatggaagcccctgcagctgatgccattatgtcaccagaggaagagctggatggctacgagcccgaaccactgggaaagcggcctgcagtactccccctacttgagcttgtcggtgagagcggaaacaacacttctactgacggcagtcttccgagtacgcctccacccgcagaggaggaggaggatgaactgtatcggcagtccctcgaaatcattagccggtatcttagggaacaggcaaccggtgcaaaagacaccaagcccatgggcagatccggggctacaagccgcaaagccctagagactcttagacgcgtgggggacggggtccagaggaatcatgagaccgctttccaggggatgttacgaaaattggatatcaaaaatgaagacgacgtgaagagcttgtcaagggtcatgatccatgtcttttccgacggagttacgaactggggcaggatagttaccttaatatccttcggggctttcgtggctaagcacctcaagaccatcaaccaggaatcatgcattgagccacttgcggaatctataactgatgtgctggtccgcaccaagcgggattggttagttaaacagagaggctgggacggctttgtggagttttttcatgtcgaggacctagaagggggtatacggaacgtactgctggctttcgccggagttgccggagttggggcaggattagcgtatctcatcaggtag

SEQ ID NO: 231404 - DNA, 1224 bp, Artificial Sequence
  Description of Artificial Sequence: Synthetic coding sequence
atggtgaatgagtataagaaaattctgctgctcaaggggttcgagctgatggatgactatcatttcaccagcataaagtcactcctggcctacgatctgggcttgaccacaaagatgcaggaagagtacaataggattaaaatcacagacctgatggaaaaaaaattccagggagtggcctgtttagacaagctgatcgagcttgctaaggacatgccaagcctgaaaaatctggtcaacaatctgaggaaggagaaaagcaaggtggctaagaagataaaaacgcaagagaaggccccagtgaagaaaataaatcaggaagaagtgggtcttgcggctccggcacctactgcgaggaataagctaacgtccgaggctagaggccgtatcccagtggcacaaaagcgaaagacccctaataaagaaaagacagaggcaaagcgcaataaggtgagtcaagagcaaagcaagccccctggaccatcgggcgcatcgacaagtgccgctgtggatcatcccccactgccacagacaagctcgagtactcccagtaacacatcctttaccccaaaccaggagactcaggcccaacggcaggtggacgcccgacggaacgtgccccagaacgacccagtgactgtggtagttttgaaggctaccgcgccatttaagtacgagagccccgagaacggtaagtctacaatgttccacgccactgtggccagtaagacccagtatttccatgtgaaagttttcgacattaacctgaaagagaaatttgtgagaaagaaggtaattacgatttctgactatagcgaatgcaaaggggtcatggagattaaggaagcatcctcggtctccgactttaatcagaatttcgaggtcccgaacaggataatcgagattgccaacaagacccccaaaatatctcagctgtataagcaggccagcgggaccatggtatatggtctgttcatgttgcagaagaagtcagtccacaagaagaacacgatttatgagatccaagacaacacaggcagcatggatgtagtgggatcggggaagtggcataacattaaatgcgagaaaggggacaagctaagactgttctgcctgcagctccgcacagtggaccggaaacttaaactggtgtgtggaagccattcattcattaaggtgattaaggcaaaaaaaaataaggaaggacctatgaatgtgaattag

SEQ ID NO: 231405 - DNA, 315 bp, Artificial Sequence
  Description of Artificial Sequence: Synthetic coding sequence
tagccaaaccggattattgaaattgcaaacaaaactccaaagatcagtcagttgtacaaacaggcctccgggacaatggtgtacggcctctttatgttgcagaaaaaaagtgtccataagaaaaatacaatatacgaaatccaagacaacaccggtagtatggatgtggtgggcagcggtaagtggcacaacatcaagtgtgaaaagggggacaaactaaggcttttctgtcttcagctccgcacagtggaccggaagttaaagttagtgatcaaggcaaaaaagaataaagagggaccgatgaatgtgaattag

SEQ ID NO: 231406 - DNA, 795 bp, Artificial Sequence
  Description of Artificial Sequence: Synthetic coding sequence
atgcgtccggatagagccgaggcccctggccctcctgccatggccgcaggtggacctggagccggtagcgccgctcctgtgtcttccaccagcagtcttccattggctgctttgaatatgagagttagaaggcgacttagcctgtttctcaacgtcaggactcaagtggctgccgattggacagccctcgctgaggagatggactttgaatatctggagattcggcagttggaaacccaggctgaccccactgggcgacttctcgacgcctggcagggtagaccaggcgcttctgtaggaagactgctcgaactcctgactaaactggggagagatgacgtcttgctggagctggggccaagcattggtcacatgccagaaaggtttgacgccttcatttgctattgtcccagtgacattcagttcgtgcaggaaatgataaggcagttggaacaaacgaattataggcttaaactttgcgtgagtgatcgggatgtgctcccgggaacctgtgtgtggtcaattgcaagcgagctcatagagaagcgctgccggaggatggtggtggtagttagtgatgactacctgcagtctaaggagtgtgatttccagaccaagttcgctctctccttatctcctggagctcaccagaaaaggctcataccaataaaatataaggcgatgaaaaaggagtttccatcaatcctcagatttattacagtctgtgattacactaacccatgtaccaagtcctggttttggactaggctcgctaaggcgctgagtctcccctag

SEQ ID NO: 231407 - DNA, 615 bp, Artificial Sequence
  Description of Artificial Sequence: Synthetic coding sequence
atgcgtcctgaccgggcagaagcccctgggcctccggcaatggccgctggtggcccaggagcaggctccgccgcacccgtgagctcaaccagctctttgcccctggccgcattgaacatgagagtccgcaggcgactgagcttattcctgaacgtgcgcacccaggtagccgcagattggactgcgcttgctgaagagatggatttcgaatacctggagattaggcagctcgagactcaggcagatccaaccgggagactgttagatgcgtggcaagggagacctggtgcctcagtgggcaggttgttggagctgctgaccaaacttggcagagacgatgtgttactggaattgggcccttctatcgaagaggattgtcagaagtacatactgaagcagcaacaggaggaggcagagaaacctctgcaagttgctgcagtcgatagtagtgtacccagaacagccgaacttgccggaatcactacactggatgatcctctgggtgcagccggatggtggtggttgtctttgatgatcacatgcagagccaggaatgtaacatctcggccaaacctccactcggctagtctgcaggtgccgataagaagcgattag

SEQ ID NO: 231408 - DNA, 480 bp, Artificial Sequence
  Description of Artificial Sequence: Synthetic coding sequence
atgcgacctgaccgtgccgaggccccaggacctccggcaatggcggctgggggaccaggtgccggatctgcggctcctgttagttctacctcatcattgccgctggcagctctcaacatgcgtgtaagacgccgactatctctattcctgaatgtccgcacgcaggttgcagcagactggactgcactggccgaggaaatggacttcgagtatctggagatccggcagcttgaaacacaggccgaccctactggtcgccttctggatgcatggcaggggaggcccggagcaagcgtcggccgtctgctcgagctgcttactaagttaggtcgcgacgatgtgcttttagagctgggtccatcaataggggcagcgggttggtggtggctgtccttgatgatcacgtgcagagcacgcaacgtgacctctcgacctaacctgcattccgcctccctgcaggtgcccatccgcagcgattag

SEQ ID NO: 231409 - DNA, 807 bp, Artificial Sequence
  Description of Artificial Sequence: Synthetic coding sequence
atgtttcggatgcttaacagtagcttcgaggatgatccatttttctctgagtcaatcctggcacacagagaaaatatgcgccagatgatcagaagcttttcggagcctttcggtagggacctcctttcaatctccgatggtcgcggacgcgcacataacaggcgagggcacaacgacggggaggattctttgacacacaccgacgtgtccagttttcagacgatggatcaaatggtgtctaatatgaggaactatatgcagaaactcgagcggaatttcgggcaactgagtgtcgacccaaacggacactcattctgttccagttctgtcatgacctatagcaaaattggcgatgaacctccgaaagtgttccaagcatctacccagacacgcagggccccaggcggtatcaaagagacaaggaaggccatgcgcgactctgatagtggcctggaaaagatggcgattggacaccacatccatgaccgagcccatgtcatcaaaaaaagtaaaaacaaaaagacgggcgacgaagaggtgaatcaagagttcattaatatgaacgaaagcgatgcccatgcttttgacgaagagtggcagtcagaagtcttaaaatacaaaccaggacggcacaacctgggcaacactcgtatgaggagcgtggggcacgagaatccgggatcaagagaactgaagcgtagggagaagccccagcagagcccagccatcgagcacgggcgacgctctaatgttcttggggataaactccacataaagggaagtagtgtcaaaagcaacaagaaatag

SEQ ID NO: 231410 - DNA, 732 bp, Artificial Sequence
  Description of Artificial Sequence: Synthetic coding sequence
atgaggcaaatgattaggtcattttccgaaccctttggcagggatctgctgagcatttctgatggaagggggagggcccataaccgcagaggccataatgacggggaagactcacttactcatactgacgtatcatcttttcagacgatggatcagatggtgagcaatatgaggaattatatgcagaaactcgagcggaatttcgggcagctgtccgttgatccaaacgggcactccttttgcagcagctcggtcatgacatatagtaagatcggagacgagcccccaaaagtgttccaggccagcacccagaccaggcgcgcacccggagggattaaagagaccaggaaggccatgcgcgacagcgattctggccttgagaaaatggctatcgggcatcatatacatgatcgggcacacgtgatcaagaagagcaagaataagaagaccggagatgaggaagtgaatcaggagttcatcaacatgaatgagtcggatgcacatgcgttcgatgaagagtggcagtcagaagttctgaagtataaaccaggcagacacaatctcggcaatacacgcatgcggagtgtaggccacgagaaccctggaagcagagagctgaagcgccgagagaagcctcagcagagccctgctattgagcacggtaggcggagtaatgtgcttggggataagctgcacatcaaagggagtagtgttaagtctaacaagaaatag

SEQ ID NO: 231411 - DNA, 900 bp, Artificial Sequence
  Description of Artificial Sequence: Synthetic coding sequence
atgctcaaggaggtgttgcagcgagaaggtaagtcctataagagtgaaacacttatgtacattaaaaaggccagagccagtgaaaataagctctcggagtcgatcttggcacacagggagaatatgcgacagatgatccggagtttctccgagccttttgggcgagatctgttaagtatctctgatggacggggaagggcacacaataggcgcggacataacgatggagaagattcactgactgccacaagttgcagcctggtgccctttggggactttgggggaatgcacaccgacgtttcttccttccagacaatggaccagatggtatctaatatgcgtaactatatgcagaagctggagcggaattttggacagctgtctgtggatcctaatgggcactcattttgcagctctagcgtcatgacatactccaagatcggagacgaaccccctaaggttttccaagcatcaacgcaaactcgcagagcccctgggggtatcaaagagacgaggaaagcaatgcgtgatagcgacagtggactggagaagatggcaatcgggcaccacatacacgatagagctcatgttattaagaagagcaaaaataagaaaacaggagatgaggaagttaatcaagaattcattaacatgaatgagtctgatgcccacgcctttgacgaagaatggcagtctgaggtcctgaaatacaagcctggacggcataaccttgggaatacccgcatgagaagtgtcggccatgagaatccaggctcgcgggagctcaaacgcagggagaaaccccagcagagccccgcaatcgagcacggacgcagatctaacgttctcggggataaactccatataaagggatcttctgtgaagtccaacaaaaaatag

SEQ ID NO: 231412 - DNA, 777 bp, Artificial Sequence
  Description of Artificial Sequence: Synthetic coding sequence
atgagacagatgatccggtccttctctgaaccctttggcagagatctgctgagtatctccgacgggaggggccgtgcccataatcgaagaggtcataacgacggtgaggatagcctgaccgctaccagttgctctttagtgccatttggcgattttggaggaatgcataccgacgtctcatctttccagaccatggaccagatggttagcaacatgcgaaactatatgcagaagctcgaacggaatttcgggcagctctccgtcgacccaaatggtcattcgttttgtagctccagcgtgatgacttattctaagattggcgatgagccccctaaagtgtttcaagcttcaacccagaccagacgcgcacccggtggcattaaagagacacggaaagcaatgcgcgactcagatagcggtctggaaaaaatggccattgggcatcacattcacgacagggctcacgtaataaagaagtccaaaaacaagaagactggcgatgaagaggttaatcaggagtttatcaatatgaacgaaagcgacgcacatgcattcgacgaggagtggcagtctgaggtcctgaagtacaagcccggtcggcataacctgggaaatactcgcatgcgctcagtgggacatgagaaccccggatccagagagctgaagcggagagagaagccacagcaaagtcctgcaatcgaacacggtcggagatccaacgtcctgggggataagctgcacatcaagggatcctccgttaagtcaaataaaaaatag

SEQ ID NO: 231413 - DNA, 777 bp, Artificial Sequence
  Description of Artificial Sequence: Synthetic coding sequence
atgagacagatgattagatccttctcagagccatttggaagggacctcctcagcatctctgatgggagaggccgtgcacataaccgcagaggtcacaatgacggagaagactctctgacggcgacgtcttgttccctggtgccttttggtgactttggaggaatgcatacggacgtgagttcctttcagactatggaccagatggtgtccaatatgcggaactacatgcagaagctcgaacgaaatttcggacagctgagcgtcgaccccaacggacattctttttgcagcagttctgtaatgacttattcaaaaataggggatgagcctcccaaggtgtttcaagcatccacacagacaagacgagcacccggtggaatcaaagagacacggaaggctatgagggattccgatagcgggctagagaagatggcaattggtcaccacattcacgaccgagctcatgtgataaaaaaatccaagaataaaaagacaggagatgaagaggtgaaccaagagtttataaacatgaacgagagcgacgcccacgcattcgacgaagagtggcagtccgaggtgctcaaatacaaacctggcagacataacctcggaaacactaggatgcggtctgtgggccatgaaaatccaggcagcagggaactcaaaagacgagagaagccacaacagtcccctgcaattgagcatggacgcaggagcaatgtgttaggagacaaactccacataaaaggtagctccgtcaaatctaacaagaaatag

SEQ ID NO: 231414 - DNA, 732 bp, Artificial Sequence
  Description of Artificial Sequence: Synthetic coding sequence
atgcgccagatgattcggtcattctcggagcctttcgggagggacctcctgtctatctcagacggtcggggaagggcgcataacagacgcggtcacaatgacggtgaagactccttaacccacacagatgtaagctctttccagactatggaccagatggtgagtaatatgcgaaactatatgcagaagctggagcgcaattttggccagttatcagtcgaccccaacggacactccttttgcagctcctctgtaatgacgtactcaaagatcggcgatgaaccccctaaggtgtttcaggcttctacgcagacaagacgggcaccgggagggattaaggagacccggaaggcaatgagggacagcgactcggggctggagaaaatggctatcggccaccatattcacgatcgcgctcatgttattaaaaaatccaaaaacaagaaaactggtgacgaagaggtcaatcaggaattcataaacatgaacgagtctgacgcccatgcctttgacgaggagtggcagtccgaggtcctgaaatacaagccagggcgacacaatctgggcaacacacgaatgcgaagtgttgggcacgagaaccctggatccagggagttgaaacggcgagaaaagccacaacaatcgcctgctattgaacatggcaggcgtagtaatgtgctgggtgataaactgcacatcaaagggtcttctgttaagagtaacaaaaagtag

SEQ ID NO: 231415 - DNA, 732 bp, Artificial Sequence
  Description of Artificial Sequence: Synthetic coding sequence
atgcgccagatgattaggagctttagcgagccgtttggacgggatctgctgtcaataagcgatgggaggggcagagcccacaaccggagggggcacaacgacggagaggattcgctgacccataccgatgtgtcttcctttcaaactatggatcagatggtgagcaacatgagaaactacatgcagaagctggaacggaacttcggacagctttccgtggatccgaatggtcatagcttctgctccagtagcgtcatgacatatagcaaaattggggatgaacctcctaaagtgttccaggcatcaacgcagactcggcgtgccccagggggtattaaggaaacccggaaggcaatgcgcgatagcgatagcggacttgagaagatggctatcggccaccacattcatgatcgcgctcatgtaattaagaagagcaagaataagaagaccggggacgaggaagttaatcaagagtttatcaacatgaatgagagcgatgcgcatgcattcgacgaggagtggcaatccgaagttctcaagtataaacccggaagacacaacctcggcaacactagaatgcggtcagttggccatgagaatcctggaagccgggagctgaaacgtagagaaaagccgcagcagagccccgctatagaacacggaaggcggagtaacgtgctgggtgacaagctgcatataaaggggagcagcgtgaagagtaacaaaaagtag

SEQ ID NO: 231416 - DNA, 603 bp, Artificial Sequence
  Description of Artificial Sequence: Synthetic coding sequence
atgagacaaatgatccgaagcttttctgagccttttggaagggatctgctgtctatctcagatggacgtggcagagctcacaatcgtagaggccacaatgacggagaagattcattaacccatacggatgtcagctccttccagacaatggaccaaatggtgtcgaacatgcgtaactatatgcaaaagcttgaacgcaatttcatcaaggaaacccgcaaagcaatgcgcgactctgactccgggcttgagaagatggctatcggtcaccatatacatgaccgcgcacatgtcattaaaaagtcaaaaaataagaagactggggatgaagaggtaaaccaggaatttatcaacatgaacgagtccgacgctcatgcctttgatgaggagtggcagagcgaggtgttgaaatacaagccgggacggcataatctgggcaacacaaggatgagatcagtgggccacgagaacccaggaagtcgggaacttaagcgaagagagaaaccccagcaatcccccgctatagagcacgggaggcgatccaacgtgttgggcgataagctgcatatcaaaggcagtagcgtcaagtcgaacaaaaagtag

SEQ ID NO: 231417 - DNA, 747 bp, Artificial Sequence
  Description of Artificial Sequence: Synthetic coding sequence
atgtttcggtttatgcgggacgtggaacctgaggatccgatgttcttgatggacccatttgctatccaccggcaacacatgagtagaatgctgagcggcggatttgggtatagccctttcctgtctataacagacggaaatatgcctggaacgcggccagccagtagaaggatgcagcaagcgggagccgtgtctccattcggtatgcttggcatgtccgggggattcatggacatgttcgggatgatgaatgatatgataggaaacatggaacacatgacagccggaggcaattgccagactttctcctcgagtactgtaatatcctactctaacactggcgacggcgcacccaaggtctaccaggaaacatccgaaatgcgcagtgcacccggaggcatccgggaaaccagacggaccgtccgggacagcgatagcggcctcgaacagatgagtattggccatcacataagggatagggcccacatcttacaacgtagccgcaatcacagaaccggggaccaggaagagaggcaggactatataaatctggacgaaagcgaagcagcagcatttgacgatgaatggaggagagagacgagtcggtttaggcagcagaggcccctggaatttaggcgcctcgagtcctccggtgctggagggcgaagagctgaaggtcccccacgattagcaattcaagggcctgaggactccccttctcggcaaagccgtaggtatgactggtag

SEQ ID NO: 231418 - DNA, 747 bp, Artificial Sequence
  Description of Artificial Sequence: Synthetic coding sequence
atgttccggttcatgcgagatgtcgagcccgaagaccctatgtttcttatggacccttttgccattcatagacagcacatgagccggatgctttcaggcggattcggttattctccctttcttagcatcactgacgggaatatgccaggtactcgcccagcgtcccggaggatgcagcaggccggtgccgtaagcccctttggtatgttgggcatgagtggaggttttatggatatgtttggcatgatgaacgatatgattggaaacatggagcacatgaccgcaggcggaaattgtcagactttcagctcctcaacggttatttcgtactcaaacactggagatggcgctcctaaagtttatcaggaaacatccgagatgaggtccgccccaggcggaatcagggaaactcgacgcacagtgcgcgacagcgacagcgggttggaacagatgtctataggacaccacattagggatagggcgcacatactgcagaggtccagaaatcaccgaaccggggatcaggaagaaaggcaagactacattaaccttgatgaatctgaggctgccgcttttgatgacgaatggaggcgagagacgagccgcttccggcagcagcgtcctttagaattccgacggcttgagtccagtggagccggaggaaggagagccgaagggccaccgagactcgccattcagggcccagaggacagcccctccaggcagtcgaggagatacgactggtag

SEQ ID NO: 231419 - DNA, 747 bp, Artificial Sequence
  Description of Artificial Sequence: Synthetic coding sequence
atgttccgttttatgcgggacgtggaacccgaggatcctatgttcctgatggatccattcgcaatccaccgccaacatatgtccagaatgctcagcgggggatttgggtacagcccttttctttctataactgacggaaacatgcctggcacaaggcccgcaagcagacggatgcagcaggcgggtgcagtctcaccattcggaatgctgggcatgtctggagggtttatggacatgtttggaatgatgaacgatatgatcggcaatatggaacatatgacagccggtgggaattgccagaccttcagtagctccacagtaattagttattccaacactggtgatggcgctccgaaggtgtaccaagaaacttcagagatgcgctccgcccctggtggcattcgggaaacgcgtcgcaccgttcgcgattctgattccggattggagcagatgagcatcggacaccatattagggaccgagctcatattctccaacgatcacgaaatcacagaacaggcgaccaggaagagaggcaggactacatcaacttggacgaatccgaagcagccgctttcgatgacgaatggaggcgggagacctcccgctttcgccagcagcgcccactggaattcaggagactggagtcctccggcgctggcggtaggagggctgagggccctccaagattggctattcaggggccagaagattccccctctagacaaagtcgacgatacgattggtag

SEQ ID NO: 231420 - DNA, 747 bp, Artificial Sequence
  Description of Artificial Sequence: Synthetic coding sequence
atgtttagattcatgcgagatgttgaacccgaggaccccatgtttcttatggatcccttcgccattcaccgtcagcacatgagccgtatgctttcagggggattcggctatagcccctttttgagcatcactgacggaaacatgcccggtacccggccagcatcacggagaatgcaacaggcaggcgctgtaagccccttcggcatgctgggtatgtctggcggtttcatggacatgttcgggatgatgaatgacatgataggaaatatggagcatatgaccgcgggtggcaattgccaaacattttcgtcaagcacagttattagctatagcaataccggggacggcgcaccaaaggtctaccaagagacctccgagatgcgatccgccccaggtggcatcagggaaactcgccgaacagtgagagactccgattccggtttggagcagatgagcataggccaccacatcagggaccgcgctcatatcctccagagatcgaggaatcaccgcaccggtgatcaagaggaacggcaggattatatcaatcttgacgagtcggaggctgcagcctttgacgatgagtggcgcagggagaccagtcggtttagacaacagcggccactggagtttcggcgtttggaatcaagtggcgcagggggtcggagggccgaaggtccgcctcgattagccatacaaggcccagaggactctcctagccggcagagccggaggtacgactggtag

SEQ ID NO: 231421 - DNA, 684 bp, Artificial Sequence
  Description of Artificial Sequence: Synthetic coding sequence
atgatggccgctggtgctgcgttagcattagccttgtggttgctcatgcctccggtggaggtcgggggagcaggtccgccacccatccaagacggagagttcacatttctccttcccgctgggcgaaaacaatgcttctatcagtctgctcctgcaaacgcatctctggagacagaataccaagttatcggcggagcaggtttagatgtggattttactctcgagtcaccccagggcgtgttgctggtaagcgaatcacgcaaagcagatggagtccataccgtcgaacccacagaggccggagactataagctgtgcttcgataattcattctctactattagtgagaaacttgttttttttgaattaatctttgacagcctccaggacgacgaggaggtggaaggatgggccgaggccgtagaaccagaggaaatgctggatgtaaagatggaagatatcaaggagtcgatcgagacaatgcgaacacggcttgaacgctctatccaaatgctcactctcttgcgcgcttttgaggccagggatcgcaatctacaggaaggcaacctggagagggttaatttctggtccgcagtgaatgttgccgtgctcttgctcgttgctgttctgcaagtgtgcacactgaaacggttctttcaggacaagaggcccgttccaacttag

SEQ ID NO: 231422 - DNA, 873 bp, Artificial Sequence
  Description of Artificial Sequence: Synthetic coding sequence
atgcggccagctgtgcttggctcgccggatagggcacctccagaggacgaaggacctgtcatggtcaagctggaggattcggaagaggagggggaagccgctctatgggatcccggaccagaggctgccagactgagattcaggtgttttcgctacgaggaggcaacaggcccacaggaggccctggcgcaactacgagagctttgtaggcaatggctccgcccagaggtgagaagcaaggaacagatgctggaattattggtcttggagcagtttctgggggcactgccccctgagatccaggcacgcgtgcaggggcagaggccaggctctccagaggaggccgcagccctcgtcgatggactccggagagagccaggcggaccccgaaggtgggtcacagtgcaggtgcagggtcaggaggtgctttccgagaaaatggaaccaagctctttccagcccttgcccgagactgagccacctacccccgaacctggccctaagacccctccacggactatgcaggaaagccccctagggttgcaggtaaaggaagagtccgaggttacggaagattcagactttctcgaaagcggcccactggccgctacacaagaatcagttccaacactgctgcccgaggaggcccagcggtgcggtacagttctcgatcaaatctttccccatagcaagaccgggccagagggcccatcctggcgggagcaccccagggcactgtggcacgaggaggcagggggaatattttcacccggagctggcgcaggtgcagcccctgcccttggcgctggatggcttggagctgctgtcgctatgtacgttgcaaggtgttctgccaacgcagctacctgctag

SEQ ID NO: 231423 - DNA, 2205 bp, Artificial Sequence
  Description of Artificial Sequence: Synthetic coding sequence
atgagacccgcagtcctcggaagtcccgatcgggctcctccagaagatgaggggcctgtcatggtgaaactggaagattccgaggaggaaggcgaggctgccctgtgggaccctggaccagaggccgcaaggcttcggtttcgttgctttcgttatgaggaggccactggcccacaagaggcacttgcgcagctgcgagagctctgccgccagtggctacgtcccgaagtaaggtcaaaggaacagatgctggaactgctggtgctggaacaatttctgggcgcactgccacccgaaatccaggccagggttcagggccaacggcctggttctcctgaggaggcagcagctttagtggacggccttcgacgcgagccaggaggcccaagaaggtgggtcacagttcaggtacaaggacaggaggttctctctgagaaaatggaaccaagtagttttcagcccttgcctgaaacagagccaccgacgcccgaacccggtcccaaaaccccaccaagaacaatgcaggaatcccccttgggcctccaggtgaaggaggagtcagaagtgactgaagactctgattttctcgaaagtggacctctggccgcaacccaggaatccgtgccaacgcttctccccgaggaagcacagcggtgtgggaccgttctggaccagatcttcccccatagcaagaccgggccagaaggtcctagctggagggaacacccccgagcactgtggcatgaggaagctggcggtattttcagtccgggattcgccctccaactagggtccatatcggccggtccaggatcagttagcccacatcttcacgtgccgtgggatctggggatggcaggcctatctggacagatacagtccccaagcagagagggaggctttgcacatgctctgcttctgccatctgatctccgatctgaacaggaccccaccgatgaggacccgtgccgcggagtgggccctgccctgataacaaccagatggagatcacccagaggccgttcccggggacgcccatccacagggggtggggtggtaaggggcggacgttgtgacgtgtgtggtaaagtcttctctcagcgttccaacctgctacgccaccaaaagattcataccggagagcggcctttcgtttgtagcgagtgcggacgaagcttttctaggagctcccatcttcttcggcatcagctgacccatactgaggaaagaccatttgtttgtggggattgtggccagggattcgtccgatctgctcggctggaagagcaccgccgtgtgcacactggcgaacagcccttcagatgcgcagagtgcggccaaagcttccggcagaggagtaatctgctgcaacatcagcggattcatggtgatccccctggacctggtgcaaagccgccagccccaccaggggcaccagagcctcccggaccattcccctgttccgagtgtcgggaaagttttgctcgcagggcagtcctactcgaacaccaggcagttcacactggcgataaatcctttggatgcgtggaatgtggagaacggtttggcagaagatctgtcctcctacagcaccggagagttcatagtggcgaacgcccttttgcttgtgctgaatgtgggcaatcatttcgacagcggtcaaacctcacccagcaccgaagaattcatacgggggagaggcccttcgcatgcgctgaatgcgggaaagcctttcggcaacggcctaccctcacacagcacctacgcgtccacactggcgagaaacccttcgcttgtccagagtgtggacagaggttttcacagcggctcaagctcacccgacaccagagaactcataccggcgagaagccttaccactgcggcgagtgcggattgggatttacccaggtgtctcgactcaccgagcaccaaaggattcacactggagaacgtcctttcgcgtgccccgagtgcggacagtctttccgtcagcatgccaacctcacccagcaccgcagaattcacacaggtgagagaccctatgcgtgtccagaatgcggaaaagccttccggcagaggcccacattgacccagcacctgcggactcataggcgtgagaagccgttcgcctgtcaggactgtggtcgcagatttcatcagtctacgaaactgattcagcatcagagagtgcactccgctgaatag

SEQ ID NO: 231424 - DNA, 1539 bp, Artificial Sequence
  Description of Artificial Sequence: Synthetic coding sequence
atggctcattcctgtcgctggcggtttcctgctaggcccggaaccactggcggaggcggaggcggaggtaggcgcggtctgggcggagcccctcggcagcgcgtgcctgcactgctgctcccacctggccctccggtgggcggagggggtcccggagccccaccctctccaccagccgtcgccgctgccgctgcggcagccggttcctccggcgctggtgtccccggtggagcagccgctgcctccgccgcatcgagctcttcggcgtccagtagtagctctagctctagctccgcgtcaagcggtccagccctcctgagggtcggccctgggtttgacgccgctctgcaggtatctgccgctatcgggacaaacctgcgacgcttccgcgcagtcttcggggaatcaggaggcggtgggggttcaggggagttgaccacccaaattccctgttcctggagaacgaagggacatattcacgataagaaaacagagcctttcagactcctggcatggtcatggtgtctaaacgatgaacagttcctgggttttggctctgacgaggaggtgcgtgtgagatctcccacccgcagtccgagcgttaaaacatcccctcgcaagcccagggggcgaccaaggagcggcagcgaccgaaactctgccatcctgagcgatccgtccgtttttagccctctgaataaaagcgaaactaaatcaggtgataagatcaaaaagaaagattcaaagagtatcgagaaaaagcggggtagaccccctaccttcccaggagtgaaaattaaaattacccatggaaaggatattagcgaactccctaagggtaacaaagaggactcgctcaagaaaatcaaaagaacaccaagtgcgaccttccagcaggccactaagataaaaaaactaagagccggaaaactgagtccactgaaatcaaagttcaagaccggaaagcttcagatcggcagaaaaggggttcagattgtacggcgacgagggcgtcccccatccactgaacgcattaagaccccttccggactactgattaactccgaactggagaagcctcagaaagtacgtaaagacaaggagggaacaccacctttaactaaagaagataagactgtagttcgacaatcgcctcggagaattaagccggttagaatcataccgagttctaaaagaaccgacgccaccattgcgaagcagctccttcagagagccaagaagggggctcagaaaaaaatcgaaaaagaggcagcccaactgcagggccgaaaggtgaagacccaagtgaagaatatccggcagtttatcatgcccgtggtgtccgccatcagcagccggatcatcaagaccccacggagatttattgaggacgaggattatgaccctccaatcaaaatagccagactagagagtactcctaactctcggttttccgccccaagctgtggatccagcgaaaaatcctcagccgcatcccagcatagttcccagatgtcctccgattcgagccgatcttag

SEQ ID NO: 231425 - DNA, 11796 bp, Artificial Sequence
  Description of Artificial Sequence: Synthetic coding sequence
atggcccatagctgccggtggcgatttcctgcacgtcccggtaccacaggaggtggaggcggagggggacgccgtgggctggggggtgcacccaggcagcgtgttccagcactcctgcttcctcctggaccaccagtcgggggtgggggacccggtgcaccgcctagtccacccgctgtcgccgctgccgcagcagctgccggatctagcggtgccggagtccctggaggcgcagccgcagctagcgctgcaagcagcagtagcgctagctcctctagctcaagtagctcgagcgccagcagcggtcccgcactcttgcgcgttggacccggattcgatgccgcactgcaggtctctgctgccatcggaaccaatctccgtagatttcgtgccgtgttcggagaatccggtgggggtggcggatccggcgaagatgagcaattcctaggtttcggatccgacgaggaggttcgggttaggagccccacgaggtccccttcagttaagacaagcccgaggaagccacggggtcgtccacgctcgggcagcgataggaactccgcgatattgagtgatcctagcgtgttcagtcccctcaataaatccgaaaccaaaagcggcgataaaattaaaaagaaagacagtaaatctatcgaaaaaaaacgcggtcggcctcccacatttcctggcgttaagataaagatcacacacggcaaggatatttcagagcttcctaagggtaataaagaagacagtctcaagaagatcaaacgtacccctagtgcaacattccagcaggctaccaagatcaagaagctccgtgccggtaagctgtcgcctctcaaatccaaattcaagacaggtaagctgcaaatagggaggaaaggtgttcagattgtgaggaggcggggacgccctccatctactgagcgcatcaaaacacccagcggcctgctgattaatagcgagttggaaaaaccgcagaaggtaagaaaggataaggagggcactccaccacttactaaggaggacaaaaccgtcgtgagacagagccctcgccgaattaagcccgtccgcattatcccctcatccaagcgtaccgatgccacaatagctaagcagctgctccaacgagccaaaaagggcgctcagaaaaaaatcgaaaaggaggccgctcagctgcaggggagaaaggttaagacgcaggtgaagaatatacgccagttcatcatgccagttgttagcgcaatctcatctaggatcatcaagacgcccagaaggtttattgaggacgaggactatgaccctcctatcaagattgctcgcctcgagtctactcccaactcccggttttccgctccatcttgtgggagcagtgagaagagctccgccgcttctcaacacagttctcagatgagctcagactcaagcagatcgagttctcctagtgtcgacacatcaacagactcacaggctagcgaagagatccaagtactgccagaggaacgctctgatacgcccgaggtgcatcccccactaccaatctctcaatcaccagaaaatgagtccaacgacagaagatctagacgatattccgtcagcgagagaagcttcggttcaagaacaacaaagaagctttcaacacttcaatccgcaccacagcagcaaacctctagcagccccccacccccactgcttacacctcctccaccgctccagcctgcttcaagtatcagcgaccataccccttggctgatgccacccaccatccctctggctagcccatttctgcctgccagtactgcccctatgcagggcaaaagaaaatcgatccttagggaaccgactttcagatggactagcctaaagcatagcaggagcgagccccagtacttttcaagcgccaagtatgcgaaggaaggattgattcgtaaaccaatatttgacaatttccgcccaccaccgctgacccccgaagatgtgggatttgcgtccggcttctccgcctctgggactgccgcatccgctagactcttttcaccccttcatagcgggacacggtttgacatgcacaaaaggtccccccttttacgggcaccgcgatttacaccctccgaggctcattctaggattttcgaaagcgtgacgcttccatcgaaccggacatccgccggaacctcttctagcggcgtgtccaatcggaaacgtaagcgaaaggtcttctcccccatcagatccgaacccagatctcccagccatagtatgagaacaaggagcggccgactctcctcaagtgaactttctccgctgacgcctcccagttctgtgagctctagcctatctatttcagttagtcccctggccactagcgcactcaatccaacttttacattcccctcccattccctaacacagtcaggagaaagcgccgaaaagaatcaaagacctcggaagcagacatcagcaccggcagagcctttcagctcatcttccccaacgcctctattcccttggtttactcccggttcacagaccgagagaggtcgcaacaaagataaggccccagaggagctatccaaagatcgtgatgccgataaaagcgtggagaaagacaagtctagggagagggatcgggaacgcgaaaaggaaaacaaacgtgaatctagaaaggagaagcggaaaaagggtagtgagatccagagttccagcgcgctgtatcctgtgggcagagtttctaaggagaaagttgtgggcgaagatgtcgccacttccagctctgcaaagaaagccactggccgtaagaagagtagctctcacgatagtggcactgacatcacttccgtcactctcggagacaccaccgccgttaagaccaagatcttgattaaaaagggtcggggaaacctcgagaagacaaatctagacctcggcccaacagccccatctctggagaaggagaaaacactctgtcttagcacacctagtagctctaccgtgaaacactctaccagtagtatcggatccatgctcgctcaggctgacaagttacccatgaccgataagcgtgttgcgagccttcttaaaaaagcgaaggcgcagttgtgtaagatcgaaaagtccaaatcactcaaacagactgaccagcctaaagcccagggacaggaatccgattcttcggagacatccgtgcgaggtccgagaatcaaacatgtttgcaggcgtgccgctgtggcactggggagaaaacgggcagtcttccctgatgacatgccaacgctaagcgctctcccttgggaggagagagaaaaaattctcagtagcatgggaaatgacgacaaaagttccattgcgggaagcgaggacgccgagcctctagcccctccgatcaagcccatcaagccggtgacaaggaataaagcaccacaagagccccctgtcaagaaaggcagaagaagcaggagatgcggacaatgtcccggttgccaggtgcctgaggactgtggggtttgcactaattgtctcgacaagccaaaatttggcggacgaaacattaaaaagcaatgctgcaagatgcggaaatgccagaatctccagtggatgcccagcaaggcctacttgcagaaacaagcgaaggcagtgaaaaagaaggagaagaagagcaagacgtcggagaagaaggatagcaaggagtcctctgtggtgaagaacgtagtagactcctctcagaaaccaactccctctgcgagagaggaccccgcaccaaaaaaatcttccagcgagcctccaccacggaagcctgtggaagagaagtctgaggaaggaaacgtgagcgctcccggacccgaatccaagcaagctacaacccctgcctctcgaaaatcgtctaaacaggtgagtcaaccggctttagttatccccccacagccaccaaccacaggaccccctcggaaggaggtgccaaagacaacgccttcggagccaaagaagaaacagccaccgccacctgaatccggccctgagcagagtaaacagaaaaaagtggcacccaggcccagcattccagtcaagcagaagccaaaggaaaaagagaaacccccaccagtgaataagcaggaaaatgccggtactcttaacatattgtccactctctccaacggtaattcctccaaacagaaaattcccgctgacggcgttcatcggattagggttgatttcaaattcgtttactgtcaagtgtgttgtgaaccgttccataagttttgtctggaggagaatgagcgcccactggaagatcaactggagaattggtgctgcaggcgctgtaaattttgccacgtctgtggccgacaacaccaggccacgaaacagcttttggaatgcaataagtgcaggaacagttaccatcctgagtgtttgggccctaactatcccacgaagcccacaaaaaaaaaaaaggtgtggatatgcacaaagtgcgtcagatgtaagagttgcggctccactactcctggcaaggggtgggacgcacaatggtcacacgatttctctttgtgccacgattgcgccaagctgttcgctaaaggcaacttctgtcccctgtgtgataagtgttacgatgacgacgactacgaatccaaaatgatgcagtgtggtaagtgcgaccgctgggtgcactccaaatgtgagaatctttcagacgaaatgtacgaaatcttatccaatttaccggaatcagttgcatacacatgcgttaactgcactgagagacatcctgccgaatggcgactcgccctggaaaaggagctgcagatctcactgaaacaggtgttgacggccctgcttaactcacgaacaactagccacctgctgagataccgccaggccgctaaacctccagatctcaatcctgagacggaggagtccattccatcccgtagcagccctgaaggacctgaccctcctgtgttgaccgaagtgtcaaaacaggacgatcagcaaccattggatttggaaggggtcaagagaaagatggaccaaggaaattatacaagcgtgctagagttttcagatgatattgtgaagattatacaagccgctattaattctgatgggggtcagcccgagatcaagaaggcgaactctatggtaaagtccttcttcatccgccagatggagcgtgtctttccatggttcagtgtaaagaagagccgtttctgggagccaaataaggtcagcagtaattccggaatgttgcccaacgccgttctacccccttcgctagatcacaattatgcgcagtggcaagagcgcgaagaaaactctcacacagagcagcccccactgatgaagaaaatcatccctgcacccaaacctaagggtccgggtgagcctgatagtcccactcctttgcatccgccaacgccccctatactgagcaccgaccgctctagagaggacagccctgagcttaatcctccaccaggcattgaagacaatcggcagtgcgccctatgtctgacctacggagacgattctgcaaatgatgccggaaggctgctgtacataggccagaacgaatggacgcacgtgaattgcgccctgtggtccgccgaggttttcgaagacgatgatggatcgttgaagaatgtccatatggcagtgatacgtgggaagcagctgaggtgcgaattttgccaaaagcccggtgccaccgtcgggtgctgcttgacaagttgcacctctaactaccactttatgtgttctcgggctaaaaactgtgtcttccttgatgacaagaaggtgtattgtcagcggcaccgcgacctcattaaaggcgaggtggttcctgaaaacggtttcgaagtcttcagaagagtgttcgtggatttcgaaggcatttctttgcggcgtaaatttcttaacggtcttgaaccagagaatatacacatgatgatcggaagtatgactattgactgcctggggatccttaacgatctgtctgactgcgaagataagctattccccatcggctatcagtgcagccgggtctactggtctacgactgacgctcggaaacgttgtgtgtacacatgtaagattgtcgaatgtcggccaccagttgtcgagcctgacattaacagcacagtggagcatgatgagaatagaacaatcgcacacagccctacctcttttacagaatcaagctccaaagagtcccaaaatacagctgaaatcatctcccccccttccccagacagacctccacatagccaaacatccggcagttgctactaccatgtcattagcaaagtgcctcggattcggaccccgtcctactcccctactcagcgatcccccggatgcagacccctccctagtgctggaagtccaacacccaccacacacgagattgtgacagttggcgatccactgctcagctctggactcagatcgattgggagtcgaaggcattccacctcctctctctcaccacagagaagcaagctcagaattatgagccccatgcgtaccggcaacacctactctaggaacaacgtttcttctgttagcaccactggaacggcaacagacctggagagtagcgcaaaggtagtcgaccacgtcctgggacctctaaattcctcaacttccctgggccaaaacactagcacatcttctaacttgcagcgaacggtggtgacagtggggaacaaaaactcacacctggatggcagctcctcctctgaaatgaaacaatccagcgcaagcgatcttgtgtcaaaatccagtagtctcaagggcgagaagaccaaggtcctgagtagcaagagtagcgaggggagtgcacacaatgtcgcctaccccggtatcccaaaactcgcgccacaggtgcataacactacatcccgcgaacttaacgtttctaagatcggatctttcgcagagccttcaagtgtcagcttctcctctaaggaagcattatcgttccctcatctacacctgagaggccagcggaatgaccgcgatcagcatactgattctacccagagcgcgaacagcagcccagatgaagataccgaggttaagacattgaaactgtctggaatgagcaacaggtcctccatcataaatgagcatatggggtcaagcagccgggacaggagacagaagggcaagaaatcttgtaaagaaacatttaaggagaagcacagctctaagagcttcctcgagccaggacaagtgacaactggcgaggagggcaacctaaaacctgaattcatggacgaggttcttactcccgagtacatgggccagcgcccttgcaacaacgtaagttccgataaaataggggacaagggtctgtctatgccaggggtgcctaaggccccaccaatgcaggtggaaggctccgccaaggagttgcaggcgccacggaaaaggacagtcaaggttaccctgactcccttgaagatggagaacgaaagccaatccaagaacgctctgaaggagtcttcccctgccagtcctttacagattgaatctaccagccccacagagccaattagcgcctcagaaaatccgggtgacgggccagtggcccagccctcgccaaacaacaccagctgccaggatagtcagagcaataattaccagaacttacccgtccaggatcgtaacctcatgctgccagacgggcctaaaccacaagaagatggcagctttaagaggcgatacccaaggcgctctgccagagcacgcagcaatatgttttttggcctgacccccctctatggtgttcgatcctacggagaggaggatatccctttttattcgtcgtctacgggaaagaaacggggaaagcgctctgctgagggacaagtggatggagcagatgatctgtctactagtgatgaggacgacctttactactacaacttcaccagaacagtgattagttcaggtggagaagagcgcctggcttctcacaatttgtttcgggaggaggaacagtgtgacctccccaagatttcccaactcgatggagtcgacgacgggacagagtctgacactagcgtgaccgcgaccactcgtaagagcagccagataccaaagaggaatggaaaggagaacggcaccgagaaccttaagatcgataggcccgaggatgccggagaaaaggagcacgtcactaagtcctcagtgggtcataagaacgaaccgaaaatggataattgccattctgtaagccgggtaaaaacacaaggacaggatagccttgaggcgcagctgtcttctctggaaagttctcggagggtgcacacttccacccctagcgataagaacttacttgacacgtacaatacagaactcttaaagagcgatagtgacaataataattccgacgattgtgggaatattctcccatctgatatcatggatttcgtcctgaagaatacaccctctatgcaggcgcttggcgaatctccagaatcatctagctcggaactgctgaacttgggcgaaggcctgggtctggatagtaatcgcgagaaagacatgggcctgtttgaagtgttctctcagcagctgcctaccacggagcctgtggacagttccgttagcagctcaatctccgcagaggaacaatttgaattacccttagaattgcccagcgatcttagcgtgttaacaaccaggtcacccacagtccctagccagaatccatcaaggctggcagtgatctcggacagcggcgaaaagcgagtgaccatcacagaaaaatctgtggcttccagtgagagcgacccagctctcctgtcaccaggggtcgaccccacacctgaagggcatatgacccctgaccatttcatccaggggcacatggatgcagatcatattagctctcccccatgcggttccgttgagcagggtcacggtaataaccaggatcttactaggaacagctctactcctgggctacaggttccagtgtctcctacggttcctattcagaatcagaagtacgtccccaacagcaccgacagccctggcccttcccagatttcaaacgccgctgttcaaacaaccccaccgcatttgaagcccgctactgagaagctgatagttgtaaatcaaaatatgcagccactctatgtcctgcagacactgcctaacggtgtgactcaaaagattcagcttacaagcagcgtttcgtcaacgccttccgtgatggagactaacaccagcgtcttaggtcctatgggcggtggtctgacactcacaacaggactgaacccttcattaccaacctcccagtccttattcccgtccgcaagcaaggggttattgcccatgtctcaccaccagcacctccactctttccctgccgcaacgcagtccagcttccccccaaatattagtaatccgccttccggcttgcttattggggtccagcctcctccggatccgcagcttcttgtcagtgagtcctcccagagaaccgatctgtctactacagttgcaacgccaagctcaggtctgaagaagagacctatctcacgattacagaccaggaagaacaaaaagctagctccctccagtactccaagtaacattgccccaagcgacgtcgttagcaacatgaccctaatcaatttcacaccaagtcagctccccaatcatcctagcttgctggatctgggatccctaaatacttcttcccatcgcactgtgcctaatatcattaaaaggtcaaaatctagtatcatgtactttgaacctgcacctctgctgccgcagtctgtgggaggaactgcagccactgctgctggaacatctaccatcagtcaagacacatcccacctcaccagtggtagtgtgtctggccttgcgtcgtcaagctcggttcttaacgttgtgtccatgcaaaccaccacaacccccaccagttccgccagcgtccccggacacgtcaccttaaccaatcctcgccttctgggtacacctgacatcgggagcattagtaacttacttatcaaggccagtcagcagtctctgggcatacaggaccaaccagtggcgttgccaccatcttcgggcatgtttccgcaactggggacttcgcaaaccccctctacagctgccatcaccgcagccagcagcatctgcgtccttccctccacgcagaccacgggtatcacagccgctagtcctagcggggaagccgatgagcactatcagttacagcatgtcaatcagcttctggcttctaagaccgggatccattcctcacagcgggatttagacagcgcaagtggccctcaagtctccaatttcacacagactgtcgatgctccaaatagcatgggcttggagcagaataaagctctcagcagcgccgtccaggcaagcccaaccagtcctggtgggtctccctcttcaccatcatcaggccaacggagcgcaagtccaagtgttccaggtcctactaagcccaagccaaagacaaagagatttcagctaccactggataaggggaacggaaagaagcataaggtgtctcacctccggacgtctagcagcgaagcacatattccagaccaggagacgacaagtctcacgtcaggcacagggacgccaggcgcagaggccgaacaacaggacacagcctcagtggaacagtcctcccagaaggagtgtggccagccagcaggccaagtggcagtgttacctgaagtgcaagtaacccaaaatcccgcaaacgaacaagagtccgccgagcctaaaacagtggaagaggaggaatccaatttttcgtccccattgatgctatggttgcagcaagaacagaaacgcaaggagtctatcaccgaaaagaaacctaagaaaggcctcgtttttgagatcagcagcgatgatggctttcaaatctgcgcagagtctatcgaggacgcttggaaatctctgaccgacaaagtgcaggaggccaggtctaacgcaagactaaaacaacttagctttgctggcgtgaacggactgcggatgctgggcatcctccatgacgccgtggtgttcttaatagagcagttgagcggggctaaacactgtcgaaattacaaatttagatttcacaagccggaggaggctaatgaaccaccgctgaacccccacggctctgcaagagcagaggtgcacctcagaaagtctgcctttgacatgtttaacttcctggcttccaagcacaggcaaccgccagaatataaccccaatgatgaagaggaagaggaggttcagctcaagtccgccaggagggccacgtcaatggacttgccaatgccgatgcgctttcgccacctgaaaaagacttcaaaggaggctgtaggagtgtacagaagtcccatccacggcagaggactgttttgcaagcgcaacattgatgccggtgagatggtaatcgagtacgccggaaacgtgattcggtccattcagaccgataagcgggagaaatactacgattccaagggaattggctgctatatgttccggatcgacgattccgaagtcgtggacgctactatgcacgggaacgctgccagattcatcaatcattcttgtgaacccaactgctattccagagtgattaacatcgacggtcaaaagcatatcgttatattcgctatgagaaagatatatcggggtgaagaactgacctacgactacaagtttcccatcgaggatgcgagtaataagctaccctgtaactgtggggctaagaagtgcagaaagttcctcaattac

SEQ ID NO: 231426 - DNA, 8639 bp, Artificial Sequence
  Description of Artificial Sequence: Synthetic coding sequence
catgcgcatcctgaatgcctgaccatggaacgcgagaaaatcctttcctcaatgggtaacgacgacaaatccagcatcgccggatccgaggacgcggaacctctggcaccacccatcaaacccattaagccggtcactaggaataaagctccacaggaacctccggtgaagaagggcaggcgtagtcgacgttgtggtcagtgccccggttgccaggtacccgaagactgcggcgtgtgtacgaactgcctggacaaacctaagttcggaggaagaaacatcaagaaacagtgttgtaagatgaggaaatgccaaaatctgcagtggatgccatcgaaggcttaccttcaaaaacaagctaaagcagttaagaagaaggagaagaagagcaagacctccgagaaaaaggactcaaaagaatccagcgtagtcaagaatgttgtggatagtagccaaaaacctactccgtctgctagagaggatcctgctccaaagaaaagctcgagcgagccaccgcctagaaaacccgtggaggagaagtctgaggaaggcaatgtgagtgctcccggaccagagtctaagcaggccaccacaccagcgtctcgtaagtcgagcaaacaagtgagccaacccgctttagttattccgcctcaacctcctactactggaccaccccgaaaagaggtgcccaaaacgacgccaagcgaacctaagaaaaaacagcctcccccacctgagtcaggcccagagcagtcaaaacagaaaaaagtggctcctcggccttccatccctgttaagcaaaagccaaaagagaaggaaaagccccctccggttaacaagcaggagaatgcgggaactctaaacatcctgtctacactgagtaatggtaactccagtaagcagaaaatcccagcggacggcgtacacaggatcagggtggacttcaaggaagattgtgaggcagaaaatgtgtgggagatggggggactcggcatactgacctccgtgcctatcacccccagagtggtgtgctttctctgcgcaagctctggccacgtagagttcgtgtactgccaagtttgttgtgaaccattccataagttttgcctcgaagagaatgagcgccctctggaagaccaactcgagaactggtgctgccgaaggtgtaagttttgccatgtatgtggtcgccaacatcaggccacgaagcagctcctcgaatgcaataagtgccgcaatagttaccaccccgaatgtttgggcccaaattaccctactaagccaacaaagaagaagaaggtttggatatgcacgaaatgtgtaagatgtaagtcatgcgggtcaaccacacctggaaagggatgggatgctcaatggagtcacgacttctcactctgtcacgattgcgcaaagctgttcgccaaaggcaacttttgtcctctttgcgacaaatgttacgacgacgacgactacgagtcaaagatgatgcagtgcggtaagtgtgacaggtgggtgcattctaaatgcgaaaacctcagcgacgaaatgtatgagatcctttccaatctgccagaaagcgtcgcctatacatgtgtgaattgcaccgagcgtcaccccgcagaatggcggctggccttggagaaggaactgcagatatccttgaaacaggtactcacagcccttctcaacagccgtacgacctcgcacctgctgcgctacaggcaggccgcaaagccaccggacttgaatcctgaaaccgaagaatccatcccctctcggtcttctccagagggccctgacccccctgtgcttactgaagtttcaaaacaggacgatcagcaaccattagacctcgagggcgtcaagagaaaaatggatcaaggaaactacacttcagtgctcgagttctccgacgatatcgtgaagatcatacaggcagccataaactctgatggaggtcagccagaaataaagaaggcaaattctatggtaaaatctttcttcatcaggcagatggagcgtgtgtttccttggttttccgtcaagaaaagccggttctgggaacccaacaaggtgtcctcaaatagcgggatgctgcccaacgccgtgttgccaccgtccttggatcacaactatgcacagtggcaggagcgcgaggagaactctcacaccgaacagcccccactaatgaagaaaatcatcccggcaccaaagccaaagggcccaggcgaacccgatagcccaacccctcttcatcctccaaccccgcctattctgtccacagataggtctcgcgaggactcaccggaactcaacccccctcctggcattgaggacaacagacaatgcgcattgtgtctcacatacggggatgactcagctaacgatgcgggacgtcttctgtatattgggcagaacgaatggacccacgtcaattgcgctctctggtcagcggaggtgttcgaggatgacgatggatccttgaagaacgtccacatggccgtgatcaggggcaaacaactccgatgcgagttttgccagaaaccgggagccacggtgggatgctgtctgacaagttgtacatctaattaccatttcatgtgttcccgcgctaagaactgcgtcttcttagacgataaaaaagtctattgccagaggcatcgtgacctaatcaagggtgaggtcgtccctgagaacggattcgaggtttttagaagggtattcgtggactttgagggaatttccctcaggcgaaagtttttgaatggcctagagcccgagaacattcatatgatgattgggtcaatgacgatagactgtctaggcatcttaaacgacctcagcgattgcgaggacaagctgtttcctatcggctatcagtgtagtcgggtctactggagcacaactgacgcgcgaaaacggtgtgtatacacttgtaaaattgtggagtgtcgaccacctgtcgtggagcccgatataaatagcacagtggaacacgacgagaacaggaccattgcacactcaccaactagtttcactgaaagttcaagcaaagagagtcagaatacagccgagattataagtcctccctcaccggaccgaccaccccactcacaaaccagtggttcctgctattaccatgtgatttccaaggtacccagaatcagaactcctagctattcccccacccaaagatctccgggatgtagaccattaccttcagccggatcccctaccccgacgacccatgagatcgtcactgttggtgaccctctccttagctccgggctgcgctccatcggcagtaggaggcacagtacctctagcttaagcccgcagcgcagtaaattgcgaatcatgtcccccatgagaacaggcaacacatattcccggaataacgtgtccagtgtctcgacaaccggcaccgcaaccgatttggaaagctcggctaaggtagttgaccacgtcctgggacccctgaactcctccaccagcctgggccagaacacgagcacaagcagtaatttgcagcggactgttgtgacagtaggtaacaagaactcccatctggatggtagctcttccagcgagatgaaacagtcatccgccagcgatctggtgtcgaagagtagtagccttaagggtgaaaagacgaaggtcctgagttccaaaagcagtgagggatctgctcacaacgttgcttaccccggaatcccaaagctggctcctcaggtgcataacactacatcaagagagttaaatgtctccaagattggctcctttgcagaaccttctagcgtaagctttagcagtaaggaggccctgtcatttccccaccttcatcttcgtggacagaggaacgatcgagatcaacacacagactctacgcagagcgcgaattccagcccagatgaggatacagaagtgaagaccctgaagttatctgggatgagtaaccgcagctcaattataaacgaacatatgggttcctccagcagggacaggcgccagaaagggaaaaagtcctgtaaggagacatttaaagagaagcactcttctaagtccttcctggagccaggacaagtgacaacgggcgaggagggaaatctcaagcctgagtttatggacgaagtcctaacccccgaatatatgggacagcgaccatgcaataacgtcagctccgataagatcggggataaaggactatcaatgcctggtgttcccaaggctccacctatgcaggtggagggatctgctaaggaattgcaggccccaagaaagcgcacagtgaaagtgacactgaccccactgaaaatggagaacgaatctcagtctaagaacgcactgaaagaatcttctccagctagccccttgcagatagaatccacaagccctacagaacccatctcagcctctgaaaatcccggagacgggccagtagctcaaccatccccaaacaatacgagctgccaggactcccagtcaaataactatcagaatctgcccgtacaggatcggaatctgatgctcccggatggaccaaagccccaggaagacggcagttttaagaggcgatatcctagaagatctgcaagagcaaggtccaacatgttcttcggcctgacacccctgtatggagtgaggtcctatggggaggaggacatccctttttacagttcttctaccggcaaaaagagggggaaaagatcagcagaggggcaggtggatggtgccgacgacctctccacgagcgatgaagacgacctgtattactataatttcactcgcaccgtgatcagctcgggaggagaggagcgcctggcctcccacaacctgtttagagaagaagagcagtgtgatttgcccaagatttctcaactcgacggagtcgatgatggaaccgaatcagatacttcagtcaccgccactactcgcaagtcaagccagatcccaaagaggaacgggaaggagaatggtacagaaaatcttaagatcgaccgacctgaagacgccggagaaaaagaacatgtcacgaagtcttccgtgggccataagaatgagcccaaaatggacaactgtcactctgtgagtcgagtaaagacacaggggcaagactctctggaagcccagctcagttccctcgaaagctctcgacgagttcacacttctactccgagtgacaaaaatttgcttgacacttacaacaccgagctattgaaatccgatagcgacaataacaattctgatgactgcggcaacatcttgccttctgacataatggattttgttctgaagaacaccccttctatgcaagccctgggtgaaagccccgaatcgtccagtagtgaactccttaatctgggcgaaggactgggactggatagtaatagagagaaagatatgggtctctttgaagtgttcagccagcagctgcccaccactgaacctgttgatagtagcgtgtcctcttccatttcagctgaggagcagtttgagcttccactagaacttccatccgatctgagcgtcctgaccacccgctccccgacagttcccagccaaaatccttcgagactggctgttattagtgattcaggagaaaagagggtaactattaccgaaaaatccgtggctagttccgagagcgatcctgccctgttgagccctggggtcgatccaaccccagagggtcatatgactcctgaccacttcattcagggccacatggatgcagatcatatttcctccccaccgtgtggtagtgtggaacaaggccacggcaacaatcaagatttgacaaggaactcctcaacaccaggcttgcaggttcctgtctctccaactgtacccatccaaaaccagaaatacgtccctaactccacagatagcccgggacccagccaaatcagcaacgctgcagtccagaccactcccccacatttgaaacccgctaccgagaagttaattgttgtaaaccagaacatgcaaccactgtacgttctgcagactcttcctaatggagtgacgcagaagattcagctcactagcagcgttagctcaaccccatccgtaatggaaaccaatacctcagtgctcggccctatgggaggaggtcttaccctaactactggacttaatcccagtctgcctactagccagtcccttttcccatccgcttctaagggactcttacccatgtctcatcaccaacacctgcactcctttcctgcagcaacccagagctcttttcccccaaatatctccaatcctccttccggattgcttattggcgtccaacctcctcccgaccctcagttactagtgagtgagagttcccagcggacagatctgtctacaactgtagctactcctagcagcgggctgaaaaaaaggccaatctcccggctacagaccaggaagaataagaaactagccccaagtagcactccctctaatatcgcaccatctgacgtggtgagtaatatgacccttattaattttactccctcccagcttccgaaccaccccagtttactagacctgggatcgctgaatacaagctcccaccggacggtgccaaatattataaaacggtctaaaagtagtattatgtacttcgagcccgctcccttgctgccgcagagcgttggaggaaccgctgctacagccgctggaaccagcaccattagccaggacaccagccatctgacttccgggagcgttagcggcctggcctcatcgtcgagcgtactgaacgtagtgtccatgcagacaaccactaccccaactagcagtgctagtgtgcctgggcacgtaacattaacaaatcctcgtcttctgggcacccctgacatcggaagtattagtaacttattgatcaaagctagccagcagtcacttggcatacaggatcagccagttgctctgcccccatcttccggcatgttcccccagctagggacttcccagacaccgtcaaccgctgctattactgcagcttccagtatatgcgtcctgccaagtacccaaaccactggcataaccgccgctagcccctccggggaagctgacgaacactaccagctgcagcacgtgaaccagctcctggcaagcaagacagggatacattcttcacagcgcgatctcgattcggcgtctggccctcaagtctctaatttcacccaaaccgttgatgccccaaatagcatggggttggagcagaacaaagctctttcttccgctgtccaggccagccctactagtccaggaggatctccatcttcgcccagttccgggcaacgtagtgcctctccttccgtgcctggtccaaccaagcccaaaccaaaaaccaagcgatttcagcttccgctggataaagggaatgggaaaaagcacaaagtgagccatttacgcacctcttcctctgaggcccatatcccagaccaggagaccacctccttgactagtggcacagggacgccaggcgctgaggccgagcagcaagacactgccagcgtcgaacagagctctcaaaaggaatgtggacaaccagccggtcaagtggcagtactgcctgaggtgcaagttactcagaatcctgccaatgagcaagaatccgctgagccgaaaacagtagaggaggaagaaagcaatttcagcagtcctttgatgctttggctgcaacaagaacagaagcgcaaggagtcaatcacagaaaaaaagccaaagaaaggccttgtgtttgagatatcctctgacgatgggttccagatttgtgcggagtcaatcgaagatgcctggaaatctcttactgacaaggtgcaagaggccagaagtaacgctcggctgaagcagctgagcttcgcaggtgttaacgggctacgtatgttaggaatcttacacgacgctgtagtgtttttaatcgaacagctgagcggtgccaaacattgtcgaaattataaattcaggttccataaaccagaggaggccaatgaaccgcctctaaatccgcacgggagcgcacgggcagaggttcatctgagaaagagcgccttcgatatgtttaactttctagcatccaagcacagacagcctcctgagtataatcccaacgacgaagaagaggaggaggtgcagctcaagagtgcacgccgtgcaacgtctatggatctgccgatgccgatgcggttccgccacctgaaaaaaaccagtaaagaggcggttggcgtttacagaagtccaatccacggcagaggattgttttgtaagagaaacatcgacgctggagaaatggttatagagtatgccggaaacgtgatccgctctattcagaccgataagcgcgaaaagtattatgattccaaaggcatcggttgttacatgttcaggatcgatgacagcgaggtggtagacgctaccatgcatgggaatgccgcacggtttataaaccactcatgtgagcctaattgctattctcgggtaatcaatattgatggccagaaacacattgtgatttttgcaatgagaaagatctatcggggagaggagcttacctatgactataaatttcctattgaggatgcctccaataaactgccttgcaattgtggtgcaaagaagtgtcggaagtttctgaatta

SEQ ID NO: 231427 - DNA, 11910 bp, Artificial Sequence
  Description of Artificial Sequence: Synthetic coding sequence
atggcgcattcatgtaggtggagattccccgctaggcctggtaccaccggcggtggcggaggcggtggaaggaggggacttggcggagcccctcggcagagggtgcctgctctcttgctgccaccagggccacctgtgggcggtggaggacctggagctccgccatcccctcctgccgtggctgccgctgcagccgctgccggatcctccggcgcaggggttcctggaggcgcagctgcagcttcagctgcaagtagctccagtgcaagctcgagcagctctagctcctccagtgccagcagtgggccagcccttctgagggtcggacctgggtttgatgctgcactgcaagtctctgctgctatcggcacaaacctgcgcaggttccgcgctgttttcggcgagagtggcggtgggggaggatccggagaggacgagcagtttctcggctttggcagcgacgaagaggtgagggtccgttcacccacacgaagcccctctgttaagacttcacccagaaagccacggggtcgacctaggtctggttcagaccggaattctgccattctctctgatccctcagtattcagccccctgaataaatctgagaccaaatccggagacaagattaagaagaaggactcaaaatcgattgagaaaaaaaggggccgtccacccacatttcccggagtcaaaatcaaaattactcatggtaaagacatctccgaactgcccaagggcaacaaggaggactctctgaaaaagatcaagcgtacaccctctgctaccttccagcaggccacaaagatcaagaagctaagggcaggcaagctcagccctctcaagagtaagtttaagacaggcaaactgcagataggcagaaaaggcgtgcagatcgtgcgcagaagggggaggcccccttctactgaacgtattaagacgccatctggtctcctgataaatagcgagctggagaaacctcaaaaagtccggaaagataaggaagggacgccacccctgaccaaagaagataagacggtggtaaggcagtctccgaggaggattaagcctgtgaggatcatccccagcagcaaaaggactgatgccaccattgccaagcaactcctgcagagagcgaaaaaaggcgctcagaaaaagatcgagaaggaagccgctcaactccagggaagaaaagtgaaaactcaggtcaagaacattaggcagttcatcatgcctgttgtctctgcaatttctagcagaattatcaagactccaagaagattcatcgaggatgaagattacgatccacctattaagatcgctcgccttgaatcaactccgaatagcaggtttagcgccccatcatgtgggtcaagcgaaaagtcgagtgccgcttcacaacattcctcccagatgtcaagcgatagctctaggtctagctcccctagtgtcgataccagtactgattctcaggcaagcgaagagatccaagtgctgccagaggagcgcagtgacacccctgaggtacatcccccactgccaataagccagagcccggaaaatgaaagcaacgaccgcaggagcagaaggtatagcgtgtccgagcggtcctttgggtcaaggactacaaaaaagctttcaacactccagtctgcgcctcagcagcagacgagctcctccccccctccgccactactgacaccccctccacccctgcagccagcgtcttctatctcagaccatacgccttggctgatgccacctaccattcctctggcatctccgtttctcccagcgtccacagcccctatgcaaggcaagcgtaaatctattcttcgtgagccgacatttcgttggacctctttgaagcactctaggagcgagcctcagtattttagttctgcaaagtacgccaaggaaggtcttatccggaaacctatcttcgacaactttcggccacctcctctcacccccgaggacgtggggttcgcctcagggttctccgcttccggcacagctgcctccgcacggctgttcagcccactacacagtggaactcggtttgatatgcataagcgaagcccattgctgagagccccaagatttactcctagcgaagcacactcacggatttttgagtctgtgaccctgccttcaaaccgtacctctgccggaacatcttccagcggagttagtaaccgaaagagaaagcggaaggtcttctccccaatccggagcgaacccaggagtccctcacattccatgaggacacgatcaggaagactcagttccagcgagttgagccctctcactcctccttcatccgtaagctcctcattgtctatttccgttagtccactggccacaagcgcactgaatccgacatttacattcccctcacattcactcactcagtccggagagagcgccgagaaaaaccagcgaccgagaaagcagactagtgcccctgccgaaccattttcttcatcttccccaacgcctctgttcccctggttcacccccggatcacagaccgagcggggtagaaacaaggataaggctccagaggaactgtcaaaagatcgcgatgctgataaaagcgtagaaaaggacaagtctcgagagagagaccgagaacgcgaaaaggaaaacaagagggagagtcgtaaagagaaaaggaagaagggctccgagatccagtctagctccgcactgtatcctgtcggacgcgtgtccaaggagaaggtggtgggtgaagacgttgccacctctagcagcgcaaagaaggctacagggaggaagaagtcatcttctcacgatagcgggactgatatcaccagtgtgacattaggcgatactacagcagttaaaactaagatcctgatcaagaagggtcgtgggaatctggaaaagacaaacctggatctgggcccaacggccccttccctggagaaagaaaaaactctctgtctaagcaccccctcatcaagtactgttaagcacagcacctctagtatcggttctatgctcgcccaggcagataagctgcccatgaccgacaaacgcgtggccagcctgctgaagaaggctaaggcacagttgtgcaaaatcgagaaatctaagtctctgaagcaaaccgatcagccaaaggcccaaggacaagagtccgactccagcgaaacaagtgtccgtggccctcggatcaaacacgtgtgccgacgcgctgcagttgcactgggaaggaagagagccgtgttccccgatgacatgccaacactgtccgccctgccttgggaggagcgggagaaaattctatccagcatgggaaatgacgacaaatcaagtatagctgggtccgaggacgcagagccattggccccacccatcaagcctatcaagcccgttaccagaaacaaagcccctcaggaacctccagtgaagaaggggaggaggtcgcgaaggtgcggccaatgccctggatgtcaggtgccagaggattgcggtgtctgcacaaattgtctggacaaaccaaagtttgggggtcgcaatatcaagaagcagtgttgcaaaatgcgcaagtgccagaatctccagtggatgccatccaaggcatacctccagaaacaggcgaaggccgtgaagaaaaaggaaaagaaaagcaaaacctccgagaagaaggatagtaaagaaagttccgtcgtgaagaatgtggtagattcctctcagaaaccaacaccctctgctcgcgaagaccctgcaccaaagaagagtagctcagagcctccgccaagaaagccagtagaagagaagtccgaggaaggaaatgtttctgcccctggcccagaatctaaacaggctaccacacccgcaagccgtaaaagtagtaagcaagtgagtcagcccgctctcgtcattcctccacagccccctacaaccggaccacctcgtaaggaggtcccaaaaacaacgcccagcgaaccgaagaaaaagcagccgccacccccagaatcaggtcccgaacaatcaaagcagaaaaaagtggccccaagaccaagtattcctgtgaagcagaagcctaaagagaaggaaaaaccacccccagtgaataaacaggagaacgccggaacgctgaatatcttgagcacactatccaacggcaatagctccaagcaaaaaatcccagccgatggagtgcataggattagggttgactttaaggaagactgcgaggctgagaacgtctgggagatgggaggcctgggcattctaacttccgtgcctatcactccccgagtggtgtgcttcctgtgtgcctcttctggccacgttgaattcgtgtactgccaagtgtgttgcgagccatttcataagttctgcctggaagagaatgagcggccattggaagaccagctagaaaattggtgttgccgaaggtgcaaattttgccatgtatgcggacgccaacatcaggcaaccaagcaacttctggaatgcaataagtgccgaaacagctaccatcctgaatgtctcggaccaaactatcccactaagcctacaaagaaaaagaaggtttggatatgtactaaatgcgtgcgttgtaagtcctgcggctccacaacccccggtaaaggctgggatgcacagtggagccacgactttagtctgtgtcatgactgcgcaaagctgttcgcgaaaggtaatttctgccccctgtgcgataagtgttatgatgatgacgactacgagtctaaaatgatgcagtgtggcaaatgtgaccgctgggtccactccaagtgcgagaacctgagcgatgaaatgtatgagattctaagcaatcttcctgaaagcgtggcctacacttgtgttaattgcactgaaagacatccagctgaatggagactggctttggaaaaggagctccagatatccctgaagcaagtcctgactgcattgcttaattctcgcacaacaagtcatctgctcagatatcgacaagccgctaagccccctgatttaaatcccgaaaccgaggaatccatcccatcaaggtcaagtcccgaaggccctgacccaccagtcctcactgaggtgagcaagcaggacgaccagcagcctttggatttagagggcgtgaagcgaaagatggatcagggtaactatacatcagtgttagaattttcggacgacattgtaaagatcattcaagcggctatcaattccgacggagggcaaccggaaattaaaaaagccaattccatggtcaagagctttttcatcaggcagatggagcgcgtgttcccttggttttcagttaaaaagtctaggttctgggagcccaacaaggtgtctagtaactctggaatgctccctaacgccgtgctgcccccaagtctggaccacaactacgctcagtggcaggagcgcgaagaaaactcgcatactgagcagcctcctttaatgaagaagatcattcctgcacctaagcccaaggggccaggcgaacccgacagtccaacacctttgcatccgccaactcccccaattcttagcactgataggagcagagaagactccccagaactcaatcctccgcctggcattgaagacaaccgccaatgtgccctgtgcctgacttatggcgatgactccgccaacgacgccggacggcttctatatattggccagaacgagtggacgcatgtgaattgcgcgttatggtcggccgaagtcttcgaggacgatgatggcagtctcaaaaacgttcacatggcagtaattcgcggtaagcagcttagatgtgaattctgccagaagcctggcgcaaccgtcggttgttgtctgactagctgcacctcaaactaccattttatgtgttcaagagcaaaaaactgtgtattcctggatgacaaaaaagtgtactgccaacgccaccgggatctgatcaaaggagaggtcgtgccagagaacggcttcgaggtgttcagaagagtgtttgtggatttcgagggcatttctttgcgccgaaagtttctaaacggcctggagcctgaaaatattcacatgatgataggatccatgacaatcgactgtttagggattctgaatgaccttagcgattgtgaggataagctgtttccaattggataccaatgtagcagggtatactggagcacaactgatgcgaggaagaggtgcgtttacacatgcaaaatcgtcgagtgcaggccgcctgtggtcgaacccgacattaacagtactgtcgagcacgacgagaataggacaattgcacacagccccaccagctttacagagtcgtctagcaaagagtctcagaacacagctgagataattagccccccaagtccagatcgtccgccacactctcagacgtcaggatcctgctattatcacgttatctccaaagtccctaggattcgcacaccttcctactctcctacacaacgcagcccaggctgccggccattacctagcgcagggtcccccacccccacaacccacgagattgtcaccgtgggcgatcctttactatctagcggactacgctctataggctctaggagacattcaacaagctctcttagcccccaaagaagcaaactgagaattatgagccccatgagaacaggaaatacatacagtaggaacaacgtctctagtgtctctactacgggtactgccactgatctggagagctcagccaaagtggttgaccacgtgctgggacccctcaacagctccacgtctctcggtcaaaacacaagcacatccagtaatcttcagagaacggtggttactgtcggcaataagaatagtcatctggatgggagttccagttccgaaatgaaacaaagctctgccagtgacctggtgagcaaaagctctagtctgaagggggaaaagacaaaggtgctcagctcaaagtcaagtgaaggcagcgcccacaacgtggcctatcccggaatacccaagttggctccacaggtccataatacgacgagtcgtgaattgaatgtatctaaaattggctcatttgccgagccctccagcgtgagctttagctctaaagaagccctgagttttccgcacctgcacctcagagggcaaaggaatgatagggaccaacataccgattctacccagtcagccaattcgtcacccgatgaagacaccgaggtcaagaccctcaagctctctgggatgtctaaccggagtagcatcatcaatgagcatatggggagctcctctcgggatagaagacagaaaggcaagaagtcgtgtaaagaaaccttcaaagaaaaacacagcagtaaatcatttctagagcccggacaggtgaccactggagaggaggggaatctcaaacccgagttcatggacgaagtgctaacgcctgaatatatggggcagcgcccatgcaataatgtgtccagcgataagataggtgacaagggattaagcatgcccggagtccccaaagcccctccaatgcaggtggaaggttccgccaaggagctacaggctccacggaagagaaccgtgaaagttacactaacaccgttaaaaatggagaacgaatctcagtccaagaacgctttaaaagagagttcccctgcgagcccactgcagatcgaaagtacgtcacctacggagccaatctcagcatcagagaatccgggagacggacctgttgcccagccttccccaaacaataccagttgtcaagatagccaaagcaataattaccagaacctgcccgtgcaagaccgcaatctcatgcttcccgacggaccgaaaccacaagaagatggtagcttcaagcggagatacccaaggagatcagctagggcacgaagtaacatgttcttcggactcactcccctctacggcgtgaggtcgtatggagaagaggatatccctttttatagttcgagcacaggtaagaagaggggcaagagatccgcagaaggccaggtcgacggcgctgacgatctcagcaccagcgacgaagatgatctatattactacaacttcaccaggacagtgatatctagtggcggagaggaaagactcgcatcacataacctgtttcgggaagaagaacaatgtgatcttcccaagatctcacaactggatggagtcgacgacggaactgagagcgatacaagcgtgactgccactacacgcaagtcaagccaaattccgaagagaaacggcaaggagaatgggacagaaaacctaaagattgatcgacctgaagatgccggtgaaaaagaacacgtgacaaagagcagcgtaggacacaaaaacgagcccaaaatggacaattgtcacagcgttagtcgcgtaaaaactcaggggcaggacagcctggaagcacagctgagcagcctggagtcttcccgacgggtgcacacatcaacgccctccgacaaaaatctgctggacacttacaacaccgagttactaaaaagcgattcagataacaataattctgatgattgcggaaacattttgccaagcgatatcatggacttcgtcttgaagaatacgcccagcatgcaagcactcggtgaaagtccagagagttcgagttccgaactgttgaacctcggagagggcttagggctcgattctaaccgggagaaggacatggggctgtttgaggtctttagtcagcagctgcccacaacggagcctgtggatagctccgtgagcagctctatttccgctgaagagcagttcgagctgcccctggaattacctagcgacttatcggtgctcaccaccaggtccccaactgtcccttcacagaacccctcacgcctggctgttatcagtgattccggggagaagcgggtcacaatcactgagaaatctgttgccagctccgaaagcgatcccgcactgctgagcccgggtgtggacccaacacccgagggacacatgacaccagaccacttcatccagggccacatggacgccgaccacattagttcccctccttgcggtagcgtggaacagggtcacggaaataatcaggacctgacgcgcaattcatctacgccgggtctacaggtgccagtgtcacctaccgtgccaatacagaatcagaaatacgtccccaacagtactgactctcccggtcctagtcagatctcgaacgcagctgtgcagactactccgcctcatctcaagcctgcaacagaaaaacttatcgtcgtcaatcagaatatgcaacccctctacgtattacagactctgccaaacggcgtcacccagaagatacagcttacgtcctcggtttcgagcactcccagcgttatggaaacgaatacctctgttctgggaccaatgggagggggacttacattaaccacagggttgaacccatctctgccgaccagccaatccctcttccctagtgcctctaagggattgctgcctatgagccatcaccagcatctgcactctttccctgccgcaactcagagtagcttccccccaaatatttcaaaccctccttctgggctgttgatcggcgttcaacccccacctgatcctcagcttctggtgtcagagagcagccagcgcacagacctttctacaacagtagctacgccctcgtccgggctgaaaaagcggcctatctcgagactccaaacaagaaagaataagaagctcgccccaagctctacacctagcaacattgcaccaagcgatgttgtgagcaacatgacactgataaattttacgccctcacagcttcctaatcatccatcactacttgacttagggtccctgaatacaagtagtcatcggactgtacctaatattatcaagcgctctaagtctagcataatgtattttgaacccgctccactcctcccccaatctgtcggaggcactgctgctacagccgcaggcacctccaccatctctcaagacactagccatttgacttccgggagcgtgtccggcctggcctctagttcttcagtgctgaatgtcgtgtcaatgcagaccaccaccacacctacgtcttccgccagcgtgccaggacatgtcacactcaccaacccccgactcctgggtaccccagatatagggtcgatctccaacctccttattaaggcttcgcaacagagcttgggcatccaggatcaaccagtggctctgcccccaagctcaggtatgttcccccaactggggacgagccaaaccccgagtactgcagccattacagcagctagctctatctgtgtgctgccaagcactcagactaccggtatcacagccgcttctcccagcggggaggcagacgaacactaccagctccagcacgtaaatcagctgctggcttcaaaaacaggcattcattcctcacagcgagacttggactctgcaagcggcccacaggtcagcaacttcactcagacagttgacgctcctaattccatgggactcgagcagaacaaggccttatcttccgcagttcaggcaagtcctacgagccccggaggatcccccagctcacccagcagtggacagcggtcggcaagtcccagtgttcctggacccacgaagcctaaacccaaaaccaaacggttccaactgccgctcgataagggaaatggtaagaagcacaaagtcagccatttgaggacttcctcgagtgaagcacacatcccagaccaagagacaacctccctgacatctggcacgggaacccctggggcagaggcagagcagcaggatactgcctcagtcgaacagtcctcacaaaaagaatgtggtcagcctgcgggacaggtagccgtcctgcccgaagtacaggtgacacagaatcccgcaaacgaacaggaaagcgccgagccaaagaccgtggaggaggaggagagtaacttttcatcccccctgatgctatggctccaacaggagcagaagagaaaggaaagcatcaccgagaaaaagccaaagaagggattggtgtttgaaatatctagcgacgacggattccagatttgtgccgagagcattgaagacgcgtggaaaagcctgaccgacaaagtgcaggaagcacgttccaatgccaggctgaagcagctgagttttgctggcgtgaatggactgaggatgctcggaatcctccatgacgcagtagtctttctgatcgagcaactgagtggggctaagcattgtcgaaactataagttccgatttcataaaccagaagaagcgaatgagccgcctctgaacccacatggaagcgctagggccgaagtgcatctgcggaaatcggctttcgacatgtttaacttcctagcctccaagcaccgccagccacctgaatataacccaaacgacgaggaggaagaggaagtacagctgaagagcgccagacgagcaactagtatggatcttccaatgcccatgcgttttagacacctgaaaaagacatcgaaggaagctgtgggggtataccggtcacctatccacggcagaggccttttttgcaaacgcaatattgatgccggagagatggtaatcgagtacgcaggtaacgttattcggtcaatccagacagataagcgtgagaaatattatgactcgaaaggcattggatgctatatgtttaggattgacgattccgaggtggtcgatgcaaccatgcacggaaatgctgcaaggttcattaatcacagctgcgaacccaactgctattccagggtcatcaatattgacgggcagaagcacatcgtgatttttgctatgaggaagatctacaggggagaggagctgacctatgattataaatttcccatcgaggatgctagtaataagctgccatgcaactgcggagcaaagaagtgccggaagtttctcaattag

SEQ ID NO: 231428 - DNA, 336 bp, Artificial Sequence
  Description of Artificial Sequence: Synthetic coding sequence
gacttcaaggacgagcagtttctggggttcggcagcgatgaggaggtgcgtgtgcgctcccccaccagatccccctcaggaagtatgctggcacaggcggacaagttgcccatgacggataaaagggtggcatctttacttaagaaagcaaaggcacagttgtgtaagattgagaagtccaagagcctcaagcagacagaccaaccaaaagcacagggacaagagagcgactcgtctgagactagcgtcaggggccctagaatcaaacacgtgtgtcgtagggcagcagtggcgctgggcaggaaaagggccgtgtttcctgatgatatgccttag

SEQ ID NO: 231429 - DNA, 4320 bp, Artificial Sequence
  Description of Artificial Sequence: Synthetic coding sequence
atggcccatagttgcaggtggcgcttccctgccaggccagggactaccggaggcggaggcggaggtggaaggcgaggcctgggtggcgcaccgaggcagcgcgtacccgcattattattgcccccagggccacccgtcgggggtgggggaccgggagctcccccttcgccaccagccgtggcagctgccgctgccgctgccggaagttccggagcgggtgtgccgggtggagcggcagccgcatccgccgctagctcttcatctgcctcgagcagtagcagcagctcctcatccgctagtagcggccctgcactcctgcgggttgggccaggattcgacgccgcactgcaggtcagcgcggctattgggaccaacctgcgacgcttccgagctgtatttggggagagcggcggaggaggcggtagcggagagcttacaactcagatcccctgctcttggagaaccaaagggcatattcacgacaagaagacagagcctttccggctcctggcctggtcctggtgtctaaatgacgaacaattcctgggattcggatcagacgaagaggtgcgtgtcagatctcccacaaggtccccatcagtcaagacttcccctaggaaacccaggggcaggccccgttctggcagcgacaggaacagtgctattttgagcgatccttctgtgttctctcccttgaacaaatccgaaactaagagtggggataaaattaaaaaaaaagattcaaagtctattgagaagaagagaggtcgtccacccaccttccctggagttaagatcaagattacgcatggcaaggatatctctgaattacctaaaggtaataaggaggatagtcttaaaaaaatcaaaagaactccgagcgccactttccagcaggccacaaagattaaaaaactgagggcagggaaattatcccctctgaagagtaaattcaaaacgggcaagcttcaaattggccgtaaaggggtccagattgtgagacgacggggacggcctccctccaccgagcgcattaagacaccgagtggccttcttatcaattctgaactcgagaagccccagaaagttagaaaagacaaggaggggactcccccactgaccaaggaggataagacagtggtacgtcagtcacccaggcgtattaaaccggtgagaataattccaagtagtaagaggaccgatgccacaatcgcaaaacagcttctccaacgggctaagaagggggctcagaaaaagatcgagaaagaagccgctcaattgcaagggaggaaagtcaagactcaggtcaaaaatattcgacagtttatcatgccggttgtctctgccattagctcgcgcataattaagactccaagaaggtttattgaagatgaagactatgatcctcccataaagatagccagactggagagcactcctaacagccggttctcggccccttcctgtggaagcagtgagaaatcttccgctgcctcacagcactccagccagatgtcaagcgatagctctcgtagcagtagcccctctgtggatactagcacagatagccaggctagcgaggaaatccaggtcctgccggaggagagatctgataccccagaggtgcacccccctctgcccatatcgcagtctcccgaaaacgagtcaaatgatcgtaggtctcggagatacagtgtctctgagcgatcattcgggtccagaaccaccaagaaactgagtaccttacaaagcgccccacagcagcaaacatccagctcccctccacctccactcttgactcctcctcctcctctccagcccgcttcttctatttccgatcacacaccttggcttatgcccccaaccatcccactcgcttcgcccttccttccagcatcaacagccccaatgcagggaaaaaggaagagcattcttcgggagccaacgttccggtggacctccctgaagcactctagaagcgagccccaatacttttctagtgccaagtacgcaaaagagggcctaattcgcaaacctatctttgacaactttaggcctccccctctgacaccagaggatgtaggattcgcatcgggcttcagcgcctcagggacagctgcttctgctcggctgttcagcccgttacattccggaactcgttttgacatgcataagagatcccccctgttgcgagcgccaagatttacaccaagtgaggctcactccagaatttttgaaagcgtaaccctgccctccaatagaacgtccgctggtacctccagttccggggtcagcaaccgtaagcggaagaggaaggtattctccccgattcggagcgagcctcggtctccctcccacagcatgagaactaggtcaggccgactctcctcatcggagctgagtcccctgactccccctagtagtgtgtcttcttcccttagtatcagcgtgtccccactggccacctcggcgctcaaccccaccttcacattcccatcacattcccttacacagagtggtgagtctgcagaaaagaatcagcggccacgcaaacagaccagcgcccctgccgagcccttctctagctcaagcccaacccccctatttccttggttcacacctggcagccagaccgaaagaggcagaaataaagacaaagcacccgaggaactctccaaagaccgggacgctgataagtcagtcgagaaggataagagcagagagcgagaccgagagagggaaaaagagaataagagagagagtagaaaagagaaaagaaaaaagggctccgagatccaatcaagtagcgcactctatcctgttggaagagtcagcaaggagaaggtagtcggtgaagatgtcgcgacctcttccagtgcaaagaaggctaccggcaggaaaaaaagttcctctcacgactccgggaccgatatcacatcggttactctgggtgacaccaccgccgtgaagacgaagatattgataaaaaaggggaggggaaacctcgaaaagaccaatctggatctgggaccaaccgctccgtcactggagaaagaaaagacattatgcctctccacccccagcagctctactgtgaagcatagcactagctctatcggttcaatgttggcccaggccgacaaactgccgatgaccgataaaagggtggcctccctactgaagaaggctaaggcccaactgtgcaagatagagaaaagcaaaagcttgaagcagactgatcagcccaaagcccaagggcaggagtccgactcatccgagacatctgttaggggacccagaattaagcatgtgtgtcgccgtgcggctgtagcattgggacggaagcgagccgtattcccagatgatatgccaactctgtctgccctgccgtgggaggagagagagaagattctttccagcatgggaaacgatgacaagtcaagtatcgcagggagtgaagatgctgagccgctcgccccacctatcaagcctatcaaacctgtgaccaggaataaagcccctcaggaacctccagtaaagaagggcagaaggtcacgaagatgtggacagtgtcccggatgtcaagttccagaagactgtggggtatgcacaaactgcctggataaaccaaaatttgggggaaggaacataaaaaagcaatgctgtaaaatgagaaagtgccagaatctgcagtggatgcccagtaaagcctaccttcagaaacaggctaaggcagtgaagaagaaggaaaaaaaatccaagaccagtgaaaagaaggactccaaggaatcctccgtcgtgaagaatgtagtggacagcagtcaaaagcccacgccatctgccagggaggatcctgctcccaagaagagttcaagcgaaccaccgcctaggaagccagttgaggagaaaagtgaggagggcaatgtgtccgccccagggccagagtccaagcaggcaacaactcccgcaagccgcaaaagctcaaaacaggtctcccagcctgccctagtgatcccaccacaaccgccaaccaccggcccaccccgaaaggaagttccaaagaccactccatccgagccaaagaagaaacagccacccccacctgaaagtggccctgaacaatccaagcagaaaaaggtcgctcctcggccatccatcccagtgaagcagaagcctaaggaaaaagagaaaccccctcccgtaaataaacaggagaacgctgggactcttaatattttaagcaccctgtcgaatggcaattccagtaagcaaaagatcccggcagacggtgtgcaccgcatcagggttgactttaagtag

SEQ ID NO: 231430 - DNA, 11919 bp, Artificial Sequence
  Description of Artificial Sequence: Synthetic coding sequence
atggcccattcttgccgctggaggttccctgccaggcctggtaccactggcggtgggggtggcggaggacgccgtggactaggaggtgcgcctcgccagcgggtccccgcactcctgctgccaccaggtccgccagtaggcggaggtgggcctggtgctccaccatctcctccagccgttgcggcagcagccgcagctgctggctcgtccggagcaggcgtgcctgggggagctgccgcagcaagcgcggcaagttcatccagcgcctcctccagcagttctagctccagttcagccagttcagggccagcgctgctgcgggtgggcccagggtttgatgctgccctgcaggtgagtgcagctatcggcactaacctccgccgtttccgtgcagtgtttggcgagtccggtggcggaggtggttccggcgaggatgagcagtttctgggcttcggctctgacgaggaggttcgcgtccgatcacctactcgcagtccttcagtaaagacaagcccccgaaagccacgtgggcgtcccaggagcggaagcgatagaaacagtgccatcctatcggatcccagcgtatttagccctctaaacaagtctgaaactaagagtggcgacaagattaagaagaaggatagcaaatccatcgagaagaagagagggagacctcctacgttccctggggtaaagatcaaaataacccacggaaaagatatttcagaacttccaaaaggcaataaggaagactccctgaagaagatcaaaaggacgccctcagccacattccagcaggctaccaaaattaagaagttacgagccggaaagctgagccctttgaaatcaaaatttaaaaccgggaagctgcagattggaaggaagggcgtacagattgtcaggaggcggggacggccacctagcactgagcgcatcaagacaccttctggactgctcataaatagcgagctcgaaaagccgcagaaggtcagaaaagataaagaaggaaccccgcctctaacaaaagaagataagacggtggtgcgacagtcccctcggcgtatcaagcccgtgcgtattatcccaagcagtaagcgaaccgacgccacaatcgctaagcagctccttcagcgtgcgaagaagggtgcccagaaaaagatcgaaaaggaagccgcacagttgcagggccgtaaggtgaagacacaggtgaaaaatataaggcaattcatcatgcctgtggtgtctgctatttccagccgaattattaaaacccctagacgctttattgaggatgaagattacgatcctccgataaaaatagcaagactcgaaagtacccccaactcacgattttccgctccgagttgcggtagttcagagaaatcgtctgctgcctcacagcactcctcccaaatgtcaagcgactcatccaggtccagctctcctagtgtggacacgagcaccgactctcaggcaagtgaggagattcaagtcctgccggaagaacgcagtgataccccggaggtacaccctcccctgccaattagtcagtcccctgagaacgagtcgaacgacaggcgctcacggaggtacagtgtttctgaacggtccttcgggagcaggaccacaaaaaagttgtcaacgctacagtcggcccctcagcaacaaaccagtagttccccgcctccaccccttctcactcctcctcctcctttacagcccgcaagctcgatcagtgaccacactccttggctgatgcctcccactatacccctggcaagtccattcttgccggcttctaccgcgccaatgcaaggtaagcggaagtctatcctccgggaaccaacatttcgctggacttcactcaaacattcccgctcagagccccagtactttagcagtgccaagtatgcaaaggaaggcttgataagaaaaccaatcttcgacaactttagacctcctcccctgacccccgaagatgtaggttttgcgagcgggtttagtgccagcggaaccgcagcatctgctcgcctattttcaccactccactctggcacccggtttgatatgcacaagcgctcccctctcctgcgcgctcccaggttcactccatctgaagcgcacagccggatcttcgagtcggttactctgcccagcaacagaacttccgccggtacaagcagttcaggcgtaagtaacagaaagcgcaagcggaaggtgttctctccgattcgctctgagccgcgtagcccctcccacagtatgcgcacacggagtggcagactgagctccagcgagctaagcccgttgacgccaccatcttcagtctcctccagcttgagcatcagtgtgagtcccttagcaaccagcgccctgaatcctacgttcacctttccctcccactccctgacccagagtggagaatcagctgagaagaaccagcgccctcgcaagcagactagcgcgcctgccgaacccttctcaagttcctctccaacccctctgtttccatggtttacaccaggatctcaaactgaacgcggacgtaataaagataaggcccctgaagaactctcaaaggaccgggacgctgataagagtgtcgagaaggataaatcacgggagagagacagggagcgagagaaggaaaataagagggaatctcggaaagagaagcggaagaagggaagtgaaatccagagtagctccgctctctacccggttgggcgagtgtcgaaggaaaaggttgtgggtgaggacgtcgcaacttccagttcagccaagaaagctactggtcgcaagaagtcgagtagtcatgactctgggacagatataacttctgtgaccctgggcgatacaacagccgtgaagacaaagattctgatcaagaagggacgcggaaatctagagaagaccaatttagacctggggcctacggcaccctcattggaaaaggaaaagacattatgtctttccactccaagctcctccacagtgaaacattctacatcttctatcggttcaatgctggcccaggcagataagctgcccatgactgacaaacgggtggcttccctgctcaagaaagcgaaggcccaactctgcaaaatcgagaaaagcaagtcactgaagcagaccgaccagcctaaggcccaggggcaggaatccgactccagcgaaacgagcgtgcggggaccgaggataaaacatgtatgccggcgtgcagccgtggctcttggacggaaaagggccgtctttccggacgatatgccaacactgagcgctctcccgtgggaggagagggagaaaatactgtctagcatgggaaacgatgacaaaagttcaattgctggttctgaggacgctgagccattagcgccacctataaaaccgataaagcccgttacgaggaacaaagcccctcaggaaccaccagtgaagaaggggcgtcggtccagaaggtgcggacagtgccctggttgccaggtcccagaggactgcggggtgtgcacgaactgtctggataagcccaaattcggcggacgaaacattaaaaagcagtgctgtaagatgagaaagtgtcaaaacttgcagtggatgccttccaaggcgtatctccaaaagcaggctaaagccgtgaagaaaaaggaaaagaaaagcaaaacctccgaaaaaaaagacagtaaagaaagcagtgtggtgaagaacgtggtggactcttcacagaaaccaaccccttctgcccgagaggatccagctccaaaaaaatcctcttccgagcctccaccacgtaagcccgttgaggagaaaagcgaggaagggaatgtttccgcgcctggccctgagtctaaacaggccactacacctgctagtcggaagtccagcaaacaggttagtcaacccgctctggtcatccctccccagccaccaacaacagggcctccacgaaaggaggtacctaagaccacccccagcgaacccaaaaagaaacagccccctccacctgagagcggtcctgagcaatccaagcagaaaaaagtagcccctcggccatccatacctgtgaagcaaaagcctaaggagaaggagaagccacctccagtaaataagcaagagaacgcaggtacgttgaacatactatcgacactttcaaatgggaattcttctaaacaaaaaatcccggctgatggggtccacaggatacgtgttgactttaaggaagattgtgaagccgaaaatgtgtgggaaatgggcggactcggtattctgactagcgttccgatcaccccccgagtggtctgttttctctgtgcctcatctggccatgtagagttcgtctactgccaggtgtgctgcgagccgttccataagttctgtctggaagaaaatgagcgccctttggaggaccagcttgaaaattggtgctgcagaagatgtaaattctgccacgtctgtggcagacagcatcaggccacaaagcagttactggaatgtaataaatgtcgaaatagctaccaccctgaatgcctgggcccaaactaccccaccaaaccaacaaagaagaaaaaagtctggatttgcaccaagtgtgtgagatgtaagtcatgtggatctaccactccagggaagggttgggatgctcagtggagtcatgatttctcgctctgccatgattgcgcaaagctcttcgcaaagggtaacttttgcccactttgtgacaaatgctacgacgacgacgactatgaatccaaaatgatgcagtgtggaaaatgtgatcgatgggtccactccaagtgcgagaacctctcaggaaccgaggacgaaatgtatgagatactgtctaatttaccagaaagcgttgcatacacttgtgtcaattgtaccgaaagacatcccgcagaatggcggctggccctcgaaaaggaactgcaaatttccctaaagcaggttctgacagctctgctgaacagtcggactactagtcacctgctgagatatcgacaggcagctaagcctccggacctaaaccccgagaccgaagagtccattccgtctaggtcaagccccgaagggcctgatccgccagtgctaaccgaggtctccaagcaagatgaccagcagccactcgatctcgaaggagttaaaagaaagatggatcagggcaattacactagcgtcttggagttttccgacgatattgtgaaaattatacaagccgctattaattccgatggcggacagcccgagatcaaaaaggccaacagcatggtgaaaagctttttcatccggcaaatggaacgtgttttcccatggttctccgtcaagaagtcgcgattttgggaacccaataaggtctcctcgaatagcgggatgctgcccaacgcggtgctcccaccatccctcgatcacaactacgcacagtggcaggaacgagaggagaattcccacaccgaacagccaccactcatgaaaaaaatcatacccgcacccaaacctaaggggccaggcgaacccgactccccaaccccactccaccccccaaccccgcctattttgtcaactgaccgctcccgggaagattccccggagctgaatcccccacccggtatcgaggacaaccggcagtgcgcactatgcctgacctatggcgacgacagcgctaacgacgcgggaagactcctgtatattggccagaatgagtggacccacgttaactgcgcactctggtctgcggaggtgtttgaggatgacgacggctctctcaaaaacgtgcacatggccgtgattcgcggtaagcaattgcggtgtgagttctgtcagaagcccggagctaccgtggggtgttgtctgacatcctgtaccagcaattatcatttcatgtgtagccgggcaaaaaactgtgtgtttctcgatgataagaaggtctattgccaaagacacagggatttgataaagggcgaggttgtgcccgaaaatgggtttgaagtgtttcgaagagtctttgttgactttgaaggcatctccctgcgccgtaagtttctgaatggactcgagccagagaacatccacatgatgatcggaagtatgacaattgactgccttgggatcctgaacgacctgtccgactgcgaggataagttatttcctatcggctaccaatgctcccgagtttactggagtacaaccgacgcacgcaaacgctgcgtgtacacatgcaagatcgttgaatgccgcccaccagtagtggagcccgacatcaattcaacggttgagcatgatgaaaacagaaccatagcccattcacccacgagcttcactgagagctccagtaaggaaagccagaacacagccgagatcataagtccaccaagtccagaccggcctcctcactcacagacttccgggtcttgctactaccatgtgatcagcaaagtgcctagaatcagaactccgagctacagccctacccagcgctcccccggatgccggccacttccctccgcaggatcccccacccctaccacccacgaaatcgtcacggtgggggaccccctgcttagttccgggttaaggtcaattggatctcgtagacacagtacatcatctctaagcccccagcgcagcaagctgagaattatgtcaccgatgagaactggcaatacgtactccaggaataacgtttcaagcgtctctacaaccggcaccgccacagacctggagtccagcgcaaaggttgtcgaccatgttctagggcctctgaacagtagcacaagcctgggtcaaaacacatctaccagctctaacctccaacgcaccgttgtgaccgtcgggaataaaaacagccacttggatgggtcgagctcaagcgaaatgaagcagtctagcgcatctgatcttgtgagcaagtcctcctctctcaaaggggaaaaaacaaaagttctgagctctaagtccagcgaagggtcagcacacaatgttgcttacccagggatccctaaactcgctccacaggtccataacacaacctccagggagctgaatgtgtctaagattggttcatttgctgagccaagctccgtgagtttcagttctaaagaagctctctctttcccccacctccacctgcgaggacaacggaacgaccgcgaccagcacaccgactcaacccagtcagccaattctagcccagatgaagacaccgaggtcaaaacccttaaactgtccggaatgtcaaacagaagctccattatcaacgaacacatgggaagcagttcccgggatcgcaggcagaagggtaagaagtcatgcaaggaaaccttcaaagaaaagcactcaagtaagagcttcctagagccaggccaggtcaccacgggtgaagaagggaatctgaaacccgaattcatggacgaagttctgaccccagagtacatggggcaacgaccctgtaataatgtctcctcggataagattggcgacaagggcctgtccatgcccggtgtacccaaagccccacccatgcaagtggaggggagcgccaaagagcttcaggcccctcggaagagaactgtcaaggtgaccctcactccgctcaagatggagaatgaatcccagtcaaagaatgcgctcaaggagtcttcaccggcttcccctcttcaaatcgagtccacctcaccaacagaaccaatctctgcctcagaaaatcccggtgatgggccagtagctcagccctcccccaacaacacatcctgtcaggacagtcagtcaaataactaccagaacctaccagtgcaagatcggaacttgatgcttcccgatggtcccaagccccaggaagacggcagttttaaaaggagatatccccgacggtctgcccgagccagatctaatatgttcttcggtctgacaccgctttatggcgtaaggtcttacggcgaggaagatattcccttctatagtagcagcactggtaagaagaggggcaaaagatctgccgaaggccaagtcgatggcgcagatgatttgtccacgtccgatgaagacgacctctattattacaattttacccgcacagtgatctctagcggaggtgaagaaagacttgcaagccataacctcttccgcgaagaagagcaatgcgatctcccaaaaatctcccagcttgacggggtggatgatgggacagaatccgataccagcgttaccgcaacgacccggaagagtagccagattcctaagaggaacggcaaagaaaatggtaccgaaaacctgaagatagatcgccctgaggatgcgggagagaaggagcatgtgaccaagtcttccgtcggacataagaatgaacccaagatggacaattgtcactccgttagccgggtgaaaactcagggacaggatagcctcgaggcccagctgagcagcttggaatcatctagaagggtgcacacatctacaccatccgacaagaatttgcttgacacgtacaacactgaactgcttaagagcgattccgataataataatagcgatgattgcgggaacatcctgcctagtgacatcatggatttcgtgcttaagaatactcccagtatgcaggcactcggcgaaagccctgaatccagttcttccgagttgttgaatttgggagaaggcctgggcttggactctaatagagaaaaagatatgggcttatttgaggtgttctctcagcaactccctacgaccgagccggtggactcatccgtttcaagcagcatcagtgctgaagagcagtttgagctgcctctcgagctgccgtccgatctgtcagtactgactacgcgaagcccgacggttccatcgcagaatccctctcgcctggccgtgatctcagactcgggtgagaagcgcgtgacaattactgaaaagtcagtggcttcgtccgaatccgaccctgcgctgctgtcccccggagtggatccaaccccagagggacatatgacgccggaccactttatccagggacacatggacgctgatcacatctcttccccaccatgcggatcagttgagcaaggccacgggaacaaccaagaccttactagaaattcctccacacctgggttacaggtgcccgtttcacccacggtgcccatccaaaatcagaagtacgtgccgaacagtactgatagtcccggaccatcacagatctccaacgccgctgtgcagacaacaccccctcatttgaaacccgcaacagaaaagcttattgtggtcaaccagaacatgcaacctctttatgtgttgcagaccttaccaaatggagtgacgcagaagatccagttaacatcaagcgtgtcttccaccccctccgtgatggaaacaaacacttcggtactcggaccaatgggaggtggcctgactctcacaaccggcctgaatccgtcgctgcctacctcacaatcattgttcccctctgccagcaaaggactcctgccaatgtcgcaccatcaacacctccattcatttcctgcggctacccaaagttcattcccccctaacatcagcaatccacctagtggcctgctgattggggtgcagccacccccagaccctcagctgctggtatcagaatcctcccaacggacagatctttccactacggttgcgactccctcttccggtctcaagaaacgtccaattagtagactgcagacaaggaagaataagaaactggcaccttctagcaccccgtcaaacatagccccatctgacgtcgtgagcaatatgactttgattaacttcacccccagccagctaccgaaccaccctagcttgctggatttggggagcctgaacacctcaagccaccggaccgtgccaaacatcatcaaaagatctaaaagttccatcatgtattttgagccggctccgctgttaccccaatccgtgggcggtaccgctgcaaccgccgctggcacgagtacaattagtcaggatactagccacttgacctcagggagcgtgagcggcctggcctcctctagctcagtactcaatgtcgtgagtatgcagaccaccactactcccacctcaagtgcaagcgtacctggtcacgtcaccctgacaaatcccagactgctcgggacccctgacataggatccatcagcaatctcttaattaaggcatcacaacagagcttgggcattcaagaccaaccagtagcactgcctcccagttcaggcatgttccctcagttgggcacatcccagacacccagcactgctgcgataactgccgcatccagtatttgcgttctcccgagcacccagactactggaataacagccgcttctcctagcggcgaagctgatgagcattaccagttgcaacacgtgaatcagttactcgccagtaagactgggatccattcctctcaaagagacttggactctgcttcgggcccacaagtttccaacttcacccagacggtcgacgcccctaactcaatggggttagaacaaaataaggcactgagctcagcagtgcaggctagccctactagccctggcggaagcccttcatctccttcctctgggcagagatctgcctctccatcggtgcccggtcctacaaagccaaagccgaagacaaagagatttcagttgccattggacaagggcaatggcaaaaagcataaagtctctcacctaagaacatcaagctccgaagctcatattcctgaccaggagaccactagtttgactagcggaaccggcacacctggagcggaggccgaacaacaggatacagcatctgtcgagcaaagtagtcagaaggagtgcggccagccagccggtcaggtggcagtgctccccgaggtccaggtgactcagaatccagctaatgaacaggagtcagccgagccaaagacagtggaggaggaggagagcaatttctcaagcccccttatgctgtggctgcagcaagagcagaaaaggaaggagagcattacagaaaagaagccgaaaaaggggctcgtgttcgaaattagttctgacgatggctttcagatctgcgccgaatcaatagaagatgcttggaagagtctcacggacaaggtccaggaagcacggagcaatgcccgtctcaagcaactctcttttgcaggcgtgaacggtctgagaatgcttggaatcctccatgacgcggtagtgtttttgattgagcagctctcgggggctaagcactgccgtaattataagtttaggttccacaaacctgaggaggccaatgagccccctctgaacccccacgggtcggcaagggcggaagtgcacttaagaaaatctgcttttgatatgtttaactttctcgcctccaagcaccggcaaccacctgaatacaacccgaatgatgaagaggaggaggaagtccagctgaagtctgcccgaagagccacaagtatggatttacctatgccaatgaggttcagacacttgaaaaaaacatccaaggaggcagtcggcgtataccgaagccccattcacgggcgagggctgttctgcaagagaaatatcgatgccggagaaatggtgatcgagtacgcgggtaatgtcattcgctccatccagacagacaaacgcgaaaagtactatgactcgaaagggatcggctgttatatgttccgcattgatgactccgaggtggtggatgccacaatgcacgggaacgcagctaggtttattaaccattcatgtgagcccaattgctactccagagttattaatatcgatgggcaaaaacatattgtcatattcgctatgagaaaaatctaccgtggagaagaactgacctacgattacaagttcccaattgaggatgccagtaacaaactgccctgtaattgcggagccaagaagtgcaggaagtttttgaattac

SEQ ID NO: 231431 - DNA, 1680 bp, Artificial Sequence
  Description of Artificial Sequence: Synthetic coding sequence
atggacaaccagtgtaccgtgcaggtccgcctggagctgggccaccgggctcagctgcggaagaaacccacgacggagggattcacccatgattggatggtctttgtcagggggcctgagcagtgcgatatccaacacttcgtggagaaagtcgtcttctggctgcacgactcattcccgaagccgagacgtgtttgcaaggaaccaccttacaaagtggaggaatcaggctatgcaggatttatcatgcctatagaggtgcatttcaaaaacaaagaggagccaaggaaagtgtgttttacttatgacctatttctaaatctggaaggcaaccctccagtgaaccaccttaggtgtgaaaagttgacttttaacaatccaaccactgagttccgatataagttactgcgggcagggggagtgatggtgatgcctgagggggctgacacagtgtccagaccaagtcccgattatcccatgttacccaccattccactctctgctttcagcgacccgaagaagacaaagccatcccacggcagcaaagatgcaaacaaagagtccagtaagacttccaagccccataaggtaactaaggaacatagggagcggccaagaaaagattcggaatcaaaatcatcctcaaaagagctcgagcgcgagcaggcaaagagctccaaggacacatcccggaagcttggcgaggggagactccccaaagaggagaaagccccacctcctaaagccgcattcaaggagcctaaaatggctctgaaggaaactaaactggagagtaccagccctaaaggaggccctcctccaccacctcctccgcctccaagagcgtcttctaaaagacctgccaccgccgattccccaaagccttcagcgaagaagcagaagaagagcagttcaaaaggcagcagatccgctcccggtacatctccacggactagcagttcctctagtttctccgataagaaaccagcgaaggacaaaagctctacacgcggagagaaagtgaaggctgagagcgagcccagggaggcgaagaaagcattggaggtggaggagtctaactctgaagacgaggcatcgtttaagagcgagagcgcacaatctagtcccagtaacagcagttccagtagtgattcgtcttcagactcagacttcgagccttcacagaaccattcacaggggcctctgcggtccatggttgaggacctgcaaagcgaagagtccgacgaggatgatagttcatctggggaagaagccgcaggtaagacaaacccgggaagggactcaaggttgtcattcagtgacagcgagagcgataatagtgccgactccagcttgccctcccgcgaaccccctccaccccaaaagcctccaccccctaactccaaagtgagcggacgcagatcgcccgaatcgtgttctaaacctgagaagatcttgaagaagggaacttatgacaaagcctacaccgatgaactagtggagttacatcgacgccttatggcccttagggagcgaaacgtgctgcaacagattgtgaacctaatcgaggaaacagggcacttcaatgtgactaatacaacattcgacttcgatctcttcagcctggacgaaaccacggtgcgaaagctgcagtcttgtctggaggctgtcgcgacctag

SEQ ID NO: 231432 - DNA, 273 bp, Artificial Sequence
  Description of Artificial Sequence: Synthetic coding sequence
atgagagatcccgtttcttcccagtactcctcttttttattctggcgcatgcccatcccggagctggacctgtccgaattggaagggttggggctcagcgataccgccacctataaggtgaaggattcaagcgtaggcaaaatgatagggcaggcaacagccgcagaccaggaaaaaaatccggagggggacggactcctggagtactccacattcaatttttggagggcacctattgcttctatccattctttcgagctggatctgttgtag

SEQ ID NO: 231433 - DNA, 417 bp, Artificial Sequence
  Description of Artificial Sequence: Synthetic coding sequence
atgaaggacctgcatagcgatgataatgaggaggagtctgacgaagttgaagacaatgataacgattccgagatggagcgccctgtaaataggggtgggagtcgatctcgaagagtatccctatcagatggcagcgattcagaatcctcatcagccagttctcccctccaccacgaacctccgcctccgctgctaaaaaccaataataaccaaattctcgaggtgaagagccccattaaacagagtaagtcagataaacagatcaagaatggcgagtgcgataagatcgttaacctgattgaggaaacaggacatttccatatcaccaatacaacatttgactttgatctgtgtagcctagataagaccacagtacgcaagctccagagttacttagagacgtcaggaactagctag

SEQ ID NO: 231434 - DNA, 489 bp, Artificial Sequence
  Description of Artificial Sequence: Synthetic coding sequence
atgaaggatctccactcagatgataatgaggaggagtccgacgaagtggaggacaatgataacgattccgaaatggagagaccagtcaatcgcggaggttcaagatcaagacgggtgtcgttaagcgatggtagtgactctgaatccagctccgcctcatcaccactgcaccatgaaccacctccacctttgttaaagacgaacaacaatcaaatcctagaggtgaagagcccgatcaaacagtctaaaagcgataagcagatcaaaaacggggaatgcgataaagcttacctggacgaattagttgaactgcacaggcggcttatgacgctgagggaaagacacatcttgcagcagatcgtcaacctgatcgaggaaaccgggcattttcatatcacaaataccactttcgattttgacctctgttcactcgataagaccacggtcaggaaacttcagagttatctggaaacctctggcacgtcttag

SEQ ID NO: 231435 - DNA, 417 bp, Artificial Sequence
  Description of Artificial Sequence: Synthetic coding sequence
atgaaggatctgcactctgacgacaacgaggaagaaagcgacgaagtggaggacaacgataacgacagcgaaatggaacgcccagtgaatcggggaggcagtagatcacgccgagttagcctgtctgatggctctgattccgagtcttcctcggcttcctcaccgttacaccacgagcctccgcctcctctgttgaaaacaaacaacaatcagatcctggaggtgaaatctccgattaaacagtctaaatccgacaagcaaattaagaacggggagtgtgacaagattgttaatctgatcgaggaaaccggacatttccacatcacaaatacaacatttgactttgatctgtgcagcctcgacaagaccacagtgcgaaagctccagagctacctcgagacttcagggacttcctag

SEQ ID NO: 231436 - DNA, 1707 bp, Artificial Sequence
  Description of Artificial Sequence: Synthetic coding sequence
atggccagtagttgtgccgtgcaggttaaacttgagctgggtcacagagctcaggtaagaaagaagcccacggtcgagggcttcacgcacgattggatggtctttgtgcggggacccgagcactccaacattcaacattttgtcgagaaagtggtgtttcacctccatgagtctttccccagaccaaaacgtgtgtgcaaggatccgccttataaagtcgaggaatctgggtatgccggattcatcctccctattgaggtttactttaagaataaagaagagccgaggaaggtgcgctttgactatgacctgtttcttcatttagagggtcacccacctgtgaatcacctccgctgcgaaaaactgacttttaacaaccctaccgaagactttcgaagaaaactactgaaggctgggggtgatccaaaccgtagcatccacacgtctagttcaagctcgtcttccagctctagctctagcagttcatcatcaagctccagctcaagttcgtccagtagtagtagttctagcagcagctcaagctcatcttccagcagcagctcctcctcaacaagcttttccaagccccataaactcatgaaggagcacaaggagaaacctagcaaggactctagagagcacaaaagcgcctttaaagaacctagccgcgatcataataagagttctaaagaatccagtaaaaagccaaaggaaaacaagcccctgaaggaggagaagattgttcctaaaatggcctttaaagagcccaaacccatgagtaaggaacctaagcccgactcaaacctgctcacaatcacatccggccaggacaagaaagcgcctagcaagcgcccacccatatcggactcagaggagttgagcgccaagaagcgtaagaaaagttcgtccgaggcactgttcaagagtttctcatccgcgccacctctgattctgacctgtagcgcagataaaaaacagattaaggataaatcgcatgtgaaaatggggaaagtaaaaattgaatccgaaacttcagagaaaaaaaaaagtacactgcctccatttgacgatattgtggatcctaatgactctgatgtggaggagaacatcagcagtaagtcagattctgaacagccatctccagcttcatcctcatcctcctcttcatctagcttcacaccaagccagacgagacagcaaggccctctgcggtctataatgaaagacctccattccgatgacaatgaagaagagagtgatgaagtcgaggacaacgacaatgactctgaaatggagaggccagtgaacagggggggttcgagatctaggcgagtgtcacttagcgatggctctgacagtgaaagcagttctgctagtagtcccctgcatcatgaaccacctcccccactactgaagaccaataataatcagatcctggaggtgaagagtccaattaagcagtctaagtccgacaagcagataaagaacggtgagtgcgacaaagcttacctggatgagctggtggaattacatcggcgtctgatgacactgcgggagagacacatcttacagcagattgtgaacctgatagaggagaccgggcatttccatattaccaatacgacatttgacttcgacttgtgctccctagacaagactactgtgcggaaactccaaagctatctcgaaacctccggaacatcgtag

SEQ ID NO: 231437 - DNA, 1698 bp, Artificial Sequence
  Description of Artificial Sequence: Synthetic coding sequence
atgtgtgccgtccaagtgaagctggaactagggcatcgggcacaagtcagaaaaaagcccacagttgaggggttcactcatgattggatggtctttgtgaggggccctgagcacagcaatatacagcattttgtggaaaaagtcgtctttcatttgcacgaatcatttccaagacccaaacgggtgtgcaaagaccccccatacaaggtggaggagagcggatatgcgggttttattctgccgattgaggtgtactttaagaacaaagaggagccaaggaaagtaagattcgactacgatttattcctacacctagagggccacccccctgttaatcacctgcgatgcgaaaagctgacattcaataacccaaccgaggacttccgaagaaaactgttgaaagccggtggtgacccgaatcgaagcattcacacaagttccagcagcagctcctcatctagctcttcatccagttcctcgtcatctagtagctcttcatcttcgtcctcctcatcaagtagctcaagctcgtcaagctcctcaagtagctcttcatcttctacctcatttagtaagccccacaaactcatgaaggagcacaaggagaagccttcaaaggacagtcgggaacataagtctgcgttcaaggagccgtcccgtgatcacaataaaagcagcaaggagagttcaaaaaagcccaaggagaacaaaccgctcaaggaggaaaaaatagtgccaaagatggctttcaaggaacctaagccaatgtccaaggagcctaaacccgacagcaatctcctgaccataacgagtgggcaagacaaaaaagccccatcaaagaggccacctatttccgattcagaggaactttccgccaaaaagaggaaaaagagcagtagcgaggctctcttcaagtcgttctcatcagctccacctctaatcctcacctgttctgctgacaaaaagcagattaaggacaagagtcacgtgaagatgggaaaggtcaaaatcgaaagtgaaacttcagagaaaaaaaagtcgaccttaccgcctttcgacgacattgtggaccccaacgactctgacgttgaggagaacatttccagcaaatctgactctgaacagccctctcccgctagctcctcttccagtagttcatctagctttaccccgtcgcagactcggcagcagggcccactgagaagtataatgaaagacctgcattcagacgataacgaggaggaatcagatgaggtggaagacaacgataatgattccgagatggagagaccggtgaacaggggaggctcacgctcacgtcgcgtctctctgagtgatgggtctgattctgagtcgagcagtgcctcaagtccacttcaccacgaaccgcctcccccactgctaaaaacaaataacaaccagattttggaagtgaaatccccaattaagcagtctaaatccgataagcaaatcaaaaatggtgagtgcgataaggcatacttggatgaactcgtggagctgcaccggaggctgatgaccctccgcgaaagacatatccttcaacagatcgtgaacctgattgaggaaactggccactttcacatcactaatactacatttgatttcgatctctgttccctagacaagacaaccgtcaggaagcttcagtcttacttagagacatcaggcacctcttag

SEQ ID NO: 231438 - DNA, 1824 bp, Artificial Sequence
  Description of Artificial Sequence: Synthetic coding sequence
atgcagcgggcacctccattccctttcatgtgtgtctcgcgcagacggaagaagtgccaggcccagcgatctctcccgaaacccagactccccgtcattcacgggtgcctatcaagcccttgcccccagtgtgccgtgcaggtcaagctggaactgggtcaccgggcacaggttcgcaaaaagccaaccgtagaaggtttcactcacgactggatggtattcgtgagaggacccgagcatagcaatatacagcattttgtggagaaggtggtattccacctgcatgagtcatttcccaggcccaaaagagtgtgtaaggaccccccttacaaggtggaggaatccggatacgcgggattcatcctgccaatcgaggtgtactttaaaaacaaggaggagccacggaaagtgcgctttgactacgatctctttctgcatttggaaggtcacccgcctgtgaaccatctccgctgcgagaagctgactttcaacaaccctaccgaggattttaggaggaagctgctgaaagctggcggagatccaaatcgcagcatccacacaagttctagcagtagttcatcttccagttcaagtagctcgtcctctagcagtagttcgtcctcaagctcgagcagttcgtccagttcatccagctcgtctagcagttccagctcaagtagttcctccaccagtttttccaagccccacaaactgatgaaggaacataaggagaaacctagtaaggattcacgagaacataaatccgccttcaaagaaccgagtcgcgaccataataagtcatccaaagagtccagcaagaaaccaaaggagaataagccacttaaggaggagaaaatagtgcccaaaatggcattcaaggagcctaaacccatgagtaaggagcctaaacccgacagtaatctcctgaccattacgtccgggcaagataagaaggcaccatcaaagaggccacccatctcagacagcgaagaactttcagccaagaaaaggaagaaaagttcgtcagaagccctgttcaaaagttttagctcagcccctccgcttattctaacctgttcagcagataaaaaacaaattaaagacaagagccacgtgaagatgggaaaggttaagatcgagtccgagacaagtgaaaagaaaaagtctacactgcccccattcgacgatatagtcgaccccaatgactctgacgtggaggagaacatttcttctaaaagcgattccgagcagcctagccctgctagctcgtctagcagttcgtcctcaagcttcaccccgtctcaaaccaggcagcagggaccccttagatcaatcatgaaggacctccactcagatgacaacgaggaagaaagcgacgaggttgaggacaacgacaacgacagcgagatggagcgccctgttaaccgcggtggaagccgaagcagacgggtgagcctcagtgacggctcggatagcgaaagcagcagcgcttcttctcccctccaccacgaaccgcctccacccttattgaagactaataataaccagatcctggaggtcaaaagccctatcaagcagagcaagagtgacaagcaaattaaaaatggcgaatgcgataaggcctacctggatgaactcgtggagctccatagaagactgatgacacttagggagcggcacattctccagcagatcgtcaacctcatcgaggaaacgggacatttccatatcacaaacaccacctttgatttcgatctgtgcagcttagacaaaacaacagtgagaaagctgcagtcctatctggagactagtggcacttcctag

SEQ ID NO: 231439 - DNA, 4985 bp, Artificial Sequence
  Description of Artificial Sequence: Synthetic coding sequence
atgtcagccggtggcagggatgaggaacgccgaaagctggccgacattatacaccattggaatgccaatagactcgaccttttcgagattagccagcctactgaagacctcgaatttcacggtgtgatgcgcttctactttcaggataaggccgcagggaactttgcaaccaagtgcatcagggtatcgtccacggccacaacccaggacgtgattgagacactcgccgagaaattcaggccagacatgaggatgctgagtagtcccaaatactccctgtatgaagtacacgtctctggtgagcgaagactggacatcgacgagaagccgttggtagtccagctgaattggaacaaggacgaccgggaagggcgatttgtgcttaagaatgaaaacgacgccatcccccctaaaaaggcccaatctaacggacctgagaagcaagagaaggagggcgttatccagaacttcaagcgcaccttgagtaaaaaagaaaaaaaggaaaagaagaaacgcgagaaagaggcactgcgccaggccagcgacaaggatgaccggcctttccagggcgaggacgtagagaacagccgattagccgctgaggtgtataaggacatgccggagactagctttacacgaactatttcaaatcctgaggtggtgatgaaacgcaggagacagcagaaactcgaaaagaggatgcaggagtttcgctcctcagacggcagaccggactctggaggaaccctacggatttacgccgattccctcaagccaaacattccatataagacaattcttttgtccacaacagaccctgcggatttcgcagtggccgaagccctggaaaaatatggcttggaaaaggagaaccccaaggattattgcatcgccagagtgatgctgccacctggtgctcagcattcagatgaaaaaggggctaaagagatcatactcgatgacgacgaatgccccctgcaaattttcagggaatggccatcagacaagggaatcctggttttccaacttaaacgcaggcctcccgaccacatcccaaaaaagactaaaaagcacctggaaggaaaaacgcccaagggcaaggagcgcgcagacggaagtgggtatggttccactctgcccccagagaaacttccctacctggttgagctgagccctggcagaaggaaccattttgcctactacaattatcatacatacgaggatggatctgattcgagggacaagcccaaactgtatcgcctgcagctcagcgtgacggaggttggcacagaaaaattagacgacaattctatccaactgttcggtcctggaattcagccccatcactgcgatttgaccaatatggacggcgtggtgactgtcacccccagatccatggatgctgaaacatacgtggaaggccaacgtatctcagaaactaccatgcttcaatcgggaatgaaagtccaattcggggcatctcacgttttcaaatttgtggacccctcccaggatcacgcattagctaagcgcagtgttgacggcggtctgatggtcaaaggtccgcgtcacaagccaggaatcgtacaggagacgacgttcgatctgggaggtgatattcatagtggtaccgctttgcccactagcaagtcaacaacaaggttagacagcgacagagtgagctccgcatcctccactgccgaacggggtatggtcaaacccatgattagagtggaacaacagccggattacagaaggcaggagtcccgtacccaggatgcttctggccctgagttaattctcccggcatctatcgagtttcgagagtccagtgaggactccttcttgagcgctattattaactatactaactctagtaccgtgcacttcaagttaagtcccacttacgtactttatatggcatgtaggtacgtgctgtccaatcaatacagacccgacatatcccctactgagcgcacccataaggtcattgccgtagtgaacaagatggtaagcatgatggaaggggtaatccaaaaacagaagaatattgccggagcccttgccttttggatggccaacgcctctgaactgctcaattttattaaacaagaccgagatttgagtagaatcacgctagatgcgcaggacgtgctcgcccacctggtgcagatggctttcaaatacctcgtgcattgcttgcagtctgaactcaataattatatgccagccttcctggatgatccagaggagaactctctgcagcggccaaagatcgacgatgtactccacaccctcactggagccatgtctctgctgcggaggtgccgggtcaatgccgcactgactatccaattgttttctcaactgttccactttatcaatatgtggctattcaatagactggtgaccgatcccgattcagggctttgtagtcattattggggcgcaattattcggcagcagctgggacacatcgaggcttgggcggagaagcagggattggaactggctgctgattgtcatctcagccggattgtgcaggctacgaccctgcttaccatggacaagtatgctccagatgatattcccaatattaattctacttgctttaagcttaacagcctgcagctgcaggctcttttgcagaactaccactgtgccccagacgaaccgttcatcccgacggaccttatcgagaatgtagtcaccgtggccgagaacacagcagacgagctcgcaagatctgatggccgagaggtccagctcgaggaggacccagatctgcagctcccgttcctgttacctgaagacggttatagctgtgatgtggtgcgaaatattcccaatgggcttcaggaattcctagacccgctgtgtcagcgtgggttttgccgtcttatcccacatacacggtcaccgggaacatggaccatctatttcgagggcgctgactatgaatcccatctcttgcgcgagaataccgagctcgctattcccttgaggaaagagcctgaaatcattactgtgacgttgaagaagcagaacggcatgggtctctccattgttgcagccaaaggcgctggacaggacaagttgggaatctacgtgaaatctgtagttaagggaggtgcagctgatgtggatggaagactagcagccggagatcagctgctatccgtcgacgggcgaagcctggttggtctgtcacaagagagagctgccgagctcatgacaaggacgagcagcgtcgtaaccttggaagttgccaaacaaggagcaatatatcatggactcgccaccctcctcaaccaaccttcacccatgatgcagcggatcagcgatcgtcggggttccgggaaaccacgcccaaagtccgaaggcttcgagctctataataacagcacacagaacggaagcccagagtcaccacagttgccttgggctgagtatagcgagccaaaaaagctcccgggagatgatcgactgatgaaaaatagggcagaccaccgcagctcaccaaatgtggctaatcaacctcctagtccaggcggaaagagcgcatacgcatccggtacaacggccaaaatcacctctgtgagcacaggcaatctctgtacggaagagcaaaccccgccaccccgacccgaggcataccccattccgacacagacctatacaagggagtatttcacattcccggcaagcaagtcgcaggatagaatggctcctccccagaaccagtggcctaactatgaggagaaaccacatatgcatactgattcaaatcactcttccatagccattcagcgcgttactagaagccaggaagagcttcgggaagataaggcataccagctggagcggcacagaatcgaggccgcaatggaccgcaagtcggatagtgacatgtggatcaatcaatcctcctctttagattcatctacgtcgtctcaggaacatctgaatcactctagcaaaagtgtgacacctgccagtaccctgacgaaatcaggccctggacggtggaaaacaccggcagccatccccgctacccctgtggcagtgtctcagcccattcgcacagaccttcctccgcctcctccgccaccccctgtccattacgccggagactttgatggaatgagcatggacctgcctttgcctccacccccaagcgcgaaccaaatcgggctgccaagtgctcaggtagccgctgccgaacgacgtaagagagaagagcaccagagatggtacgagaaggaaaaggcccgtctggaggaagagagggaacgaaaacgaagggagcaggaacgtaagctgggccagatgaggactcaaagtctcaaccctgccccattttcacctctgaccgctcagcagatgaaaccagagaaaccttccacccttcaacgaccacaggaaaccgtgattcgcgaactccaaccacagcagcagcccagaaccattgagcggagggatctccagtatataacggtgtctaaggaggagctctcgtccggtgacagtctgtcccctgacccatggaaacgagacgctaaggagaagctggagaaacagcagcaaatgcacatcgtggatatgctatcaaaagagattcaggaattacagtccaaacccgatagatcagcagaggagtcagatcggctacgaaaacttatgctggagtggcagtttcagaaacgcctgcaagaatccaagcaaaaggacgaggacgatgaggaggaggaagatgacgatgtcgacaccatgctgattatgcagcgcctggaggccgagcgcagggcccgacagacagccatgcccgcaattagtgttctggatcttctccaggacgaggaaaggcggagacagcagcaactggaagagatgcgcaagagagaagcggaggacagggctcggcaagaggaggagagacgccgacaggaagaggagaggacaaaacgcgatgcagaggagaagta

SEQ ID NO: 231440 - DNA, 4998 bp, Artificial Sequence
  Description of Artificial Sequence: Synthetic coding sequence
atgtccgccggaggcagagatgaagagcgcaggaagcttgcggatatcatccatcattggaatgcaaatcggcttgatctctttgagattagtcagcctaccgaggacctggagtttcatggcgtgatgcggttctactttcaggacaaagcagctggcaatttcgccaccaagtgcattcgggtgtcaagtaccgcgactactcaggatgtgattgaaactctggctgaaaaattcagaccggacatgcggatgctatcatcccctaagtacagcctgtacgaagtccacgttagcggcgagagacgactggacattgacgagaagccacttgtggtgcagttgaattggaacaaagatgatcgagagggcaggtttgtccttaagaacgaaaatgacgctatcccgcctaagaaggcacagtccaacgggcctgaaaaacaggagaaagaaggagtcatccagaattttaagcgcactctgtcaaaaaaggaaaaaaaagaaaagaaaaagagggaaaaagaggccctcagacaggcttcagacaaagacgaccggcctttccagggcgaagacgtagagaacagccggctggctgctgaggtctacaaggatatgccagaaacctctttcacaaggaccatttctaaccccgaagtcgtcatgaagaggcgtaggcaacagaagctggagaaaagaatgcaagaatttcggtcatccgacggtcgacccgacagcggcggaacattgagaatctacgccgattcacttaagccgaatattccctacaagaccatactgctttcaactacagacccggcagactttgcagtcgctgaagctctggaaaaatatgggctcgagaaggaaaatcctaaagactactgtattgcccgtgtgatgctgccaccaggagctcagcactccgatgagaaaggtgccaaggagatcatcttggacgacgacgagtgtcccttgcagatcttccgcgaatggccttcagataagggcattctggtcttccaacttaagcgcagacccccagaccacatccccaagaaaacaaaaaagcacctcgaggggaaaacccctaagggtaaagagagggcagacggatcaggttatgggtctactctgccgcctgaaaaactgccgtatctggtcgagctgagtccaggtcgcaggaatcactttgcctattacaattaccacacctacgaggatggtagtgactccagggataaaccaaagctgtaccgactccagctcagcgtcaccgaggttgggacagaaaagctggacgacaactccatacaactgtttggtcctgggattcagccacatcactgcgacttaacgaatatggatggggtcgtgaccgttacacccagatctatggacgccgaaacatacgtggagggtcagcgcataagcgagacaaccatgctgcaaagtggcatgaaggtgcagtttggagctagtcacgtctttaagttcgtcgatccatcccaggaccacgcactggccaagcgctcggttgacggcggtctgatggtcaagggaccaaggcacaagcctggaattgtacaggagacaacgtttgacttgggcggagacatccatagcgggaccgctctccccacatccaagagcactacaaggctcgattccgaccgcgtgtcttctgccagctcaaccgccgagcgcggtatggttaagcccatgattagagtcgaacagcagcctgattaccgacgtcaagagagccgcactcaagatgcttccggacctgaactcatcctgccagctagtattgagttcagggaatcttcagaggacagtttcctaagcgctatcattaactacactaatagtagcactgtgcatttcaaactgagtccaacctacgtcctgtatatggcctgcaggtacgtactctccaatcagtacaggcccgacataagtcctaccgagcggacccacaaagtgattgctgtggtaaacaaaatggtaagtatgatggagggggtgattcaaaagcagaaaaatattgcgggagctctggctttttggatggccaacgcctcagagcttctcaactttatcaaacaagaccgagatttgtcccggatcacccttgatgctcaggatgtcctagcacacctggtccagatggcctttaagtacctggtgcactgtctgcagtctgagttgaacaattacatgccagcgtttttagacgaccccgaagaaaactccctccagaggcctaagatagacgatgtgctccacaccctgaccggagcaatgagcctcctgagaaggtgccgcgtgaatgccgcactcaccatccaattgttctctcagctcttccattttataaacatgtggctgtttaaccgcctagtgacagatccggacagcggcctctgctctcactattggggtgccatcatccggcagcaacttggacacatcgaagcctgggctgaaaaacagggcctggagctggcggctgactgtcatttgtccaggatcgtacaggccacgacacttctgaccatggataagtatgcacccgatgatattccaaacatcaattccacctgctttaagctaaactccttgcagctccaggccctgctgcagaactatcattgcgccccagacgagccgttcattcctaccgatttaattgaaaatgtggtcaccgtggccgaaaataccgcggacgagctcgctcggtctgatggaagagaagtccaactcgaggaggatcctgacttgcagctgccattcctcctccccgaggatggctactcgtgcgatgttgtgcggaatattccaaacgggctacaggaattcctcgatcccctatgtcagcgtgggttttgccggctgattccacatacccgctcgccaggaacttggaccatctattttgagggagcagattatgagagccatctcttgagggagaacactgagctagcccagcccttgcggaaggaacccgaaattatcacggtgacactgaaaaagcagaatgggatgggactgagtatcgtggcggctaaaggagctggccaagataaactaggcatttacgttaagtccgtcgtgaagggaggcgctgccgacgtggatggaagactggccgctggtgaccagctgctttctgttgacggaagaagtctggtgggtctgtctcaggagagagctgccgagctaatgacacgtacaagctccgtcgtcactttagaagttgcaaagcaaggcgctatctaccacggtctggctacactgctcaaccagccatcccctatgatgcagcgcattagcgatcgcagaggaagcgggaaacccaggccaaagtcagaaggttttgagctttacaacaattctactcagaatggctctccagagagtccgcagctgccctgggctgagtactctgagcccaagaagctgcccggagacgaccgcttaatgaaaaatcgcgcagaccatcgctcctctccgaacgtcgctaatcagcctccctctccaggcggaaaatcggcctacgccagcggcaccaccgccaaaatcacctccgttagcacggggaatttatgcaccgaagagcagacccctccgccaagacccgaagcatatccaattcccacccagacttacacgagggaatatttcacatttccggctagtaagtctcaggatagaatggcaccaccacaaaaccagtggccaaattatgaggaaaaaccacacatgcacacagacagcaaccactcgtccatcgcgatccagcgtgtcacccgatcccaggaggaactgagagaagacaaagcctatcagcttgagcggcacagaatcgaggctgccatggataggaaatccgatagtgatatgtggatcaaccaatcctctagcctggacagctctacatccagccaggaacatctaaatcacagcagcaagtcagttacacctgctagtaccctgaccaaatctggtccagggcgttggaaaactcctgcagctataccggctactccagtcgccgtttctcaaccaatccgaaccgatctgcctcccccacccccacccccaccagtacactacgcaggcgacttcgatggtatgagtatggacttacccctgccaccccctcccagcgccaaccagatcggcctgccctcagcccaggtagcagccgcagaaaggaggaagagggaggagcatcaacgatggtatgagaaagaaaaggcaagacttgaagaggagagagaaagaaagagacgagaacaagagcggaaactgggacagatgagaactcaaagcctcaaccccgcacctttcagtccactgactgctcagcaaatgaagccagaaaaaccttctactctgcagcgcccacaggagacagtgatcagggagctgcaacctcagcagcagccaaggacaattgaacggagagatcttcagtatattactgtgagtaaggaagagctgtcaagcggcgacagtcttagtcccgacccgtggaagcgcgacgcaaaggagaaactggaaaagcagcagcagatgcacatcgtagatatgctcagcaaagaaatccaggagctgcagtcaaagccagatagaagtgcggaggagtccgaccgtcttagaaagttaatgctggaatggcagttccagaaaagactccaggagagcaagcagaaggacgaagacgacgaagaagaggaagatgacgatgtcgacaccatgctgattatgcaacgcctggaggcagaacgccgtgctagacagacagcgatgcccgctatcagcgttctggacctgctgcaggacgaggagcgtagacgccaacagcagttagaagaaatgaggaaaagagaggcagaggacagggcacgacaggaagaagagcgcaggcgccaggaagaggaaagaacaaagagggacgcagaggagaaggttatggtgctttag

SEQ ID NO: 231441 - DNA, 5474 bp, Artificial Sequence
  Description of Artificial Sequence: Synthetic coding sequence
atgtccgcagggggtcgggacgaggagagacgcaaactggcagacatcattcaccactggaacgcgaaccggctggacctcttcgagatttcgcaacctacggaagatctcgagtttcatggggttatgagattctacttccaggataaggccgctggaaactttgctacgaaatgtatccgggtctcaagcactgccacgacccaggacgtcatcgagaccctggccgagaagttcagacccgacatgcgcatgttgtcctctccaaaatactctttgtacgaagtgcatgtaagcggagagagaagactggacattgacgaaaaacctctagtggtccagcttaactggaacaaagacgaccgggagggacgctttgtgttgaagaacgaaaacgatgcaatcccgccaaagaaggcccagagcaatggacctgaaaagcaagagaaggagggggtgatacagaattttaagcgcacactgagcaaaaaagagaaaaaggagaaaaagaaacgtgagaaggaggcgttaagacaggccagtgacaaggacgataggccatttcagggtgaggacgtggaaaactctcgcctcgctgccgaggtatataaggacatgcctgagacatcgttcactcggactatctccaatcctgaagtcgtgatgaagaggcggcgacagcagaagctggagaaacgcatgcaggagttccgttcgtcggacggacgacctgactccggcggtaccctgagaatctatgccgattcacttaaacccaatattccttataagaccattctgctgtccactactgaccctgcagatttcgccgtcgcagaggcccttgagaagtatggcctcgagaaggaaaaccctaaggactattgcatagccagagtcatgctgccccctggcgctcagcactccgacgagaagggcgcaaaagagatcatccttgatgacgatgaatgtcccctccaaattttcagagagtggccctcagataagggcatcctggtgtttcagctgaagagacgtccacccgatcacatacccaagaagaccaagaaacacctggaagggaaaaccccaaaagggaaggagcgcgctgacggatcaggttacggatccacgctcccaccggaaaaactaccttacttggtcgaattgtcaccgggtcgacgcaaccatttcgcctactataattaccacacctacgaggacgggtccgattcacgtgacaagcctaagctctataggctccagctaagcgtgacagaagttgggactgagaagcttgacgataatagcatacagctgtttgggccaggcattcagccgcatcattgtgacctcaccaatatggacggggtcgtcactgtgacccctcgatccatggacgctgagacttacgtagagggccagcgcatcagcgaaactaccatgctacagtccggcatgaaagtgcagtttggtgcatcacacgtgttcaagttcgttgatccctcccaggatcacgcgcttgcaaagaggtcagtggacggcggactcatggtcaaaggaccacggcacaagcccggaattgtccaggagacaaccttcgatttagggggtgatatccactccggcacagccctccctacctcaaagtctaccactcggctcgattccgaccgagtcagtagcgcttcctccacagcagagcggggaatggttaaaccaatgatccgagtcgagcagcagcccgattaccggaggcaagagtctaggacccaggacgcgagcggacccgagctcattctgcccgcaagcattgaatttagagagagctcagaagattcgttcctctccgccattattaattacacaaacagcagtaccgtacactttaagttatcccctacatacgttctgtacatggcttgtagatatgtcctgagcaatcaatacagacccgatatatcacccaccgaacgaacacataaagttatcgccgtggtcaataagatggtctctatgatggagggtgttattcagaaacagaaaaatatcgccggtgcgttagccttctggatggccaacgcctcggagctgctgaatttcatcaagcaagaccgtgatctctctagaattacactggatgcccaagatgtgctcgctcaccttgttcagatggcctttaaataccttgtacattgcctccagagcgaattgaataactatatgcccgcatttctcgatgaccctgaggagaactccttgcagagacctaaaatcgatgacgtgttgcatacgctgaccggggctatgtccttactaagacggtgtcgagtcaatgccgctctcacaatacagctttttagtcagctttttcatttcataaatatgtggctgttcaatagactcgtaacagatcccgattccggtctgtgtagccactattggggcgctataatccgccagcagctggggcacatcgaagcctgggctgaaaagcaaggtctggaactggctgccgattgccatttgtcgcggatcgtgcaggccaccaccttgctcactatggacaaatacgcccctgatgatatacctaatatcaacagtacctgttttaagctgaacagtcttcagctccaggcacttttgcagaattaccactgcgcccctgatgaaccatttattcctaccgatctgatcgagaacgtggtgactgttgccgaaaacaccgctgacgagttggctcggtcagacggaagggaggttcagcttgaggaggaccctgatcttcagctcccctttctgctgccggaagacggatactcgtgtgatgtcgtgcggaatatacccaacggtctacaagagttcttggatccgctttgccagcgaggattctgccgcctgattccccacactagatcccccggtacctggacaatttactttgagggcgctgactacgaatctcacttgcttagagagaataccgaactcgccatccccctccggaaagagcccgagataattaccgttacattgaaaaaacagaatggcatggggctcagtatcgtcgctgccaagggtgccggtcaggacaaactcggaatatacgtaaaatccgttgtaaaagggggagccgctgatgttgatggtaggcttgccgcaggggaccagctcctgtctgtggatgggagatcactggtcggtctgtcgcaagaaagagcagccgaacttatgacacggactagttctgtggtgaccctcgaagttgccaagcaaggcgctatctaccacggcctggcaacactcttgaaccagccctctcccatgatgcagcgtatcagtgacaggaggggcagcggtaagccaagacccaaatccgagggctttgagctctataataactcaacccaaaacggaagtcccgagagtccacagctcccctgggcggagtacagcgagcctaaaaaacttcctggcgacgacagattgatgaagaaccgtgctgaccaccgatcctcccctaatgtggcgaaccagccgccttcccccggtgggaaatccgcatacgcgagcggaaccaccgccaagatcacttccgtgtctactggaaatctctgcaccgaagaacagacaccaccgccacgcccagaggcttaccctatcccaacccagacatatacacgagagtactttacttttccagctagcaaatcacaggatcggatggcgcctcctcagaatcaatggcctaattacgaggagaagcctcatatgcatacagactcaaaccactcttcaattgcaatccaacgagtcacccggtcacaggaagaactgcgagaggataaagcctaccagctagagagacataggatagaggccgctatggatcgcaaatccgacagcgacatgtggatcaatcagtcaagttccctggacagctctacaagctctcaggagcacttaaaccactcatccaagtccgttacaccagccagcaccctcaccaagtccggccctgggagatggaagacaccagccgcaatacccgctactccagtcgcggtaagtcaaccgatacgtacagacctccctccaccccctcctcctccaccagtgcactacgcgggtgattttgatggtatgtccatggacttacctctcccacccccaccctccgccaatcagataggtctgccctccgcccaggtggctgccgctgaaagacgaaagagagaggaacatcagcggtggtacgaaaaagagaaggctcgtctggaggaagaacgagagcgaaaaaggcgggagcaggagaggaaacttggtcaaatgcggactcagtctctgaaccccgcacccttcagtcccttaacagcgcagcagatgaagccagaaaagccctcaacactgcaaagaccccaggaaactgtcatccgggagctgcaaccccaacaacagcctagaactattgagcggagagatctgcaatacatcacagtctctaaagaggaactctcttccggagactcactctcaccagacccatggaagcgggacgctaaagagaagctagaaaagcagcagcagatgcacatcgtggacatgctatctaaagaaattcaagaattgcagagcaaaccagacaggagcgcagaagagtcggaccgactccgtaaactgatgctagagtggcaattccagaagcgtctgcaggaatctaaacagaaggacgaagacgatgaagaggaggaggacgatgatgtggacactatgctcatcatgcagcggttggaagctgagcggagagctaggctgcaagatgaggagagaaggaggcagcagcagctcgaagaaatgcgaaagcgggaggccgaagaccgggctcgacaggaagaagagagaaggcgccaggaagaagaaagaactaagagggatgctgaggaaaagcggcgacaggaagaaggatactatagccggctagaggcagagaggcgcagacagcatgacgaagcagccaggcgattgttggaacctgaagctccaggactgtgccgcccaccactgcccagggattacgagccaccttctccctcccctgccccaggggcaccgccaccccctccacagcggaatgcaagctaccttaaaacgcaagtgctttctcccgattccctgttcaccgccaagtttgttgcttacaacgaggaagaagaagaagaagactgtagtctggctgggcctaattcataccctggttctaccggggctgccgtcggggcacacgacgcctgcagagatgcgaaggaaaagcgctccaaaagccaggacgccgacagtcccggaagtagtggagctcctgagaacctcacttttaaagagagacagaggcttttttcacagggtcaggacgtgtctaacaaggtgaaagcctctcggaaactgaccgagctggaaaatgaactgaacacaaagta

SEQ ID NO: 231442 - DNA, 4955 bp, Artificial Sequence
  Description of Artificial Sequence: Synthetic coding sequence
atgagcgcgggtggccgagacgaagagcgcaggaaactggccgatataatacatcactggaacgctaatcgcctggacctcttcgagatctcccaaccaactgaggacctggaattccatggcgttatgaggttctattttcaggataaggccgctgggaattttgcaactaagtgcattagagtgtcgagtacagctaccacgcaggacgtaatcgaaacactggctgagaagttccggcctgatatgcggatgctgtcttcccccaaatattccctatacgaagtgcacgtgagcggagagagacgtttggatatcgacgagaaaccgctcgtcgttcagcttaactggaacaaggacgatcgagaggggcgttttgtcttgaaaaatgaaaacgatgctatcccacctaagaaggctcagtcaaacgggcctgaaaagcaagagaaagaaggagtcatacaaaacttcaaaagaaccttatctaagaaagaaaaaaaggaaaaaaaaaagagggaaaaagaggccctgagacaggctagtgacaaggatgatcgtcccttccagggtgaggacgtcgaaaattcacggctggctgcggaggtgtataaggatatgccggaaacgtctttcactaggacaatctctaaccctgaggtggttatgaaacggcgacggcagcagaaacttgaaaaacggatgcaggagttcaggtcatcagatgggcgtcctgatagcggtgggaccctccgtatttacgccgattctctgaaacccaacatcccatataagaccatcctgttatctactaccgaccccgcagatttcgccgtcgctgaggccctggaaaagtacggcttggagaaagagaaccctaaggactactgtattgccagagtgatgttacctccaggtgctcagcacagtgatgaaaaaggagctaaggagattattctcgacgatgacgagtgtcctctgcagatcttccgcgaatggccctccgataaaggcatcctggtctttcagctgaagcggaggccacctgatcacatccccaagaaaaccaagaagcatctcgaaggtaagacacccaagggtaaagaaagagccgacgggagtggctacgggtccaccctgccccctgaaaagctgccgtaccttgtcgaactgtctccgggacggagaaaccactttgcctattacaactaccatacatatgaagacggttcggatagtagggataaaccgaaactgtatcgactacaactctcagtaaccgaagtggggaccgagaagctggatgacaatagcatacagttgttcggacccggtattcagcctcatcattgcgacttgacaaacatggacggcgtggtgaccgtgacacctcgctctatggacgcagaaacctacgtagagggacagcggatctcagaaacaaccatgctccagtcaggcatgaaagtgcaattcggcgcatcccatgtgtttaaattcgtggatccctctcaggatcatgctttggcaaaacggtctgtagacgggggtctgatggtgaaggggcctcggcacaaaccagggatcgttcaggaaactaccttcgatctcgggggtgacattcactctgggaccgccctccccactagtaaaagtacaactcgcctggacagtgatagagtgtcatccgcgagttccaccgctgagcgcggtatggtcaagccaatgatccgagttgagcaacagcctgactaccggcgacaggagtcccggacccaggatgcatctggaccagaactgattctgcccgctagtattgaattccgcgagagtagcgaggactcatttctgtccgcgattatcaattacacgaatagctctacagtgcatttcaagctgagccccacctacgtattatatatggcctgtagatatgtcctttcaaaccagtataggcctgatattagtccaactgagagaactcacaaggtgattgcggtcgtcaacaaaatggttagcatgatggaaggggtgatacagaagcaaaagaacatcgccggagcgctcgccttctggatggcaaatgcatccgaacttctcaacttcatcaagcaagatcgggatctgtccaggataaccctggatgctcaggacgttctggctcacctagttcagatggcttttaagtacctcgtgcactgtctccagtctgaactcaacaactacatgcccgcttttctggatgatcccgaggagaactcactccagcgccctaagatagacgatgttctgcacacacttaccggagctatgtcccttcttcggcgttgccgcgttaatgccgcattaacaatccaactattttcccagttgttccatttcattaatatgtggttattcaatcgtcttgtcacagacccagacagcgggttgtgctctcattattggggtgcaataatccgccagcagctcggtcacattgaagcctgggcggaaaagcaaggtcttgaattggctgctgattgccacttgtcccgcattgttcaagcgaccactctgctcacgatggacaagtatgccccagacgatataccgaacattaactcaacctgcttcaaactcaactcacttcaactccaggctctcttgcagaattatcactgcgcgcctgacgaaccttttattcctaccgatctcattgaaaatgttgtcacagtggccgagaacactgctgatgagctcgctcggagcgatggccgtgaggtgcagctggaggaggatcctgacctgcagttgccttttctcttacccgaagacggatattcctgcgacgtggtgcgcaacattcctaatggtctacaagaattcctagatccactatgccagcggggtttctgtcgtctgatcccacacacgcggtctcccggaacatggaccatatactttgagggcgcagattacgaaagccacctcttgcgtgagaatactgagctggcccagccattaagaaaggaacctgaaatcatcactgtgactctcaaaaaacagaatggaatgggtctgtctattgtcgccgcaaaaggtgccggacaggataagctaggtatttacgtgaagtcggtcgtaaagggtggcgctgcagatgtcgatggacgcctcgccgctggcgaccagctgttgagcgtcgacggcagatcccttgtgggactgtcacaagagagggcagctgagctgatgactagaacctccagcgttgtgactctggaagtggctaagcagggcgctatataccatggccttgcaacgctgcttaatcaaccaagtccaatgatgcaacgaatctccgaccggaggggaagtggcaagccacggcctaagagtgagggattcgagctttataacaacagcacgcagaatggcagcccagaaagcccccaactcccctgggctgaatattcggagcctaagaagctgcctggcgacgacaggctgatgaagaatcgcgctgaccacaggtctagccctaacgtggcgaaccagccgccttcgccgggaggtaaatcagcctacgcctctggcaccacagctaagatcactagcgtgtccactggtaatctgtgcaccgaggagcagaccccaccccctcgccctgaagcctaccccatcccgacccagacatacactcgggagtactttacttttcctgcttcaaagtctcaagacagaatggcaccaccacagaaccagtggcccaactacgaagaaaagccacacatgcatacagactccaatcatagcagtatagcgatccagcgcgttactcggtctcaggaggagctgagggaggacaaagcgtaccaactggagagacaccgcatcgaagccgcaatggatcgcaaatccgacagcgatatgtggatcaaccagtctagctctctagattctagcacttcctcccaggagcacctgaaccacagctctaagtcagtaacaccagcctcaactctgaccaagtcaggccctggcagatggaaaactccagctgccatacctgccacaccggtggctgtcagccagccaatcaggacggatttaccacccccacctccacccccaccagtccactatgcaggggattttgatggtatgagcatggacctgccgctcccccctcccccttccgctaatcagattgggctaccttccgcccaggtcgcagccgcagaaagacgcaagagagaggagcatcagcgttggtacgagaaggaaaaggctcgcctggaggaggagagggaaagaaagcggagggagcaggaacgtaagctcggtcagatgcgaacccagagcctcaaccccgctccctttagccccttgaccgcccagcagatgaagcctgagaaaccctcgaccttgcaaaggccccaggagaccgtgattcgcgaactgcagccccagcagcagccacggaccattgagagacgggacttgcagtacattaccgtgagcaaagaggagctctcttccggcgacagcctctcaccggatccctggaagagagacgccaaagagaagctggaaaaacagcagcagatgcatatcgtcgacatgcttagtaaggagatccaggagctacaaagcaagccagacagatctgcagaagagagcgacaggctgcgaaagctaatgcttgaatggcagttccaaaagcggttacaagagagcaagcagaaggacgaagacgatgaggaggaggaagacgatgatgttgacactatgctgatcatgcagagacttgaagctgaacgcagggcgagggatgaagaacggcgaaggcagcagcagctcgaagagatgcgcaagcgtgaagccgaagacagagctagacaggaggaggagcggcgtcgccaggaagaagagcggactaagcgggatgctgaagagaaagtgatggtcctgta

SEQ ID NO: 231443 - DNA, 5231 bp, Artificial Sequence
  Description of Artificial Sequence: Synthetic coding sequence
atgtctgccggtggcagggacgaagagcggaggaagctggctgacattatccatcactggaatgcaaacaggctagacctgttcgaaatctcccagcctaccgaggacctggagtttcacggggtgatgcgcttctatttccaggacaaggccgctgggaactttgcaaccaaatgtatcagagtgagctctaccgccacaacacaggatgttatcgaaaccctagccgaaaagtttaggcctgacatgcggatgctatcttccccaaaatactcattatatgaagtccacgtgtctggggaacgaaggttggatatcgacgagaagccgcttgtcgttcagctgaactggaacaaggatgatagagagggtagatttgtcctaaagaatgaaaatgacgccatcccacccaaggctcagagcaatggaccggagaagcaggaaaaggaaggcgtcatccagaacttcaagaggacactcagcaaaaaagagaagaaagagaaaaagaaacgggagaaggaggcactgcgacaggcctcggacaaggatgatagaccctttcagggggaagatgtggagaactcccgcttggcggctgaggtgtataaggacatgccagaaacctcttttacacgaacaatcagcaatccagaggtggtcatgaaacgcagacggcagcagaagctcgaaaaacgcatgcaggagttccgcagcagtgacgggcgaccggatagtggcggaaccctccgaatatatgccgacagcctgaagccaaatatcccatataaaaccatcctgttatcgaccactgacccggctgacttcgccgtggctgaagcattggagaagtacggccttgaaaaggagaacccaaaggactactgtatcgcaagagtaatgctgcctcccggagcacaacactcggacgaaaagggtgcaaaagagattattttggacgacgacgagtgcccactacagatctttagggagtggccctccgataagggtattctcgtgttccagctgaagcgcaggcctcccgatcacatccccaagaaaacaaagaagcacctggaggggaaaacccccaaaggtaaggagcgggctgacggaagtggatacggctcgacactgcctcccgagaaattgccttaccttgtcgagctgtcccctgatgggtcagattccagggacaagcctaaactttataggcttcagctctccgtgactgaggtgggcactgaaaaactggatgacaacagcatacaattgtttggccctggaattcaaccccatcattgcgacctgactaacatggacggggtcgtgacagtgactccacgtagcatggatgccgagacgtatgtggaaggccagaggatcagcgaaactaccatgctgcagtctggaatgaaggtgcaattcggtgcgtcccacgtttttaagtttgtggatccttcacaggatcacgccctggcaaagagatctgtagatggcggtctgatggtgaaaggtcccaggcataagcccggaattgtgcaggaaacgacttttgacctggggggtgacattcactcgggaaccgcactacccacgagtaagtcaacgacccgtctggatagcgacagggtgtcctcagcttcttcgactgcagagcgaggtatggttaaacccatgatcagagttgagcagcagcctgattaccggaggcaggaatctagaacacaggatgcctctggcccagagctgattctccccgcttcaattgagtttagggagagtagcgaggatagtttccttagcgccatcatcaattacactaactcttccaccgtccactttaaactctcacccacgtacgttctgtatatggcctgtagatacgtgctaagcaatcaatatagaccagatattagccccacggagcggacacacaaagtgatcgccgtagttaataagatggttagtatgatggaaggcgtcattcagaaacagaagaatatagccggtgccctggccttttggatggctaacgcaagtgaattactcaactttatcaaacaagacagggatcttagtaggattacattggatgctcaagacgtgctcgcccatctagtgcagatggctttcaaatacctggtgcattgtctgcagagtgagctgaataactatatgccggctttcctggacgatccagaggaaaattccctgcagaggcccaagattgacgatgttctgcatactttaactggcgctatgagcctgctccgacgctgcagagtaaatgccgctctgactatacagctattttcccaattatttcacttcattaatatgtggctgtttaatcgcctggtcacagatcccgatagcggcttatgttcacattactggggggctatcattcgccaacagctgggacacattgaggcctgggcagagaagcagggactggaacttgctgccgactgtcatctatccaggatcgtgcaggctacaactctgctgacgatggataagtatgcccctgatgatattccaaatattaattccacgtgtttcaagctgaattcattacagttgcaggcccttctccaaaattaccactgcgctccagatgagcccttcatcccaacagatcttattgagaatgtggtgacagttgccgagaacactgccgacgagttggctcgcagcgacggcagggaggtgcagctcgaagaggaccctgacctccagctgccattcctattaccagaagatgggtactcttgcgatgttgtcaggaatatccctaatgggctccaagagtttttggaccctctgtgccagcggggattctgtcggcttatccctcacaccaggagtcccggtacttggaccatttactttgaaggcgcagattacgaatcacatttattacgcgaaaacactgagctcgctatcccgctgcggaaggagcctgaaatcatcaccgtaaccctgaaaaagcagaacgggatgggcctgagtattgttgctgctaaaggggctggacaggacaagctgggcatctacgtgaaatctgttgtgaagggcggagccgctgacgatggaagacttgctgcaggtgatcagctcctttctgtcgacgggagatccttggttggcttaagccaggagcgagccgcagaattgatgacgcgcaccagctctgtggttacattggaagtcgctaaacagggagccatctatcacggtctggcaaccctcctgaaccagccgtcccccatgatgcagcgcattagtgaccggcgtgggtccggcaaacccagacccaagagtgagggcttcgagctctataataatagtactcaaaatggctccccagagtcccctcagttgccatgggcagaatacagtgagcccaaaaaactccctggggatgatagactgatgaagaatagagcagaccatcggagtagccccaatgtcgcaaaccagcccccatctcctggaggaaaatccgcttacgcatctggcacgactgcaaaaataacctccgtatctactggcaacctttgtacagaggagcagacaccacctccccgtcccgaggcttaccccatacctacacagacctacacgagagagtacttcacattcccggctagtaaaagccaagaccgaatggccccacctcaaaatcagtggcctaactatgaagagaaacctcacatgcacaccgatagcaatcacagctcaattgctattcaaagagtaacaagaagccaggaggagctccgggaagataaagcataccagctggagcggcatcgaatcgaagctgccatggatagaaagagcgatagtgatatgtggatcaatcaaagttcaagtctggactccagtacatctagccaggaacacttgaatcactcatcgaagagcgttacccccgcatcaacgttgaccaaaagtggcccaggcagatggaagacccctgccgctatcccagccacccccgtggccgttagtcaacccataagaaccgacttacctccacctccaccaccaccacctgtacattacgccggtgactttgacggcatgtctatggacctcccattgcccccacccccttctgcaaaccagatcggattgccgagcgcccaggtcgcggctgcagaaagaaggaaacgggaggagcatcagaggtggtatgaaaaggagaaagctcgcctggaagaggaaagagaacggaagagaagggagcaggagcgcaaactcgggcagatgcgtacgcagagcctcaatcccgctcccttctcccctcttacagcccaacagatgaagcctgaaaagcccagcaccctccagcggcctcaggaaacagttattcgggagctgcagcctcagcagcagccacggaccatcgagcgtcgcgacttgcagtacatcaccgtgtcgaaggaggagctctcaagcggagactcactcagtccggacccgtggaaacgggatgcaaaggaaaagctcgagaagcagcagcagatgcacattgtggacatgctaagtaaagaaatccaggaactgcagagtaaaccagaccgatccgctgaggagtccgacaggctgaggaaactgatgctggagtggcagttccaaaaaagacttcaagaatctaaacaaaaagacgaagatgacgaagaggaagaagatgacgatgtggatacgatgttgatcatgcagaggctggaggcggagaggagagcacgcttacaagacgaggagaggagacgacagcagcagttagaagaaatgcgcaagcgtgaggcagaggacagagcacgccaagaggaggagcggcgacgccaggaagaagaaagaacaaagcgcgacgctgaggagaagcgcagacaggaagaagggtattactcacggttagaagccgagaggaggcggcagcacgacgaagcggcaaggaggctgctggagccggaagcccctggccctaatagctacccaggcagcacaggtgccgctgtgggtgctcacgacgcgtgccgggacgcaaaagaaaagcggagcaaatcccaggacgccgattcacccggtagtagtggtgctccggagaacctcaccttcaaagaacggcaaagactgttttctcaggggcaagatgtgtccaacaaggttaaagcaagccgaaaactgacagaactggagaacgagttaaataccaagta

SEQ ID NO: 231444 - DNA, 5474 bp, Artificial Sequence
  Description of Artificial Sequence: Synthetic coding sequence
atgagcgccggaggaagagacgaagagcgaagaaaactggcagacattattcaccattggaacgccaatagactcgacctgttcgagatttctcagcctacggaggacctggagttccacggagtgatgagattttactttcaagacaaagcagctggaaactttgcaactaagtgcattagggtctcatctactgcaaccacccaggacgtgatcgagaccctcgcagagaagttccgcccagacatgcggatgttgtcttcacctaagtactccctttatgaagttcacgtgagcggtgagcgtagactggacatcgacgaaaagccgcttgtcgtgcagctgaattggaataaggacgaccgggagggcagatttgtgctgaagaatgagaacgacgctatccccccaaaaaaggcccagagcaatgggccagagaagcaggagaaggaaggcgtgatccaaaacttcaagcgtaccctgtccaagaaggaaaagaaagagaagaagaagagggagaaggaggcccttcgccaggcctctgataaggacgacagacccttccaaggagaggacgtcgagaatagcaggctggccgcagaggtgtataaagatatgccggagacgtcctttacgcgaactatcagcaatccggaagtggtaatgaaaagacgacgccagcagaaactggaaaagcggatgcaggagttccgatcatctgacggcagacccgattctggagggactctcagaatttatgcagacagcctcaagccaaatattccttataaaacaatcctgctcagtacaacggaccccgcagacttcgccgtcgctgaggccctcgaaaagtacggactagaaaaagagaaccccaaagattattgtatcgccagggtcatgctccctccaggcgcacagcacagtgacgagaagggagccaaagaaatcatactggatgatgacgaatgtccacttcagatattccgtgagtggccttccgacaaaggaattctggtgttccagttgaaacgcagaccccctgaccatattcctaagaagaccaagaagcatctggaggggaagacgcctaagggcaaggaaagggctgatggctctgggtatggttctacactgccacccgaaaagctgccatatctcgtggagctgtcacctggcagaagaaatcacttcgcctattacaactaccatacctacgaggatggcagtgacagtcgagataaaccaaagctgtaccgactgcagctgtcagtaaccgaggtagggactgagaaactagacgacaattctattcagctattcggtcctgggatccagccacatcattgcgacctgacgaacatggatggcgtcgtgactgtaactccgagatcaatggatgcagagacttatgtggagggacagcggatatccgagacaaccatgctgcaaagcggtatgaaagttcaattcggcgcttcccacgttttcaagtttgtcgatccctcgcaagaccatgcactggctaagcgcagcgtggacggtggcttaatggttaaggggcctagacacaagccaggcatcgtgcaggagaccacctttgacctgggcggtgatattcatagtggtacagctttgccaacctccaaatctactacgcgactagatagtgatagggtgagttcagccagttccacagctgagcggggtatggtgaagccaatgatccgcgtggaacagcagcctgactacagaagacaagagtcacggacccaggacgccagcggccctgagctcatcctccccgcatctatcgagttccgtgaatcttccgaagattcattcttgtccgcaataattaattacaccaacagttctaccgtacattttaaactgagcccaacttacgtgctgtatatggcttgcaggtacgtgctgagcaatcagtaccgcccagacattagcccaacggaacggacccataaggtcattgcagttgttaataagatggtatccatgatggaaggagtgatccagaaacagaagaatatcgccggagccctggcattttggatggctaatgcttcagagttgctgaatttcattaaacaggatcgggatctcagcaggataacactcgatgctcaggacgtgctcgctcacctggtacagatggctttcaagtatctcgtgcactgcctacagagcgaactcaataactacatgccagcttttctcgacgaccctgaggagaacagccttcagcggcctaagatagacgacgtactacataccctcaccggcgcaatgtctctgctgcgcagatgtcgggtcaatgctgcgctgaccatacagctgttttctcagctgttccacttcattaatatgtggttattcaaccggctcgtgacagatcccgacagcggcctttgttcccactattggggtgctatcatcagacagcagctgggacacatcgaagcctgggctgagaagcaaggtttggagctggcagccgactgtcacctatccagaattgttcaggcaactacacttctgacaatggataagtatgcgcctgacgacattcccaatattaactctacgtgctttaagctgaatagcctccagctgcaggccctactacaaaattatcactgtgcacccgacgagccattcattcctactgatctgattgaaaatgtggtcactgtagccgagaatacagccgacgaactggccaggtccgatgggagggaagtgcagcttgaagaagatcctgacctccagcttccctttctgttaccagaagacggatatagttgtgatgtagtgagaaacatccccaacggtctgcaggagtttttggatcccttgtgccagaggggcttttgccgcttgattccacacactcgctcacccggaacctggaccatttatttcgagggcgctgactacgagtcccacttattgagggagaacacagagttggcacagcccttgaggaaggagccggaaattatcacggtgaccctgaagaagcagaacggcatgggcctctctattgtcgcagctaagggcgctgggcaggacaagctgggaatctatgtaaaatcggtggttaagggtggagccgctgacgttgacggtcgcctggctgccggtgatcagctcctgagtgttgacggaagaagcctggttggcttaagccaggagagagccgcagagctgatgacacgaacatcttcagtggtgaccctcgaggtcgccaaacagggagcaatctaccatggtctggctacgctgcttaaccagccctcccccatgatgcagaggatttcggacagaagggggtctggcaaacccaggccaaagtcggaggggtttgaactgtacaacaactcaacccagaatggctcaccggagtctccccagctcccttgggctgagtactccgagcctaagaagctaccgggagatgacaggttgatgaaaaatcgcgcagaccatcgctcctcgcccaacgttgccaaccagcccccatcacctggcggaaagagtgcctatgcttccggaaccaccgcaaagataacatccgtctccactgggaacttgtgcaccgaagagcagacgccacctccaagacccgaggcctatccaatccccacccaaacgtacacgcgcgaatatttcacttttccagcttcaaaatctcaggaccgcatggctcctcctcaaaatcagtggcccaactacgaagagaagccccacatgcacaccgactccaatcactccagcatagcaattcagcgcgtgactcggagccaggaggagctgagagaagacaaggcctaccaattagaacggcaccgtatagaggctgctatggaccggaaatctgactcggatatgtggattaatcagtcaagcagccttgattccagcacatcatctcaggagcacctgaaccacagcagcaaaagcgtcacaccagcatctacgctaactaaaagcgggccagggagatggaagaccccagctgccatccccgcaacaccggtcgcagtgtcgcaaccaattcgcacggatttgcccccaccacctcccccacctcccgtacactatgctggagactttgacggcatgtcaatggacctgccactacccccacctccaagtgctaaccagatcgggctgccttccgcccaggtggctgccgcagaacggagaaaaagggaagagcatcaaagatggtacgaaaaagagaaagctcggctagaggaggagagagagaggaagcggcgtgagcaggaaaggaaactcgggcagatgcggacacaaagcttaaatccagcgccttttagccctctgacagcacagcagatgaaacccgaaaaaccctctacactgcaacgacctcaggaaactgtcatccgggaactgcaaccccagcaacaaccacgcaccatcgagcggagagatctgcagtacatcaccgtgtcaaaggaagaactcagctccggggacagcctctcccctgatccgtggaaacgggacgccaaggaaaagctagaaaagcagcagcagatgcacatcgtagacatgctctccaaagagattcaggagctgcagtccaagccagatagatctgctgaggagtcagatagattgcgaaagctgatgcttgagtggcagtttcagaaacggctgcaggaatccaaacagaaggatgaggatgacgaggaggaggaagatgacgacgtggatactatgctgattatgcagcggcttgaagcggagaggagagccaggctgcaggatgaagagcggaggcgccagcaacagttggaagaaatgagaaagcgcgaggctgaggaccgggcacgccaggaagaggaaagaaggcggcaggaagaagagcgcactaaaagggacgctgaagagaagagacgacaggaagaggggtattattctagactcgaagcagaacgaaggaggcagcacgatgaagcagcccgtcggctgctcgaacccgaggctccaggattgtgccgaccgcctctgcctcgagactacgaacccccttctccatcgccagccccaggagccccaccaccgccaccccagagaaacgcttcgtatctcaagacgcaggttctgagccccgattcactgtttactgcaaaattcgtggcttataatgaggaggaagaggaggaggactgtagtctcgccggaccaaattcgtatccagggagtacaggcgctgcagtgggagcgcatgacgcctgcagggacgctaaggagaagcggtcaaagagccaggatgcagactcccctggctcctcgggggctcctgagaacttgacctttaaagagaggcagagactgttcagtcagggccaagatgtttccaacaaagtgaaggcaagtaggaaactgacggagttagagaatgagctgaatacaaaata

SEQ ID NO: 231445 - DNA, 3282 bp, Artificial Sequence
  Description of Artificial Sequence: Synthetic coding sequence
atgaaggagatggtgggcggatgttgcgtttgttctgacgaacggggatgggcggagaatccgctagtgtactgcgacggccacgcttgctctgtggttgttcaccaagcgtgttatgggattgttcaggtgccaacagggccatggttctgcagaaaatgtgagagccaggagcgggctgctcgggttaggtgtgagctgtgccctcataaggatggagctctgaagaggactgacaacggtggctgggcccacgtcgtgtgtgccctgtatattcccgaggtccaattcgctaacgtcctaactatggaaccaatcgttttacaatatgtcccacacgaccggttcaacaagacttgctacatttgtgaagaacaggggagggaaagtaaagcagccagcggcgcttgcatgacttgtaacagacatggctgccgccaggcattccatgtgacgtgtgcgcagatggccggactgttgtgtgaggaggaggtccttgaggtagacaatgtgaaatactgtggatattgcaaataccattttagcaagatgaagacatctcgccactcaagcggaggtggcggtggtggggcagggggtggtggcggatcgatgggaggaggcggatccggtttcattagcgggcgaaggtctcgctctgcatccccttcaacccagcaggaaaagcacccaacacaccacgagagagggcagaagaagagccggaaggataaggaaaggttgaagcaaaagcacaagaagcggcctgaatcccctccctccattcttaccccacccgtcgtacccaccgccgataaggtgagtagttccgcatccagtagttcccaccacgaagcaagcacacaggagaccagtgagtctagtcgcgaatctaagggcaaaaagagctcttctcattccttatcacacaaaggcaagaagttgtccagcggcaagggagtatcgagctttacctctgcgtcttcctcgagttcatcctcctcttccagcagtggagggccttttcagccagccgtgagctctctgcagagttcacctgatttttctgcatttccgaaactggagcaaccagaggaggacaaatatagtaagccaaccgcccctgctcctagcgctccacccagccctagcgcacccgagcctcctaaggccgatttgttcgagcagaaggtggttttttcaggattcggtccgatcatgcgctttagtaccaccacttcctcctccggtagggcacgtgccccatccccaggagattacaaaagccctcacgtgaccggtagcggggcttcggctggcacgcataaacggatgccagcactgtcagccactcctgtccctgcggacgagactccagaaactggattaaaagaaaagaagcacaaagcctcgaagcgttctcgacatgggccaggtagacctaagggatctcggaataaagaaggaaccggcggacctgcagcgccaagcctcccctctgctcagcttgctggtttcaccgcaacagctgcctctcctttttccggtggttcgctggtgtctagtggactcggaggcctgtccagcaggacttttgggccttcaggcagtcttccgtctctgtctttggagagtcctctgttaggagccggaatttatacaagcaataaggacccaatttctcactccgggggtatgctccgcgctgtgtgcagcacacccttaagttctagcctgctcgggcctcctggtactagcgccctccctagactcagcagatccccttttacttccaccctgccctcatccagtgctagcatcagcaccacccaagtcttttctcttgccggatctacattcagcctaccttcgacacatatcttcgggacacctatgggagctgtgaaccctctgctttcacaggcagagtctagtcatacagagcctgacttggaggattgttcttttcggtgtcggggtacaagtcctcaggaatccttgtctagtatgtcacccataagtagcctccccgcactctttgaccaaacggcaagtgccccatgcgggggtggccagctggatcctgccgctcctggcactacaaacatggagcagctgctggaaaaacaaggagacggcgaagctggggtcaacatagttgagatgctgaaagcgctgcatgctctgcaaaaggaaaaccagcgactgcaagagcaaattctctccctgactgcaaagaaggagcgcctccaaatccttaacgtgcagctgtcagttccgttcccagccttgccagccgctttgcccgctgcaaacggtccagtccccggaccctacgggctcccccctcaggcaggatctagtgatagcctgtcaacctctaagtctccccctggtaagagtagcttggggctcgacaatagcctgtctacaagtagtgaagacccacattcaggatgcccttctcgaagctccagtagtctgtcctttcatagcacacctccacctcttcctctgttgcagcaatctcctgccactttgcctctagccctcccaggagccccagcaccactgcccccacagccccagaatggattaggaagagcaccaggagccgctggactgggagccatgcctatggccgaggggttgttaggcggactcgcgggtagtgggggacttccccttaacggactgctaggaggtctgaacggggctgctgcaccgaacccagcctctctgtcgcaagctggaggagctcctaccctgcagttgcctggttgcctgaacagtcttacagaacagcaaaggcacctgctgcagcagcaggagcagcagctgcagcaacttcagcaactgctcgcttccccccagcttacacccgagcaccagacggtcgtgtaccagatgatccaacagatccagcaaaagcgtgagttgcagagactgcagatggctgggggatcccagctgccgatggccagtctgctcgctggctcgtccacgccccttctgagcgccggaacacctggactgttgcccacagcttcagcacctcccctgctgccagctggggctctggttgccccttcactcggcaataatacgagtctgatggccgcagcggctgccgcagcggctgttgctgctgcgggaggccctcctgttctgaccgcccagaccaatccttttctgagtttgtctggcgctgaaggcagcggcggagggcctaaaggtggaacggcagacaagggcgcatcagctaatcaagaaaaaggatag

SEQ ID NO: 231446 - DNA, 978 bp, Artificial Sequence
  Description of Artificial Sequence: Synthetic coding sequence
atgaaggagatggtcggaggctgttgcgtgtgtagcgacgagagggggtgggcggagaacccccttgtttactgtgacggacatgcgtgctctgtcgttgttcaccaggcctgttacgggatcgtacaggttcccacgggaccctggttttgtaggaagtgcgagtcacaggaaagggcagcccgagtacgctgtgaactctgtcctcacaaagatggggcattgaagcggaccgataatgggggatgggctcatgtggtctgtgcactttacatccctgaagtccagttcgctaatgttctgaccatggaacccatcgtgcttcagtatgtaccacacgaccggtttaacaagacctgctacatttgtgaggagcagggcagagagtccaaagccgcttctggcgcttgtatgacttgcaaccgccacggttgtcggcaggcttttcacgttacatgcgcccagatggccggtttgttgtgtgaagaggaagtgctcgaggtggacaacgtgaaatattgtggctactgtaaatatcatttctcaaagatgaaaaccagtcggcactcttcaggcggaggaggaggcggagccggaggcggaggaggctccatgggaggaggcggttctggcttcatctcgggtcgaagatcgcgaagcgcaagcccctccacgcagcaggagaaacacccaacacaccacgagagaggacaaaagaagagcagaaaggataaggagcgtctaaaacaaaaacataagaagcgacctgaatctcctccaagtatcctcacccctccagtggtgcccaccgctgataaacccaggcgtggacaccagagcccaactaaccatggcattggcagtcttggctgttgcctgccagatacaccgatttgcctgtgtcctgaaggcctgtccccaggcctgcttagcgctgaatcagggggaaggcattctgggctcttgtccaagttctag

SEQ ID NO: 231447 - DNA, 16614 bp, Artificial Sequence
  Description of Artificial Sequence: Synthetic coding sequence
atggattcccagaaactagctggcgaagacaaggattccgagcctgctgcagatggtcctgcggcatccgaagatccatctgccacggagtctgacctgccaaatccacacgtaggtgaagtcagcgtgctcagtagtgggagcccccgactgcaggaaaccccacaagattgttctggcggacctgttcgaaggtgcgcactctgtaactgcggggaaccatcccttcacggccagcgcgaattacgccgattcgagctcccattcgactggcccaggtgtcctgtcgtgtcacctggcggatcaccaggccctaacgaggcagttctgccttctgaggatctgagtcagatagggttccccgagggcttaacacccgctcaccttggtgaaccaggtggatcatgctgggcacaccattggtgcgccgcttggtccgcaggggtctggggacaggagggacctgaactgtgtggggtggacaaagccatattcagcggaatttcccagcggtgcagccattgtacccgtttgggggcatctattccttgtcgcagtccaggatgtcctaggctgtaccatttcccctgtgccacggcatcaggatccttcctgtctatgaaaactctccagctgttgtgcccagagcattccgaaggtgccgcatacctggaagaggcccgatgcgctgtttgtgagggccctggggagttgtgcgacctatttttttgcactagctgtgggcaccactaccacggagcctgccttgatacagctttaaccgcgaggaaaagggccggttggcagtgtccagaatgcaaagtgtgccaggcctgtcggaaaccgggaaatgactccaagatgcttgtgtgcgaaacctgcgataagggatatcatactttttgcctaaaaccgccaatggaggaactgccagctcattcctggaagtgcaaagcatgcagggtctgcagagcatgtggggctggcagtgcagaattaaaccccaactcagagtggtttgagaattattctctgtgtcaccgttgccacaaggcccaaggtggacagactatcaggagcgttgctgagcaacatactccggtttgctcccgattttcgcctcctgaaccgggagacactccaacggacgaaccagatgccctttatgtggcgtgccaggggcagccgaagggaggacacgtaacatcaatgcagccaaaagaacccggaccattacaatgcgaagcgaagccgctcggaaaggccggagttcagctagagccacaattggaggcacccctgaacgaggagatgccattgctgccaccaccagaagagtctcctctcagtcctccgcctgaagagtcgcctaccagtccacctcccgaggctagtcgcctgtctccgccacctgaagagttgccagcctctccacttcctgaagcactgcatctcagcagacctctggaagagagccctctgtcccccccaccggaggagagtcccctgagtcctccgcctgagtccagcccttttagccccctagaggagtcccccctgagcccacctgaggagagcccaccctcgcctgcgctcgagaccccactgtccccaccgcctgaggccagccccctgtctccaccatttgaggagagcccgctgtctccacctccggaggagttgccgacttcacctccaccagaagctagtcgcctttctccaccacccgaggaatcaccgatgtccccccctccagaggagtcgccaatgtctccaccgccagaagcgtcaaggctattcccccctttcgaagagagcccactgtctcccccacccgaggagtctcccctgagtccgccaccagaggcctctagactttcgcccccaccagaggattctccaatgagtccacctcctgaagagagccccatgtcaccgccaccggaggtgagtcgactcagtcccctgccggtcgtgagtaggttatcaccgccaccagaagagtccccccttagtccccctccagaggagtctcccacttcccccccaccggaggcctcacgacttagccctccccctgaggacagtcccacaagtccaccacctgaagacagtccagcctcacctccgccagaagactctctaatgagtttaccacttgaggaatcaccattgctacccctccctgaggagccccagctctgccccaggtcagaaggcccacacctaagcccacgaccagaagaaccacatctatctccaagaccagaagaaccgcatttgtctccccaggctgaagagcctcatctgagcccacagcctgaagaaccttgcctttgcgccgtacctgaagaaccacatcttagcccccaagctgagggccctcacctgagtccccagccagaggagctgcacctatcacctcagactgaggagccccacctctctcccgtgccggaggaaccctgtctgtccccacaacctgaggagagtcatctcagtccccagtccgaagaaccttgtctgtcccctcggcctgaagagtcacacctgagtcctgaactggaaaaaccacccctgagcccaagaccagaaaagcccccagaagagcccggtcaatgccccgcacccgaggaactgccactctttccacctccaggagaaccttcgctgagtccacttctgggcgagccagcgctgtccgaaccgggtgagccaccactctcacctcttcctgaagagctccctctttccccttctggcgagccaagtctctccccccaactcatgcctcctgacccgctgccacctcccttgagccccattattacagcggctgcccctccagctctgtcccccctgggagaattggaataccctttcggtgcaaaaggagattcagatccggagtcccctttagctgcacctatcctcgagacacccatctccccaccacctgaagccaactgtaccgatcccgagcccgtcccgccaatgatcctacccccaagccccggaagtcccgttggtccagctagccccattctgatggagcctctgccgccacagtgcagtccactgcttcagcacagcttggtgcctcagaactcacctccaagccagtgttcccctccagcactccccctgagtgtccctagcccgctgtcaccaataggaaaagtcgtgggcgtgtccgatgaggccgagttgcacgaaatggagaccgagaaggtgtctgagcccgagtgtccggcactggagccaagcgccacgagtccccttcctagccccatgggtgacttatcctgccccgctccgtcccctgccccagccctggacgacttctccggcttgggagaggataccgcgcctttagacggcatcgacgctcccggtagccagcccgaacccggtcagacacccggatcactggcttcagaattgaagggcagccccgttttgttagatccagaggagctggcccctgtgacccctatggaagtgtatccggaatgtaaacagacagcaggtcaggggtccccttgcgaagaacaggaagagcctagggcacccgtggcccctactccacccactctgattaaatcagacattgtgaacgagatctcaaacttatcgcagggagacgctagcgcctcctttccaggcagtgagccactcctggggagccccgatccagaggggggtggttcactatccatggagctgggcgtctctacggacgtgtctcccgcacgcgacgagggctcactcaggctgtgcacagactcgctccccgagaccgatgattccctcctgtgcgatgctggcaccgccattagcggaggcaaagccgagggggagaaaggcaggagaaggtcttccccggctaggtctagaataaaacaaggtaggtcctcaagcttccctggcagaagaaggcctagggggggagcgcatgggggtagaggcagaggcagggcccgtcttaaatctaccgctagctccatcgaaacactagtggtggccgacatcgatagctccccctctaaggaggaagaggaggaggatgacgacactatgcaaaatactgttgtgctgttcagcaacacggacaagttcgttttgatgcaggacatgtgcgtggtttgcggaagtttcgggcgaggggcagaaggacatctattggcgtgctcccaatgttcacagtgttatcatccgtactgtgtcaacagtaaaattaccaaggtaatgttactcaaaggttggcgctgcgtggagtgcatcgtgtgtgaagtgtgcggccaggcctctgacccgtcaagactcctgctgtgcgacgattgtgacatttcctaccatacctattgcttagacccaccacttcttacggtcccaaagggaggttggaagtgtaaatggtgcgtgtcttgtatgcaatgtggcgcagctagtcccggtttccattgcgagtggcagaactcgtacactcactgtggaccatgtgcttcactcgttacttgtcctatttgtcacgcaccttacgtcgaagaggacttgctgatccagtgcaggcactgcgagagatggatgcatgccggatgcgaaagcctgtttactgaggatgacgtggaacaagcagccgatgaggggttcgattgtgtcagttgccagccctatgttgttaagcccgttgctccagtcgcccctccagaactcgtacccatgaaagtgaaggagcctgagcctcagtatttcagatttgagggtgtgtggcttaccgagactgggatggcccttctccgcaacctgactatgtccccgctgcacaagaggcgccaacggaggggaagacttgggttgcctggggaggccggactggagggtagtgaacctagcgacgccctcgggcctgatgacaaaaaagatggcgaccttgacactgacgaactgttgaaaggtgaaggaggagtggaacacatggagtgcgagatcaagctggagggtcctgtttcccccgatgtcgagccaggaaaagaggagaccgaagaatctaagaagaggaaaagaaagccttatagacccggtatcgggggattcatggtgcgacagaggaaatctcatacacgaaccaaaaagggccctgcggctcaagctgaggttctgagtggggacggccagcccgacgaagtgattccagccgacctgcccgctgagggcgctgtcgagcaatcactggccgaaggagacgaaaagaagaagcagcaaagaagaggcaggaagaagtctaagcttgaagacatgttcccggcataccttcaggaagctttctttggaaaagaactactcgacctgagtcgaaaagcattgttcgccgtgggcgttgggaggcctagtttcggcttaggcaccccgaaggcaaaaggtgatgggggttctgagaggaaggagttacccacatctcagaaaggcgacgatggtccagacatcgccgatgaggagagcagggggttagaggggaaggcggacacacctggtcctgaggatggtggcgtcaaggcctctccggtaccgtcagaccccgagaagcctggaacacccggagagggaatgttgtcgtctgacctggaccggatttctactgaggaacttcctaaaatggaatctaaggaccttcagcagctttttaaagacgtgttgggcagcgaaagagaacagcacctgggctgtggtaccccgggacttgaggggtccaggactcccctgcagcggccattcctccaggggggattacccctaggaaacctgccaagttcctcccccatggactcataccccggtctgtgtcagtctccctttttggatagtcgcgaaagagggggtttcttctccccagaacccggagaaccggatagcccctggactggatccggcggaacaacgccgagcacgccaaccacccctacaaccgaaggggagggggacggcttatcctataatcagagaagtcttcagagatgggagaaagatgaagagttgggtcaattgtcaaccatttctcctgtgctatatgcaaacatcaactttccaaacctgaaacaagattatcccgattggagctcccgctgtaaacaaatcatgaagttgtggaggaaggtgccggctgcagacaaggccccatatctgcaaaaagccaaagataacagagcggctcataggatcaataaagtacagaaacaggctgaaagtcagatcaataagcagacgaaggttggcgatatcgctagaaaaaccgatcggcctgccctgcaccttagaataccccctcagccaggcgcattaggctcgcctcccccagcagccgctcctacaatctttatcggctctcctaccacaccagcaggactctctacatccgcggatggttttctgaaaccacccgcagggagcgttcccggaccggactctccaggagagttgttccttaagctgcccccacaggtcccagcccaggtaccttcccaggatccctttgggttggcacctgcatatcccctcgagcctcggtttcccaccgccccacctacttacccaccctatccctctcccacaggcgcacccgctcaacctcctatgctgggagcaagcagtagacccggtgctggacagccaggcgagttccacacaacacccccaggcacccctaggcatcagccctccacacccgatcccttccttaaaccgaggtgtccctctctggataacctcgccgttcccgaatcgccaggagtcggaggagggaaagcatccgaacccctgctgagcccgccaccttttggagagtcgcgcaaggctctcgaagtgaaaaaggaagagcttggagcgtcttcaccctcgtatggcccacctaacttgggcttcgtagacagtccatcttccgggactcacctggggggtctagagctcaaaacccctgacgtcttcaaagctcctcttacaccacgggcttctcaggtggaacctcaaagccccggtctgggcttgagaccacaggaaccacccccagcacaggccctcgccccatcgccaccctctcatcccgatatcttccgccctgggagttataccgacccctatgcacagccacccctgacccccagaccacagccacctccaccagaatcgtgctgcgctcttccccctagatccttgccttccgaccctttttcaagggttccagctagcccccagagccagagtagcagtcagtcacccctgactcccagacctctctcagccgaggccttttgtccttcccccgtgacccctaggtttcaatccccggacccgtattccagacccccttcgcgtccacagtcccgcgatcccttcgcccctctgcacaagcctccgagacctcagccccctgaagtggcatttaaggccggttccttggcgcatacgtccttgggtgctgggggattcccagccgctctcccagctggacctgccggagagctccacgctaaggtgccttctggacaaccccctaactttgtcaggagtcccggaactggggcttttgttggaactccatctccgatgaggtttacatttcctcaggctgttggcgagccctcccttaagccccctgtaccccagccaggtcttccacccccacatgggattaatagccatttcggaccgggaccaacccttggaaagccccagagtacgaattacactgtggccactgggaattttcacccaagcggttccccccttggaccgagcagcggatccactggcgagagctatggactgtcaccactgcgaccgccaagtgttttacctccccctgctcctgacggcagtctgccatatctcagccatggagcctcccagcgttccggaatcaccagccctgtggagaaaagggaagaccctgggacgggaatgggatcctctttggctaccgccgagctgccaggcacccaggatcctggaatgagcggactcagtcaaaccgaactggaaaaacagcgtcagagacagcggttgcgggaactgcttattcggcagcagatacagcgtaatacgcttcggcaagaaaaagaaactgcggctgcggcagcaggagctgtagggcctccaggcagctggggggcagagccgagctctcccgctttcgagcagctgagcagaggacagacacctttcgccggtacacaagataagtccagtctggttggcctgcccccaagcaaattatcaggtccaattctgggaccgggatcattcccctcggatgatagactgagcaggccaccccctcccgctacaccaagcagcatggatgtaaattcccgtcaactggtcggcggttctcaggcgttttatcaacgggctccctaccccggttcgttgccattacagcagcagcaacaacagctctggcaacagcagcaggccactgccgctacctctatgcgctttgcaatgagcgctcgcttcccaagcacccctgggcctgaactaggtagacaggcccttggatctcccctcgctggcatctcaacccgcttgcccggacccggagagccggtgcctgggcctgcaggccctgcccaatttatcgagttgcgccataatgtccagaagggtctgggcccaggtgggacaccattccccggtcagggtcccccacagaggccccgtttttacccggtgagtgaagaccctcaccgcctggcccctgaaggcctccgaggcctggcggttagcggtttgccgcctcaaaagccgtcagcccctccggcacccgagctgaacaatagcttgcacccaacaccacacaccaaagggccaacccttccaacaggcctggaattggtgaacagacccccttctagcacagaattgggcaggcctaaccccctagcccttgaagcaggtaagttaccttgcgaggatcctgagctcgatgacgacttcgatgcccataaggcgttggaggatgatgaggagctggcacatctgggcttaggtgtggacgtggctaaaggagatgacgaattgggcaccctggaaaatctcgaaacaaacgatccccacctggacgatctgctgaatggcgatgagttcgatctgctggcctatacggaccccgagctcgacacaggcgataagaaggatatcttcaatgagcatctgcggctggtggagagtgccaacgaaaaagccgagcgcgaggctctactgaggggtgtggagccgggtccactcgggccagaagagcgcccaccaccagccgctgatgctagcgagcccagattagcatctgtcctcccggaagtgaaacccaaagttgaggaggggggtaggcatcctagcccttgtcagttcaccatcgcaacaccaaaagtggaaccagcccctgcagccaactcactggggctgggactgaaacccggtcagagtatgatgggctcacgggatactcgcatgggcaccggcccattctcgagttctggtcatactgcagagaaggcttccttcggtgccacgggaggcccacctgcccacttgttgactcccagcccattgtcgggtccaggtgggtcttctttgctagagaagtttgagctggagtctggggctttgacactccccggtggtccggcagccagcggagacgagctggacaagatggagtccagcctggttgccagtgagctcccgctgcttattgaggacctgctggaacatgaaaagaaagaactccagaagaagcagcaactcagtgcccagctccaaccagcccaacaacagcagcagcagcaacagcagcattccctgctgtccgcccctggccctgcacaggctatgtcactcccgcacgagggttcatcacctagcctggcaggaagccagcaacagctttccctgggtctggccggagccagacagcccggactacctcagcccttgatgccgacacagccgccagcacacgccctgcaacagcgtctcgccccaagcatggccatggtgagcaatcagggacatatgctctctggccaacatggcggtcaggccggactggttccccagcagtcttcacagcccgtgttgtctcagaaacctatgggcaccatgccccctagcatgtgtatgaaaccacagcagttagccatgcagcagcaactggctaattctttcttccctgatacggacctcgacaagtttgctgcggaagatatcatcgatcctatcgcaaaggccaaaatggtcgcactaaaaggcataaagaaggtaatggcccaggggagcatcggggtggcacctggtatgaatcgacagcaggtcagtttattagcgcagcggctgagcggtggaccgtcttcagacctccagaaccacgttgccgctgggagtggccaagagaggtctgccggtgatccttctcagcccaggcctaacccaccgaccttcgcccaaggcgtgatcaacgaggccgatcagaggcagtacgaggaatggttattccacacccagcagctactgcagatgcagttgaaagtgctcgaggaacagattggcgtacaccgaaagagtcgaaaagcgctttgcgctaagcagcgcactgcaaagaaagcagggagagagtttcccgaggccgatgctgaaaaactaaaattagtgaccgaacagcagtctaagattcagaaacagctggaccaagtccggaagcagcaaaaggaacatacaaatctgatggccgagtacaggaacaagcagcagcagcagcagcagcaacagcagcagcagcagcagcagcattcggccgtactggcacttagccccagccagagccccaggttgctcactaaacttcccggtcaacttctgcccggacacggcctgcagcctccacagggccctcccggagggcaggcgggtgggctaagactaactcccggagggatggctctcccgggtcagccaggaggcccattcctaaataccgcactggcccagcagcaacagcagcagcacagcggcggagccggtagtctggcgggaccctcggggggattctttcccggaaatctcgctctgcggtcactggggcctgactctcgcctactgcaggaaaggcagttgcagctccagcagcagcgaatgcagctggctcagaaactgcagcagcaacagcaacagcagcagcagcaacagcacctactgggtcaagtcgccatccagcagcagcagcaacaaggacccggagtacagaccaaccaggctctcggaccaaagccacaaggcctcatgccaccgagttcacatcagggtctgctcgtgcagcagctttcaccccagccgcctcaagggcctcaaggcatgctcgggcctgcccaggtcgcagtgctccagcaacagcaccccggtgctcttggaccccagggtccccaccggcaggtgttgatgactcagtcacgtgtgttgtcatctccccaattggcccagcaggggcagggactgatgggccaccgactggtgacagctcagcagcagcaacagcagcagcagcatcaacagcaggggtctatggctggcttaagtcatctgcaacagtctctgatgtctcatagtgggcagcccaagctcagcgcccagccaatgggttctctgcagcagttacaacagcagcagcaattacagcagcagcagcagctgcagcagcaacaacaacaacaactacagcagcaacagcagcttcagcaacagcagctccaacagcagcagcagcaacaacagctgcagcaacagcagcagcagcagttacagcagcagcagcagcagctccagcaacagcagcaacagcaacagcagcagttccagcagcaacaacaacagcagcaaatgggactacttaaccagtccaggaccctgttatctccccagcaacagcagcagcagcaggtggcacttggcccagggatgccagctaaaccgctgcaacacttttcttcccccggagccctaggacctactctcttgcttactggcaaagagcagaacactgtggatcctgccgtgagctctgaagccacagagggcccatccactcatcaggggggacccttggctattggcaccactcctgagagcatggcaaccgagcccggtgaggtcaagccttcattatccggtgactcccagctgttactagtccagccacagccacaaccgcaaccatccagtctacagctccaaccgcctctccgccttcccggacaacagcagcagcaagtcagcttactccatactgccggaggtgggtctcatgggcagctgggatccgggagttctagtgaagctagctccgttcctcatctgttagcgcagccctcagtgagtctgggggaccagccgggtagcatgacccagaatttactgggacctcaacagcccatgttggaaagaccaatgcagaacaacacgggccctcagcccccaaagccagggccagttctccaaagcgggcagggcctcccaggagtcggtataatgcctaccgtgggacagctgagagctcaactgcagggcgtgctggcaaagaacccacagctgcggcacttatctcctcaacagcagcagcagcttcaggccctgctgatgcagcgccagcttcagcagagtcaggccgtgcgccagacacccccataccaggagcctgggacccagacaagtccactacagggcctgttaggatgtcagccacaacttggcggttttcctggacctcagaccggtccactccaggagcttggcgctgggcctcgaccccagggccctcctaggcttcctgccccacctggagccctgagcactggaccggtgctcggacctgtccaccctacacctccaccctcaagtccccaagaacctaagcggccaagtcaactcccttctccaagctcgcagctgcctaccgaagcccagctgcccccaacccacccagggactccaaagccacagggcccaacactggagcccccaccaggcagggtgtctccagcggctgctcagctcgctgacacacttttttcaaaaggtttaggcccatgggacccccctgacaaccttgctgaaacccaaaagcctgagcagtcaagtctcgtacctggacacctcgaccaggttaatggccaggtggtccctgaggcttctcagttgtcaattaagcaggaacctagagaggaaccatgcgctctgggcgctcaatctgtgaaaagagaagcaaatggcgagcccattggcgctcccggtaccagcaaccacttgctactggctggccctaggtccgaagccggtcatctgctcctgcaaaagctccttcgtgccaaaaacgtgcagctgtcaaccggccgaggttccgagggcctcagagcagagataaatggacacatagactccaaactcgctggcttagagcagaagctgcagggaacgcctagtaacaaggaggacgctgccgcacggaagcctttgactcccaagccaaaacgggtgcagaaagcctcggacaggttagtctcgtcacgcaagaaactgagaaaggaagatggggttcgggctagtgaagcactcctgaagcagttgaagcaggagctcagtttactgccactgaccgaacctgctatcaccgctaacttttcgctcttcgcaccctttggatctggttgtccagtgaacggccagagccaactccgcggtgcctttggctctggggcactgcccacgggacccgattattattcacagttgcttactaagaataacttgtctaaccccccaacacccccaagcagcttgcctccaacaccgccacctagcgtgcaacagaaaatggtgaacggagttacccccagtgaagaactcggagaacaccccaaggacgcggcatccgcaagagattctgaaagggctctgagggacacatccgaggtgaagagtctggacttgctggcggctctgcctacccctccgcataaccagactgaggatgtgaggatggagagcgatgaagatagcgactcacccgattcaatcgtgcctgcctcttcacccgaatccatcctgggcgaagaagcccctcggtttccacatctggggtccgggcgatgggagcaggaagatcgcgctttgtctcccgtgatacctctaatcccaagagcctctattcctgtgttccctgacactaagccttatggagccttgggtctggaggttcctggaaaactgccagtaaccacatgggagaaagggaaggggtctgaggtgtcagtgatgctgaccgtctctgctgccgctgccaagaatctgaacggggtaatggttgctgtagccgagctgctgagtatgaaaatacctaactcgtacgaagttctttttccagagtcgccggcaagagctgggacagagccaaagaagggcgaagctgaaggaccgggagggaaggagaagggactggaaggtaaatcacccgatacagggccagactggctcaaacagtttgacgccgtgttgccgggttacaccttgaaaagtcaactcgatatccttagtctcctgaagcaggaaagtcctgccccagaacctcccacccaacacagctacacttacaatgtgtctaatctggacgtgcgtcagttatctgcgcctcctccagaggaaccttcgcccccaccctcccctctggctcccagtcctgctagcccaccaacggagcctttagttgagctaccaaccgaaccgctcgcggaacctcctgtgccttcccccctacctttagcgtctagccccgaatcagcacggcctaaaccgagggcgcgtccaccagaagagggagaggactcacgccctccaagacttaaaaaatggaaaggcgtccgctggaaacggttacgtctcctgctgactattcagaaagggtctggcagacaggaggatgagagggaggtggctgaatttatggagcagctggggacagccctgcggccagacaaagtccctcgagatatgagacggtgttgcttttgccacgaagagggcgatggggctacagacggccctgccaggctattgaacttggacctagacctatgggtccatctcaattgtgctctgtggtctacagaagtttatgagacccagggcggagccttgatgaacgttgaggtggcacttcaccgtggcctgcttacaaaatgctcactctgccagcgaacaggagctacctcttcatgcaaccgcatgaggtgccctaatgtgtaccatttcgcttgtgcgatccgggctaagtgtatgttttttaaggacaaaacgatgttgtgccccatgcacaagatcaaaggaccatgcgagcaggagttaagcagttttgccgtgtttcgtagagtctatattgaaagagacgaagttaagcagatcgcttctatcatccaaagaggcgagcgactccacatgtttagggtcggcggactggtgttccacgccatcggtcagctgctgcctcaccaaatggccgacttccattctgctaccgccctttaccctgtgggatacgaagccacaaggatctattggtcactccggaccaacaatcggagatgttgctaccggtgctcgatcggtgagaacaacggtcgccctgagtttgtgattaaggtgattgagcaaggtctcgaggacctcgtatttacagacgcctctccacaggctgtgtggaaccggataatcgagcccgtcgccgctatgcggaaagaagcagatatgttgcggctgtttccagagtatctgaagggtgaggaactgttcgggttaactgtgcacgctgtcctaagaatagcggagtccctccccggagtcgagtcctgtcagaattacttatttcggtatggccgtcatcccttgatggaattgccattgatgattaatcccaccggttgtgccagatctgagcccaagattctgacccactataagcgtccccacaccctaaatagtacctccatgagcaaagcctaccagagcacctttaccggtgagactaacaccccctacagcaagcagttcgtgcacagcaaaagcagtcagtaccggagactgagaacagagtggaagaacaacgtgtacctggccagatcgaggatccagggccttggactctacgccgctaaggatctggagaagcatacaatggtgatcgagtacataggcaccataatcagaaatgaggtagccaataggcgcgagaagatatatgaagagcagaatcgaggcatctacatgttccggattaataacgagcacgtgattgacgctaccctgaccggcggacccgctaggtatatcaatcattcctgcgccccaaattgcgtggccgaagtggtgacctttgacaaagaagacaagatcattattatttcctcaagaagaattccgaaaggcgaggagttgacgtatgactatcagttcgacttcgaggatgatcagcataagatcccatgtcactgtggtgcatggaactgccgcaagtggatgaattac

SEQ ID NO: 231448 - DNA, 441 bp, Artificial Sequence
  Description of Artificial Sequence: Synthetic coding sequence
atggatagccagaagctggccggtgaggataaggattccgaaccagctgctgacggaccggcagcctccgaagaccctagcgcaactgagtctgacctgcctaacccgcatgtgggggaagtttcagtcttgtctagtggatctcctagactgcaggaaacgccccaagactgtagcggaggacccgtgcggaggtgtgcactatgtaactgcggcgagccgtcactgcatggccagcgggagctccggagattcgagctgccattcgactggccacgttgcccagttgtgtcaccgggaggaagtcctggtcccaatgaggctgttctgccctctgaggatctttcccagattgggtttcccgagggcctgacacctgctcacctgggggaaccgggtggttcttgctgggcccaccactggtgtgctgcatggtcctag

SEQ ID NO: 231449 - DNA, 14736 bp, Artificial Sequence
  Description of Artificial Sequence: Synthetic coding sequence
atgtccagcgaggaggacaagtctgtggagcagccacagccccctcctccccctccagaggaacctggcgcacccgctcccagcccagctgccgctgataagcggccaagaggtagaccacgcaaagatggagccagtccctttcaaagggcccgaaaaaagcccagatccagagggaagaccgctgtggaagatgaagattccatggatggcttggaaacaacggagaccgaaaccatagtggagaccgagatcaaggagcagagcgcagaggaagacgccgaggcagaagtggataattccaagcaactaattccgactctgcagcggagtgtttccgaggagtctgcgaactcgcttgtcagtgtaggtgttgaagccaaaatctccgaacagctttgtgcattctgttattgcggggaaaagagtagtctgggacaaggcgatctcaagcagttccgaattaccccaggattcatactcccatggaggaatcaaccttcaaacaagaaggatatcgacgataactccaacggtacatacgagaagatgcagaattcggctccccgaaaacagcggggacagcgaaaggaaaggagccctcagcaaaacatagtcagctgcgtgtccgtgtccacccagaccgcctcagatgaccaggcaggaaagctgtgggacgagctcagcctggtcggcctgccggatgccattgatatacaagcgctgtttgattctacgggcacctgctgggcccaccatcgttgtgtggagtggtctctgggcgtctgccagatggaggagcccctgcttgtgaacgttgataaagctgttgtttctggctctacagagcggtgtgccttctgtaagcatctgggcgctacaataaagtgttgtgaggaaaagtgtactcaaatgtaccactacccttgtgctgcaggtgctggaacgtttcaagacttcagtcacatctttctgctgtgtcccgagcacatagatcaggcgcctgagaggagcaaggaagatgctaactgtgctgtgtgcgattctcctggtgatttgttagaccaattcttttgtaccacatgtggccaacattaccacggtatgtgtctggacatcgcggttacaccactgaaacgtgccggttggcaatgtcctgagtgcaaggtctgccaaaactgcaagcagagcggtgaggactccaaaatgttggtgtgcgacacttgtgacaagggataccacacattctgcttacaacctgtgatgaaatcagtcccaacgaatggttggaagtgcaagaattgtcgaatctgcatcgaatgcggaactcggtcgtcctcacaatggcaccacaactgtctcatttgtgacaattgctaccagcaacaggataacctgtgcccattctgcggcaagtgctatcatcctgaactgcagaaggacatgctgcactgcaatatgtgcaagcggtgggtgcaccttgaatgcgacaagccaacagatcacgaactggacacccagttaaaggaggagtacatttgcatgtactgtaagcacctgggggcagagatggataggctccagccaggagaggaggtcgaaattgcagagctcacaacagactataacaacgagatggaagtagagggcccagaggaccagatggtcttctccgagcaagccgctaataaggacgtgaatggccaagaaagcactccaggcattgtccctgatgccgttcaggtgcacactgaagagcagcagaaatcccatccgagcgagtccctagatactgatagcctactaatcgctgtgagctcccagcacacagtgaatacggagttggaaaaacagatctctaacgaagtggatagcgaggatctgaagatgtcttcggaggtcaagcacatctgcggggaagaccagattgaagacaagatggaggtcaccgagaacattgaggtggtgacacaccagatcaccgtgcagcaggagcaactgcagctgctggaagagcctgaaacagttgtttcacgggaggaaagccgccctcccaagctagtcatggagagtgtgacactccccctggagacgctagtttcccctcacgaagaatctattagtctctgtcctgaagagcagctggtaattgaaagactgcagggggaaaaggaacaaaaagaaaactccgaattatcaacaggtctgatggattccgagatgacgcctacgatcgaaggctgtgtaaaagacgtgtcctaccagggtggtaagagtatcaaactatcttcagagactgagtctagcttcagctcttccgcagatattagcaaggcagacgttagttcatcccccaccccatcctctgatctcccttcccacgacatgctacacaactatccttctgccctgtccagcagcgcagggaatattatgcccaccacctacatctcagttaccccaaagatcggcatgggcaaaccggctatcaccaaacgcaagttttcacctgggaggccacgatcaaaacagggcgcttggtccactcataacaccgtcagtcctccgtcatggagccctgatatcagcgaggggagagaaatcttcaagcccagacaactgcccggaagcgcaatatggtccataaaggtgggcagaggctctgggtttcctggcaagcgaagacctagaggagcaggcctctctggtcgtggcggaagagggcgaagcaagctgaagtccggcattggtgctgtagtcctgcccggtgttagtacggcagacatcagttctaataaggatgacgaggagaactctatgcacaacaccgtggtgcttttttcctcgtccgacaaatttactctgaatcaggatatgtgcgtggtctgtggttcattcgggcagggagctgaaggtcgactgttagcctgctcccaatgtgggcagtgttatcacccctattgtgtcagcatcaaaatcaccaaagtagtgctgagtaagggctggcgctgcttggaatgtactgtctgcgaagcctgtggcaaagccaccgatcctgggagactgctgctgtgtgacgactgcgatatttcttaccacacatactgtctggaccccccactccagaccgtgccgaaaggagggtggaagtgcaagtggtgtgtgtggtgtcggcactgcggtgccacgagcgcagggctgagatgcgaatggcagaacaactatactcaatgcgcaccctgtgcatccctgtcctcttgcccagtatgttaccgcaactaccgggaagaggatctgatcctccagtgccgtcagtgcgatcggtggatgcacgctgtttgccagaacctgaacactgaagaagaggtagagaatgtggcggatattggcttcgattgtagcatgtgccgaccttacatgcctgcgagtaacgtccctagcagcgactgctgcgagtcttccctcgtcgctcagatcgtgacaaaagtgaaggaactggaccccccaaaaacctacacacaggatggggtgtgcctgacagaatctggaatgactcagctccagtcacttacggtaacagtcccacgcaggaaacggagcaagcccaagctgaagctgaaaataattaatcagaacagtgttgcggtgcttcagacaccgcctgatattcagtctgagcacagtcgggacggcgagatggacgattcgcgagaaggagaactgatggactgcgacgggaagtctgagtcttcacctgagcgtgaagccgtcgatgatgaaacaaaaggcgtggagggaacagatggcgttaagaaacgaaagcgcaaaccatatagacctggtatcggaggctttatggtgagacaaaggtcccgaacaggtcagggaaagaccaagcgatccgttatccgcaaagattctagcggtagcatcagtgagcagctgccatgtcgggatgatggttggtcggaacagctgccggatacactcgtggacgagtctgtgtctgtaactgagtctacggagaagattaagaagcgatacagaaaacggaaaaacaagttggaggaaacctttccggcttatctgcaagaagccttttttgggaaagacctgctggatacctctagacagagtaagatctcactggataacctttccgaggacggcgcacaactgctgtacaagaccaacatgaatacgggctttttagaccctagtcttgatcccctactctcgtcttcgtccgcaccaacaaaatcaggcactcacgggcctgctgatgaccccctggctgacattagcgaagtactgaacacggacgatgatatactgggcatcatctcagacgacttagctaagtccgtagaccattccgatatcggtcccgtcaccgatgatccgagctcattgccgcagcccaatgtgaaccagtccagcagaccgctgagcgaagaacaactcgatggtatactttcccctgaactagacaagatggtcactgacggtgcgattctgggcaaactttataagatccccgaactaggtggaaaagatgttgaggacctgttcacagcagtgttgtcaccagctaacacacaaccaacgcctttgccccaaccccctccacctacccaactgctgccaatccataatcaggatgctttctccagaatgcccttgatgaacgggctaattggctcctcaccccacctgccccacaactcacttccgcctggctcaggcctggggacattctcagccatcgctcagagcagctacccagatgccagggataaaaattctgccttcaatcccatggcctccgacccaaataactcctggactagctccgcccctacagtggagggggagaatgacaccatgtctaacgcccagcggagtacactgaaatgggaaaaagaggaagccctaggagaaatggcaaccgttgctcccgtgctgtacactaatattaactttcccaaccttaaagaggagttcccagattggaccactagagtgaagcaaattgccaagctgtggcggaaagcttcaagtcaggaacgggctccatacgtacaaaaagcgcgtgacaaccgagccgcactgcggattaacaaggtccaaatgtcgaacgattccatgaagcggcaacaacagcaagatagcatagatccatcgagcaggatcgactccgagctgttcaaggatcccctcaagcagagagagtccgaacacgaacaagaatggaaattccggcaacagatgagacagaaatctaaacagcaggcaaagatcgaggctactcagaagttagagcaggtcaaaaatgagcagcagcagcagcagcagcagcaatttggatctcagcacttgctagtgcagagcgggtctgacactcccagctctgggattcagtcccccctcacgcctcaaccaggcaacggcaatatgtctccggcacagtcttttcataaagagctgttcacgaagcagcctcctagtaccccaacctcgaccagctcagatgacgtgtttgtgaaaccacaggcgccacctccacccccagctccttcccgaatccccattcaggactccctgtctcaggcccagactagtcagcctcccagccctcaggtgtttagtccaggatcgtctaatagccgcccaccaagtccaatggacccctatgctaaaatggtgggtacacccaggcctccgcctgtgggccacagtttctcgcgccgtaatagcgccgctccagtggaaaactgcacccccttgagttctgtgagtagaccattgcagatgaatgagaccactgcaaatagacccagcccagtgcgagacctgtgtagttcgtctacaaccaacaacgatccatatgcaaagccacccgatacacctcgcccagtgatgactgaccagttccccaaaagtctagggctctcacggagccccgtggtgtctgagcagactgccaagggtccgattgctgcaggcacctctgaccattttacaaagccttctccgcgagctgacgtgtttcaacgccagaggatcccggatagttatgcccgtcctctgctgacaccagcgccactggattcaggcccagggcctttcaagacgccaatgcagccgcctccatcatctcaggatccttatggtagcgtgagccaagccagcagaagactgtccgtggatccttacgagcggcctgcacttacgcctcgaccaattgacaattttagtcacaatcaatctaatgatccctacagccagccacccttaacccctcacccagctgtaaacgagtcattcgcacatcccagtcgcgctttttctcaacctggcacaattagtagacctacgagtcaggatccatattcgcaacctcctggaactcccagaccggtggtggactcctacagccaatccagcggcaccgcacgcagcaataccgacccatacagccagcccccagggactccccgtcctacaaccgtggacccatactctcaacagccccaaactccacgcccttctacccagacagatcttttcgtgacacctgtcaccaatcagaggcacagcgacccctacgcccatccacctggtaccccacggcctggtatctccgtcccttattcccagcctcccgctacccccaggccccgaataagcgagggatttacaaggagttcaatgacgcgcccagtgctgatgcccaatcaggaccctttccttcaggccgctcaaaatcgagggcctgccctgcccggacctctggtcaggccccctgacacatgctcccagacacccaggccgccaggcccaggactgtcagacacctttagtcgcgtcagccccagcgccgcacgggacccttatgaccagtcaccgatgactccacgatcacaatccgacagctttggcacaagccagactgcacacgatgtagcagatcaaccacgccctgggtctgaaggctctttttgcgcatcctccaatagtccaatgcactctcaggggcagcagtttagcggggtgtctcagctacctggtccagtccctacctccggcgtcaccgacacccagaatacggtgaatatggcgcaggctgacacggaaaaactgagacagaggcagaagcttcgtgagattatcttacagcagcaacaacaaaagaaaatcgctgggagacaggagaaaggctctcaggacagtccggcagtgccccatccaggtcccttgcagcattggcagccagagaacgtcaaccaagcctttacccgccctccgccaccttaccccggaaatatacgcagcccggttgctcctcctttaggaccacgatacgccgtctttcccaaggaccagaggggcccttatccacctgacgttgcttctatgggcatgcgtccacatggattccggttcgggttcccaggtggaagtcacggcaccatgccttcacaagagcggtttttggtcccaccccaacagatacaggggtctggcgtgtctcctcagcttcggagaagcgtgtccgtcgatatgcccagacccctcaacaactcccaaatgaataaccccgtagggttaccacagcacttttcgcctcaatccttgccagttcaacagcataatatcctgggccaagcttacatcgagctcaggcatagagcccctgatggacggcagaggctgcctttctccgctcccccaggatccgtagtggaggctagttctaacctgcgtcacggcaacttcatccctaggcctgacttccctgggcctcggcacacggacccgatgcgccgaccccctcagggactaccaaatcaactccctgtgcacccagatcttgaacaagtcccacccagtcagcaggagcagggtcacagcgtgcacagcagctcaatggtgatgagaaccctcaatcatccactcggaggggagttcagtgaagcccctctcagcacctcagtcccttccgaaaccacctctgacaatttgcaaattaccactcaaccctcagacggattggaggaaaagttggattccgacgatccaagtgtgaaggagctcgatgtcaaagacttagaaggcgtagaagtgaaagacctggatgatgaggacctggagaatctgaacctggatacagaagatggaaaggtcgtggagctagacacgctcgataatctggaaaccaacgatccaaatttagatgatctcctcagatctggagaattcgatattatcgcatacacagatcccgagctggacatgggagataagaagtccatgttcaatgaggagctggacctcccaatcgacgataaactggacaatcaatgcgtgagcgtggagcccaaaaagaaagaacaggaaaataagacgttagtcttaagcgacaaacactccccacaaaaaaagtctacggtgactaatgaagtcaaaaccgaagtactgtctccaaactcgaaggttgaaagtaaatgtgaaactgagaagaacgacgagaataaggataatgtagacacaccctgctctcaggcaagcgctcattcagatcttaacgatggggaaaaaacaagcttacatccgtgtgatcccgatctttttgaaaagcgcacaaacagggaaactgccggaccttcagcgaacgtgattcaagcttcaacccagctgcctgctcaggatgtgattaactcctgcggcattacagggagcacaccggtcctgagctcgctgctcgcaaatgagaagagtgataattcagacataagaccaagcggaagcccaccccctcctaccttgcctgcctccccctcgaaccatgtcagcagcctccccccttttatagcaccacctggaagggtgctggataatgccatgaattctaacgtgacagtggtcagcagggtgaatcacgttttttcacagggagtgcaagtaaaccctggcctgatcccaggacagagcactgtgaaccattctcttggcaccggaaagcctgcaacccagaccgggcctcagacctctcaatccggcacttctagtatgagcggccctcagcagttaatgattccccaaacactggcgcagcagaaccgggaaaggcctctcttgttggaggaacaaccactgttgctccaagacctgctggatcaagaaaggcaggaacagcaacagcagcgacaaatgcaggccatgatccgacagagaagcgagccattttttccaaacattgactttgatgccattactgaccccattatgaaagccaagatggtcgcactgaaaggcatcaacaaggtgatggcccagaataacttgggcatgcctcccatggtcatgtcaagatttccttttatgggccaggtcgtgaccggaacccagaactctgaaggccagaatctaggcccacaggcaatccctcaagacggttccatcactcatcagatcagtcgacccaatcctccaaatttcggacctgggtttgtgaatgatagtcagagaaagcagtacgaggagtggcttcaggaaacccagcaactgctccagatgcagcaaaaatatttggaagagcagatcggagcgcacagaaagtctaaaaaagctctgtccgccaaacagaggaccgctaagaaggccggtagggagtttcccgaagaggacgccgagcagttgaagcatgttacagagcaacagtctatggtccaaaagcagctggagcaaataaggaagcagcagaaggaacacgccgagctgatcgaagattacaggatcaaacagcagcagcagtgtgccatggccccaccaacgatgatgccctcagtgcagccccagccaccacttatcccgggagccaccccccctacaatgtcccagcctacttttcccatggttcctcagcagctgcagcaccagcagcatacaaccgttataagcgggcacacaagtcctgtgaggatgccttcactgccaggttggcaaccgaactctgcacccgcacaccttcccctgaatcctcccaggatccagccacccattgcgcagctcccgatcaaaacatgcacaccagcacctgggaccgtgtcaaacgccaatcctcagtcagggcctcctccccgagtggaattcgatgataacaatccattcagcgagagctttcaggagagagaaagaaaggagcgcctgagagaacagcaagagagacagcgcatacaacttatgcaagaggtggacaggcaaagggctctgcagcagcggatggagatggaacagcatgggatggtcggatctgaaatctcctccagtagaacatccgttagtcagattcccttctattcctctgatctgccctgtgactttatgcagccactggggcctctccagcaatccccccaacaccagcagcaaatggggcaggtgctccagcagcagaacatccagcagggttctattaactctccatccacgcagaccttcatgcagactaatgagaggcggcaagtagggccaccttcattcgtgcccgattctccgagcattccggttggctctccgaatttctcatccgttaagcagggacatgggaacctcagtggcacgtcttttcagcagtcccctgtccggcctagcttcacccccgcactgcctgccgctcccccagtagctaactcaagcctgccttgtggccaggactccactatcactcatggacattcatacccaggcagcactcagtctctcattcagttatattccgatataatcccagaggagaaaggcaagaaaaaacggactaggaaaaagaagagagatgatgacgctgagtctactaaggctcctagcactccacatagtgatatcacagcccctccaactcccggtatctctgagaccaccagcacaccggcagtgagcacaccatccgagctccctcagcaggcagatcaggagagcgtcgaacctgtgggaccctccactccgaatatggcagccggacagctctgcactgagttagagaacaagctgcctaattccgacttttctcaagccacaccaaaccaacagacctatgctaacagtgaagtagataagttgtcaatggagacccccgcaaaaaccgaagaaataaagttggagaaggcagagacagagagttgtcctggacaggaagagcccaagttggaggagcagaacggtagcaaggtcgaagggaacgccgtggcctgtccagtgagcagcgcacaatccccccctcacagcgcaggtgccccagcggctaagggcgacagcggtaatgagttgctgaaacacttactgaaaaacaagaagtcatctagcctgctgaaccagaagcccgaagggtccatctgctccgaggatgactgcacgaaagacaacaagctggtagaaaaacagaaccctgcggagggtttacagaccctcggcgctcagatgcagggcggatttgggtgtggcaatcagctacccaaaaccgatggtgggtccgagacaaagaagcagcgctccaagcgcacccagcggacaggtgagaaggctgcacctaggtccaaaaagcggaagaaagatgaggaggagaagcaggccatgtacagttcaaccgacacattcacccacctgaaacaacaaaacaacctttccaatcccccaactccgcctgcctcactgccacctacaccccctccaatggcatgtcagaagatggcaaacggctttgctaccaccgaggagcttgctggtaaagccggtgtcctggtaagccatgaggtcactaagaccctgggtccgaagccctttcagctaccattccggccacaggatgacctcttggccagagcactggcccagggtccaaagaccgtcgacgttccagcctcactcccgacgccacctcacaacaatcaagaggagctgagaattcaggaccactgcggcgatcgggacacacccgacagctttgtcccttctagttcacctgagagcgtggtgggggtggaagtttcacgatatcccgatctttccctagttaaggaagagcccccagagccagtgccttccccaatcattcccatcctgccctcaacagctggaaaatctagtgaaagccgcaggaatgacataaagacagagcctggcacgctctatttcgcaagccccttcgggcctagcccgaacggccctagatcaggcttgatttccgtggccatcaccctgcatcctacagctgccgagaatatttccagtgtggtcgctgctttctctgatttgctacacgtcaggattcccaacagctatgaagtaagcagcgcacccgacgtgcccagcatgggactggtctcaagccatcgtatcaaccctggcctggagtaccggcaacatctcctgctgagaggacctccacctggcagcgccaatcctcccaggctcgtgtccagctaccgacttaaacaacccaatgtgccattccctcccacaagtaatgggttgagcgggtataaggacagctcacacggcattgcggagagtgccgcactgcggcctcagtggtgctgtcattgtaaggtcgttatccttggatctggagtgaggaaaagtttcaaggatctcactttgctcaataaagattccagagaatccaccaagcgggttgaaaaggatatagtgttttgttctaacaattgcttcatcctttacagctcaacagcccaggcaaaaaattctgagaacaaggagagtatcccatctctcccacaatctccaatgcgggagacaccgtcaaaagcattccaccagtacagcaataacatctccaccctggacgttcactgcctccctcagctccccgagaaggcatctccacctgcaagcccgccaatagcctttccacctgctttcgaggccgcacaggtcgaagctaaaccagatgaattgaaggtgacagtgaagctgaagccaagactccgcgcagttcatgggggttttgaggattgccggccactgaacaagaaatggagaggcatgaaatggaaaaaatggtccattcatatcgtgattccaaaaggtacatttaaaccaccctgcgaagacgagatcgacgagttcttaaagaagctcggcacttccctgaagccagaccccgttcctaaagattaccgcaaatgttgcttttgccacgaagagggtgatggactaaccgatggccctgcccgactcctgaacctagatcttgatctttgggtgcatttaaattgtgcactgtggagtacagaggtttatgagacccaagccggagctctgatcaatgtggagctcgcgttacgcagaggtttacagatgaaatgcgtcttctgtcacaaaactggcgctaccagcggctgtcatcggtttagatgtaccaacatttatcacttcacctgtgcaataaaggctcagtgtatgttcttcaaggataagacaatgttgtgcccgatgcacaagccaaagggaatccatgagcaggaactctcctatttcgctgtgttccgaagagtgtacgtgcaaagagacgaggtccgtcagatcgcaagcattgtgcagaggggcgaaagggaccacacatttcgggtgggcagcttgatctttcacacaatcggtcagttgctaccacaacaaatgcaggcgtttcactcccccaaagcccttttccctgtcgggtatgaggcctctcggctttattggtcaacacggtatgccaatcggagatgccggtacctgtgtagtatcgaggagaaggatggtcgcccagtgttcgtgattcgcatcgttgagcaggggcacgaggacctcgtcctttcagatatttccccgaagggagtttgggacaaaatattggaacccgttgcatgtgttaggaagaagtccgagatgctgcaactgttccccgcttatttaaagggagaggaccttttcggcctgaccgtgtctgcggtggccagaattgccgaatcgctgccaggcgttgaagcttgcgaaaattacacattccgttatggaagaaaccccctgatggaactgcccttggcagtgaaccctacagggtgtgccaggtccgagccaaagatgagcgcccatgtgaagagatttgtcctgagaccacataccctgaattctacgtctacctccaaaagtttccagtccacggtgactggagaactgaatgccccatatagcaagcaatttgtccacagcaaatcaagccagtaccggaaaatgaagaccgagtggaaatccaacgtctacctagctaggagtcgcatccaaggtctgggcctgtatgccgctagagatatcgagaaacatacgatggtaattgagtatatcggcaccattatcagaaacgaagtggctaatcgcaaggaaaaactatacgagtcacagaacaggggcgtgtatatgtttaggatggacaacgatcacgtcattgatgctactcttaccggcggacccgcaagatatatcaaccatagttgcgccccaaactgtgttgccgaggtcgttacgtttgaaagaggccacaagattatcatctcctcctcaaggcgcattcagaagggcgaggagctctgttatgactacaaattcgatttcgaggacgatcagcataaaattccttgccattgtggggcagtgaactgtagaaagtggatgaattat

SEQ ID NO: 231450 - DNA, 14907 bp, Artificial Sequence
  Description of Artificial Sequence: Synthetic coding sequence
atgagctcagaagaagataagagtgtagagcagccccaacccccaccaccaccacctgaggaacccggagctcccgctccttctcccgctgctgcagataagcggcctaggggcagacctcgcaaggacggggcatcccctttccagagagcgaggaaaaagcctcggtcaaggggcaaaaccgccgtcgaagacgaggatagcatggacggtttggaaacaactgagacagagacgatcgttgaaacagagattaaagagcagtccgctgaggaggacgccgaagccgaggttgataacagcaagcagctgataccgaccttacagcgatcagtctccgaagaatcagcaaacagtctggtaagtgtgggagttgaagctaagatttctgagcagttgtgcgcattctgttactgcggcgagaagtctagtctgggacagggcgacctcaaacaatttcgaatcactcccggatttatacttccctggcgcaaccagccctctaacaagaaggacattgacgacaatagcaatggaacctatgaaaagatgcagaattcggctccaaggaagcagcgtggacagaggaaggagcggtctccccagcagaacatcgtgagttgcgtatcagtgagtactcagactgcctctgacgaccaagctgggaaactttgggatgagctgtcgctggtcgggttgcccgacgccattgacattcaggcgctcttcgattccaccgggacctgctgggcccatcaccgatgtgtcgaatggagtttgggggtttgccagatggaggaacctttgttagtaaatgttgataaggcggttgtctcaggttctaccgagagatgtgccttctgtaagcacctgggtgctaccattaaatgttgtgaagagaagtgtacccagatgtaccattatccatgcgccgctggcgcagggactttccaggatttcagtcatattttcctgctctgtcctgagcatattgatcaggccccagagcgaagcaaggaagacgccaactgtgccgtgtgtgattcgcccggtgacttgctggaccagtttttctgcaccacctgtggacagcattatcacggcatgtgtctggacatcgccgttactccactgaagcgagcagggtggcagtgtcccgagtgcaaggtgtgtcagaactgtaaacagagtggcgaggacagcaagatgctggtttgcgatacatgcgacaagggataccataccttttgtctgcagcctgtcatgaaaagtgtgccaacaaacgggtggaagtgtaagaattgcagaatctgcatcgagtgcggaactagatccagcagccagtggcaccataactgtctaatttgcgacaattgctaccaacagcaagacaatctgtgccccttttgcgggaaatgttaccaccccgagctgcagaaggatatgctacactgtaacatgtgtaaacggtgggttcacctggaatgtgataagccaacggaccatgaactggacacacaattaaaagaagaatacatttgcatgtattgcaagcatctgggcgctgagatggaccgtttacaacccggagaggaggttgaaattgcagaactcacaaccgattacaacaatgagatggaggtggagggtcctgaggaccaaatggtattctcagaacaggccgctaacaaagatgtgaacggtcaggagtctacgcctgggatcgtcccagacgctgtgcaggtgcacacagaagaacaacaaaaaagccacccatctgagtctctggatacggactccctgcttatagccgttagcagccaacatactgttaacactgaactcgagaagcagatttctaatgaagttgattcagaggacttaaaaatgtcatccgaggttaaacacatctgcggagaggatcaaattgaggacaagatggaggtgactgaaaacattgaagtggtgactcatcagataaccgtccaacaggaacagttgcagttgctagaggaaccggagaccgttgttagcagggaagaaagtcgaccaccaaagctcgtgatggagagcgttacattgccgcttgagaccctggtgtcccctcacgaagagtcgatctctctgtgtccagaggagcagctcgtgatagaaagattgcagggcgaaaaagagcagaaggagaactccgagctatctacagggttgatggactcggaaatgacccctactatcgaaggatgcgtaaaagatgtatcctaccaggggggtaagagcatcaaactgtccagtgaaacagagtctagcttttcctccagtgcggatatctctaaggccgacgtttccagcagccctacaccctctagtgacctcccgtcacacgacatgctgcacaactatccctccgcactcagcagttctgccggtaacatcatgccaactacatatattagcgtcactcccaaaattggcatgggcaaacccgcaatcaccaagcgaaaattctcaccaggtaggcccagaagcaagcagggggcatggtccacccacaacacagtatcacctccgtcctggtcccctgatatttccgaaggcagagaaatatttaagcctcgtcagctgcccggaagtgcgatttggagcatcaaggtgggacgaggcagtggcttccctggcaagcgtcgccctcgcggtgcaggtctctccggtcggggtgggagagggagatccaaattaaagtctggaatcggtgctgtggttctgcccggtgtgtcaactgctgatatttcctcgaacaaggacgatgaagaaaatagcatgcataatacagtggtcctgttctcatcctctgataaatttaccctgaatcaggacatgtgtgtggtgtgcggttcctttgggcagggagctgaaggacgccttctggcctgctcccagtgcgggcaatgttatcacccctactgcgtgagcattaaaattactaaggtggtgctgagcaagggctggaggtgcctggagtgcactgtctgcgaggcatgcggtaaggccacagatcctgggaggctgctgttatgcgatgactgtgacatcagctaccacacttactgcctggaccctccgctgcagacagtacctaaagggggttggaaatgtaagtggtgcgtgtggtgcagacactgtggagctacaagcgccggattaagatgcgaatggcagaataactacacccagtgtgcaccctgcgcttcactgtctagctgcccagtctgttataggaactaccgcgaagaagatttaatactgcaatgtcggcagtgcgaccggtggatgcacgccgtctgccaaaatctgaacacagaagaggaagtagaaaacgtggccgatattgggtttgattgcagtatgtgccgcccatatatgcctgcgtctaacgtcccaagttcagattgctgcgagtcttccctcgtggctcagattgtcactaaggtgaaggagctggacccccctaaaacttacactcaggatggcgtgtgcctcacagagtcaggcatgacacaacttcagagtctgacagtcactgtccctagaaggaagcggtcaaagccgaaactgaagctgaagataattaaccagaattccgtggccgtcctacagaccccacctgacatccagtccgagcactcccgcgatggagaaatggacgattcaagagagggcgagctaatggattgcgatgggaaaagtgagtctagccccgagcgcgaggccgtggacgatgaaacaaagggcgtcgagggcactgatggtgtcaagaaaagaaaacggaagccttacaggcccggtatcggcggttttatggtgcggcaacgcagccgcaccgggcagggtaaaaccaagaggagtgtcataaggaaggactcctcaggctccatttccgagcagttgccatgtcgggacgacgggtggagcgaacagctccccgatactcttgtcgacgaatccgtgtctgtaacggagtccacggagaagatcaagaaaagataccgaaagcgtaagaacaagcttgaagagactttccctgcatatctgcaagaggcctttttcggaaaggacctcttagatacttcccgccaatctaagatctcccttgataacttatccgaagatggggctcagctgctctacaagacaaatatgaataccggcttccttgatcccagtctggacccattgttatcttcatcctccgctccgacaaaatcaggcacgcacggtcccgctgatgatcccttagccgatatatcagaggtgttgaacaccgacgacgacatcttgggaatcatctctgatgatctggccaagtcagtggaccactctgatattgggccagtcacagatgaccctagttcattaccccagccaaacgtgaaccagagctcccgtcccctgagcgaggaacagcttgatggaatcttgagccctgagctggacaagatggtgacagacggcgcaattctcgggaagctatataagatccctgaactgggaggcaaagacgtcgaggacctcttcaccgcagtgctctcaccggctaatacgcagcccaccccactgccgcagcctccaccccctacccagctgctccctatccataaccaggatgctttttcccgcatgcctctgatgaacggactcatcggtagttctcctcacctcccccataactctttgccccctggatccggcttaggcactttctccgctatcgcacagagtagctacccagatgcacgcgacaagaatagtgcctttaaccctatggcatccgacccaaacaatagctggacctctagcgcccctaccgtggagggagagaacgacactatgagcaacgctcagcgaagtacattgaaatgggaaaaggaagaggccctgggagaaatggcgacagtggcaccagtcctctatacaaacattaactttccaaaccttaaggaggagtttcctgattggaccacgcgtgtgaagcagattgctaaactgtggaggaaagcatcgtctcaggaacgcgctccgtacgtccagaaggcacgtgacaacagagccgctctgcgtatcaataaggtccaaatgtctaacgatagtatgaagagacagcagcaacaggacagtatcgaccctagctcccgcatcgacagcgaactctttaaagatcctctaaaacagagagagagcgaacatgagcaggagtggaagttcaggcaacaaatgaggcagaagagtaagcagcaggcaaagattgaggccactcaaaagctggagcaggtgaaaaacgaacagcagcagcagcagcaacaacaattcggtagccagcatcttttggtacagtccggatctgatacaccctctagtggtatacagagccccctgacccctcaacccggtaacggcaatatgtcccctgcccagtcttttcacaaggagctcttcacgaagcagcctcccagtactcccacgtctacctcgagcgacgatgttttcgtgaaacctcaagcccctcctccacctccagcaccaagtcgaatcccaatccaggactccctgtcccaggcccagacctcacaaccacccagccctcaggttttttccccagggtcctctaactccagacccccttctccaatggatccttatgcgaaaatggtcggcacaccgagaccgcctccagtgggccattcattctcgcgacgaaatagcgcagctcccgtggagaattgtactcctctctcatctgtaagtcgtcccttacagatgaatgaaaccaccgccaacaggccttccccagtgcgggacctctgctccagctcaacgacgaacaatgacccttatgccaaacctcccgatacacccagacccgttatgaccgaccagtttccaaagtcacttgggctgagccggtctcctgtagtgtcagaacagacagcgaaaggtccaatcgctgccggaacaagcgatcacttcacaaaaccgtccccacgagccgacgtttttcagagacagagaataccagactcctacgcacgaccactcctcacacccgctccactcgattctgggccaggcccattcaaaaccccaatgcaaccgccacctagctcacaagatccatatggttcagtgagtcaggccagccgtcggctgagcgtggacccatacgagcgacccgcactcactcctcgcccaattgataatttttctcataatcagtcaaatgacccatactcccagccaccgctcactccacacccagccgtgaacgaaagctttgctcacccttctagagcattcagccagcctggcactatctcgcggccaaccagccaggatccatatagccagccacccggaactccacggccagtggtggattcttattcacaatcaagcggaaccgcacgtagcaataccgacccttattcccagcctccaggcacaccaagaccaaccactgtggatccctattcccagcagccacaaaccccacgcccttcaacacagactgatctctttgtcacaccagtgactaatcagcgccacagcgacccctacgcccaccctcccggaacccctaggcctgggattagcgtgccttacagccagccgcctgcaacacccagacctaggatcagtgaaggcttcacacgctcttcaatgacaagacctgtgcttatgccgaaccaggacccgttcctccaggcagcccagaaccggggaccagctctgcctggccctcttgtcagaccgccagatacttgttcccagacacctcgaccacccggtcccggtctgagcgataccttctctcgtgtgagccctagtgccgctcgggatccatatgatcagagcccaatgacacctagaagtcagtcagacagcttcggcacatcccagactgctcacgacgtggccgaccagccccgacctgggtccgagggatccttctgtgcgagcagcaactcacccatgcattctcagggtcagcagttctccggtgtgtcgcagctgccaggcccagtgcctacaagcggagtgactgatacgcagaatacggtgaatatggcccaggcggataccgaaaagctccgtcagagacaaaaattgcgtgaaattattctgcagcagcaacaacagaagaagatagccggacggcaagaaaaaggatcacaagactcccccgcagtgccccatccaggccctctgcaacactggcagccagagaacgtcaaccaggcatttactaggcctcctccgccttatccgggtaatataagatccccagtagcgcctcctctcgggcctcggtacgcagtgttcccaaaggaccagaggggaccataccctcccgacgtcgctagcatgggtatgcgaccccatgggtttaggttcgggttcccagggggatcacacgggaccatgccctctcaagagcggttcctggtcccccctcagcagatccaagggtcgggggttagtccccagcttcgaagatcagtctccgtggacatgccaagaccgctgaacaactcacagatgaataacccggtaggactgccccagcacttttctcctcagtccctgccagtgcagcagcacaatatccttggccaggcttatattgagctgcgacacagggcgcctgatggcagacaacggttacccttctcagcccctccagggagcgtcgtagaggctagttccaatcttcgacatgggaacttcatacctcggcctgattttcctggacccaggcatacagaccctatgcggagacctcctcagggactcccaaatcaactacctgttcatcccgacttagaacaggtgccacccagtcagcaggagcagggacacagtgtgcacagctcaagtatggtaatgcgaactctaaaccaccctctgggaggggagttctctgaagccccattgagtacctcggtgccctccgagaccacatctgacaatctgcaaatcacaacccagccctccgacgggctggaggaaaagctggatagtgacgatccctccgtgaaagagctggatgtgaaagatctggagggggttgaggtcaaggatctcgatgacgaagatctcgaaaatctgaaccttgacaccgaggacggaaaggttgtcgaattggacacactggacaatctggaaaccaacgatcctaacctggatgacctgctgcgctcaggagagttcgacatcatcgcctatacggatcccgagctggatatgggagataaaaaatctatgtttaacgaagaattggatctgccgattgatgacaagctggacaaccagtgtgtttctgtcgaaccgaagaaaaaggagcaggaaaataaaaccctcgttctgtccgataagcactcccctcagaagaagtcgacagtgacaaacgaagtcaaaaccgaagttctaagcccaaattcaaaggtcgagtctaaatgcgaaacggagaaaaatgatgaaaacaaggataatgtggatactccatgtagccaggctagtgctcattccgatcttaacgacggtgagaaaacttccctacatccctgcgaccccgatcttttcgagaagcggaccaatagggagacagctggacccagcgctaatgtgatccaggccagcacgcaactaccagcccaagatgtaatcaacagctgcggaattacaggttctacgcccgtgctcagctccctgctggctaacgagaaaagcgacaatagtgatatcagaccgtccggaagcccccctcctcccaccctgcctgcatccccgtctaatcatgtgtcaagtctccctcccttcattgctccacctggtcgagtactggacaatgctatgaatagtaacgtgactgtggtgtcaagggtgaaccatgtcttcagccagggggtccaagttaacccaggactgattccaggtcagagtaccgttaatcatagcttgggaaccggcaagccggctactcagacaggcccacagacaagccagagcggaacttcttctatgtccggccctcaacaactcatgatcccgcagactctcgcccagcaaaacagggagaggcctctgctcctggaggaacagccactgttgcttcaagacctgcttgaccaggaacgtcaggaacagcagcagcagcggcagatgcaggccatgatccgccagaggtcggagccgttcttccccaacattgacttcgacgcgatcaccgatccgatcatgaaggctaagatggtggctctgaagggcataaataaggtgatggcccagaataatcttggcatgccacctatggtgatgtccagattcccgttcatgggtcaggtggtgacgggaactcagaattcagagggacagaacttaggccctcaggcaatcccccaggacggatctattactcaccagatctctagacctaatcccccaaactttgggcctggattcgtaaacgattcccagcgaaaacaatatgaggaatggttgcaggagacccaacaactcctgcagatgcagcagaagtatctggaagagcagatcggcgctcaccgaaaatctaaaaaagctctctccgctaagcagcgtaccgcgaagaaagccggaagagaatttcccgaagaggacgcggaacagttaaagcacgtgacagaacaacagtctatggtacagaaacagctagagcagatacgaaagcaacagaaggagcacgctgaacttatagaagattatagaattaagcagcaacagcagtgcgcaatggctccgcctactatgatgccaagtgtgcaaccacagccgcctctgatccctggcgcaacgcccccaactatgtctcagccaacttttccaatggtgccccagcagttgcagcaccaacagcatactacggtgataagtggtcacacatctcccgtcagaatgccttctctgcccggatggcagcccaactcagcccctgcgcatctacctctgaacccccctaggatccagccaccaatcgcacaactgcccatcaagacctgcactcccgcaccaggaactgtgtctaacgcaaacccacagtccgggccacctccccgagtggagtttgacgataacaatccattctccgagtcattccaggaaagagaaagaaaggaaagactgagagagcagcaggaaagacaaaggatccagttgatgcaggaagtcgaccggcaacgcgctctacaacaacgtatggaaatggaacaacatggaatggtaggaagcgagatctcatctagcagaacctcagtcagccaaatcccattctattcttctgatcttccatgcgacttcatgcagcccctgggccctctgcagcagtcccctcagcatcaacagcagatgggacaagtgttgcagcaacagaacattcaacagggctccataaattcaccctccactcagactttcatgcagacaaatgagcggcgacaagttggacccccttcttttgttcctgactcccctagtatcccagtgggaagtccaaacttcagctctgtcaagcagggccacggaaatctgagcgggacctcctttcaacaaagccctgtgaggccaagctttactcctgcgttgccagcggctccaccagtggcaaacagctctctcccctgtggtcaggactccaccatcacgcatggccacagctaccccggttcaacacagtcattgattcagctctatagtgatataatccccgaagaaaaagggaagaagaagaggacacgtaagaagaagcgtgatgacgatgctgaaagtaccaaggctccttctacacctcatagcgatatcactgcccctccaacccccggaatatccgagacaacaagtactcctgctgtatccacaccgagtgaacttccgcagcaggccgatcaggaatcggtggaacctgtggggccttccacacctaatatggccgctggacaactctgcaccgagctcgaaaacaagttgcctaattccgatttttcccaggccacgcctaatcagcagacatacgctaattccgaagtggataagcttagtatggaaacccctgccaaaacagaggagattaagttggagaaggccgagacagaaagctgtccgggtcaggaggaacccaagctggaagagcagaacggatctaaggtggaaggaaacgcggttgcctgccccgtttcctccgcccaatctccacctcatagcgctggggcacccgcagctaagggcgactccggtaacgagctcctgaaacacttgctaaagaataagaaaagctccagtttactgaaccagaagcctgaggggagtatctgttcggaggatgattgtacaaaagacaataagcttgtcgagaagcagaaccccgctgagggcttgcagactcttggggctcaaatgcagggtggattcgggtgtggcaaccagctgcccaaaacagatggtggctcagaaacaaaaaagcagcgatctaagcggacgcaacgtaccggagaaaaagcagcccctagaagcaaaaaacgcaagaaagatgaagaggagaagcaggccatgtactccagcacggacacattcacccatctaaaacaggtgcgccaactatctctgctgcctctaatggagccaattatcggcgtgaactttgctcacttcctgccctacggttcagggcagttcaatagtggcaacaggctactggggacctttggatctgcgactttggaaggcgtatccgattactacagccagttaatctacaaacaaaacaatctctcaaaccccccaactcccccagcctcgctgcctcctacccctccacccatggcttgtcagaaaatggctaacggcttcgcgactactgaggagctagccggaaaagccggtgttctcgtttcacacgaggtgaccaagactctggggcctaaaccctttcagctcccttttcgtccccaggacgaccttttggcaagggccctggcacagggcccaaaaaccgtggatgtgcccgcatctctcccaactccccctcataacaatcaggaagagttgcgcatccaggaccactgcggtgatagggacacccctgattccttcgtgccaagtagcagccccgaatcagtggtaggagtggaagtgtcgcgatatcccgacctgagtctagtgaaagaggagccaccagagcccgtaccaagtcccatcataccgattttgccgagtaccgccggaaagagctctgagtcgagaagaaacgatataaaaactgaaccgggaactctgtacttcgcaagcccatttggaccttcaccaaacggcccaaggagtgggctgatatccgtcgccatcacccttcaccccacagccgctgaaaacatttccagcgtggtggcagcgttctctgaccttttgcacgtgcgcatccctaactcctacgaagtcagctctgccccagacgtcccatccatgggtttggtgtcatcacaccgcataaatcccggtctcgagtaccgtcagcacttactcttgaggggaccgcctcccggatccgccaatccccctcggctggttagctcataccgcctgaaacagccgaacgtcccattcccccctacatctaatggcctgagcggctataaagattctagccatggaatcgcggagagtgccgctctacggccacaatggtgctgccactgtaaagtggtgatcctagggtcaggggtgcgcaaatcattcaaggacttaacgctcctgaacaaggactccagggaaagtaccaaaagagttgaaaaggatattgtgttttgttccaacaattgctttatcctgtatagcagcacagctcaagctaaaaacagtgagaataaggaatctatcccttcgctccctcagtcccctatgcgtgaaacaccttctaaagcattccatcagtattctaataatattagcacattagacgtccactgccttccacagctccctgaaaaggctagtcctccagcctcacccccaatagccttcccaccggcattcgaagctgctcaggttgaggccaaacctgacgaactcaaagtgaccgttaagctaaaacctcgactgcgcgcagtgcatggcggattcgaagactgtcgacccctgaataagaaatggcgaggaatgaagtggaagaagtggtcgatccacattgtgatccctaaagggacatttaagcctccctgcgaagatgaaatcgatgagttccttaaaaagcttgggaccagccttaaaccagacccagtccccaaggactatagaaagtgctgcttctgtcatgaggagggcgacggactgacagatggaccagcacggcttttgaatctcgatctggacctgtgggtccatctcaactgcgcactgtggagcaccgaagtgtatgagactcaggcaggcgcactgattaacgtagagctcgcccttcggagggggctgcagatgaagtgtgttttctgccacaagacgggagccacctccggctgccataggttccggtgtaccaacatttaccattttacatgcgctatcaaggcacagtgcatgtttttcaaagataagacaatgctgtgccctatgcacaagcccaaagggattcatgagcaggaattgtcttattttgccgttttccgcagggtctacgtgcagagggatgaggtgcggcagatcgcaagtatcgtgcaacgaggcgaaagagatcacacgtttcgcgtcggcagtctgatttttcacactatcgggcagctgctgccacaacagatgcaagcattccactcacccaaggcactctttcctgtagggtatgaagccagcagactctattggtccaccaggtacgctaatagaaggtgcagatacctgtgcagcatcgaagagaaagatggcaggcccgtgttcgtgatccgaattgtagagcagggccatgaggatttggtcctcagcgacatttcccctaaaggcgtgtgggacaagattcttgagcctgtggcctgcgttcgcaagaagtctgaaatgttgcagttattccctgcatacctgaagggcgaagacctgttcggcctgaccgtctctgcagtggctcgaattgcggagagcttaccgggagtggaggcctgcgaaaactataccttccgttacggtagaaatcccctaatggagttacccttggccgttaaccccacgggctgcgcgcgtagcgagcctaagatgagtgctcatgttaaacgctttgtgttacgccctcatacccttaactccacctcaacatctaagagctttcaaagtacggtgacaggcgagctcaatgcaccttacagcaaacaatttgtccacagcaaatcttcgcagtaccgaaaaatgaaaactgaatggaagagtaacgtgtacctcgctagatcacgtatccaaggcctgggcctctatgccgctagggatattgagaagcacaccatggtgatcgaatatatcgggactataattagaaacgaggttgctaacagaaaagaaaagctttacgagtcgcaaaaccggggtgtatacatgtttcgcatggataacgatcatgtcattgacgccaccctcacaggtggcccagctagatacattaatcatagctgtgcgcctaactgcgtagccgaagtggtgacgttcgaaagaggccacaagataatcatctccagtagcaggaggatccaaaagggagaggaactttgctacgactataaattcgactttgaagatgatcaacacaagatcccgtgccattgcggagcggttaattgtaggaagtggatgaactaa

SEQ ID NO: 231451 - DNA, 4575 bp, Artificial Sequence
  Description of Artificial Sequence: Synthetic coding sequence
ctaatgcaggaggtcgaccgacagcgggctctccagcagcggatggagatggaacagcacggaatggtggggagcgagatctcaagctcccggacatctgtcagtcagatccctttttactccagcgacctgccgtgtgacttcatgcaaccactggggcctttacagcagtcccctcagcatcagcagcagatgggacaagtgttgcagcaacagaacatccagcaagggtcaatcaacagtcccagcactcaaacattcatgcagactaacgagagacggcaggtgggtcctccttctttcgtgcccgactcacctagtattccagtcggcagccccaactttagttcagtgaagcaaggccatgggaatctgtctggaactagcttccagcaaagcccagtccggccttcattcacacccgcactgcccgcagcccctccagtggccaactcatctttgccctgcggacaagattccacaatcactcacggacattcctacccaggatcaacccagtcattgattcagctgtacagcgatattatacccgaagaaaaaggcaagaaaaaacggaccagaaagaagaaacgagacgatgatgctgagagcactaaagcgccatctaccccacacagcgatattacagcaccaccaacccctggaataagcgagactacttccacaccggcagtgtctacgccctccgagctgccgcagcaggccgatcaggaaagcgtggagcccgtgggtcccagtacgccaaacatggctgccggtcagctttgcacagagctcgagaataaactccctaacagtgacttctctcaagcaacccctaatcaacagacctacgccaactcagaagtggataagctgagtatggagacccccgcaaaaaccgaagaaattaaactcgagaaagcagagactgagtcctgtcctgggcaggaagagcccaaactggaagaacagaatggttctaaggtggaagggaacgcggtagcgtgccctgtatccagcgcccagagcccgccacactcagctggggctccagccgctaagggagactccggtaacgaattgctcaaacacctacttaagaacaaaaaatcctcctcactactgaaccagaaaccagaaggatcgatctgttccgaggatgattgcaccaaagacaacaagctggtggaaaagcagaatcccgctgagggacttcagactttaggagctcagatgcagggcggtttcgggtgcgggaatcagctgccaaaaaccgatggcggaagtgaaactaagaaacagagaagtaaaagaacgcagcggactggcgagaaggccgctcctcgaagtaagaaacgcaagaaagacgaggaagaaaaacaagctatgtactcaagcacggacactttcacgcacctgaagcaacaactgtctttactcccactcatggaacctattattggtgttaattttgcccactttcttccctatggaagcggccagttcaatagcggcaaccgcctgctggggaccttcggttcagctaccctggagggggtatccgactactacagccagctgatctataagaagatggccaacgggttcgcgaccacagaagagcttgcaggcaaggccggagtgcttgtcagtcacgaggtgactaaaacactcggcccaaaacctttccagctcccgttcaggccccaagatgacctcctggcacgagccctagcgcagggtcccaaaaccgttgacgtgcccgcatcccttccgacaccgccacacaataatcaggaagagttacgcatccaggatcactgtggagatagagacacaccagacagcttcgtgccttcatctagtcctgagtcagttgtaggcgttgaagtgtctaggtatcccgatttgagcctggtgaaagaggagccgccagagcctgtacccagtccaattatccccatcctccccagcacagcgggtaagtccagcgagagccggagaaatgacattaaaactgagccagggactttgtatttcgcaagtccctttgggcctagccccaacggacccaggtcaggattaatcagcgtcgcgatcaccctgcaccccaccgccgcagagaatatttcttctgtggtcgccgcattctctgatttgctccacgtgagaatcccgaacagctacgaggtgagttcagcccctgacgtaccctcgatgggactcgtgagttcacaccgcatcaacccaggcctggaatatcgtcaacatttactgcttcggggtcctccccctgggtccgctaatccgccaagattggtctccagctatcgcctgaagcagccaaacgtgccctttcctcctacttcaaacggactttccggctacaaagatagctctcatggcattgctgagagcgccgcactccggccacagtggtgttgccactgcaaggtcgtgatactggggtccggtgttaggaagtccttcaaggaccttaccttacttaataaagattccagggaaagtaccaaaagagtggaaaaggatatcgttttctgctcaaacaattgctttatcctgtattcctcgacagcccaggccaagaatagcgagaacaaggagagcattccatctctcccacagtccccaatgcgggagacccccagtaaagcattccaccaatacagcaacaacatctctacactggacgtgcactgccttccccaactgcctgaaaaggcttccccacccgcaagcccacctattgcctttcccccagcctttgaggcagctcaggtcgaagccaaacctgatgaactcaaagtgacagttaagctgaaaccccgtctcagggctgtccatggaggcttcgaggattgccgccctcttaataaaaagtggcgaggaatgaagtggaagaaatggtcgatccatattgtcatacctaagggaacctttaaacccccttgcgaggatgagatagacgaattcctcaagaagcttggcacttccctcaagccagaccctgtccctaaggactaccggaagtgctgtttctgccacgaagaaggtgatggcttgactgatggccctgctcgcctgcttaacttggaccttgacttgtgggtccaccttaactgcgcactctggagcactgaggtttatgaaacccaggctggagcgctgatcaatgtcgagctggcactcaggcggggactccagatgaaatgtgtattctgccacaaaactggcgcaacgagcggttgtcacagatttagatgcacaaacatctaccatttcacgtgcgcaattaaggcccaatgcatgttcttcaaggacaagacgatgctgtgcccgatgcacaaacccaaagggattcacgaacaagagctatcatacttcgcagttttcagacgtgtatacgtacagagggatgaagtgcggcagatcgcttcgattgtgcaaagaggagagagggaccacacattcagggttggctcccttattttccatactatagggcagctcttaccacagcagatgcaggcttttcacagccccaaggccttattccctgttggctatgaggcttcccggctttattggagcacccgttatgcgaaccggagatgcaggtacttgtgctcgatcgaggagaaggacggcagacccgtctttgtgattagaatcgtcgagcaaggccatgaggacctcgtactgtctgatatttctccgaaaggagtgtgggacaaaattctggagcccgttgcctgcgtgcgcaagaagtcagaaatgctccagttatttcccgcatatctgaaaggggaggatctctttgggctgaccgttagcgctgtggccagaattgcagagtcactgcctggggttgaggcctgtgagaattacaccttcagatacgggaggaacccccttatggaactgccattagcagtgaatccaaccggatgtgccaggtcggaacccaagatgagtgcccacgtgaaaagaccacacacgctgaacagcacaagtacaagtaagtcattccagtctaccgtcacaggagaattgaatgcgccttacagtaagcagttcgttcactccaaatcatcacagtatcggaagatgaagactgaatggaagtcaaatgtttacctcgcgcgttcccggatccaagggctgggtctgtacgctgcgagggatatagaaaaacacaccatggtgattgagtatatagggaccattattaggaacgaggtggccaaccgaaaagaaaaattatatgagtctcaaaataggggcgtttacatgtttcgaatggacaacgatcacgtgattgacgccactctgactgggggaccagccagatacatcaatcattcttgcgctcctaattgcgtggccgaagtcgtcaccttcgagcggggacataaaatcataataagctcgtcacggaggatacagaagggagaggaactgtgctacgactataagttcgacttcgaggatgaccagcacaaaattccctgccactgtggagctgtcaattgccgaaagtggatgaactag

SEQ ID NO: 231452 - DNA, 351 bp, Artificial Sequence
  Description of Artificial Sequence: Synthetic coding sequence
atggtcattgaatatatcggaactataatcagaaatgaagtagcgaacaggaaggagaagctgtatgagtctcagaaccgtggggtgtacatgtttagaatggataatgatcacgttattgatgcaactcttacaggcggacccgcaaggtacattaaccattcttgtgctcctaattgcgttgccgaagtggtaacgttcgaacgcggtcataagattattatcagttcatcgcgcagaatccagaagggagaagagctctgttatgattacaagttcgatttcgaggacgatcagcacaagatcccttgccactgcggggctgtgaattgccggaaatggatgaactag

SEQ ID NO: 231453 - DNA, 5576 bp, Artificial Sequence
  Description of Artificial Sequence: Synthetic coding sequence
atgtccattgtgatacccctaggcgtcgatacggctgagacaagctacctggagatggcggctggcagcgagccagaatccgtggaggcttcccccgtcgtggttgagaaaagtaatagctatcctcatcaactttataccagctccagtcatcattcacattcttatattgggctgccatatgctgatcacaactacggagcgcgtcctccccctacaccacctgcatcccctccaccgtctgtcctcatctccaaaaatgaagtcggaatcttcaccacaccaaactttgacgagacctcaagtgcaacaaccatatcaacatcggaagatggttcatacggcacagatgtaactagatgtatctgcggcttcacacacgatgacggctacatgatctgttgcgacaaatgctctgtttggcagcacatcgactgtatggggatcgatcgtcagcatatcccagacacttatttgtgtgagaggtgtcagcccagaaatttggataaggaaagggcagtcctccttcagagacggaaaagggagaacatgagcgatggcgatacaagcgctactgagagcggcgatgaggttccagtcgagctgtatacagccttccagcacacccctacgtccattactctcactgcttcaagagtatcaaaggtgaacgataagaggcggaagaagtcaggggaaaaggagcagcatattagcaagtgtaaaaaggctttccgtgaaggttcaagaaaaagcagcagagtcaaggggtctgctcccgaaatcgacccttcctccgacggatccaatttcggttgggaaactaaaatcaaggcgtggatggaccgatacgaggaagcaaacaataaccaatactccgaaggggtgcagcgggaggcgcagcggatcgccttaaggctcggaaacggcaatgacaaaaaggaaatgaataaaagcgatttgaatactaataacttgctattcaagccgcctgttgaatcccacattcagaagaataaaaaaatcctgaaatcggcaaaagacttgccccctgacgcgttaatcatcgaataccgcggtaaattcatgctccgcgagcaattcgaagcaaatgggtacttcttcaaacgcccatatccgtttgtactcttctactctaaatttcatggcttggaaatgtgcgtggatgctcgcactttcggcaatgaggctaggtttatcaggcggtcatgcaccccgaacgcagaggtcagacatgaaatccaggatgggaccattcacctatacatctatagtattcattcgattccaaaggggactgaaatcaccattgctttcgactttgactacgggaactgtaagtataaggtggactgcgcttgcctcaaggagaatcccgaatgccctgtactgaagcggtcctctgagtccatggagaatattaatagtggctatgagacgcgtcggaagaaagggaaaaaagacaaagacatcagcaaagaaaaggacacacagaaccagaatatcaccttagactgtgagggtacaacaaacaagatgaagagcccagagactaagcagcggaaactttcccctctgaggctctcggtttcaaataatcaggaacctgactttatcgacgacatcgaagaaaaaacacctatctctaacgaggtcgagatggaatctgaagagcaaatagccgagagaaaacggaaaatgacccgggaggaaaggaagatggaggcaattttgcaggccttcgccagactggagaaacgagagaaaagaagagagcaagctctcgaacgcattagcaccgctaaaactgaggtgaaaacagagtgtaaggacacgcagatagtttccgatgccgaggtgattcaagagcaggcaaaggaggaaaatgcatccaaacccaccccagccaaggtcaaccgtaccaagcaaagaaaaagcttctctaggtcccgtactcacatcggacaacagcggaggagacaccgtaccgttagcatgtgtagcgatatccagccaagttcccctgatattgaagtgacaagtcagcagaatgacatcgaaaatactgtcctgaccatcgagcctgagacagaaacagccttagcggagatcataaccgaaacagaggtgccagccctgaacaaatgtccgacaaagtaccctaagacgaaaaaacacctcgttaacgagtggctttcagaaaaaaatgagaagactggaaaaccttctgatggactgtcagagcgtccgctgaggattactaccgatcctgaggtgctagccacccaactgaattccctcccgggacttacgtatagccctcacgtctattccaccccaaagcattatattcggttcacttctcccttccttagtgagaaacgcaggaggaaggaaccaacagaaaacatttccggctcctgcaagaagaggtggctcaaacaggcactggaggaagagaatagcgccattctgcaccgattcaatagtccctgccaggagagatcaagaagtccagcagtcaatggtgagaataaatcgcccctgctcctgaacgatagttgttccctaccggatctaaccacaccactgaaaaagcgtaggttttaccaattactggattccgtttattcagaaacaagcaccccaacgccatccccctacgccaccccgacacacacggatattaccccgatggatccttcatttgccacaccccctcggataaagtccgacgacgaaacgtgcagaaatggttataagccaatctattccccggttactccagtcactcccggaacccctggcaacactatgcactttgagaatatttctagtcccgaaagtagtcccgagatcaagagaagaacttattcccaagagggatacgacaggagtagcacaatgttgacactcgggcctttccggaattcgaatctgacggagctcgggctccaagaaattaaaactatcggctatacgtcccccagatctaggaccgaggttaaccggcaatgcccaggcgagaaagaaccagtctcagatttacagcttggattagacgctgtggagcctaccgcgctccacaaaaccctggagaccccagcccatgacagggctgaaccaaactctcaactggatagtacccatagcggacggggtaccatgtatagcagttgggtaaaatcgcccgaccgcaccggggtgaacttttctgtgaatagcaatcttagagatttaactccttcccaccaactggaagtaggaggcggatttcgaatttccgagtctaagtgcctgatgcaggacgacacaagaggaatgttcatggagacaactgttttttgtacaagtgaagatggcctggtgtcaggcttcggcaggactgtgaacgacaacctcatcgatggcaactgtaccccacagaatccaccgcagaagaaaaaggtgtcactcctagagtacaggaagcgtcagcgagaggcacgtaagagcgggagcaaaacagagaacttcccactcatctctgtgagtcctcacgcatccgggtcactgtccaataacggagacgggtgcgcgagttctaacgacaatggggagcaggtggaccacaccgcttcgcttcccctgcctactcccgctacagtgtacaacgccacttctgaggagacaagcaataactgcccggtgaaggatgccactgcatctgagaaaaatgaaccggaggtacagtggactgcttctacgagcgtggagcaggtgcgtgaaaggagctaccagcgcgcactactcctcagcgatcatcgcaaggataaggactccggtggggagagcccgtgcgtttcttgcagcccctcacatgtgcagagcagcccatcttctcactcaaatcatatcccacagctgcaggcaaaggggcctgtgccaagctttagcgagctaatggaagatcctgaccccgagaaccctgagcctactactaccaatgagtgtccctccccggacacaagccagaatacatgtaagtcgccccctaaaatgtcaaagccaggcagccctggcagtgttatccctgcccaggcccatgggaagatcttcaccaaacccgatccgcagtgggactcaactgtaagcgcctccgaagccgagaatggagtacacttaaagactgagcttcaacagaagcagttgtcaaataacaaccaggctctttcaaaaaaccacccccctcagacacatgtacggaatagtagcgaacagctctcccaaaaactccctagtgtacctacaaaactgcactgcccgcctagcccccatctcgaaaaccccccaaaaagttctacaccccacacgcccgtgcagcacgggtacctctctcctaagccccctagccaacagctgggcagcccttacaggccccatcattcacagtcgcctcaagtgggaactcctcagcgggaaccccagcgtaacttctacccagccgcacagaatttacccgctaatacacaacaagctacctctggcaccctgtttacccagacaccatccggccaaagtagcgccacctacagtcagttcaatcagcaatctttgaactccaccgcgcctccacctccacctcccccaccaccatccagttcgtattaccagaatcaacagccatcggccaacttccagaattacaaccagctgaaagggtcactatcccagcaaacagtgtttactagcgggccaaaccaggccttgcctggtaccacaagtcagcaaactgtgccaggccaccatgtaacccccggacattttctgccttctcagaatcccaccatccatcatcaaacagctgccgctgtggtgccccctccccctccccctccacccgcacccggaccccatctggtgcagcagccaaattcccatcagcagcactcagtggcccatgtcgtgggcccagtgcacgccgtcacacccggtagccacattcactctcagaccgcgggacatcacctgcccccaccacccccaccacccggtccagctccgcaccatcacccaccaccacatccatccacaggtttgcaagggcttcaggcacagcaccagcacgttgtaaatagtgccccaccccctcctccacctccgccaccgtcgtctgtcctggcatctggccaccacacaacgtcggcccaggccctgcaccaccccccacaccagggacctcctctatttccatcaagcgcccacccaactgtgccaccgtatccatcccaggcaactcatcatactaccctggggccagggccacaacatcagcctagtggcacaggaccacactgtcctctgccagtcaccgggcctcatctgcagcctcagggcccaaattcaatcccgactcccaccgcatccggattctgcccccaccctggcagcgtggcactgcctcatggcgtccaggggcctcagcaagccagcccggtacccggacagatccccattcaccgagcccaggtgcctccgacctttcaaaataattatcacggcagcgggtggcacta

SEQ ID NO: 231454 - DNA, 5577 bp, Artificial Sequence
  Description of Artificial Sequence: Synthetic coding sequence
atgtctattgtgatccccctgggagtcgacaccgccgaaaccagttatctcgaaatggccgcaggaagtgaacccgagtctgtggaggctagccccgttgtggtggagaagtctaactcatacccgcatcagctgtatacttcttcaagccaccattcacactcctacatcggtcttccatatgccgatcacaattatggagccaggcccccacccaccccgcctgcttcgcctcccccatctgtcctgatctcaaagaacgaggtgggcatttttacaacacctaactttgacgaaacctcttccgcaaccacaatctctaccagcgaggacggctcctatggaactgatgttactcgatgtatctgcggattcacacatgatgacggctatatgatatgctgtgacaagtgttctgtgtggcagcatattgattgcatgggtattgatcggcagcatatacctgatacctatttatgcgagaggtgccagcctcgaaacctagataaggaacgcgcagtcctgctccagcggagaaaacgggagaacatgagcgatggggatacaagcgccacagagtccggcgatgaggtgcctgtggagctttacactgccttccagcatactcccactagcataacactgacagcctcccgtgtgtccaaggtcaacgataaaagaaggaaaaagtctggcgaaaaggagcagcatatcagtaagtgtaagaaggcatttagggagggctctaggaaatcctcgagagtcaaggggagcgccccagaaatcgacccatcttctgatggttctaattttggatgggaaacgaagattaaggcctggatggatcggtatgaagaggccaataataaccagtatagtgaaggtgtgcaacgtgaagcccagcgcatagcgctgaggctcggtaatggtaacgacaagaaagagatgaataagtccgatttgaacacgaacaatctcctgtttaaaccgccagtggaatctcatattcagaagaataagaaaatcttgaaaagtgcgaaagatctacctcccgacgcactgatcatagagtatcggggtaaatttatgctgagggagcagttcgaagccaatggatatttcttcaaaaggccttacccattcgtgctattttatagtaagttccacggactggaaatgtgtgtggacgctcgtacattcgggaatgaggcccgtttcatcagacgaagttgtacccccaacgcagaggtcagacatgagatccaggatggaactattcatttgtacatctattccatccattccataccaaagggaactgaaatcacaattgcgttcgacttcgattacggtaattgcaagtataaagtggattgtgcctgcctgaaggagaatcccgaatgtcccgtgctcaaacgctcttccgagtctatggaaaacataaacagtggctatgaaacacgccgaaagaagggtaagaaggataaagacataagcaaagagaaggatactcagaatcagaatattaccctcgactgtgaaggaactacaaataagatgaaatctcccgagacgaagcagagaaagctttcccccctgcgacttagtgtttctaataaccaggagccagatttcatcgatgacatcgaggagaaaaccccaatctcaaatgaggttgagatggagtccgaagagcagatcgctgagcgaaaaaggaaaatgacccgggaagaaaggaaaatggaagccatcttgcaagcgttcgcacgcttggagaaacgcgagaagcggagagagcaagcattggagcgcatcagcaccgctaagactgaggtgaagactgagtgcaaggacacccagatcgttagtgacgcggaggttatccaggaacaggcaaaggaggagaacgcctccaagccaactcctgccaaggtaaacaggaccaaacagagaaagagtttctccaggagcagaacccatatcggtcaacagagacggaggcacaggaccgtctccatgtgttcggacatccagccaagctcgcctgacattgaggtgacctcccagcagaacgacattgaaaataccgtcctgactattgaacctgaaaccgaaacagctctcgcagaaatcattacagaaacagaggttccagcattgaataaatgccccaccaagtatcctaaaactaagaaacacctagtaaacgaatggttgtccgagaaaaacgagaagaccgggaagccgagcgatgggctgtccgagaggcctcttcggattaccactgacccagaggtcctggccacccagctcaactctctccccggtctaacttactcaccacacgtatactctactccaaagcattacataaggtttacgtcacccttcctttccgaaaaaagaaggagaaaggagccaactgagaatattagtggttcttgtaaaaagagatggcttaaacaagcccttgaagaagagaactccgctatcctgcacaggttcaactctccttgccaggagcgctctcgatcccccgcagtgaacggtgagaacaagtccccactcctgctcaacgatagttgcagtttgccggacctaaccacaccgctgaagaaacgcaggttctaccagctcctcgattctgtctactctgagactagtacacctaccccttctccctatgctactcccactcacacggatatcacccctatggaccctagttttgctaccccgcctagaattaagagcgacgacgaaacttgtaggaatggatacaaacccatttacagccctgtgacccccgtgactcctggaacacccggaaacacaatgcacttcgagaacatttcttcccctgaatcctcccccgagatcaagaggcgaacgtacagccaggagggctatgacagaagttcaaccatgctcactctaggtcccttccggaatagtaatttgaccgagctggggctgcaggagattaagaccattggttataccagtccaaggagccggaccgaagtgaaccggcagtgccccggagagaaagagcctgttagtgacctgcagctgggactcgatgcagtggaacctacggcgctgcacaaaacgctcgagacacccgcacacgaccgggcagagccaaactcgcaactggactctacgcactcaggaagaggaacaatgtactcttcttgggtgaagtcaccagatcgcacaggagtgaattttagcgtgaactccaacctacgagacctgacgccatctcaccaactcgaggtgggaggtggcttccgtatttccgagagtaaatgtctgatgcaggacgacacaaggggaatgtttatggaaaccacagtgttctgtacaagtgaagatggcctggtgtccggattcggacgcaccgtgaacgacaacctgatcgacggaaactgcactccgcaaaacccaccccagaaaaagaaagtgtccttgctagagtaccgaaaaaggcagcgcgaggcaaggaagagtggctctaaaactgagaattttccgctgattagcgtgtcccctcatgcttccggcagcctgagtaacaacggagacggctgtgccagtagcaacgataatggagagcaagtagaccacaccgccagcctgccgctgcccaccccagccaccgtgtacaatgccacgtcggaggagacctccaacaactgtcccgttaaggacgccaccgcttccgagaagaatgagcccgaagtgcagtggacggcatccacatcagtcgaacaagtgcgtgaaaggagctaccagcgggctctgctgctgtctgatcaccgaaaagacaaagacagcggcggtgaaagcccctgcgtgtcctgcagtccctctcacgtgcagtcctcgccaagctcacattccaatcatatccctcagctgcaggcaaaggggcctgtgccatctttctcagaactgatggaggatcctgatcccgaaaatccagagccaactaccactaacgagtgcccgtcccccgatacatctcagaatacttgtaagtctcctccgaaaatgtcgaagccaggaagcccaggcagcgtcattccagcccaggctcatggcaaaatctttactaagcccgatccacagtgggacagcactgtctccgctagtgaagcggagaacggcgtgcacctgaagactgaactgcagcagaaacagctgagcaacaacaaccaggcgctcagcaagaatcacccgccacagacacacgtgagaaattccagcgagcaactgtcacagaagctgccgagcgtgcccacaaagcttcattgccctccttccccacacctggaaaatccgcctaagtccagcacccctcacaccccagtccaacatggttacctttcccccaaacctccctcacaacagctgggctctccgtatcggcctcaccattcccaaagcccgcaagtcggcaccccccaacgcgagccacagcggaacttctaccctgccgctcaaaatctaccggctaatactcagcaggctacgagtggaactctcttcacccagactccgagcggacagtcttcagctacatattcccagttcaaccagcagtcccttaacagcaccgcccctcctccacccccacctcccccaccatcttcctcctactatcaaaaccaacagccatcagccaacttccagaattacaatcaacttaaaggaagtctcagccagcagacagtgtttacttctggccctaatcaggccttgccgggaaccacaagtcagcagacagtccctggacatcatgtcactcctggacactttctacctagccaaaaccccacgattcaccaccagacagccgctgcagtggttcctccgcctccaccaccccctccggctcccggaccccatttggtacagcaaccaaactcacaccaacagcattctgtcgcccatgttgttggaccggtgcatgcggttacacccggttcccacatccactctcagaccgccggtcaccatctgccacctccacctcctccgccaggccctgccccacatcaccacccccctccacatccatccaccggtctccagggcctacaggctcagcatcagcatgtggtgaacagcgcccctcctccaccccctccaccacccccatcaagtgtgctggcttctgggcaccacactacttctgcgcaagcattgcatcatccacctcatcagggtcccccacttttccccagttctgcccacccaaccgttcctccttacccaagtcaagcaacccaccatacaaccctgggcccaggcccacagcaccagccaagcggcaccgggccacattgtcctctcccggtgaccggcccacacctgcaaccacagggtcctaactctatcccgaccccaacagcttctggattctgcccccaccccggatccgtggcgttaccacatggggtacaagggcctcaacaggcttcaccagtgccaggccagatccccattcaccgggcacaagtccccccaacattccaaaacaattaccatggtagcggatggcattat

SEQ ID NO: 231455 - DNA, 5450 bp, Artificial Sequence
  Description of Artificial Sequence: Synthetic coding sequence
atgagtatcgttattcctcttggcgtcgacacagcggagacaagctatctagaaatggctgccggaagcgagcccgaaagcgtggaggcatcaccagtcgtggtagaaaagtctaacagttaccctcatcagttgtatacctcctcctcacaccactcgcactcatacatcggcctgccctatgccgatcataactacggggcaaggccccctccaactccacccgcttctccccctcctagtgtactgatctcaaaaaacgaggtgggaatctttactacccccaacttcgatgaaacaagttccgctaccacgatatcgacttctgaggacggctcgtacgggactgacgtcacaaggtgtatctgcgggttcactcatgacgatggttatatgatttgctgcgataagtgcagcgtgtggcagcacatcgattgcatggggattgatcggcaacacattcccgacacctatctgtgcgagagatgccagcccagaaacctcgacaaggagcgcgctgtgctcctgcagcgacgaaagcgcgaaaatatgtccgacggggatacaagcgctaccgagagcggcgacgaggtcccagtggagctgtatactgccttccaacacacgcccaccagtatcaccttgaccgcgtcccgtgtgtctaaagtgaatgacaaacgcagaaagaagtcgggagaaaaagaacaacatatcagcaagtgcaaaaaagccttccgggaaggctctcgaaaaagctcgcgtgtgaagggctcagcccctgagatagatccgagctccgatgggagtaactttggatgggaaactaaaattaaggcatggatggatcgctacgaggaagcaaacaacaatcagtactcggagggggtgcaacgcgaagcgcagcgcattgctctgcgactcggaaacgggaatgacaaaaaagagatgaacaagagcgatctgaacacaaacaacctgctcttcaagcccccagtggagagtcacatccagaagaacaagaagatcctcaagagtgctaaagatttgcctcctgatgctctcatcattgaatatcggggtaagtttatgctgagagagcagttcgaggctaacggatactttttcaagagaccctatccgtttgtcttattctattctaagttccacggactagagatgtgcgtggatgccagaacattcggaaatgaagccagatttattagacgcagctgtacgcccaatgcagaagtgcggcatgaaatccaagatgggaccatccacctctatatctattccatccattcgattccaaaagggacagagattaccattgcattcgattttgattatggcaactgcaagtacaaggtcgattgtgcttgcctaaaagagaaccccgaatgcccagtgcttaaaaggtcgagtgagtccatggagaacattaacagcggatacgaaacgagaaggaagaaaggcaaaaaagacaaagatatctctaaagagaaggacacccagaatcagaacatcacactcgattgcgagggaaccactaataaaatgaagagccccgagactaaacagaggaagctctcccctctgcgcctgtcagtgagcaacaaccaagaacctgattttatcgacgacattgaggaaaaaaccccgatctccaacgaggtcgaaatggagtcagaagagcagatcgccgagcgcaaaagaaaaatgacacgagaggagagaaagatggaggcaattctacaggcctttgcaagattagagaaacgggagaaacgcagagagcaagctctggaacgaatctctacagcaaaaacagaggtcaaaaccgagtgtaaggacacccagatcgtgtccgacgccgaagtgattcaggagcaggcgaaggaggagaacgcctctaaacctaccccagcgaaagtaaaccgcacaaagcagagaaagagtttcagccgcagtaggactcacatcggtcagcagcgtaggcgccatagaacggtttctatgtgttccgacattcagccatcgagccctgatattgaggtaacttctcaacagaacgacattgaaaacactgtcctgaccattgagcccgagaccgaaaccgcacttgccgagatcatcacagaaactgaagtgccggcattgaacaaatgccccactaaatatccaaagactaagaaacacttggtcaacgaatggctgtcagaaaaaaatgaaaagacagggaaaccctccgatggcctcagtgaaagacccctacgaataaccaccgacccagaggtgctggccacgcaactgaattcacttcctggcttaacctactctcctcatgtttattcgacccccaagcattatatacgatttaccagcccctttctctctgaaaagcgacggaggaaagagcctaccgaaaacatctcaggctcatgtaaaaagagatggttgaaacaggcactcgaggaagagaatagtgcaattctgcacagatttaattcgccttgccaggaacgcagtaggtcccccgcagttaatggggaaaataagagtcccctgctgctgaacgattcttgctcccttcctgacctgactaccccgttaaagaaaaggcggttctaccagctgctggattcggtgtacagtgaaacttcgacccctaccccatcaccctatgcaactccaacccataccgatatcacgccaatggacccatcctttgcaactcccccacggataaagtccgacgatgaaacctgtagaaacggttataaacctatctattccccagtgaccccagtaacccctggcacgcctggtaatacgatgcatttcgaaaacatttcctcccctgagtcaagtcctgagattaagaggcgtacttactcccaggaaggatatgaccgtagctccactatgctcactctcggtccgtttaggaacagtaatctgacggaattggggctgcaggaaatcaagaccatcggctatacttctcctcgaagtcgtacggaagttaaccggcagtgccctggagagaaggaaccagtatcagacctgcagctgggtctggacgctgtggagccgacggccctgcataagaccctagaaacgccagcacatgaccgggctgagccaaatagtcagctagattcaactcacagcggcaggggcaccatgtatagcagctgggttaagagcccagatagaaccggcgtgaatttcagcgttaacagtaatctcagggacctgacaccctcccaccagctcgaggtaggcggaggtttcaggatttctgaatccaagtgcctgatgcaggacgatacacgcggaatgtttatggagacaactgttttttgcacctcagaggacggactggtatcagggttcggtagaactgtgaatgacaatctaatcgacggtaactgtaccccccagaatccgccacaaaagaagaaggtgtcccttctcgagtataggaaaaggcagcgggaagcaaggaagtctggcagcaaaacagaaaatttccccctgatttccgtctcccctcacgcctccggcagcctgtcaaataatggagacggctgcgccagctccaatgacaacggagagcaggtggatcacacggcaagcctccccttgcccactcctgctaccgtgtataatgccacctctgaggagacctctaataactgtcctgtcaaggatgcaaccgccagcgaaaagaacgagcctgaggtgcagtggacagcctcaacctcagtggagcaagtgcgggaacgcagttatcaaagagccctcctgctgagtgaccatcgtaaggacaaagattccgaccctgaccccgagaacccagagcctacgacaaccaatgagtgcccatcccccgacactagccaaaatacatgtaaatctccaccgaagatgtcgaagcccggaagtcccggttcagtgatacccgctcaggcccatggaaagatattcacaaagccagatccacagtgggactctaccgtctccgcaagcgaagcagaaaatggcgttcacctgaagactgagctgcagcaaaaacaactgtccaacaataaccaggctcttagcaagaaccacccccctcagacgcacgtacggaattcttctgaacagctctcccagaagctgccttctgtccccaccaaattgcactgtcctccctctccgcatttggagaaccccccaaaaagttctacacctcacacaccggtgcagcacggctacctgagtcccaagcctccatcccagcagctcggaagcccttacaggcctcaccacagccagtctccccaggtaggaacccctcagagggaaccccagcggaacttctaccccgcagctcagaatctccccgctaatacccaacaggctacctccggaacacttttcacccaaaccccatccgggcagtcatctgccacttattctcagttcaaccagcagagtttaaatagcactgcgcctccccctcccccaccccctcccccatctagctcctattatcagaaccagcaaccctccgccaatttccagaactacaaccaactgaaaggctctctctcacagcagaccgtatttacgtccggacccaaccaagctttacccggtaccaccagccagcaaaccgtacccggacaccacgtgaccccagggcacttcttacctagtcagaatccaactattcaccaccagaccgctgctgctgtcgtgccccctccgccacccccaccacctgccccaggcccacacttagtccagcagcccaactcccaccagcaacactctgtggctcacgtggtcggcccagtccatgcggtgaccccgggatctcacattcactcccagaccgccggacatcacctgcctccacctccaccaccaccgggacccgctcctcaccaccatcccccaccacacccctctacaggcctgcagggattgcaggcccagcaccagcatgtggtcaattcagcccctcctccccctcctcccccacctccaagctctgttcttgcctccggtcaccatactactagcgcccaagcgctccaccatcccccacaccagggtccgcctttgtttccttccagcgcacatcccacggtgcccccttacccaagccaggcaacacaccatacgaccttgggtcctggtccacaacatcagcctagtggcacaggaccccactgcccactgcccgtgacgggcccacatctccagccacaggggccaaactctatccccacacccactgcctctggattctgtcctcatcccggatccgtggccctgcctcatggcgtacagggcccacaacaagcctcgcctgtgcctggtcagattccaattcatcgcgcacaggtaccacccacatttcagaataattaccacggctctggctggcacta

SEQ ID NO: 231456 - DNA, 1770 bp, Artificial Sequence
  Description of Artificial Sequence: Synthetic coding sequence
atgcacttcgaaaacatcagttctcctgagtctagcccagagatcaagagaagaacatactcccaagagggctatgatagatctagcactatgctcacactgggcccatttcgcaatagtaatcttaccgaactgggcctgcaggagattaagaccatcggatacacaagccccagaagtagaacagaggtgaataggcagtgtcccggagaaaaagagcctgtcagcgacttacagttgggtctagacgcagtggaacctaccgccttacataaaactctggaaaccccagcgcacgatcgtgcggaacccaactcccagctcgattccacacacagcggcagaggaacgatgtacagttcctgggtgaaatcacccgaccgcaccggcgtgaacttctccgtgaacagcaacctccgggacctgacccctagtcatcagctggaagtgggcggaggcttccggattagcgagagcaagtgtctgatgcaggatgatacacggggaatgtttatggagactaccgtgttttgtacctccgaggacggacttgtgtcaggctttggtcggaccgtgaacgacaaccttatcgacggaaattgcaccccccaaaatccaccacagaagaaaaaagtgagtctcctggaataccgaaagcgccagagggaagctagaaaatcaggctctaaaacagagaacttccccctgatcagcgtgtctccgcatgcctctgggtcattgagcaataatggtgacgggtgtgctagcagcaacgacaacggagagcaggtggaccacactgcaagtctgccacttcctacaccggctactgtctacaacgccacaagcgaagaaaccagtaataattgcccagtgaaagatgcgacagcctcagaaaaaaacgaacctgaagtgcaatggacagcttccaccagcgttgagcaggttcgggagcggagttatcagagggcgctcctactgagcgatcaccgtaaggataaggactcaggcggtgaatcaccgtgcgtgtcttgctccccctcacatgtccaatctagcccttcctcacactcaaaccatattccacagctgcaagccaaaggccctgtgcccagctttagcgaactcatggaagatcccgatccagagaaccctgaacccactaccactaacgagtgcccgtctcctgacacatcgcagaacacctgtaaatctccacctaaaatgtccaagcccggttccccgggatcagtgattcccgctcaggcccacggcaagattttcacaaaaccagacccacagtgggattcaaccgtttcggcctctgaagcggaaaatggggttcacctcaaaactgagttacaacagaagcaactgtccaataacaatcaggctctgagtaaaaaccatccacctcaaacccacgtcaggaactcctccgagcaattaagccagaagctcccttccgtgccaacgaaacttcactgcccccctagtcctcatctggaaaaccctcccaagagctcaaccccccatactccggtgcaacatgggtatctgagccccaagcctcccagtcaacagcttggctccccttaccggcctcaccattcccaaagcccgcaggtgggtacacctcaaagagagccccagagaaatttttatcctgctgcccagaacctccccgctaacacccagcaggctaccagtggcacgctctttacccaaacgcctagcggccagagctccgcaacttacacacagagatag

SEQ ID NO: 231457 - DNA, 5336 bp, Artificial Sequence
  Description of Artificial Sequence: Synthetic coding sequence
atgagcatagtgattcccctgggcgtcgacactgcagagacaagctacctggaaatggccgctggaagcgaacccgagagcgtggaggcttcccctgtagtcgtcgaaaagtctaatagctatccgcaccaattgtacacgtcaagcagtcaccactcacactcttatatcggattaccttatgctgatcacaactacggcgcacgcccacccccaaccccccctgcatcccctccgccatcggtgctcatatctaagaatgaggtcgggatttttactactcctaacttcgacgaaacgagttccgcaacaactattagtacaagcgaagacggctcctatgggactgacgtgacacgatgcatctgcggcttcacccacgacgacggctacatgatatgttgcgacaaatgtagtgtgtggcagcacatcgattgtatgggcattgatcgccaacatatccctgatacctatctatgtgaacgatgtcaacccagaaacctggataaggaaagggcggttctccttcagcggagaaaacgagagaacatgtccgacggcgacacttcagctaccgaatcaggtgatgaggtccctgtagagttatatacagcatttcagcacacccctactagcattacgctgaccgcgtcacgcgtgtccaaagtcaacgacaagagaaggaaaaaaagcggtgagaaagagcaacacatttcaaagtgtaagaaagccttccgggaaggtagtcgaaaatctagtcgcgtcaaaggatctgctcctgaaattgaccccagcagcgatggaagcaacttcggatgggagaccaaaattaaggcgtggatggacagatacgaggaggctaataacaaccagtacagtgaaggagttcagagggaggctcagcggatcgcgctgcgcctgggtaacgggaacgataaaaaagaaatgaacaaatcagatttgaacaccaacaatctgctgtttaagccgccagtagagtcacacatacagaaaaataagaaaatattaaagagcgccaaggacctccctccagacgccctgataatcgaataccggggaaagtttatgcttcgtgaacagttcgaggcgaatggctactttttcaaaaggccatacccctttgtactgttttactcgaagttccacggcctcgaaatgtgcgtggatgctagaactttcggaaacgaggcgcgatttattcggcgtagttgtaccccaaacgctgaggtccgacacgaaatacaggacggtacgattcacctctatatatattcaatccatagtatccctaagggcaccgagataacgatcgcattcgacttcgactacggcaattgcaaatataaggttgactgtgcatgcttgaaggaaaaccctgaatgtcccgtcctgaaacgttctagcgaatcaatggagaacatcaactccggatacgagaccaggcgaaagaagggcaaaaagacacgggaagagaggaagatggaagcaattctgcaggcctttgcaaggctagaaaaaagagaaaagagaagagaacaggcccttgaaagaatctcaaccgcaaagacggaggtgaagaccgagtgtaaagacacccaaatcgtcagcgatgccgaagtcatccaggagcaagctaaggaagagaacgcgagcaagcccactcctgccaaagtgaaccgtacaaagcagagaaagagcttttctagaagtcgaacacatatcgggcagcagagacgccgtcatagaacagtgtcaatgtgctctgacatacagccaagctcacccgacatagaggtaacttcacagcagaatgacatagagaatactgtgcttacgattgagccagagactgaaacagcactggcggagataattactgagaccgaggtgcctgcattgaacaagtgtcccaccaagtaccctaaaactaagaaacacctggtgaacgaatggctgagcgagaaaaatgagaaaaccgggaagccgtcagatggcctcagcgagaggcctcttcgcattaccactgatcccgaagtgcttgccacccaattgaattctcttcccggtctcacttacagcccccacgtgtactccacccccaaacattatattagatttacttctccctttctcagcgagaagaggagacgcaaagagcccactgagaatatcagcggaagctgtaaaaaacggtggttgaagcaggctctggaggaagagaattccgcaattcttcaccggtttaattcaccctgtcaggagcggagtcgtagcccagccgtgaatggagaaaacaagagccctctcttgcttaatgactcgtgctcgctgccagacctaaccacaccactcaaaaagagacggttctaccagctgttggatagtgtgtactctgaaacaagtaccccaaccccctccccttacgccacacctacccataccgatatcaccccaatggatccaagcttcgccactccgcctcggatcaaatccgacgatgagacctgccgtaatgggtacaagccaatttatagtcccgtgacaccagtcactccgggaaccccgggaaatactatgcacttcgagaacataagctcaccagagagttcaccagaaatcaaaagacgcacatattctcaagagggctacgatagatcctcaacgatgctgacactggggcctttcaggaacagcaatttaaccgagctgggtttgcaggagattaagactattggttatactagcccccgatcgcggacagaggtgaatcgtcaatgccccggagaaaaggaacccgtgagcgacctgcagttaggactggacgccgtcgagcctaccgcccttcacaaaacgcttgaaactcccgctcatgacagggctgaacctaactcccagctggacagcacacactccgggaggggtacaatgtactcctcctgggtaaaatcccctgacagaactggagtgaatttctccgtgaactccaacttacgcgacctgacccctagtcatcagctggaggttggtgggggatttcggattagcgaaagcaagtgtctgatgcaggatgatactaggggtatgttcatggagacaactgtgttttgcacatctgaggatggattggttagcggcttcgggcgaaccgtgaatgataaccttatagacggaaactgcacaccacagaatcccccacagaagaagaaggtaagcctcctagagtatcgtaaacggcaacgggaggctcggaaaagtggatctaagactgaaaacttccctctgattagcgtgagcccccacgccagcggctccctttctaacaatggtgatggctgcgccagctcaaatgacaacggtgaacaggtggatcatacagcttcactcccactcccaactccagcgactgtttacaacgcaaccagcgaggagacaagtaacaactgccctgtgaaagatgcaaccgctagcgaaaaaaacgaaccagaggttcagtggaccgcctccactagcgtagaacaggtccgcgaacgttcttaccagagagccctgctgttatcggatcaccggaaagacaaggactccggcggagagtcaccttgtgtgagttgcagcccaagtcacgttcagtcatctccttcctcacactctaatcatatcccccagctccaagcgaagggccctgtgcccagcttctcagaattaatggaggaccccgaccccgagaaccctgaacccacaaccaccaacgaatgtccctcgcccgacacaagccagaacacatgcaaaagccctcccaagatgtctaaaccaggctctcccggtagcgtgatcccagcccaggctcacggtaaaatctttaccaagcccgatcctcagtgggactctaccgtttccgcctccgaggccgagaatggggtgcatctgaaaaccgagctgcagcagaagcagctcagcaacaacaaccaggccctgtctaagaatcatcctccacagacccacgtgaggaacagcagcgaacagctgtcccagaagctccctagtgttccaacaaaactgcattgtccaccgagtccccacttagaaaaccctccgaagagcagtaccccccacacccctgtgcagcacggctacctgagcccaaagcctccctcgcagcaactaggaagcccctatagacctcaccactcccagtccccccaggtcgggacaccccaaagggaacctcaacgaaacttttaccccgctgcacagaatttgccagcgaatacccagcaagctacctctggtacgctctttacacaaacgccctcgggacagtcatctgccacttactctcaattcaaccagcagtccctgaattctacggctcctccgcctcctccaccacctccacccagctcatcatattaccagaatcaacagccaagtgcaaatttccaaaattataatcagttaaaagggtccctgtcccagcagaccgtgttcacaagtggcccaaaccaggcactgcccggtacaacatcccagcaaaccgtcccaggacaccacgtaaccccgggtcattttctgccgtcacagaaccctaccatccatcaccagactgctgcagctgtcgtgcccccacctccccctcctcccccagctcccggtccacacctcgtccagcagcccaattcacaccagcagcacagtgtggcgcatgtggtggggccagtgcatgcagtgacacctggctctcacatacattcccaaacggccggacaccatctccctcccccaccaccccctcccggtccagcgccacaccaccacccccctccgcatccatccactggccttcagggcctgcaggcccagcatcagcacgtggtgaactccgccccaccacctcccccaccacccccaccctcctccgtgttggcctcagggcaccacaccacttcagcacaggctctacaccacccacctcaccaagggccaccattattccccagttcggcacaccctaccgtccctccttacccaagccaagccactcaccacacaactctggggccaggtccccaacaccagccttccggaacgggaccccactgtcccttacccgtaaccggacctcatttacaaccgcaaggaccaaacagtatcccgacgcctactgccagtggattttgcccccaccccggtagtgtggcccttcctcatggagttcagggcccacagcaggccagcccggttccgggtcaaatccctattcatcgtgcacaggtgccccctacctttcagaataactatcacggcagcggctggcacta

SEQ ID NO: 231458 - DNA, 4962 bp, Artificial Sequence
  Description of Artificial Sequence: Synthetic coding sequence
atgtctatcgtgatcccccttggcgtcgatacagcagaaacaagctacttggagatggcagcaggaagtgagcccgaatccgtcgaagcgagccctgtcgttgtggagaaatctaatagctatccacaccagttgtacacaagctctagccaccactcccattcttacattggactgccctacgcggaccataattatggagccaggcccccacctacacctcctgcttcccctccccctagcgtcctgatttccaaaaacgaagtggggatattcactacacccaatttcgacgagacctctagcgccaccacaattagcacaagcgaggacggctcttatggcacagatgttaccaggtgcatttgcggattcacccatgatgacggttatatgatctgttgtgataagtgtagcgtttggcagcatatagattgtatgggcatcgatcggcagcatatacccgacacatacttatgtgaaaggtgtcagcccagaaatttagataaggaaagggccgttctgttgcaaagacggaagcgtgagaacatgtccgacggcgacacttctgccacggagtctggtgatgaagtgccggtggagctgtatactgcttttcaacacacaccaacgtccattaccctgacagcgtcccgggtaagcaaagtgaacgacaaacgtcggaagaagagtggcgagaaagagcagcacatttcaaagtgcaaaaaggccttcagagaaggaagcagaaaaagctcaagagtcaagggctccgctcccgagattgaccctagctccgatggatctaattttggatgggaaacaaagatcaaggcttggatggatcggtacgaggaagctaacaacaaccagtacagcgaaggggtgcaaagggaggctcaaagaatcgcgcttaggcttgggaatggaaacgataagaaggagatgaacaagtctgatctcaacactaataatcttcttttcaagccaccagtggagtcacatatccagaaaaataaaaagattttaaaaagtgccaaggacctgccccctgatgctcttattatcgagtataggggaaagttcatgctcagagagcagttcgaagctaatggatacttcttcaagaggccttacccctttgtgctgttctattccaagttccatggactcgaaatgtgtgtggacgcccgtacatttggcaacgaggccagattcataagacggagttgcacaccgaacgcagaggttagacacgaaatccaggacggaaccattcacttgtatatatactccatccatagtattccaaagggaacagaaatcacgatcgcatttgacttcgattacggcaactgtaagtacaaggttgattgcgcatgtctcaaagagaatcccgagtgccctgttcttaaacggtcttctgaatccatggagaatataaattccggatacgaaactcgccgtaagaagggcaagaaggataaggatatatccaaagagaaagatacccaaaaccaaaacatcacactggattgtgagggcacaacgaacaaaatgaaaagtccagagactaagcagagaaagctttctccactccggctttcagtttccaacaaccaggaaccggatttcattgatgacatcgaggaaaaaaccccaattagcaacgaggtcgagatggagtcagaggagcagattgcagaacgtaaacggaagatgaccagggaggaaagaaaaatggaggctatactgcaagcttttgccaggcttgaaaaaagagagaaaaggagagagcaggcgctggaaagaatttctacggctaagactgaggtcaagaccgagtgtaaagatactcaaatcgtgtctgacgcagaagtcatacaagaacaggcaaaagaagagaatgcgtctaaaccaactcccgctaaagtgaatcgtactaagcagagaaagtcattcagtcggtctaggacgcacatcggacagcagagaagacggcatcggactgtgtctatgtgttctgatatccaaccaagctccccagacattgaagtaacaagccagcaaaacgacattgaaaacactgtgctcactatcgagcccgagaccgagactgcccttgcggagattataaccgagaccgaagttcccgcattaaataagtgcccaacaaagtatcctaagaccaaaaaacatctggtaaatgagtggttgtccgagaagaacgagaagacggggaagccttcagacggcttatctgagcggccactcagaataaccactgatccagaggtccttgccacccagctgaactcgttgcccggtctgacttactccccacacgtctactcaaccccaaaacactacattcgttttacctctccctttctgtccgaaaaacgaagacgtaaggaaccgacagaaaacatctcaggctcttgtaagaagcgatggctgaaacaggcactggaggaggaaaactccgccatccttcatagatttaatagtccttgtcaggagcgctctagatctccagcagttaacggcgaaaacaagtcccctcttttgctgaacgactcctgctcgctgcccgatctcaccacacccctgaagaagcggcgtttctaccaactcctcgatagcgtgtatagcgagacatccacaccgacgccctccccctacgcgacgcccacacacacggacattactccaatggatcctagtttcgcaaccccaccgaggattaagtccgacgatgagacatgcaggaacgggtacaagcccatctattctcctgtgactcccgtcacgcccggaacccccggtaataccatgcacttcgagaacatttctagtcctgagtctagcccagaaataaagcgcaggacctactcccaggagggctacgatcggagttctacaatgctaaccttgggtccattcagaaattccaatctgaccgaactcggactccaggaaatcaagaccattggatacacaagcccaagaagtaggacggaggtgaacagacaatgccctggggagaaggaacctgtctcagacctgcagcttgggctggatgctgtagagcccaccgccctgcataaaacgttggagaccccggctcatgatcgggctgagcccaacagccaactggacagtacacactccggacgcggaaccatgtactcctcctgggttaagtctccggatcgaaccggcgtgaatttcagtgtcaacagcaacttgagagacttaaccccctcccaccaacttgaagtgggtggcggttttcggatcagtgagagtaagtgtttgatgcaggacgacacccgaggtatgtttatggagaccaccgtgttctgcacgagtgaggacggcctagtgtcaggctttggacgcacggtgaatgacaacttaattgacgggaactgcactcctcagaacccacctcagaagaaaaaggtgtccctcctggaatacagaaaacggcaacgcgaggcgaggaaatctggatccaaaactgagaactttcccttgatcagcgtcagcccacacgcttccggaagtctttccaacaatggtgacggttgtgccagcagtaatgataatggggaacaggtcgatcacacagctagcctgccactcccgacacccgctacagtttacaacgccacctctgaagagacaagcaataattgccccgttaaggacgcaacagctagtgagaagaatgaacccgaggtccagtggactgcctccacctctgtggagcaagtgagggagaggtcctatcaacgcgctctccttcttagcgaccatcggaaggataaagactctgggggtgaatccccatgtgtctcatgcagccccagccacgtgcagtcttctccatcctcccactccaaccatatcccccaacttcaagccaaaggccctgtcccatcgttcagcgagctgatggaggatccggatccggagaatcccgaacctacaactactaatgaatgtcccagcccggacacatcccagaacacgtgtaagtcgccccctaaaatgagtaagcctggctctcccggtagcgtaatccctgctcaagcacatgggaagatctttacaaagcctgatccccaatgggactctaccgtgagcgcctctgaagccgagaatggtgtgcacctgaaaacagaacttcagcagaagcagctgtctaacaataaccaggccctgtcaaagaaccaccctccacagacgcatgtgaggaacagtagcgagcagctgtctcagaagcttccctcagtgcccaccaaactccactgtcctccctcccctcacctggagaacccaccaaaatctagtaccccacatacccctgtgcaacacggctatttgtctcccaagcctccctctcagcaactcgggtctccctatagaccccatcattcccagtcaccccaggtgggaacccctcaaagggagccccagcggaatttttatcctgcagcacagaatctgccagtcttctggttgctaggtattatcccacatcagctgaagccatataccacacatctcatcaaagacttacatttctttctaagggtactgatacagctgtaccataggattcctcacaaactccacataatccccctctgggaccgagacccttcaacttctctcctggagcagggtcatattgtacactacttgagccaggtgcttatctcatctcctaaggatcaaaccgtcttccagcatctcctccttcaagggagcgtactgattctggcattatggccgtgtcacatgggatttaaagatctgtcccggcatctccagtgcctcgaccgcttccaattcaccgaacacagatgccaccagcacttcaaaactatcactatggggcaaggcggtataaaaatggactcaaagaacattttcctgaacgtcctctag

SEQ ID NO: 231459 - DNA, 378 bp, Artificial Sequence
  Description of Artificial Sequence: Synthetic coding sequence
tagggcagcttgtccaataatggcgacgggtgcgcatcatccaatgacaacggcgagcaggtggaccacaccgcatcgctccctttgcccactcctgccaccgtgtataacgccacatccgaggagaccagtaacaactgtcctgtgaaagatgccactgcatcagagaaaaacgaacccgaggtgcagtggactgctagtactagtgttgagcaggtccgggagcggtcttaccagcgcgcattgctcctctccgatcaccgcaaggacaaggacagcgatcctgacccggagaatccagagcccacaaccacaaatgagtgcccatcgccggacaccagtcagaacacttgtaagagccctcccaaaatgtcttag

SEQ ID NO: 231460 - DNA, 216 bp, Artificial Sequence
  Description of Artificial Sequence: Synthetic coding sequence
atgagcatcgtgattcctcttggtgtcgataccgcagagacctcttacctggaaatggccgctggcagcgagccagaatccgtagaggcttctcccgtggttgtcgagaagtccaatagctacccccaccagctatacacatccagttcacaccacagccattcttacattggcttaccatatgccgatcacaattacggcgcacgacctccatag

SEQ ID NO: 231461 - DNA, 1830 bp, Artificial Sequence
  Description of Artificial Sequence: Synthetic coding sequence
atgagcattgtgattcccctgggggtagacacggctgagacatcatacctggagatggctgcaggcagcgagccagaatctgtggaggcgagccctgtggtggtagaaaaatctaactcctaccctcatcaactgtacacctcaagttcccatcactcgcatagttacatcggacttccttacgccgatcacaactacggagccagaccaccccctacccctcccgcatcccccccaccctccgttttgatttccaaaaacgaagtgggtatcttcacaactcctaactttgacgagacatccagcgcaaccactatttccacctcagaagatggttcttatggaaccgatgtgacccggtgcatttgtggatttactcacgatgatgggtacatgatctgctgcgacaagtgcagcgtctggcaacacatagactgcatggggatcgacaggcagcacatccccgacacatatttgtgtgaacgatgccaaccccgtaacctggataaagaaagagccgtactgctccaaaggagaaagcgggagaatatgagcgacggtgacacctctgcgactgaatctggagacgaggtccctgtggagttgtacaccgcttttcagcatacccccactagcataactttgacagctagcagagtgtccaaggttaatgacaagcggaggaaaaaaagtggcgagaaggagcagcatatttccaagtgcaaaaaggcgttccgggaggggtctcgaaaatctagccgcgtgaaagggtccgccccagaaatagacccgagctcggacggatccaacttcgggtgggagacaaaaattaaagcctggatggataggtatgaggaagctaacaacaaccaatattccgaaggagtacaaagagaggctcagaggatcgcgctgagactcggcaacggtaacgataagaaggaaatgaataagtctgatctgaatactaacaatctgctgttcaaaccaccagttgagtcccacattcaaaaaaataagaaaatcctcaaatctgcgaaagacctgccacctgacgccctaataatcgagtataggggtaaattcatgcttcgtgagcagttcgaagctaacggttacttcttcaagcgaccctacccattcgtgctgttttacagtaagtttcacggcctcgagatgtgcgtagatgctagaacatttggaaatgaggcgcgatttattagacgcagctgtacacctaatgccgaggtgaggcatgaaatccaagatgggaccattcatctctacatctactccatccacagtattcccaagggcaccgagatcacaatagcttttgattttgactatgggaactgcaagtacaaggtagactgcgcctgtctgaaggagaatccagagtgcccagtgctgaagcgcagtagcgagagcatggaaaatatcaactccggctatgaaactagaaggaagaagggtaaaaaagacaaggacatcagcaaggagaaggacactcaaaaccagaatatcactctagattgcgaagggaccactaataagatgaagtcgcccgagacaaagcagaggaagctgagtcccctgagattatcagtgagtaacaaccaggaacctgatttcatcgacgatatagaagagaagacccccattagcaatgaggttgaaatggagagcgaggagcagattgcagagcggaaacggaagatggtaagctgggaagcttcaagtcttggactggtcacagcagccctgcatatggtgatcgttgccgctttcacctgggcttttacactcttcttcgaggtttctgaatag

SEQ ID NO: 231462 - DNA, 693 bp, Artificial Sequence
  Description of Artificial Sequence: Synthetic coding sequence
atgagtattgtgatcccattgggggttgacaccgccgagacatcttatctggaaatggccgcagggtctgaacccgagtctgtggaagcctccccggtggtggtggagaagtctaatagttacccacaccagctctacacttccagcagtcaccattctcattcctatatcggactgccctatgctgaccacaactatggcgcacgcccacccccaacccctccagcctctcctccgccaagtgttttgatctcaaagaatgaagttggcattttcactactcctaacttcgacgagacctccagtgctaccactatttccacctccgaagacgggtcttatggaactgatgttacccgctgtatctgcggcttcacacacgacgatgggtacatgatctgctgtgacaaatgctctgtgtggcagcacattgattgcatgggcatcgataggcagcacatccctgatacctatctatgtgaacggtgccagcctcggaatctggataaggagcgggctgttctgctgcagcgcagaaaaagggaaaacatgtctgacggcgacacttctgccacagagtctggggatgaggtccccgtggagctgtacacggcttttcagcatactcctaccagtatcaccttgaccgcctcccgagtgtcaaaagtaaacgacaaacgtaggaaaaagtag

SEQ ID NO: 231463 - DNA, 1362 bp, Artificial Sequence
  Description of Artificial Sequence: Synthetic coding sequence
atggtcctggtattatccgatacctccgcttcacctcctccatcagtgctgattagcaaaaacgaggtggggattttcactactccaaatttcgatgaaactagtagcgcaaccactatttcgactagcgaggacggctcgtatggtaccgacgtaaccaggtgtatttgcggctttactcatgatgacggttatatgatatgctgcgataaatgttctgtctggcaacacattgattgcatgggcattgatcgccaacacatacccgatacctatttgtgtgaacgttgccaaccccgtaacctggataaagagcgggctgtactactgcagagacggaaacgggaaaatatgtcagatggtgacacatccgctacagaaagcggcgacgaagtgcctgtggaactgtacaccgcatttcaacatacccccaccagtatcacactcactgcctccagggtgtctaaagttaacgataagcgacgcaagaagagcggcgagaaagagcagcacatatcaaaatgtaaaaaggccttcagggagggttcacgcaaatcttccagagtcaaaggatcggcacctgagatcgatccatcaagcgacggctctaattttggttgggagaccaaaataaaagcctggatggatagatatgaagaggcgaacaataaccagtactcagagggggtccagcgggaagcccagaggatagccctgcgtttgggcaacggcaatgacaagaaggaaatgaataaaagcgacctgaatacaaataacttactgtttaaaccacctgtggagtcccatatccagaaaaacaagaagatcttgaagagcgccaaggatctaccccctgacgcccttatcattgagtatagaggcaaattcatgctaagggagcagtttgaagcaaatggatatttttttaaacgtccctatccctttgttctgttttacagtaaattccatggactggagatgtgcgtggatgcccgaacattcgggaacgaggcacgctttatccgccgaagttgcacccctaatgccgaagtgaggcacgagattcaggacggaactatccacctctatatctacagcatccactctatcccgaaggggactgagattactattgctttcgacttcgattacggaaattgtaagtacaaagttgactgtgcctgtctcaaggagaacccggaatgtcctgtacttaagcggagtagcgaaagcatggagaacataaattccggctatgaaacccgacgcaaaaagggtaagaagacaaaaatctttcagaagaagaaaattcacaaaataagaatacttttatggatcgtgaaggagagacctactaaatag

SEQ ID NO: 231464 - DNA, 969 bp, Artificial Sequence
  Description of Artificial Sequence: Synthetic coding sequence
atgccagtcactgtgacgagaaccaccattactacaacaacaacttcttcttccgggcttggctcaccaatgatcgtcggctctccacgcgctctgacacagcctctgggcctcttacgacttctgcagctggtgtccacatgtgtggccttctccttagtcgcttccgtgggcgcttggaccggcagtatggggaactggagtatgttcacttggtgcttctgtttcagcgtgaccctgattattctgatcgtggaactgtgtggactgcaggctcggtttcccttgtcctggcgtaattttccaattacatttgcatgttacgccgctctcttttgcctctcggcgagtataatttatcctaccacctatgtgcagttcctgtctcacggccgatcgcgggatcatgcaatcgcagccacctttttctcttgcatagcctgtgtggcatacgctaccgaagtagcttggactagagctcggccaggcgagatcactgggtatatggctaccgtgcctggactcttgaaggtgctagaaactttcgtcgcctgcataattttcgccttcatatccgacccaaacctttatcagcaccaacccgcactggagtggtgtgtggcagtgtacgctatttgctttattctcgcagccatcgccatccttcttaatcttggggagtgtaccaacgtgctccccatccctttcccatctttcctaagtggactcgccctactctccgtccttctgtatgccacagctctggtgctatggccgttgtatcaattcgatgaaaaatacggcggtcagccacgacggtcaagagatgtcagttgttctcggtcccatgcttattacgtgtgtgcatgggacaggcgcttagctgtggctatcctgacagcaatcaatctcctggcctacgtagccgatctcgtgcactcagcacatcttgtttttgtgaaggtgtag

SEQ ID NO: 231465 - DNA, 969 bp, Artificial Sequence
  Description of Artificial Sequence: Synthetic coding sequence
atgcctgtgactgtgactcgaactactatcaccactactaccacaagttccagcggcttaggctctccaatgatagtaggcagccccagggcccttactcagcctttgggattgctaaggctactacaactggtttctacatgcgtggcattcagcctggtcgctagcgtgggcgcttggactggaagcatggggaattggtccatgtttacttggtgtttttgtttctccgtcactcttatcattctgatagtggaactgtgtggcctgcaggctcgttttcctttgagttggcgcaacttcccaatcaccttcgcctgctatgccgcactcttctgcctctctgcgtctatcatttaccccaccacttacgtccagttcctgtctcacgggcgatcaagggaccacgccattgctgcgactttcttctcttgtatcgcgtgcgtggcgtacgctactgaggtggcatggacacgagcacggccaggcgaaatcaccggctacatggcaacagtgccaggactcttgaaagtgctcgaaacattcgtggcttgcattatttttgccttcatcagcgatcccaacctgtatcagcaccaaccggctttagaatggtgcgtggccgtgtacgccatttgtttcatcctggccgctatcgccatactgctaaacctaggagagtgcactaatgtcctcccgatcccgtttccgagtttccttagtggtttggcgttgctatctgtgctgttgtatgcaacggccctggtcttgtggccactataccaatttgacgagaagtatgggggacaaccccgtcggagccgagatgtttcatgttcccgttctcatgcatattacgtgtgtgcctgggaccggagattagcggtggctattttgaccgccatcaatctgctcgcgtacgtggccgatctggtccacagtgcgcacctggtcttcgttaaggtgtag

SEQ ID NO: 231466 - DNA, 969 bp, Artificial Sequence
  Description of Artificial Sequence: Synthetic coding sequence
atgccagtcaccgtaacccgtaccaccatcaccactacaaccacttccagctcaggactaggctcccccatgattgtggggtcaccgagagcattaacccagcctcttggactgttacgcttgcttcagctggttagcacgtgcgtagcatttagcctagtcgcttctgttggcgcatggacaggctcaatgggcaattggagcatgttcacatggtgtttctgcttcagtgtgacgttgatcatcctgattgtcgaactctgcggcctacaggctcgatttcctctgagctggcgcaatttccctatcacattcgcctgttatgccgcacttttctgcctcagcgcaagcatcatctatccaactacttacgtccagtttttgtcccatggacggagccgagatcacgctatagccgctaccttttttagctgcatcgcgtgtgtggcctatgccacggaagtggcatggacacgggctagacccggagaaattactggttacatggcaaccgtaccaggtttgctgaaagtgctcgaaacgttcgtcgcttgtatcatatttgcctttatttctgaccccaatctctatcagcaccagcctgcgttagaatggtgtgtggcagtttatgccatctgcttcatcctggctgccatcgccatcctgttaaatctgggcgaatgtactaatgtgctaccaatcccctttccgtcatttctatcaggactcgctcttctatccgtccttctgtacgccactgccctagtgctgtggcccctgtaccagtttgacgagaagtacggcggacagcccaggaggtcgagagatgtgtcctgtagcaggtcccatgcctattatgtttgtgcctgggaccgcaggctcgcagtggcaattctcaccgccatcaacttgctcgcatatgtcgctgatctggtccacagtgcccaccttgtgttcgtgaaggtttag

SEQ ID NO: 231467 - DNA, 969 bp, Artificial Sequence
  Description of Artificial Sequence: Synthetic coding sequence
atgcccgtgaccgtgacacgaactaccattacaactacaacgacatcatccagcgggctgggaagtccgatgatcgtcggcagcccacgggcattgacgcagcctttagggctgctgcgactgctgcagctggtgtctacatgcgttgcttttagtcttgtagcatctgttggagcctggactggaagcatgggtaactggtccatgttcacctggtgtttctgcttcagtgttaccctcattatactaatcgtggagctgtgcggccttcaggcccgattcccgctgagttggcgcaactttcccatcactttcgcttgttacgctgccctgttttgtttgtccgcttcaattatttaccccactacttatgtgcagtttctgagccacggaaggtcgcgcgatcacgccatcgccgctaccttcttcagctgcatcgcctgcgtggcctacgcgaccgaagttgcctggactcgagcaaggcccggtgagattacaggttatatggctacggttccaggtttgctcaaggtgctcgaaacctttgtggcatgcatcattttcgcctttatatccgaccccaacctttatcagcaccaacccgctttagagtggtgtgtagcggtgtacgccatttgttttatactggcggctatcgccattctactgaacttgggtgaatgcaccaatgtattgcccataccttttcccagcttcctctccggattggcgctcctgagcgtgttactgtatgcaaccgcgctggtactgtggcctctgtatcagttcgatgaaaaatacggcggacaaccgagacgctcaagagatgtctcttgctctcgctcccacgcctattatgtttgcgcgtgggatcgtagactggcagtggccatactgaccgccataaatttactcgcttatgtggcagatttggtgcactccgctcacctcgtatttgtcaaagtgtag

SEQ ID NO: 231468 - DNA, 969 bp, Artificial Sequence
  Description of Artificial Sequence: Synthetic coding sequence
atgcctgtgacagtgacaagaactactatcacaacaaccaccacatcgagcagtgggctagggagccccatgattgtgggtagccccagagccctcactcagcccttggggctgctaaggctgttacagttggtatctacttgcgttgctttctctctcgtggctagcgtcggcgcatggaccggcagtatggggaactggtccatgtttacatggtgcttttgcttttccgtcactcttatcattctgattgtcgaactctgtgggcttcaggccaggttccccttgtcctggcgcaatttcccgataacatttgcttgctatgctgctcttttctgcctttcagcttctattatttatccaaccacgtacgttcagttcctgtcgcatggacggtcaagggatcatgcgattgccgcaaccttcttcagctgtatcgcttgcgtggcgtatgccacagaggtagcttggacccgcgctcggccaggcgaaatcactggatacatggcaaccgtcccgggtcttctcaaggtcctagagaccttcgtggcatgcattatctttgcctttattagcgatcctaatctttaccagcatcagcctgctttagaatggtgcgtggcagtctatgctatttgttttatcctggccgctatagcaatcctgttgaatttgggggagtgcacaaacgtcttaccgatacccttcccaagctttttgtccggcctggctctgctgtctgtgttattgtatgctacagcattagtgttatggcctttgtaccaattcgatgagaagtatggcggacaacctcggaggtccagggacgtctcatgctcccgaagccacgcttattatgtgtgcgcctgggaccgccgactcgccgtggccatactcacagcgattaatctgcttgcctacgtggccgatttggtgcactcagctcatctggtgtttgtgaaggtctag

SEQ ID NO: 231469 - DNA, 444 bp, Artificial Sequence
  Description of Artificial Sequence: Synthetic coding sequence
atgcctgtgaccgttacgaggaccacaatcacaacaaccaccacctcaagctctgggctgggttctccaatgatcgtaggcagcccacgcgcacttacccagccactgggcttactccggctgctccaactggtcagtacctgcgtggccttctctctggtggctagcgttggcgcatggaccgggtcaatgggaaactggtcaatgttcacttggtgtttttgctttagtgtgactttgataatactcatcgtcgaactgtgtggactccaagccagattccctctgagctggagaaatttcccaattactttcgcatgctacgcagccttattttgcttgtcagcttcaatcatttacccaactacatatgtgcagttcctgtcccatggaagatcccgcgatcacgctatcgctgcgacatttttttcatgcattgcctag

SEQ ID NO: 231470 - DNA, 858 bp, Artificial Sequence
  Description of Artificial Sequence: Synthetic coding sequence
atgcctgtgactgtcacaagaactacaatcaccacgaccacaacttcgtcgagcggattgggtagtcccatgatagtgggttcaccacgggctctgactcagcctctgggattgctcaggctgttgcagttggtctccacctgcgtggcttttagccttgtagcgagcgtcggggcttggacaggaagcatggggaactggtctatgttcacctggtgtttctgcttctcggtcaccctgatcatactcatcgtggagctgtgcggattgcaggccagattccctttgtcctggagaaatttccctattacattcttctcttgcatcgcctgtgtcgcctacgccaccgaagtggcctggactagggcacgacccggagagattaccggttatatggcaaccgtgcctggcctgctgaaggtgctggagacattcgtcgcctgcatcatttttgccttcattagcgatccaaacctgtaccagcaccagcccgctcttgagtggtgcgtggctgtttatgcaatctgtttcattctcgcagcaatcgccatactgctcaatctgggcgaatgtacgaacgtgctgcctatcccatttcctagctttctgtcgggattggccctgttaagcgttctcctgtatgcaaccgctctagtcctatggccactgtaccagttcgatgaaaaatacggaggccagcccaggagatccagggacgtgtcctgcagtcgctctcatgcttattacgtgtgcgcctgggaccgcagactcgcagtcgccatcctcaccgctatcaatcttctggcctatgtggctgacctggtgcattcggcccatctggtatttgtgaaagtttag

SEQ ID NO: 231471 - DNA, 729 bp, Artificial Sequence
  Description of Artificial Sequence: Synthetic coding sequence
atgcccgtgaccgtgacacgcactacaatcaccacgaccactacgagctcgagtggattaggatccccgatgatcgtagggagcccaagggcacttacccagcctctggggctcctgagactgctgcaactcgtgtcaacctgtgtcgcattttctctggtggcatcagtaggggcatggaccgggagtatgggtaattggagcatgtttacctggtgtttttgctttagtgtgactttgattattctgattgttgaactgtgcggactacaggccagattccctctgtcgtggcgcaactttcctattacattcgcctgctacgctgctctgttctgtctgagcgcctcaataatataccctactacttacgtgcagtttctgtctcatggacggtctagggatcacgccatcgccgctacctttttttcttgtattgcctgcgtggcatatgccaccgaagtggcctggacaagagctcgcccaggggaaatcaccggctacatggctacggtgcccggattactcaaggttttagagactttcgtagcctgcattatctttgcctttatcagtgaccctaatctatatcagcaccaacccgctctggagtggtgtgtggcggtgtatgcgatctgctttattctggcggctatcgcgatactgctgaatctgggagagtgcacaaacgtgctccccatcccgtttccaagcttcctgtcaggttag

SEQ ID NO: 231472 - DNA, 780 bp, Artificial Sequence
  Description of Artificial Sequence: Synthetic coding sequence
atgcccgtgacagtcactcggaccaccatcacaactaccacaacctcctcttctggtctgggtagcccgatgattgtcggctcccccagagccttgactcaacctctcggactgctgcggctgctgcagctggtctccacatgtgttgcctttagccttgtggcctctgtgggagcctggaccggctcaatggggaattggtccatgtttacctggtgtttctgtttctccgtgactctcatcattctgattgtcgagctgtgcggactccaagccagattccccctttcttggcgaaattttcccatcaccttcgcctgttacgccgcattgttctgcctatccgcatctatcatatatcctactacttacgtccaattcctttcccacggcaggtctagggatcatgcgatagcagctaccttcttttcctgcattgcatgtgtggcatatgcaactgaggtcgcttggacccgagctaggcctggcgaaataacaggctatatggccactgtgcctgggctgttaaaggtgcttgagacatttgtcgcctgcattatctttgcttttatttccgaccctaacctgtaccagcatcaacctgcactggaatggtgtgtcgccgtgtacgctatctgcttcattctggccgctatcgcgattctgctaaatctcggtgagtgtaccaacgttttgcctatcccattcccgtcgtttctttccggactcgccttgctgtctgtgttgctctatgcaactgctctcgttctgtggccttag

SEQ ID NO: 231473 - DNA, 567 bp, Artificial Sequence
  Description of Artificial Sequence: Synthetic coding sequence
atgcctgttacagtaacgcggaccacaatcactaccaccaccacgtctagcagcggcctgggtagcccaatgatagtgggcagccccagggctttgactcagccactggggctgctgaggctcctgcagctcgtgtccacatgtgtggcattctctctagtggcgtctgttggagcatggaccggtagcatgggcaactggtcaatgtttacctggtgtttttgcttctctgtcacactaatcattctgattgtcgaattgtgcggacttcaggcccgatttcctctctcctggcgcaacttccctataacctttgcatgttatgctgccctattttgtctcagtgcgagcatcatttaccccactacctacgtccaattcctttcgcacggaaggtcaagagaccacgcaatagctgctactttcttttcttgcatagcctgtgtcgcctacgctacagaggttgcatggacccgggctcgaccaggcgagataaccgggtacatggctacagtccccggtttgttaaaagtactcgagacgttcgtagcctgtatcattttctag

SEQ ID NO: 231474 - DNA, 942 bp, Artificial Sequence
  Description of Artificial Sequence: Synthetic coding sequence
atggccctgaggatttgtgtgacgtatacccctgcactgcccatcggtctctgtacaaggtgctgtttgtgtctggagcaatcaccgtcctggtgccactgcttgcggggtgtgagctttctcacctttcacctccatcagagcgtccccctgggcgacagagactctctgctgatgttcaccaggcaagcgggtcacttcgtagagggatcgaaagctgggaggtcacggggacgtctgtgcctgtctcaagcattacgcgtggcagtcagaggagcattcgttagcctgtggtttgcggcaggtgccggagaccgtgagcggaataagggggataagggagcacagactggggctggactgtcccaggaggcagaagatgtcgatgtatcgagagccagacgagtgacagacgctccccagggcacactttgcggaacgggtaataggaacagcggcagtcaatctgctcgtgtggtcggtgtggctcaccttggggaagccttccgtgtaggagtggagcaggcaatctccagctgcccagaggaagttcatgggcgtcatggtttatccatggaaattatgtgggcccgaatggacgtagcgttgcggtctcctggacgtggcctactggcaggagctggcgctctctgtatgacgctcgccgagagtagctgcccggactatgagcgaggaagacgcgcatgccttacactgcacaggcacccgacgccacactgttcaacatggggactgccgctgcgcgtggcgggtagctggctgactgttgtcactgtagaggctctcgggggttggcggatgggcgtccgcaggactggtcaggtcgggcctaccatgcaccccccacccgtgtctggagcttccccactcctgctacatcacctgctactactgctgttgattattatccttacctgttag

SEQ ID NO: 231475 - DNA, 942 bp, Artificial Sequence
  Description of Artificial Sequence: Synthetic coding sequence
atggctctgagaatctgtgtcacctatactcccgcattacccatcggcctgtgcactaggtgttgcctatgtttggaacagtctccgagctggtgccactgcttgcgtggggtttcattccttacatttcacctgcaccagtctgtacccctgggtgatagagactcactgctgatgttcaccagacaggcgggtcactttgtggagggaagcaaggcagggaggtccagaggccgtctctgtttgagtcaagcacttcgagttgccgtcagaggggcattcgtgtcgttgtggtttgccgctggcgctggggatcgcgaaaggaacaaaggcgacaagggcgcacagaccggggcaggcctgagccaggaggctgaagacgtggatgtgtctagagctaggcgcgtcactgacgcgcctcaaggcaccctgtgtggtaccggtaatcgcaacagtggatcccaatctgccagagtggtcggtgtcgcccaccttggcgaggcttttcgagtcggggttgagcaagccatcagctcctgccctgaagaggttcacgggaggcacgggctgtccatggaaatcatgtgggctaggatggatgtggcccttcgtagtcctggacgcggattgctcgctggggcaggcgcattatgcatgaccctggccgagtcgtcttgcccagactatgaacgaggtaggagggcatgcctgacactacaccgccatccaacaccccattgttctacttgggggttgcctttgcgggttgcaggtagctggctcacggtagtgacagttgaagccttggggggatggcgcatgggggtccgcaggactggacaggtgggacccaccatgcatcctccacccgtgtctggggcatcaccactattgctccatcacctgctgcttttgttacttatcataattctgacatgttag

SEQ ID NO: 231476 - DNA, 279 bp, Artificial Sequence
  Description of Artificial Sequence: Synthetic coding sequence
atgcaggtaagcacagccgcattggccgttttgttgtgcacaatggccttatgcaaccagttcagtgcgagcctggctgcggatacgcccaccgcctgctgtttttcctacacaagtcgccaaatcccacagaatttcatcgccgactactttgagacttcatctcagtgcagcaagcccggtgttatttttttaacaaagaggagtcggcaagtgtgcgccgacccctccgaggaatgggtgcagaagtacgtgtccgacctcgaactgagtgcttag

SEQ ID NO: 231477 - DNA, 2334 bp, Artificial Sequence
  Description of Artificial Sequence: Synthetic coding sequence
atgggcgttccctttttttctagcttgcgatgcatggtggatctcgggccatgttgggccggaggcttaaccgctgaaatgaagctcctgctagcactggctggcctgcttgcaatcttagcaacaccacagccaagcgagggagcggcacccgctgtgcttggcgaggtggacacaagtttagtcctcagttccatggaggaagcgaagcagcttgtagataaggcctacaaagagaggcgggagtccattaagcagcgcttgagaagcggcagcgcgtcccctatggagctgttaagctattttaagcaacctgtcgctgcgactcggaccgccgttcgggcagccgattatctgcatgtggcccttgacctcctggaaaggaaactccggtcgttgtggcggcgaccctttaacgtgactgacgtcctgacacctgcacagcttaatgtactgagtaagtcttctggatgcgcttatcaggatgtcggggttacctgcccagaacaggataaatataggacgatcacaggcatgtgtaataatcgatgcggatggctgggagttgccgcaggcactgggttacgggaggcctctcggacacctcaagcatcgaggtgccaacgcccagtgctcccatgtcgcaggagtcccaccttgggcgcttccaaccgagccttcgtgcggtggctcccagccgagtatgaagacggcttctctcttccatacggatggacacccggagttaagagaaacggctttcctgtagccctggcaagggccgtgagtaatgaaattgtacgcttcccaaccgaccagctgactcctgatcaggagcgtagtttaatgtttatgcaatgggggcaactgctggaccacgatctggacttcacccccgaacccgcagctagggctagtttcgtgacaggggtcaattgcgagaccagctgcgttcagcagcctccttgtttccccctgaaaatacctccaaacgatcccaggatcaaaaaccaggccgactgcatccccttctttaggagttgtcctgcctgtcccggatccaacattacgatacgaaatcagatcaatgctctgacatccttcgtcgacgcctcaatggtttatggaagtgaggaaccattagcacgtaacctgcggaatatgtcaaaccaactcggtcttctggccgtgaatcagcgattccaagacaacggacgcgctctactgcccttcgacaacctgcacgacgatccatgcctcctcacgaatcgctctgctaggataccttgtttcctggcgggagatacaaggtcctccgagatgcctgagctcacaagtatgcatactctccttctgagggaacataatcgactggcaaccgagctgaagagcctgaaccccaggtgggacggcgaacggttgtatcaggaggctcggaaaatagtgggagccatggtgcagattattacctaccgcgactacttgcctctcgtgctaggccctaccgcaatgcgtaagtatctgcctacctaccgttcctacaacgacagtgtggaccctaggattgcgaatgtgttcacaaatgcgttccgatatgggcacacccttattcaaccattcatgtttcgactagataaccgatatcagcccatggagccaaaccccagggtgccattgagccgggtgtttttcgcttcctggcgcgtggtgctggaggggggaatagatccaatcctacggggactgatggctactccagctaaactcaatagacagaatcagatcgccgtcgacgagattcgggaacggctattcgaacaggtgatgagaatagggctcgacttgccggcacttaacatgcagcgtagccgcgaccacggtctccctggttacaatgcgtggcggagattctgtggacttcctcagccagaaaccgtggggcaattaggaacagtcctgagaaatctcaagctggctcgcaagttaatggagcagtatggaacccctaataatatcgacatctggatggggggagtctctgaacccctgaagcggaaggggagagtcgggcctttactcgcttgtatcatcgggacacagtttcgcaaactgagagacggggacaggttctggtgggagaacgagggcgtgttcagtatgcagcagcggcaggccctggctcagatatctctcccccgaatcatttgtgacaacacaggcattacgacagtgagcaagaataatatattcatgtctaattcttacccgagagactttgtgaactgcagtacccttcccgcactcaacttggcctcttggcgggaggcttcgtag

SEQ ID NO: 231478 - DNA, 1542 bp, Artificial Sequence
  Description of Artificial Sequence: Synthetic coding sequence
atgccatcctgggctttgttcatggtgacttcctgcttgctgctggctccccagaacctggcccaggtaagtagtcaggacgtcagcctgctggcctccgatagtgaacctttaaagtgtttcagccgcaccttcgaggacttaacctgcttttgggatgaagaagaggctgctccctctggaacataccagttgctttatgcatatcctcgtgagaagcccagggcctgcccgctttctagtcaaagcatgccccactttggcaccaggtacgtctgtcagttccctgatcaagaggaggtgcgtttgttttttcccctgcacttatgggtcaaaaacgtcttccttaatcagacacggactcagcgcgtactcttcgttgacagcgtgggactccctgcccctcctagtatcattaaagcaatgggcggttcccaaccgggagaactacagatatcttgggaggagcccgcaccagagattagcgacttcctgagatacgagctaaggtacggaccgagagatccaaaaaattcgaccggtccgacagtgatccagctgatcgccactgaaacgtgctgtcccgctctccagagaccgcatagtgcatccgcgttagaccaaagcccttgcgcccaacctaccatgccctggcaggatggaccaaagcagacatctccttcccgtgaggctagcgcactcactgctgaagggggatcctgcctcatcagtggcctgcaacctggcaacagctattggctgcagcttcgctctgaaccggacgggatttctctggggggaagctggggcagctggtctctaccggtgacggtggacttacctggcgatgccgtcgcattggggctgcaatgttttaccctggacctgaagaatgtgacctgtcagtggcagcagcaagaccatgcctctagtcaggggttcttctaccactcacgggcaagatgttgtccaagagacaggtaccccatatgggagaattgcgaagaagaggaaaaaacaaaccccggactccagacccctcagttctcacggtgtcactttaaaagcaggaacgatagcatcatccacatcctagtcgaggtcaccaccgcccctggcacggtacattcttacttaggatccccgttttggatccaccaggccgtacggctcccgacacccaacttgcactggagagaaatctcgagtggccacctggagctcgaatggcagcatcctagttcgtgggctgcacaggaaacctgctaccagcttcggtacaccggcgagggacaccaggattggaaggtgcttgagccgcctctgggtgctcgtggcggtaccttggagctgaggcccagatcccggtatcgcctgcagctcagagccagactgaacggcccaacttaccaggggccatggtcttcctggagcgacccgacaagggtagaaaccgctacagagacggcttggatttccttagtgactgcccttcacctggttctcggcttatccgccgtgctgggcctgctcctcctctag

SEQ ID NO: 231479 - DNA, 1908 bp, Artificial Sequence
  Description of Artificial Sequence: Synthetic coding sequence
atgcctagctgggcactgttcatggttacatcttgcctactgctggctccacaaaatttagctcaggtatcatcccaggacgtttccctcctcgcctcagattcagagcccttgaaatgcttcagtcgtactttcgaagacctgacttgcttctgggacgaggaagaggccgctcccagtgggacttatcaactactatacgcttatccacgcgagaaacctagggcctgtcctttgagttcacagtccatgccacatttcggcacacgatacgtatgtcagttcccagatcaggaagaggttcgactcttctttccgctccatctgtgggtgaagaacgtctttctgaatcagacgcgcacccagcgtgtccttttcgtcgactccgtaggattgccagccccaccaagcattatcaaagccatgggtgggagccagcctggggagttgcaaatcagttgggaggaacccgcaccggaaatcagtgattttctgcggtacgaattgcgctatggacccagagaccccaaaaactcaacagggccaaccgtgattcagcttattgccacagaaacttgctgtcccgcactgcagcgacctcatagtgcttccgccctggaccagtcaccctgcgcccagccgacaatgccttggcaggacggacccaagcagacttccccatcgcgcgaggcaagtgccttgaccgcagagggcggatcttgcctcatcagtggccttcagcccggtaattcctattggctccaattgagaagtgaaccggacggaatcagtcttggaggttcatgggggtcctggtctctgcctgtgaccgtggatttaccgggagatgctgtcgcgttaggcttacagtgctttacgctggatttgaaaaacgtcacctgccagtggcagcaacaggaccatgcctcctcacagggttttttttatcactccagggccaggtgttgtcccagggaccgttaccccatttgggaaaactgtgaagaggaagaaaagactaatccaggacttcagactccacagttttcaaggtgccactttaagtcacgcaacgacagcataatccacattttagtggaagtgacgactgctcccggaactgtgcattcctatctcggaagcccattctggattcaccaagcagtgcgcctgcccactccgaacctccactggcgcgaaatttccagcgggcatttagaattggagtggcagcacccctcatcctgggcagcacaggagacatgctaccaacttcgctacacaggggaggggcatcaggattggaaagtgttagagcccccactgggagcacgcggaggaaccctggagctccggcctcgctccagatatcggttacaattgagagcccgactgaatggcccaacatatcagggaccctggtctagttggagcgatcccacacgggtggagacagcaaccgagaccgcgtggatttcgctagtgacggccctccatctggtgctgggcctgagtgctgttctgggcctccttctgcttcggtggcagtttcccgcacactacagacgattgcgccacgctctgtggccaagtctgcccgacctgcaccgcgtcttgggacagtacctgagagatacagcagccctttcaccacccaaagctaccgtcagtgacacctgtgaggaggtggaacccagcctgttagagatcctgccgaagtcctctgaacgcaccccccttcctctgtgctcttcccaggcccaaatggactaccggcgactccagccatcctgtctgggcaccatgcccctgtcagtgtgtccgccaatggcagagagcggctcgtgctgcacaacgcatattgccaaccattcgtacttaccattatcttactggcaacagccatag

SEQ ID NO: 231480 - DNA, 1650 bp, Artificial Sequence
  Description of Artificial Sequence: Synthetic coding sequence
atgcctagctgggcgctgtttatggttacatcttgcctgctgctggcaccacagaacctggcccaagtgtcaagccaggacgtgtctctgctagctagcgattctgagcccttgaagtgcttctcccgcactttcgaggatctgacatgcttctgggacgaggaggaagccgcaccctcgggtacataccagttgctgtatgcatatccgcgagagaagcccagagcctgcccgctgtcgagccagtctatgcctcactttggaacacggtatgtttgccagttccctgaccaggaggaggtgaggctgtttttccccttgcatctgtgggtcaagaatgtcttcctgaaccagacccggactcagcgggttctcttcgtggactcagtgggtctacccgcacccccatcaatcatcaaggccatgggtgggtctcagccaggcgagctgcagatttcctgggaggaacctgctcccgaaatcagtgattttctgagatacgagttgcgttacggccctcgggaccctaagaactcaaccggtccgaccgtaatccagctgattgccacggaaacatgctgtcccgctttgcagagacctcactcggcttccgccctggatcagagcccctgtgcccagcccaccatgccatggcaggacggcccaaaacagacttcaccgagccgagaggcttcagcactgactgcagagggcggaagttgcttgatttccgggcttcaaccaggtaattcctactggctgcaactgcggtccgaaccagatggcatcagcctgggagggagttgggggtcttggtcccttcccgtcactgtcgacctcccgggagacgccgtcgccctcggcttacagtgcttcacgctagacctcaaaaacgtcacctgtcaatggcagcaacaggaccacgccagttcccaagggttcttttatcatagccgggcacgctgttgtcctagagacagataccccatctgggagaactgtgaggaagaggagaagacaaacccagggctccagactcctcagttctcccgctgtcacttcaaatcccgaaatgatagcattattcatattctcgtggaggtgactactgccccagggacagtacactcatatttgggatcccctttctggattcaccaagcagtgaggctgccaacacctaacctgcactggagggagatttcgtctgggcacctagagctggagtggcagcatccaagttcctgggccgctcaggagacctgctatcagcttcggtataccggagagggccatcaggactggaaagtactggaacccccactcggcgcaaggggcggaacactcgagctgcgccctaggagtcgttataggctgcagctccgagcacgcctgaacggtcccacctaccaggggccttggagttcttggtctgatcctacgagagttgaaacggcaacggagaccgcctggatcagcttagtgaccgccctgcacctggtgttgggtctgtccgccgtgttaggtctgcttctgcttagatggcagttccctgctcactacagatacaggcccagacaggccggagactggagatggacaaggtggagccgcaggcccgtcaatcgacacagttggttcgccctctag

SEQ ID NO: 231481 - DNA, 2817 bp, Artificial Sequence
  Description of Artificial Sequence: Synthetic coding sequence
atgacattactgggctccgagcattccctgttgatccgttcaaagtttcggtccgtgttgcagctcaggcttcaacagagaagaactcaagaacagttggcaaaccaggggattatccccccactgaaacgccctgccgagtttcacgagcaacgcaaacacctggatagtgataaggctaagaattcgctgaaaagaaaggccaggaatagatgtaacagtgccgacttggtcaacatgcatatactacaggcttcaaccgcggaaaggagcataccaactgcacagatgaagctgaaacgggctcgcttggctgacgatctaaacgagaagattgccctgaggccaggacctctggagctggtggagaagaatatactgccggttgacagcgcagtaaaggaggctatcaaaggaaatcaagtgtccttctccaaatccacagacgccttcgctttcgaggaggactcatctagcgatggcttgtcccccgaccagacccgatcggaggatcctcagaatagcgccggtagcccaccagacgcaaaagcatccgacacgccttcaaccggctccttagggacaaatcaggacctggcaagcgggagtgaaaacgacaggaacgactctgcttcacaaccctcccaccagagcgacgccggtaagcaaggtctcgggcctccttctactcccattgccgtccacgccgctgtaaagagtaagtctctgggcgattcgaaaaaccggcacaagaaacctaaagatccaaaaccaaaggttaagaaattaaaatatcatcagtatatccccccagaccaaaaagctgagaaatcacctccacccatggattctgcttatgccaggctgctgcaacagcagcagctcttcttgcaacttcaaattcttagccagcagcagcaacagcagcagcatagattttcctacctggggatgcatcaggcacagctgaaggagccaaacgagcagatggtgcgcaatcccaattctagtagtacacctcttagcaataccccactgagcccagtcaagaatagcttttcagggcagacaggtgtgtcaagctttaaaccagggccactgcctccaaatctggatgatctgaaggtgagtgaacttcggcagcaactcagaatccggggactgcctgtttctggaacaaagaccgcactgatggacagactgaggccgtttcaggattgcagtgggaatcctgtgccgaacttcggcgatatcacaaccgtgactttccccgttacgccaaacacgctcccgaattatcagtccagcagttccacaagcgcgctatccaatgggttttaccacttcggctccaccagttccagcccccctatcagccctgcaagcagcgacttatctgtcgcaggctccttacctgacactttcaatgatgcgagtccgtcatttggcttgcatccttcgccagtccacgtgtgtacagaagagagcctgatgagtagcctgaacggcggaagcgtgcctagtgaactggacggcttggatagcgaaaaggataagatgctggtggaaaagcagaaggtcattaatgaattaacatggaagttacagcaggagcagagacaggtcgaggagctgcgtatgcaattgcagaagcaaaagaggaataattgctccgaaaagaagcctttgccatttctcgccgcatctatcaaacaggaggaagccgtgtcctcttgccctttcgcctcacaagtgccagtgaaacgtcagtcgtccagctctgaatgccacccccctgcttgtgaagctgctcaactccagcccctaggtaatgctcattgtgtggagtcatccgatcagaccaacgtactttcatcaacgttcctgagcccacaatgcagccctcaacattctcctcttggagccgtgaaatccccacaacacatctccttaccccctagcccgaacaacccgcacttcttaccaagtagctccggggctcagggtgaaggccacagagtttcctcccccatcagtagtcaagtgtgtacggcccagatggcaggtttacacagcagcgataaagtggggcctaaattctcaatccctagcccaactttcagtaaaagttcctcagccatttccgaggtgacccagccaccttcttacgaagacgctgtcaaacaacagatgaccagaagtcagcagatggatgagctgctcgatgtcctgattgagtcaggcgagatgcccgcagacgcccgagaggaccattcatgccttcaaaaagtgcctaaaataccgaggtcatcaagaagtccaaccgccgtactgaccaaaccatctgcctccttcgaacaagcatcctctgggagccagattccgttcgacccatatgctacagatagcgacgaacacctagaggtcctgctgaacagtcaaagccccctaggcaagatgtctgatgtcaccctactgaagatcggcagcgaagagccccattttgacggtatcatggacggattcagcggtaaggccgctgaagacttgtttaacgcgcacgaaatattacctggcccactgtcaccaatgcagactcagttctccccaagctccgtagatagcaatggtctccaactttccttcacagaatctccatgggagacaatggaatggctggatttgacccctccaaatagcacgcccggattttcggcactgacaacctccagtccgtcaatattcaatattgactttctagacgtcactgatttgaacctgaactcaagcatggacttgcatctgcagcagtggtag

SEQ ID NO: 231482 - DNA, 1989 bp, Artificial Sequence
  Description of Artificial Sequence: Synthetic coding sequence
atggatagtgcctatgcgaggctgctgcaacagcagcagcttttcctacagctccaaatcttgagtcagcaacaacaacaacagcagcaccggttctcttacctcgggatgcatcaggcacagttaaaagaacctaacgagcagatggtcaggaacccaaatagttctagtactcccctctcaaacacacctctaagtcctgtgaagaacagtttcagcggccagactggtgtctcatccttcaaaccaggaccactgccccctaacctcgatgatcttaaggtgtcggaactgcgccagcagttgcggattcgtgggctacctgtcagcggcacaaaaacagccttgatggatcgactacgcccatttcaggattgctccggtaacccagtgccaaacttcggggacatcactacagtcacctttccggtgactcctaacacgctgccaaattatcagtcttcatctagtacatccgcactcagcaacggattttatcactttggctccacgagcagctcccccccaatttctccggcatcttctgatctgtcagtcgccggatctctgcctgacacattcaacgatgcctcacccagtttcgggctgcatccaagtcccgtgcatgtttgtacggaagagagccttatgtcctctctgaacggcggttccgtgccttctgagctcgatggcctcgactctgagaaggataagatgctagtggaaaagcagaaggtgattaacgaactcacatggaagctccaacaggagcagcgccaagttgaggaactacgcatgcagctgcagaagcagaagaggaataactgcagcgaaaagaagcctctcccgtttctcgccgcatctattaagcaggaagaagctgtttcctcctgcccttttgcttcccaggtcccggtgaaacgccaaagttcatccagtgaatgtcaccctccagcatgtgaagcagctcagctgcagcctctcggcaacgctcattgcgtggagtctagcgatcagacgaatgtactgagctccacctttttgtccccacagtgttcccctcaacacagcccattgggagcagtcaagtccccacagcatatctcactcccaccttcgcctaataaccctcacttcctcccaagctcttccggggctcagggcgaaggccatcgtgtctcatctcctatctcctctcaagtgtgcaccgcccaaaacagtggagctcacgacggacacccgcctagtttttcaccccactctagctcactgcatccaccattcagcggcgctcaggccgattcctcgcacggtgccggtggcaatccttgcccaaagtctccctgcgtgcagcaaaagcagatgactaggagtcagcagatggacgaacttctggacgtgctcatagagagtggagagatgcccgcagatgctagagaagatcattcatgtctgcagaaagtgcccaagatcccacgttcgtctcggtcaccgaccgccgttctgacgaagcccagcgcttcctttgagcaggcctctagtggcagtcagatcccatttgatccctatgctaccgattctgacgagcatcttgaagtgttactgaactcccagtctccactagggaagatgtcggatgtaactctattgaagattggcagtgaggagccgcacttcgacggaattatggatggtttctctgggaaagctgcagaggacctgttcaacgcccacgaaatcctgcccggacccctctctcctatgcagactcagttttcacctagtagcgtagacagtaacggtctccaattatcctttacagaatccccttgggagaccatggaatggctggatttgaccccacctaacagcaccccgggattctccgcactgactaccagtagcccatccatctttaacatagacttcctcgatgtcacagatctcaatctgaacagttctatggacctacacctccagcagtggtag

SEQ ID NO: 231483 - DNA, 2055 bp, Artificial Sequence
  Description of Artificial Sequence: Synthetic coding sequence
atgaaactgaaaagggccaggctggccgatgacctgaatgaaaagatcgcgttaaggcctggcccactggagttggtcgaaaagaacattttacccgtggattctgccgtcaaagaagccattaagggtaaccaagtgagcttcagtaagtccacagacgcctttgccttcgaggaagactcatcaagcgacgggttgtcgcccgaccagacccggtcggaggaccctcagaattcagccggatcacccccagatgcgaaggcctctgacacaccaagcaccggatccctgggcactaatcaggacttggcttcaggtagtgaaaacgaccgaaatgacagcgcgagtcagcccagccaccagtctgacgccggaaagcaaggactggggccaccatccaccccgatagcagtccacgccgcagttaagagtaaaagtttaggagacagtaaaaatcggcataagaagcctaaagaccccaaacctaaggtcaagaagcttaagtaccaccagtacatccccccagatcaaaaggctgagaaatctccacccccaatggattcagcttatgccaggctgctgcagcagcagcagctatttcttcagctgcagatcctgtcccagcagcaacagcagcaacaacacagattcagctatctcgggatgcaccaggcccagctgaaagagcccaacgagcagatggttcgcaatcctaacagcagtagtacccctctgtccaacactcccctgagcccagtgaaaaactccttcagcggccagactggcgtgagcagcttcaaacccggacccctgccaccaaacttggacgatctgaaagtttcggaactgaggcagcagcttcgaatcaggggtctgccagtgtctggtactaaaaccgcgctgatggacagactgaggccttttcaagactgttcgggcaacccggtacccaattttggcgatattacaaccgtgacttttcctgtaactcccaacacgttacctaattaccagtcatcaagttcaacatctgccttgtcaaatggcttttaccactttggaagtacctcttcttccccaccaatcagccctgctagttcagacctgtctgtggcaggaagcctgccagatactttcaacgacgcatcaccttcgttcggattgcacccttcaccggtgcatgtctgcacggaagagagtctgatgagtagcttgaatggtggtagtgtgccatctgagcttgatggattggattcagagaaagataaaatgctggtggagaaacagaaagtgattaatgaacttacctggaagctgcagcaagagcaacgccaagtcgaagaactgagaatgcagctgcaaaagcagaaacgtaacaactgcagcgagaagaagcctttgccttttctcgcggcaagcatcaaacaagaggaggccgtgagcagttgtccctttgcctcccaagtcccagtaaagagacaaagctcatccagcgaatgtcacccccctgcttgtgaggctgcccaacttcaacccctgggaaacgcccattgcgttgagtccagcgaccagacaaacgttctgagttccacgtttctttcaccgcagtgctcacctcagcatagcccgctcggtgcagtgaaatcacctcaacatatctcgctaccacccagtcccaacaatccacacttcctgccttcctccagtggcgcacagggggaggggcaccgcgtgagctcccctattagctctcaggtctgcactgcccaaaacagcggcgctcatgacggccatcccccttctttcagcccacactctagtagcttgcaccctccattctcaggagcacaggccgacagttctcacggcgctggagggaatccctgtcctaagtcgccgtgcgtgcagcagaagatggccggactgcacagcagcgataaggttggacctaagttctcaatccccagccctactttcagcaaatcctcctctgcaatatcggaggtgacccagccaccctcttacgaggacgcagttaagcaagtcaccatgtag

SEQ ID NO: 231484 - DNA, 2961 bp, Artificial Sequence
  Description of Artificial Sequence: Synthetic coding sequence
atgacattgctggggagcgaacactcattactgatcagatcaaagtttcggtccgtgcttcagctgcgtctacaacagaggcgcacgcaagaacagctggccaaccagggcattattcccccactgaagagaccagctgagttccatgagcaacgaaagcatctggattcagataaggccaagaactcattgaagcgcaaggcaagaaaccgatgcaacagcgcagatctggtaaatatgcacatattgcaggcaagcacagcggagcggtccatacccaccgctcaaatgaagctgaagcgcgctagacttgctgacgatcttaatgaaaagatcgctctgcgcccaggtccactggagctagttgagaaaaatattctgcccgtggatagcgctgttaaagaggctatcaagggaaaccaggtgagcttctctaagtcaacagatgcgttcgcctttgaagaggattcttcaagtgacgggctctcaccagaccagaccaggtctgaagatcctcaaaactccgctggctcaccccctgatgcaaaagccagtgacactccctcaacgggaagcttaggcacaaatcaggatctcgccagcggaagtgagaatgatagaaatgactctgcaagccagccttctcatcaatctgacgccggaaaacaaggcttgggccctcctagcaccccaattgcggttcacgcagctgtaaaaagcaagtctctgggagacagcaaaaacaggcataagaagccaaaagatcctaagcccaaggtcaagaagcttaagtatcaccaatatattccgcctgaccagaaggctgagaaaagtccgccacctatggattccgcctacgcaaggctcctgcagcagcagcaactatttctccagctccagatcttgtctcagcaacagcaacagcagcagcaccgatttagttatctggggatgcaccaggctcaattgaaggagccaaacgaacagatggtgaggaatcccaatagctccagtactcctttgtctaatacacctctgtcccccgtgaaaaattccttcagtggtcagacgggcgtgtctagctttaagcccggtccactgcccccaaacctcgacgatttaaaggtatcagaactacgacagcaattaaggataagaggactgcctgtgtccgggacaaagacggcattaatggatcggctgcgtcccttccaggattgtagcggaaatccagttcccaatttcggagacataaccacagtcaccttccctgtcacccccaatacactgcccaattaccaatcaagctcgtctaccagtgctctcagcaatggattttatcatttcggatcaaccagctcttctccccctatctctccagcgtcaagcgatctgagcgtcgctggttctctgcctgatacatttaacgacgccagtccatcatttggtctgcatccctcacctgtgcacgtgtgcacagaggagagccttatgtcatccttgaatggcggtagcgtgccttccgagctggatgggctcgattcagagaaggacaagatgctggtggaaaagcagaaggtcatcaacgagctgacatggaaattacagcaggaacagagacaggtggaggagcttagaatgcaactgcaaaaacaaaaaaggaacaattgcagtgagaagaagcccctgcctttcctcgctgcaagtatcaagcaggaggaggcggtttctagctgtccgtttgcaagccaggtaccagttaagagacagtcatcctctagcgagtgtcatcctcccgcttgtgaagcagctcagcttcagccactcgggaacgctcactgtgtcgagagctccgaccaaaccaatgttctgtcctctacttttctctcacctcagtgctccccgcagcattccccactgggggctgtgaagagcccacagcacatctccttgccaccatccccgaacaacccacacttcttaccgtcttcctcaggggctcagggcgagggacatagggtgagttcccctatctcatctcaggtgtgcactgcacaaaattcaggcgctcacgatggacatccgccttccttctcaccccactcctcttcactacatccacccttttctggagcccaggctgattcaagtcacggcgctgggggtaatccatgccctaagagcccctgtgttcaacagaaaatggccggtctccactcaagcgataaagttggcccaaagttctccataccgtcgcccacattttctaaaagttctagcgcaatttctgaggttactcagcccccaagctacgaagatgcagtgaagcagcagatgaccaggtctcagcaaatggacgagctgctggatgtgcttatagagtccggcgagatgcctgcggatgcgcgagaggaccacagttgcctccagaaagtgcctaaaattcccagaagcagccgttcccccactgcggtgctgactaaaccctctgcttctttcgaacaggcctcgtcaggcagtcagattccctttgacccctacgccacggactcagatgaacatcttgaagttttactgaattcacagtcaccactgggaaagatgtcggacgtgaccctgttgaagattgggagcgaggaacctcactttgacggaattatggacggattctccggtaaagctgcagaagatctgttcaatgctcacgaaatccttccagggcctcttagtcccatgcagacccagttcagccccagcagtgtggattctaacggcctgcaactgtcgttcaccgagtccccttgggagaccatggaatggcttgatctgaccccgcctaattcgacccccggattcagcgctctgacaacctcaagcccaagcattttcaacattgacttcctggacgtcactgacctgaatctcaactcctctatggacctccacttgcagcagtggtag

SEQ ID NO: 231485 - DNA, 1947 bp, Artificial Sequence
  Description of Artificial Sequence: Synthetic coding sequence
ttcctgcagctccagattctgagccagcaacagcagcaacagcagcacagattctcttacctgggcatgcatcaggcacaattaaaggagcccaatgagcagatggtgaggaaccccaattcatcatctacaccgctatccaacacaccattatcaccagtaaaaaattcgttctccggccaaacaggggtctcatcctttaaaccaggaccactccctccgaacctcgatgatctgaaagtaagcgagctgcgacagcagctgcggattagaggcttacccgtctcgggtacaaagacagctctcatggacagacttaggccctttcaggattgtagtgggaaccccgtgcctaactttggtgacatcacaaccgtgacctttccagttactccgaacacgttaccaaattatcagtccagtagctctacctcagccttgtcaaacggcttttaccatttcggttccaccagttcttcccccccaatctctcccgctagctccgacctgagcgtggcgggttccctccccgataccttcaacgatgcatccccatccttcggccttcacccatcccctgtccacgtttgtactgaggaatccctgatgtcaagcttaaacggcggatccgtcccttcagagctcgacgggctagacagtgaaaaagataaaatgctggtggagaagcagaaagttataaatgagttgacctggaaactgcaacaggagcagaggcaagtggaagagctgcggatgcagctgcaaaagcaaaagagaaacaactgtagtgaaaaaaagcctttgcccttcttggctgcttccattaaacaggaggaggccgtttcttcctgtcccttcgcttcccaagtgcccgtgaagcgccagagtagtagctcagaatgtcacccccctgcctgcgaagctgcccaattgcagccgctcggtaatgcacactgcgtcgagtcctcagatcagacaaacgtcctctctagcacatttctctctccacagtgcagcccccagcactccccactcggcgcagtgaagtccccacagcacatcagcttgcctcctagccccaacaatccccacttcctgccatcctcctccggagcccagggcgagggccacagggtctccagccccatctcttcacaggtttgcacagcccagaatagcggggctcacgatggacatcccccaagcttttccccccatagtagctctctgcaccctccttttagcggcgcacaggcagacagttctcatggggcaggcggaaacccatgcccaaagagcccttgcgttcagcaaaagcagatgacaaggagtcagcagatggacgagctgcttgacgtcctgatagagagtggcgagatgcctgccgatgctcgggaagatcattcctgtctgcagaaagttccgaaaatcccacgctccagcagaagccctacagcagttctcaccaaaccaagcgcctccttcgagcaggcttcaagcggttcccaaatcccattcgatccatacgccacagactccgatgaacacctggaggtgttgctgaatagtcagtcaccactcggcaagatgagtgatgtgaccctcctcaagattggtagcgaagagcctcactttgatggtataatggacgggttctccggtaaggccgctgaggacctatttaatgcccacgagattctgccagggcctctgtcccctatgcagactcaattttcgcctagcagcgtggattccaatggactgcagctgagctttaccgagtccccctgggaaaccatggaatggctcgacctaacccctcctaattctacccccggatttagtgcattaactacttcctcccccagcatttttaatatcgatttcttggatgtgacagatttgaatcttaacagctccatggatctgcacctgcagcaatggtag

SEQ ID NO: 231486 - DNA, 1515 bp, Artificial Sequence
  Description of Artificial Sequence: Synthetic coding sequence
atgaggttcttctgcgctcggtgttgtagcttcggacccgagatgccagccgtgcagctgctcttactggcatgtctggtctgggatgtaggtgcgaggacggcacaacttcggaaagcaaatgaccagagcggacgttgtcagtacacctttagtgtggcctcccccaacgagagcagctgcccggagcaaagccaagccatgtcggtaatccacaacctccagcgggactcttcgacccaaagactggatctagaagccacgaaagctaggctgagctcactggagtcccttttacaccaactaacactggaccaggccgctcggccacaggaaacacaggaagggcttcaaagagagctcgggacattgcgcagagagagagaccaactcgaaactcagacccgagagctggaaaccgcctactctaatctgctcagggacaaatccgttctcgaggaggagaagaaaaggctcaggcaggaaaacgagaacctggctcggagacttgagagtagttctcaggaggttgcgcgactgcgtagagggcaatgtcctcagactcgtgacaccgctcgcgcagttcctcccggttccagggaggtgtccacctggaacctcgacacgctcgccttccaggaactgaaatccgagcttactgaggtccccgcatcacggattctcaaagagagtccctctggctacctgagaagtggggagggtgataccggatgtggtgagctggtctgggtcggagagcctctcaccctgaggactgccgaaactattaccggcaaatacggggtttggatgcgcgaccccaagccaacgtatccttacacccaggagacaacttggcggatcgatacggtaggcacagacgtccggcaggtgtttgagtacgatcttattagtcagttcatgcaggggtacccatcaaaggtgcacatccttccaaggcctctcgaaagcactggcgctgtagtctactccggctctctttattttcaaggtgccgagagccgcacagtgatcagatacgaactgaataccgagaccgtcaaagccgagaaggaaattcctggggctggctaccacggtcagttcccatattcctggggaggctatacagacatcgacttggctgtcgatgaggcaggactttgggtgatttattctacagacgaagccaaaggcgctatcgtactcagcaaactgaatcctgaaaatcttgagctggaacaaacgtgggaaaccaacatccggaagcagagtgtcgccaatgcgtttataatttgcggaaccctgtataccgtttcttcttacacgagtgccgatgcaacagttaactttgcatatgatactggcacggggatttccaagaccttgacgatcccattcaagaatcgctacaaatatagttccatgatcgactacaatccattggagaaaaagctttttgcatgggacaatctgaatatggtcacttatgacataaaactctccaagatgtag

SEQ ID NO: 231487 - DNA, 1374 bp, Artificial Sequence
  Description of Artificial Sequence: Synthetic coding sequence
atgagattcttctgtgcaagatgctgcagctttggtccagagatgcccgctgtacagctgctgttgctggcctgcttagtatgggatgtcggcgcacggacagctcagctgcgcaaagccaacgatcagagcggaagatgtcagtacactttcagtgtggcgtccccgaacgaatcatcttgccctgaacagagtcaggctatgtcagtcattcataaccttcagagagactcctcaacacagcgcctcgacctggaagccactaaagcacgcctttccagcctcgagagtctgctaagagacaaatctgtgcttgaggaagagaagaagcggctacggcaagaaaatgaaaatcttgcccgacggctcgaaagcagttcccaagaggtggcccgtctcaggagaggtcagtgcccccagactagggacaccgcaagagcggtcccaccagggtccagggaggtctccacgtggaatctcgacaccttggcctttcaggagttgaagagcgaactgacagaggtccccgcaagccgcattttgaaagaatccccttccggctatttaaggagtggcgaaggcgatacaggctgtggcgagcttgtgtgggtgggcgagcccctaactcttaggacggctgagactataactggtaaatacggggtttggatgagagacccaaagcctacctatccatacacgcaggaaacaacgtggcgaatcgataccgtcgggacggacgtaagacaagtgtttgaatacgacctgatctcgcagttcatgcaggggtacccgtctaaggtgcacattcttcccagaccactcgaatcgaccggtgccgtggtgtatagcggttccttatacttccagggggctgaaagtcgaacagtgattcgctatgagctaaacactgagaccgtaaaggcagaaaaggagattcctggggctggctaccatggccagtttccgtatagttggggcggatatacagatatcgacctggctgttgacgaagctggtttgtgggtaatctatagcacagacgaggccaagggcgctatcgtccttagcaaactgaatcctgagaatcttgagctggaacagacctgggaaaccaacatccgcaagcagtcagtcgccaacgctttcattatttgtggaaccctgtatactgtctcaagctacacttctgctgatgccactgtcaattttgcttatgacaccggcaccggcatctccaagacattgaccatcccctttaagaatcgctataagtattcgtctatgatcgattacaatcctcttgaaaagaaactgttcgcctgggataacctaaatatggtgacttacgacatcaaattaagcaagatgtag

SEQ ID NO: 231488 - DNA, 1314 bp, Artificial Sequence
  Description of Artificial Sequence: Synthetic coding sequence
atgtccgttatccacaaccttcagcgcgatagcagtactcaacgcctcgacctcgaagcgaccaaggcaaggctcagctctctggagagtctgctccatcaattgacattagatcaagctgccaggccacaggaaacccaggaaggcctgcagagggaactgggcacattgcgccgtgagcgtgatcagttagagactcagactagagagttagagaccgcctactccaatctgctgcgcgacaaaagcgtactggaggaggagaaaaagagactgaggcaggaaaatgaaaacctggccagacgactggagtcctcctcacaggaggtggcgagactgcggcgagggcagtgtccacagacaagagatactgctcgggctgtccctcctggcagccgtgaggtgtccacctggaatttggataccttagcgttccaggagttgaaatcagagctcacagaggtccccgcttctaggatccttaaagagagtcctagtggatacttacgatccggtgaaggggacactggctgtggcgagctggtgtgggtcggcgagccactgactctgcgcacggccgagacaatcacaggcaaatatggggtctggatgcgggatcctaaacctacctatccctatactcaggagaccacttggcgcattgataccgtggggacagacgtgagacaagtatttgagtacgaccttatctcacagttcatgcaggggtacccatcaaaggtacacatcctaccccgaccgttagaaagtactggagcagtggtttactcggggtctctttatttccagggggcagagtcccgcacggtcattagatacgaactgaatacagaaacagtgaaggcggagaaagagattcctggagcaggttaccacggacagttcccttattcctggggaggttacaccgacattgacctggccgtcgatgaggctggtctttgggtcatctacagcacggacgaagctaagggcgctatcgtgctgagcaaactgaaccccgagaatttagagctggaacagacttgggaaactaatatccggaagcagtcggtggccaacgcgttcatcatctgcggaactctctacactgtaagctcgtacacatccgcagacgctacggtgaatttcgcttacgacacagggaccgggatcagcaaaacactaaccatcccattcaagaatcggtataagtactctagtatgatagattacaaccccttagaaaagaagctattcgcctgggacaaccttaatatggttacctatgacattaagcttagcaagatgtag

SEQ ID NO: 231489 - DNA, 1035 bp, Artificial Sequence
  Description of Artificial Sequence: Synthetic coding sequence
atgcggtttttctgtgctcgctgttgcagcttcgggccagaaatgcctgctgtgcagctgctgctgctggcttgcctggtgtgggacgtgggggctcgcactgcccagctgcgaaaagccaacgatcagtcggggcgttgccagtatacctttagtgtggcatcccccaatgagagcagctgtcctgaacagtcacaggctatgagcgttatccacaatttgcaaagagactctagtacccagagactggatctagaggcaacaaaggcacggctgagtagtcttgaatcactgttgcatcagctgaccctggatcaagccgctaggcctcaagagacacaggaaggacttcagagggagctggggaccttgcgacgcgagagggaccagctggagacccaaaccagggagcttgagaccgcatacagcaacctcctccgcgataagtcagtcttggaggaggaaaagaagcgcctgcgacaggagaatgagaatctcgctcgtcggctggagtcaagctcgcaggaagtggcgcgactcagacggggacagtgccctcaaactagggatactgctcgcgctgtcccgccaggctcccgagaggtgagtacatggaacctggatactctggcgtttcaagagctgaagagtgagctgaccgaggttccagcgagccgaattctcaaggagtccccatccggctacttgagatcaggcgagggcgataccggctgcggggaacttgtctgggtgggagagcctctgaccttaaggaccgccgagacaatcaccgggaaatacggcgtgtggatgagggaccctaagccgacgtatccctatacccaggagacgacctggcgcatcgatactgtgggaacagacgtacgccaggtcttcgagtacgacctgatttcgcagttcatgcagggctacccaagcaaagtgcacatcttaccaagacccctagagtccaccggcgctgtggtctacagcggatctctgtattttcgagcgttgtctccagaactgtcctag

SEQ ID NO: 231490 - DNA, 1521 bp, Artificial Sequence
  Description of Artificial Sequence: Synthetic coding sequence
atgggcaggaaaaagatacagataacccgcattatggatgaaaggaatagacaggttaccttcaccaaacgcaaatttgggctgatgaagaaggcctatgaacttagtgtcctgtgtgattgtgagatcgcattaattatcttcaacagctccaacaagctctttcagtacgcgtccacagatatggacaaggtcctgctgaaatacacagaatataacgaacctcacgagtcacggactaattccgacatcgtggagaccctgcgaaagaagggactaaatggatgtgagagtccagatgccgatgattacttcgagcacagccctctaagtgaggatcgcttctccaagctgaatgaggacagtgacttcattttcaagaggggacctcccggtctgccccctcagaatttcagcatgagcgtcactgtcccagttacatcccccaacgccctttcctacactaacccaggctccagcctggtgagccctagtctggcagcatcttcaaccctgactgacagttccatgttaagtccccctcagaccacactgcacaggaacgtgagcccaggggctccgcagcgaccaccatccacaggaaacgccggaggaatgttgagtaccactgacctcacggtaccaaacggggctggcagctccccagtgggaaacgggttcgttaactcgagagcgtccccgaacctcattggcgctacaggtgctaatagtctgggtaaggtgatgccgaccaaatcaccaccaccgcctggcggaggaaacttaggaatgaactctcgcaagcctgacctcagagtggtcattcctccttcttccaagggcatgatgccgccattatatttgaagcggcaactgaacactaacaatactcagcggatctctagctcccaggctacccagcccctcgccactccggtggtaagtgtgacaacaccttcccttcctccccagggtcttgtatactcggcgatgcccacagcctacaataccgattattctctgaccagcgcagacctttccgccctccagggatttaattctccgggaatgttgagcctgggccaggtttccgcatggcagcagcatcaccttggacaggccgcactgtcatccttggtggccggaggtcagctgtctcaagggagcaatctaagtataaacacgaatcaaaatatttccattaaaagcgaacctatctccccccctagagacagaatgacaccaagtggctttcagcaacagcagcagcagcagcagcaacagcagcctccccctcccccacagccccaacctcaaccaccccagccacagcccaggcaggaaatggggagatctcccgtcgattcccttagtagcagcagtagtagttacgatggttctgaccgtgaagatccgcgtggagatttccacagccccatcgtccttggtcggccacctaatacagaggatcgtgagtctcctagtgtcaaacgtatgagaatggacgcctgggtgacctag

SEQ ID NO: 231491 - DNA, 1500 bp, Artificial Sequence
  Description of Artificial Sequence: Synthetic coding sequence
atggggaggaagaaaattcagatcacccggattatggatgagcgcaatcggcaagtaacttttaccaagcggaaatttggcctgatgaaaaaggcgtatgaactcagcgtgttgtgtgactgcgaaatcgcccttatcatatttaactcatcaaacaaactctttcagtatgcatctaccgatatggataaggtgcttctgaagtacaccgaatacaacgaacctcacgagtctagaactaattccgacatcgtggaagctctcaacaagaaggaacaccgcggatgcgattctcctgatcccgacacatcctacgtgcttacaccccacaccgaagagaagtataaaaaaatcaacgaggagtttgataacatgatgagaaaccataaaatcgcacccggtttgcccccacagaacttctcaatgagtgtgactgtgccagttacttcaccgaacgccctcagttataccaacccaggtagctccctcgtgagcccaagcctcgctgcaagtagcactctgacagactccagtatgctgtcaccaccccagactaccctgcaccgcaatgtgagtcctggtgctcctcagcgccctccatccaccggaaatgccggtggtatgttatctaccaccgatttgacagtccctaacggagccggttcttccccagtcggaaatggattcgtaaactcaagggcctcccccaacctgatcggcgctaccggcgcaaatagtctcgggaaggtgatgccaacaaagtcaccaccaccccctgggggtgggaacttgggtatgaacagtcgcaaacccgatctgcgagtcgtgataccccctagctctaaaggcatgatgccgcctcttaacactcagaggataagttcatcacaggccacacagcccttagcaacacctgtggtgagtgtgacaaccccttctctgcccccacaagggctggtctacagcgctatgccgacggcgtataacaccgattacagcttgacctccgccgatttgtctgccctgcagggattcaacagtccaggaatgttaagtctcggccaggtgtcagcctggcagcagcatcacctggggcaagcagctctgtcctcactagtcgccggaggacagctgtcccagggaagcaacctgagcatcaatacaaatcagaacatctcaattaaatccgagcccatttcacccccacgggatcggatgaccccatcaggattccagcaacagcaacagcagcagcagcagcagcagcctcctccaccccctcagccacagccccagccaccccagccgcagcctaggcaagagatgggcagatccccagtcgactcattaagttcaagctcatcatcatacgacgggagcgacagggaggaccccaggggggacttccactccccaattgttctgggcaggccccctaacactgaggatcgtgagagcccttctgttaagaggatgagaatggatgcttgggttacctag

SEQ ID NO: 231492 - DNA, 1290 bp, Artificial Sequence
  Description of Artificial Sequence: Synthetic coding sequence
atggggagaaagaagatccagattacacgtattatggacgagcgaaatcgccagactctccgcaaaaagggtctcaatggttgcgagtcacctgacgctgacgattacttcgagcacagtccgctgtctgaggatcgcttcagtaaactgaacgaagattccgacttcatcttcaaaagaggaccccctggcctgcctcctcaaaatttctcgatgagtgttaccgtcccggtcacttcccctaacgccctttcctacaccaacccgggttcttctttggtgtcccctagtttagccgctagctccacactcaccgatagctctatgttgagccccccacaaacaacactccatagaaatgtctcacccggagctccacagaggccgccaagtaccggaaacgctggagggatgttatcaaccaccgacctcacagtgccaaatggggctgggtcctcccccgtcggaaacggcttcgtcaatagtagggcctctcctaacctgattggtgctaccggagccaactccctgggtaaggtgatgcctacgaaaagccctccaccacccggtggcggtaatctcgggatgaatagtaggaaacctgacctcagagtcgtgataccacccagttcaaaaggcatgatgccacccttgaatactcagcggatttcatcatcccaggccacacagcccctcgctacccccgttgtttccgtaaccaccccctccctgccaccccagggattagtgtatagtgcaatgcctactgcatataacacggactacagtcttacatcagccgacttgtctgcgctccagggattcaattcccccggaatgttgagcctaggacaagtatccgcctggcaacaacaccacctgggccaggctgccctatcaagcctggttgcaggtggccaactttcccaggggagtaatctctctatcaatacaaaccagaatatctcgatcaaatcggaaccaattagcccgcctcgcgacagaatgactccctccggttttcagcagcagcaacagcaacagcaacaacagcagccacctccgccaccgcagccgcagccacagcctcctcaacctcagcccaggcaggaaatgggaaggagtcccgtcgatagtttaagtagttcttcatcaagctatgatgggagcgaccgggaggatcctaggggggacttccactcacccatcgtgttagggaggccacctaatactgaagatcgcgagtccccttccgtaaagcggatgagaatggacgcctgggtcacttag

SEQ ID NO: 231493 - DNA, 1494 bp, Artificial Sequence
  Description of Artificial Sequence: Synthetic coding sequence
atgggcagaaaaaaaattcagatcactcggattatggacgagcgcaatcgccaggtgactttcacgaaaaggaaattcggactaatgaagaaggcctatgagctgtcagtactctgcgattgtgaaatcgcacttatcatatttaactcttcgaataaattattccagtatgctagcactgatatggacaaggttctcctgaagtataccgagtataatgagccgcacgagtctaggaccaattccgacattgtcgaaactctgaggaagaagggtttgaatggctgcgaatccccagatgccgatgattattttgaacactctccccttagcgaggacagatttagtaaactaaacgaagatagcgattttatttttaagcgaggccctccaggcctgccccctcaaaacttcagcatgtccgtcaccgtcccggtaacctctccaaacgcgctgagctacacgaatccaggatcttctctggtatcaccatctctggccgcatcatcaacccttactgactcatcaatgctgtctcccccacagacaacgctgcaccgtaacgtgtctcccggagcccctcagagacctccaagcaccggcaatgcgggaggcatgctctccaccacagatcttacagttcctaatggggcagggtccagcccagtggggaatggctttgtgaactcccgagctagccccaacctcattggtgcaacaggggctaattctctgggcaaggtgatgcccaccaaaagtccccctccgcctgggggtgggaacctcggcatgaactcacgcaagcccgaccttagggttgtaattccacctagtagcaaaggcatgatgcccccactaaatacgcaacgcatcagttcctcacaggccacccaacctctggcaacaccagtggttagtgttacgactccctcactgcctcctcagggcctggtctatagtgctatgcctacagcctacaacactgattatagcctgacaagcgccgatctgtctgccctccaaggcttcaactcccccggaatgctttctctgggacaggtgtccgcatggcagcagcaccacctgggacaggccgcactgtccagtctggtcgctggagggcaattgtcacaggggtcaaatctctcaatcaacacaaaccagaacatttcaatcaagtctgaaccaatctctccccctagagacaggatgactccgtctgggtttcagcaacagcaacagcagcagcagcagcagcagccccctccccctccacagccccagccacaacctccccaaccccaaccccgtcaagaaatggggagatcaccggttgactctttatcttcaagtagctccagctacgatggctctgacagggaagatcccagaggtgattttcacagcccaattgttttggggagacctccaaatacagaggatagagaatcaccgtcagtgaagagaatgaggatggacgcctgggtaacatag

SEQ ID NO: 231494 - DNA, 1494 bp, Artificial Sequence
  Description of Artificial Sequence: Synthetic coding sequence
atgggtcggaaaaagattcagattactcgcattatggatgaaaggaaccgccaggtgacattcacaaaacgcaagttcggcctcatgaagaaggcctacgaactctccgtgctgtgcgattgcgaaattgcgctcatcatctttaactcatcgaataaactgttccagtacgcttcaacggacatggataaggtattactgaagtacacagaatataacgaaccccacgagagccgtactaactctgatattgttgagactctcaggaagaagggtctgaacggctgcgagtcccctgatgccgatgactactttgaacactcgcctctgtccgaggaccgtttcagcaagttgaatgaggatagcgactttatcttcaagcggggaccacctggattgcccccacaaaacttcagcatgagtgttactgttcccgtgacaagtccaaacgccctctcgtacaccaaccccggtagttcattggtgagcccaagcctcgccgcttcaagcaccctgacagactcctcaatgctctccccgccacagaccacactccatcgtaacgtctcccccggtgctccccagcgccctccctcaaccggtaatgctggaggcatgctcagtaccacagatctcacagtcccaaatggggctggctcctcaccagttggtaatggcttcgtcaattccagggcctccccaaatttaataggcgcaactggagcgaatagcctcgggaaggtcatgcctactaaatccccgcctcccccaggcggaggaaatctgggtatgaactcacggaaacctgacctgcgagtggtcatccccccatctagcaaaggcatgatgcccccattgaatacccagcgtatttcctcctcacaggctactcaacccttagctacacccgtagtgagcgtgacaaccccctccctgcccccacaggggttggtatattcagctatgcccactgcttataacacagattattctctgacttctgctgatctgagcgcccttcagggctttaactccccgggaatgctgtctctcgggcaggtgagtgcctggcaacagcaccacctcgggcaggccgctctgagttctctggttgccggtggccagctgtcccagggttcaaatctgtccattaacaccaaccagaacataagcatcaagagcgagccgatatccccaccacgcgacagaatgacaccttccgggttccaacagcagcagcagcagcaacagcagcaacagccgccacctccacctcagccccagccccagccaccgcagccacagccacgccaagagatggggaggtcgcccgtggattcactatcaagttcatcaagcagttacgatggctccgaccgcgaagaccctcgcggtgattttcattcccccatcgtgctagggcgaccccctaacactgaagacagggaatccccctccgtgaaacggatgaggatggacgcttgggtaacttag

SEQ ID NO: 231495 - DNA, 1518 bp, Artificial Sequence
  Description of Artificial Sequence: Synthetic coding sequence
atgggcagaaaaaaaattcaaataacccggataatggacgagagaaaccgccaggtgacatttaccaaaaggaagttcggcttaatgaagaaggcttacgagctcagcgtgctttgcgactgcgagattgcactgattatcttcaactcaagcaataaactgttccagtatgccagcaccgacatggacaaagtactgttgaagtacaccgaatataatgagccgcatgaatcccgcaccaactctgatatcgtagaaacattacggaaaaaggggttaaatgggtgtgagtcgcccgatgccgacgactacttcgaacactccccattgagtgaggacagattctcaaagctcaatgaggacagcgacttcatctttaaaaggggaccacctggcctgccccctcagaatttcagtatgtccgtcactgtgcctgtgacatctccaaatgctctgtcttacacgaacccgggttcttcactggttagcccaagccttgctgcttcgagcaccttgaccgactctagcatgctgtctccccctcagactaccttgcatcggaatgtgtcacccggtgccccacagagaccaccgagcaccgggaacgccggagggatgttgtccacaacagacctgacagtgcctaacggtgcagggtcatctcctgtgggaaatgggtttgtgaattcaagagcatctccaaatctcatcggtgccacaggagcaaattcccttggaaaggtgatgccaaccaaatctccccctccacctggtggcggtaatctcggcatgaattcaagaaagcctgacctgcgagtggtcattcctccgagctctaaaggcatgatgcccccattatccgaggaagaggaactggaactaaacacacagagaatttcttcatcccaagcaactcaaccactggccactcctgtggtgtccgtcaccacacccagcctgccccctcagggcctggtgtattctgccatgcccacagcttataatactgactattccctaacgtcagctgatttgtccgctttacaggggttcaactctcccggtatgttgagtctcggacaggtcagcgcctggcagcagcaccacctgggccaggctgccttaagcagcctagttgctggcggacagctctcacaagggtctaatttgagcatcaacactaaccaaaatatcagcataaaaagtgaacccatcagccccccacgcgatcgcatgacaccgtcgggtttccagcaacaacagcaacagcaacaacagcagcagccccctccaccaccacagccccagccacagccccctcagcctcagcccaggcaggagatgggtagaagccccgtcgatagcttatcatcgtctagtagctcttatgacgggtctgatcgggaggaccctcgaggtgattttcattctcccatcgtgctaggcagaccacccaataccgaggaccgcgaaagcccttccgtaaagcggatgcggatggatgcctgggtgacttag

SEQ ID NO: 231496 - DNA, 117 bp, Artificial Sequence
  Description of Artificial Sequence: Synthetic coding sequence
atgggaagaaagaaaattcagattacgcgcattatggatgagagaaaccggcaggtgacatttacaaaacgaaaatttggacttatgaaaaaagcatacgagctcagcgttctctag

SEQ ID NO: 231497 - DNA, 1314 bp, Artificial Sequence
  Description of Artificial Sequence: Synthetic coding sequence
atgggacgcaaaaaaatccagattacgcgcattatggacgagcgaaatagacagacgttgcggaagaagggactgaacggctgtgaatcacccgacgctgatgactatttcgagcattcccctctgagcgaagatcggtttagcaagctcaatgaggattccgatttcatatttaaacgcggacccccaggcctaccccctcagaacttctccatgagcgtcacagtgccggttacttcacccaacgccctgagctatacaaatccaggtagctctctcgtgtcgccatctctcgctgcgtcatctacgcttacagacagttccatgttgagcccaccacagaccactctccacaggaatgtctccccaggggctccgcagcgcccaccgtctaccgggaatgccggtggaatgctgtcaaccacagatctgactgtgcccaatggcgctgggagcagcccggttggcaacggatttgtgaactcccgggcatcgcctaatttgatcggagctaccggggcaaacagcctgggcaaggtgatgccaaccaaatctccccctcccccaggcggaggaaatctgggaatgaacagcagaaagcctgacctccgagtcgttattcccccttcttctaaaggcatgatgcctcctctgagtgaagaggaggaacttgaacttaatacacagcgcatatcatcatcccaggctacacagcccttagccacccctgtggtgtcagtaaccactccctccctcccgccacaaggactcgtgtattccgccatgccaaccgcctataacacagattactcattgacttcagccgatctgtctgctctgcaggggttcaactcaccaggaatgctgtctctgggtcaggtgagcgcgtggcagcagcaccatcttggccaggctgcactaagttcccttgtcgctgggggacagttaagccagggctccaacctatccatcaatacaaaccagaacatcagcataaaatccgaaccaatctcacccccacgagacaggatgaccccatcgggttttcagcagcagcagcagcagcagcagcagcagcagccgcctcctccaccacagccacagccccagccaccacagccacaaccccgtcaggaaatgggacgctcgccagtcgacagcctctcatctagcagctccagctatgacggaagcgatagagaagaccccaggggcgacttccatagtcccatcgttctaggcaggcccccaaataccgaggaccgcgagtcgccctctgtgaaacgcatgcggatggacgcctgggtgacatag

SEQ ID NO: 231498 - DNA, 234 bp, Artificial Sequence
  Description of Artificial Sequence: Synthetic coding sequence
atgggtcgaaaaaagattcagataacaagaattatggatgaacggaataggcaggtgacatttacgaaacggaaatttggtcttatgaaaaaagcctacgaactaagtgttttgtgcgattgcgagatcgcattaattattttcaattctagcaataagctgtttcagtatgcttcaactgacatggataaggttctgttaaaatacacggagtacaatgagccccacgaatag

SEQ ID NO: 231499 - DNA, 258 bp, Artificial Sequence
  Description of Artificial Sequence: Synthetic coding sequence
atgggtagaaaaaagatacagattacccgcataatggatgaacgtaatcgacaggtaacctttactaagaggaagtttggcttgatgaagaaggcctacgaactatccgtgctctgcgattgcgagatcgccttaatcattttcaacagcagcaacaagctgttccagtacgcctcaacagacatggataaagtgctacttaagtacaccgaatacaatgaaccacacgaatcccgcaccaacagcgacatcgtatag

SEQ ID NO: 231500 - DNA, 1107 bp, Artificial Sequence
  Description of Artificial Sequence: Synthetic coding sequence
atggggagaaaaaagattcaaatctctcgaatactggaccagcgcaatcgccaagtgactttcactaagagaaaattcgggctgatgaagaaggcttacgagttatcagtgctgtgtgactgcgagatcgccctgattatatttaactcagcaaacagactgtttcagtatgccagcactgatatggatcgcgtgttgctaaagtataccgagtacagcgagccccatgaatcccgaaccaatacagacattctcgaaacactgaaaagacggggtatcggccttgatgggcctgaactggaacctgatgagggcccagaggagccaggcgaaaaatttcgaagactcgctggcgagggaggcgacccagccctgcctaggccgaggctctatcctgcagctcccgctatgcctagtccagatgtggtctatggagcattaccccctcccggttgtgacccgtcagggctgggcgaagccctccctgcccaaagccggcctagtccattccgcccagctgcaccaaaggctggacctccgggtttggtgcacccactgttcagtccttcacacctcacctcaaagactccccctcccttatatctgccgactgaggggagacgctccgatttgcctgggggacttgcaggccctagggggggtctcaatacaagcaggtctttgtactcaggccttcaaaatccctgctccacagctaccccaggcccaccactcggcagctttccatttctgccaggaggtcccccagagtatggcctaggcgatcctccacctcccccagggctgctgcagcctccaacacttgctccttggcagccatccaggggagacggccctcctgccgtgtcctctcaaccgtctggcggtaggtccctcggagaagagggacctccaactagaggagcctccccgccaacccctccagttagcatcaaaagtgagcggctgtccccggctccagggggaccaggagattttccaaaaacatttccataccctcttctgctggcgcgatctttggccgaaccattgagacccggaccagcacttagacgcctgcccttagccgatggatggcctaggtag

SEQ ID NO: 231501 - DNA, 894 bp, Artificial Sequence
  Description of Artificial Sequence: Synthetic coding sequence
atgggccgaaaaaagattcaaatttcccgtatcctggatcagagaaatcgccaggtaacatttaccaaaaggaagttcggtctgatgaaaaaggcgtatgaattgtccgtgctgtgtgattgcgaaattgctctgatcatctttaacagcgccaacaggctgttccagtacgcatcaacagacatggacagagttctgctcaaatacaccgagtactccgagccacacgagagtagaacgaatacagacattctcgaggtgcctcagaccctgaaaaggagagggatcggcctggatggtccagaattggaaccggacgaggggccagaggaacccggtgaaaagttcaggcgccttgcaggggagggcggagacccggctctgcctagaccacggctgtaccccgcagcgccagccatgccttccccggacgtggtttacggtgcactgcccccaccaggctgtgatccctcaggcctcggcgaggccctcccagcacagtcccggcctagtccatttcggccagcagctccaaaagccggaccacctggactcgtacacccactcttttctccctctcatttgacctcgaagacccctcctcccctctatctgcctacagaggggagacggagtgatctgcctggagggctagccggacctcgtggtggactcaatacttctcgttcattatatagcgggctccagaacccctgcagtacagctacaccgggacccccattagggtcattcccctttcttccagggggacccccagagtatggattgggcgaccccccacccccacccggattgcttcagcccccaacactggccccatggcagccttcacggggagatggccctcccgctgtgtcgagccagccacgatag

SEQ ID NO: 231502 - DNA, 1107 bp, Artificial Sequence
  Description of Artificial Sequence: Synthetic coding sequence
atgggcaggaaaaagattcagatttctagaatcctggatcagcggaatcggcaggtcaccttcacaaagagaaaattcggcctgatgaaaaaggcctatgaactgtccgtgctgtgtgactgcgagatcgcactcatcatctttaattctgctaacagactctttcagtacgcttccacagatatggaccgggtgttgttgaaatacacagaatactccgagccgcatgaatccagaacaaatacagatattctggagacactaaaacgtcggggtatcgggctggacggacctgaactggagcccgacgagggacccgaagaaccgggagagaaatttcggaggttggctggggagggaggagatccagctcttcctagacccagactgtatccagccgctcccgctatgccatctccagatgttgtgtacggcgctctccccccaccgggttgcgacccctccggcctgggggaagctctccctgcacagagcagaccgagcccttttcgaccagcagcgccaaaggctggccctcctggactggtgcatcctctgttctcaccgtcccatctgacttccaagacaccacccccattgtacctgcccactgagggcagaagatcggacttgcccggaggtctggcagggccacggggaggtctaaacacatcccgctcactgtattccgggctgcagaacccctgttctaccgctacacctgggccaccgttgggctcttttccgttcttaccaggaggtccacctgagtatggactcggggacccaccgccaccccctgggttgttgcaaccccctaccctagctccttggcaacccagccgcggtgatggaccccctgccgtatcttctcaaccaagcggtgggaggtccttaggagaggagggacccccaacacggggagcctcccctccaacacctcccgtcagcatcaagtccgaacgcctcagccccgctccaggaggcccaggcgactttccgaaaacattcccttatcccctgctgttagctcggagcctcgccgagccactgcgacctgggcctgctctgcgacgtctgccgcttgccgatggttggccacgctag

SEQ ID NO: 231503 - DNA, 1098 bp, Artificial Sequence
  Description of Artificial Sequence: Synthetic coding sequence
atggggagaaaaaaaatccagatatccagaattctcgaccagcggaatcgacaagtcacgtttaccaaacggaagtttgggctgatgaaaaaagcatacgagctcagtgtactttgcgactgcgaaattgcactgatcattttcaacagtgccaacaggttgttccagtatgcatccactgatatggatagggtgctgctgaagtataccgaatacagcgagccacacgagtcccgtacaaacactgatattttggaaactcttaagcggcgaggcatcggccttgatggcccagaacttgaacccgatgaaggccctgaggaacctggagagaagtttcgacggctggctggagaggggggagaccccgcactgcccagacctcggctgtaccctgcggctcctgctatgccttctcctgacgtagtgtacggtgcccttccccctcctggctgtgatccttccgggctaggggaggctcttcctgcccaaagccggccatctcccttccggccagctgcccctaaggccggtcccccaggactggtacaccccctcttcagcccatctcacctcacatccaagacaccccctcccctctacctccctactgagggtcgcagatctgaccttcccggaggtctcgctggccctcggggtgggctgaacacttcaagatctctttattcgggcctccagaacccatgctccaccgccacaccaggcccaccactcggctctttccccttcttaccgggagggccaccagtgggagcagaagcctgggcacgaagggtccctcaaccggctgcccctccacgcaggccaccacagagcgcctctagtctaagtgctagtctccgaccccctggagcgcctgcaacctttcttaggccatcccccataccctgcagctctccaggaccctggcagtccctttgtgggctcggtcctccttgcgccggatgcccttggccaactgctggtcctgggagaaggtccccaggaggcacctctcccgagcgctctccaggaaccgcgagggccaggggggaccctacctctcttcaggcttccagcgagaaaacccagcagtag

SEQ ID NO: 231504 - DNA, 1392 bp, Artificial Sequence
  Description of Artificial Sequence: Synthetic coding sequence
atgggcagaaagaagattcagatcactaggattatggacgaacgaaatcggcaggtaacctttaccaaacggaaattcggccttatgaagaaggcctacgagctgagcgtattgtgtgactgcgagatcgcgctcattatatttaactcaaccaacaagctgttccagtatgctagtacggacatggacaaggtgctcctcaagtacacggagtacaacgagccccatgaaagtaggacgaactccgacatagtggaggccttgaataaaaaggagaataagggctgcgagagccccgatccagacagctcctatgccttaacccccaggactgaggaaaagtataagaagatcaacgaagaattcgacaatatgattaagtctcataaaatccccgctgtcccacccccaaactttgaaatgcccgtgtccatcccagtctcctcccataatagtctggtgtactccaatccggtctctagtctcggcaatcccaatttgctgccccttgcacatccctcgctgcagagaaactctatgtcgccgggtgtcacccatcgccctcctagcgccggaaataccggcggtttgatggggggtgacctcacctctggtgctggaaccagcgctggtaatgggtatggcaatcctcggaattcacctggactactcgtgtccccagggaacttgaacaagaatatgcaggcaaaaagccccccacctatgaacctcgggatgaacaataggaagcctgatcttcgagtccttattccacccggaagtaaaaataccatgcctagcgtgaatcaacgtatcaacaactctcaatctgcgcaaagcttggctacacccgtggtttccgtcgccactcccactcttccgggacaggggatgggaggatatccttccgcgataagcaccacctatggcaccgaatattctctgtcctccgctgacctcagcagtctgtcaggctttaatacagcctctgccttgcacctgggctctgtgacaggttggcaacaacagcatctgcacaatatgcccccatccgccctctctcaattgggtgcctgcactagcacccatctgtcccagagctcaaacctgagcctgccttctacccaatctctgaacataaaatcagaaccggtgtcacctccaagggaccgcacaacaaccccctctagatacccccagcatacccgccacgaagcaggaagatctcccgtggattctctttccagttgctcatcatcttacgatggtagcgatcgcgaggaccaccggaacgaatttcattctccaattggcctcaccaggccaagcccagatgaacgggaaagcccttctgttaaacgaatgcgactgagcgaggggtgggccacctag

SEQ ID NO: 231505 - DNA, 1422 bp, Artificial Sequence
  Description of Artificial Sequence: Synthetic coding sequence
atggggaggaagaagatccagataacacggataatggatgaacggaaccgccaggtgacttttactaaacgtaagtttgggcttatgaagaaggcctacgagctgagcgtgctgtgtgattgcgaaatcgctctgatcatctttaattccaccaacaaactgtttcagtacgctagcacagacatggacaaggtactgttaaaatatacagaatataacgaaccacatgagtcccgtacaaattctgacatcgtagagaccttacgcaagaaagggctgaacgggtgcgattcccccgaccccgacgctgatgactccgtgggccactctcccgagtccgaagacaagtacagaaaaataaacgaagatatagatcttatgattagcagacaacgtttgtgcgccgtaccaccacccaatttcgagatgccagtgtccatcccggtatccagtcacaacagtctagtttactccaatccagtgagttctcttggaaatccaaacctgctgccattggctcatcccagcttacagcggaactcaatgtcgcccggagtaactcatcgacccccatccgccggaaacaccggcggtcttatgggaggagacctgacatcaggagcaggaactagcgctggcaacgggtatggcaatccgcgtaattccccaggattgctggtttcgcccggtaatctgaataagaatatgcaggctaagtcccctcccccaatgaatttgggaatgaataacaggaagccagatctccgggttttgattccgcctggctctaaaaatacaatgccgagcgtcagcgaggatgttgacttgctgctcaaccagaggatcaataatagccagagcgcacagagcctcgcaacgcctgtggtgagtgtggctacacccacccttccaggtcagggtatggggggatacccatcagcaatttccaccacgtatggcacagagtactctctttcctctgcggacctctcgtccctgtctggtttcaacaccgcttctgccctccatctgggttccgttactgggtggcagcagcagcacttgcacaatatgcccccatctgcactctcacagctcggagcctgtacgtccactcatctgtctcagagtagtaatctgagcctgccttctacacagtccttaaatattaaatccgaacccgtgtcaccccctcgggaccgcaccacaactccgtccaggtatccgcagcacaccaggcacgaagccggtcgctcccccgtagattcccttagcagctgttctagttcttatgacggcagcgatagggaggaccatcgtaacgaatttcactcccctatcggcttgacaaggccctcccccgatgaaagggaatctcctagtgtgaagaggatgagactgtcagagggctgggccacctag

SEQ ID NO: 231506 - DNA, 297 bp, Artificial Sequence
  Description of Artificial Sequence: Synthetic coding sequence
atgggccgaaaaaaaattcaaattaccagaatcatggatgaacggaacagacaggtaactttcacaaaacgcaaattcggcttgatgaagaaggcctacgagctatcagtcctctgcgattgtgagattgcgctcattatcttcaattctacaaataagctgtttcaatatgcgagtactgatatggacaaggttcttctcaagtatactgaatacaatgaaccccacgagtctagaactaattccgatatcgtcgagacactgagaaagaagggattgaatggttgtgactcttag

SEQ ID NO: 231507 - DNA, 390 bp, Artificial Sequence
  Description of Artificial Sequence: Synthetic coding sequence
atggggaggaagaagatccaaatcacaaggatcatggatgaaaggaatcgccaggtgaccttcactaaaaggaagtttgggctaatgaagaaggcctatgaactgtcagttctgtgtgattgcgagatcgctctgatcattttcaactctaccaataagttgtttcagtacgccagcacagacatggacaaagtcttgctcaagtacaccgaatacaacgaaccacacgagagtagaaccaatagcgatatagtggagacacttagaaaaaaagggctcaatgggtgtgattcccctgaccccgatgctgatgacagcgtgggacactctcccgagtcagaggacaagtacaggaagatcaacgaagacattgatcttatgatcagttag

SEQ ID NO: 231508 - DNA, 264 bp, Artificial Sequence
  Description of Artificial Sequence: Synthetic coding sequence
atgggacgcaaaaagattcagatcactcgtattatggatgagaggaacagacaggtgacatttactaagcgaaaatttggcctcatgaaaaaggcctatgagttgtcagtgctgtgtgactgcgagatcgccttgattatttttaatagcacaaataaactgttccagtatgcaagcacagacatggacaaagtgttgttgaaatataccgaatacaatgaacctcatgaaagccgaacgaattctgatatagtggagacctag

SEQ ID NO: 231509 - DNA, 1422 bp, Artificial Sequence
  Description of Artificial Sequence: Synthetic coding sequence
atgggaaggaaaaagattcagattacaagaataatggatgaaagaaacaggcaggtgactttcactaagaggaaatttggcctgatgaagaaagcttatgaactgagcgtgctctgtgactgcgagattgcactgattatctttaattccaccaataaactgttccagtatgcaagtacggacatggacaaggtacttctgaagtacacggagtacaacgagccacacgagtctcggaccaactccgacatcgtggaaacactccgcaagaagggactcaatggatgcgactcgccggatcctgatgccgatgactctgtgggtcactcccctgagtctgaggacaagtatcgaaaaatcaatgaggacattgatctgatgattagtaggcagcggctgtgtgcagttcctccccctaatttcgagatgcccgtttccatacccgtttctagccacaattctctcgtgtacagtaaccccgtgtccagcctgggcaatccaaaccttctgcccttggcccaccccagcctgcagcggaatagcatgtctcctggggttacccataggccacctagtgccggaaacacaggcggactcatgggcggtgacctcacctcaggagcaggaacatcggccggtaatggatatgggaatcctagaaacagccctggtctcttagtatcccccggaaacctaaataaaaacatgcaggccaagagccccccaccaatgaacctgggaatgaacaatcgaaagcccgacctgcgggtgctgatccctccagggagcaaaaacactatgccgtctgtggtcattcagaactatatcttaaagaatcaacggattaacaactcacagtcagctcagtctctcgccacgcctgtggtttctgtggcaactcctactttacccggacagggcatgggaggatatccttccgcaatctcaactacctacggcactgaatactctctgtcatccgccgatctgagctccctcagcggttttaatacagcctcggccctgcatcttgggtcggtgactgggtggcagcagcaacacctacacaacatgcccccaagcgcactgagccagctcggagcctgtacgagtactcatctgtcccagagctccaatttgagcttacctagcacccaaagcctcaacataaaatccgaaccagtatctccacccagagatcggaccacgactccctcccgttacccccagcatacccgtcacgaagcaggcagaagtcccgtggactcccttagctcctgtagcagttcttacgatgggtccgacagagaagaccacaggaacgaatttcattcccccattggactgaccaggcctagtcccgacgaacgggaatctccttcagtcaaaaggatgcgccttagcgaggggtgggccacatag

SEQ ID NO: 231510 - DNA, 684 bp, Artificial Sequence
  Description of Artificial Sequence: Synthetic coding sequence
atgggacggaaaaagatccagataacccgtatcatggacgaacgaaacagacaggtgacattcaccaaaagaaagttcgggctgatgaaaaaggcttatgagctgagtgtgctatgcgactgcgagatcgctctgatcattttcaactctactaataagttattccagtatgcgtccacggatatggacaaagttctcctgaagtataccgaatataatgaaccacacgagtctcgtacaaatagcgatatcgtggaagctctcaataaaaaggaaaataaggggtgcgaaagccccgatccagattcaagttatgccttgacgccacggactgaggaaaaatataaaaaaataaatgaggagtttgataacatgatcaaatcacacaaaattccagccgtgcctccgcctaattttgagatgccggtcagcatccccgttagcagccacaattctctggtatactccaacccggtgtcctcactcggtaacccaaacctgctccccctggcacacccctccctgcagcgcaactccatgtccccaggggtcactcatcggccaccttctgcaggaaacaccggcggactaatggggggagacttgactagcggagcgggtactagcgctggtaatggatatgggaatcccaggaattcacccggactgctcgtttctccttag

SEQ ID NO: 231511 - DNA, 363 bp, Artificial Sequence
  Description of Artificial Sequence: Synthetic coding sequence
atgggcaggaaaaagatccagatcacacgaattatggatgagagaaataggcaagtaacttttaccaagagaaaatttgggctcatgaaaaaggcttatgagctgtccgtgctgtgtgattgtgagatcgcccttatcatctttaattcgaccaataaattgttccaatatgctagcacagacatggataaggtgctgctgaaatataccgaatacaatgagccccatgaatccagaaccaactcggatattgtggaagccctgaataagaaagaaaataaaggatgtgagagcccggaccctgactcaagctatgccctcacccccagaaccgaggagaaatacaaaaagattaatgaatag

SEQ ID NO: 231512 - DNA, 381 bp, Artificial Sequence
  Description of Artificial Sequence: Synthetic coding sequence
atgggtagaaagaaaattcaaattacaaggataatggacgagcgcaaccgccaagtcactttcactaaaaggaagtttgggttgatgaagaaggcgtacgagctgtccgttctgtgtgactgcgagatcgctctgattatcttcaactctacaaacaaattgttccagtacgcgtcaaccgacatggacaaggtactccttaagtacacagagtataacgaaccccacgagtcccggaccaattccgacattgtggagactttgaggaagaaaggtctcaatggctgtgattccccggacccagatgcagacgactctgtcggccactcccctgagagcgaggacaagtacagaaaaatcaatgaggatatagacttatag

SEQ ID NO: 231513 - DNA, 87 bp, Artificial Sequence
  Description of Artificial Sequence: Synthetic coding sequence
atgggtcgcaaaaagattcagatcaccaggattatggacgagcgcaatagacaggtgacattcactaagagaaaatttggattgtag

SEQ ID NO: 231514 - DNA, 1398 bp, Artificial Sequence
  Description of Artificial Sequence: Synthetic coding sequence
atggggcgaaagaaaatccagattactcgcattatggacgaacgaaaccggcaagtgacatttactaagcgcaaatttggtctgatgaagaaagcttacgagctgagcgttctgtgtgactgtgagatcgctttgatcatatttaacagcacaaataagctgttccagtacgctagcacggatatggataaagtgttgctgaaatacacggagtataacgagcctcacgaatctcgaaccaactctgacatcgtcgagacactgagaaagaaggggctgaacggctgcgatagccctgacccagacgccgacgattctgtcgggcacagccccgaatccgaagacaaataccgtaagattaacgaagacattgacctgatgatttcacgtcagagactgtgcgctgtgccacctcctaacttcgaaatgcccgtttctatcccagtctcaagccataattcgctcgtctactccaatccagtgtccagccttgggaaccctaatttactgcctcttgcgcacccatccttgcagaggaattctatgagtcctggggtaacacaccggccacctagcgctggaaacacggggggtctgatgggcggtgacctcacaagtggcgctggtacatccgcgggaaatgggtatggcaacccacgaaattcccctggactgctggtatccccgggaaacttgaacaagaatatgcaggcgaagtccccacctcccatgaatctcggcatgaacaatagaaaaccggatctgagagtcttgatcccccctgggtcaaaaaacactatgccctccgtcaatcagcggatcaataatagtcagtccgcacaatccctggccacaccagttgttagcgtggccacccccacattgcctggacagggcatgggtggataccctagtgctatttccaccacttatggtaccgagtatagtctaagctcagcagacctgagcagtctctccgggttcaacacagccagcgccctgcatctgggctccgttacgggctggcagcagcaacatctgcacaacatgccaccatcggcgctgagccaactgggcgcatgcacaagcacacatctgagccagtctagcaacctgtcccttccctctacacagtccctcaacatcaaatctgaacctgtgtccccacctcgtgaccggacaactacgccttcacgctacccccaacacacccggcatgaagcaggcagaagtccagtggatagtctcagtagctgttcttccagctatgatgggagcgatcgtgaagaccatagaaatgagtttcatagcccaatcgggctgactcgccctagccctgacgagcgcgagagcccctctgtcaaacggatgcgtttatcagaaggctgggcgacatag

SEQ ID NO: 231515 - DNA, 729 bp, Artificial Sequence
  Description of Artificial Sequence: Synthetic coding sequence
atgggtaggaaaaaaatacagatcacaaggattatggatgagcgtaaccggcaggtgaccttcactaagaggaagttcggccttatgaagaaggcgtatgaacttagtgtgctgtgcgattgtgaaatcgcactgatcatattcaattcaacgaacaaactcttccagtatgcaagtacagacatggacaaggtactgctgaaatacaccgaatacaatgaacctcatgagtcaaggacaaacagtgacatcgtggaggctcttaataaaaaggaaaataaagggtgtgaaagtcctgatccagactcctcttatgcgctcacgcctcgcaccgaagaaaagtataagaaaatcaatgaggaattcgataacatgatcaagtcacacaagatccccgcagtaccaccccctaatttcgagatgcctgtctctatccccgtgtctagccacaacagcttagtgtactccaacccagtttctagcttaggtaaccccaatctgctcccgctcgcacacccaagcctccaacgcaatagcatgagcccaggcgtcacccataggccacctagcgctggtaacacaggaggactgatgggaggcgatttgacttcaggagctggtacaagcgcaggaaatggatatggcaacccacgcaactcacctggtctgcttgtgtctcctggaaatctcaacaaaaatatgcaggccaagagccctcccccaatgtag

SEQ ID NO: 231516 - DNA, 1326 bp, Artificial Sequence
  Description of Artificial Sequence: Synthetic coding sequence
atggggaggaagaagattcaaataaccaggatcatggatgaacgcaacagacaagtgacttttaccaaacggaagtttggcctcatgaagaaagcatatgagctcagtgtcctgtgcgactgtgagatcgcgttgattattttcaatagcacaaataagctgttccagtacgccagtacagatatggataaggtgttattgaaatacactgaatataacgagcctcacgaaagcaggacaaatagtgatatcgtggaaacactgaggaaaaagggactgaacggatgcgatagccctgaccccgatgcggatgactctgtgggccattcaccagagagcgaggataagtaccgcaagatcaacgaggatatcgacctcatgattagccggcagaggctctgcgccgtgccgccacccaattttgaaatgccggtctctatacctgtgtcttcacacaactctctggtctattccaaccccgtaagcagtttggggaaccccaacttgctccctttggcccatccatctctgcagagaaattccatgagcccaggggtcacgcatcggcctccctcggcaggcaacacagggggtctcatggggggagacttaaccagtggagccggtacttcagctggcaatggttatggcaacccccgtaatagccccggtcttctggtgtctcccggtaatttgaataagaacatgcaggccaagtccccaccacccatgaatttagggatgaataacaggaaacccgatctgcgggttctgataccacctggaagcaagaacactatgcccagtgtgtctgaggatgtcgacctccttttaaatcaaaggataaataacagccaaagtgcgcaaagcctggcaacacccgttgtcagcgtcgcaaccccaaccctcccgggtcagggtatggggggatacccaagcgccatatcaacaacatatgggacagaatacagcctgtcttctgctgatttaagttcactgtcagggttcaatactgcctctgctctccacctcggatccgtaacaggctggcagcagcagcatctgcacaatatgcccccatctgctttgtctcaactgggtgaccggacaacaacaccttccaggtacccacagcacactcgccatgaggcaggcaggtcccccgtagacagtctgtcatcttgttcctcctcatatgacggctctgatcgagaggaccacaggaatgaatttcactcacccatcggtttgacgagaccctctccggacgaacgggaaagtcctagcgtgaaacgaatgcgactgtcagaggggtgggctacgtag

SEQ ID NO: 231517 - DNA, 1422 bp, Artificial Sequence
  Description of Artificial Sequence: Synthetic coding sequence
atgggtaggaagaagattcaaattacacgaatcatggatgaacggaaccggcaggtgacatttaccaagcgtaagttcggcctgatgaagaaggcatacgaattgagcgttctgtgcgattgtgagatcgccctcatcatcttcaattccacaaataaacttttccagtatgcctcaaccgacatggataaagtccttttgaagtacacagaatataacgaaccacatgagagcagaacaaacagcgacattgtcgagactctcaggaagaaaggtctgaacggatgcgatagcccagatccagatgccgatgattctgtcggtcactcacccgagagtgaagataaatacagaaagatcaacgaagacattgacttaatgatctcccggcagcgactgtgtgcagtgccaccccctaattttgaaatgccagtgagcattcctgtgtctagccacaactccctggtgtatagcaatcccgtctctagtcttggcaaccccaacctcctcccccttgcccacccctcactacaaagaaactccatgagccccggagttactcaccgcccaccttcagccggaaacactgggggactaatggggggtgacctaaccagcggagcaggcacttccgcgggtaacgggtatgggaatcccagaaactccccaggtctgcttgtgagcccagggaatctgaataaaaatatgcaggctaagagcccccctccaatgaacttaggtatgaataaccgcaagcctgacctgcgtgtgctgatcccacccggatctaagaacacaatgccctctgtgtccgaagacgtggatctcctgttgaatcagcgcataaataatagtcagtcagcccaatccttggctacaccggtggtctctgttgcaacccctacactgcccggacaaggcatgggcggttaccccagcgctatctcaaccacctacggtactgaatacagtttaagctccgccgatctaagcagtctgagcggctttaatacagcctctgcgctccacttaggctctgtgacggggtggcagcaacagcacctccacaacatgcccccttctgccttatcccagctcggcgcatgcacgtcaactcatttaagtcaatcaagcaacctatcactaccctctactcagagcctaaatataaagtctgagcccgttagtcctcctcgggataggacaaccaccccatcccgctacccccaacataccaggcacgaggcgggtcgatccccggtggatagcttgtctagttgctcctcctcctatgatggctccgatagagaagaccacaggaatgaattccatagccccattggccttactagacccagccccgatgagcgagagtctcctagcgttaagaggatgagactttcagagggttgggcaacctag

SEQ ID NO: 231518 - DNA, 1254 bp, Artificial Sequence
  Description of Artificial Sequence: Synthetic coding sequence
atgggccgaaaaaagattcagatcacacgtattatggacgagagaaaccgacaggtgaccttcactaaacggaaattcgggctcatgaagaaggcctatgaactgtcggttctgtgtgactgcgaaattgctctcataatctttaactccacaaacaaacttttccagtacgctagcaccgatatggacaaggttctgctgaagtacaccgaatacaacgagccccacgagagccgaacaaacagcgacatcgttgaagccgtcccccctcccaattttgaaatgcctgtctcaattccagtgtcatcccacaattctctagtgtactcaaatccggtctcatcactgggcaatcccaacctgctcccgctcgcccacccgtctttacagaggaattcaatgtcaccgggtgtgactcaccggccaccaagcgctggcaatactgggggtctgatgggtggggacctgacctccggtgccggaacgtcagcaggcaacggatacggaaatcccaggaactcacccggtcttctcgtgtcccccggtaatctgaataaaaacatgcaagctaagagtccacctccaatgaatctgggtatgaacaaccgcaaacctgatctacgggtcctaatcccacccggttcaaaaaatacaatgcccagcgttaatcagcgcatcaataatagccagtcggcacagtccctggctacgcccgtggtttctgtggcgacgcctacgctgccaggtcagggcatggggggttacccctccgccatttccaccacatatgggaccgagtattcactgagttccgccgacctgtcatccctgtctggctttaataccgcttctgcgttgcacttaggatcagtaaccggatggcagcaacagcacctccacaacatgcccccatctgctcttagccaattaggagcatgcacgtcaactcacctcagccaatccagcaatctcagcctgccttccacccagtctctcaatataaagtccgagccagtctcccccccacgggacagaacaacaaccccttctaggtatccccagcatacaaggcatgaagctggcaggagccctgtggactccttgtcctcttgcagctccagctatgacggaagcgaccgtgaagatcacaggaatgaattccatagcccaattggactgaccagaccttctcctgacgagcgtgaatcaccatccgttaaacgcatgcggctgtctgagggatgggcaacctag

SEQ ID NO: 231519 - DNA, 1452 bp, Artificial Sequence
  Description of Artificial Sequence: Synthetic coding sequence
atgggaaggaagaagatccagatcactcgcatcatggatgagcggaatcggcaagtgacttttaccaagaggaaattcggtctgatgaaaaaggcatacgagctgtccgttctctgtgactgcgagatcgccctaattattttcaactcgacaaataaactcttccagtatgcatccaccgatatggacaaggtgcttctcaaatacacagagtacaacgagcctcacgaatccaggaccaactctgacatcgtggagactctcaggaaaaagggacttaacggctgcgatagtccggatcccgacgccgacgacagcgctctgaacaagaaggagaacaagggatgcgaaagtcccgacccagactcctcatacgctctgacacccagaaccgaggagaaatacaagaaaatcaatgaagaatttgataatatgatcaaatctcacaaaatccccgctgtgcccccaccaaacttcgagatgcctgtgtccatccctgtctcttctcacaacagcctggtctactcaaatcccgtatcttccctgggaaatcccaacttgttgcctctcgcacaccctagcctgcagcgcaattcaatgtcccctggcgtaactcaccgcccaccctctgcaggtaacaccgggggattgatggggggtgacctcacaagtggcgcaggcacatccgcaggaaatggctacgggaacccgagaaactcacccggactactggtatccccaggcaacctgaataagaatatgcaggccaagagtcccccaccaatgaacctggggatgaataacagaaagcctgacctacgggtgctgattcctcctgggtcaaagaatacaatgccgagtgttaatcaacggataaacaacagccaaagtgcccagagcttggccactcctgtggtgtcagttgccacaccgacacttccaggacagggaatggggggatatccgagcgctatctccacaacatacgggacagagtattctctgtcctccgcagacttgagttcactctccggattcaatacagcttcggcacttcacctcggctcagtgacgggttggcagcaacaacacctgcataacatgcctccatctgccctgagccagcttggggcatgtactagcacccacttatctcagtccagcaacctaagccttccatccacccagtctttgaacatcaagtcagagccggtcagccctccccgagaccgcacaacaactccctcccggtaccctcagcatacaagacatgaggcgggtcggtctccagtggatagcttgtccagttgttcctctagttacgacggatcagaccgggaggatcaccgtaacgaattccattcccccatcgggctgaccaggccatcccccgacgagcgggaaagcccaagtgtaaaaaggatgcggctttctgaagggtgggccacctag

SEQ ID NO: 231520 - DNA, 1563 bp, Artificial Sequence
  Description of Artificial Sequence: Synthetic coding sequence
atgggacgcaaaaaaattcagattcagagaataaccgacgagagaaatcggcaggtgacctttaccaagcgtaagtttggcctcatgaaaaaagcctacgaactgtctgtactatgtgactgtgaaatcgctttgatcatcttcaatcattccaataaattgtttcagtatgcctcgactgacatggacaaggtcttgctaaagtacacagaatataatgagccacacgagtcacgcaccaacgctgacattatcgaggccctccataaaaaacacagggagtgtgagagccctgaggtggatgaggtgttcgccctgaccccacagacagaagaaaagtacaagaaaatcgacgaagaattcgacaagatgatgcaatcataccgcctggcctccacagtgccggctcctaatttcgcgatgcccgtgacagtccccgtgagtaaccaatcatccctccagttctctaatcccagtggaagccttgtgacaccatcactcgttactagctcacttaccgatcccaggcttctgtcaccacagcagcctgcactgcagcggaattcagtctcccccggactgccacagagacctgccagcgccggagccatgcttgggggtgatctcaatagtgcaaatggggcttgtccctcccccgtcgggaatggctatgtaagtgctagagcctcccctggactcttaccagtggccaacggcaatagtcttaacaaagtgataccagcaaagtcacctcctccacccacgcactcaacacaactaggggctcccagtagaaagccagatttacgcgttattacctcgcaagcgggaaaggggctgatgcaccatctgaccgaggatcacctggatctgaacaacgcacagagacttggcgtatctcaaagtacccactctctaactacccccgttgtgagtgtggctacaccctcactgctgtcacagggcctgccttttagttcgatgccgactgcctacaacaccgactaccagcttacttcagccgaactgagtagccttcccgcatttagttcacctggcggtctgtctctgggaaacgtgacagcttggcagcagccccagcagccacagcaaccccagcagcctcagccacctcaacagcagcctccccagcctcagcagccacaaccccaacagccccagcagccccaacagccgccacagcagcagtcacatctggtgccagtctctctatccaatttaatccctggatccccgctgccacacgtgggcgcagcgctgacggtgactacccacccgcatatttcaattaagagcgagccagtgagtccgagccgcgagcggagtccagccccaccccctccggcagtattccccgcagcccgtccagaacccggagacggcctgagttcacctgcgggtgggtcctatgagactggagatcgagatgacggcaggggcgacttcggtcccacacttggcctgttgaggcctgctcctgagccagaagcagaagggtccgcggtgaaaaggatgcggctggatacttggactctaaagtag

SEQ ID NO: 231521 - DNA, 1566 bp, Artificial Sequence
  Description of Artificial Sequence: Synthetic coding sequence
atgggaagaaaaaagattcagatccagagaataacggacgagcgtaatcgacaggtgactttcacaaagcgaaaatttggcctgatgaaaaaggcatacgagttgtccgtgctgtgcgactgtgagattgcactcatcattttcaatcacagtaacaagctgttccagtatgccagcaccgatatggataaggtgctcttgaagtataccgaatataatgaaccacacgagtccaggacaaacgcagacatcattgagaccttacggaagaaaggatttaacggctgtgacagtcctgagcccgacggggaggattcactcgaacaatcccctctgctagaggataagtacaggagggcgtcggaggaactggacggactatttagaagatatggtagtaccgtgccggcaccaaatttcgccatgccagtgactgtgcctgtgagcaaccaatcttctttacaattctcgaatccctccgggtccctggtcacacccagccttgtgacctcaagccttaccgaccctcggctcctgagcccgcagcaacctgcactgcaacggaactccgtcagccccggactgccccaaaggcctgcgagcgccggagccatgctgggcggagacctgaactccgccaatggagcttgtccatccccagtggggaacgggtacgtgagcgccagagcaagtcccggtttgttgccagtcgccaacggaaactcactgaataaggtgattccggctaaaagccctcctccacccacacactccacacagttaggagcaccaagtagaaaacccgacctgcgtgtgatcaccagccaagcgggtaaaggcttaatgcaccatttgacggaagatcatctcgacttgaacaacgcgcagcggctcggcgtcagccagagcacccactccttgacaactcctgttgtcagtgtcgcaaccccatcactccttagccagggactgccattttcctccatgcccactgcctataacactgattatcaacttactagcgcagaactctcctctcttcccgctttctccagccccggaggcctaagcttaggaaatgttactgcttggcagcagccccagcagccacagcagccccaacaaccacagccaccccagcagcagccccctcagccgcaacagccgcagccccagcagccacagcagccccaacagcccccacagcagcagtcccatctggtgcccgtgagcctttcaaacctgatccccggttcccctttaccacatgtgggggctgccctcacagtgactacgcacccacatatctctatcaaatctgagccagtgtctcccagtcgcgagcggagtcccgctcctcccccaccagctgtcttcccggctgccagacccgaacccggtgacggtctgagtagccctgccggtggtagctacgaaacaggcgacagggacgatggcagaggggatttcggtcctacacttggcctgttaagacccgcacccgagccggaggccgaggggtcagcagtcaagcgcatgagactggatacatggaccctcaagtag

SEQ ID NO: 231522 - DNA, 1428 bp, Artificial Sequence
  Description of Artificial Sequence: Synthetic coding sequence
atggggaggaagaaaatacagatccagcgaataaccgatgagcgcaatagacaggtcaccttcaccaagcgaaagtttggcctgatgaagaaagcctacgagttgtcagtgctgtgcgattgcgagatcgccctcatcatcttcaatcactccaataaattgttccaatacgcctccacagatatggacaaggtcctactgaagtacactgagtataacgagccccacgaaagtcggaccaatgccgatatcattgagagtacggttcccgcacccaactttgcaatgcccgtgaccgtgcctgtgtctaaccaatccagcctccagttttcaaacccttctgggtccctagtcactccctcgctggtcaccagctccctgaccgatccaaggctgctatcgccacagcaacctgctttacagaggaattctgtatcgcccggactgccccagcggcctgcctccgcgggtgcaatgctgggcggagacctgaattccgccaacggtgcctgtcctagccctgttggcaacggctatgtttcagcccgtgcctcacccggattactccccgtggctaacggaaactctctcaacaaggtgattcccgcaaaaagtccacccccacccacccattcaacacaactcggagcaccttcgcgcaaaccagatctccgcgtcataacatcccaggctgggaagggcctgatgcatcacctgacagaggatcacctcgacctcaacaatgcccaacgtctcggggtgagtcagtccacccactctctaacaactcctgtcgtctccgtcgcaacacctagtctccttagccagggactgcccttctcttcgatgcctaccgcttataatactgactaccaactcaccagtgccgaactgtccagcctgccagccttttctagcccgggtggtctcagcctgggaaacgtgacagcctggcagcagccacagcaacctcagcagccacagcaaccacagccccctcaacagcagccccctcagccccagcagcctcagccacaacagccccagcagcctcaacagcctccacagcaacaaagtcacctagtgcctgtaagcctcagcaacctgattcctgggtcccctctcccacatgttggcgcagccctcaccgtaactacacatcctcacataagcattaagtctgaacccgtgtctcctagcagggagcgttcgccggctccaccaccaccagccgtttttccagctgcacgtcccgaacccggtgatggactgtcctcacccgcaggagggagctatgaaaccggagaccgggacgacggtaggggcgatttcggccctacattaggtctcctgcgacccgcaccagagcctgaggcagagggatcggccgttaagcgcatgagattagacacctggactctcaagtag

SEQ ID NO: 231523 - DNA, 1545 bp, Artificial Sequence
  Description of Artificial Sequence: Synthetic coding sequence
atgggcaggaaaaaaattcaaatccagcggatcacagacgaaaggaatagacaagtgacgttcacaaagcgcaagtttggtcttatgaaaaaggcctacgagctcagtgttctgtgcgattgcgagattgcccttatcatattcaaccactccaacaagctgttccagtacgcttcaacagatatggacaaagtgctcttaaaatatactgagtacaatgaacctcatgagtccaggacaaatgcggatataattgagacacttcggaagaagggcttcaacggctgtgattcgccagaacctgacggcgaagattccttggaacagtccccactgctggaagataaatacaggcgggcatctgaggaactcgacggacttttccgtaggtacggcagcaccgtgccagcacccaatttcgccatgcctgttactgtccctgtcagtaaccaaagtagtcttcagttctcaaatcctagtgggagcctggtgaccccatctttggtgacttcctccctgactgatccacgcttgctctctcctcaacagcccgctttgcagcgtaatagcgtgtcgccagggctgccccaaagacccgctagtgctggagccatgttgggcggagatctgaacagtgcgaatggtgcctgtccgtcacctgtgggtaatggatacgtctcagccagagcctcccccggactgctgccagtagctaatgggaactctctcaacaaagttattcccgctaagagcccccctcccccaacacattccacacaactcggtgccccatcacgaaagcccgacttaagagtaataaccagccaggctggcaagggactgatgcaccatctgaataatgcacagagacttggggtgagccagtctacacatagtttaaccacacccgtcgtgtctgtggccactcctagccttctctcacaggggctgccctttagttctatgcccactgcttacaacactgactaccaattgacttctgcggaattatcttccttgcctgcctttagcagcccaggtggcttgtcgctaggcaacgtcactgcctggcagcagcctcagcaaccacagcaaccacagcagcctcagcccccacagcaacagcctcctcaacctcagcagccacagccccagcaaccacagcagccacagcagccccctcagcagcaaagccatctggtgccagtgtcactcagtaacttaataccaggctcaccgcttcctcatgtgggcgctgcgctcactgtaaccacgcaccctcatatctctattaagagcgagcccgtgagcccatcacgcgagcgttctcccgctcctccacctcccgctgtgttccctgcagctcgccctgaacccggagacggactcagttctccagctggtggatcttacgagaccggagatcgtgacgatggcaggggcgacttcggaccgaccctggggctgctgagacctgctccagagccagaggccgaggggagtgcggtgaagcgtatgagactggacacttggactctgaagtag

SEQ ID NO: 231524 - DNA, 1545 bp, Artificial Sequence
  Description of Artificial Sequence: Synthetic coding sequence
atggggaggaaaaaaatacagatccagcggataactgatgagagaaatagacaggtaactttcactaaaagaaagttcggcttaatgaagaaggcatatgaactgtctgtgctgtgtgactgcgaaattgctcttatcatatttaatcactcaaataaactgtttcaatacgcgagtacagatatggataaagttctgctcaaatacaccgagtataacgaaccccatgagtcacgcacaaatgcggacatcattgagacccttaggaagaaaggattcaacggttgcgattcccccgaacccgatggcgaggattccctcgaacaatccccgctgctggaagataaatataggagagccagcgaggaactagacggcttatttcggagatacggaagcacagtacctgcaccaaattttgcaatgccagtcactgtccccgtcagcaatcagtctagcctacagttctcgaacccctccggcagtctcgtaaccccaagtctcgttacaagctcattgacagacccccgtcttctgagtcctcagcagcccgcattgcagcggaatagtgtgagccccggacttccacagaggccggcttctgccggtgcgatgctgggtggcgacttgaattcagctaacggcgcttgtccatcccctgtcgggaatggatatgtgtccgctcgggcttcgccaggcctgctccctgtggcaaacggaaattccctgaacaaagttatccctgccaaaagtccacctccaccaacccatagtactcaattgggtgctccgtcaagaaaacctgatcttagggtcatcaccagtcaggcagggaaaggcttgatgcatcacctgaataacgcccagcgattaggcgtctcacagtcaacacatagcttgacaactcctgtcgtctctgtggcaaccccttccctcctctcccagggcctcccgttttccagcatgccgacagcctataacaccgactatcaattaacgtcggccgaactctcctctcttcccgcattctccagccctggcggtctatccctgggcaacgtcaccgcttggcagcagccccagcagccccagcaaccccagcagcctcaacctccacaacagcaacctcctcaacctcagcaaccgcagcctcaacagccacagcagccacagcaaccaccgcagcagcagagccatctcgtgccagtaagcctgagcaacttaatccccggatccccacttccccacgtcggtgctgctctgactgtaaccacccatcctcatatcagtattaagtcagaacccgtttcgcccagccgggagcggagtcctgcaccgcctcctcctgccgtgtttcctgccgctcggcctgaaccaggagatggactgagtagtcctgcgggtgggtcttacgagaccggtgaccgcgacgacgggaggggcgactttgggccaaccttgggcctcctgaggccagccccagagccggaggctgagggctcagcggttaagcgcatgcgactcgatacatggacactgaagtag

SEQ ID NO: 231525 - DNA, 1533 bp, Artificial Sequence
  Description of Artificial Sequence: Synthetic coding sequence
atggggcgaaagaaaatccagattcagcgtataacagacgaacgtaatcggcaggttaccttcaccaaacgcaaattcgggttaatgaaaaaggcctatgaactctccgttctttgcgattgcgagatcgccctgatcatctttaaccacagtaacaagttgtttcagtacgcttccacagatatggacaaagtgcttctgaaatacactgagtacaacgaaccacacgagtccagaaccaacgccgatatcattgaagcactccacaagaagcatcgagagtgcgagagcccggaggtggacgaggtcttcgctctgacacctcagacagaggaaaagtacaaaaagattgatgaagagtttgataagatgatgcagagctaccgcctcgcgtcaaccgttcctgcacctaactttgccatgccggtgacggtgccagtgtcaaatcagagctctctgcagtttagcaacccctctggcagcctggtcactccaagcttggtgacttcttccctgactgacccccgactattgtcaccccagcagccagccttgcagcgaaatagcgtcagtccagggttgccccaacgtccagccagtgctggcgcaatgctgggcggagatttgaatagcgcgaacggggcatgtccctctccagtagggaatgggtacgtgtccgccagagcctctcccggattactccctgttgcgaatggcaatagcctgaataaagtgatccctgcgaagagcccccctccacccacgcacagcacacagctgggcgcaccatctaggaagccggatttacgcgttattaccagtcaggccggtaagggcctgatgcaccatctgaataatgcacagcgcttaggcgtcagccagagtactcattcactcaccactcctgtggtctccgttgccacaccatccctgctctcccaggggctgccattttcttcaatgccaacagcctataacaccgattaccagttaactagcgccgaactgtctagtctgcccgcttttagttccccgggaggcctgtcattgggcaacgtgaccgcctggcagcagccccaacagccacaacaacctcagcagccacagccacctcaacagcagccacctcagccccagcagccgcaacctcagcagccccagcagccgcaacagccccctcagcaacagagccatctggtgcccgtctctctgagcaacttaattccaggatctccactcccgcacgtgggtgccgcactgactgtcacaacacacccacatatttctatcaaatcagaacccgtttcaccaagtagggagcgcagccctgcgccacctcctcccgcagtgtttcccgctgcacgacctgaacctggcgatggtctgagcagccccgcaggagggtcttacgagactggtgacagggatgacggtagaggggattttggaccgacattggggttgctccggcctgccccagagccggaggcagagggctccgcagtgaaaagaatgcgcttggacacatggtag

SEQ ID NO: 231526 - DNA, 420 bp, Artificial Sequence
  Description of Artificial Sequence: Synthetic coding sequence
atggggagaaagaagattcagatacagaggataaccgacgaacgtaatcgccaggtgactttcactaaacgtaagtttgggcttatgaaaaaagcctacgaactctctgtgctctgtgattgtgaaatcgctctgattatatttaatcacagtaacaaattattccagtacgcatctacagatatggataaggtcctgctaaagtatacggagtataatgaaccacatgaaagccggaccaacgccgatatcattgaaactctgagaaagaaagggtttaacggatgcgacagtcctgaaccagatggcgaagactcacttgaacagtcaccgttactggaagataagtatcggagagcaagcgaagagctggatggactctttcggaggtatggcggaccatgttggggggtcacatag

SEQ ID NO: 231527 - DNA, 1410 bp, Artificial Sequence
  Description of Artificial Sequence: Synthetic coding sequence
atggcggaagagcgcgagcccgagctgtacctcaaatggaaacactgcgagacccccggagtgaaaacgctgtgtaaccttaagcattgcgaaacaccaggggtaaaaactctatgtaacctgaaaaagttgctgaatcgtcttcaaaaggatcacagggaggacgtatatctttacatcagcggtcacttgaatccgaataagttgtatcaaccgccagagactattttgcagcattggccaaatgcccacaggcccaaaggtgagcgcgcaagcgaagtgggcgaaccacccgctgggaaagttgcaagaatgaaggaagctctcgcgcacttcaccatccacaccgctttggtaccatctgaggcacaggacacaccactgttccgctatttgaatcctcaggccagcctttcacatacgtccgaagaggatttcttgccagtggaggccgtgcgtgagggcaaggaagaaaaaaaagggggacccccagggagaggacctccaggttggcgtagaagagaggagctgaggctgccagacttaaaagtgctctgttaccaggaagctggctctcggggtacccgcgatagacaccactacgtgtcaagctacctagccggtgcaacaagtgctgataggtataggatgttccttcggttccaaaaagaggtgctcgccaaacaagatctgttgaaaaatgactttacaggctctaaagccgcagccggtcatgagagaaagctgcagcaggaacttcagaagatctgtacatgttctccacagcagtttaacaggctacatgtgttcggcaaggtgtttgaggacatttgcaattctagtttgattttcggcgacctgcttaagaaagtcaaggacgagtacgagctgtacatggctacacttcttgaaagccagcctgccgctcaatacgaggcactacttgctcagctcaaggcactgggacagcggcctgttaagacggctgacatggaccttgcacgagaagagctgcgcatgctggtgactgccacaaaggcagccctagagcagaatgaccgattgagaagcgaacttgaaatggaggtggccctgttacagagcgcaaaggaacggtctgaatcatctgagaagcacattatcgatgagaatagattgactctcacagaaaaagtggaaaagaaaaggtgtgagatcctgtccaagtgggatgagattcaagccctggagaaagaaataaaaacaactctggtccatacgggaatcagtgatattactgagaatcggatcaaaagtatagagcatgaagccatccagcttgaaactgaaaacatgatacttaagaaaaagattaaaggcccactcgagatataccagggtatctgcaagattaggggcaacagacgttag

SEQ ID NO: 231528 - DNA, 741 bp, Artificial Sequence
  Description of Artificial Sequence: Synthetic coding sequence
atgtatcaagtgtctggacagcgtcccagtggctgcgatgctccatacggcgcacccagcgccgcacctggccctgctcagacactttccctcctgccaggcctagaggttgtcacagggagcacccaccccgctgaagccgcaccagaggaggggagcctcgaggaggctgcgacaccgatgccgcaggggaatggacccggaataccccagggactcgactcgactgacctcgacgtcccaaccgaggctgtgacttgccagcctcaggggaatccacttgggtgtacgccactattgccaaacgactcgggccatccttctgagttgggaggcactaggagggccggaaacggagctcttgggggtcccaaggcacatcgaaaactgcagacccacccatctcttgcgtcacagggatccaagaagagcaagagctcctcaaaatctacaacctctcaaatccctctacaggcacaggaagattgttgcgttcactgcatcctcagttgtctgttttgcgaattcctcactctgtgtaacattgttctggactgcgctacatgcggatcgtgtagttctgaggattcgtgtctttgttgttgttgctgtggaagtggcgagtgtgctgactgtgatctgccctgtgacttggactgtggaattttggatgcatgttgtgagagtgccgactgcctcgagatctgcatggaatgctgcggcctctgtttctctagttag

SEQ ID NO: 231529 - DNA, 696 bp, Artificial Sequence
  Description of Artificial Sequence: Synthetic coding sequence
atgtaccaggtgtccggacaaagacccagcggctgtgatgccccatacggcgctccctccgcagcccctgggccagcccagacactgtctttgctgcccggactggaggtggttaccggttctactcatcccgctgaggctgctcctgaagagggctccctggaggaggcagctactccgatgccgcagggtaatggacccggtatcccgcaagggctggattctactgacctggatgtgcccacagaggcagtgacatgtcaaccacaaggcaatccacttggttgcacaccgttgcttccaaatgattccggccacccaagcgagcttgggggtaccagacgcgctgggaacggcgcacttgggggacctaaggcccatcgcaaattgcagacgcacccctccctggcatcccagggtagtaagaaatctaagtccagctcgaaatccacaacgagccagatccctcttcaggctcaggaagattgctgcgttcattgtattctgtcttgtctgttttgtgaattcctcaccctatgcaacatcgtgctggactgcgccacctgcgggagctgttcaagtgaggattcctgcctgtgttgttgttgttgcggaagtggggaatgcgctgactgtgacctcccttgcgacctcgattgcggtatcctggacgcctgctgcgagtctgctgactag

SEQ ID NO: 231530 - DNA, 642 bp, Artificial Sequence
  Description of Artificial Sequence: Synthetic coding sequence
atgtaccaagtgagcggacagcggccttcaggttgcgacgcaccctacggcgcaccatcagcagcccctggaccagcccagaccctaagtctgctaccaggcctggaggtggttactggcagtacgcaccccgctgaagccgctcctgaagaggggtccctggaagaagcagccactccaatgccacaaggcaatgggccaggaataccgcagggacttgacagtactgatttggacgttccaactgaagcagtaacgtgccagcctcaggggaatcctttggggtgtacccccctgttgcccaatgattcagggcatccctctgaactcggcggaacacgtagagccggaaatggagccctcggcggaccgaaagcccatcgcaaactccaaacccacccttcactcgcctcccagggcagcaagaagtccaagtcaagctctaagagcactaccagccagatccccctccaggctcaggaggattgttgcgttcactgcattctgtcctgtctgttctgcgaatttctaactctctgtaacattgtgctcgattgtgctacatgcggctcttgcagctctgaagatagttgtctgtgttgctgttgctgtggtagcggggagtgtgcagattgtgactag

SEQ ID NO: 231531 - DNA, 297 bp, Artificial Sequence
  Description of Artificial Sequence: Synthetic coding sequence
atgtatcaagtatctgggcaacggccaagcggatgtgacgccccatacggggcacctagcgccgctccgggaccagctcagaccctatcactattacccggactggaagtggtcacgggatccacccatcctgcagaagcggcacccgaggaggggtccctggaagaagcagccactcctatgcctcagggcaatggacccggaattcctcaagggctggactcgaccgatctcgacgtaccgacagaggccgttacatgccagcctcaaggtaaccctctggggtgtactccgtag

SEQ ID NO: 231532 - DNA, 387 bp, Artificial Sequence
  Description of Artificial Sequence: Synthetic coding sequence
atgtaccaggtgtccggacagaggcccagtggatgtgacgccccatacggggctccttctgccgcacctggaccggcacagacactgagcctgctcccaggcttggaggtcgtcactggctccacccaccctgcggaggcagcacccgaggaaggatcgctggaggaggctgccactcctatgccccaggggaacgggccaggaataccacagggtctggattctaccgatcttgatgtcccaacagaagctgtcacgtgtcagccgcaaggaaacccgctcgggtgcaccccactgctacctaacgattcgggccacccatccgagttggggggaacgagacgggctggtaacggggcactgggcggacccaaagcccatagatag

SEQ ID NO: 231533 - DNA, 741 bp, Artificial Sequence
  Description of Artificial Sequence: Synthetic coding sequence
atgtatcaggtctccggtcagaggccgagtggctgtgatgctccctatggagcaccatccgcagccccaggacccgctcaaaccctctctttgcttccgggactggaagtcgtaaccgggagcacccatccggcagaagcagcccctgaggagggctccctggaagaagcagccacccctatgccacaaggaaacggtcctggaatcccacaaggactagactctactgacttggacgtccccaccgaagccgtgacatgccagccgcaaggtaaccccctggggtgtacgccactgctcccaaatgactccggacatccatccgaattgggcggaacgcgcagggcaggaaacggcgcactgggaggaccaaaggcccataggaagcttcaaacacatcctagtctggccagtcagggctctaaaaaaagcaaatcgtccagcaaaagcaccacatctcagattccgctgcaggcccaagaggactgttgcgtgcattgcatcttgtcctgtctgttctgcgaattccttactctctgtaatatcgtactcgactgcgccacttgcggctcttgttcgagcgaggatagctgtctctgctgctgttgctgcggaagcggagaatgtgcggattgtgaccttccatgtgacctcgactgcggtatcctggatgcctgctgtgagagtgccgactgccttgagatttgtatggaatgctgcggtctctgcttttcaagttag

SEQ ID NO: 231534 - DNA, 729 bp, Artificial Sequence
  Description of Artificial Sequence: Synthetic coding sequence
atgatgatggacctctttgaaacaggttcttacttcttctatctcgacggagaaaatgttactctccagccactggaggtagctgagggcagtcccctttatcctggctcagacggcactttgagcccatgtcaagatcaaatgcctcccgaagctgggtctgacagttccggcgaggaacacgtactggcacctcccggtctacaaccccctcattgcccgggtcaatgccttatttgggcctgtaaaacgtgcaaacgcaaaagtgctccaacagatcgtcgcaaggccgcaacactaagagagagaaggcgtctgaagaagattaatgaggcgttcgaagcattaaaacgaagaacagtagcaaaccctaaccagcgtctgcctaaagtggagattctacgatccgccataagttacatcgagcggctgcaagatctgttacaccggctcgatcagcaggagaagatgcaggagttgggggtagaccctttctcctacaggccaaagcaggaaaacctggagggagcagacttccttaggacatgctcctcccaatggccgagcgtttccgatcattctcgcggtctggtgattacagccaaagaagggggagcatctattgacagttcagccagcagcagtctgcggtgtttgagcagtatcgtagacagcatctcctccgaagaaagaaagcttccatgtgtggaagaggtggttgaaaagtag

SEQ ID NO: 231535 - DNA, 1527 bp, Artificial Sequence
  Description of Artificial Sequence: Synthetic coding sequence
atgactcagactttgaaatatgcgagccgggtatttcacagagtgcgctgggctcccgaactcggagccagcctcgggtaccgggagtaccatagcgcccgaagatctctggcagacataccaggtccctcaaccccttcgttcctggcagagcttttctgtaaagggggacttagcaggctgcacgaactgcaggtgcagggggcagctcactttggacctgtttggcttgctagcttcggaacagttagaactgtgtacgtggccgctcccgcattggtagaggagctgctccggcaggaaggcccaagacctgagagatgctccttctccccatggacagagcacagaagatgcagacagcgggcttgtggtcttctcactgcggaaggggaggaatggcaacgccttagatctctgctggcgccactactcttgcggcctcaggcggcagcgaggtatgcaggcacattgaacaacgtggtgtgtgatctggtgaggagactgagaaggcagcgcggtaggggcaccggaccacccgctcttgtccgggacgtggctggcgagttctacaagtttgggctggagggaatcgccgctgtgctgctgggaagcagattaggttgcttggaagcccaggtcccaccagacaccgaaacatttattcgcgctgtcggatccgtgtttgtatccactctcctgacaatggcaatgcctcattggcttcggcatctcgtcccaggtccttggggacggctgtgtagagactgggatcaaatgtttgcatttgcgcagagacacgtcgagcggagggaagcagaagccgctatgcggaacgggggtcaacccgagaaagaccttgagtcaggcgcacatctcactcactttctgttccgtgaagagttgccggcacagagtatcttaggtaatgtaacagagctgctgcttgcaggagttgataccgttagcaatacactcagctgggctctgtatgagctctcacggcacccagaggtgcagactgctttgcacagtgagattactgctgccctgtcaccagggagttccgcctatccatctgctacagtgctgagccagttgccccttcttaaggccgtggtaaaagaggtgctccggttgtatcctgtcgttcccggaaacagccgggtgccagacaaagatattcacgtcggagattacatcatcccaaaaaatacactcgtcacgttatgtcattacgccacctcccgagatcccgcacaatttccagaacccaacagctttaggcccgcacgctggcttggagaaggacctacaccacatccctttgcgtcactaccttttgggtttgggaaaaggtcatgcatgggacggagactggccgaactcgagctgcagatggctttggcacagatcctgacccacttcgaggtgcaacccgagcccggagcagctccagtgcgccctaaaaccagaacggttctggttcctgaaaggtcgatcaatctgcagtttctggatagatag

SEQ ID NO: 231536 - DNA, 675 bp, Artificial Sequence
  Description of Artificial Sequence: Synthetic coding sequence
atggaactatacgaaacttcaccctacttttatcaggagcctcgtttctacgacggcgaaaattacctgccagttcacttgcagggatttgagccacccggatacgagaggacggagttgacattaagtccggaggcgccaggaccccttgaggacaaagggctcggaactcctgaacactgcccgggacaatgcctcccatgggcatgtaaggtttgtaaaagaaaaagcgtatccgtggaccgcaggagggccgctacactgagagaaaagcgtaggctgaaaaaagtgaacgaagctttcgaggctctgaagaggagcacgttgttgaatcccaatcagcgtctgcccaaggtagagatcctgcgcagtgctattcagtacattgagagattgcaggccctgctgtctagcctaaaccaggaggagcgcgacctgcgttacagaggcggaggagggccacaacccggtgtcccctcagagtgcagcagtcactcagcatcatgtagccccgaatggggatcggcgcttgaattttccgctaaccccggagaccatctcttaaccgctgacccgacggatgctcacaacttgcattccttaacctctatcgtggactcgatcaccgtggaggatgtgtccgtcgcttttcccgacgaaaccatgcccaactag

SEQ ID NO: 231537 - DNA, 465 bp, Artificial Sequence
  Description of Artificial Sequence: Synthetic coding sequence
atgggcctgtcagacggtgagtggcagctagtgctcaatgtctggggtaaggtggaggccgatattccagggcatggtcaggaagttcttatccgcctcttcaaaggacatcctgagactctagagaaatttgataagtttaagcatttaaagtccgaggatgaaatgaaggcatcggaggatctgaagaaacacggggcaaccgtcttaaccgctcttggcggaatcctgaaaaaaaagggccaccacgaagcagaaatcaagccactagcgcagtctcacgcgacaaagcacaagatacctgtgaagtatctggaatttatctcggagtgtataatccaggtgttgcagtccaagcaccccggtgacttcggagctgatgcccagggggctatgaataaagccctggagttatttaggaaggacatggcctctaactacaaagaactgggcttccaaggatag

SEQ ID NO: 231538 - DNA, 465 bp, Artificial Sequence
  Description of Artificial Sequence: Synthetic coding sequence
atgggcctgtccgacggggagtggcaactggtgcttaacgtatggggaaaggtggaggctgatatccctgggcatggacaggaggtgctgatcaggttatttaaaggacatccggagactttggaaaagttcgacaagtttaaacatttgaagagcgaggacgaaatgaaagcctctgaggacctcaaaaagcatggcgctaccgtgctcacggctttgggtggtattctgaaaaagaaaggccaccacgaggccgaaatcaaacctctggctcagtcacacgccacaaagcacaagattcctgttaaatatcttgaattcatatccgagtgtataatacaggttttgcagagcaagcatcccggagactttggggctgacgcacagggtgcaatgaacaaggctcttgagctgtttcggaaggacatggcttcaaattataaagagctcggatttcagggatag

SEQ ID NO: 231539 - DNA, 465 bp, Artificial Sequence
  Description of Artificial Sequence: Synthetic coding sequence
atgggcctgtccgatggtgagtggcaacttgtcctaaacgtctggggaaaggtggaagcggacatccccggacacggccaggaagtattaatccgcctcttcaagggacaccccgagaccttggaaaagtttgataagttcaaacaccttaaaagcgaggacgagatgaaagcaagcgaagatctgaaaaaacatggcgcaacggttctgactgctttaggcggaattttgaagaaaaagggtcaccatgaggctgagatcaagcccctggcgcagagccatgctacgaaacacaagatcccagtaaagtacttggagttcatttcggaatgtattatacaggtgttgcagtccaagcacccaggtgactttggcgctgacgcccagggcgctatgaacaaggctctggagcttttccgcaaagacatggcaagtaattacaaggagctcggattccaaggatag

SEQ ID NO: 231540 - DNA, 465 bp, Artificial Sequence
  Description of Artificial Sequence: Synthetic coding sequence
atggggttatcagacggagaatggcagctggtcctgaatgtctggggcaaggttgaagccgacatcccaggacatggacaggaagtgttaatcaggcttttcaaaggacatccagaaaccctggaaaaattcgacaagtttaaacacctgaaatcggaagatgaaatgaaggcctctgaagatttgaaaaagcacggcgcaaccgtcttgacagcactgggcggaatcctgaaaaagaagggccaccacgaggcagaaatcaagcccctggcgcagagtcacgccactaagcataaaataccagtcaagtatctcgagttcatctcggaatgtattatacaggttctccaatctaagcaccctggagattttggagctgacgcacagggagcgatgaataaggcactggaactctttcggaaagatatggcaagcaattacaaggaacttggattccaagggtag

SEQ ID NO: 231541 - DNA, 234 bp, Artificial Sequence
  Description of Artificial Sequence: Synthetic coding sequence
atggggttgtcagatggcgagtggcagctcgttttgaacgtatgggggaaggtggaagcggacataccagggcacggccaggaagtgcttatccgcctctttaaggggcatccagaaactctggagaaatttgataaattcaagcacttaaaaagcgaggacgagatgaaggcctctgaagatctgaagaagcacggcgctaccgttctgacagccctaggcggaatcctatag

SEQ ID NO: 231542 - DNA, 432 bp, Artificial Sequence
  Description of Artificial Sequence: Synthetic coding sequence
atggggctctcagacggggagtggcagctcgtactcaacgtatggggaaaggttgaggctgatatccccggacacgggcaggaggtgctgatcaggctctttaaagggcacccggaaacactggagaagttcgataaattcaaacacctcaagtcagaggatgagatgaaagcgtccgaggatctgaagaaacacggtgcaaccgtgctgactgcccttggcggtattctcaagaagaaaggccaccacgaagcagaaatcaagccattagcccagtcacacgccactaagcacaaaattcccgtcaaatatctggaatttatcagtgaatgtatcattcaagtgctccagtcaaagcatccgggagactttggggctgacgcccagggagccatgaataaggcactggaactcttcagaaaagacatgtag

SEQ ID NO: 231543 - DNA, 321 bp, Artificial Sequence
  Description of Artificial Sequence: Synthetic coding sequence
atgggcctttcagacggcgaatggcagctggtgttgaacgtgtgggggaaagtggaagccgacatccccggacacgggcaggaagtgcttatacggctctttaagggacacccagagacactggaaaagtttgacaaatttaagcacctgaaaagcgaggatgagatgaaggccagcgaggatctcaaaaaacacggcgcaacagtgttgacagccctgggcggaatacttaagaaaaagggtcaccacgaagctgagatcaagcccttggcccagagtcacgccacaaagcacaaaatcccagtcaagtatctggagtag

SEQ ID NO: 231544 - DNA, 321 bp, Artificial Sequence
  Description of Artificial Sequence: Synthetic coding sequence
atgggtctgtcagatggagagtggcagttggtgttgaacgtctggggcaaagtggaagctgatattcctggtcatggccaggaggtcttgatccggctcttcaaaggacaccctgaaactcttgaaaagtttgacaagtttaagcacttaaagtctgaggatgagatgaaagcatcggaggacctgaaaaaacatggggcaactgtgctgaccgccctcgggggaatcctgaaaaaaaaaggacaccatgaggctgagatcaagccactggcccagtctcacgccaccaagcataagattcctgtaaagtatctcgaatag

SEQ ID NO: 231545 - DNA, 411 bp, Artificial Sequence
  Description of Artificial Sequence: Synthetic coding sequence
atggctgtaggggctgaaaggctcggtgaagttttgatccggctattcaagggtcaccctgagaccctagaaaagttcgataagtttaaacatctgaaatcagaggacgaaatgaaagcatctgaagatctcaagaagcacggtgccaccgttctgaccgccctgggcggaatcctaaaaaaaaaaggccatcacgaggcagagatcaagccgcttgcccagtctcacgcaaccaagcacaagataccagtgaagtacctcgagttcatttctgagtgcattatccaggtgctacagtcgaaacatccaggcgatttcggcgctgatgctcagggcgctatgaataaggcccttgagctattccgaaaggacatggccagcaattataaggagctgggatttcaggggtag

SEQ ID NO: 231546 - DNA, 4398 bp, Artificial Sequence
  Description of Artificial Sequence: Synthetic coding sequence
atgtcgctggtgacagtacccttttatcagaagaggcaccgccattttgatcaaagctaccgcaacattcagactagataccttttggatgaatacgcatccaaaaaacgggcaagcacgcaagccagctcccagaagtcactgagccaacgatcttcatcgcagcgcgctagttcacagactagtctggggggtacaatctgtcgcgtctgcgcgaagcgcgtgagcacgcaggaggatgaggagcaggagaatcggtcaagatatcagtccttggttgctgcttacggagaggccaaacggcaaagatttttgtccgagttggctcacctggaagaagacgtgcacctggctcgatcccaggctcgcgacaaattagataaatatgctatacagcaaatgatggaagataaactggcatgggaaagacacacatttgaagaacgtattagtagagcaccggagattctcgtccggctccggtcccataccgtgtgggaacggatgagcgtgaaactgtgtttcactgtgcaagggtttcccacgcccgttgtacaatggtacaaggatggatccctcatctgccaggccgctgagccgggaaaatatagaatcgaaagtaactatggagtgcacacccttgaaattaaccgcgctgacttcgacgacaccgccacttatagcgctgtggcaactaacgcacatgggcaggtctcgactaatgccgctgttgtggtgcgaagatttcgcggagatgaagaacctttccggagcgtgggactgcccatcggcctcccgctgagctctatgatcccttatacacacttcgacgtgcagttcctggaaaaatttggggttacttttcgcagagaaggggagactgtgacactcaaatgtacgatgttagtgacacccgatctgaagagggtccaaccgagagcagaatggtatcgcgatgacgtgctactgaaggagtccaagtggaccaagatgttttttggcgaggggcaggcctcactgtctttcagtcacctccacaaggatgacgagggactctacacattaaggatcgtcagcaggggaggcgtttctgaccacagtgccttcttgttcgtgagagacgccgaccccctggttactggtgctcccggagctccaatggacctgcagtgccatgatgctaacagggattatgtaattgttacatggaaacctcctaacacgacaaccgagagccctgttatgggatatttcgtcgacagatgtgaggtgggtacaaacaattgggtccaatgcaacgacgctccagtcaagatatgcaagtatccagtgacaggacttttcgaggggcgaagttatattttccgcgtgcgagctgtgaatagcgccggtatctctagaccgagccgcgtgtccgacgcagtggctgctctcgatcctctggatctgagacggttgcaggcagtccaccttgagggcgagaaggaaattgcaatttaccaggatgatctggagggggatgctcaggtaccaggaccacctactggagtccacgctagtgaaatctcccgcaattatgtggtgctctcatgggagccacccacgcctaggggtaaggacccacttatgtatttcatcgagaagagtgtcgttggttctggtagttggcaacgggtgaatgcccagactgctgtgcgttcccctcgctatgccgtgttcgatttgatggaggggaagtcctacgtttttcgggtattgagcgccaatcggcacggcctctccgaaccatcggaaattactagccctatccaggcacaggacgtcacagtcgtgcccagtgccccagggcgagtcctggcctcaagaaatactaaaacgtcggtcgtcgtgcagtgggacaggcctaagcatgaagaggacctgctaggttactacgtcgactgttgcgtagctggcaccaacctgtgggaaccatgcaatcataagcctattggatacaaccgctttgttgtccacgggttgaccacaggggagcagtatatatttagggtgaaggcagtgaatgcggtgggcatgagtgaaaactcccaggagtctgatgtgataaaggtgcaagctgccctgaccgtgccaagccatccatatggcattaccctcctgaattgcgacggacacagtatgactctggggtggaaggtacccaaattttccggcggaagccccattctgggctactacctggataaaagagaggttcatcataagaattggcacgaggtgaattcttcaccctccaaaccaactattctgacagttgatggactgacggaaggcagcctgtatgaattcaaaattgccgctgtaaacctagccggaatcggagagccttccgacccctcagaacacttcaagtgcgaagcttggaccatgcctgagcccggaccagcttacgacctgacattttgcgaggtcagagacacaagccttgtgatgctgtggaaagcacctgtctactccgggtcgagtcccgttagtgggtacttcgtggacttccgcgaagaggatgccggtgagtggatcacggtcaatcagacaaccacagcaaaccgatatctgaaggtctctgacctgcagcagggtaagacctatgtgttccgggtgcgtgcggttaacgccaacggggtgggaaaacccagcgacacctcagagcctgtgcttgtcgaggctcgccctggaaccaaagagattagcgcaggcgtggacgaacagggaaacatttacctgggttttgattgccaggagatgaccgacgcgtctcaattcacctggtgcaaatcatacgaagaaatttctgacgatgaacgctttaaaatcgagaccgtgggggaccattcaaagttgtatcttaaaaatcctgataaggaagatctaggcacctactcggtgtctgtgtcagacacagatggagtgagcagcagctttgttcttgatccagaagagctggagcgtctaatggctctctccaatgagatcaaaaatcccaccattccgctgaaatcagaacttgcatatgagatcttcgacaagggacgcgtaaggttttggctccaggctgaacatctcagccccgatgcatcctacagatttatcatcaacgatagagaagtcagtgacagtgaaatccacaggataaagtgcgacaaagccaccggaattattgagatggtgatggaccgtttcagcattgaaaatgaggggacgtataccgtccagatccacgacggtaaggcaaagtcgcagagctcactcgttcttatcggcgatgcctttaagacagtgttggaggaggccgagttccagagaaaagagtttctccgcaaacaggggcctcatttcgctgagtacctccattgggacgtcaccgaggaatgtgaagttaggctcgtttgtaaggttgcgaatactaaaaaagagaccgtcttcaaatggctcaaggacgatgttctttatgaaaccgagaccctccctaatctcgaacggggaatttgcgagctcctaattcctaagctgtctaaaaaggaccatggagaatacaaagcgacactcaaagacgaccgcggacaagatgtatcaatcctggaaattgccggtaaagtctacgacgatatgattctggcaatgtcccgcgtttgtggaaagagtgccagcccgttgaaggttctctgtacaccagagggaatcaggctgcagtgtttcatgaagtactttacagatgaaatgaaggtgaactggtgtcataaagacgcaaaaatcagcagctccgagcacatgaggatagggggtagtgaggaaatggcctggctccagatttgcgagcctacagaaaaggacaaagggaagtacactttcgagatcttcgacggcaaggataaccatcagagaagcctggacctgtccggacaagctttcgatgaggcatttgctgagtttcagcagttcaaagccgcagcttttgccgaaaagaatcggggtagactgattggcggacttccagacgtggtgacaattatggaaggaaagacattgaacttgacatgtacagtgtttggaaacccagacccagaagtaatttggtttaagaatgaccaggacattcagctgtccgaacacttctctgtgaaggtggaacaggcaaaatacgtatccatgacaattaagggagtgactagcgaggactctggtaaatactccatcaacattaagaacaaatatggcggtgagaaaattgatgttacagtgtccgtatataaacatggggagaagattcccgatatggctccacctcagcaagcgaagcctaagctcatccctgcatctgccagtgcagccggacagtag

SEQ ID NO: 231547 - DNA, 3420 bp, Artificial Sequence
  Description of Artificial Sequence: Synthetic coding sequence
atgcccgagcctacgaagaaggaggacgaagaggaggtcagccctccgtcagctttacctcctgattggaccctagtagagactcccccaggcgaagagcaggccaagcaaaacgctaattcccagttgtctatccttttcattgagaaaccacagggtggcactgttaaggtcggcgaggacatcacctttatcgccaaggtcaaagctgaggacttactgagaaagcccaccatcaaatggttcaagggcaaatggatggatttggcaagcaaggcaggcaagcacttgcaactgaaggagacatttgagcgccattcaagagtgtatacctttgagatgcaaattatcaaggctaaggataactttgccggtaactacagatgcgaggtgacttataaggacaaattcgattcttgctcattcgacttagaggtgcacgagagcactggcacaacacctaatatcgacatacgatctgctttcaagcgttcaggagagggtcaagaagacgctggggagctggatttttccggtttgctcaagaggcgggaggtgaagcagcaggaagaagagcctcaggtagacgtgtgggagctcttaaagaatgcaaagccatctgagtacgaaaagatcgcgtttcagtacggaataaccgacttacgcggaatgctgaagcggctcaaacgtatgagaagagaagaaaagaagagcgcagcctttgctaagattctggacccagcatatcaggtagacaagggcggaagagtccgctttgttgtggaactcgccgaccccaagctcgaagttaagtggtataagaatgggcaggagatccgcccttcaaccaaatacatctttgagcataaaggctgccagcggattctattcataaataactgccagatgactgacgatagcgaatattacgtaaccgcgggagacgagaagtgtagcacagaactctttgtacgcgagccgccaatcatggttaccaaacaattggaagacaccaccgcgtattgtggggagcgcgtagagttagaatgcgaagtgtcagaggacgatgcaaacgtaaagtggtttaaaaatggggaggagatcatccctgggccaaagtctcggtatcggattcgcgtggaaggcaagaaacacattctgataattgagggggctacaaaggctgacgccgctgagtacagcgtgatgacaactgggggtcaatctagcgcaaaactcagtgttgatttgaagcctctaaagatcctcaccccacttacggatcagaccgtgaacttaggcaaggaaatttgtctgaagtgtgaaatctcagaaaacattcctggtaagtggacaaaaaatggactaccagtccaggagtccgatcgtttaaaagtggttcacaaaggtcggatccacaaattggtaatcgccaatgccctcaccgaagacgagggtgactacgtgtttgcacctgacgcctacaacgtgaccctgcctgcaaaagtgcatgtcatcgaccccccaaagatcatattagacgggctggatgccgataatacagtgactgtcattgccggaaacaaactgcgactggagatccccatcagcggggagccgccacccaaagcaatgtggtctaggggagataaagccatcatggaaggatccggcaggattcgcaccgagagctaccccgattccagcaccttagtgattgacattgccgaacgcgatgacagtggcgtgtaccatatcaacctaaagaatgaagccggtgaagctcatgcttcaataaaagtgaaagtagtggatttcccagatccgccagtcgccccaacagttacggaagtaggcgatgattggtgcatcatgaattgggagccaccagcctatgacgggggttctcctatccttggatacttcatagaaaggaaaaagaagcagagttcaagatggatgagacttaattttgatctttgcaaagaaacaaccttcgaacctaagaagatgattgagggggtcgcctatgaggttagaatattcgccgtgaatgccatcggcatcagcaagccctccatgccctcccggcctttcgtacctctggccgtgacgagtccccctactctactcaccgtggattcagtaactgatacaacagtcacgatgagatggagaccacccgaccatatcggcgctgcagggctcgacggttacgttcttgagtattgttttgaaggcaccgaggattggattgttgcaaataaagatttgatcgacaagacaaagttcacgatcactggacttccaactgacgccaagatttttgtgcgagtgaaagctgtgaacgctgccggtgctagcgagccaaaatattactcacagcctattctagtgaaagagatcattgagccaccgaaaattaggatccccaggcatctgaaacaaacgtatatccggagggtgggggaggcagttaacctggttatcccattccagggcaaacccaggcctgaattgacctggaaaaaggacggcgctgagatcgataaaaaccagattaacataagaaacagcgaaaccgacactataatatttattcggaaggctgaaagaagtcattctgggaagtatgaccttcaggtaaaagtggacaagttcgttgaaacagcatcaattgatatccagatcatcgatcgacccggtcccccacaaatagttaagatagaggatgtttggggcgagaatgtggctttgacttggacaccaccgaaggatgacggcaacgctgcaattaccggctatacaattcagaaggctgacaagaaaagtatggagtggtttacagtcattgagcattatcaccgtacatctgcaactattaccgagttggtcatcggaaacgagtattatttccgcgtattcagtgaaaacatgtgtgggttgagcgaagacgctaccatgaccaaggaaagtgcagtaatcgcgcgtgacggtaagatctataagaatccggtttatgaagattttgattttagcgaagctcctatgttcactcagcctcttgtcaatacatacgcaatcgccggttacaacgccacattgaactgtagcgttcggggaaatcctaagcctaagatcacatggatgaaaaataaagtggccattgttgatgaccctaggtacaggatgttttcaaaccagggggtgtgtacactggagatccgtaagcccagtccatacgatggcggaacttactgctgtaaagcggtaaacgatctgggcaccgtggaaattgaatgtaagcttgaagtgaaagggggattaagcttttgccgtctactgctgcagggcgtgcccccaaacatcatagattcctacctcagagatctgcactctagcaatccagaagaatactag

SEQ ID NO: 231548 - DNA, 3522 bp, Artificial Sequence
  Description of Artificial Sequence: Synthetic coding sequence
atgccggagcctacaaagaaagaagagaacgaggtacctgctcccgctcccccacccgaggaaccttccaaggagaaggaagccggtaccacacccgcaaaagactggaccctcgtggagaccccacctggagaggagcaggcgaagcagaatgccaacagccagctgagcattctgtttattgaaaagccacagggagggacggtaaaagtgggggaagacattaccttcatcgcaaaagtgaaggctgaagacctgctgaggaagcctacaattaagtggttcaaaggaaagtggatggatctggcctccaaggctggcaagcatttacagctaaaagaaactttcgagcggcactcacgggtgtacacattcgagatgcagatcatcaaggccaaggataattttgcgggaaattataggtgcgaagtgacctacaaagataagttcgactcttgtagcttcgatttggaggtgcatgaatcaacgggcacaactcccaatatcgatatacggtcagcgttcaaaaggtcgggggagggccaggaggatgccggagaactggattttagtgggctgctaaaacgaagagaagtcaagcaacaggaagaggaaccccaggttgatgtatgggagttattgaagaatgctaagccgtccgagtatgagaaaatcgcgttccagtacgggataaccgatctaaggggcatgctgaaacgactgaagcggatgcgccgagaagagaagaaatctgcagcttttgctaagatcctagatcctgcctaccaggtggataaggggggaagagttcggttcgtggtcgagctggccgaccctaaactggaggtcaaatggtataaaaacgggcaggaaatcagaccaagtactaaatatatttttgaacataaaggttgccaacggatcctgtttattaataactgccaaatgacagatgactcagagtattacgttacagctggcgatgagaagtgtagcacagagctgttcgtacgcgagccacccataatggtcacaaaacaactagaggacacaaccgcatactgcggcgagagggtcgaacttgagtgtgaagtttcagaggatgatgcgaatgtaaagtggtttaagaacggtgaagagatcattcctggcccaaaatcccgctaccgaatccgggtggaaggcaaaaaacatatactgattatcgagggcgcaacaaaggctgacgccgcagaatactcagtgatgacaaccggcggacagagctctgccaaactcagcgttgacttaaagccacttaaaatcttaactcccctcacagaccagaccgtaaacctagggaaggagatctgtttgaaatgtgaaatttctgagaatattcctggaaaatggacaaagaacggacttcctgtccaggaaagcgatcgtctcaaagtagtccacaaaggcagaattcataagctcgtaatagcaaatgcattaaccgaagatgagggggattatgtgtttgccccagacgcatacaatgtgacactgcctgctaaggtgcacgtcatcgatccacccaagattattcttgatgggttggatgcagacaataccgtgactgtgatcgcaggcaataagctcagactcgagatccccatctccggcgaacccccaccaaaagccatgtggtccagaggcgataaggcgattatggagggttctgggagaatccggacagaatcgtaccctgattcctcaacactcgtgattgacatagctgagagagatgattctggcgtctatcatattaatctgaaaaatgaagcgggagaggctcacgcctccataaaagtgaaagttgtagatttccctgaccctccagtcgctcccactgtgactgaggttggcgacgattggtgtattatgaactgggagcctcctgcctacgatggcggtagccccatcctgggatacttcatcgaacgtaagaagaagcagagctcaagatggatgcgcctgaactttgacctgtgcaaagagactacgtttgagcccaagaaaatgatcgaaggcgttgcttacgaagttcggatatttgccgttaacgcgattggcatcagcaaaccgagtatgccttcccggcctttcgtgcctctcgccgtcacgtccccacccacccttctcaccgtggactctgtgactgatacaactgtgacaatgagatggagaccacctgaccacataggtgctgctggtctcgacgggtatgtgctggagtactgttttgaggggtccacttctgctaaacagtctgacgaaaacggcgaagctgcatacgacctgcccgctgaggactggatcgtagccaataaagatctcatcgataagaccaagttcaccatcacgggcttgcccactgatgccaaaatattcgtcagggttaaagcagttaatgccgcaggcgcaagcgagccgaagtactactcccagccgatcctggttaaagagatcattgaaccgccaaaaatccgcatccccaggcatctgaagcagacttacatcaggcgtgtgggcgaagcggtgaatctggtcatccccttccagggaaaacctaggcccgagttgacatggaagaaggacggagcggagatagataagaaccagatcaacattcggaacagcgagactgataccattatctttattagaaaagcagagcggagccactctggtaaatatgatcttcaggtaaaagttgataagtttgttgaaaccgcctccatcgatatccagataatagacaggccaggaccccctcagattgtcaagatcgaggatgtctggggggaaaacgtggcactgacatggacaccgccaaaagatgacggtaatgccgctatcactggatacaccatacagaaggccgacaaaaaatctatggaatggtttactgtcatcgagcattatcaccggaccagcgctaccatcacagaactggtgataggtaacgagtactatttccgagtgtttagcgaaaacatgtgcgggctgagtgaggacgccactatgacaaaggagtcagccgtgattgctcgcgacggcaaaatctacaaaaatcctgtttacgaagactttgacttttccgaagccccaatgtttacacagccactggtaaatacctatgccatcgcgggatacaacgccactcttaattgctctgtgagaggcaatccaaagcccaagatcacgtggatgaaaaacaaagtcgcaattgtggacgatccacgctaccgtatgttctctaaccagggtgtttgcaccttagaaatccgtaaaccctcaccatacgatgggggaacctattgctgtaaagccgtcaacgacctggggaccgtggagatcgaatgtaagctggaggtaaaagttatctatcaaggagtgaacacgcccggtcagcccgtttttctcgagggccagcagcaagtggggtcaccatccgctgactcaagttgcaaagcctacctccaaacgtag

SEQ ID NO: 231549 - DNA, 3384 bp, Artificial Sequence
  Description of Artificial Sequence: Synthetic coding sequence
atgccagagccaacaaagaaagaggagaacgaagtgcccgcacccgcaccgcctccagaagaaccctccaaggagaaggaagctggaaccacccctgccaaagactggacgttggtggaaaccccccctggagaggaacaggcgaagcaaaatgccaatagccagctttccatcttgtttatcgaaaaacctcagggtggtacggtcaaagttggagaggacatcacctttatcgcgaaagtcaaagctgaggacctgctgcggaaacctacaatcaaatggttcaaggggaaatggatggatctcgcttctaaggccggaaagcacctgcagctgaaagagacatttgaacggcactcccgagtctatacttttgaaatgcagatcatcaaggcaaaggacaacttcgcaggaaattaccgctgcgaagtgacttacaaagataaattcgattcttgttcatttgacttagaggtccatgaatcaacgggtactactcccaacattgatatccggtctgcttttaagagaagggaggtcaagcagcaagaggaggagccacaggtggatgtttgggagctgttgaaaaatgcaaagccatctgaatacgaaaagattgcattccagtatggtatcacagatttgagaggaatgctcaagagactcaagcggatgcgaagggaggaaaagaaatccgctgcgtttgccaaaatactggaccctgcttaccaggtggacaagggcggacgcgttcggtttgtggtcgaactggcagatccgaagttggaggtcaagtggtataagaacggccaagaaattagaccctccaccaaatatattttcgagcataaggggtgtcagcgcattctatttatcaacaactgtcagatgacggacgacagcgagtactacgtgaccgctggagacgagaaatgctccacagagctgttcgtaagagagcctccaattatggtgacaaagcagctcgaggacactactgcctactgtggggaaagggtggagcttgagtgcgaggttagcgaggatgatgctaacgttaaatggttcaaaaatggagaagagatcatccctggacccaagtcacggtataggattcgggtggaggggaaaaagcacattctgatcatcgaaggcgctactaaagccgatgctgcagaatactcagttatgacaactggaggccaatccagtgccaaactgtccgtagatcttaaacccctcaaaattctgaccccgctcaccgatcagacagtgaatttggggaaggagatctgcctcaagtgtgagatttctgagaatattcccggaaaatggacaaaaaacggtctgcctgtgcaggagagcgatcggttaaaagtcgtccataagggcagaatacacaaacttgttatcgccaacgcattaactgaggatgaaggggactacgtcttcgccccagacgcttataatgtgactctgcctgccaaggtccatgtgatcgacccacctaagatcattttagacggactggacgccgacaataccgtgactgtcatagcagggaataagctaagactggagatcccaatctcgggtgagcccccaccgaaggccatgtggtcccggggagacaaagccatcatggaagggtcaggaagaattaggaccgagagctaccctgattccagtacactggtgatcgacattgccgaaagggacgacagcggtgtgtaccacattaatctgaagaacgaggcgggagaagctcatgcttctatcaaggtcaaggttgttgatttccccgaccctcctgtggcccctacggtcacagaagtgggagatgactggtgtataatgaattgggaacctcccgcttacgatgggggtagcccgatcttgggatattttattgagagaaaaaagaaacagtcgagtcggtggatgcgcctgaatttcgatctctgtaaagaaaccacgttcgagcctaaaaagatgattgaaggggttgcctatgaagtgcgaatcttcgctgtgaacgctatcggaatctcaaagcctagcatgccgtccaggccattcgtccccctggccgtcactagtccgccaaccctgctgacagtagactcagtgacggacaccacagttacaatgcggtggaggcctccagaccacataggagccgctggtctcgatggatatgtgctggagtactgttttgagggaacggaagattggatcgtggctaataaagacttgattgataaaacaaagttcacgattactggtctccccactgatgccaagatctttgtccgggtaaaggcagtgaacgcagccggagccagcgaacctaagtattacagccagcctattctggtaaaggagatcattgagccacccaaaattaggatccccagacatctgaaacagacctacattcggagagtcggcgaggccgttaatttagttatcccgtttcaggggaaacctcgccctgaactgacctggaaaaaagatggagctgagatcgataagaaccagatcaacatccgcaactcggaaacagacacaatcatttttattaggaaggctgaacgctctcatagtgggaaatacgatctccaggtgaaggtagataagttcgttgagacagcttccatagatattcagattattgacagaccaggccctccacagatcgtgaaaatcgaggacgtttggggggaaaacgtcgctttaacttggacgccgccaaaggatgatgggaatgctgcgatcactggatatactatccaaaaggctgacaaaaagagcatggaatggttcacagtgatagagcactatcatcgcacgtccgcgacgataaccgagctcgttatcggaaacgagtattactttcgggttttcagcgagaacatgtgcgggttgagtgaggatgcgacaatgacgaaggaaagcgcagtcattgctcgggacggaaaaatatacaagaaccctgtgtacgaagatttcgacttcagcgaagccccaatgttcacccagccgctagtgaatacgtacgcgattgcagggtacaacgcgacactgaattgtagcgtgcgtggcaatccaaagcccaagattacatggatgaagaacaaggttgccattgtagatgacccccgatataggatgtttagtaaccagggcgtttgtactctcgaaataagaaagccaagtccttatgatggaggaacctactgttgcaaagctgtgaacgaccttggcacagttgaaattgaatgtaaacttgaggttaaggtcatctaccagggcgttaatacgccagggcagcctgtctttctggaaggccagcagcagtccttgcataacaaggatttctag

SEQ ID NO: 231550 - DNA, 3363 bp, Artificial Sequence
  Description of Artificial Sequence: Synthetic coding sequence
atgcccgagcccaccaagaaggaggattggaccctggtggagactccccctggcgaagaacaagcgaagcaaaatgctaacagtcagctgagcattctatttatcgagaaacctcaggggggtacagtcaaggtcggggaggatatcactttcattgctaaggtgaaggcagaggacctgctgagaaagcccactatcaaatggttcaaggggaaatggatggacctcgcaagcaaggccggaaagcacttacagctgaaggaaactttcgaacggcattctagggtgtacacgttcgaaatgcagatcattaaagccaaagacaacttcgctggtaattaccgatgtgaggtcacgtataaggataagttcgactcttgcagcttcgacctggaggtccacgagtccacgggcactacaccaaacattgacattagaagtgcctttaaaagatctggggagggccaggaagatgctggggaattggacttttcggggctgctgaagcgcagagaggtgaaacaacaggaagaggaaccccaagttgatgtctgggagcttctaaagaacgctaagcctagtgagtatgaaaagatcgccttccagtacggtatcaccgatttgcggggtatgctaaaacggttgaagaggatgcgaagagaggagaagaaatcagccgcttttgcaaagatcctggacccagcttaccaagtcgacaagggcggtagggtaaggtttgtagtcgaactggccgaccccaaacttgaagtgaaatggtataagaacggacaggagattagacctagcaccaagtatatctttgagcacaaaggatgtcagaggattctctttatcaacaattgtcagatgacagacgatagtgagtattacgtgactgccggagacgaaaagtgtagcactgagctgtttgttcgcgaaccccctatcatggtgaccaagcagctggaagacaccactgcctactgcggtgagcgcgtagaattagagtgcgaagtttccgaagacgacgccaacgttaagtggtttaagaatggggaggaaatcatccctggcccaaagtccagataccggattcgggtggaaggcaagaagcatattttgattatcgagggggctaccaaggcggacgcagcagaatactcagtcatgactacgggtgggcagtcatccgcaaaactgagcgtggacctgaaaccgctcaagatacttacgcccctgacagatcagacagtgaatcttggtaaggaaatctgcctgaaatgcgaaataagcgaaaatatccctggaaaatggaccaagaacggactgccagtacaagagtcagaccggctgaaagtggtccataaaggccgtattcacaagttagtgattgctaatgccctgactgaagacgaaggagactacgtcttcgccccagacgcctacaacgtcactttgcctgcaaaggtgcatgttatcgatccccctaagattatactggatggactggacgcagataatactgtgaccgtgatagcagggaataaattgcgtttggagatcccaatctctggcgagcccccaccgaaggccatgtggtcacgcggagacaaggcaatcatggagggatcaggaaggattcgtactgaaagttatccagattcatcaaccctggttatcgatatcgcagaacgagacgactccggcgtgtatcacattaacttgaagaacgaagctggggaggcacacgcaagcataaaggtgaaagtggtagattttcccgacccaccggtcgcgccaaccgtgaccgaggtgggagacgactggtgcatcatgaattgggagccaccagcctacgacggcggatcccccattcttggatatttcatagagcggaagaaaaaacagagtagccgttggatgagactcaacttcgatctctgcaaggaaacaacctttgagcccaagaagatgattgagggagtcgcctatgaggtgcgaattttcgcagtaaatgccattggtattagcaaaccgagtatgccgtctaggcccttcgtgcctctggcggtgacttcacctccaacccttttgaccgtcgacagcgtgacagatactacggttaccatgcggtggaggccgcctgatcacatcggtgcagctggactggacgggtatgtgcttgagtactgcttcgaggggacggaagactggatcgtcgcgaacaaagacctcattgacaagacaaagtttacaatcacggggttgcccacagacgctaaaatttttgtgcgagttaaggctgtgaacgctgcgggagcttccgagcccaaatattacagccagccaatcctggtgaaggaaattatcgaacccccaaagattaggataccccgacaccttaagcagacttacattagaagagtgggggaagcggtgaatctcgtgattccgttccagggaaagcctagacccgaactgacttggaagaaagatggggcagaaattgacaagaaccagatcaatattaggaacagcgagaccgacaccatcatttttatccgtaaagcagaaaggagtcacagcggcaagtatgacttgcaagtgaaagtggataagttcgttgaaactgcttcaatcgacattcagatcattgaccggcctggaccaccacaaattgtgaagattgaggatgtttggggcgagaacgtggccctgacctggaccccccctaaggacgacggtaatgcggcaattaccggctacaccatccagaaggcagataaaaagagtatggagtggttcacggttattgagcactaccatagaacttcagccactatcacagaacttgtgatcggaaatgaatactatttccgggtgttctctgaaaatatgtgtggcctttccgaggatgccaccatgacaaaggagtcggccgtgatcgcaagagacggcaaaatctacaaaaatcctgtgtacgaagacttcgatttctctgaagctcccatgttcacacagcccttggtgaacacctatgctatagctggctacaatgctactctcaactgtagcgtgcggggtaaccctaagcccaaaatcacatggatgaaaaataaggttgccatcgtggacgatccacggtatagaatgttctcgaaccaaggtgtgtgcactctggaaattagaaagccttccccatacgatgggggtacttactgctgcaaggctgtgaacgacttgggaacagtggaaatcgaatgtaagctggaggttaaagtcatttatcagggggtcaacacaccgggtcagccagtcttcttggagggccaacagcaatcccttcacaataaagacttctag

SEQ ID NO: 231551 - DNA, 3399 bp, Artificial Sequence
  Description of Artificial Sequence: Synthetic coding sequence
atgccggagccaaccaaaaaagaagagaacgaagtcccagcgcctgcccctccccctgaggactggacccttgtggaaaccccgccaggcgaggaacaggctaagcagaatgcaaattcccagctgtcaatcctttttatagaaaagccacaagggggtaccgtcaaagtgggggaggacataacatttatagccaaggtgaaagctgaagatctgttgcggaaacctacaataaaatggtttaagggaaaatggatggacctggcctccaaggctgggaagcacttacaacttaaagagacattcgaacgtcattcccgggtgtacactttcgaaatgcaaatcattaaagccaaagacaatttcgcaggcaactaccgttgcgaagttacgtataaagacaaatttgactcatgcagtttcgatcttgaagtgcatgagagtaccggcaccacacccaacattgatattagaagcgcctttaagcggtccggggaaggacaggaggacgctggcgaactcgactttagcggtctacttaagagaagggaggtgaagcagcaggaagaagaaccacaggtggacgtatgggagctcctaaaaaatgcgaaacccagtgaatacgagaagatcgcatttcagtacgggatcaccgacttgaggggaatgctcaagcgcctcaagaggatgcgcagagaagaaaaaaagagtgccgcatttgccaagatactcgacccagcataccaagtagataagggtggtcgtgtgaggttcgtggttgagttagccgatcccaagcttgaggttaaatggtacaaaaacgggcaggaaattcgcccatcaaccaagtacatcttcgagcacaaggggtgccagaggatcctattcatcaataactgccagatgacagacgacagtgagtactatgttacagctggggatgagaagtgctcaacggagttattcgtacgcgaaccacccataatggtgactaaacagctggaagacacaaccgcgtactgtggtgagcgggtagagcttgagtgtgaggtgtccgaggacgacgctaacgttaagtggtttaagaatggagaggaaatcatcccagggcctaaaagccggtatcgaatacgtgtggaaggaaagaagcatattctaattattgaaggcgctaccaaggccgatgcagctgaatatagcgtcatgacaaccgggggtcagtcgagtgctaaactgtccgtggatctgaagcctctcaagatattgacccctctgaccgaccagaccgtgaacctcggaaaagaaatctgtttgaaatgcgagataagcgaaaacatcccgggaaagtggacaaaaaatggactgcctgtgcaggagagcgacaggttgaaagtggtgcacaaaggcagaattcataaactggtgatagctaacgctctgacagaagacgagggcgactacgttttcgcacccgacgcctataacgtgaccctgcccgctaaagtccacgtcatcgatccgccaaagatcatcctggatggactcgacgccgataacaccgtgactgtaatagcgggaaataaattgcgtctggagattcctattagcggcgaacctcccccaaaggccatgtggagcagaggtgacaaggcgatcatggagggctccggcaggattcggactgagagctatccagattccagtacgttggtaattgatatcgctgagagagacgattccggcgtgtatcacattaacctaaaaaatgaagctggggaagcccacgcctcaattaaagtcaaggtggtggacttccctgacccacctgtggcccctaccgtcaccgaggtgggcgacgactggtgcattatgaactgggaacccccagcctatgatgggggaagccctatattggggtactttattgagagaaagaaaaagcagagttccaggtggatgcgactcaatttcgatttgtgcaaggagaccacctttgagccaaagaaaatgattgaaggggtggcttatgaagtccgaatctttgcggtcaatgctattgggattagtaaaccttcaatgcctagtcgcccttttgtgcctctcgcagtgaccagtccccctaccctcctcactgttgattccgttaccgacaccaccgttaccatgcggtggcgaccccctgaccacatcggtgctgctggattggatggttacgtgttggagtactgttttgagggtactgaagattggattgttgctaataaggatctgatcgacaaaacaaagtttactattactggcttacccacagacgcaaaaatatttgttagagtgaaggcagtgaatgccgctggtgccagcgagccaaagtactactcccaaccgatactggttaaggagatcatcgagcccccaaaaatccgaatacctaggcaccttaagcagacctacatccggagggtgggcgaggctgtgaacctggtgatcccttttcaaggtaagccacggcctgagttaacatggaagaaggacggcgctgaaatagataaaaatcagatcaatatccgcaactcagagactgacactattatatttattaggaaagcagagcggagccactccggtaaatacgacctgcaggtgaaagttgataagttcgtcgaaacagcaagcattgacattcagatcattgatcggcctggccctccacagatcgtgaaaatagaggatgtgtggggcgaaaacgtagcccttacatggacaccccctaaggatgacggaaatgcggctatcactggatataccattcagaaagccgataaaaagtccatggaatggtttacggtcattgagcactatcaccgtacaagtgccaccatcacagaacttgtaatcggtaatgaatactactttcgtgttttctctgagaacatgtgcggactctccgaggatgcgactatgacaaaggaaagtgcagtgattgctagagatggtaagatctacaagaatcctgtgtacgaagattttgacttctcggaagccccaatgtttactcaacccctggtgaatacttatgctattgcagggtataacgctacactcaattgctccgtccgaggcaaccccaaacccaagatcacatggatgaaaaacaaagtggccatcgtcgatgatccacgctaccgcatgttcagcaatcaaggcgtgtgtacgctagagatccgtaaaccttccccttatgacggaggtacatactgttgcaaagcagtgaatgacttgggaacggtggagatcgagtgtaaattggaagtgaaagtaatatatcagggtgtgaatacccccggacagcctgtcttcctcgagggccaacaacagagcttgcataacaaggacttttag

SEQ ID NO: 231552 - DNA, 3822 bp, Artificial Sequence
  Description of Artificial Sequence: Synthetic coding sequence
atgccagaacccggtaagaagcccgtttctgccttttcaaaaaagcctagatcagtggaggtagccgcagggtccccggcagtgtttgaggccgagactgagcgcgcaggcgtgaaagtgcgttggcaacgcggtgggagcgacatcagcgcgtccaataaatacggtctggccactgaagggacgaggcacactctgactgttcgggaggtgggccctgccgaccaaggaagttacgctgtaattgcaggaagttctaaggtgaagttcgacctgaaggtgatcgaggcagagaaggccgagcctatgctggccccagctccagccccagcggaagctacaggcgcaccgggtgaggctcctgctccagcagccgaattaggtgaaagtgccccatcacccaaaggctccagttctgccgctctcaacggacccacacctggtgcacctgatgaccccattggtttatttgtcatgcgccctcaggatggggaagtgacagtgggaggaagtattacattcagcgcacgcgtggctggtgctagtctccttaaacccccagtcgttaaatggttcaaaggtaagtgggtggatttgtcaagtaaggttggccagcacctacagttacatgatagctatgaccgcgctagcaaagtttatttgtttgaattgcacatcacggatgctcagccagccttcacaggcagctaccgttgcgaggtaagcaccaaggacaaattcgactgttcaaattttaacctgactgttcacgaagctatgggtaccggggatctggatctccttagcgcattcagaaggacatcactggctggcggaggcaggcgcatctccgactctcacgaggacactggcattctggacttttcgagcctgctgaagaaatcttcatcgtttcggacccccagggatagtaagctggaggccccagctgaagaagacgtttgggagatcctgaggcaagccccaccttcagaatatgagcgcatcgcattccagtacggtgtcactgacttgaggggaatgctcaagcgtctcaaaggtatgcgcagggatgaaaaaaagtccacagcctttcagaagaagctcgagcccgcttatcaagtttccaaaggccacaaaattaggctgactgtagaattagctgaccacgacgctgaggtgaagtggctgaaaaacggacaggagattcaaatgtcaggaagatacatatttgagtctataggcgctaagcgaacattgaccatatcacagtgctcgttagctgatgacgcggcttatcaatgcgtcgtcggaggggaaaagtgcagcactgaactgttcgtgaaagagccaccagtgttaattacacggcctctagaggatcagctcgtgatggtggggcagcgagtggagtttgaatgcgaggttagcgaggagggtgcccaggtgaagtggctgaaagatggggttgaactcacacgcgaagagacctttaaatataggtttaagaaggacggccagaggcaccatcttatcataaacgaagccatgctcgaagacgcaggacattacgcgctgtgcaccagcggtggacaagctctcgccgagctaatcgtgcaagagaaaaaactggaagtgtatcagtctattgccgatctaatggtaggcgcaaaagaccaggcagtgtttaagtgtgaagtgtccgatgaaaacgtaaggggcgtgtggctcaaaaacgggaaggagctagtgcccgattccaggattaaggtcagccatatagggcgtgtacataaactgacaatcgacgacgttacacccgctgacgaggctgactacagttttgtccccgaaggatttgcctgcaatttgtctgcaaaacttcacttcatggaggtgaaaatagactttgtccctcgccaggagcctcccaagatacatctcgattgccccggtcgaattcctgataccatagtcgtggtggctggtaacaaactccgtctggacgtaccgataagtggtgatcctgcacctaccgttatttggcagaaggccatcacacaggggaacaaggctccggctagacctgctcccgatgctcccgaagacacgggtgacagcgatgagtgggtctttgacaaaaagctcctatgcgagactgagggcagagtgagagtggaaacaactaaagaccgcagtatctttactgtggaaggggctgaaaaagaggacgaaggcgtgtacaccgtgaccgtgaaaaatcccgtgggcgaggaccaggtcaatctgaccgtgaaagtaatcgacgtgcccgacgccccagccgctcccaagatcagcaacgtgggcgaggactcctgtacagttcagtgggagcctcccgcatatgatgggggtcagccaatcctaggttacattcttgaacgcaaaaagaagaagagctaccgatggatgcgcctgaatttcgacctgattcaggagctgtcccacgaggcccgacggatgatagaaggagtggtctatgagatgcgcgtgtacgcggtgaacgcaatcgggatgagccgccctagcccagcatcgcagccctttatgccaataggaccaccatccgaaccaacacatcttgctgtagaggacgtgtcggatacgaccgtctcactgaaatggcgtcctcctgagagggtcggtgcgggaggtctggatgggtacagcgtcgaatattgtccagagggctgctctgaatgggtggctgctctgcaaggtctgaccgaacatacgtccattctggtgaaagatctgcctacgggggcacgcctactcttccgcgttcgcgctcataacatggccggaccaggggctcctgtgacaactacagagccagtgactgtgcaagagatactccagcgacctcgactgcagctgccccgtcacttacgccagaccatccagaaaaaggtgggcgagcccgtgaatctcctgattccttttcaaggcaaacctagaccccaggttacttggactaaggaaggtcaacctctcgctggcgaggaggttagcataaggaattctccaacagacactatccttttcatcagagccgctcgacgcgtgcactccgggacctatcaggtcacagtgagaattgaaaacatggaagataaagctacactcgtgctgcaggtagtggacaagccatctccccctcaggatctcagagttacggacgcgtggggattaaacgtcgctttagaatggaaaccaccgcaggacgtggggaataccgagctgtgggggtatacagtacagaaggctgataaaaaaacaatggaatggttcacagttcttgaacattacaggagaacgcattgtgtggtgcctgagctgatcatcggcaacggatactatttccgggtgtttagccaaaacatggtgggattttcagatagggccgctactaccaaggaaccagtgtttatcccgcgacctgggatcacctacgaaccacccaactacaaggctctcgacttcagcgaagctcctagcttcacccaacccctggtcaatagaagcgtaatcgcgggatataccgccatgctatgctgtgcagtgagaggatcgcccaaacccaaaattagttggtttaaaaatggtctagacctgggtgaggatgcaaggtttcgaatgttcagcaagcagggagtgctgaccctcgagattagaaagccctgtccttttgatggcggaatttacgtttgtagagccacaaacctgcagggcgaggctcgctgcgagtgtcgtctcgaggttagagttcctcagtag

SEQ ID NO: 231553 - DNA, 3825 bp, Artificial Sequence
  Description of Artificial Sequence: Synthetic coding sequence
atgcccgagccaggtaaaaagccggtgagcgcttttagtaagaagcccagatctgtggaggtggctgccggttccccagcagtttttgaagccgagacagaaagagccggagtgaaagttcgctggcaaagaggagggtccgacattagtgcctctaacaaatacggcctcgctacagaagggacaaggcataccctcaccgttagagaggtgggccctgccgaccaagggtcctatgcagtaatagccggttctagtaaggtgaaattcgatttgaaagtgattgaggctgaaaaggccgaacccatgttggctcccgcacccgctcccgctgaagccaccggtgctcctggcgaagctccagcaccagccgctgagctcggtgaaagcgccccttcacctaaaggaagttcctcagctgcccttaacggacctaccccaggtgcacctgacgacccaattggcctttttgtcatgcggcctcaggatggcgaagtaactgttggcggtagcataaccttttctgccagagtagcaggcgcaagtcttctgaaaccccctgtcgtgaagtggttcaaaggaaaatgggtagatctctcatcgaaggtaggacaacacttgcagcttcatgacagctacgacagagctagtaaggtttacctattcgagttgcacatcacagatgcacagcccgctttcacaggtagctaccgctgtgaggttagtacgaaagacaagttcgattgcagtaatttcaatctgacggttcatgaggctatgggtaccggcgatctggaccttttgtcggccttccgaaggacaagtttggcaggcggaggcagaagaatctccgacagtcacgaagacaccggaattttagacttttctagcctactgaaaaagagctcatctttccgcaccccccgtgactcaaagctagaggcacctgctgaagaggacgtgtgggagattctccgccaggcccctccttccgagtatgagcgcatcgccttccagtacggggtgaccgatctgaggggaatgttgaagcgactcaagggtatgcgccgagacgaaaagaagtccaccgccttccagaaaaagctggaacctgcataccaggtttcaaaagggcacaagatcagattgacagttgaattagccgaccatgatgctgaggtgaagtggcttaagaacggtcaggaaatccaaatgtcaggatccaagtatatcttcgaaagtatcggtgcaaagcgtacactaaccatcagtcagtgttccctggccgatgatgcagcctaccagtgcgtagtcggtggggaaaaatgtagcactgaactcttcgtaaaagagccacccgtgctgatcacaagacctctggaagatcagctcgtcatggtgggacagagggtagagtttgagtgcgaggtgagcgaagagggcgcacaggtcaagtggctaaaagatggtgttgagctcacaagggaagaaactttcaagtaccggttcaaaaaagacggacagcgccaccatcttattatcaacgaggctatgctcgaagacgccggacactacgctctttgtacttctgggggacaggccctagcagagttgatcgttcaggagaagaaactagaggtttaccagagtatagctgacctcatggtaggcgcaaaggatcaagccgtgttcaagtgcgaggtgtccgatgagaatgtacgcggagtgtggctgaagaatgggaaggaactggtacctgatagccggattaaagtctcacacattggccgtgtacataaactgaccatcgacgacgtgactccggctgacgaggcggactactcatttgtgcctgagggattcgcttgcaatctgagtgcaaagctacattttatggaggtgaagattgacttcgttcctcggcaggagccaccaaagattcatttggattgtcctggacgcatccctgacaccatcgtggtagtggcaggcaacaaactgcgactcgacgtccctatctccggcgaccctgctccaacagtgatctggcaaaaagcgataacccagggaaacaaggcaccagcccgacctgcaccagatgcgcctgaggacacgggagattcagacgaatgggtctttgataagaagctgttgtgtgagacagaaggacgtgttcgggttgagacgaccaaagaccgctctattttcacagtagagggggcagaaaaagaggatgaaggagtctacaccgtaacggttaagaatccagttggtgaggatcaggttaacttgacggtcaaggtcatcgacgtgccagacgccccagcagccccaaagatttctaacgtgggggaggactcctgcacagtccagtgggagccacctgcctacgacggtgggcagccaattttgggatatattctcgagagaaaaaagaagaaatcctacagatggatgagattgaacttcgacttgatccaagaactgtcccatgaagcccgtaggatgatcgagggcgtggtgtacgaaatgagagtgtacgccgtgaatgccattggaatgtcaagaccatccccggcatcacagcccttcatgccaattgggcctccctccgaacccactcatctggccgtggaagatgtctctgacacaacagtcagcctaaagtggaggcctcccgagcgagtcggagccggtgggctggacggatactccgtagaatattgtcctgagggttgctcagagtgggtggccgctttgcaagggctgaccgaacacacctctatcctggttaaagatctgccgacgggcgcacggcttctgttccgtgtccgggcacacaacatggccggacccggtgccccagtaaccaccacggagcctgtcacagtgcaggaaatcctacaacgacctagactgcagttacctcgccacttaagacagactattcagaaaaaggtcggtgaacctgttaaccttttgattccttttcaggggaaacctcgccctcaggtgacctggaccaaggaaggccagcctctggcgggagaggaagttagtattcggaattcacccacggatacaatcctgttcatcagagccgctcgtcgagtgcacagcggcacttaccaagtcaccgtgcgcatcgagaacatggaggataaagccaccctggtgctgcaagttgtcgacaagcccagtcctccccaggatctgagagtgacggatgcctggggactcaacgttgcactggagtggaagcctccccaggacgtgggtaacaccgagttgtggggatacacagtccagaaagctgacaaaaagaccatggagtggtttacggtgctggagcactacagaagaacccactgcgtcgtccctgagttaatcatcggcaatgggtattatttccgggtattttcccaaaacatggtcgggttctctgacagggctgccactactaaagagccagtgtttatcccacgtcctggcatcacatatgagccgccaaactacaaagccctggattttagcgaggccccaagcttcacccaacccttagtcaaccggagcgtgatcgctggctatacggctatgctgtgctgcgccgttcgagggtcccctaagccaaaaatctcttggtttaagaatggactggacctcggcgaggacgccagatttaggatgttctccaagcagggtgtcttgaccctagaaatcagaaaaccctgcccatttgatggcggaatttacgtctgccgtgcaactaacctgcagggggaggccagatgtgagtgtcggttagaggtacgcgtgccccagtag

SEQ ID NO: 231554 - DNA, 3825 bp, Artificial Sequence
  Description of Artificial Sequence: Synthetic coding sequence
atgccagagccaggcaagaaaccggtctcagctttttcaaaaaagcctcggtctgtagaagtggccgcaggaagccctgcggtattcgaagccgaaaccgagagggccggagtgaaagtacgttggcagcgaggaggttctgatatctctgcctccaataagtacgggttggcaacagagggcacaagacatacattgaccgtgagggaggtgggcccagccgatcagggttcttacgctgtcatcgcgggatcatctaaggtgaaatttgatctcaaagttattgaagccgaaaaggctgagcccatgctagcgccagcccctgccccagccgaggcaaccggcgcacctggagaagcacccgcacctgcagccgaattgggagaaagtgctccaagtcccaaaggaagtagctccgcggcactgaacgggcctactcccggagctcctgatgaccctattggcctgtttgtgatgcgccctcaagacggcgaggtcacagtcggcggaagcattactttcagcgcgagggtggccggagcctcactcttgaagcccccagttgtgaagtggtttaagggtaagtgggtggatctgagtagcaaggtcgggcagcacctccaactgcacgactcttacgatcgcgctagcaaagtctatcttttcgagctacacataaccgatgcacaacccgctttcacggggtcttatcgctgcgaggtatccaccaaggacaagttcgattgcagcaacttcaatttaacagttcacgaagcgatgggtacaggggacctagacctgctgagcgcctttcggagaacttcgttagccggtgggggaagacgcatttcagattcccacgaagacactggaattttggacttctctagtctgcttaaaaaacgagatagttttcggacaccacgtgattcaaaactggaagctcctgccgaggaagatgtgtgggaaatcctgaggcaagcccctccctccgaatacgaaaggatcgcctttcagtatggggtgacagatcttaggggcatgctgaagcggctgaagggtatgaggcgcgacgagaagaagtcaacagcgtttcaaaaaaaactggaaccagcataccaggtttccaagggacacaaaatcaggctgacggtggaactggctgatcacgatgccgaagtgaagtggcttaagaacggacaggagatccagatgagcggcagtaagtacatattcgagagtattggggctaaacgcacactgactatctctcagtgtagcttagcagacgacgccgcttatcagtgcgtggtgggaggggagaaatgttccaccgaattgttcgtgaaagaaccccctgttctcattacacgcccactggaagatcagctcgtgatggtaggacagcgtgtggagtttgaatgcgaagtctcagaagagggtgctcaggtgaagtggcttaaggatggagtggaactgacaagagaggagacgttcaaatatcgattcaagaaggatggccaacggcatcatttgatcatcaatgaagcaatgttggaggacgctggtcattacgctttgtgcacctcaggcggacaggctctcgctgaattaattgtccaggaaaaaaagctagaagtataccaatcaatcgccgacctgatggtgggtgctaaggaccaagccgtattcaaatgcgaggtgagcgacgaaaacgtcaggggggtttggctgaaaaatgggaaagaacttgtcccagactccagaatcaaggtgagccacatcggccgagttcacaagctcaccatcgacgatgtgaccccggctgacgaggcagactactctttcgtgcccgaaggcttcgcctgcaacctgagtgccaaactccacttcatggaggtgaagattgacttcgttcccagacaggaaccccctaaaatccatctcgattgcccgggacggatacccgatactatcgtggtggtggccggtaacaaactgcgcctcgacgtgcccattagcggcgaccctgcgccaacagtgatttggcaaaaggctatcactcaggggaataaggcaccagcacgcccagcgcctgatgcccctgaggacacgggagactctgatgagtgggtctttgacaaaaaactgttgtgtgagaccgagggacgtgtacgagtggagaccaccaaggacagatcgatctttaccgtcgaaggagccgaaaaagaggatgaaggcgtatacactgtgaccgtgaagaatcccgtcggtgaggaccaggtcaacctcaccgttaaagttatcgacgtgccagatgccccagccgctcctaagatttcaaacgtaggggaagatagttgcaccgtacagtgggagcccccagcgtatgacggagggcaaccaatcctgggatacattttggagcgcaagaaaaaaaagagctatcgctggatgcgactaaacttcgatctcattcaggaactcagccatgaggcacggaggatgatcgaaggcgtagtttatgagatgagagtgtacgccgtgaatgctatcggcatgtccagaccttcgcccgctagccagccattcatgccgattggcccaccgagtgagccaacacacctggcagtggaggacgtgtccgacaccactgtctccctgaagtggcgtccaccagaacgcgtgggtgcgggtggacttgacggttattctgtggaatattgccccgaaggctgctctgaatgggtggcggctctgcaagggctgactgaacatacgagcatcctcgtcaaggatctgccaaccggagcacgtcttttatttagggtgcgggctcacaacatggcaggccctggagcgccagttactactacagaacctgtaacggtccaggagattctgcagcgaccaagactacagctgccacgacacctgcggcagaccatccagaagaaagttggagagccagtaaatctgctcataccattccagggaaagcctcgaccacaggtgacttggactaaggaagggcagccgctcgcaggagaggaggtttcaatacgaaacagccccacagatactatactgttcattcgcgctgctaggcgagtccatagcggcacctatcaggtgaccgttaggattgaaaatatggaagacaaggcaacactggtcttgcaggtggtcgacaagccgagcccccctcaggatttacgtgttaccgatgcttggggattgaacgttgctctggagtggaagcccccacaggatgtcggcaatacagagttgtggggctatacagttcagaaagccgataaaaagaccatggagtggttcacggtcctcgagcactataggcgcacccactgcgtagtgcctgagttgattattggtaacggttactactttcgcgtgttcagtcagaatatggtcgggttctccgaccgtgccgcaacaacaaaggaaccagtgtttattccgagacccggaatcacgtatgagcctcccaactataaggctttagatttctctgaagctcctagttttacgcagccactcgtgaatcgctccgttatcgccggttacaccgccatgttatgctgcgcagtgcgaggttcccccaagccaaaaatcagctggttcaagaatggactggatctgggcgaggatgcacgattccgtatgttcagcaagcaaggggtgctgacgctggaaattaggaaaccttgcccattcgacgggggaatatacgtgtgtcgcgctactaatctacagggggaagcgagatgcgagtgcagacttgaggtcagggtacctcaatag

SEQ ID NO: 231555 - DNA, 3426 bp, Artificial Sequence
  Description of Artificial Sequence: Synthetic coding sequence
atgcccgaggcgaagcctgctgctaagaaagcccctaagggcaaagacgctcctaagggagcgcctaaggaggcccctcccaaagaggcccctgccgaagctccaaaggaagctccccctgaggatcaaagtcccaccgctgaagaacccaccggggtctttctgaaaaagccagattccgttagcgtggaaacagggaaggatgctgtggtggttgcaaaggtgaacgggaaggaacttccagacaagcccacaatcaagtggttcaaaggaaagtggttggaactgggttctaagagcggcgctcggttttcttttaaagagtcacataattcagcaagcaatgtctataccgtggaactgcacattgggaaggtcgtactcggggaccgagggtattatcgacttgaggttaaggcaaaagatacttgtgacagctgtggattcaacattgacgtggaagccccaagacaggatgccagtggccagagtctagagagcttcaaaagaactagcgagaagaagtctgatacggctggagaactcgacttctctgggcttctgaagaagagagaggttgtggaagaggaaaaaaaaaagaaaaaaaaagacgatgatgacctgggcattcctcccgagatttgggagctgctgaagggagcgaagaagagtgagtacgagaagatcgcatttcaatatggcatcacagacctgcgaggtatgctgaagagattaaaaaaggcaaaagtggaagtgaagaaatcagcagcttttactaaaaagttggaccctgcgtatcaggtcgatagaggcaataaaattaaactaatggttgagatatcggatccagatctgaccctcaagtggttcaaaaatggccaggagatcaaacccagctccaagtacgttttcgaaaatgtgggaaagaaaagaatattgaccattaataaatgcaccttagctgatgacgctgcatacgaagttgcggtgaaagacgaaaagtgctttaccgagctttttgttaaggagcctccagtcttgattgtgacccctctcgaggaccaacaggtgttcgtgggcgaccgggtcgagatggccgtagaagtgtctgaagagggggctcaggtaatgtggatgaaagatggggtggagctgacaagggaggactctttcaaagcccgataccggtttaaaaaggacggtaaacgccacatcctgatcttttctgatgtagtgcaggaagacaggggtcggtaccaggtcatcacgaatggaggtcagtgtgaagctgaacttatcgtagaggagaagcagctcgaagttctgcaggacattgccgacttaacagttaaagccagcgagcaggcagtgttcaagtgtgaggtgagtgacgagaaggttactggtaaatggtataaaaatggagtggaagtcaggccaagcaaacgaattaccatcagtcacgtaggaagattccacaagctggtgattgatgatgtgagacccgaagacgaaggcgattacacttttgtcccagatggatacgcgttgtcactttctgctaagcttaacttcttggaaataaaggtggaatatgtgcctaagcaggaaccgccaaaaatccatctggactgcagtggaaaaacctctgagaacgcaatcgtcgtggtggcaggcaataaactgcggctcgacgtgtctattaccggcgaaccccctcctgtggccacttggctcaaaggagatgaagtattcaccactaccgaaggcaggacgagaatagagaagagagtcgattgtagcagctttgtgatcgaaagcgcacagcgcgaggatgaagggaggtatacaattaaagttacaaatcctgtaggagaggacgttgcaagcatcttcctacaagtggtggacgtgcctgaccccccagaggccgtgagaatcacatcagtcggggaggattgggcgatcctcgtctgggagccaccgatgtacgacgggggaaagcctgttaccggctacctggttgagcggaaaaagaaaggaagtcagcgttggatgaagcttaacttcgaggtgttcaccgagacaacctacgaaagtacaaaaatgatagagggaatcctgtatgaaatgagggtgttcgctgtgaacgctattggcgtctcccaaccatctatgaacacaaaacctttcatgcccatcgccccaacaagcgagcccttacatcttattgtcgaagacgttactgacactaccacaacactgaagtggcgccctccaaatcggatcggcgcaggagggattgacggctacttggtggagtactgcctcgagggcagcgaagaatgggtgcccgcaaacactgagcccgtcgaacgttgtggatttacggtgaagaatctcccaaccggtgctcgtattctctttcgcgttgtcggagttaacatcgcagggaggtcggagcccgctacactcgcccagcctgtgactatcagagaaattgctgagcctccaaagatcaggctgcctcgacatctccgccagacatatatcagaaaagtgggagaacagttaaacttggtggttccgttccaagggaaaccgcgtcctcaggtcgtctggactaagggtggcgcacccttagacacatcacgagttcacgtccggaccagtgacttcgacactgtgtttttcgttaggcaggctgcccgtagcgacagcggggagtacgagctgtccgttcagatcgagaatatgaaggacaccgcgaccattcggatcagagtcgtggagaaggccggaccgcctatcaatgttatggttaaagaggtttggggcaccaatgcgctcgtcgagtggcaggcaccaaaagatgacgggaatagtgagatcatgggctatttcgtgcagaaagcggataagaagacgatggagtggttcaacgtttatgagagaaaccgacatactagctgcaccgttagcgatctaattgtgggcaatgaatattattttcgagtgtataccgaaaatatttgcggactttccgactctccaggggtatcaaagaataccgccaggattctcaaaacaggaatcacctttaaacctttcgaatataaggagcatgacttccggatggctccgaagttcctaacacctctgattgatagggttgtcgtagcaggttattccgccgcattgaactgcgcagtgcggggtcacccgaaacccaaggtggtttggatgaaaaataagatggagattcgggaggatccaaaatttctaataaccaactatcagggagtgctgaccctgaacattagacgacccagcccatttgacgccggtacatacacgtgtcgggcagtgaacgagctgggtgaagccctagctgagtgcaagctcgaggttagggtaccccagtag

SEQ ID NO: 231556 - DNA, 3426 bp, Artificial Sequence
  Description of Artificial Sequence: Synthetic coding sequence
atgcctgaacctacaaaaaaggaggagaacgaggttcctgcaccagcgcctccacctgaggagccgagtaaggagaaggaggctggtacaacaccagccaaggattggacactcgtcgagacacctccaggagaggagcaggcaaagcaaaatgcaaactcccaactctctattttgtttattgaaaagcctcaagggggaacagtcaaggtgggggaggatattactttcatcgccaaggtcaaggctgaagacctgctgcgcaaacccaccatcaaatggttcaaaggaaagtggatggatttagcttccaaggctggcaaacacctgcagcttaaggaaacattcgagcgccacagccgcgtttacacgtttgagatgcaaatcatcaaagccaaggataatttcgccggaaattacagatgcgaagtgacatataaggataaattcgatagttgttctttcgatctggaggtgcatgagagcaccggaaccacgccaaacatcgatatccgttcagctttcaaaagaagcggcgaaggccaagaggacgccggtgagctcgacttctccggcctgctaaagaggcgcgaagttaaacagcaggaggaggaaccacaggtggatgtctgggaactgctcaagaacgcaaagcctagtgagtatgagaaaattgcatttcagtatggcatcacagacctgagaggcatgctcaaacggctgaagcgcatgagaagagaagaaaagaaatctgccgcattcgccaagatcttggatcctgcttatcaagtagataaggggggacgggtcaggtttgtggtggaactcgctgaccctaaattagaagtgaagtggtataagaacggccaggagatccgccctagcaccaagtatattttcgagcacaaaggctgccagcgaatactctttataaataattgtcagatgaccgacgacagtgagtactacgtaacagccggagacgaaaagtgttccactgagctgttcgttcgcgaaccaccaattatggtcaccaaacagctggaggataccacggcatactgcggagaacgagtcgagttagaatgcgaagtctccgaagatgacgccaacgtcaagtggttcaaaaatggggaggaaatcatacccggacctaaaagtaggtatcggatcagggtggagggtaagaaacacatactgatcattgaaggagcaacaaaggctgatgccgctgaatacagcgtgatgaccaccggcggacagtcttctgcaaagctaagcgtagacctgaaaccactgaagattctgacacccttaactgaccagacagtcaatcttggcaaggaaatctgtttgaagtgtgagataagcgaaaacattcccggtaaatggacgaaaaacgggctgcccgttcaagagtcagacagactcaaggtggtgcacaagggcaggatacacaagctggtcatagcaaatgccctcaccgaggacgaaggcgattatgtgtttgcacccgatgcgtacaatgtgactctgccggcaaaagtccatgtgatcgaccctccaaagatcatactggacggactggatgccgacaataccgtgacggttattgccggtaacaaactgaggctcgaaatccccatttctggcgagcctcctcctaaggctatgtggagcaggggcgataaggctattatggagggctctggaaggattcggacggaatcatatcctgatagttccacacttgtcatcgatattgcagagcgcgatgatagcggcgtgtaccacattaatctgaagaacgaagccggtgaggcccacgcctcaataaaagtcaaggtggtggatttccccgaccccccagtagctcctaccgtcactgaagttggcgatgactggtgtataatgaactgggagccacctgcatacgatgggggatctccaatactgggatacttcatcgaaaggaaaaagaagcagtcttcacgatggatgaggctcaatttcgatctttgcaaggagacaacgttcgaacccaagaaaatgatcgaaggcgttgcttacgaggtcaggatcttcgctgtcaatgctatcggcataagcaagccctccatgccctctcgcccattcgtgcccctggcagtgacctcgccgccaaccctcctcacagtggacagcgttacggacaccaccgttaccatgcgctggagacccccagatcacatcggcgctgccggacttgatgggtacgttctggagtactgttttgaggggtcgacttctgctaagcagagcgacgagaacggggaggcagcttacgatctccccgctgaggactggatcgtagcgaataaagacttgatcgataagaccaagttcacaataaccggattgcctacagatgctaagattttcgtcagggtcaaggcagtgaacgccgctggcgcatctgaaccaaaatactactcccagcccatcctagtgaaggagataattgagccacctaaaatccgcataccgagacacctgaaacaaacttatatccgaagggtgggagaagctgtcaatcttgtgatcccctttcagggtaaacccaggccagagctcacctggaagaaagatggggctgagatcgacaaaaaccagattaacattcggaattccgagacagacaccattatattcatccggaaggccgaaagatctcatagcggcaagtacgatctgcaggttaaggtggacaaatttgttgagactgcctccatcgatattcagatcatcgatcggcctggccctccccagatcgttaagatagaggatgtgtggggcgagaacgtagcactgacttggacccctcccaaggacgacgggaacgctgccattaccggctacactattcagaaagccgacaaaaagagtatggagtggttcaccgtaatagaacattaccaccggacgtctgctacaatcaccgagctggtgatcggaaatgagtattattttcgcgtgttctcagagaatatgtgcggcctttcagaggatgcgacgatgacaaaagagagcgctgtcatcgcacgggacgggaagatctataaaaaccccgtctacgaggatttcgattttagtgaggcacctatgttcacccaaccacttgttaatacttacgcaattgccggttacaacgcaacgttgaattgctcagtcagggggaatccaaaacctaaaatcacttggatgaagaacaaggtggcaattgttgatgaccccagatatagaatgttctcaaatcagggagtctgtacactggagattcgtaagccaagcccctatgatgggggaacatattgctgcaaagcagtgaatgaccttggaacggtagaaatcgagtgtaagctcgaggtgaaagtaatagcccagtag

SEQ ID NO: 231557 - DNA, 3516 bp, Artificial Sequence
  Description of Artificial Sequence: Synthetic coding sequence
atgcccgaacccaccaagaaagaggaaaatgaggtgccagctcctgctccgccaccggaagagccatctaaagagaaggaagccggaacgaccccagccaaagacgaggaggaagtaagtccccctagcgctttgcctccgggtctggggagtcgcgctctggaacggaaggattctgactggacgctggtcgaaaccccgcctggggaggaacaagccaagcagaacgccaactcccagctctcaatcctgttcattgagaagccacagggagggactgtgaaagtgggcgaggacataacatttattgccaaagtcaaggctgaggatctgctccgaaagcctaccattaagtggtttaagggcaagtggatggatctggcaagtaaggcaggaaagcatctgcagctgaaggagacctttgagcggcattcccgcgtctatactttcgagatgcaaattattaaggccaaggacaatttcgccggaaactaccgctgtgaagtgacttataaggacaagtttgactcctgctctttcgatttggaggtgcatgaatcgacaggtaccactcctaacattgatattagatctgcctttaagcggagtggtgagggtcaggaggatgctggagaactggacttttcaggactgctcaagcgcagggaggtgaagcaacaggaggaagagccccaggtggatgtatgggaactgcttaagaacgctaagcccagcgagtacgaaaagatagctttccagtacgggattaccgatttgagaggaatgttaaagcgcctaaagcggatgagaagagaggaaaagaagagtgccgctttcgctaaaattctggatcctgcataccaggtggacaagggcggaagagtccgtttcgtcgtggaacttgctgacccgaagctggaggtaaagtggtataagaacgggcaggaaatccgccctagcacgaagtacatcttcgagcataaaggctgtcagcggatcctgttcattaacaactgccagatgaccgatgactctgaatactacgtgactgcaggagatgagaagtgttcaacagagctgttcgtgcgggagcctcccattatggtgaccaagcagctcgaagataccactgcgtactgtggagaaagagtggaactggagtgcgaagtgtctgaagatgacgctaatgtcaagtggtttaagaacggcgaagagattattcccggacctaagagccggtacaggattcgcgtggagggcaagaaacacatactgataattgaaggcgcaaccaaggccgacgctgccgagtactccgtgatgacaaccgggggacagagttccgccaagctgagcgttgatcttaagcctctgaagatcctgacgcccctgacagatcagaccgttaacctgggtaaggagatctgcctcaagtgcgagattagcgagaacatacctggtaaatggacaaagaacggtctgcccgtccaagagtccgacaggctgaaggttgtccacaaaggaaggatccacaaacttgtgatagctaatgccttaacagaagatgagggcgactatgtgtttgcgcctgatgcatacaacgtcaccctccccgctaaggtgcatgtgatcgacccgccaaaaattatactggacgggctggatgcggataatacagtcaccgtgattgccggaaataagctccggctggagattccaattagcggtgagccccctcccaaggccatgtggagcaggggagataaagcgattatggagggaagcgggcgaatccgtacggaatcctaccccgattcttccactttagtgatcgatatcgcagaacgcgatgactctggcgtgtaccacatcaaccttaaaaatgaggctggagaagctcatgcctccatcaaggtcaaagtggtggatttcccggatccacccgtcgctcccaccgtcactgaggtcggcgatgattggtgcattatgaactgggagccccctgcatatgacgggggatccccaatactgggctactttatagagaggaaaaaaaaacagtcttcacgctggatgcgactgaactttgacctctgtaaagagaccacgttcgagccaaagaagatgattgaaggagtggcctacgaggttaggatttttgcggtaaacgccatcgggatctcaaaaccaagtatgccttctcgcccatttgtgcccctggcggtcacttcacctccgaccctccttaccgtggactccgtgaccgacaccactgtaaccatgaggtggagacccccagaccatattggcgctgcgggactggatgggtatgtgctagaatactgctttgaagggactgaagactggatagtagccaataaagacttgattgataagactaaattcactattacgggcctgccaactgacgccaagatcttcgttcgggttaaggcagttaacgccgctggcgctagtgaaccaaagtattattcccagccgatcctggttaaggaaatcatcgaacccccaaaaatcagaattcctcgacacctgaagcagacctacattagaagagtgggtgaagcagtgaatctggtgatccctttccaaggcaagccgcgtcctgaacttacttggaaaaaggacggggctgagatcgacaaaaatcagatcaatattcgaaactctgaaaccgatacaattatttttataagaaaggctgaacgctctcatagtggtaaatacgaccttcaagtaaaagttgacaaatttgtggaaacagcatcaattgatatccaaataatcgataggcccggtccgccacaaatagtgaaaattgaggatgtgtggggtgaaaatgtggctctgacatggaccccaccaaaagatgatggcaacgccgcaatcaccggttatacaattcagaaagcggataagaaatctatggagtggttcaccgtcatagagcactaccatagaacgagcgcgacaattacagagctggtgattggcaatgaatactattttcgggtattctctgagaacatgtgtggacttagtgaagacgcgacaatgactaaagaaagcgcagttatcgcccgagacggcaagatttacaagaatccagtgtacgaagattttgatttctccgaagcacctatgtttacacagcccctggtgaacacttatgccattgctggatacaatgccacactaaactgctcagtccggggaaatcccaaacctaagattacctggatgaagaataaagtggccatcgtcgacgatcctcgctaccgaatgttttccaaccaaggggtttgtaccctggagattcgaaagccatcaccttatgatggtggtacgtactgttgcaaggccgtcaacgatctgggaacagtggaaatagagtgcaaactagaggtaaaagtgatctatcaaggcgtgaatacgcctgggcaaccagtgttcctggagggacagcagcaatcattacataacaaagatttttag

SEQ ID NO: 231558 - DNA, 3447 bp, Artificial Sequence
  Description of Artificial Sequence: Synthetic coding sequence
atgcccgagcccaccaaaaaggaagagaatgaggtacctgcgcctgccccacccccagaagagccttccaaggagaaggaggcgggaaccacacccgcaaaggatgaggaggaggtgtcccccccatctgccctcccacccggattaggatctcgtgcccttgagcggaaggattccgactggaccctcgtagagaccccacccggagaggaacaggcgaaacaaaacgccaatagtcagttgagcatcctattcattgaaaagcctcagggtgggacagtcaaggtgggcgaagacattacctttattgccaaggtcaaagcagaggacctgttgcggaagcccactatcaaatggtttaagggaaagtggatggacctggcctccaaggctggaaagcacctgcagctgaaggagacattcgagaggcactcccgagtgtacacgttcgagatgcagatcattaaggctaaggacaatttcgctggtaactacaggtgtgaagttacatacaaagacaagttcgactcatgctccttcgatctagaggtgcacgagagtaccggaaccactccaaacattgacattaggtcagcatttaagcgttctggcgaaggacaggaagacgccggtgagctggacttctccgggctgctgaaacgacgagaggtcaagcagcaggaagaggagccccaggtggacgtttgggaactgctcaagaatgcaaagcctagtgagtatgaaaaaattgcctttcaatatggaatcacagatctccggggtatgttgaaacgcctcaagagaatgcgcagagaggagaagaagagcgcagctttcgccaagatcctggaccccgcttaccaggtcgataagggaggcagagtccggtttgttgtggaactggcggacccaaaactggaagtgaagtggtataaaaatggccaggagattcgcccttccaccaagtacatcttcgagcacaaagggtgccagagaatcctgttcatcaacaattgtcagatgacggatgacagcgaatattatgtgaccgcaggcgacgaaaaatgttctacggagcttttcgttagagaaccccctatcatggttaccaaacaacttgaagacaccaccgcttattgcggagagcgtgtcgaactggaatgtgaggtgtccgaggatgacgcgaacgtgaagtggttcaaaaacggggaagagatcattccaggacctaagtcccgctaccgaatccgcgttgaaggcaagaagcacatactcataattgagggcgcaacaaaagccgatgccgcagagtattcggtaatgactactggcggtcaatcatcggctaaactgtctgtggacctgaaaccattaaagattttgacacctttaaccgatcagacggttaatctgggcaaagaaatttgtctgaaatgtgagatctccgaaaacatccccggtaagtggactaagaacggcttgcccgttcaagagagcgataggctcaaggttgttcacaagggcaggatacataaactcgtcattgcaaacgccctcacggaagacgagggggattacgtctttgcccctgacgcttacaatgtgacgctgcccgctaaagtacacgtgatcgacccccctaaaattatcttggacggcctcgatgccgataacacagtcaccgtgatagccggaaacaagctcagattagagattcccatttcaggagagcctcccccaaaggccatgtggtctcggggagacaaggcgattatggaaggaagcggccgaattagaacagaatcatatcctgactcttcaacactggtgatcgatattgccgaacgtgatgacagcggtgtgtaccatatcaatctgaaaaacgaagccggtgaagcgcacgcgtctatcaaggtgaaggttgtggattttccggaccctcctgtagccccaaccgtcacagaagtcggggatgactggtgtatcatgaactgggagcctcccgcatacgacggagggtcacctatcctggggtacttcattgaaaggaagaagaagcaatctagtaggtggatgcgactgaatttcgacctctgcaaagaaactacatttgaaccaaaaaaaatgattgaaggggtggcgtacgaagttcgtatattcgcggttaatgctatcggaatatcgaagccgagcatgccctcgagaccgtttgtaccgctcgccgtcactagccccccaacactgctgaccgtcgattcagttaccgataccacagttactatgaggtggagacctccagaccacatcggggcagcaggcctcgatggctatgtgcttgaatattgtttcgaaggcacagaggattggatagtagctaacaaggatctcatcgataaaacaaaattcacgataactggacttcctactgatgcgaaaattttcgtgcgcgtcaaggctgtcaacgctgcgggagccagtgagcccaaatattatagtcagcctatcctggtgaaagagattatagagccccctaaaattcgcatcccccgtcacctgaaacagacatatatcaggcgcgtgggcgaagctgtaaacctcgtcatcccttttcagggtaaaccccgtcccgagctgacatggaaaaaggacggtgctgagatcgacaagaaccaaatcaacataagaaactcagagaccgacacaataattttcatccgcaaagctgaacgcagccatagtgggaagtacgatcttcaggttaaggtcgacaaatttgtggagacagcaagcattgatatacagattatcgataggcctggacctccccagatcgtgaagatagaagatgtgtggggtgagaatgtcgcactgacctggactccccctaaagacgacggtaacgccgcaattactggatatacaatacagaaagctgataagaaatccatggagtggttcaccgtaatcgaacattatcatcgaacatcagccacgatcaccgagttggttatcgggaacgagtactacttcagggtcttcagcgaaaacatgtgcggcttgagcgaagacgctacaatgaccaaagagagtgcggtgatcgctagagacgggaaaatttataagaatccggtctatgaagactttgatttctcagaggctcccatgtttacacaaccgctggtaaatacatacgccattgccggttacaacgccactctgaactgttctgtaaggggcaaccccaaaccgaaaattacatggatgaagaacaaagtggccattgtggacgaccctagataccgcatgttctccaaccagggtgtctgcacactggagatccgaaagccctcgccatacgacggaggcacatactgctgcaaagcggtaaatgatctcggaaccgttgagatcgaatgtaaactggaagtcaaggtgatcgctcaatag

SEQ ID NO: 231559 - DNA, 3495 bp, Artificial Sequence
  Description of Artificial Sequence: Synthetic coding sequence
atgcctgagccaacaaaaaaggaagagaacgaggtacctgcgcctgcaccgccacccgaggagccaagcaaggagaaagaagctggaaccacaccagctaaggactggacactggtcgaaacaccacccggagaggagcaggccaaacaaaacgccaatagccagctctctatcttgtttatcgaaaaaccccaaggaggcactgtgaaggtaggcgaagacatcacgtttattgccaaggtaaaggcggaggaccttctgagaaagcctactattaagtggtttaaaggcaagtggatggatttggccagcaaagcaggcaaacacctgcaactgaaagaaaccttcgagcgtcacagccgggtgtatacattcgaaatgcagatcatcaaagctaaggataattttgccggaaattatcgttgtgaagtgacatacaaagataaatttgatagttgttctttcgatctggaggtgcacgaatcaaccggcacaacccccaacatagacatccgatcggcctttaaacgttcaggggaaggccaagaagatgcaggggagctggatttttccggccttctgaagcggagagaggttaaacagcaagaagaggagccccaggtcgatgtatgggaactcctgaaaaatgccaaacccagcgagtacgagaagatcgcttttcagtacgggataaccgacctgagaggtatgcttaagcggctcaagcggatgcgccgtgaagaaaagaaaagcgccgcttttgccaaaatcctggatcccgcatatcaagtggataagggtggccgtgtccggtttgtggtcgaattagccgacccgaaattggaagtgaagtggtataagaacggccaggagatcagaccctcaacaaagtacatcttcgagcacaagggctgtcagcggatcttgttcatcaataactgccaaatgacagacgatagcgagtattacgttaccgctggcgatgagaaatgctctacggagttgttcgtacgcgaaccaccaataatggtgacaaaacagctggaagatactaccgcttactgcggtgaacgggtggaattggagtgcgaggtttctgaggatgatgctaatgtgaaatggttcaagaatggagaggagatcatccctggtcctaagagccgctaccgcatccgggttgaggggaaaaaacatattttaattatcgaaggtgcaaccaaggccgacgcggctgagtactctgttatgactaccggtggacaatctagtgcaaaattgtcagtcgacctgaagcctctgaagatcctcactccgctgaccgatcaaaccgtgaacctcggcaaagaaatttgtttaaagtgcgaaatctccgagaacattccaggtaaatggacgaaaaacggacttcctgttcaagaatccgaccggcttaaagtggtgcacaagggcagaatccacaagttggtcatcgctaacgccctaaccgaggatgagggggactatgttttcgccccagatgcctacaacgtgacgttaccagccaaagttcacgtgatcgacccacccaaaatcatcttagatggcttagatgccgataacactgtgactgtcattgcgggtaataaactgagactcgagattccaatctctggtgagccacccccaaaggctatgtggagccgcggtgacaaagccattatggagggatcaggacgcatacggaccgaaagttatccagacagttcaactctggttatcgatatagcggaacgcgatgacagcggcgtctaccacattaatctaaagaacgaagcaggagaggcacatgcttctattaaggtgaaagtggtcgactttccggatcctcccgttgccccaactgtaaccgaggtgggcgacgattggtgcattatgaactgggagccccctgcatacgatggaggctcgccaatcctaggctatttcatcgagcgcaaaaagaagcaatcatcaagatggatgaggctcaatttcgacctgtgcaaagaaaccactttcgagcccaaaaaaatgatcgaaggcgtggcctatgaggttcgtatctttgctgtaaacgccatcgggatctctaaaccatcaatgccatccagaccattcgtccccctggctgttaccagccccccaactctccttaccgttgattctgtgaccgacacaaccgtcacgatgcgttggagacctccggatcatatcggggctgcgggattggatggttatgtccttgagtattgtttcgagggatctacgtccgccaaacagtccgatgagaatggagaggccgcttacgacttgccagctgaggactggatcgtggcgaacaaggacctgatcgacaaaactaaattcactatcaccgggctccctacagacgcgaaaatttttgtgcgagtgaaggcggtgaacgccgctggagcttctgaaccaaagtactatagccagccaatactggtgaaggagattattgaaccacccaaaataagaatcccaagacacttaaagcagacatacattcgcagggtcggggaggcggtcaatctggtgatcccatttcagggcaaaccacggccagagttgacttggaaaaaggacggggctgagatagacaaaaatcagattaatatcaggaattccgagacagatactattatcttcatacggaaagctgaaagatcccattccggcaaatacgatctgcaggttaaggtggacaagtttgtggagacggcgtcaatcgatatccagatcattgataggccgggaccaccccagatagtcaagatcgaagacgtgtggggcgagaacgtcgcgctcacctggacaccaccgaaggatgacgggaacgctgccattactggctatactatccaaaaagccgacaaaaaatccatggaatggttcactgtgatcgaacattaccatcgcacaagtgccaccatcaccgagctagtgattggaaacgagtattattttagagtcttttctgagaacatgtgtggactgtccgaggacgcaacaatgacgaaggagtccgcagtgatagcgagagatgggaagatttataagaatccagtctacgaagattttgacttttccgaagcccctatgttcacacagccactcgtcaacacatacgccattgctggatataacgctacattgaactgcagcgtgagggggaatccaaagcctaagatcacgtggatgaaaaacaaagtcgcaatcgtcgatgacccccgttataggatgttctctaaccagggcgtctgtactctggagattaggaagcccagcccttacgatggcggtacttattgctgcaaggccgtcaatgacctcggcactgtggagattgaatgtaagttagaggtgaaagtcatttaccagggggtgaatactccaggacagcccgtctttttggaaggtcagcagcagtctctgcacaataaggacttctag

SEQ ID NO: 231560 - DNA, 2349 bp, Artificial Sequence
  Description of Artificial Sequence: Synthetic coding sequence
atgcccgaacctacaaagaaagaggagaatgaagtcccggctccagctccacctcccgaagagccatccaaggagaaggaggctggaaccacaccagccaaagacgaagaggaggtgtctcccccatccgcccttccaccgggattgggaagtagggctctggagcgcaaagactccgactggaccctagtcgaaacaccgcctggagaagagcaggccaagcagaatgcaaactcccagttgagcattctctttattgaaaaaccccaaggcggtactgtgaaagttggcgaggacataaccttcattgctaaggtgaaggccgaggatctccttagaaagccgactattaagtggtttaaaggcaagtggatggatttggcctccaaagctggcaagcacctgcagctaaaagagacgttcgagagacattcacgagtctatactttcgagatgcaaataatcaaagcgaaggacaattttgcaggtaactatagatgtgaagtcacttacaaggacaagtttgactcatgctccttcgacttggaggtccacgagtccacagggactacccccaacatcgatatacgctccgcattcaagaggagcggcgaagggcaggaagacgcaggtgaactggacttctccgggttgctaaaacgcagggaggtgaagcagcaggaggaggagccccaggtcgatgtgtgggaattacttaaaaatgcaaagccatccgagtatgaaaaaattgcattccagtacggtatcactgatctgcgcggaatgctcaagaggctgaagcgcatgagacgcgaagagaagaagtcagcggctttcgccaagattctcgatcctgcctaccaggttgataaaggtggaagggtgcgatttgtggtcgagctggctgatcctaagcttgaggtaaagtggtataaaaacggtcaggaaatccgacccagtactaaatacatctttgagcataaaggatgccagcggatcctgttcattaataattgccagatgacagatgattcagaatattatgtgacagccggtgacgaaaagtgcagcaccgaattgttcgtgcgcgaaccccctattatggtcaccaaacagttggaagacactacagcttactgcggagaaagagtggaattagagtgcgaggtgtctgaggatgatgctaacgtgaagtggttcaaaaatggcgaagagatcatccccggacccaaatccagatatcgcatcagggtcgaagggaaaaagcacattctaatcattgagggtgctacaaaagctgatgcggcagagtacagtgtgatgactacagggggacaatcctccgctaaactgagcgttgatcttaaaccgctcaagatccttacacccttaactgaccaaaccgttaacctgggaaaggagatttgtctcaagtgcgagatctcagagaacatcccaggtaaatggacaaagaatgggctacccgtccaggagtctgatcgccttaaagtggtgcataaaggcaggatccataaattggttatagctaatgctctaactgaggatgagggagattatgtctttgctcccgacgcatacaatgtaacccttccagctaaggttcatgttatcgacccgccaaagattattttggacggcttggacgctgacaatacagtcacggtgatagccggtaataagctgcgcctggaaatccccattagtggggagccgcctcctaaggcaatgtggagtcggggagataaagcaatcatggaggggtccgggaggattcgaacagagagctatcccgattcatctactctagttatcgacattgctgagcgcgacgacagtggcgtgtaccatatcaacctcaagaacgaagccggagaggcgcatgcgtctataaaagtgaaagttgtggattttccggacccaccagttgccccaactgtgaccgaggtcggagacgactggtgcatcatgaactgggaacctcctgcctacgatgggggttctcccatattaggatatttcatcgagagaaaaaagaagcagagcagtaggtggatgcgcttgaacttcgatctgtgtaaggagacgacgttcgagcccaagaaaatgattgagggtgtggcgtacgaagtgagaatatttgcggtgaatgccataggaatttctaagcctagcatgccatctcggccttttgttccactggccgtgacgagcccgccaactcttttgaccgtggattctgtgacagacacaactgtaacaatgcgctggcgccctcggccacattggtgttctcggttccgctggctatgcgctcgggtactattgtag

SEQ ID NO: 231561 - DNA, 3426 bp, Artificial Sequence
  Description of Artificial Sequence: Synthetic coding sequence
atgccagagcctacaaaaaaagaggaaaatgaagtccctgccccagccccaccccctgaagaaccctctaaagagaaagaggccggaacgacccctgcgaaggactggacgctggtggagacccctcctggcgaagagcaggctaaacagaacgcaaattctcaactgagcatcttattcattgaaaagccacaaggcggaacagtaaaggtcggtgaggacataacgtttatcgcaaaggtgaaagccgaagatttacttagaaaaccgaccattaagtggtttaaaggcaaatggatggacctggcatctaaagctggaaagcacctgcagctcaaggaaacatttgagcgccatagtcgtgtgtacaccttcgagatgcaaatcatcaaggcaaaggataattttgcaggcaattaccggtgcgaagtgacatacaaagacaaatttgatagctgttccttcgatctcgaagtccatgaatccacaggcaccactcccaatattgacataagatctgctttcaaacgaagcggcgaaggccaagaggatgctggtgaactcgatttctcagggcttctgaaacgccgtgaagtgaaacaacaggaagaggaaccacaggttgacgtgtgggagctgcttaagaacgctaaaccttctgagtatgaaaagatagcttttcaatacggtattacagatctcaggggcatgttgaagcggctcaaaagaatgagacgggaggagaagaagagcgcagcgtttgccaagatcctagatccagcttaccaggtggacaaaggtggacgggtaagattcgtggtagagttggcggatcccaagcttgaggtgaaatggtacaaaaacggacaggagatacgtcccagtacaaagtacatttttgaacacaaagggtgccagcggattcttttcatcaataattgccagatgaccgacgatagcgagtactacgtgaccgccggagacgagaagtgctccaccgaattgttcgtgagagagcccccaattatggtgacgaaacagctggaggacactaccgcgtactgtggcgagcgcgtggagttagaatgcgaagtttcagaagatgatgccaatgtcaagtggtttaaaaacggagaagaaattatcccagggccaaagtccagataccggatcagggtcgagggaaaaaaacatatcctgattatcgagggagctacaaaagccgatgccgcagaatacagcgtcatgaccaccggtggacagtccagcgccaaattgtcagtggacctcaagcccctgaagatcctcactcctctcaccgaccaaactgtgaatctgggcaaggagatatgtttgaaatgtgaaattagtgagaacatcccagggaagtggactaaaaacgggctcccagtacaggaaagtgatcggctcaaggtggttcacaagggaaggatacacaaactcgtgatcgcaaacgccttgacggaggacgagggagactacgtattcgcgcctgatgcctacaacgtcaccttgcctgctaaggtacacgtgatcgaccctcccaagatcatcctggacggactcgatgccgataacacggttaccgtgattgccggtaataaactgcgcctagagatcccaatcagcggggagccccctcctaaagcgatgtggtcccggggtgacaaggcaatcatggagggctcaggcagaataagaactgagtcctatcctgactcctcaaccctggttatagacattgccgagagagatgatagtggcgtgtaccacataaatcttaagaacgaagctggggaggcccatgcctcgattaaggtgaaggtagtggacttccccgacccaccagtagcacccacggttacagaggtgggcgacgactggtgcattatgaattgggaaccgcctgcctatgatggcggaagccccatcctgggatatttcatagaaaggaagaagaaacagagcagccgatggatgcgtttaaatttcgatctgtgtaaagaaacaaccttcgagcccaaaaaaatgattgagggggtagcctacgaagttcggatcttcgcagttaatgccattggaatttctaaaccctcaatgccttccaggcccttcgtccccctcgcggttacctccccaccaacactccttactgtagacagtgttactgataccaccgtgactatgcgttggcggcctcctgatcatatcggtgcagctggtctcgacggttacgttctggaatattgctttgaggggtcgacgtctgctaaacaaagtgacgagaacggagaagcagcctatgatctcccagccgaggactggattgtggcgaacaaggatctgattgacaagactaagttcactattacaggactacccacagacgcaaaaatttttgtacgggtgaaggctgtcaacgctgcgggagccagtgaacccaagtactatagtcagcctattttggtgaaagaaataattgagccacccaagattcgtatcccacggcatctgaaacagacatacattcgtagagtcggtgaggccgtcaacttagtcatacctttccagggcaagcccagacctgagctgacctggaagaaggatggggcagaaatcgataagaatcagataaacatccgcaacagtgagacagacactataattttcattagaaaggcagagaggtctcactctggaaagtatgatttgcaggtgaaggtggataaattcgtggaaactgccagcatcgacattcaaatcatcgacagacctggtccacctcagattgtcaaaatagaagatgtctggggggagaacgtagcactgacatggactccacccaaggacgacggaaacgcggctattaccggctatactatccagaaagctgacaaaaaaagtatggagtggtttaccgtaatcgagcattatcaccggacatcggcgacaatcaccgaactcgttataggaaatgagtactactttcgggtgttttctgagaacatgtgcggcctgagcgaagacgccactatgactaaggaatcagcagttatcgcaagggatggtaagatttacaagaaccctgtgtacgaagactttgacttctctgaggcgccaatgttcactcaacctctggtgaatacatacgccattgccggatataacgcaacactgaattgttccgtcagaggcaacccgaaaccgaagatcacatggatgaaaaataaagtagcgattgtggacgatccacgctaccggatgttcagtaatcagggagtgtgcacactcgaaatccgcaaacccagtccatacgacggaggcacttactgctgcaaggcggttaacgatctgggcaccgtggagatagagtgcaaactggaggtgaaagtaatcgcacaatag

SEQ ID NO: 231562 - DNA, 3372 bp, Artificial Sequence
  Description of Artificial Sequence: Synthetic coding sequence
atgcctgaaccgactaaaaaggaggagaacgaagttccggctcccgctccaccaccagaagaacctagcaaagagaaggaggccggaactaccccagccaaagattggaccttggttgagacacctccaggggaagagcaggctaagcaaaacgctaatagccaactgtcaatcctgttcattgaaaagccccaaggaggcaccgttaaggtgggtgaggatatcactttcatcgccaaggtgaaagctgaagacttgttacgaaagccaaccattaaatggtttaaaggaaaatggatggatctggcaagtaaggctggcaaacatctccagctcaaagagacatttgagcgccacagcagggtttacacattcgaaatgcagatcattaaggcaaaagacaactttgctggcaattaccggtgcgaggttacctacaaagataagttcgactcctgttcttttgacctagaggttcatgagtccactggcactactcctaatatcgacatccgaagcgccttcaaacgatccggcgaagggcaggaggatgcgggagaattggacttctccgggctgttaaaacgtagggaagtaaaacagcaggaggaggaaccccaagttgatgtctgggaacttctaaagaatgccaaacctagcgagtatgaaaaaatcgcctttcaatacgggattactgatctgcgcggtatgctgaaacggctgaagcgaatgcgcagggaggaaaagaagtcagctgccttcgcaaagatcttggatcctgcttaccaagtagataagggcggtagggtccggtttgtggtcgaactagccgatcccaaattggaggtgaaatggtacaagaatggacaagagatcagaccaagtaccaaatacatcttcgaacataaagggtgtcagcggattctcttcatcaataactgtcagatgacagatgattcagagtattatgtgacagcaggagacgagaaatgttccacagagcttttcgttcgtgagccacccatcatggtgactaaacagttggaagacacaaccgcttactgcggggagagagtggagctggagtgcgaggttagcgaagacgatgcaaacgtgaagtggttcaaaaacggcgaggaaattataccgggtccgaagtcgcggtaccggatccgcgtagaaggtaagaaacacatcctgataatcgagggtgccacgaaagcagacgccgctgagtactcagtgatgaccacaggaggccagtcctctgcgaagctgtcggtggacctgaagcctttgaaaatcctaacgcccttgaccgatcagacagtgaacctgggaaaagaaatctgtctgaaatgtgagatcagcgaaaacattcccggtaaatggacaaaaaacgggctgcccgtccaggagtctgacaggctgaaagttgtgcataaaggcaggatacacaaactggtgattgccaatgccctgaccgaggatgaaggggactatgtcttcgcccctgatgcctataacgtgaccctccctgccaaggtgcacgtgattgaccccccaaagatcatacttgatggattggacgccgataacacagtaactgttatagctgggaacaaactgcgcctggaaatacctataagtggggagcctcccccaaaggcgatgtggtccagaggcgacaaggctattatggagggatccggcagaattaggactgagtcttacccggattcctcaactctggtgatcgatatcgcagaacgagacgactccggggtgtatcacataaacctgaaaaacgaagctggtgaagctcacgccagcatcaaagtcaaagttgtggacttccctgaccccccagtggctccaaccgttacagaagtcggtgacgattggtgtattatgaattgggagcctcccgcttatgatggaggatctccaattctgggctatttcattgaacggaaaaaaaagcaaagttctcgctggatgcgactgaattttgatttatgcaaggagactacttttgagccaaagaaaatgatcgaaggggtggcctatgaggtcaggattttcgcagtcaatgccataggcatatcaaagccgtccatgcccagtagaccctttgtccctctggccgtaacaagccctcccactctcttgaccgttgacagcgtcactgatacaacagttacaatgcgctggcggcctccggatcatattggtgcagcgggtcttgacggctatgtcttggagtactgcttcgagggtacagaggattggatcgtcgctaacaaagaccttattgataagaccaagttcacaatcaccggccttccgactgatgctaaaattttcgtccgcgtaaaagccgtcaacgccgctggggcaagcgagcccaaatattattctcagccgatcctggtgaaggaaatcatcgagcccccaaaaattaggatccctcgacacttaaagcagacctacatcagaagggtcggcgaagccgtgaatttggttattcccttccagggtaaaccaaggccggaactcacctggaagaaggatggcgcagagatcgacaaaaaccagatcaacattagaaatagtgagaccgacaccatcatcttcatccgcaaagcagagagatcccactcaggcaagtacgatctgcaggtcaaggtcgataagttcgtggagacagcgtctatcgatatacaaatcatcgaccgccctggccctcctcagattgtgaagatcgaggatgtatggggagaaaacgtggccctaacgtggacgccccctaaagacgatggtaatgcggctatcacgggctatactatccagaaggctgacaagaaaagtatggagtggttcaccgtcatagaacactatcaccgcactagtgcaactataacggaattagtgatcgggaatgaatactattttcgagtcttctccgaaaatatgtgtggactctctgaagacgccaccatgaccaaggagagcgccgttatcgcccgagacggcaaaatatacaagaatccagtgtacgaagacttcgatttcagtgaagcccctatgttcacccaaccattagtgaatacatacgccatcgctggctacaacgctacactgaattgtagtgtacgaggcaaccctaaacctaagatcacatggatgaagaacaaagtggcgatcgtggacgaccctcgatacaggatgttctctaaccagggggtctgcacactcgaaatccggaaaccctccccatacgatggtggcacctattgttgtaaggctgtcaacgatcttgggaccgtcgagatagagtgtaagctggaggtaaaggtgatcgcccagtag

SEQ ID NO: 231563 - DNA, 1434 bp, Artificial Sequence
  Description of Artificial Sequence: Synthetic coding sequence
atgatggaaaagaatacctctgagggtccagcctgcagtccagaagaaactgctagtgagtcagccaaggtgcccaccgcagagcccccaggggaagtggcggtctctgaatcaacacgagaagaacaggtccccaagccccaggctccggctccccaagcaccaactgcctcaaccgccactaagccagcaccaccatccgaagatgttccaagcgctccccttctgctcaccctggacgacgtgtcctcatcctcagtcactgtgagctgggaaccgcctgagcggcttggaaggctagggctgcagggctacgtgctcgaactgtgcagagagggcgcatccgaatgggtacccgtaagtgcgcgaccaatgatggtcacccagcagacagtaaggaacctcgccctcggcgacaaatttttgctccgcgtgagtgcagtgtcatccgccggtgccggtcctcctgctatgctcgatcaacccattcacatccgcgagaatatagaagccccaaagataagggtccctcgccatctgagacaaacgtatatcagacaggtgggagaaacggtcaatctgcagatcccgttccaaggtaagcccaagccccaggccacctggacccataacgggcatgctctcgactcacagcgcgtcagtatgagaacaggcgatcaagacagcattttatttatcaggagcgcccagaggagtgactccggcaggtacgagttaacggtcagggtcgaggaccttgaagcgaaggcagtaattgacatattagtaatcgaaaaacccggaccgccttcctctatcagactgctggacgtgtggggctgtaacgccgctctacagtggacacctccccaggatacaggaaacaccgaattgctgggatacatggtccagaaagccgataaaaagaccggccagtggtttaccgtactggaacggtaccatcccacaacctgtaccatcagcgatttaattatcggcaattcctactcattccgtgttttctcagagaacttatgcggcctaagtacatccgccaccgtcacaaaagagcttgcgcacattcagaaggctgacattgccgcaaaacctaagggttttatcgagcgggatttctccgaggcgccttctttcacacaaccactggccgaccacacatctacgcccggatactccactcagctgttttgctctgtacgcgcatctcccaaaccaaaaattatctggatgaagaataagatggaaatccagggaaatcccaagtaccgggctcttagtgagcagggcgtgtgcaccctggaaatccggaaacctagcccctttgacagcggcgtgtatacctgtaaggccattaatgtgctgggggaggcctcagttgattgcagactggaagtgaaggcctccgctgcccactag

SEQ ID NO: 231564 - DNA, 5816 bp, Artificial Sequence
  Description of Artificial Sequence: Synthetic coding sequence
atgtccagtgacgcagaaatggcaatatttggggaagccgctccgtatctgagaaaaccagagaaggaaagaatcgaagcccagaatcgccctttcgacagcaagaaagcgtgcttcgtggccgataacaaggaaatgtatgtgaagggtatgattcagactcgcgaaaatgacaaggtgatcgttaaaaccctggacgatcgcatgttgacccttaataatgatcaagttttcccaatgaacccccctaagttcgacaaaatcgaagatatggccatgatgacacacctccacgagccagctgtactgtataatctcaaagaaaggtatgctgcctggatgatctatacctacagcggcctcttttgcgtgacagttaatccatacaagtggctccctgtgtataagcccgaggtcgtggctgcttacagggggaagaaaagacaagaggctccccctcacatcttctccatctctgataatgcataccagttcatgttgacagacagggataaccagagtattctcattacaggtgagtctggcgctgggaagactgtcaacaccaaacgagtgatccagtactttgccaccattgctgtgaccggcgacaagaaaaaagaaacccagcccggaaagatgcaaggcaccctcgaagaccagattatacaggcaaatccccttctagaggccttcgggaacgccaaaacggttagaaatgataatagttcacgattcggtaagttcattcgcatccacttcggggctaccgggaaactcgcctcggccgacattgaaacatatctgcttgaaaagtcacgcgttacctttcagctttcatctgagcgcagttaccacattttctaccagatcatgtccaataagaagcctgagctcatcgatttgttgctcatctcgaccaacccatttgattttccgtttgtctcgcagggggaggtgactgtggctagtatcgatgactcagaggaattactggccactgacaatgccattgatatcctgggttttagtagtgaggagaaagtgggcatttacaagctcactggggctgtgatgcactacggcaatatgaagtttaagcagaagcagagagaagagcaggcagaacccgacggaactgaggttgccgacaaagcaggatacttgatggggctcaactcagcagaaatgctgaagggattgtgctgcccacgagtgaaggtaggcaatgaatatgttacaaaaggccagaatgtgcagcaagtgactaactccgtaggagccctggcgaaagctgtgtatgagaaaatgtttttatggatggtcactcgcatcaaccagcagttggataccaagcagccacggcagtatttcattggagttctggatatcgcgggattcgagatctttgacttcaattcccttgaacaactttgcatcaatttcaccaacgaaaaattgcagcagttttttaaccaccacatgttcgtattggagcaagaggagtataagaaggagggcatcgagtgggagttcattgatttcggcatggacctggcggcttgtattgagcttatcgaaaagccgatgggaatcttctccattctggaggaggagtgcatgtttccgaaagcaactgacacctcttttaagaacaaactgtatgaccagcacctgggcaagagcaataacttccagaagccaaagccagcaaaaggcaaagctgaagcccattttagtctggtccattacgctggtactgtcgactataacattgccggatggctggataagaataaagatcccctgaatgaaactgtcgttggtctctatcaaaaatccagcctcaagctgcttagctttcttttctcaaactacgcaggcgcagagactggagactcaggaggtagcaagaagggtggtaaaaaaaaaggatctagcttccagaccgtgagtgccgtctttcgggagaatttaaataaacttatgacaaatctgaggagcacgcatccccacttcgtccgatgtcttattccaaacgaaaccaaaacacccggagtgatggatcattatctggtcatgcatcagctacgatgcaatggagtactcgaggggattcgaatctgtcggaagggctttccctcgcgaatcctgtacgccgattttaagcagaggtatagaatcctaaatgcgtctgcaatccctgaaggtcagttcattgatagcaagaatgccagcgaaaagttattgaactccatcgacgtagaccgcgaacagttccggttcggaaacacaaaggttttttttaaggcagggctgctgggattattggaggaaatgagagatgaaaagctggtcacactgatgacctcaacccaggcagtatgtcgcggttatctgatgcgggtcgagtttaagaagatgatggaaaggcgggatagcattttttgcatccaatataacattcgctctttcatgaatgtgaagcactggccatggatgaacctatttttcaagatcaagcctctactgaaatccgccgaagcggagaaggagatggccaccatgaaggaagacttcgagaggaccaaagaggaactcgccaggagcgaagctagacgcaaagaactggaagagaagatggtatctttactgcaagagaaaaatgatctccagctacaggtgcaatccgagaccgagaacctgatggacgctgaagagcggtgtgaaggactgataaaatctaaaattcttttagaagcaaaggttaaagagctgactgagagattagaagaagaggaggaaatgaactctgaactcgttgccaaaaagcgcaacttagaagataagtgcagtagccttaagagagatatcgatgacctggaattgacacttactaaggtggaaaaagaaaaacacgctactgaaaataaggtgaagaaccttagcgaagaaatgacagcattagaggagaacatctcaaaactgacgaaggaaaaaaagtcgcttcaggaggctcatcagcaaaccctggacgatcttcaggtggaagaagataaagtgaatgggcttattaagatcaatgccaaattggagcaacaaacagacgatctggaagggtccctggagcaggaaaagaagctcagagctgacctggaacgagccaaacgcaagctggaaggagaccttaagatgagccaagagtctatcatggaccttgagaacgataagcagcagatagaggagaaacttaaaaaaaaggagtttgaactgtctcagcttcaggctaaaattgacgacgagcaggtccattccctgcagttccagaagaaaataaaggagctgcaggcccgaatcgaggagctggaagaggaaattgaggccgagcacacactacgagccaaaattgagaaacagcggagcgatctggccagggaactggaggaaatttcggagaggttagaagaagcttcgggagccacttcggcccaaatcgagatgaacaagaagagggaagccgaattccagaagatgaggcgggatctcgaggaggctaccctgcagcacgaggccactgctgccacattacgaaagaagcaggccgactcagtggccgaactgggagaacagatcgataatctgcagcgagtgaagcagaagttggagaaggaaaagtctgagcttaaaatggagatcgatgacatggccagtaacattgaggctttgtctaagtccaaaagtaatatcgaacgaacttgtcggacagttgaagaccagttcagcgaaatcaaggccaaagacgagcagcaaacgcagctgatccacgatctgaatatgcagaaggcccgtttacagacccagaatggtgagctatcgcaccgtgtcgaagagaaggagtccctgatctctcaactgacaaagtccaagcaggcccttacacagcagctggaagaactaaagcggcagatggaagaggagaccaaagcgaaaaacgccatggcgcacgcgctgcagagcagccggcatgactgcgatctcctgcgcgagcagtacgaagaggaacaagaagccaaagcagaactgcagcgagctctgtccaaggctaattctgaggtggctcagtggcgaactaaatacgaaaccgatgccattcaacgaacagaggaacttgaggaggcaaagaaaaagttagcccagcgactgcaagaagcagaagaaaataccgaaaccgctaactcgaagtgcgcctctttggaaaaaactaaacagaggttgcaaggtgaggttgaagatctgatgagagacctcgagaggagtcacactgcgtgtgccaccctcgataagaagcagagaaacttcgacaaggttttggcggagtggaagcagaagctcgatgagtcacaggctgagcttgaagcagctcagaaagagtcccggtccctgtccaccgaattattcaaaatgcggaacgcttacgaagaggtagttgaccagctggaaaccttaagacgcgaaaacaagaatcttcaggaggaaattagcgatctgactgaacagattgcagaaaccggcaagaacctgcaggaagcagagaaaacaaaaaaactggtggagcaggagaagtccgatctgcaggtcgccttggaggaagtggaagggtctttagaacacgaggaaagtaagatactgagagtgcagctggaactaagccaagtgaagtccgaacttgatcggaaagtgatcgagaaagatgaagagattgaacagctgaagcggaactcccaacgtgcagcggaagcactgcagagtgtgctcgatgctgagatcagatcaagaaacgacgccctgagactgaaaaaaaagatggaaggcgatctcaatgaaatggaaattcagctgggacatagcaatagacagatggcagaaacacagaagcaccttaggactgtgcagggacagctaaaggatagtcagctgcatctggatgatgccttacggagtaatgaggacctcaaggagcagctggccatcgtggagaggaggaacgggctgctgctcgaagaactggaagagatgaaggtggccctggaacaaactgaacgaaccaggagattgtccgagcaggagctgttagatgcatctgatagagttcagcttcttcacagccaaaatacttctctgattaatacaaaaaaaaaactggaggccgacatcgctcagtgccaagctgaggtcgagaattcaatccaggagtctaggaatgccgaagagaaggcgaaaaaagccattacagatgcagccatgatggcggaagagctcaaaaaggagcaggacaccagcgctcacctggagagaatgaagaaaaacctggagcagacagtaaaggacctgcaacatagactagacgaggccgaacagctggcccttaaaggaggcaaaaaacagatccagaaactggagaatcgggtccgtgaactggagaatgagctggatgtggagcaaaagagaggcgctgaagccttgaaaggcgctcacaagtatgaacggaaggttaaggaaatgacgtatcaggctgaggaagatcacaagaatatcctgcgcctgcaggacttggtggataagctgcaagctaaggttaaaagttacaaaagacaagcggaggaagctgaagagcaggctaatactcagctgtccagatgccggagagtgcagcacgaactggaagaagctgcagagagagccgacatcgcagagagtcaagtgaataagttacgggcaaagagcagagatgtgggctctcagaaaatggaggagta

SEQ ID NO: 231565 - DNA, 6110 bp, Artificial Sequence
  Description of Artificial Sequence: Synthetic coding sequence
atggccgcagtcacaatgtccgtgcctggcagaaaagcccctcccagacctggcccagtgcccgaggctgcgcagcccttcctgtttaccccaaggggaccatccgccggtgggggacctggatcaggcacatcccctcaagtagagtggaccgccaggcgcttagtctgggtcccctctgagctgcacggctttgaagccgcagccctacgcgatgagggagaagaggaagcggaggtggagttagccgagtccgggagaagactccgcctgccacgcgatcagattcagagaatgaacccccctaagttttccaaagcagaggatatggccgagcttacatgcctgaatgaagccagtgtcctccacaatctccgggaacgctactactccggccttatttacacatactcaggacttttttgcgtcgtaattaacccatataaacagctccctatctacactgaggcgatcgttgaaatgtaccggggaaaaaagcgacatgaagttccaccccatgtctacgccgttaccgagggcgcttaccgctctatgctgcaggaccgcgaggaccagtctattctttgcacgggagaatcgggcgcaggaaagacggagaataccaagaaggtcattcagtacctagcccacgtagccagctcgcccaagggccgaaaggaacctggagtacccgcttccgtgtcaacggttagttatggagaactcgagcgccagctgcttcaggcaaaccccatcctggaggctttcggcaatgcgaagacggtaaagaatgacaacagcagccgctttggcaagtttattcggatcaatttcgacgtggcagggtatatcgtcggagctaatatcgagacttatttactcgagaaaagtagggctatccgtcaggcaaaagatgagtgtagcttccacattttttaccagctcctcggaggcgcaggggaacagctcaaagctgatctgctgctggagccttgtagccactatagattcctcacaaatggaccctcatccagcccagggcaggagcgcgaactctttcaggagacgctcgagtccctgcgggtccttggcttctcccatgaagagatcatttctatgctacgtatggtgtccgccgtgctgcagtttggaaacatagccttgaagcgcgagcgcaataccgatcaagctaccatgcctgataatacagccgcacagaaactatgtcggctgctggggctgggcgttactgacttctcccgggctctgctcaccccaagaatcaaagtggggagagactacgttcagaaggcccagaccaaggagcaggccgacttcgcgctcgaggccctggctaaggcgacgtatgagcgcttgtttcgctggctggtccttcgattgaatcgagcgttagatcgctcgccacgccagggagcatcgtttctaggcatactggatatcgccggtttcgagatctttcagctcaactcattcgaacagctgtgcattaattataccaacgaaaagttacagcagttgttcaaccacaccatgtttgtgctggagcaggaggaataccagagagagggaattccgtggacattcctggatttcggactcgaccttcagccctgcatcgacttgatcgagagaccagccaacccacctggtttgctggccctcctcgacgaagaatgctggtttccaaaggccacggacaagtcgtttgtggaaaaggttgctcaggagcaaggcggtcaccccaagtttcagcggccacggcatctccgcgatcaagcagacttttccgtcctccattatgccggtaaagtagactataaggcaaatgagtggctaatgaagaatatggatcccctgaatgacaatgtggcagcactgcttcaccagtccacagaccgtctgacagccgaaatttggaaagatgagcacgggggttttcaacaattctcctttctgggcagtttcccccctagcccccctggcagcgcagagcgttgttcatccgctatttcccctcccggtgtcgagggaatcgtggggttggagcaggtgtcctcccttggtgacggtcctcctgggggtcgccctcgcagaggcatgtttcggacagtcggtcagctctacaaggagagcctatctcggctgatggcaacactcagtaacacaaatccttcctttgtgcgctgtatcgtgccaaatcacgagaaacgggctgggaaactggagccgaggctggtgctggaccagctccggtgtaatggcgtgcttgaaggaatcagaatctgcaggcaggggtttccaaatcgaatactgttccaagagtttaggcagagatatgagatactgacccccaacgccattcccaaaggcttcatggacggtaagcaggcatgcgagaagatgattcaggccttggaactcgatcctaatctctatcgggtcggtcagtcaaagatcttcttcagggccggagtgctcgcccagctcgaggaggagagagacttaaaagtgaccgacataatagtgtcgttccaggccgctgctaggggctatctggctagacgggcattccagaaacgtcagcagcagcaatcggcactcagagtgatgcagcggaactgcgcagcctatctgaagcttaggcactggcagtggtggcggttatttaccaaggtaaagcccctgttacaagtaacaaggcaagatgaagtgctccaggctagggctcaggagctacaaaaagtgcaggagctgcagcaacagtctgctagggaagtgggcgagctccaggggagagtagctcaactagaggaagaaagggcacgcctggcagagcaattgcgagctgaggcggagctttgtgcagaggccgaggagaccagaggccgacttgcagccagaaagcaggaattggaactcgtggtgtccgaattggaggctagagtcggcgaggaggaggagtgttcacgacagatgcaaacagagaagaaacgattgcagcagcacatccaggagctcgaagcacatttggaagccgaggaaggcgctcgccaaaagctccaattagagaaggtgacaactgaggctaaaatgaaaaaattcgaagaagaccttttgctcctagaggaccagaatagtaagctgtccaaggagcgcaagctcttagaggatcgactcgcagagttttcttctcaggctgccgaggaggaggagaaggtaaaaagcctaaataagctacgcttgaagtacgaggccactatcgctgacatggaggatcgcctgcgcaaggaagaaaaggggagacaagagctggagaaactgaaacgcagacttgacggggagtcttctgagctccaggagcagatggtggaacagcaacaaagggctgaagaattgagagcccagctcggcaggaaagaggaggagttacaagctgcgttggcacgcgctgaggacgagggcggagccagagcccaactcctcaagagcctgagggaggctcaagctgccctggcggaagcacaagaagacttggaatcagaacgcgtagctcggacgaaagccgaaaagcagaggagggatctgggagaagaattggaagctcttaggggggagcttgaggacacactggattccacaaacgctcaacaggaactgcgatctaaacgcgagcaagaagtcacggagctgaagaaaacgctggaagaagaaacaagaatccacgaagccgctgtgcaggagctgcggcagcgtcacggacaggccctgggtgagctggctgagcagctggagcaggccagacgaggaaaaggtgcctgggaaaagacaagactggccttagaggccgaagtcagcgaactgagagccgaactgagttccctgcagaccgccaggcaggaaggcgagcagaggaggagacgactcgaactccagctgcaggaggtccaggggagggccggtgatggcgagagagcacgagccgaggccgctgagaagttgcagcgcgcacaggctgagctcgagaacgtctcgggcgcattgaacgaggctgagagcaaaaccattagactgtcaaaggagttaagctctaccgaggcccagttacacgacgcacaggaactgcttcaggaggaaactcgcgctaagctggccctcggctcgcgtgttcgagccatggaagctgaggcagctggtctgcgggagcaactggaagaggaagctgctgcacgcgaaagagccggacgggagctgcaaactgcccaagcccaacttagtgagtggagaagacgccaggaagaagaggcgggtgctcttgaagccggagaggaagctcgtcgaagagcagcgagggaagccgaagctctgactcagcgcctcgcggagaaaactgagacagtagaccgtcttgaaaggggtaggcgtaggctccagcaagagctggacgatgccacaatggatctggagcagcagaggcaactggtcagtaccctcgaaaaaaaacagcggaaattcgaccagctcctagcggaggagaaggctgcagttttgagggcagttgaagagcgtgagcgtgctgaggccgagggaagagaacgggaggctagggcattgtcactgacccgcgcactggaggaggaacaagaggctagagaggagttggaacggcagaacagagctcttcgggcagaactcgaagctttactaagttctaaggacgatgtgggcaagagcgtgcatgaattagagcgtgcatgtagggtggccgagcaggcagctaacgaccttagagctcaagttaccgagctggaggatgaactgactgccgcagaagatgccaaactccgcctggaggtgactgtgcaggcactcaagacacagcacgaacgggacctgcagggacgagacgaggctggggaagagcgaaggaggcagctcgcgaagcagttacgagacgctgaagtggagagggacgaggaaaggaaacagagaaccctggccgtggcagctcgtaagaagctggaaggcgagcttgaggaactcaaggcccagatggcgtcagccggacaaggcaaagaagaggccgtgaaacagctcagaaagatgcaggcccagatgaaggagctttggcgggaggtggaggagaccagaacctcgagggaggagattttttctcagaatcgagagtcggaaaaacgactgaaagggctcgaagcagaagtcttgcgccttcaagaagagctcgccgcatctgatcgggcacgccgacaagcccaacaagacagggatgaaatggctgacgaggtggctaacggtaacttgtctaaggcggcaatcctggaagaaaagagacagctggaaggtaggctcggacagctggaggaggagctggaagaggaacaatctaacagcgagctgttaaacgacagatacaggaaactactactccaggtcgagagcttgaccaccgaactttctgccgagagaagctttagcgccaaggcagaaagcggacggcagcaactggagcggcagatacaggagctgaggggcaggctgggcgaagaggacgccggtgctagagcccgtcacaagatgaccatcgccgcactcgaatcgaagcttgcccaagcagaggagcaacttgagcaagagactcgcgagcgaatcctgtctggcaagctggtgcggcgagctgaaaagaggttgaaggaggtggtgctgcaggtcgaggaagaacgcagggtggccgatcaactcagggatcaattggaaaagggcaatctgagggtcaaacagttgaaacgccagctggaagaagcagaagaggaggctagtcgcgctcaggcgggacgaagacgtttgcagagagaacttgaagacgtcactgaatcagccgagagcatgaatcgcgaagtcactacactgagaaaccgattacgacgcggaccgctaactttcactacacgtacagtacgacaggtgttcaggctagaggagggtgtcgcatcagacgaggaggccgaagaagctcagcctgggtccgggccaagtccagagcccgagggtagcccacccgcacacccacagta

SEQ ID NO: 231566 - DNA, 5822 bp, Artificial Sequence
  Description of Artificial Sequence: Synthetic coding sequence
atgagctcagacacagagatggaagtattcggaatagcagctccctttctccgaaaatccgagaaagagcggatcgaggcacaaaaccagcccttcgacgccaagacctactgcttcgtggtggacagcaaggaggagtatgccaaggggaagataaaatcctcccaagacggcaaggtcacagtcgagacagaggataacagaactctggtggttaaacctgaggacgtttacgccatgaatccaccaaagtttgatcgaatcgaagacatggcaatgcttacccacctgaacgaacctgccgtgctgtataacctgaaagaccgctacaccagctggatgatctacacttatagcggattattttgcgtgacagttaatccatataaatggcttcccgtgtacaaccccgaagttgtcgaaggttaccgaggtaagaagagacaggaagcccctccacatatcttcagcatctctgacaatgcctaccagtttatgctgactgatcgtgaaaatcagagcattctgatcacaggagaatctggcgcagggaaaactgttaacactaagcgggtcattcagtatttcgcgacgatcgccgctaccggagatctggcaaagaagaaggactccaaaatgaaagggacattagaggatcagatcatcagtgccaaccccctcctcgaggcattcgggaacgcaaagacagttcgaaatgacaactccagccggtttgggaagttcatcaggattcatttcggcactacaggcaagctggccagtgccgatattgagacttacttgctggaaaaatctagggtaacctttcaactcaaagccgaacgctcataccacatcttctatcagatactgtccaataaaaagccagagctgatcgagttgctgctgatcacgactaacccctatgactatccattcattagtcagggcgaaattctggtggccagtattgatgatgctgaggaactgttggccactgattcagctatagatattttgggctttaccccggaagaaaagagcggactttataagttgaccggagcagtgatgcattatggcaacatgaaatttaagcaaaagcaacgtgaggaacaggcagaaccagacggcactgaggtagccgacaaaaccgcctacctgatggggctgaacagctctgatttgctgaaagccctttgcttccctcgagtcaaggttggaaatgagtatgtcactaaaggccagacagtagaccaggttcaccacgccgtcaatgccctgagcaagagcgtgtatgagaaactcttcctttggatggttaccaggataaaccagcagctggacacaaagctgcctcggcaacactttatcggagttctagacattgcaggttttgaaatattcgaatacaacagccttgaacagctgtgtatcaacttcacaaacgagaagctacaacagttttttaaccaccacatgtttgtgctggagcaggaggaatacaagaaagaaggtatagaatggacatttatcgacttcggtatggatctggcagcatgcatcgagttgattgagaaaccaatgggcatcttttccatccttgaagaggagtgtatgttcccaaaagccaccgatacatcttttaaaaataaactttacgaccagcacttaggcaaaagtaacaacttccagaagccaaaagtagttaaaggcagggcagaggcccatttttctctgattcactacgccggaactgtcgactattcagtgagcggctggctggagaaaaacaaggacccgctgaatgaaactgttgtgggtctgtaccagaaatcttccaatcggctcctcgcccatctctacgccacctttgccaccgctgacgccgatagtggaaaaaagaaggtggcaaaaaagaaaggcagctcgtttcaaaccgtgtccgctctgttcagggagaatctgaacaagttaatgagcaatctgaggaccactcatccccacttcgtccgctgtattattccaaatgaaaccaagacgcctggcgctatggagcactccttggttttgcatcagctgcgctgcaatggagtgctggaggggatcagaatctgtcgtaaaggtttcccaaatcggatcttgtatggggattttaaacaacgttacagagttttgaacgctagcgcaatacccgaaggacaattcatagactcaaagaaagcctgcgagaaattactggcttcaatcgatattgaccacacccagtacaaatttggacatacgaaagttttctttaaggccggtttgctgggtactctcgaggaaatgcgggacgatcgcttggccaagctaatcaccagaacgcaggcagtgtgcagagggttccttatgagggtggaatttcagaagatggttcagcgcagagagtctatcttttgcatccagtataatatcagatcattcatgaacgtcaagcactggccgtggatgaagttgttcttcaaaattaagcccctgcttaagagcgccgagactgaaaaagagatggctaccatgaaagaagagttccaaaagacaaaagacgagctggccaaatctgaagcaaagcgtaaagagcttgaagaaaagcttgttacactcgtgcaagaaaaaaacgatctccagctgcaggtgcaggccgagtcggagaatctactggacgcagaagaacgttgtgaccagttgattaaagctaaatttcaacttgaagcaaagattaaggaggtgaccgagagagccgaagacgaagaggaaattaacgcggagctgacagccaaaaagagaaaattagaagacgagtgttccgaacttaaaaaagacattgatgatttagaactgactctggcaaaggtggaaaaggagaaacacgccaccgaaaataaggtgaagaacctgacagaagaactgagtgggcttgatgaaactattgccaagctgaccagggagaaaaaggccttacaggaggctcaccagcaggccttggacgatctgcaagctgaggaagacaaggtgaattcgctcaataagaccaaaagcaagttagaacagcaagtggaggatctggaatcttccctggagcaggaaaaaaagttgcgtgtcgatctggagaggaacaaacgcaaactggaaggcgatctgaaactggcccaggaaagcattctagatcttgagaatgataagcagcagcttgacgaaagattgaagaaaaaagatttcgaatactgccagctgcagtctaaagtcgaggatgagcagaccctcggactacagttccagaagaaaattaaagagcttcaggcccgtatcgaagagttggaggaggagatcgaggctgagagagccaccagggcgaagaccgagaagcagcgctctgattatgcaagagaactggaggaactgtctgaacgcctcgaggaggctggcggagtgaccagtactcagatcgaattaaataagaagcgcgaggccgaatttcttaagctcaggagggacctggaagaagctactctgcagcatgaagcaatggttgcagcccttcgcaagaagcacgccgattcagtagcggagttaggcgagcaaattgacaacctacagagagtaaaacaaaaactggaaaaggaaaaaagcgaatttaagctggaaatagacgatctttctagctctatggaatcagtctcaaaaagcaaagccaatcttgagaaaatctgccgaactctcgaggaccagctatcagaagccagggggaagaatgaagaaattcaacgctcactcagtgagctgaccacacaaaagtcccgattgcagactgaggcgggagaactgtcccgccaacttgaagaaaaggagagtatcgtttcccagttaagcaggagcaagcaggccttcactcagcagactgaagagctgaagcgccaactcgaggaagagaacaaagccaaaaacgcactggctcatgcactgcagtcttcacggcatgactgtgacctcctccgcgagcaatatgaggaggagcaagagggaaaggccgaactgcaacgcgctctttctaaggcaaactccgaggtggcacaatggcgcaccaagtacgagacggacgctattcaacggaccgaggaacttgaggaggctaaaaagaagctcgctcagagactgcaagacagtgaggaacaggtggaggcagttaacgctaagtgcgctagtctggagaaaacaaagcaaaggttgcaaggggaagtggaagacctcatggtggacgtggaacgcgctaacagcctcgcagccgcactggacaagaagcaaagaaactttgacaaggtgctggccgaatggaagactaaatgcgaggagagtcaagctgaactagaggcttcgcttaaggaatcacgatctctatccacagaactctttaaacttaagaacgcctacgaagaggccctcgaccagttggaaacggtgaaaagagagaacaaaaatctagagcaggaaatcgctgatctgaccgagcagattgctgagaatggcaaaaccatccacgagcttgagaagtctcggaaacaaattgagctcgagaaggccgacatccagctcgcactggaggaagccgaggccgcactagaacacgaggaggcgaaaatcctgcggatccagttggaactgactcaagttaagtccgaaatcgaccggaagatcgccgagaaggatgaagagatcgagcagctaaagaggaattatcagcgcacggtagagacaatgcaaagtgccctcgacgccgaggtgcgctcccgaaatgaggctattcgccttaaaaaaaagatggaaggtgatctgaatgaaatcgagatccagctaagtcatgccaatagacaggcggctgaaactcttaagcatctccgatccgtccaaggccagttaaaggatacccagctgcatctcgacgacgcgttgagaggccaggaggacctcaaagagcagctggccatcgttgaacggagagcaaatctgctccaggccgaagtggaagagctcagagcgaccctggagcaaactgaacgggcaagaaagttagctgagcaagaactgctggattccaacgaacgggtgcagctgttgcacacccagaacaccagcctgatacacacgaagaagaagctggagaccgatctgatgcagctccagtcagaagtcgaggacgcaagcagagacgcacgcaacgctgaagagaaagcaaagaaggccatcaccgacgccgcaatgatggccgaggaattaaaaaaggagcaggacacctccgcccatctggagcggatgaaaaagaacctcgaacagactgtgaaagatctccagcacagactagatgaagccgagcagctggctcttaagggtggaaagaagcaaatacagaagttggagaccaggatcagggagctggaattcgagttggagggagagcagaagaagaatacagaatccgtaaaaggccttagaaaatacgagcggagggtaaaagaactcacttaccagagtgaggaggaccggaagaatgtactgcgcctgcaggacctcgtagataaattacaggtgaaggtgaagtcttacaagagacaggctgaggaagcggatgagcaagctaatgctcacctgaccaaattcagaaaggcccaacacgagctcgaggaagccgaagagagggcggacatagccgaaagtcaggtgaataagttgcgcgcaaaaacacgggactttacaagttcacggatggtagtccatgaatcagaagagta

SEQ ID NO: 231567 - DNA, 3132 bp, Artificial Sequence
  Description of Artificial Sequence: Synthetic coding sequence
atgccgctcttggaggggtctgttggagtcgaagatctcgtgctattggagcctctggtggaagagtccctgctaaagaacctgcagttgagatacgagaataaggaaatctatacatatataggcaacgtggttatctctgtgaacccataccaacagctgcctatatacggcccagagtttatcgccaagtaccaagactataccttctatgagctgaagccacatatctacgcccttgccaatgtggcctatcagtctctgcgggatcgggatcgggatcagtgtatactcataactggggaaagcgggtcaggcaaaacggaagcaagtaagctcgttatgagttacgtggccgcagtctgtggcaaaggggagcaagtgaattctgttaaggagcaactgctgcagtctaacccagtgcttgaggcgttcggaaatgctaaaacgatacggaataacaattctagccgctttgggaagtatatggatatcgagtttgactttaaaggcagtcctctgggcggtgtgattaccaactatctgctggagaagtcacgtttagtaaaacagcttaagggggagcgaaattttcatatcttttaccagctgctggctggcgctgacgaacaacttctgaaagccctgaagctggagagggatacgactgggtatgcttatctgaatcatgaagtcagcagagtagatgggatggacgacgcgagttccttccgtgcggtgcaaagcgccatggccgtgattggatttagcgaagaggagataagacaagtgctcgaggtgacatctatggtcctgaaactcggaaacgtgctggtggctgatgagtttcaggcctccggaatccctgcttctgggattagggatggccgtggggtccgcgagatcggggaaatggtggggctgaactctgaagaagttgagagagccctctgctcccggaccatggagaccgcaaaggagaaggtcgtgaccgccctcaatgttatgcaggcccagtacgccagggacgccctcgccaagaatatatactcgcggttgtttgactggattgtcaacaggatcaatgagtcaatcaaagttggcatcggcgaaaagaaaaaggttatgggagtgctggacatctacgggttcgaaattcttgaggacaactccttcgagcagttcgttattaattattgtaatgagaagctgcagcaggttttcatcgaaatgacactaaaagaagaacaggaggagtacaaacgggaggggattccctggacaaaggtcgactacttcgacaatggtattatttgcaaactgatagaacacaatcagagaggtattctggcgatgttggacgaggagtgcctgcgccctggggtcgtgtcagactctacatttctagccaaattaaaccagctgttctccaaacatgggcactacgagagtaaggtgacgcagaatgcacagagacaatatgaccacaccatggggttaagctgcttccgcatttgtcattacgctggcaaagtaacctacaacgtcacctcgttcattgataagaataacgatttactgttccgcgaccttctgcaggcgatgtggaaggcccagcaccctttgctgcgctccctattccccgagggaaatcccaaacaggcctcactgaagcggccacccacagccggtgcgcagttcaaatcatctgttgccatcctgatgaaaaacttgtacagtaaatccccgaattacatcaggtgcattaaaccaaacgaacatcaacagaggggccagttctctagcgacctggttgctacccaggccaggtatctaggccttctggagaatgttcgggtgcgtcgggctggatacgcccaccgacaaggctacggcccattcctggagagatacaggctcttgagcagatccacatggccccactggaatggcggagaccgagagggcgtagagaaagtactgggagagctgagcatgagcagcggtgaactggcttttggcaagacgaaaattttcatccggagtcccaagactctcttttatctagaggagcaaagaagactcagactacagcaactcgccacgttaatccagaaaatatatagaggctggaggtgcagaactcactaccaactgatgcggaagagtcagatactgatcagcagttggtttcgcggaaatatgcagaagaagtgctatggaaaaatcaaggcctcagttcttctgatccaggcgttcgtacgcggatggaaagcgcgaaagaattacagaaaatactttaggtctgaagcagccctgactctggccgacttcatctacaaatctatggttcagaagtttttgcttggtctgaaaaataatctcccatccacaaatgttctcgacaaaacatggcccgctgctccatataaatgtttatcaactgcaaatcaggaactccagcagctgttctaccagtggaaatgcaaaaggttccgcgatcagctgagccccaagcaggttgagatactgcgagaaaagctttgcgctagcgagctcttcaaaggtaagaaagcctcttatccccagtccgttcccatccccttctgtggggattacattggattgcagggcaaccctaagcttcagaagcttaaagggggtgaagagggccctgtgcttatggctgaagcggtgaagaaggttaaccgcggaaatggaaagacgagctctcggattctgcttttgacaaagggacatgtgatccttacggacaccaagaaatcacaggcaaaaatcgtaattggtctggacaacgttgccggtgtgtctgtgacctccctgaaggacggtttgttttctctccatctgtctgagatgagctcagtgggcagtaagggggattttttattagtttcagagcacgtaatcgagctgctcactaagatgtacagagccgtactggacgctacccagagacagttgaccgttaccgtaaccgaaaagttctccgtaaggttcaaggaaaattccgtggctgtgaaagtggttcagggccctgctggaggggacaattccaaactgaggtacaagaagaagggaagccactgcctcgaggtgacagtgcagtag

SEQ ID NO: 231568 - DNA, 291 bp, Artificial Sequence
  Description of Artificial Sequence: Synthetic coding sequence
atgcctctgctcgagggttctgtcggtgttgaagatctggtgcttcttgagccattagtggaagagagtttgctgaagaatttgcagttgagatacgaaaacaaagagatatatacctacatcggcaacgtcgtcatctctgtgaacccttaccagcagcttcccatctacggacccgagtttattgctaagtaccaagattataccttctacgagctaaaacctcatatctatgctctggcaaacgtcgcataccagtcgctgcgcgatagggaccgcgatcagtgctag

SEQ ID NO: 231569 - DNA, 3132 bp, Artificial Sequence
  Description of Artificial Sequence: Synthetic coding sequence
atgccactccttgagggcagtgtgggagtggaagacctggtgctgctggagccccttgtcgaagagagcctcctcaaaaaccttcagctgcgctacgagaacaaagaaatttacacctacatcggcaacgtcgttatttccgtcaacccctatcagcagctgcccatttacggacccgagtttatcgctaagtaccaggattatacattctatgaactgaaaccacatatttacgccctggcaaacgtcgcctatcagtcgttaagggatagagacagagaccagtgtattctcatcacaggcgagtcgggctctgggaagaccgaggcttcaaaactggttatgtcatacgtggcagctgtgtgcggcaagggggaacaggtgaactcagtcaaggagcagctcctacagagcaaccccgtactcgaggccttcggaaacgccaaaaccataaggaacaacaatagcagcagattcggcaaatacatggacatcgagttcgatttcaagggaagccccttaggcggtgtgattaccaattacttgttagagaagtcaaggctcgtgaagcagttgaagggagaacgaaatttccacatcttttaccagttgcttgctggcgctgacgagcaactgctgaaggcactgaagttggaaagagacacaaccggctatgcttatctgaaccacgaagtttctagagtggatggtatggatgatgccagcagttttagggcagttcagtcagccatggcagtgattggattctccgaggaagagataaggcaggtactcgaagtgacgtccatggtactgaagctcggcaacgtgttggtggcagacgagtttcaggccagcggcatcccagcctccgggatcagagacggcaggggtgtgcgcgagattggcgaaatggttggtctgaacagtgaagaggtggaaagagccctttgttctcggacaatggaaacagccaaagaaaaagtagtgactgcattaaacgtgatgcaggcccaatatgctcgtgacgccctcgctaaaaacatttactcccggctgttcgactggattgtcaatagaattaatgaaagcatcaaagttggtatcggtgagaagaaaaaagtcatgggcgtgctcgacatttatgggttcgaaatcttagaggataactcgttcgagcaattcgtcatcaattattgtaacgaaaaacttcaacaggtgtttattgaaatgactctaaaagaagaacaggaagagtataagcgagaggggataccctggactaaggttgactattttgacaacggaattatttgtaagttgattgaacacaatcagcggggaattttggctatgctggacgaggaatgcctgcggccaggggtcgtgtccgattccaccttcctggctaaactcaaccaacttttttccaagcacggacattacgaaagtaaagtcacacaaaacgcccagaggcaatatgaccacacaatgggattgtcgtgttttagaatttgccactacgccggtaaggtcacatataacgtcaccagtttcatagacaagaataatgatcttctttttcgagacctactgcaggctatgtggaaggcccagcatcccctgctgcgctctcttttcccggaaggcaatcccaagcaggcgtcattaaagcgcccacctacagcaggcgcacaatttaaaagcagtgtagctatcctcatgaagaatctctactccaagagtccgaattatattcgctgcattaaaccaaatgaacatcagcaacggggacagttttcctccgatctcgtggccacacaggccaggtaccttggcttactagaaaatgtacgtgttaggcgcgctgggtatgctcaccggcagggatatggtccgtttctcgagcgctaccgactactgtcccggtcaacttggccacactggaatggaggggacagagagggagtcgaaaaggtcctgggcgagctttctatgtcttcaggggagctggcgtttggaaagacaaagattttcattcggtccccaaagactctgttctaccttgaggaacaacgaaggctgcgactgcaacagctggcgacacttatccagaagatctatcgcggatggaggtgccggacgcattaccagctgatgcggaagagccagatcctgatttcctcttggttccggggtaacatgcaaaagaagtgctacggcaagatcaaggcctccgtgttgctgatccaggcgtttgttagaggttggaaggctcgcaaaaattaccgcaaatacttcagaagtgaggccgctctgacccttgctgatttcatctacaaaagcatggtccaaaaattcctgctgggtctgaagaacaatctgccgtctacaaacgtcctcgacaagacatggcccgcagccccatacaagtgtctgtcgaccgctaatcaggagctgcagcagctgttctaccagtggaagtgcaaaaggtttcgcgatcagttaagtccgaagcaggtggagattcttagagaaaagctatgtgctagcgagctgttcaagggcaagaaagcctcatacccccagtctgtgccgattcctttctgcggggactacatcggattacagggcaatccaaagctgcagaagttgaagggcggagaagaagggccagtcctgatggccgaagcggttaagaaggtcaaccgtggcaatggcaagacgtctagtaggatcttactcctgacgaagggacatgtgatcctaacagatactaagaagagtcaggcaaaaatagtgataggtcttgacaacgtggctggggtctccgtgacctctctcaaagacggcctcttcagcctgcatctttcggaaatgtcgtcggtgggatcaaaaggtgactttttattggtgtccgaacacgtcatcgaacttttgaccaaaatgtatcgcgcagtattagatgctacacaacgccagttaactgtcacagttaccgagaaattctcggtcagatttaaagagaatagcgttgccgtgaaagtggtgcaagggccagcaggcggagataactccaagttgaggtataagaagaagggatctcactgcttggaggttaccgttcagtag

SEQ ID NO: 231570 - DNA, 2646 bp, Artificial Sequence
  Description of Artificial Sequence: Synthetic coding sequence
atggacatcgagttcgacttcaaaggcagccctctgggcggagttatcaccaattatttgctggaaaagtcaaggctagtgaaacaactgaagggggagcggaacttccacattttctatcaactcctagctggagctgatgagcagctgctgaaagcactaaaactggaacgtgatactactgggtacgcatacctcaatcacgaagtttcacgagtggatggcatggacgacgcatctagctttagggccgtacagtccgccatggccgtaataggattttcagaggaggaaatcagacaggtgcttgaagtgacgtctatggtgctcaagctcggcaatgtactggtcgctgatgagtttcaggccagtggaattccagcctcgggaatcagagatggaagaggagtacgagagattggcgagatggtcggacttaactctgaggaggtcgagagagcactttgtagccgcactatggagaccgccaaagaaaaagtggtgaccgctttaaatgtgatgcaggcccaatatgctcgggacgctctggccaagaacatctactcgcgcctgttcgattggattgtcaacaggatcaatgagtcaatcaaggtcgggatcggcgagaaaaagaaggttatgggggtgctcgatatttacggattcgaaatcttggaagacaattcatttgagcaattcgtgattaactactgtaatgaaaagctgcaacaagtattcatcgaaatgaccctgaaagaggagcaggaagaatataagagggaggggatcccatggacaaaagtggattactttgataacggcataatctgcaagctgattgagcataatcagagaggaatccttgccatgctggatgaggaatgtttgaggccaggcgttgtcagcgacagcacgtttcttgcaaaactaaaccagctgttcagtaaacatgggcattacgagtccaaggtcactcagaacgcacaacgccaatatgatcacactatgggattgtcttgctttcgaatctgtcactacgccggaaaggtgacctacaatgttacgtccttcatcgacaagaacaacgacctgctttttcgggacttgctgcaggccatgtggaaggcacagcatcctcttttgcgcagcctcttcccagagggcaaccccaagcaagccagcttaaagcgccctccaacagcaggggcacagttcaaaagttcggttgccatcctgatgaaaaatttatattcgaaatcacctaactacatccgatgtattaaacctaatgagcaccaacaaagaggtcagttcagtagtgatctggtcgccacccaggccagatacctgggcctcttggaaaacgtgcgagtgcgccgtgccggatatgcgcaccggcaggggtacggccctttccttgaaaggtatagactccttagcaggtccacatggccccactggaatgggggtgacagggagggcgtagaaaaggtcttgggagagttgtcgatgagctctggcgagctggcattcgggaagactaaaatcttcattcggtccccaaaaactctgttttatttagaagagcagcgcaggttgcgactgcaacagctcgccactctcatccagaagatttaccgcggttggaggtgtagaactcattaccagctgatgagaaaatctcaaattttaataagtagctggttccgcggaaatatgcaaaagaagtgctacggtaaaattaaagcttcggttctcctgatacaggcatttgtgcggggttggaaagctcgcaaaaattataggaaatatttccgttcagaagcggcactcacattggccgatttcatctacaaatcaatggtgcagaagtttctgcttggactgaaaaataacctgccaagtactaatgtacttgacaagacctggcccgcagcaccttataagtgcctgtccaccgcaaaccaagagctgcaacaactgttttaccagtggaagtgtaagagatttcgggaccagttgtccccaaagcaggtagaaatacttcgggagaagctgtgtgccagtgaactcttcaaaggcaagaaggcctcatatcctcaaagcgtgcccatcccattctgcggagactatatcggattacaaggaaaccctaagctgcagaaattaaagggcggagaggagggacccgtgctgatggctgaggccgtgaagaaggttaatcgtgggaacgggaagacatcttcccgaatcctgctgctcactaaagggcatgtaattctcactgacaccaagaaatctcaggccaagatcgttatcggcctggataacgtggccggtgtttctgtgacgtctctgaaggacggtctcttcagcctgcatttgtctgaaatgagctccgtgggcagtaaaggcgattttctgctggtctctgagcatgtgattgagttgctgacgaagatgtatcgagcagtgttggatgccacacagcgacagctcacagtgaccgtaacagagaaattttccgtacgcttcaaagagaactccgtggcggtgaaggttgttcaggggccagcgggtggggataatagtaaacttcggtacaagaagaagggatcccactgtctggaagtaaccgtccaatag

SEQ ID NO: 231571 - DNA, 3411 bp, Artificial Sequence
  Description of Artificial Sequence: Synthetic coding sequence
atggcaaaaatggaggtcaagacgtccttactggacaacatgatcggcgtgggggatatggtgctgttggaacctcttaatgaagaaacctttattaataatctgaaaaagagatttgatcacagcgagatatacacatacattggttctgtggtcatcagtgtcaatccataccggtcccttcctatatattccccggaaaaggtggaagagtataggaataggaacttctatgaactgtcccctcacatcttcgccctgagtgatgaggcatataggtccttgagggatcaggataaagaccagtgcatattgatcacaggtgaaagcggcgcaggaaagacagaagcgagcaagctggtaatgagctacgttgccgctgtatgcggaaagggtgcggaggtgaatcaggtaaaagaacaactgcttcaaagcaatcctgtcctggaagctttcggtaatgctaaaactgtgcgcaacgataacagctcccgatttggcaaatacatggatattgagtttgacttcaaaggggaccccctcggcggagtcatatcgaactatctgctggagaaatccagggttgtcaaacaaccaaggggggagcgtaatttccacgtcttctatcagctactctctggggctagtgaggagttgttaaataagcttaaactggagcgagacttttcccggtacaactatctttcactggatagcgctaaggtgaatggtgtggacgacgccgcaaacttcaggactgttcggaacgccatgcagatcgtcgggtttatggatcacgaagctgaatcggtactggcggtggttgctgcggtgctcaaacttggcaacattgagtttaagcccgaatcgagagtgaacggactagacgaatcgaagatcaaagacaaaaatgagctcaaagaaatctgcgagctcaccggaattgaccagtcagtgctcgagcgagcattttcattcagaacagttgaggccaaacaagaaaaagtcagtaccaccctgaacgtcgcccaagcttattatgccagagatgctctcgctaagaacttatacagccggttattctcatggcttgtcaataggataaacgagtccattaaggctcaaaccaaagtcaggaagaaggtgatgggcgtcctggatatttacgggtttgaaatctttgaagacaactcatttgagcagttcattatcaactactgtaacgaaaagctgcaacagatcttcatcgagctgacgttaaaggaagagcaagaggagtacatccgagaagacatcgagtggacacatatcgattactttaataacgcgatcatctgcgacctgatcgagaacaacaccaacgggattctagctatgctggacgaggaatgcctccggccaggtacagtgacggatgagacatttctcgagaaacttaatcaggtctgtgctacgcaccagcatttcgagtcccgcatgtctaagtgctcaagatttttaaacgacacatctttgccccacagctgtttcaggattcagcattatgcaggaaaggtgctgtatcaagtcgagggtttcgtggacaagaataacgaccttctgtatagggatctgtcccaggctatgtggaaggcttctcacgcactgattaagtctcttttccccgaaggtaacccagccaagatcaatctaaagaggccacctacggctggctcccaatttaaagccagcgtcgcaacactgatgaagaacctgcaaaccaagaatccaaactacatccggtgcatcaagcctaacgataagaaggccgcacatatctttaacgaagcgctggtgtgtcaccagattcgatacctgggcttgctcgagaatgtcagagtgagaagagctggctatgcatttcggcaagcatacgagccttgtctggaaagatataaaatgctctgtaagcaaacctggccccactggaaggggcctgccaggtccggggttgaagttctctttaatgagctcgagatcccagtggaagagtacagtttcggtcgttctaaaattttcattcgtaaccccagaacattatttaagctagaagatctgaggaaacagcggctcgaagacctggctacgctgattcaaaagatctatcgcggatggaaatgccgaacccatttcctgcttatgaaaaagtctcagattgtcatagctgcatggtacaggaggtacgcccagcagaagagatatcagcagacaaaatcctctgcattggtgattcagagctatatccgagggtggaaagccaggaaaatcctacgggaactcaagcatcaaaagcggtgcaaggaggcagtgactacaatcgcagcatactggcacggcactcaagccagacgagagctccggcgtctgaaagaagaagcacggaataaacacgccatcgccgtcatatgggcatattggctgggctctaaggctcgcagagagttgaagcggctgaaggaggaggccagaagaaaacacgccgtggctgtgatctgggcttattggctggggctaaaggttaggcgggagtaccggaagttttttcgcgctaatgcaggtaagaaaatatatgagttcactctgcagcgcatcgtccagaagtattttctcgagatgaaaaacaagatgccttccctgtcacctatcgacaagaattggccctcccgtccctatttgtttctagattccactcataaagagctaaaacgaatttttcatttatggcgctgcaagaagtaccgggaccaattcactgatcagcaaaagctgatctacgaggagaaattggaggcaagcgaactatttaaggacaaaaaagcactttatccaagctcagttggccagccctttcagggcgcttatctggaaataaataaaaacccaaagtacaaaaagctgaaagatgctatcgaagaaaagattatcattgcggaagtagttaataaaatcaaccgtgctaacggaaaaagtacgagccggatcttcctgctgacaaacaacaacctgttgcttgcagaccagaaaagcggacaaatcaaaagcgaagtccctctcgtggacgtgacaaaggtctcaatgagcagccagaatgacgggttctttgcggtccacctcaaagagggatcagaggctgcctccaaaggagatttcctgttcagctctgaccatcttattgagatggctactaaactttacagaaccactctgtcccagactaagcagaaactcaacattgagattagcgacgaattcttagtccagttccgccaggacaaggtctgtgtcaagttcatccagggtaaccagaaaaatggatctgtgcctacctgcaagcgaaagaacaatagacttttggaggttgcagtaccctag

SEQ ID NO: 231572 - DNA, 3237 bp, Artificial Sequence
  Description of Artificial Sequence: Synthetic coding sequence
atggctaaaatggaggttaaaacgagcctacttgacaatatgatcggagtcggggatatggttctcctcgagccattgaatgaagagaccttcataaataacctaaaaaaacggttcgatcattccgaaatctacacctatatcggatccgttgtgatctctgttaatccttacaggagtctgcctatttacagcccagaaaaggttgaggaatacagaaacaggaacttctacgaattgtctccccacattttcgcgctgtcagacgaggcctacaggtctctaagggaccaagataaggaccagtgcatacttatcaccggagaaagtggagctgggaagacagaggccagcaaattggttatgtcatatgttgccgctgtgtgcggaaagggcgctgaggtgaatcaggtcaaggaacagctgctgcagtctaatccggtgcttgaagcgtttggcaatgcaaagaccgtgagaaacgataacagctccagatttggtaaatacatggatatcgaatttgattttaaaggcgaccctctggggggtgtgatttcaaattacctactagagaagtcccgagtcgtaaagcagcctcggggagagcgcaatttccacgtcttctaccagttgctttccggagcttcagaagagttgctcaacaagttaaaactagagcgcgatttctcacgatataattacctctcccttgattctgccaaggtgaacggggtggatgacgcagccaacttccgaactgtcagaaatgcaatgcaaatcgtgggatttatggatcatgaggccgaaagcgtgttagcagttgttgcagctgtgctgaagctgggtaatatcgaatttaagcccgagtctagagtaaacggactggacgagtccaagatcaaggataaaaatgagctgaaagagatctgtgagctgacagggatcgatcaaagcgttctagaacgggctttctcttttagaactgtggaagcaaaacaggagaaggtgtccacaaccttaaacgtggctcaggcctattatgcgagagatgcgctggcgaaaaacctgtatagtaggctcttctcctggttggtgaatcgcatcaatgagtccattaaggcccaaacaaaggtccggaagaaagtcatgggagtgcttgacatttatggattcgagatcttcgaagacaattcttttgagcaatttatcatcaattactgcaacgaaaaactgcaacaaatcttcattgaactaactttgaaggaggagcaggaagaatacattcgcgaagacatagagtggacccatatcgactattttaataacgctatcatttgcgacttgatagaaaacaataccaatgggatcctcgccatgctggacgaagagtgtttgcgccctggaacagtgactgatgaaacattcctagagaagctaaatcaggtgtgtgctacccatcagcacttcgagagcaggatgtcaaagtgttcccggtttctcaacgacacatctctgccccactcctgttttaggatccagcactacgccggtaaggtactttaccaggtcgaaggttttgtggacaagaataacgacctgttgtatagggatctgtcacaggcaatgtggaaagcctctcacgcccttatcaagtctctctttcctgaaggaaatcctgctaaaattaatctgaaacggcctcctacagctggcagccagttcaaggctagcgtcgcaacactgatgaaaaatcttcagactaaaaatccgaactacattaggtgtattaagcctaacgacaaaaaggcagctcacattttcaacgaggctttggtctgccaccagatcaggtatctggggctgttggagaatgtccgagttagaagagccggatatgcatttcggcaggcctacgaaccctgcctcgaaaggtacaagatgctgtgcaagcagacctggccacactggaagggacccgctagatcaggagtagaagtgctgttcaatgagctggagattccggtggaggagtactccttcggaagatctaaaatcttcataagaaatcctcgaacgctgttcaagctggaagatctgcggaagcagagactcgaagaccttgccaccctcatccagaaaatttaccgaggctggaagtgtcgaacccactttctgctcatgaagaagagccagatcgtgatcgcagcctggtatagacgatacgcccagcaaaaacggtaccagcagactaagagtagtgccttagttatccagtcttacatcaggggctggaaggcgcgaaagatcctaagagagctgaagcaccaaaagaggtgtaaagaggctgtgaccaccattgccgcttactggcacggcacccaggtacggagggagtatcgtaagttctttcgagcaaatgcaggcaagaagatttacgagtttacactgcaaaggattgtgcaaaagtattttctggagatgaaaaacaagatgccatctctgagccccatcgataagaattggccgtcaaggccctatctgttcctggattctacgcacaaagaacttaaacggatttttcacctgtggagatgtaaaaagtacagggaccagttcactgaccagcaaaagttgatctacgaagagaagctcgaagccagtgagctgtttaaggataagaaggctctctacccctcctctgttggacagccgttccagggcgcttatctggagataaacaaaaaccctaaatacaagaaactgaaggacgcaattgaggagaagatcattattgctgaggtagtgaacaagattaatcgggcaaacggcaagtctacgagtcggatctttctcctgaccaacaacaatttactcctcgcagaccagaaatcgggacagatcaagtccgaggttccgctggtggacgtgaccaaggtaagcatgtcctcgcagaatgatggctttttcgctgtccatttaaaggagggttctgaagctgccagcaaaggagactttctgttctcctcagaccacttaatagaaatggccaccaagctctacaggaccactctgtcacagactaagcagaagctgaacatcgaaatcagtgacgaatttctagtccagtttaggcaggataaagtgtgtgttaaatttatccagggcaaccagaaaaatggatccgttccaacatgtaaaaggaagaacaacagacttctcgaggttgccgtgccttag

SEQ ID NO: 231573 - DNA, 3324 bp, Artificial Sequence
  Description of Artificial Sequence: Synthetic coding sequence
atggctaaaatggaggttaaaacgtcactgctagataatatgattggcgtcggggacatggtgctcctcgagcctctgaatgaagaaacttttatcaataacttgaagaagcgcttcgaccattccgagatctacacatacataggctcagtcgtaatttccgtgaacccttacaggtcattgccgatatatagccccgaaaaggttgaagagtacaggaaccgtaatttctatgaactctcacctcacatcttcgccctctccgacgaggcgtaccgttcactgcgggatcaggataaagaccagtgtatcctgatcacaggggaatctggagcgggaaaaacagaggctagcaaactcgtcatgagctatgttgccgctgtgtgcggcaagggggctgaggttaatcaggtcaaagaacagctgctacagtcaaatcctgtgcttgaggcctttggtaatgcaaagactgttcgtaacgataactctagtagatttggaaaatatatggatatcgaattcgatttcaaaggggaccccctgggcggtgtcataagtaattatctgctcgagaaatcacgagtcgtgaaacagccacggggtgaaagaaatttccatgttttttaccaactgttgtcaggcgcttccgaggaactactaaacaagctgaaattggagcgggacttttcccggtataattacttgtcactggacagcgccaaggtcaatggcgtcgatgatgccgctaactttcgcaccgtcagaaatgccatgcagatcgtaggctttatggatcatgaagcggaaagcgtgctcgctgttgtggctgccgtgctgaagctaggaaacattgagtttaagcccgaatcaagagtgaacggtctggatgagagcaaaatcaaggataagaacgagctgaaagaaatctgcgagctaacaggaatcgaccagtctgtgctagagagggccttctcattccgcacagtggaggccaagcaggaaaaagtgtccacaaccctgaacgttgcccaggcgtactacgcaagagatgccctggcaaagaacctctactcacgcttgttctcatggcttgtcaaccggatcaacgaaagtatcaaggcccagaccaaagtgaggaagaaagtcatgggtgtgctcgacatctatggcttcgagatcttcgaagataatagttttgagcagtttatcatcaattattgtaacgaaaaactgcaacagattttcatagaactaacattgaaagaagaacaggaggagtatatacgcgaggacatcgagtggactcatatagactacttcaataatgctatcatctgtgacttaatcgaaaacaacaccaatggtattctcgccatgttggacgaggagtgtctgcgacctggcacagttaccgacgagacatttcttgagaaactcaaccaggtgtgcgctacccaccagcacttcgagagcaggatgtctaagtgtagtcggtttctgaacgacacgagccttccccacagttgttttcggattcaacattatgcagggaaagtgctgtatcaggtagagggcttcgtggacaaaaacaatgacctgctctaccgcgacctgtctcaagcaatgtggaaggccagccatgctcttattaagagcctcttccctgagggaaaccccgctaagatcaatctcaaaagaccacctaccgccggatcccagttcaaagccagtgtggcgacactgatgaaaaatctgcaaaccaaaaatcccaactacattaggtgtattaaacctaatgacaaaaaggctgcccatatattcaacgaggctctggtttgtcatcagatccgatacctgggcctgctcgagaacgtgcgggtgagacgcgctgggtatgcgttccggcaggcctacgaaccctgcctggagagatacaagatgctgtgtaagcagacctggccccactggaagggcccagcgaggagcggcgttgaagtgttgtttaacgagttagagatccccgtcgaggagtatagtttcggacggtctaaaatctttattcgcaaccccaggacactgtttaagttagaggacctcaggaagcaacgcctagaagatctggctactcttatacaaaaaatctacagaggctggaaatgcagaacccacttcttgctgatgaaaaagagccagatcgtaattgcggcatggtacagaaggtatgcccagcagaagcgatatcagcaaacgaagtcctcagcgctcgtgattcagagctacatccgaggctggaaggcaaggaaaatcctaagggagttgaaacatcagaagaggtgtaaggaggctgtgactactattgccgcttactggcacggcacgcaagcccgtcgtgagctgaaacgactgaaagaagaggcgagacggaagcacgccgttgctgtcatctgggcctattggctgggcttgaaagtgagaagggaataccgcaagttttttagagctaacgccggaaagaagatctatgagttcaccctgcaacggatcgttcagaaatactttttggagatgaagaacaagatgccttcattgagtccaatcgacaaaaactggcccagtcgcccatacctttttttggacagcacccataaagagctgaagcgcatcttccatctgtggcgctgtaagaaatatcgtgaccagttcacagaccagcagaagctgatatacgaagagaagctcgaggcgtctgaattattcaaggataaaaaagcgttgtacccttcctctgtgggccagccattccaaggagcatatcttgagatcaacaagaatcccaaatacaaaaagctgaaagatgctatcgaagaaaagatcataatagccgaagtagtgaacaagatcaatcgcgcaaacggtaaaagcacatctaggattttcctgctgaccaacaataacctgttgctggccgaccagaaatccggccaaatcaaaagtgaggtaccgctcgttgatgttactaaagtgtcaatgtcttcccagaatgatggcttctttgcggtgcacctgaaagaaggttccgaggccgcttctaaaggtgacttcttgttttcatctgaccacctgattgaaatggccaccaaactgtacaggacgaccctgagtcagacaaagcagaagctcaatatcgagatctctgacgaattcctggtgcagttcagacaagataaagtttgcgtgaaatttatccaaggcaatcaaaagaatggcagtgtgcccacgtgtaagcggaaaaataatcgcctgctggaggtggctgtaccgtag

SEQ ID NO: 231574 - DNA, 3411 bp, Artificial Sequence
  Description of Artificial Sequence: Synthetic coding sequence
atggcaaaaatggaagtcaaaacctcgctgctggataatatgattggcgtcggggacatggttttgctcgagccattgaatgaggagaccttcatcaataacttgaagaaacgctttgatcactccgaaatctacacttacattggctctgtggtcatctctgtgaatccctataggagtctgccaatatattctcccgagaaggttgaggagtaccgcaatcgtaatttctatgaactgagcccccacatattcgcgctgagcgatgaagcctaccgttcgttacgagatcaggataaggatcagtgcatcctaattacaggagagagtggggcaggcaagaccgaggcctcaaagctcgtaatgtcctacgtagccgctgtgtgcggtaagggagccgaggtaaaccaggtcaaagagcagttgcttcagtccaaccctgtcctcgaggcctttggtaacgcgaaaacagttcgtaatgataattcttcgagatttggcaaatacatggacatcgagttcgacttcaaaggcgacccactgggcggagtcataagcaattatttgcttgaaaagagcagggtggtgaaacagccacgcggagagagaaacttccacgtgttctaccagctcctctctggagccagcgaagaactgctgaacaagctgaaacttgagcgcgacttcagcagatacaactacttgtcattagattccgctaaggtcaacggagttgacgacgccgcaaactttcgcaccgtcagaaatgcaatgcagattgtgggattcatggaccacgaggcggaatctgtgctcgccgtggtggcagccgtcctgaagttagggaatatcgaattcaagccagagagccgtgtaaacgggctggatgaaagtaaaattaaagacaaaaatgaactaaaggagatctgtgagctcactggtatcgatcaatcagttctcgaacgtgccttttccttccggaccgtggaggcgaagcaggaaaaagtttcaaccaccttaaacgtggcacaggcctattatgctagagatgctctggcaaagaatctctacagccgtcttttctcatggttggtcaacaggatcaacgaatcaattaaagcccaaaccaaggttaggaagaaagtgatgggcgtgctggacatctacggcttcgagatatttgaggacaattcttttgagcagttcatcatcaactattgtaacgaaaaacttcagcagatcttcatcgaactgacactcaaggaagagcaggaggagtacattagggaggatattgagtggacccacattgattattttaacaacgccatcatatgcgatctgattgagaataataccaatgggattcttgccatgctggacgaagagtgtctgaggcctggcaccgttacagacgaaaccttcttagaaaagctcaatcaggtctgcgccacccaccagcacttcgaatcccgcatgtcaaagtgcagcaggtttctcaacgatactagtcttccgcactcatgctttagaatccagcactacgcaggcaaagtattgtaccaggtggaaggatttgtggataagaacaatgatctcctctacagggacctctcccaggccatgtggaaggcttcacatgctctaatcaagagccttttccccgaagggaaccccgcaaaaattaatctgaagagaccccctaccgctggttcacagttcaaagctagtgtggcgacactcatgaagaatctgcaaacaaaaaatccgaattatatccggtgtattaagccaaatgacaagaaggcggcacacatctttaacgaagctctggtgtgtcaccaaatccgttatctcggtctcctggagaatgtgcgtgttaggcgcgcaggatacgctttccgccaagcctatgagccttgcctagagcgctacaaaatgctctgcaagcagacctggccacactggaagggcccagcacgctctggggttgaagtgctcttcaatgaactcgagattccagtggaggagtacagttttggccgttccaaaatctttataaggaatcccaggactctgtttaagttggaggacttgaggaaacagagactcgaagacctggccacactgatacagaaaatttatcgcggatggaagtgccgcacgcacttcctcctgatgaagaaatctcagattgtgatcgctgcctggtaccgcaggtatgctcagcagaaaaggtaccagcagaccaagagttccgccctggttattcagagctacattcgcggatggaaagctcgcaagatcctgcgtgagctgaaacaccaaaaacggtgtaaggaagccgtaacaacaatcgctgcttattggcatggcacccaggccagacgtgagctgagaagactgaaagaggaggccagaaataaacacgccattgccgtgatatgggcgtactggctgggatctaaagcaagacgggagctgaaaagactcaaggaggaggctcggagaaagcacgctgtggccgttatttgggcgtattggctgggtctgaaagtgaggcgggaataccggaagtttttccgcgcaaatgcgggaaaaaagatttacgagtttaccctccagaggattgtccagaagtattttctggaaatgaagaacaaaatgccgtccttgagtccgattgacaaaaactggcccagccgcccttacctttttctggatagcacgcataaagaattgaagcggatctttcatctctggcgttgcaagaaatatagagaccagtttactgaccagcagaaacttatttatgaggagaaattagaggcctcggagctatttaaggataaaaaggcactttacccgtcttccgttggccagcccttccagggcgcataccttgagatcaacaaaaaccctaaatacaaaaagttgaaggatgccattgaggaaaaaattattatcgcagaggtcgtgaacaagattaatcgcgctaatggtaagtccacttcgagaatattcctgctgacaaacaacaacctcctcctcgcagatcaaaagtctggccagatcaagtctgaggtgccactagttgatgtgaccaaagtttcaatgtctagccagaatgatgggttcttcgcggtccacctgaaggagggctccgaagctgccagcaagggcgacttcctgttttcatctgatcacctcattgagatggccactaaactgtacagaaccacgctttcccaaactaagcaaaagctgaacatcgaaatttcagatgagtttttggtgcaattccggcaggataaagtatgcgtgaaattcattcaggggaatcagaagaatgggtccgtgcctacttgcaagagaaaaaacaaccggctcctcgaagtcgctgtcccatag

SEQ ID NO: 231575 - DNA, 492 bp, Artificial Sequence
  Description of Artificial Sequence: Synthetic coding sequence
atggcaaagatggaagttaaaacctctctgcttgataacatgataggagttggagacatggtactccttgaaccactcaatgaagagacctttattaacaacctgaaaaagcgctttgatcacagtgagatttacacatacatagggtcagtcgtgatctctgtgaatccgtatcgatccctgccgatctacagtcccgagaaggtggaggagtataggaataggaatttctacgagctgtcgccacacatcttcgcactgtccgatgaagcgtacaggtcactccgagaccaggacaaggaccagtgtattttaatcaccggagaatctggggctggaaagacagaagcaagcaaactcgttatgtcgtatgtagctgcagtgtgtggaaagggggcagaggtgaaccaagtgaaagagcagctgctccaatccaacccagtgttggaggccttcggcaacgcaaagacagttcggaacgacaattcatag

SEQ ID NO: 231576 - DNA, 252 bp, Artificial Sequence
  Description of Artificial Sequence: Synthetic coding sequence
atggccaaaatggaggtaaagacctccctgttggacaacatgatcggagtgggggacatggtgctgcttgagcccctaaacgaagaaacctttatcaacaatcttaagaaaaggttcgaccattctgagatttacacttacatcggaagtgtcgtgatatccgttaacccatacagatcgctgcccatttactcacctgaaaaggtggaagagtataggaatcgcaacttttatgagctctcaccccactag

SEQ ID NO: 231577 - DNA, 450 bp, Artificial Sequence
  Description of Artificial Sequence: Synthetic coding sequence
atggccaagatggaggtgaagacaagcctgttggataatatgattggagtgggtgatatggtcctacttgagccattaaatgaggaaacgttcatcaacaacctgaagaagaggttcgaccactcggagatctatacctatattgggtctgtggtgattagcgtgaatccttataggtctctgccaatctacagccccgagaaggttgaggagtataggaatcgtaacttctacgagttatcgccacacatctttgcactgagcgatgaggcataccggtcgctaagggaccaggacaaggatcaatgcattctcatcactggtgagagcggggctgggaaaacagaagctagcaaactcgtcatgagttacgtggctgccgtttgtggaaagggggctgaggttaatcaggtgaaagagcagctcttgcaatcaaatcccgtgctgtag

SEQ ID NO: 231578 - DNA, 1146 bp, Artificial Sequence
  Description of Artificial Sequence: Synthetic coding sequence
atgaagaagtcccagatcgtcatcgccgcatggtacagacgttatgcgcaacagaaacgctatcagcagacaaagagcagtgcactggttattcaaagctacatccggggatggaaggccaggaagattctaagagagctgaaacatcaaaaaaggtgcaaggaagcagtgaccactatcgctgcatactggcatggaacgcaggctcgcagggaactgaagagactgaaggaggaggcgagaaggaaacacgccgtcgccgtaatttgggcatactggctggggctgaaagtccggagagaataccgtaaattctttcgcgctaacgccggtaagaaaatctatgagttcaccctgcaacgcattgtacagaagtacttcctagagatgaagaataagatgcctagtctgtcaccaattgataagaactggcccagccggccatatctgttcttagattcaacacataaagaattaaagcgaatcttccacctgtggcgatgtaagaagtatcgcgaccagtttaccgaccaacagaaattaatctacgaggagaagcttgaggcttctgaactgttcaaggacaagaaggcactttatccttcatctgtcgggcagcctttccaaggagcatacctcgaaatcaacaagaacccgaaatataaaaagctcaaagacgccattgaggaaaaaatcattatcgcagaagtggtcaataagataaatcgtgccaacggcaaaagcacgtcccggattttcctgctgaccaataataacttgctactggccgatcagaaaagcggccagatcaaaagcgaggttccattggttgatgttacaaaggtctctatgagcagccagaacgacggctttttcgccgtccacctcaaggagggttccgaagccgctagtaagggggacttcttgttcagctctgaccacctgattgaaatggcaactaagctgtatcgtacaacactgtctcagaccaagcagaagttgaacatagagatttccgacgagtttctagtgcagttcagacaagacaaggtgtgcgttaagtttatccaggggaatcagaagaacgggagcgtgcctacatgtaaacggaagaacaatagactcctggaggtcgccgttccttag

SEQ ID NO: 231579 - DNA, 924 bp, Artificial Sequence
  Description of Artificial Sequence: Synthetic coding sequence
atggccaaaatggaagtgaaaacgtctctcttggacaatatgattggggtgggcgatatggtgctgctagagcctcttaacgaagagacatttattaataacttgaagaagcgcttcgaccacagtgagatttatacctacattggaagtgtggtaattagcgtgaatccttataggagtctcccaatctacagcccagaaaaggtcgaggagtaccgcaacagaaacttttacgagctgagtccccacatctttgctctgagcgacgaagcttaccgtagccttcgggaccaagataaagatcagtgtattcttatcactggcgagagcggtgcaggaaagaccgaggcttccaaactggtgatgtcctacgtggctgctgtttgtggtaaaggggctgaggtgaatcaagtgaaagaacaattgctccaaagcaacccagtcctagaagcctttggcaatgcaaagactgtcagaaatgacaatagctcacgcttcgggaagtacatggacattgagtttgattttaaaggtgatcctctgggcggtgtgatctccaactatcttcttgaaaaatcacgggtggtcaagcaaccacgtggggaacgaaacttccacgtgttctaccagcttctgtctggggctagcgaggaactcttgaataagctcaaactggaaagggatttctcacgctacaattatctgtctctggatagcgccaaagtcaacggcgtcgacgatgcagctaacttcagaacggtgcggaatgctatgcaaatagtcgggtttatggatcatgaggcggagtctgtgctggctgtagttgccgcagtcttgaagctcgggaatattgagttcaagccagaatcccgggtgaacggactggacgagtccaaaattaaggacaaaaacgagtccaagtag

SEQ ID NO: 231580 - DNA, 912 bp, Artificial Sequence
  Description of Artificial Sequence: Synthetic coding sequence
atggccaagatggaagtcaagacctccctgctggataacatgatcggggtgggggacatggttttgctggaaccactgaacgaagagaccttcattaataatctgaaaaagagattcgaccatagcgaaatctacacgtacatcggatccgttgttatttccgtgaacccttacaggagcctgccaatttactcaccagaaaaggtagaagagtatcggaacaggaatttctatgaattgtcccctcacatatttgctctgtcagatgaggcctacaggagccttcgggaccaggataaggaccagtgcattttgataacaggagaatccggggctggaaagacagaagcctctaagctagtgatgtcttatgtggccgcagtgtgtggaaaaggggctgaagtcaaccaggttaaagagcagttattacaatcaaacccagttttggaggcttttgggaatgccaaaacagtgagaaatgacaatagctctcggtttggcaagtacatggatatcgagtttgatttcaaaggagatcccctcggaggtgtgatctcgaattacctgctggaaaagtccagggtggtgaaacaacctcgaggggagcgcaatttccatgtcttctatcagctactgtcaggagcctcagaggaactgctgaataaactgaagctcgagagagacttcagtcgatataactacttgagtctggattctgccaaagtgaacggtgtggacgatgccgctaacttcaggaccgtgcgaaatgctatgcagatcgtgggcttcatggaccacgaggcagagtccgtgctagcagtggtggctgcagtgttaaagcttggcaacatcgaattcaagcctgaaagccgggtgaacggactggacgagtccaaaattaaggacaaatag

SEQ ID NO: 231581 - DNA, 3192 bp, Artificial Sequence
  Description of Artificial Sequence: Synthetic coding sequence
atggccctccaagtggaactggtgcccactggagaaataattagagtcgtgcatcctcacaggccgtgtaaactagccttgggcagcgacggcgttcgcgtgactatggaatcagcgctgaccgctcgcgatcgcgtgggggtgcaggattttgtgctgctggaaaattttacttccgaggcggcttttatagaaaatcttcggcgacgattccgcgaaaatctgatctatacctatattgggccagtgctggtaagcgttaatccataccgggatttgcagatttatagccggcagcatatggagaggtaccggggagtgtcattttatgaagtgcccccacaccttttcgccgtagcagatacagtctacagggcattaagaactgagcgacgggatcaagctgttatgatctctggtgaaagcggcgctggaaagactgaagcgactaagcggcttctgcagttctacgccgagacctgccctgccccagagcgaggaggcgcagtgcgtgatcgcctcctccagtcaaatcccgtgcttgaggcattcgggaatgcgaagactttacgcaacgataactccagtaggttcggcaaatatatggatgtgcagttcgattttaagggagcacctgtaggtggacatattctgtcctacttactcgagaagtccagagttgtccatcagaatcatggggaaaggaattttcacattttctaccagctgcttgagggcggtgaggaggagaccctgcgaaggcttggccttgagcgcaacccccaaagttacctgtatttagttaaggggcaatgcgcaaaggtatcctcaattaatgacaaaagtgattggaaggtggtccgtaaagccctgacggtcatcgactttaccgaggacgaagtggaggatttattgtcgatcgtcgcctcagtgctgcatctgggcaacattcacttcgccgcaaacgaggagagcaatgctcaagtgacgacagagaatcagctgaagtatttgacgcgccttctgtccgtcgaagggtccactctaagggaggctttaactcacagaaagattatcgctaaaggcgaggaactgctgagccctcttaatctcgagcaggccgcttatgccagagatgccctcgccaaggccgtttacagtagaactttcacatggttagtgggtaaaattaatcgttctctcgccagcaaggatgtcgaatccccttcatggagaagtaccactgtgttaggacttctcgatatttatggctttgaagtgttccagcataactcattcgagcagttctgcatcaattactgtaacgagaagcttcagcagttgttcatcgaactcacgctgaaaagtgaacaggaagaatacgaggccgaagggatcgcctgggaacccgtccagtactttaataacaaaatcatttgtgacctggtggaggagaaatttaagggaatcatctctatactggacgaggaatgcctgaggccaggtgaggccacggatctgacttttctcgagaaattggaggacacggttaaacaccacccccacttccttacacacaagttggccgaccagcgcacccggaagagcctcgggaggggcgaattccggctgctgcactacgcaggcgaagttacttatagcgtgaccgggttcctcgacaaaaacaacgaccttcttttcagaaatctgaaagaaactatgtgttccagtaaaaatccaatcatgtcccaatgttttgatagaagtgaactctctgacaagaaacggcctgaaacagtcgccacacagttcaagatgagcttattacaactggtggagatcctccagtccaaagaaccagcctacgtgcgatgcatcaagcccaacgatgccaagcagcccggtcggttcgatgaggtcttgattcgccaccaggttaaatatttaggactgttggaaaatctgcgcgtgcgcagggccggtttcgcgtatagaaggaaatacgaggctttcctacagcggtataaatccttgtgtcctgagacgtggcctacttgggccggacggcctcaagacggcgttgccgttctggttcgccacctcgggtacaaaccagaggagtataagatggggaggacaaaaattttcattcgatttcccaagactctgtttgctacagaggacgcattagaggttcgccgacagagcctcgccacaaaaatacaggccgcttggcgcggtttccactggagacagaagttcctgcgagtcaagagaagcgccatatgtattcaatcttggtggcggggaacattaggccgacgcaaagctgccaaaagaaaatgggccgctcaaaccattagaaggctgatccggggatttgttcttaggcatgcgcctaggtgcccagagaacgctttctttcttgatcatgtacgaacttctttcttgctcaatctaaggcgccagctgccccaaaacgtgttagacacaagctggccgaccccacctccagccctcagggaggcctccgagctgttgagagaattatgtataaaaaacatggtgtggaaatattgtcgatcaattagtcccgagtggaaacagcagctacaacagaaggcagtggcatccgaaatctttaagggcaagaaggataattatcctcagtctgtcccacgcctgtttatctcgacccggcttggcacggacgaaatatcccccagggtcttgcaagctttaggatcagagcctatccaatacgccgtacctgtcgtgaaatacgaccgcaagggctacaaacccaggtccaggcagttacttttgacaccaaatgctgtggtgattgtggaggacgcaaaagtgaagcaacgcatcgattacgccaatcttacagggattagtgtgtcgagcttaagtgatagtctctttgtgcttcatgtccaacgggcagataacaagcagaaaggagacgtggtgctccagagtgatcatgtgatcgagacattaactaaaaccgccctgtcggcaaatagagtgaactccatcaatataaaccaaggaagcataacattcgcaggcggtccaggacgtgatggcactatcgatttcacacccggatctgaattgctgattaccaaggcaaagaacggccatctcgccgtggtggcaccacgcttgaacagccggtag

SEQ ID NO: 231582 - DNA, 3087 bp, Artificial Sequence
  Description of Artificial Sequence: Synthetic coding sequence
atggagagcgcacttacagcgagagaccgggtgggagtgcaggatttcgtacttttggagaacttcacatcagaagccgctttcattgagaacctgagaaggcggtttagggagaatcttatctatacttacatcgggcctgttctggtctcagtgaacccttaccgggacctgcagatatatagtcggcagcatatggagcggtacaggggcgtgagtttttatgaggtgcctccacacctgtttgctgtggcagacacagtttatagagccctgaggacagaaaggcgcgatcaggccgtgatgatcagcggggagagtggcgcaggaaagaccgaggcaactaagcgtcttctccagttttatgctgagacctgtccagctcccgagcgaggtggtgccgtgcgcgatagacttctgcaatccaatcccgtcctggaggctttcgggaacgccaaaaccctaaggaacgataatagctctcggtttggaaagtacatggacgtgcagtttgattttaaaggcgcaccggtgggcggacatatcctctcctacttgttggaaaagtcccgcgtagttcatcaaaaccacggagagcggaacttccacatcttctatcagctgctggagggtggcgaagaggaaactcttcgcagactcggcctggagaggaacccacagagctatctatacctggttaagggccagtgcgccaaagtcagctctattaatgacaaatccgattggaaggttgtgcgcaaggcactgacagttattgactttactgaagatgaggtggaggacttactctctatcgtcgctagtgtgctgcatcttggcaatatacactttgcagccaatgaagaatctaacgcacaggtgactacagagaaccagcttaagtatctgacacgtctcttaagcgtggaaggtagcaccctgagggaggctctgacccatcgcaagatcattgccaaaggagaagagctgctgtcacccctaaacctggagcaagccgcttatgccagagacgcgctggcaaaagccgtgtactccaggactttcacatggctggttggcaagatcaaccggtctctggcctctaaagatgtggaaagtccctcttggaggagtacaactgtactcggcctacttgacatttatgggtttgaagtgttccaacataacagcttcgaacagttctgcatcaactactgcaatgagaagctgcagcagcttttcattgagcttaccctgaagagcgagcaggaggagtacgaggccgaaggcattgcatgggagcctgtgcagtattttaacaacaagattatttgcgatttagtggaagaaaagttcaaggggattatttcaatcctggacgaggaatgcttgcgtcccggagaagccactgatcttacttttctggagaagcttgaggataccgtgaagcaccacccacacttcctgacacacaaactggcagatcagcgcactaggaagagcttaggtcgcggtgagtttaggctgctgcactacgccggtgaggtgacctactccgtcacgggttttctggacaagaacaatgacctgctctttcggaacctaaaggagacaatgtgttcatccaaaaacccaataatgagtcagtgttttgatcgctcggagctctctgataaaaagcgacctgaaaccgttgctacgcaatttaaaatgtcattgctgcagctggtggagatcctccaatcaaaggagcctgcatacgtgaggtgcattaaaccaaatgacgctaagcagcctgggcgttttgacgaggtgcttattaggcaccaagtcaaatacctgggactattggagaacctgcgtgtacggagagcgggttttgcgtaccgcaggaagtacgaagcatttctgcagcggtataagagtctgtgccccgagacatggcccacttgggcaggaagacctcaggatggtgtagcggtactggttcgccatctaggctataagcctgaagagtataaaatgggacgaacaaaaatctttatacgctttcccaaaacattatttgctacagaggatgctctggaagtacggaggcaatcactggctacaaaaatccaggcggcatggcggggattccattggcgccagaagttcctgagagttaagagatctgccatatgcatacagagctggtggagggggaccctcggtagaagaaaggctgccaagagaaagtgggccgcacaaacgatccgtcggctcatccggggatttgttcttaggcatgcaccaagatgccctgaaaacgcctttttcctggatcacgtgcgtacctcctttttgctgaatttgcgccgacagttgccccaaaatgttctcgatacctcatggccgaccccacctcctgccctgagagaggcttcagagctgcttcgggaactgtgcattaaaaatatggtgtggaaatattgcaggtctatcagtcctgagtggaagcagcagctacagcagaaagctgtcgcctcagaaatcttcaaaggaaagaaagacaattatccacagtcagtgccgagactgtttatttcaacaaggctgggcacagatgagattagtcccagggtccttcaagcactgggttcagaacctatacagtacgctgtccccgtcgtcaaatacgacaggaaggggtataaacccagatccaggcaacttctcctcaccccaaatgccgtagtaatagtcgaggacgccaaagttaagcagagaatcgattatgccaacctgaccggcatatcagtctcctcgctctctgattccctattcgtcttacatgtccagagagccgacaacaaacagaagggggacgtcgtgctgcagagcgatcatgtgatagagaccctgaccaagactgccctttcagccaacagggtcaactcgattaacattaatcaggggtctattacgtttgccggagggccaggacgggacggaactatagacttcactccgggttccgagctgctcattacaaaagccaagaacggacacctcgctgtggtggcgcctagacttaattcccgctag

SEQ ID NO: 231583 - DNA, 3135 bp, Artificial Sequence
  Description of Artificial Sequence: Synthetic coding sequence
atgcggtatagggcttccgcactgggaagcgatggcgttagagtcactatggaaagcgctctcaccgcacgcgaccgcgtgggcgtccaggactttgtgctgctcgagaactttacctcagaggccgcttttatcgaaaatctccgacggagattcagagagaaccttatttatacctatattgggcctgtgctggtgagcgtaaatccctatcgcgatctgcagatttattctaggcagcacatggagcggtacaggggcgtgagcttctacgaagtcccccctcatcttttcgccgtggcagacaccgtttaccgcgctcttcggaccgagcggagggaccaggcagtgatgatctccggagagtccggtgccggtaagaccgaagccactaagcgactgcttcaattttacgctgagacgtgtcccgctcccgaacggggaggggctgtacgagatagattactccagtctaatccggtactggaagcctttgggaatgcaaaaacattgagaaacgataactcgtccagatttggaaagtacatggatgtccaattcgacttcaagggagctccagtgggaggccacattttaagttatctcctagagaaaagcagggtggtgcaccagaatcacggtgaacgcaactttcacatattctaccagttgctggagggaggcgaggaagaaacgctgcgccgattgggcctcgagcgtaaccctcaaagctacttatatctggtcaagggccagtgtgctaaggtcagtagcatcaatgataaatcagattggaaggtggtgaggaaagccctgacagtgatcgactttactgaggacgaggttgaagatctgttatcaatcgttgcatcagtgctccatctcggcaatatccacttcgctgctaatgaagagagcaatgcacaggttacaacggagaatcagctcaagtatttgacaagactactttcagtcgaaggctcaacactgagggaagctctgacacatcgcaagatcattgccaagggcgaggagctcctgtccccccttaatctggagcaggcagcatatgcccgtgacgccctcgccaaagccgtttattcccgtaccttcacctggttggtcggaaaaattaatcgcagtcttgcgtccaaggatgtcgaatctcccagttggcggagtaccacagtattggggctcttggacatctacgggtttgaagttttccagcacaactccttcgagcagttctgtatcaactactgcaacgagaagctccaacaacttttcatcgaactgactttaaagtcggaacaggaagaatacgaggctgaggggatagcatgggagccagtccagtatttcaataataagattatttgcgatctggtagaggagaagttcaagggaatcatttcaattttggatgaggagtgtctccggccaggtgaggccacagacctgacttttctggagaaacttgaggacactgtgaaacaccaccctcattttcttactcacaagcttgctgaccaaagaacccggaaatccctgggaagaggagaatttcggctgctgcattacgcgggtgaagtgacctattcagtgaccggttttctggacaagaacaacgacctcctgttccggaatctgaaggaaaccatgtgctcgtctaagaaccccatcatgtcccagtgtttcgaccgcagcgagctgagcgataagaaaagacctgagaccgtggcaactcaatttaagatgtcattgctgcagctggtcgaaatcctccaatcaaaagaacccgcttacgtgagatgtatcaaacccaatgacgcgaaacagcccggaaggtttgatgaagttcttatacgccaccaagtgaagtacctgggcctgttggaaaatctcagagtgagacgggcaggctttgcttatcgccgtaaatacgaggcattcttacaaaggtataagagcctctgccctgaaacttggcctacatgggcaggtagaccccaggacggggtggccgtgctggttaggcacttgggctataagcccgaggaatataaaatgggtaggactaaaattttcatcaggttccctaagaccttattcgccactgaggatgctttggaagtgaggcgacaatccctggccaccaagattcaagctgcctggaggggctttcattggcgtcagaagttcctcagggttaagcggagcgctatatgcattcagagctggtggcgcggtacgctaggtagaaggaaagccgcaaagaggaagtgggccgcacagacaatacgacgactcattcgcggttttgtgctccggcacgcccctaggtgccctgagaatgctttctttctcgaccatgtgaggacaagctttctccttaacctccgcagacagctcccgcagaatgtgctcgataccagctggcctacaccccctcctgcgctccgggaggccagtgagctgctacgtgaactctgtataaagaacatggtctggaaatactgtcgtagcatctcccccgagtggaaacagcagctgcagcagaaagccgtcgccagcgagatttttaaagggaaaaaggacaactatcctcagagtgtgccgcgtcttttcatctctactaggctggggacagacgagatttcccccagagtgctccaggcccttgggtctgaacctatccagtatgccgtgcccgtcgtgaagtatgacagaaagggctataagcctaggagccgacagctcctgctgacccccaacgccgtcgtgatagtggaagacgccaaggtgaaacagcgaattgattacgccaatctgaccgggatctccgtctccagccttagcgattcattatttgttcttcacgtccagcgagcggataataaacaaaagggcgacgtcgtcctgcagtctgaccatgtgattgaaacactgacgaagaccgcactgtctgccaatagagttaatagtattaacattaaccagggctccatcacattcgcaggtggcccagggagggacgggactatagacttcacccccggttctgagctgttaattacgaaggctaagaacggccatctcgccgttgtagcaccacgactgaactcacgatag

SEQ ID NO: 231584 - DNA, 2418 bp, Artificial Sequence
  Description of Artificial Sequence: Synthetic coding sequence
atggaatccgctctgacagccagggatagggtaggggtgcaggacttcgtattgttagaaaactttacatctgaagcagccttcattgaaaatctccggaggaggtttcgcgaaaacctcatctacacatacataggccctgtcctcgtgagcgtgaatccctacagggatcttcagatctactccaggcagcacatggaaagataccggggtgtgagcttctacgaggtccctccccatctttttgccgtggctgatacagtttatcgcgctcttcggaccgagagaagagatcaagcagtcatgatatctggagaatcaggggctggtaagacagaagccactaagcgcctgctgcaattttacgccgagacctgccctgcacctgagagaggcggagcagtcagagatagactcttgcagtccaaccctgtgctggaagcctttggaaatgccaagacactcaggaacgataactccagcagatttggcaaatacatggatgtccagtttgatttcaagggggctcccgttggcggacatattctctcgtatctgctggagaaatcaagggttgttcatcagaaccacggggaaaggaacttccatatattttaccagcttctggaaggaggagaagaagagacgctgagaaggcttggattagagcgtaacccacagtcttatttatatctcgtgaaggggcagtgcgcaaaggtttcatccattaacgataagagcgactggaaggtcgtgcgtaaagccctaacagtcattgactttaccgaagatgaggttgaagacctgttgtcaatcgttgcctctgtgctgcacctcgggaacatccattttgcggctaatgaagagtccaacgcccaggttacaacagaaaaccagctaaagtacttgaccaggctgctgtcggtcgaaggttctaccttgagggaggctctgacccaccggaagatcatcgccaaaggcgaagaactgctttcacccctgaacctggagcaggctgcctacgccagggacgccctcgctaaggctgtttatagcagaaccttcacttggctcgtgggcaagataaatagaagcctggcatcaaaagatgtagaatctccatcttggcgttccaccacagtgctggggttactggatatttacggctttgaggtgtttcaacataattctttcgaacagttttgtatcaactattgtaacgaaaagcttcaacagctgttcattgaacttactcttaagtcagagcaggaggaatacgaggcggaggggattgcctgggaacctgtgcagtatttcaataataaaatcatctgtgacctggtcgaggagaagtttaagggcattatcagtatcctggacgaggaatgcttgcggcctggtgaggccacagatttaacattcttggaaaagcttgaagataccgtgaaacaccacccccactttttgactcacaagctcgctgaccagagaacccgcaaatctctgggacgcggagagtttcgcttgctgcactatgccggagaggtcacctattcagtcactggttttttggacaagaacaacgacctactgttccgtaatctgaaggaaaccatgtgctccagcaagaacccaatcatgagccagtgcttcgaccgcagcgaactgtctgacaagaagaggcctgagacggtagctactcagttcaaaatgtctctgctgcaactggtggagattctacagtctaaggagcccgcatatgtgcgctgcatcaagcctaatgatgccaagcagcctggcagattcgacgaggtactcattcggcaccaggtgaaatacttgggactgctggagaaccttcgcgtcaggagggccggatttgcataccgtaggaaatacgaggcatttcttcaaagatataaatcactgtgccctgagacatggcccacctgggccggtaggcctcaggatggcgtggccgtactggtgcgacatctgggatacaaaccagaggaatataagatggggagaaccaaaatatttattagattcccaaaaacccttttcgcaactgaggatgctctggaggtacgccgacaaagtttagctactaagattcaggccgcttggcgcggtttccactggaggcaaaaattcctacgggtgaaacggtctgccatctgcatccagtcgtggtggagaggtacactgggacggagaaaagcagcaaaggaggtcggaggtacggatcaccccgcagcccatccaagattgcggccagcgcctcgaccccctctgcctcgggagcgattactgcccggaccctgcgctcacctctttttcgctaaacccgaggccgcagccgctcctgagtgtcccggtcaccttgttgcgcatgcgcctacttgccccgcatag

SEQ ID NO: 231585 - DNA, 3135 bp, Artificial Sequence
  Description of Artificial Sequence: Synthetic coding sequence
atgcgtgggagggcgagtgctttggggtcagacggagtccgcgtgaccatggaaagcgcactgactgctcgcgatcgtgtcggggtacaggactttgtgctcctggagaactttactagcgaagcggctttcatagagaacctgaggagaaggtttagagagaacttaatttacacatatatcggtccagtcctggtgtcagtaaatccataccgcgatctgcagatttactcaagacaacatatggagaggtaccgcggagtgagcttttacgaggtaccacctcacctctttgctgtagcagacaccgtctatcgggcactgcggacggagaggcgggaccaagctgtgatgatatctggcgagagcggagcgggtaagactgaagctactaagaggctcctccaattctacgctgagacttgccccgctcctgaacggggaggggctgtcagggatagattattgcagtccaatcctgtcctagaagcttttggtaatgcaaagacacttcggaacgacaatagctctagattcggaaagtacatggatgtgcaatttgatttcaaaggcgctccggtgggtggacacatcttgagctatttgctggaaaagagcagagttgtgcatcaaaatcacggagaaaggaactttcacatcttctaccagttacttgaagggggagaggaggagaccctccggaggctagggctggaaaggaatccccagtcctacttatacttagtcaaaggacagtgcgcaaaagtctcaagtattaatgacaaaagcgattggaaggtggtgcgaaaagccctcaccgtcatagatttcacagaagacgaggttgaggatcttttgagcatcgtagcgtccgtgcttcatttggggaatatccactttgctgcgaacgaggagtccaacgcgcaggtcacaacagagaaccaacttaagtacctgaccagattgctaagcgtcgaagggagtacattgagggaagcgttgacacacaggaagattatcgccaagggtgaggaacttctgtctcctctcaacctggagcaggccgcatacgctcgggatgccttggccaaagcagtttactccaggactttcacatggctggttggcaagattaaccgatccctggcctccaaggatgtggaatcgccctcttggcggagtaccaccgtgctgggcctgttggatatttacggcttcgaggtgttccagcacaatagttttgaacagttttgcatcaattactgtaatgaaaagctgcagcagctgtttatcgagctgaccttgaagtctgaacaggaggagtacgaagctgaaggtatagcatgggagccagtccagtattttaacaacaagattatctgcgacttagtagaggaaaaattcaagggtattatcagtatcctcgacgaggagtgcctcaggccaggagaggccacagacctcaccttcttagagaagcttgaagacactgttaagcaccacccccactttttgactcacaaactggccgaccagcgtactcggaagagccttgggagaggcgaatttaggctgctccactatgctggagaagtcacctactccgtgacaggatttctggataagaataacgacctgttgttcaggaatctcaaagaaactatgtgttccagtaaaaatccaatcatgtcccagtgttttgatcgcagcgagctgagcgacaaaaagcgtcccgagacggtggcgactcagttcaagatgtccttactccagctggttgaaatactccagagtaaagaaccggcatatgtgaggtgtataaagccgaacgacgcaaagcagcctggcaggtttgacgaagtgcttatcaggcaccaagtcaagtacctcggcttgctggagaatctaagggtgcggagagctggctttgcatacagacgtaagtatgaagcttttctgcaacgctataagagcctgtgtcctgaaacctggcccacatgggcgggtcgtcctcaagacggagtagcagtgttggtgagacaccttggctacaagccagaagagtacaaaatgggtcgcacaaaaatcttcattcgattccccaaaacgttatttgcaaccgaggacgccctggaagtgagaagacagtcacttgccaccaagatccaggccgcttggcgagggttccactggagacaaaagttcctgcgggtcaaacggtcagcaatttgcattcagtcatggtggagaggcacccttggcagacgcaaggccgctaaaaggaagtgggctgctcagacaataaggcgcctcatacgcggtttcgtgctgagacacgcaccgcgatgtcccgagaatgctttcttcctcgatcatgtccggacatccttcctgctcaacttgagaagacagcttcctcagaacgtgctagatacatcttggcctacacctccgccagctttgcgtgaagcctccgagcttctgcgggagctgtgcatcaagaatatggtgtggaagtattgtcggagcatttctcccgaatggaagcagcaacttcaacaaaaggctgtggcgagcgagatcttcaaggggaagaaagataactatcctcagtcagttcctagactgttcatttccactagactgggaaccgacgaaatctccccccgagtgttgcaggccctgggctccgagccaattcagtacgcagtgcccgtggtgaagtacgacagaaagggttacaaaccgaggagcaggcagctacttctcaccccaaacgctgttgtgattgtggaggacgctaaagtcaagcaaagaatcgattatgcaaacctgacaggcatcagtgtttccagtctgtccgactctttatttgtcctccacgtgcagcgagccgataataagcagaagggtgacgttgtgctgcagtcggaccatgttattgagactctgactaagactgcgttaagcgctaaccgggtgaattcaatcaatatcaaccagggcagcatcaccttcgcaggcggacctggacgcgacggcacaatcgattttacaccgggaagcgagttgctaataaccaaagcgaaaaacgggcatctcgcggtggttgccccaagattaaactccagatag

SEQ ID NO: 231586 - DNA, 3120 bp, Artificial Sequence
  Description of Artificial Sequence: Synthetic coding sequence
atggccctaggctccgacggggtaagggtgacaatggaaagcgccctcacagcgcgagacagggttggggttcaggattttgtcctgctggagaacttcacttctgaggccgcattcattgaaaatctgcggaggcgatttcgcgagaacttgatctacacctacatcggcccagtgctcgtgtctgtcaacccctatcgggatcttcagatctatagccggcagcatatggaacggtaccggggtgtctcattctacgaggttcctccgcacctttttgcagttgctgacaccgtataccgggcactgaggactgaaagaagggaccaggccgtaatgatctcaggagagtccggagccggtaaaaccgaggccacgaaacggttactgcagttctacgcagagacctgtcccgcacctgagaggggaggtgccgttcgggacagattgctgcaaagtaacccagtcctggaggcttttggcaatgccaagaccctgagaaacgacaacagctcacggtttggaaagtatatggatgtgcaattcgactttaaaggggctccggtgggcggacacatcttaagctaccttctcgagaaatcccgggtcgtgcatcagaaccatggagagaggaactttcatatcttttaccagctgctagaaggaggcgaggaggagaccttaaggcgcctgggcctagagcggaacccccaatcatatttgtatcttgtgaagggccagtgtgccaaagtgtcgtccataaacgataaatcagactggaaggtcgttcggaaagcactgaccgtgatagacttcaccgaggacgaggtagaagatttgctctccatcgtcgcatccgtgctgcatctggggaacatccactttgctgcaaatgaggagtcaaatgcacaagtgacaacagagaaccagcttaaatacctgacccggctccttagcgttgagggatctacgctccgcgaagcactgacacaccgaaagatcattgcgaagggggaggagctgctgtctccattgaaccttgagcaggctgcctacgctcgcgatgctctggcaaaggctgtgtactctagaacctttacctggttggtgggaaagattaaccgaagtcttgcatctaaagacgtagaaagtcctagttggcgctcaacaacggtgctgggactgctggatatttatgggttcgaggtgtttcagcataactcattcgagcagttctgcattaactattgcaatgaaaagctccagcagttgttcatcgaactgacgttgaagagtgagcaggaggaatatgaggcagagggcattgcctgggaacctgtgcagtacttcaacaataaaatcatctgcgaccttgttgaggaaaagtttaagggcatcatcagcatcctggacgaagagtgtctcaggccaggagaggccaccgatctgacatttttggagaaactagaggatactgtgaagcaccaccctcattttttgacacacaagctggcagaccaacggacaagaaaaagcctcggtcggggagaattccggctgctgcattacgctggagaggttacttatagcgtaacgggattcctcgacaaaaacaacgatctactgtttagaaacctgaaagagaccatgtgctcatccaagaacccgatcatgtctcagtgctttgaccgttcggaactgagcgataagaaaaggcccgagaccgtcgctactcagtttaagatgagtctgctgcagcttgtagagatactgcagagcaaggaaccggcttatgtgaggtgtataaagcctaacgacgccaaacaaccaggtcggttcgatgaggtactgattcgccatcaggtcaaataccttggattactcgagaacctgcgggtgagaagggctggctttgcatacaggaggaaatacgaagccttcctgcagcgctataagtctctatgccctgagacctggcccacttgggcaggcaggccacaagacggagtggcagtgctggtgagacacttaggttacaaacccgaggagtataaaatgggacggacgaagatcttcatcagatttcctaaaactttgtttgctactgaggacgcactggaagtgcgaaggcagtcattagccactaaaattcaggcggcatggagggggttccactggagacagaaattcctccgtgtgaagcggtctgcaatttgtatccagtcctggtggcgcggaaccctgggtaggcgaaaggccgcaaaaagaaagtgggcggctcaaaccatcagacgtttaattcggggattcgtccttcggcacgcccctcggtgccccgagaacgcctttttcttagatcatgtcagaacctccttcctgctgaatttgcgtcgccaattaccgcaaaacgttttggacacctcttggcccacaccccctccagccctgagggaagctagtgagctacttcgcgagctgtgcatcaagaacatggtgtggaagtactgcagaagcatttctcctgaatggaaacagcagctccagcagaaggcggttgcttcagaaatctttaaaggtaagaaggataattatccccagagcgtccctcggttatttatcagcaccagacttgggactgacgagataagtcccagggtgctgcaggcacttggtagcgagcccatccagtatgcggttccagtcgtgaaatacgataggaagggttataagccgcgttctcgacaactcctactgactcctaacgctgtggtgatcgtggaagacgctaaggtgaagcaacgcatagactacgctaacttgactggaattagcgtgtccagtctgtcagactctctgtttgtgttgcacgtgcagcgcgctgataacaaacagaaaggcgacgtggttttacaatctgatcatgtcattgagacattgacaaagacagcactctccgctaatcgagtcaacagcattaacattaatcaaggatctatcacgtttgctggcggacccggaagagacgggaccatcgatttcacgccaggcagcgagcttttgatcaccaaagctaagaacgggcacctggccgtcgtggcccctcggctcaactcccgctag

SEQ ID NO: 231587 - DNA, 3021 bp, Artificial Sequence
  Description of Artificial Sequence: Synthetic coding sequence
atggccgaacaagagtccctggagttcggcaaagctgactttgttttgatggatacagttagtatgccagaatttatggcaaacctccgattgcggttcgagaagggacgtatctacaccttcatcggggaagtagtcgtttctgtgaatccctacaagctcctcaacatctatgggagagacaccatcgaacagtacaagggtcgtgaactgtacgaacgcccaccacatcttttcgcaatcgcagacgctgcttataaggccatgaagcgcagatctaaggatacctgcatcgttataagtggcgaatctggcgctggaaaaacagaagcatcaaagtatataatgcagtatatcgctgccattacaaatccaagccagcgggcagaggtggaaagggttaaaaatatgcttctgaagagcaactgcgtgctggaggcattcggtaacgcaaaaactaaccgcaacgacaattcaagtcggttcggcaaatacatggatattaactttgatttcaaaggcgatccgatagggggacacatcaataattatctgctggagaaatcaagagttatcgtgcagcagcccggtgaacggtctttccactcattttaccagctgctgcaaggcggatcagaacaaatgctgcgatcccttcatttgcaaaagagcctctcaagctataactacatccacgtcggtgcgcaactgaagagctctattaatgatgctgccgagttccgcgttgttgccgacgctatgaaggttataggtttcaagccagaagagatccaaacagtgtataagatcctcgcagccatacttcacctaggtaatcttaagtttgtggtcgatggagacaccccactgatcgagaacggaaaagtcgtctccattatagcggagctgttgtcaactaaaactgacatggtggagaaagctttgctctatcgcacagtcgctactgggagggacatcatagacaagcagcacactgaacaggaagcatcatacgggagggacgccttcgctaaagctatctacgaaaggctcttctgttggatcgtgacacgaattaacgatataattgaggtcaagaactacgacaccaccatccatggaaagaacactgtgattggtgtgttggatatctacgggttcgaaatctttgacaacaacagcttcgagcagttttgtattaattattgcaatgagaaactccagcaattgtttatccaactggtgttgaaacaggagcaggaagaatatcaaagggaaggcataccttggaaacacattgattatttcaataaccagattatcgtggacctggttgagcagcagcacaaggggattatcgccatcctagatgatgcttgcatgaacgtggggaaggtcactgacgagatgttcttggaggccctgaattcaaagttagggaaacacgctcacttcagttcacgcaaactctgcgcttcggataagatcctggagttcgatcgagacttcagaatccgccattacgccggagacgtcgtgtacagtgtgatagggttcatcgacaaaaacaaggatacattgttccaggactttaaaagactaatgtacaactccagcaatccagtgttgaagaatatgtggcccgaggggaaactgtccatcaccgaggtgaccaagaggcccttaacagccgctactctctttaagaacagtatgatagctctcgtggacaatctcgcgtctaaagagccttactatgtgcgctgcataaagcctaacgacaagaaatccccacaaatctttgacgatgagcggtgtaggcaccaagtcgagtatttagggttactcgagaatgttcgagttagaagagccggttttgcgttccggcagacctatgaaaagttcctccatcgttataagatgatcagtgagttcacgtggcccaaccacgatctgccgtcagataaggaggccgtgaagaaactgatcgaacgttgtggctttcaggatgacgttgcctacggaaagacgaaaatattcatcagaacaccccgaacactgttcaccctggaggagctgcgggctcagatgttgatcaggattgtattattcctccagaaggtgtggagaggcacgcttgcacgaatgcggtacaagagaacgaaagcggctctcaccatcatcaggtactacagaagatataaagtgaagtcctatatccatgaagttgcacgaaggttccacggggtcaagaccatgcgggattacgggaagcacgtcaaatggccatcccccccaaaggtgttacgaagatttgaggaggcacttcaaaccatttttaatcgttggcgggcatcacagttaattaagtctatccccgcatccgatctgcctcaggtccgggcaaaagtggcggcagttgagatgttgaaaggccagagggcagacctcggcctccaaagggcttgggaggggaattatctggcttccaaacctgataccccacagacaagcgggacctttgtgcctgtggccaacgagcttaaacgcaaggataagtatatgaacgtgctgttctcctgccatgttagaaaagtgaacaggttttcgaaggtggaagatcgcgctatcttcgtgactgaccgccatttatacaaaatggatccaaccaaacagtacaaggtaatgaaaacaatacccctgtacaaccttactgggctatcagtatctaatggcaaagaccagctcgttgtttttcacaccaaggataacaaagacttaatcgtgtgtctgttctctaaacagccgactcacgagtcccgcattggagaactcgttggcgtcctggtaaaccattttaagtccgagaaaaggcatctgcaggtcaacgttactaatccagttcaatgtagtttacacggaaagaagtgcacggtgagtgtggagacccgactcaatcaacctcagcccgactttacaaagaatcgttccggatttattctgagcgtcccagggaactag

SEQ ID NO: 231588 - DNA, 597 bp, Artificial Sequence
  Description of Artificial Sequence: Synthetic coding sequence
atgctgaaaggacagcgagctgacctcggactacagcgtgcctgggaaggaaactatctagcaagcaaacctgatacgccccagaccagcgggacattcgttcctgtagcaaacgaactgaagaggaaggataaatatatgaacgtcctgttctcatgccacgtcagaaaagtgaaccgcttctctaaagtcgaagatcgtgcaatttttgtgacagatcgtcatctttacaagatggacccaacgaagcagtacaaggtaatgaagaccattccactttacaacctaaccggcttgagcgtcagcaacgggaaggatcagctagtggtgttccataccaaggataacaaggacctgatcgtctgcttattcagcaagcagcctactcatgagagtaggatcggcgagctcgtgggcgtcctggtgaatcacttcaagtccgaaaagcgccatctccaggtgaatgtaacaaatcctgtccagtgcagcctacatgggaagaaatgcacagtatccgtggaaacacgactgaaccaaccacagcccgacttcaccaaaaatagaagcggattcatccttagtgtgcccggtaactag

SEQ ID NO: 231589 - DNA, 3327 bp, Artificial Sequence
  Description of Artificial Sequence: Synthetic coding sequence
atggggagtaaaggggtgtatcagtatcactggcagagtcacaacgtcaagcacagtggagtcgatgatatggttctgcttagcaagatcactgagaattctatagtggagaatctgaagaaaagatatatggatgattatattttcacctacattggaagcgtcctgatcagcgtcaatcctttcaaacagatgccatacttcggggaaaaagagatagaaatgtaccaaggcgctgcccaatatgaaaacccaccacacatctatgctctggcagataatatgtatagaaatatgatcatagatcgcgaaaatcagtgtgttattatcagcggagaatcaggcgctggcaaaacagtggccgcaaagtatatcatgagctatatttccagagtaagcggtggcggaacaaaggtgcagcatgttaaggatattattcttcagtccaaccccctcctcgaagcctttggaaacgcaaagactgtgaggaacaataactccagccgtttcgggaagtatttcgaaatccagttttctcccggaggagagccagatgggggaaaaatatcgaacttcctactggaaaagagtagagttgttatgcggaaccctggcgagcgcagcttccacatcttttatcaactgattgagggcgcatcagccgagcagaagcattcattgggcatcactagtatggactattactactacctgtctctgagcggaagctacaaggtcgacgatatcgatgaccgccgtgagttccaggaaactctccacgccatgaatgtgatcggaatattcgccgaagaacagacgttagtgcttcagatcgtggccggaattttgcacctcggaaacatctcctttaaggaggtcggcaactacgccgcagtggaatccgaggagttcctggctttccccgcttatttgctcgggattaatcaggataggttgaaagaaaagctaactagccggcaaatggattccaagtgggggggaaaatcagagtcaatccatgtgacactcaacgtggagcaggcgtgttacactcgcgacgcattggctaaagccttacacgcacgcgtctttgacttcttggttgattcaataaacaaggccatggaaaaggatcatgaggagtataatatcggtgtactggatatctatggtttcgaaatcttccagaagaatggattcgaacagttctgcatcaatttcgtgaatgagaagcttcagcagatcttcatcgagcttaccctgaaggcggagcaggaagagtatgtgcaggaaggaattaggtggacacctatagagtacttcaataacaagattgtttgcgatttaatcgagaacaaggtcaatcctcctggcatcatgtcaatcctcgacgatgtgtgcgctaccatgcacgccgtcggagagggcgctgatcaaaccctcctccagaagctgcagatgcagattgggtcccacgaacacttcaacagctggaatcagggtttcatcatacaccattacgcgggtaaggtgagctatgatatggacggcttctgtgaaagaaatcgagacgtgctttttatggatctaatcgaacttatgcagtctagtgaactgcctttcataaaaagcctgtttcctgaaaatctgcaggcagacaaaaaagggcgtccgacaaccgcgggaagcaaaatcaagaaacaggcaaacgacctggtgtccacacttatgaagtgtaccccccattacatccggtgcattaagcctaacgaaactaagaagccaagggattgggaagagtcgagagtgaaacaccaggtggaatatctggggctgaaagaaaacatacgcgtgagacgggcaggatatgcctacagacgtattttccagaagttccttcagcgatatgccattctcaccaaagcaacctggccaagctggcaaggggaggaaaaacaaggggtgctacacctcttgcaatccgtgaacatggatagcgaccaatttcagttgggcagatccaaggtgttcatcaaggcacctgagtctctcttcctgttggaagaaatgagggaacgcaagtatgacggctacgcaagggtgattcagaagagttggcgcaagttcgtggctcgtaaaaagtacgtgcagatgcgtgaggaagcctccgacttactgcttaacaaaaaagagcgtcggcgaaattctatcaaccgcaatttcatcggtgactacattggcatggaagagcaccctgagctgcagcaattcgtaggaaagcgcgagaagatcgactttgccgacactgtgacgaagtacgaccgacgcttcaagggagtgaagagggatcttttattgacccccaagtgcctgtacctgatcgggagagagaaagtcaagcagggccctgataaagggctggtcaaagaggtgttgaagaggaagattgagattgaacgaatcctgagtgtctccctttcaaccatgcaggacgatatctttatcctccacgaacaggagtatgacagcctgctggaatctgtattcaaaaccgagttcttatccctgctcgctaagcgctatgaagaaaagacgcagaaacagcttcccctaaaattctccaacactctagaactgaaattgaagaaggaaaattggggtccgtggtctgcaggaggttcacgtcaggtccagtttcaccaaggctttggagatcttgcagttctgaagcccagcaataaggtgcttcaggtctcgataggccctggactgcccaaaaactccagaccaacacggagaaatacgacccagaacaccgggtacagcagtggcactcagaacgcaaattatccagtcagagccgctcctcccccacctggatatcatcagaacggagtgatcagaaatcagtacgtgccgtacccccacgccccaggcagccagcgtagcaatcagaagagcttgtacacctcaatggccaggccccctctgcccaggcagcagtcgacttcctctgaccgcgtttcccaaacacctgaaagtctcgattttctcaaggttcctgatcaaggggcagctggggtcagaagacaaaccacatctcgccctccaccagcaggaggtaggcccaaaccccagcctaagcctaaaccccaggtcccccaatgcaaagctctgtacgcttatgatgcccaagatactgacgagctgtcattcaacgccaacgacattatcgatataatcaaagaggatccaagcggatggtggactggacggcttcgagggaagcagggcctctttcctaataactatgtcacgaagatctag

SEQ ID NO: 231590 - DNA, 3312 bp, Artificial Sequence
  Description of Artificial Sequence: Synthetic coding sequence
ggtactaaagctggaagccctgtcaatggacagaagcagggccatgcacaggccacccctaaaattccattgaacctacatctgcatcatgatcccttccgcagtttgcaggagccaaggcaccaaccgccaacgatgggaagcaaggagcggtttcactggcagtcccataacgtcaagcagagcggcgtggatgacatggtgcttctgcctcagatcactgaggacgccatagcagcaaatctgaggaaacgtttcatggatgactacatattcacctacataggtagtgtcttgattagcgttaatcctttcaagcaaatgccatatttcaccgaccgggaaatagatttataccagggggctgcacaatacgaaaatccccctcacatctacgccctgacagataacatgtaccggaatatgctgatcgactgtgagaatcaatgtgtgatcattagcggcgagagcggggctggtaaaacggtggccgctaaatatattatgggttacatcagcaaagtgagtgggggaggagagaaagtgcagcacgtgaaggacatcatcttgcagtccaatcctctgctcgaggcgtttggtaacgccaagactgtccgaaataacaatagctcgaggttcgggaagtatttcgagatccagttcagtcggggaggggagcccgacgggggaaagatatcaaattttctgctggaaaagtctagagtggtgatgcaaaatgaaaacgagcggaatttccacatatactatcagttactggaaggtgcaagtcaagaacagcggcagaatttgggcttgatgacccccgattactactattatctgaatcaaagcgacacataccaggtggatggaactgatgaccggtcggacttcggagagaccttaagcgctatgcaagtaatcggaatacccccatctatacagcagttagtgcttcaacttgtggctggcattctgcatcttggcaacatatctttttgcgaagatgggaattacgccagagtcgaatctgtcgatctactggcctttccagcgtacctccttggaatcgattccggccgtctgcaggagaagctcacctcccgtaagatggattctcgttggggaggacgctccgaaagtattaacgttaccctgaatgttgaacaagcagcttacacccgcgacgcgcttgctaagggtttgtacgcgaggctgtttgacttcctggtggaagccattaaccgggctatgcagaaaccgcaggaggagtattcaatcggagtcctggacatttacggctttgaaattttccagaagaacggcttcgaacaattctgtattaatttcgtaaacgaaaagctccaacagatatttattgaattgactcttaaggcagagcaggaagaatacgtgcaggaaggcatccggtggacgcccattcaatattttaacaataaggttgtatgtgacctaattgagaataaactcagcccacctgggataatgtccgtcctagacgatgtgtgtgcgacaatgcatgccactggaggaggcgctgaccagacactgctgcagaaactccaggccgcagtagggacccacgagcattttaactcttggtccgccggttttgtaattcaccactatgccggtaaagtatcatacgacgtttcgggtttttgcgagcgcaatcgggatgtgctcttttccgacctgatcgagctcatgcagacgagtgaacaagccttcctacgaatgctatttccggaaaaattggacggcgataagaaggggagacctagcacagcagggtccaaaataaagaagcaagcaaacgatcttgtggccactctgatgaggtgcactccccactatatcagatgcattaagcccaacgaaactaaacgacctagagattgggaagagaatcgggtgaagcaccaggtggagtacctcggcctcaaggaaaatatcagagtgcgtcgagccggtttcgcctatcgcaggcagttcgcgaagtttctgcagcggtatgctatactcacccctgagacctggccacgctggcgaggggacgaacgccagggtgtgcagcacctactccgagcggttaatatggaaccagaccagtatcagatggggtcaaccaaagtctttgttaagaaccctgaatccttgtttctactagaagaagtgagagagcggaaattcgacggctttgccaggactatccagaaggcatggcggcgacatgtcgccgtaagaaagtatgaagagatgagagaagaagcgtccaacatcctgctcaacaaaaaggagagacgtcgcaattcaattaaccgcaatttcgtgggcgattatctcggcctagaagaacggcctgagctgagacagtttctgggaaagagggagagagtggatttcgccgactcagtcactaagtacgacagacgatttaaacctattaagcgcgacctgatcttgaccccgaaatgcgtctatgtgattggacgcgaaaaagtgaagaagggtccggaaaaaggccaggtttgcgaggtgctcaaaaaaaaagttgatatccaggctctgcggggtgttagcttgtcaacccgccaggacgactttttcattttacaagaggatgctgcagacagctttctggagtcagttttcaaaaccgaatttgtgtctttgctatgcaaaagattcgaggaggctacccgtagacccttgcccctcaccttctccgataccctgcagtttcgggtcaagaaagaaggctggggcggagggggaacccgttcagtgaccttctcacggggttttggcgacttagcggtgctgaaagtcgggggaaggaccctgacagtatctgtcggtgatggactgccaaagtcatccaagccaactagaaagggcatggctaaaggaaagccccgacgcagcagccaggcacctacccgcgctgctccagccccaccaagagggatggacagaaacggcgtccctcctagtgctcgcggtggcccacttcctggcgatcacgtttggcggggtcatccacaagcctcacccggactcaggcctcatccctgggaacctgctgacgatccaggacacgtgaggccccagtctacgacacaaaactcatccacatgtctgacaagagcttggccagcctgcagagggagcgccgcatggggaaacggacaatgccttgtgtgggctgaccctagcccttcactaggacatatggtgcccggtgcgggaccttacactagtacctgggcaaagatgtggacttcttag

SEQ ID NO: 231591 - DNA, 3297 bp, Artificial Sequence
  Description of Artificial Sequence: Synthetic coding sequence
atgggctccaaggaacgcttccattggcagtctcacaatgtgaaacagagcggagtcgatgacatggtgctgctcccccagattacggaagatgccattgctgcaaacctgaggaagaggttcatggatgactacattttcacctacatagggagtgtgcttatctccgttaacccttttaaacagatgccgtatttcaccgatcgggagattgacctctatcagggcgctgcgcaatacgagaatccgccacatatatacgcactcacagataatatgtatcgcaacatgctcatcgactgtgagaaccagtgcgtcatcatctccggcgagtcaggagccggtaagaccgtcgctgccaaatacattatgggctacattagtaaggtgagtggtggcggtgaaaaggtgcagcatgtgaaggacatcatactgcagtcaaaccctctcctggaggcattcggcaatgccaaaacagtgaggaataataactctagccgattcggtaagtattttgaaattcagttctccagaggtggagaaccagatggcggaaaaatttctaacttcttacttgaaaagtctagagtcgtcatgcaaaacgaaaatgaacgcaatttccacatctactaccaactgctggagggcgctagccaggaacaaaggcagaacctgggacttatgacccctgattattactactatttgaaccagtctgatacctatcaagtcgatggcactgatgatcgctcagacttcggagagacactctctgccatgcaagtgatcggcatccccccatccatccagcagttggtcctgcagctggtggccggaatccttcacctcggcaacatcagtttttgcgaggacggcaattacgcccgagtggagtccgttgacctccttgccttccctgcctatctattggggattgatagtggacgattgcaggagaaactgaccagtagaaagatggattcgaggtgggggggacgcagcgagagtatcaatgtcaccctgaacgtggagcaggccgcatacacacgagacgctttagccaagggcttatatgcgagactgtttgactttcttgtggaagcgatcaaccgtgcaatgcaaaagccgcaggaggagtactctatcggcgtactggatatctatggtttcgaaatcttccaaaagaacggcttcgaacaattttgcatcaacttcgtgaacgagaaacttcaacagatcttcatcgagcttaccctgaaggctgagcaagaggagtatgtccaggagggtattcgatggactcccatacagtactttaataataaagtggtgtgcgacctgatagagaacaaactcagtccccctggtattatgtccgtgctagacgatgtctgcgctactatgcacgcaactggtggtggcgctgaccagaccttattgcagaagctgcaggccgctgttggtacgcatgaacacttcaactcgtggtccgcagggttcgtcatacaccattatgctggaaaagtcagctacgacgtctccggcttctgcgaacggaaccgcgacgttctgttttccgacctgatcgaactaatgcagacaagtgagcaggccttcctcaggatgctgtttcctgagaagcttgatggtgataagaaagggaggcctagcacggcgggatccaaaataaaaaagcaggcaaacgacctggttgcaactctcatgcgctgcaccccacactacatccgctgtataaagcccaacgaaactaagagaccacgggactgggaagaaaaccgggtgaagcaccaggtggagtatctgggccttaaagaaaacatacgtgttaggcgcgcaggcttcgcttataggcgtcagttcgccaagttcttgcagaggtatgccattctcactcctgaaacgtggccgaggtggaggggcgatgaacgccagggcgttcagcacctcctgcgcgcagtgaatatggaacctgaccagtaccagatgggatcaacgaaagtgtttgtaaagaaccctgagagcctgtttttgttggaggaggtaagggagcggaagttcgatggctttgccaggaccatccaaaaggcctggcggaggcatgtggccgtccggaaatacgaagaaatgagggaggaggcatctaacatactactaaataaaaaagagagacgtaggaattccataaatcggaactttgtgggcgactacctgggcttagaagagcggcctgaactcagacagtttttgggcaaacgcgaaagagtggattttgccgatagcgtgacgaaatatgataggaggttcaaaccaattaaaagagacctcattctgacaccaaaatgcgtttacgtaatcggcagggagaaggtgaaaaaggggccagagaaaggccaggtttgtgaggtgcttaagaagaaagtcgatattcaggccctcaggggggtgtccctctccaccagacaagatgacttctttatactgcaggaggacgcagccgattcttttttagaatccgtgtttaaaaccgaattcgtgagcctgctgtgcaaacggttcgaagaggcaacccgtcgtccgcttccactcaccttttctgacaccctgcagttccgagttaagaaagaaggatggggaggtggaggaaccaggagcgtgaccttttctcgtggttttggcgacttagccgtgctcaaggtggggggtcgtacgcttaccgtttccgtgggggatggactgcctaagagctccaagccgacccgcaaaggcatggcaaaggggaagccgaggcgcagttcccaggcccctacccgtgccgctcccgctcccccacggggtatggatcggaacggtgtgcctccgagcgcacgaggaggcccactgccactggaaatcatgagtgggggaggcacccacagacccccacggggaccaccatccacaagcctgggtgcttcccggcgacctagagcccgtcccccatctgaacataacacggaattcttgaatgtgccggatcagggaatggctggcatgcagagaaagaggtcagtcggacagcgccctgtgcccggagtgggcaggcccaaaccacagcctcgcacgcatggtcctaggtgtcgggctctttaccagtacgtcggacaggacgttgacgagctgtctttcaatgttaacgaagtcatcgaaattttaatggaagacccctcaggctggtggaagggccgtctgcatggacaggagggtcttttcccagggaactacgtggagaagatttag

SEQ ID NO: 231592 - DNA, 3057 bp, Artificial Sequence
  Description of Artificial Sequence: Synthetic coding sequence
atggaagatgaggagggcccagagtacggaaaacctgacttcgttctgctagatcaagtgactatggaggactttatgaggaacctgcagctgcggtttgagaagggcaggatttatacctatattggagaggtactggtatccgtcaacccttaccaggaacttcctctgtacggccctgaggccatcgcacgatatcagggtcgcgaactgtatgaaagaccccctcacttatatgccgtcgcaaatgcagcatataaggccatgaaacacagatcccgtgatacctgtattgttattagtggtgaatccggtgctggaaagaccgaggcaagcaagcatatcatgcagtatatagctgccgtgactaacccaagccagagggccgaagtagagcgggtcaaggatgtgctgctgaaatcaacgtgtgtgttggaagccttcggcaacgcccgtaccaataggaatcataactcctcgaggtttggcaagtacatggacattaattttgatttcaagggggaccctatagggggacacatccacagttacttgctagagaagagtcgggtgctaaagcagcatgtgggggagaggaatttccacgctttctatcaacttttaagggggtctgaagataaacagcttcacgagctccacctggagcgcaatccagccgtgtataacttcacacaccagggagccggattgaatatgactgttcactccgctctggacagcgacgaacagtctcaccaagcagtgacagaggccatgagagttattggattctcacctgaagaagttgaatcagtccaccgaatcttggccgcaatcctgcatttggggaatatcgagttcgtggaaaccgaggaaggtggcctgcagaaggagggccttgcagtcgctgaggaagctttggtcgaccacgtggcggaactcactgccacaccaagagatctcgtgctcagaagcctgctggccagaacagtcgcatccggagggagagagttgattgagaagggacacacagccgctgaggccagttatgctagagacgcctgcgccaaggccgtataccaacgattgtttgaatgggtggtcaaccgcattaactcggtcatggaaccaagagggagggatcccagacgggacggcaaagacaccgtgatcggagttctggacatttacggtttcgaagttttccccgtgaatagtttcgagcagttttgtatcaactactgcaacgagaagctgcagcagctgtttatccagttaatactcaagcaggaacaggaggagtacgaacgggaagggatcacttggcagagtgtggaatatttcaacaacgctacaatcgtcgacctcgttgagagaccccaccgagggatactcgccgtcctagacgaggcctgtagctctgcagggaccattactgatagaatctttctccagactctggatatgcaccaccggcatcacctccattacaccagccgccaactgtgcccaacagacaagaccatggagttcggcagagacttcaggatcaagcactacgccggtgacgtgacatactctgtggagggctttatcgacaaaaaccgggatttcctatttcaggatttcaaacgtctcctgtacaactcgacagaccccacactaagagccatgtggcctgacgggcaacaggacatcaccgaggttaccaaacggcctctcactgctggcaccctcttcaaaaattccatggtggccctggtggagaacctggctagcaaagaaccattttatgttagatgcatcaaacccaacgaggataaggttgctggcaaacttgacgagaaccattgccgtcaccaagtggcgtatctgggcctcctggagaatgtccgcgtaagaagagccggttttgccagtcggcagccatactcaagatttctgttgaggtataagatgacgtgtgaatacacatggcctaatcacttgcttggttcagataaagcggcagttagcgcactcctagagcaacatggtttacaaggagacgtggcttttggacactccaagttatttatcagatcaccacgcaccctggtcactctggaacagagtagagctaggctcatccctattattgttttactacttcagaaggcttggcggggaactttagccaggtggcgctgccgacggctacgcgctatatatacaatcatgcgttggttcaggcggcacaaggtccgagcccacctagctgagttacagcgtagattccaggctgcaagacaaccacccctgtacggaagagatttagtgtggccactccccccagccgtgctgcaaccattccaagacacctgtcatgcacttttctgtcggtggagggcaaggcaattagtcaagaatatccccccatctgacatgcctcagattaaagccaaagtcgctgctatgggtgctctgcagggcctccggcaggactggggatgtaggagggcctgggcccgagactacttgagttcagccacggacaacccaaccgcatccagcctttttgcacaaaggctgaaaactttgcaggacaaagacggtttcggcgctgttctattcagtagtcacgtgcggaaggtaaaccgcttccataaaatccgcaaccgtgccctgctgctgacagatcagcatctctataaactggatccagacagacaatatcgcgttatgagggccgtcccgctggaggcagtgactggactgagcgtcacaagtggcggagatcagttggtcgtgcttcacgcccgaggtcaggatgatctcgttgtctgcctacatcgcagccggccaccattggataacagggtgggcgaactcgtaggcgtgctcgcagcccactgtcagggcgagggcagaacactggaggtgcgggtctctgactgtatccccttgagccaccgcggtgtacgacgcctgattagtgtcgaaccacggcctgaacagcccgagccggattttcggtgcgctcgaggctcttttacattgctgtggccctcccgttag

SEQ ID NO: 231593 - DNA, 4851 bp, Artificial Sequence
  Description of Artificial Sequence: Synthetic coding sequence
atgttcccactcattggtaaaactataatctttgataattttccggaccccagtgacacttgggaaataaccgagacaatcgggaaaggcacctacgggaaggtgtttaaagtgttaaacaaaaaaaacgggcagaaggcggcagtgaagatcttggaccctatccatgatatagatgaagagatcgaagctgagtacaacattctgaaagcgctctctgaccacccaaacgtcgtcagattttacggaatctactttaagaaagacaaagtaaatggcgataagctgtggcttgttctggaactgtgctctgggggatcggttacagatttggtgaaaggcttccttaagaggggagagaggatgtctgaacctctcatagcttatatactccacgaagcactcatggggctccagcacctgcataataacaaaacaatccatcgggatgtgaagggcaataatattctgctgacaactgaggggggagtaaagctagtggatttcggcgtgtctgcccagctgacaagcaccaggcaccgacggaatacatctgtggggacacccttctggatggctccggaggtgatcgcatgtgagcagcagctagataccacatacgatgccagatgtgatacctggtctctcggtattactgccatagagttgggagatggagaccctcctctcgccgatttacatccgatgcgagcgctctttaagataccccgtaacccacctccaaaattacgccaacccgaactgtggagtgcagagtttaatgactttatctcgaaatgcctcaccaaggattacgagaaacggccaaccgtctctgagctgctgcagcataaattcataacgcaaattgaggggaaggacgtcatgttgcagaagcagctgacagagttcatcggtatacatcagtgcatgggcggaactgagaaggccaggcgggagagaatccacaccaagaagggcaacttcaatcgtccgctaatctctaaccttaaagacgtcgatgacttagcgacacttgagatccttgacgaaaatactgtatctgaacagctggagaagtgttattctagagatcagatctatgtttatgtgggtgatattttaattgcccttaatccctttcaatccctgggactgtacagcacaaagcacagcaagctgtacattggctctaagcggacggctagtccaccccacatctttgcaatggctgacctggggtatcagtctatgatcacttacaattccgaccagtgcatcgttatttccggggaaagcggggctggaaagacagagaacgcacacctcctggtgcagcaactgacggttctgggcaaagcaaataacagaaccctccaagagaagattcttcaagtgaacaatctggtggaagccttcgggaatgcatgcacaattataaatgataattcttctcgatttggtaagtacttggagatgaagtttacctccagtggagccgtagtgggcgcacagatttccgaatacctgttagagaaaagtagagtcatacaccaggccatcggagagaaaaactttcacatattttattacatctatgccggactcgcggagaagaaaaaactggctcactataagttgcctgagaataagcccccacgctacctccagaatgaccacttgagaaccgtccaggacatcatgaacaattcattttacaaaagccagtatgagctcatcgaacagtgcttcaaagtcatcgggtttactatggaacagctaggcagcatttattccatcctcgctgccatcttaaacgtcgggaatatagaattcagttccgtagccacagaacatcagatcgataaatcgcatattagcaatcacacggccctggagaactgcgctagcctgctctgcattcgtgctgatgagctccaggaagccctaacgtctcactgtgttgtgacgagaggagaaacgatcattagacccaatacggtcgagaaagccaccgacgtacgagatgccatggccaagacactctacggacgtctgtttagttggattgtgaactgcataaactccctcctgaagcatgacagctcaccctcaggcaatggggatgagcttagcatcgggatccttgacatttttggatttgagaacttcaaaaagaattcttttgagcaattatgcataaacatcgcaaatgagcagatccagtattactacaaccaacacgtgttcgcctgggaacagaatgagtacctgaatgaggacgtcgatgcccgagttatcgaatatgaggacaactggcccttgctggatatgtttctgcaaaagccaatgggactgttaagcctattggacgaggaaagccgatttcctaaagccacagatcagaccctggttgagaagtttgagggaaacctgaagagtcagtatttttggcgaccaaagagaatggagttaagtttcgggattcatcactacgcagggaaggttctgtacaacgctagcgggttcctggccaagaaccgggatactctcccaaccgatattgtactgcttctgaggtcgagcgataacagtgtcattcggcagcttgtcaaccatccgctaaccaagactgggaatctgccccattcgaaaactaaaaacgtgatcaactatcagatgcgaacatccgaaaagctgatcaacctggccaaaggggacactggagaagctacccgacatgcaagggaaacaacgaacatgaagacccaaaccgtcgcaagctatttcagatactccttaatggacctactttctaagatggtcgtggggcagccccattttgtgagatgtattaagccaaactccgagcggcaggcacggaaatatgataaggagaaggtgctgcttcaactgcgctacacgggaatattagagaccgctaggatacgacgtctgggcttcagtcacaggatcttattcgcaaactttataaagcgatattatctgctatgctacaagagtagcgaggagccgagaatgagcccagatacctgcgccaccatcctggaaaaggcaggtctagacaattgggctctgggtaaaactaaagtgttcctgaaatactatcatgtcgaacagttaaatctgatgcgaaaagaggccatcgacaagctcatcctcatacaggcttgcgtgcgagctttcctgtgctctagaaggtatcagaagattcaagaaaaacggaaggagtcggcaatcattattcaaagcgcagctagaggacacttggtgaggaaacagcgcaaggaaatcgtggatatgaaaaacaccgccgtgacaacaatccagaccagcgatcaggaattcgactataagaaaaatttcgagaatactcgagaaagcttcgttaagaagcaggccgagaatgccatttccgcgaatgaacggtttatttctgccccaaataacaagggctctgtgtctgtggttaagacgagtactttcaagccagaagaagagacgaccaatgccgttgaaagcaataaccgggtctaccagactcctaaaaagatgaataacgtctacgaggaagaagtgaagcaggagttctacctggtggggcctgaggtgtctcctaagcaaaagtcagtgaaggatctcgaggagaactctaatctgcggaaagttgagaaagaggaagcaatgatccaatcgtactaccagcgctacaccgaagagagaaactgcgaggaatccaaggctgcatacttggaacggaaggccatatccgagaggccgtcttatccagtgccctggctggctgagaacgaaaccagtttcaagaagactcttgaaccaactctatcccagcggtccatttatcagaatgctaattcaatggagaaagagaagaagacttctgtcgtgacgcagagggccccaatatgctcccaagaagaggggagaggacggctgcggcacgaaactgtgaaggaacgccaagttgagccagtgacccaggcccaagaagaggaagataaggctgcagtttttatccagagcaaataccggggatataaacgcagacagcagctgagaaaggataagatgagttcgtttaaacatcagcggattgtaactaccccaacagaggtggcacgtaacacccacaacctttatagttacccaacaaagcacgaagagattaacaatattaaaaagaaggataacaaggattctaaagccacaagtgagcgggaggcgtgcggcctggctatcttctcaaagcaaatttcaaaactctcagaggagtactttattctccaaaaaaagctgaatgagatgattctgagccagcagctcaagtcactctatcttggtgtgagtcatcataaaccaattaatcgacgagtatcttctcagcagtgcttatcgggcgtttgcaaaggtgaagagcccaagatcttaaggccaccccgtcgcccacgcaagccaaaaactttgaataacccagaagactccacctattactatttactgcataagagtatacaagaggaaaagaggagaccccgtaaggattcacagggaaagctcctggatctcgaggatttttattacaaagagtttctcccctcacgatctggcccaaaggaacatagtccctccttgcgcgagcggaggccacaacaggaacttcaaaaccagtgcataaaggctaatgagagatgttgggcagcggagtcccccgaaaaagaagaagaaagagaacctgccgctaatccttacgatttcaggcgactgctgaggaagacatcccagcggaggcgattagtgcagcagagttag

SEQ ID NO: 231594 - DNA, 594 bp, Artificial Sequence
  Description of Artificial Sequence: Synthetic coding sequence
atgtttcctctgatcgggaagaccattattttcgacaattttcctgaccccagtgatacgtgggagattacggagacaatcgggaagggtacatacggaaaagtgtttaaggttctgaacaagaagaatgggcagaaagctgcggtaaagatacttgatcccattcatgatatagacgaagagatagaggcagaatataatattttaaaggctctgagtgatcacccgaatgtggtgcgattttatggtatctattttaaaaaggataaggttaacggagacaaattatggctcgtgctcgaactgtgtagcgggggaagtgtgaccgacctcgtcaagggtttcctgaagcgcggagagaggatgtctgaaccactcatcgcctacattctccatgaagctctgatgggcctgcagcacctccacaataacaaaaccattcaccgcgacgtcaaaggtaataacattctccttacaacagaagggggtgtcaaactcgtggatttcggcgtaagtgcccagctgacctcgactaggcacaggagaaacacatccgttggaacccctttttggatggcccctgaggtccggtag

SEQ ID NO: 231595 - DNA, 744 bp, Artificial Sequence
  Description of Artificial Sequence: Synthetic coding sequence
atgttcccattaattggcaagaccattatcttcgataatttcccagacccgtctgatacttgggaaattaccgaaaccatcggcaaagggacttacgggaaagtgtttaaggtcctgaacaagaaaaacgggcaaaaggccgctgtcaagattctcgacccaatacatgacatcgacgaagagattgaggcagagtataatatcctgaaggcattgagtgaccaccccaatgtggtgcgattctatgggatttactttaaaaaggacaaagtgaatggagataaactgtggctagttttagaactttgttccggagggagcgtcaccgatctggttaagggctttctcaagcggggagagcgcatgtctgagccactcattgcctacatcctacatgaggcattgatgggacttcagcacctgcataacaataaaacaattcacagagatgtcaaagggaacaatatacttctgactaccgaaggcggtgttaaactggtagactttggagtgagcgcacaacttaccagtacaaggcacagacggaacacgagcgttggcacccccttctggatggcaccggaggtcatcgcatgcgagcagcaactagacactacctatgatgcccgttgcgacacatggtctctgggcattactgctattgagctgggagacggggatcctcccctggctgacttgcaccccatgcgagctctctttaagattccccgtagcgacgactag

SEQ ID NO: 231596 - DNA, 1995 bp, Artificial Sequence
  Description of Artificial Sequence: Synthetic coding sequence
atgtttccccttataggtaaaacaattatttttgacaactttccggatccaagtgatacatgggagattacagagaccataggcaaaggaacgtacggaaaggtcttcaaggtactgaataagaagaatggacagaaagcggctgtgaaaatactggatcccatccacgacatcgatgaagagatcgaagccgagtacaacatactcaaggcacttagcgaccatccaaacgtcgtcaggttttacgggatatattttaagaaggacaaggttaatggcgataaactctggctggtgctggagctgtgttcgggtggctcagtgacagatcttgtgaaagggttcctgaagcggggagaaaggatgtctgagccattaatcgcctatattctgcatgaagctctgatggggctccaacatcttcataataataaaaccattcatcgcgacgtgaaaggaaacaatattctactcaccaccgaagggggagtgaagcttgtggactttggcgtttccgcacaactgacttctactagacataggaggaatacgagtgtgggaactccattttggatggccccagaggtcattgcctgtgaacagcagctcgacacgacttatgatgcaaggtgtgatacctggtcgttaggcatcacggctatcgagctgggtgacggggatccacctctggcagatctgcacccaatgcgcgcactctttaaaattccccgaaacccaccgccaaagcttaggcagcctgaactgtggtctgctgagttcaacgactttatttctaaatgtcttactaaagactacgagaagcggcctactgtgtccgagctgttgcaacataagtttatcacccaaatcgaagggaaggatgtcatgctgcagaaacaactgactgagttcatcggaatacaccagtgcatgggcggaacagagaaagccagacgcgagagaattcacactaaaaaaggtaactttaataggccactgatcagcaacctgaaagatgtggacgacctagcgacactagagatccttgacgaaaacaccgttagcgagcagttggaaaagtgctattctcgggatcagatctatgtctacgtgggagacattctgattgcattaaacccttttcaatctctgggcttgtattccaccaagcacagtaaactttatatcggaagcaaaaggaccgcgagtcccccacacatcttcgccatggccgatctaggctatcaaagcatgatcacgtacaacagcgatcagtgcatcgtaataagtggtgagtctggggctggaaagaccgagaacgctcatctgttagtgcagcagttgacagtactcggcaaagccaacaaccggactcttcaggagaagatcctgcaggtgaataacctggttgaagctttcgggaatgcctgtacgattataaacgataacagctccagattcggcaaatatctggagatgaaattcaccagcagcggggctgtcgttggggcacaaattagtgagtatcttctggaaaagtctagggtcatccaccaggcgatcggtgaaaaaaactttcatatcttttactacatttacgctgggttggccgagaaaaagaagcttgcccattataagctgcctgaaaataagcctcccaggtacctgcagaatgatcacttacgtactgtgcaggacattatgaataacagtttctacaaaagccagtatgaactgatagagcagtgtttcaaggtgattggtttcaccatggaggtgctcggtggaggagaaccccgagaggggggaggtgagagggcgtcatcacagccattacgtcttcaagaagctccagctcagaatcttccagccccagctcctaggcccgcagtgctgactgttcaacgtgggtcacaccggcgacggaaagcattggagccagcgggacagcagggtccctcaagacatagcggggcaggcaccagccgacattag

SEQ ID NO: 231597 - DNA, 3834 bp, Artificial Sequence
  Description of Artificial Sequence: Synthetic coding sequence
aaacacctgtatggactgttccactacaatcccatgatgctggggttagagtccctgcctgatcctacggacacctgggaaatcatcgagacgataggaaaagggacctacggaaaagtctataaagtgactaacaaacgagatggatctttggctgcagtgaagattctcgatccggtatctgatatggacgaagaaattgaggcagaatataacatcctgcagttcttgcccaatcatcctaatgtggtcaaattctacggcatgttttataaggctgatcactgcgtggggggtcaattgtggttggttcttgagctgtgtaacggcggttccgtcaccgagcttgtgaaggggctattgaggtgcgggcaacgactggacgaagccatgatcagttatatcctctatggcgcactcctaggactgcagcatcttcataacaatagaattattcatagagacgtgaaaggtaataacatcttactgacaaccgaagggggagttaagttggtagatttcggtgtgtcagcccagctcaccagcaccagattgagacgaaatacgtctgtggggactcctttctggatggctccagaagtaatcgcctgtgagcagcagtacgacagttcctacgacgccaggtgtgacgtctggtccctgggtatcaccgccatcgaacttggagacggtgatcctcccctcttcgatatgcatccagtgaaaacgctgttcaaaattcccagaaatccccctccgactctgttgcatcccgagaagtggtgtgaggagttcaatcatttcatcagccaatgcctcattaaagacttcgaacggaggccaagtgtcacacatttgctggaccaccctttcataaaaggtgttcacgggaaagtgcttttcctgcagaagcagcttgccaaggtcctgcaagatcaaaagcatcagaatcccgtcgccaaaaccaggcacgaaagaatgcatactcgcaggccttatcatgtagaggatgctgaaaaatactgcctggaagacgacttggtcaatttggaggtgcttgatgaagataccatcattcatcagctgcagaaacgctacgccgatttgctcatctacacttacgtgggggatattctcatcgccttgaatcctttccaaaacctgagcatctatagtcctcaattctcccgtctatatcatggtgtcaagagagctagcaatccccctcacatcttcgcatcagcggatgcggcttatcagtgcatggtcactctgtccaaagatcagtgtatagttatttcgggcgagtccggatctggcaaaactgaatctgcccatctgattgtacagcatctgacatttctaggaaaagcaaataatcaaacgctgcgggagaagatcctgcaggtcaactcactcgtcgaagctttcggaaatagctgtactgctattaacgacaactcttctcgatttgggaagtatttagaaatgatgtttaccccaaccggcgtggttatgggggcacggattagcgaatacctgttagagaagagtcgggtgataaaacaggcagccagagagaagaactttcacatcttttattatatttatgccggacttcatcatcaaaaaaagctgtctgatttccgattgcccgaggagaagcctcccagatacattgccgacgaaacgggtcgcgtaatgcacgatatcacaagtaaggaatcttaccggagacaattcgaagcaatccaacactgcttccgcattattggcttcaccgataaggaggtccattcagtgtacaggattctggccggaatcctcaatatcggcaacatcgagttcgccgctataagtagccaacaccagaccgataaatccgaagtcccaaatgctgaagcgctgcagaacgctgccagcgtgctgtgtatttcacccgaagaactgcaggaggccttgacatcgcactgcgttgtcaccaggggcgagaccataatccgggcaaatacggtagaccgcgctgccgacgtgcgtgacgccatgtcaaaggcgctctacggtcgactcttttcttggattgtgaataggatcaacactctgctacagcctgacgagaacatatgttctgcgggaggcggaatgaatgtgggaatcctggatatttttggctttgaaaacttccaaagaaactcatttgaacaactgtgcataaacatagctaacgagcaaatccaatattattttaatcagcatgtcttcgcgcttgagcagatggaataccaaaacgagggtatagacgcagttcctgttgagtacgaagacaatcgccctctgctggatatgttccttcagaagccccttggcctactagcccttctagacgaagaatctcggttcccacaggccactgatcagacactggtcgataagtttgaggacaatctgcgctgcaagtacttctggagacctaagggcgtggaactttgtttcgggatccaacactatgcaggaaaggtgttatatgacgcgtctggcgtcctggagaagaacagggataccttgccagccgacgtcgttgtcgtcctgcggacatcagaaaataaactgcttcaacaattattttcaattccgcttaccaagacaggcaacctggcccagacccgcgctaggatcactgtggcctcctcttcacttccccctcacttctctgcaggtaaagctaaggttgacaccctcgaagttattcggcacccggaggagactaccaatatgaaacgccagacggtggcaagttattttaggtattcattgatggaccttctgtccaaaatggtggtgggacagcctcacttcgtcaggtgtattaagcctaatgacgatcgcgaggcgctgcagttctccagggaaagggtcctggctcagctccgcagtactgggatcctggaaacagtgtctattcgcaggcagggctactcgcatagaattctgtttgaggagttcgttaagcggtactattatttggcattcaccgcccaccagacgccccttgccagtaaggaatcatgcgtggccattttagagaagagcagactggaccattgggtgctgggcaagaccaaagtttttcttaagtattatcatgtcgagcagcttaatctgctactccgcgaggtcatcggacgcgtcgttgtgcttcaggcttacacaaaaggctggctgggcgctcggaggtacaaacgagtgagagagaaacgtgaaaaaggcgcaattgccattcaatctgcgtggcgtgggtacgacgcaagacggaagtttaaaaagatttctaacagacgaaatgaatctgctgcccacaatcaagcaggggacacatccaatcaatcaagtggccctcacagccccgtcgctgccggaacaaggggcagtgccgaagtgcaagattgctccgagcctggcgaccacaaagtgttgcgcggatctgtacataggaggtctcacagtcaggccgaatcaaacaatgggcgaactcagacatcatcaaactccccggcagttacagaaaaaaatggacactcccaagcgcaatcttccccgaagggttgcgatatattcgccggacatgctaataaacatagcgtgtcgggtactgacctgctgagctcgcgaatctgccacccagcccctgaccagcaaggcctgagtctgtggggcgcaccacaaaagcctgcgtttccccactacggttgtaatttctacggttttagaaaatggtcgtgcaccgaagccagcaatacatccccaaccatgagcgctgctcagaacgccgagtag

SEQ ID NO: 231598 - DNA, 4053 bp, Artificial Sequence
  Description of Artificial Sequence: Synthetic coding sequence
atgctacagtcagctttactctccaccagaaaacacctgtacggcttattccactacaatcctatgatgttagggttggagtcccttcctgacccaaccgacacatgggaaattattgaaacaatcgggaagggtacttatggaaaggtgtacaaagtgactaataagagggacgggagcttggccgcagtcaagatattagatcccgtaagtgatatggatgaggaaatagaagctgagtacaacattttgcagtttcttcctaaccatcctaatgtggtcaagttctatgggatgttctacaaagcagaccattgtgtagggggacagctgtggctggtgctggaactgtgtaacggaggctcagtaaccgagctggtgaaagggcttctgcgctgtggacagcgtctggacgaagccatgatttcctatatcctgtatggggctttactgggcttgcaacatctgcataataaccggattatccatcgggacgttaaaggaaataacatcctgctgaccacagaagggggagtcaaactggtcgactttggtgtgtccgcacaactcacatcgacgagactgagaaggaacacatcggtcggtacaccgttctggatggctcccgaggttattgcatgcgagcagcagtacgattcatcatacgatgcgagatgcgacgtttggtcactggggatcaccgccatcgagttgggtgacggcgaccccccactttttgatatgcaccccgtgaaaactttattcaagatacccaggaacccgccaccaaccttgttacatcccgagaagtggtgcgaagagttcaaccattttattagtcagtgcttgattaaagatttcgagcggaggccctctgtcacacacctgctggaccaccccttcattaaaggagtgcacggcaaagtgctgttcctccagaaacaacttgccaaagttctgcaggaccagaaacaccaaaaccctgtggctaaaacgcgccatgagaggatgcacacccggcgaccttaccacgtggaggatgccgagaaatattgtctcgaagatgacctggtgaacctcgaagtcttggatgaagatacaatcatccaccagctgcagaagagatatgctgatctcctgatttatacatatgtcggggacatcctgatagccttgaatccatttcaaaatctctcaatttatagccctcagttttcacgcctgtatcatggcgtgaagagagcaagcaatccaccccatatttttgcatcagccgacgccgcttaccagtgcatggtgaccctgtccaaagatcagtgcatcgttatcagcggtgagtccgggagcggtaagacggagagcgctcatttgatcgtccagcatctgacatttcttggcaaggctaataatcagacgttgagagagaaaattctgcaggtaaattccttagtcgaggccttcggcaatagctgcactgctatcaatgacaactcgtctcgattcggaaagtacctggagatgatgtttacaccaacaggcgtggtcatgggtgctcgtatttcagagtatctgctggagaagtcaagggtcataaagcaggcggctcgggagaagaattttcacatattttactatatctatgccggactgcaccatcaaaaaaagttgtcagatttcagactaccagaggagaagcccccacgatacatcgccgatgaaactggacgagtgatgcacgacatcacctctaaagaatcctataggagacagttcgaggcaattcagcactgttttaggatcatagggttcactgacaaagaagttcactctgtgtatcgcatattggccggtatcctcaatattggtaatattgagttcgcggcaatcagctcccagcaccagacagacaaaagcgaggtcccaaatgctgaggctctccagaacgccgcaagcgtattgtgtatttcacctgaggaactccaggaggcgcttacctctcactgcgtggtaactcgaggggaaactatcatcagggcaaacaccgttgaccgcgcagccgacgtacgggacgccatgtcgaaagcactgtacggtcggttattttcatggatcgtcaacagaatcaacactctattgcagccagatgaaaacatctgctctgccggtgggggtatgaatgtcggtatactggatatcttcggcttcgaaaacttccagcggaatagctttgagcaactgtgtatcaatattgccaacgagcagattcagtattactttaatcagcacgtatttgccctggaacagatggagtatcagaatgaagggatcgacgctgtccccgttgagtatgaggataatcggcctctgcttgacatgtttctgcagaaaccactcgggttgttggcgttactggatgaagagtctagatttccccaggctacagaccagactctagtggataaattcgaagataatcttcgctgcaaatacttttggcgacccaagggggtcgaattatgcttcggaatacagcactatgccggtaaggtgctgtatgacgcaagcggcgttctggagaagaacagagataccctaccagccgacgtggtcgtcgtcctgcgaactagtgaaaataagcttctacagcagcttttttctattcccctcactaagacaggcaatctcgcacaaacccgggctcgaattacggtcgcctcttcttcacttccaccacacttttcagctggcaaggcgaaggtagacacactcgaagtgatacgacaccctgaagagacaaccaacatgaagcgacaaaccgttgccagctatttcaggtactcgctgatggacctcctgtcaaaaatggtggtgggacagccccattttgtgcgatgtatcaaacccaatgacgacagggaagcgctgcagttctccagagagagggtcctcgcccagttgcggagcacaggtatccttgagactgtttcaattcggagacaaggatactcccacagaatcctttttgaagaattcgtgaagcgctactactacctggccttcacagctcaccagacaccactggcctccaaagagagctgcgtggctatactagagaagtccagactggatcactgggtcctgggcaagactaaagtattcttgaaatactaccatgtagaacagttaaatctgttgctgcgggaagtgatcggtagggtcgtggtgctgcaggcttataccaaaggatggttgggggctagaagatacaagagggtcagagaaaaaagggaaaaaggagctattgccattcagagcgcctggcggggatacgatgccaggagaaagttcaagaagattagtaatagaaggaatgaatctgctgctcacaatcaggctggagacacctcgaatcagtcaagtggaccgcactctcccgttgccgcagggactcgcggaagtgcagaagtgcaggactgttccgagcccggtgatcataaagtgctgcgcggtagcgtgcacaggcgcagtcatagccaggcggagagcaataatggcagaacccagacttcaagtaattcccccgcagtaactgaaaagaacgggcatagtcaagcccagtcaagccccaagggttgcgacattttcgccggacacgccaacaaacatagcgtttccggaaccgacctgctgtcttctaggatctgtcatcctgcacctgatcagcaaggcctgagtctgtggggggctccccagaagcccggttctgagaatggcttggctcaaaagcacagaacacctcggcgaagatgccagcaacctaaaatgctgagcagtccagaagataccatgtactataatcagctgaacggcacgctggagtaccagggcagcaagcggaaacctcgaaagctaggccaaataaaggttctggatggagaagacgaatattataagagtttaagcccagttgactgtatacctgaggaaaacaattcagcacatccatccttcttctcttccagttctaaaggggactcattcgcccagcactag

SEQ ID NO: 231599 - DNA, 4026 bp, Artificial Sequence
  Description of Artificial Sequence: Synthetic coding sequence
atgaaacatctctatggtttgtttcattacaacccaatgatgctcggcttggagtcgctacccgatccaacagacacgtgggagataatcgaaactataggaaaggggacatatggaaaggtctacaaggtgaccaataagcgggacggcagccttgctgcagtcaagattctggatccggtctccgatatggacgaggaaattgaggctgagtacaacattcttcagtttctgcctaaccatcccaatgtggtgaagttctacgggatgttctacaaggccgatcactgcgtggggggacaactgtggctggtcttggaactttgtaatggcggatccgttaccgagctggttaagggtctgctccgttgcggacagagactggatgaagctatgatctcatatattctgtacggcgcattgctaggcctacaacatctgcataacaacaggatcatccaccgcgacgtcaaggggaataacatcttgctgaccacagaaggtggagtaaaacttgtcgatttcggcgtgtccgctcagctgacctcaacgcggttacgcagaaatacttctgtaggaacgccattctggatggcacctgaggtgatcgcatgtgaacagcagtacgattcttcctacgatgcgaggtgtgacgtctggagcttaggcattacagctatcgaactgggtgacggcgatcccccattgttcgacatgcatcccgtgaaaaccttatttaaaatccctcgcaacccacctcccaccctgctgcatccggaaaaatggtgtgaggaattcaaccattttatctcacagtgtttgattaaggatttcgagcgccgtccgagtgtgacccacctgcttgatcatcccttcatcaagggagtgcatggtaaggtcctcttcttgcagaagcagctggctaaagttctgcaggaccagaagcaccagaatccagtggcgaagacaagacacgaacggatgcatacaagacggccttaccacgtggaagatgctgagaagtactgcctggaagacgatcttgttaacctggaggttctggacgaggataccatcatccaccaactccagaagcgctatgccgacctgttgatctatacttacgtgggggacatcctcatagcactgaaccctttccagaacctttctatatactccccccaattttccagactctaccatggcgtaaagagggcctccaatccccctcacatatttgcgagtgccgacgccgcataccaatgtatggtgaccttatctaaagaccagtgcatcgtgatatctggcgagtcagggtctggcaagaccgaaagcgcacacctgatcgtgcagcatttgacattcctgggcaaggcaaacaatcagacattacgcgagaagattctgcaggtgaactcactcgtggaggccttcgggaacagttgcacagctatcaatgataactcatcccgatttggtaagtatttagagatgatgtttaccccgactggagtggtcatgggcgctcggataagcgagtatctcctcgagaaatcccgagttatcaagcaggctgcacgggagaaaaattttcacatcttctattatatttacgcgggacttcaccaccaaaagaaactctcagacttccggctgccagaggaaaaaccacccaggtatattgctgacgagactgggagagtgatgcacgatattacatctaaagaaagttatcgacggcagttcgaggccattcagcactgcttcagaatcataggcttcactgacaaggaagtgcattcagtctacaggatcctagccggaattcttaacatcggcaatatcgagttcgccgctatcagttctcaacaccagacagataaatccgaggtgccaaatgctgaggcactacagaacgctgcttctgtcctttgcatttcccctgaagaactccaggaggcgttgacttctcactgtgtggttacaagaggagagaccatcatccgtgcgaatactgtcgaccgtgctgccgatgtacgcgacgcaatgagcaaagcactatacgggagactcttttcctggatcgtgaacaggatcaatacgctcctgcaaccggacgagaacatctgttctgctggcggaggcatgaacgtcggcatcctggacatattcgggtttgaaaattttcagcgaaatagcttcgagcagctatgcatcaacattgctaacgaacagatacagtattatttcaatcagcatgtgttcgcactagaacagatggagtatcagaacgaaggcatcgacgccgtgccagtcgagtacgaagacaatcgcccactcctcgacatgttcctgcagaagcctctgggcctgctggctctgcttgatgaagagtcccgcttcccacaggcaactgatcagaccctggtggacaaatttgaagataacctgaggtgcaagtatttctggcgccctaagggagttgagttgtgcttcggcattcagcattacgccggtaaggtgctgtatgacgcatccggggtgttagaaaaaaatcgggatactctcccagccgacgtggttgtggttctccggacctcagagaataagctgcttcagcagctattctcgattcctttgaccaagacggggaaccttgcccaaaccagagcacgcattaccgttgcttccagttcccttccgccacactttagtgcgggaaaggcaaaggtggatacgctagaggttataaggcacccagaagagaccacaaacatgaagcgccagaccgtcgcctcatacttccgctattctctcatggacctgctgagtaagatggtcgtggggcaaccccactttgtgaggtgtattaagccgaatgacgatagagaagcattgcagttttcacgagagcgcgtcctcgcccagctgaggagtaccggcatcttggaaactgttagcatccgaaggcagggctacagtcacagaatcctatttgaagaattcgttaaaaggtattattacctcgctttcactgctcatcaaactccccttgccagcaaagagtcgtgtgtggcaatccttgagaagagtcgtctggaccactgggtgttagggaaaactaaagttttccttaagtactaccatgtagagcaactcaatctgctactgcgggaagtcattgggagggtcgtcgtgcttcaggcctacacaaagggatggctcggggctcgcagatacaaaagggtgagagagaaaagggagaaaggagcaatcgcaatccagtccgcatggaggggttatgacgctcggagaaagttcaagaaaatcagtaacaggcgaaacgagtctgcggcacacaatcaggctggggataccagtaatcagtcgtcaggccctcactcaccagtggcagccggtactagaggaagcgccgaggttcaggattgctctgagcccggtgaccataaagtgctccgtggttcagtgcaccgcaggtcacacagccaagctgagtccaataacggaagaacgcagacatcttccaattctccggcagttacagaaaagaacggacactcacaggcccaatcatcccccaagggctgcgacattttcgccggacacgcaaataaacactccgtgagcggcaccgacctcctctccagtcgcatttgccatcctgcaccagatcagcagggactctcactgtggggggctccacagaaacctggctccgagaatgggttggctcaaaaacaccgaacccctcgcagaaggtgccagcagcccaagatgctgagtagccccgaagacactatgtactataatcagctgaatggcacactcgaataccagggatcgaagagaaagccccgaaaattaggccagattaaagttctggacggggaggacgagtactataagtcactgagtcccgtcgactgcattccagaagagaataactccgctcatccatcctttttttcctcttcctctaagggggactccttcgcgcaacactag

SEQ ID NO: 231600 - DNA, 3945 bp, Artificial Sequence
  Description of Artificial Sequence: Synthetic coding sequence
atgaagcacctgtacggtttgttccactacaacccaatgatgttaggactcgagtccctgccagacccaaccgacacctgggaaattatagagaccatagggaaggggacctacgggaaggtttacaaggtgactaataagagggacggctccctggcagccgtgaaaattctggatcccgtctccgacatggacgaggagatcgaggctgagtacaatatcctccagttcttgcccaatcaccccaacgtggtgaaattctacggaatgttctacaaagcagatcactgtgtcggcggacagctttggctagttctggaactgtgtaatggcggatcagtgactgaactggtgaagggcctgctgcggtgcgggcagcggttagacgaagcgatgatcagctacatcctgtatggggcactgctggggctccaacacctccacaataaccgtataatacacagggacgtaaagggaaataacattttgcttaccactgaaggaggcgttaagctggttgacttcggtgtctctgcccaactcacatccactcgacttaggagaaatacaagcgtgggaacacccttttggatggcccctgaggtaattgcctgcgaacagcagtatgactcctcgtacgatgctaggtgtgatgtttggtccttggggataacagcaatagaactgggcgacggagacccgcctctgttcgacatgcacccggtcaagaccctgttcaaaatcccaagaaaccctccgcctacacttttgcacccagagaaatggtgtgaagaattcaaccatttcattagccagtgcctgataaaagattttgagagacgcccttctgtaacgcacctgctggaccatccgtttataaaaggggtccacggcaaagttctctttcttcaaaaacaactggctaaggtgctgcaggaccagaaacatcaaaacccagtggcaaaaacccgccacgagaggatgcataccagacgcccttaccatgtagaggacgccgagaagtattgcttggaggacgacctagtgaacttagaggttctcgacgaagataccatcattcatcagctccagaaacgctatgccgacctcctgatctacacgtatgtgggcgacatccttattgcactcaatccattccagaatctgtccatctactctccgcagttcagccgcttataccatggggtaaagagggcatccaacccaccccacatcttcgcatccgctgatgctgcataccaatgcatggtcacgctctctaaagaccagtgtatcgtgatcagcggcgagtccggatccggaaaaactgagagcgcacatttaattgtccagcatcttactttccttgggaaagctaacaatcagacattgcgggaaaaaatcttgcaggtcaacagccttgtcgaagctttcggcaattcttgcacagctatcaatgacaacagttcacggttcggaaagtacttggagatgatgttcacacctaccggagtggtgatgggcgctcgcattagcgagtatttactggagaagtcccgcgttattaagcaggcagcgagagagaagaattttcacatattctactacatctatgccggacttcaccatcaaaaaaagctgtcggatttccggcttccagaggagaaaccccctcggtatatcgccgacgagaccggtagggttatgcatgacattaccagcaaagaaagttaccgacggcagttcgaagccatccagcattgctttcgtattatcggattcactgacaaggaagtacactccgtttaccggatcttagcaggaattctcaatataggtaacatcgagtttgccgctatcagcagccagcaccagactgacaaatctgaagtgccaaatgctgaggcactgcagaatgcagcctccgtactctgtatctctccagaggagctgcaggaagccctgacttctcactgcgtggtgacaagaggagaaacaatcatccgggcaaataccgtggacagagctgctgacgtaagggacgccatgagtaaggcgctgtatggaagactcttctcctggatcgtaaatcgaataaacaccctgctccagcctgacgaaaatatttgctccgcaggaggcggaatgaatgtgggcattctcgatattttcgggtttgagaatttccaaagaaattcatttgaacagttgtgcatcaatatcgccaacgagcaaatccagtattattttaaccagcatgtttttgccttggagcagatggagtaccagaatgaggggattgacgctgttccagtggagtacgaggacaacagacctctgttagacatgtttcttcagaagccactgggtttattagcgctgctcgacgaggagtcacggttcccgcaagccaccgatcagacgctggtcgacaaatttgaagacaacctgcggtgcaaatatttttggagaccaaagggggtggaactatgtttcggcattcagcattacgccggaaaggtcctctacgacgccagcggtgttctggagaagaatcgtgacacgctgcctgccgatgtcgtcgtggttctacgcactagcgaaaataagctgctccagcagctgttttcaataccactgactaagactggcaacttagcccagacacgagcacgaatcaccgtcgccagcagtagcttacctccacatttcagcgcaggaaaagccaaagtcgacaccttggaggtgattcggcaccctgaggagactaccaatatgaagcggcagacagttgcatcctacttccgatattctttaatggacctcctttcaaagatggttgttggccagcctcattttgtccgttgtattaagccaaatgacgatcgagaggccctgcaatttagtagggagcgcgttttagctcagctgcggagcactgggatcctggagaccgtgagcattaggcgccaggggtactcacaccgtattctattcgaggagtttgtaaagcggtactattacttggcctttaccgcgcaccagaccccgcttgcgtccaaagagtcttgcgtggctatcctagagaagtccaggctcgatcattgggttctaggcaagaccaaggtattcctgaaatactaccatgtcgaacagcttaacctgttgctgcgtgaggttattggacgggtagtggttctccaggcctacaccaagggctggttgggcgctcggagatataaaagagttcgggagaagagggagaagggggctatcgccatccaatcaggggacactagcaaccagtccagcggacctcatagtccggtcgctgctggaacccgcggaagcgctgaagttcaggactgttcagagcccggagatcacaaagttttgagagggagtgtgcatcgaagaagtcactcccaggccgagtcgaacaacggacgcacccagacatcttctaattctccagccgtcaccgagaaaaatggccatagccaggctcagtcaagccccaagggttgtgatatcttcgcaggccacgctaacaaacactcagtgtctggcacggatttgctgagttcaagaatctgtcaccctgccccagaccagcagggcttgagcctttggggtgctcctcagaagccgggaagtgagaacgggctggcacagaaacatcggacccctcgccgacgctgccagcagcctaagatgcttagttcccctgaagataccatgtattataaccagctgaacggtaccctggaatatcaaggttctaagagaaaacccagaaaactgggccagataaaagtcctggatggcgaagatgaatattataagtcgttatcccccgtagactgcattcctgaggagaataattcggcccaccctagcttcttctcaagttcatctaagggagattcattcgctcagcactag

SEQ ID NO: 231601 - DNA, 3390 bp, Artificial Sequence
  Description of Artificial Sequence: Synthetic coding sequence
atgaatattaacgacggtggaagacgtcgattcgaggataacgagcacacattgaggatttacccaggagccatctccgaaggcacgatctattgtcctatcccagctcgaaagaactcgactgccgctgaggtcattgagtcactgataaataagctacacctggataaaacgaaatgttacgtccttgcagaggtcaaagagttcgggggagaagaatggatcctcaacccgacagactgccccgtgcagcgtatgatgctgtggcccaggatggccctcgagaatcgcctcagcggcgaggattaccggtttctgttacgtgagaagaatctggatggctcaatccactatggctcactgcaatcctggcttagagtgacagaggaaagaagacggatgatggagcgaggcttccttccacagccccagcagaaggacttcgacgatctgtgtagcctacctgaccttaacgaaaagacactgctcgagaatctgcggaaccggttcaagcatgagaaaatatacacgtacgtcggatctattctcattgtaatcaaccctttcaagttcttgccaatttacaaccctaaatacgtaaagatgtatgacaaccaccagttgggcaaactggaaccacatatctacgctgtcgctgatgttgcctaccatgctatgctgcagaggaaaaaaaaccagtgcatagttatttccggcgagagtggctccggcaagacacagagcacgaatttcctgatccatcatctgacggccttgtcacaaaagggtttcgcatcgggagtggagcagataatcctaggagccggacctgtgctagaagcctttgggaacgcaaagaccgcccacaacaacaattccagccgttttggaaagtttatccaagtgaactaccaggaaacagggacagtactgggagcatacgtggagaaatacttactagagaagagcagattggtataccaagagcataacgaacgtaactaccatgtcttctactatttactggctggcgctagtgaggacgagcgcagcgccttccacctgaagcagccggaagagtaccactacctgaaccaggattgttttacggtggagggagaagacttgaggcacgatttcgagagattgcagttggccatggaaatggtcgggttccttccaaagactcgcaggcagatattttcattattgagtgccatcttgcacctgggtaacatctgctacaagaaaaagacttaccgcgatgacagcatcgacatatgcaaccccgaagtgctgcctatcgtttcagagctcctagaagtcaaagaggagatgctcttcgaagcactcgtcacacgaaaaactgtgacggtgggcgagaagctgatactgccatacaagttagcggaggcagtgaccgtgcgaaacagcatggcaaaatccttgtatagtgcgctgttcgattggattgtctttcggataaatcacgccctgctaaattcaaaggatctggagcacaacaccaaaaccctttccatcggtgtactagatatttttggcttcgaagattacgagaacaactcgtttgagcaattttgcataaacttcgccaacgaacgactccagcactatttcaatcagcacatttttaagttagaacaggaagagtatagaaccgagggaatctcatggcataatatagactatatcgataatacatgctgcattaacctcatctccaagaaacccactgggctgcttcaccttctagatgaagagagcaatttcccacaggccaccaaccagacgctgctggataagttcaagcatcagcatgaggataatagctacatcgagttcccagcagtgatggagccggcattcataattaagcactacgctggaaaggtgaagtacggggtcaaggattttcgagaaaagaacacggaccacatgaggccagacatcgttgccctcttacgttccagcaaaaatgcctttatctcaggcatgatcggtatcgaccccgtcgccgtttttcggtgggccatcctgcgggcttttttccgggcaatggtggcattccgcgaggctggcaagaggaatatccatcgtaagaccggccacgatgacacagcaccttgcgctatcctaaaatcaatggattcattctctttcttgcaacacccagttcaccagcgcagcctcgaaatcctgcaacggtgtaaagaagaaaaatactcaatcacccgcaaaaatcctcggaccccgctgtcggacttgcaagggatgaacgccttgaatgagaaaaaccaacatgatacctttgatattgcatggaacggcaggacagggatcaggcagtctaggctctccagcggaaccagcttgctggataaggatggaatcttcgctaattctactagcagtaagctcttggaacgcgcacacggcatcctgacacgcaataaaaatttcaaaagcaagccagccttgccaaaacatctgttggaagttaactccctgaagcacctgactcggttgactctccaagatagaatcactaagagcctcctgcatttgcacaaaaagaaaaagccgcctagcatctcagcgcagttccaggccagtctgagtaagctcatggagactctgggccaggccgagccgtatttcgtgaaatgcatacgctcgaacgctgagaaactccccctccggttcagcgatgtcctcgtgttgaggcagctgcgatataccgggatgctggagacagtgcgcattcggcaatctggctattcatcaaaatacagttttcaagactttgtgagccacttccatgtgctgctgcccagaaacatcataccatcaaagtttaatatccaggatttttttcgaaagatcaatcttaatccagataactatcaggtcggaaagactatggtgttcctgaaagagcaagagaggcagcaccttcaggatctgcttcaccaggaggtgttgcgcaggataatcctgctccagaggtggttcagggtactgctgtgcagacagcatttcttgcatctgcgccaggcgtcagttattatccagcgcttctggaggaactacctgaatcaaaaacaagtgagagatgccgctgttcagaaagacgcctttgtcatggctagtgccgctgcattactgcaagcctcctggcgtgcacatttagaaaggcaaagatatctggaactcagggctgctgctatcgtcattcagcaaaagtggcgggattattacagacgccgacacatggcggctatatgtatccaggctcgatggaaggcttaccgggagtccaaaagatatcaggagcagagaaaaaattatcccttcgctataaacatgtag

SEQ ID NO: 231602 - DNA, 7646 bp, Artificial Sequence
  Description of Artificial Sequence: Synthetic coding sequence
atgaatattaatgatggtggccgacggaggtttgaagacaatgaacatacattgaggatctaccctggggcaattagcgagggcactatctattgccccatcccggctagaaaaaattcaacagccgctgaagtgatcgaaagcctgataaataaattacacctggacaaaactaaatgttatgtcttagcagaggtcaaagagttcggcggagaagaatggatcctgaaccccacagactgtcctgtgcagagaatgatgttatggccaaggatggcgcttgagaacaggctctctggcgaagactacagattcctcctgagagaaaaaaatctggacgggagcattcattatggttcacttcagtcgtggttgagggtgacggaggagcgtaggcggatgatggaacgtgggttcctgccccagccccagcagaaggacttcgatgatctatgctcactccccgacctcaatgaaaaaacactgttggagaatctgcgcaaccgttttaagcacgagaaaatttacacgtacgtcggatctatcttgattgtaattaacccattcaaatttctgcccatctacaatcccaaatacgtgaaaatgtacgataatcaccaactcggcaagctggagccgcacatctacgcagtcgcggacgtggcctatcacgccatgctgcagaggaaaaaaaatcaatgcattgtgatatccggtgagagcgggtctgggaagacccagtctacaaacttcctgattcaccatttaaccgctctttcgcaaaaaggattcgcctccggtgtcgagcaaattatactcggggcaggtccagtactggaagcattcggaaatgcaaagactgctcataataataactcaagcaggtttggcaagtttatccaagtgaactaccaggaaacaggtaccgtgctaggagcatatgtggaaaagtatctcctggagaagtcccgactcgtttatcaggaacataacgagcgaaactatcacgttttctattacctgttagccggtgcttcagaagacgagaggtccgcctttcatctgaagcaacctgaagagtaccactatcttaatcagattaccaaaaaaccactgcggcagagctgggatgactactgttacgattcagagcctgactgtttcactgtggaaggcgaggatctgagacatgactttgagaggctgcaattggccatggagatggttggtttcctgccaaaaacacgcaggcagatcttttccctgctaagtgctatccttcacttgggcaacatctgttataaaaaaaagacctatcgtgacgacagcattgatatttgtaaccctgaggtgctgcctatcgtatcggaactcctagaagtcaaagaggagatgctcttcgaagcgttagtgacacgtaagacggtgacagtcggcgaaaagctgatattgccatacaaactcgccgaggccgtgacagttcgaaactcaatggccaagtctctctacagcgcattgttcgattggattgtgttcagaatcaatcacgcactgttgaattcaaaggaccttgagcacaacaccaagactctgtcgataggagtactcgacatcttcggattcgaggactatgagaacaattcctttgagcaattctgtattaatttcgccaatgaacgcctgcaacattatttcaatcagcacatattcaaactcgagcaggaggaataccggactgaggggatcagctggcacaatatcgactacattgacaacacttgttgtatcaacttaatcagtaagaaacctaccggccttttacacctcctggacgaagaatccaacttcccccaggccacaaaccagactctgcttgacaaattcaaacaccagcatgaggataattcatacatcgagtttccagctgtgatggaaccggcattcattatcaaacactatgccggaaaggtgaaatacggggtgaaggatttccgggaaaagaacaccgatcatatgcgtccagatattgtcgctctcctacgctcatccaagaatgcgtttataagcgggatgataggaatcgacccagttgcggtctttcggtgggctatactgcgggctttcttccgcgcaatggtggcctttcgggaagccggaaaaagaaatatccatcggaagaccggccatgacgacaccgctccctgcgccatcctgaaatcgatggactcattcagttttctgcagcatcctgtccatcaacgttccctagagatactccagcggtgtaaggaggaaaaatattccattacccggaagaacccaagaacaccactcagcgatctgcagggtatgaatgccctcaacgaaaagaatcaacacgacacttttgatattgcctggaatggcagaacaggcattaggcagtccaggctctcctcgggcacgtcactcttagacaaggatggtatctttgccaattccacctcatcgaagttactggaaagagcacacgggattctgacaaggaataaaaactttaagagtaaaccagctctgccgaagcacctgttggaagtgaatagtctgaagcatctgacgcgtctgacactgcaggatcgcatcaccaaatctctcctacatctccacaagaagaagaagcctcccagcattagtgcccagtttcaagccagcctttcgaagctgatggagaccctcggccaggcggagccctatttcgtgaagtgtattaggagtaatgctgaaaagctccctctccggttttctgacgtgctcgtcctgagacaacttagatatactggaatgttggaaaccgttagaatcagacagtccggctacagttctaaatactcgtttcaagatttcgttagtcatttccacgtgctgttacccaggaacattattccgtcaaagtttaatatccaggatttctttaggaagattaacctgaatcctgacaattaccaggtcggaaagaccatggtgtttctcaaagaacaggaacgacagcacctccaggatcttctacaccaggaagtgctccgtcgaatcattctgctccagcggtggtttcgtgtactgctctgccgtcagcactttcttcaccttcgacaggcgtctgtgatcatccagaggttctggcgcaattatttgaatcagaaacaagtgcgagatgcagcggtacagaaagacgcttttgtgatggccagcgcagcggctctgctgcaggcttcctggcgtgcccacctggagagacagaggtacctggaactcagggccgctgctatcgtcatccagcaaaaatggcgggattattatcgcagacgccatatggcggctatatgtatccaagcaagatggaaagcgtatagggaatcaaagcgctatcaagagcagagaaagaagatcattctgctgcagtcgacttgccggggattccgcgctcggcagcgatttaaggctttaaaagaacaacggctgagagagacaaagcctgaagtgggcttagtgaatattaaaggctatggaagcctggaaattcaagggtcagacccttctggctgggaagactgttcgttcgataatagaatcaaggccatcgaggaatgcaaaagtgtcatcgagtcaaatcggatcagcagggaaagctcagtagattgcctgaaggagtctcccaacaaacaacaggagcgcgctcagtctcagtccggcgtggacctgcaggaggacgtgttggtgcgcgagagacccaggtcactcgaggacctgcatcagaagaaagttgggagggcgaagcgggagagccgaaggatgcgagaactcgaacaggctattttttccctggagttgctgaaggtcaggagcctcggcggaatttcaccatctgaggatagacgatggtctactgagctggtgccggagggattgcagtctccacgaggtacgccagatagtgaaagtagccagggcagtcttgaactgctgtcctacgaggagagccagaagagcaaactggaatcagttatctctgatgagggcgacctccagttccctagcccaaagatttcctcctcccctaagtttgactctagggacaatgcactatccgctagcaacgagacctcaagtgcagaacatctgaaggatggcacgatgaaagaaatggttgtgtgctctagtgagagcatcacttgtaagccgcagctcaaggactcctttatcagcaattctctgcctacctttttctatatcccacagcaggaccccctgaaaacaaatagccaactggacacctcaattcagcgcaacaaacttctcgagaacgaggatacagccggagaagccctgacgctggacatcaatcgggagacaaggagatatcattgtagcggcaaggaccagattgtacctagtttaaataccgagtcctctaacccagtgctaaagaagctggagaagctcaacaccgaaaaggaagaaaggcagaaacagctccagcagcagaatgagaaggagatgatggagcagatcaggcaacagacagacatacttgaaaaggagagaaaggcattcaagacaatcgaaaagccacgcatcggtgagtgtttggtggcgcctagctcctaccaatccaaacagagagttgagagaccatcgtccctgctgtcactgaacacatcgaacaagggagaattgaatgtgctcggctctttgagtctgaaagacgcagccctcgcacagaaggactctagcagtgcccacctgcccccaaaggatagacctgttactgtgttctttgaacgcaagggctcaccatgccagtcaagtacagtgaaagaattatccaagacagatcgtatgggcacccagcttaacgtagcttgcaagttgtcaaacaacagaatctcaaaacgggaacattttcgacccacacaatcctacagccataacagcgatgacctgtcgagggagggaaacgcaaggccaatcttctttacgcccaaagataacatgtcaattcccctcgtgtctaaagaggctctcaatagcaagaacccccagctgcacaaagaggatgaaccggcttggaagccggttaagctggccggaccaggtcaaagggaaactagccagcggttttcaagcgtagatgagcaggccaagctgcataagaccatgagtcaaggagagatcacaaaactggcagtccggcagaaggcatctgacagcgatataaggccccagcgcgcaaaaatgagattttgggccaagggaaagcaaggcgagaaaaaaaccacaagggtgaaaccaacaacacaatccgaggtcagccctttgtttgcaggcacggatgtgatacccgctcaccaattcccagacgaattggctgcctaccatcccaccccccctctgtctcctgaattgcccggtagttgtcggaaagagttcaaagaaaataaagaacctagcccaaaagctaagagaaagcgctctgtgaaaatcagcaatgttgcgctggactctatgcactggcagaacgacagcgtgcaaattattgcttcagtctccgatctgaaaagcatggacgaattcttgttgaaaaaagttaacgacttagataatgaggatagcaagaaagacaccctcgttgacgttgtttttaagaaggccctcaaggaattccggcaaaacatcttttctttttactcgtcagcactcgccatggacgacggtaagagcattcgctataaagacctctacgcacttttcgagcagatcctggagaagacaatgagattagagcaaagagatagcttgggagagagccctgtgagggtctgggtgaacacattcaaggtgttcttagatgaatatatgaatgagttcaagacaagtgactgtaccgctactaaggtccctaaaacagagcggaaaaaacgcagaaaaaaagagactgaccttgtcgaagagcacaacggtcatatctttaaagccacccagtacagcatccctacctactgcgaatattgttcgtctttgatttggattatggatagggcaagtgtctgtaagctctgcaagtatgcctgtcataagaaatgctgtctaaagactacggcaaaatgtagcaagaagtacgatcctgagctttcttctcggcaattcggagtggaattgtctcgtctaacatcagaggataggacggtccccctggtcgtcgagaagctcatcaattacatcgagatgcatggcctatacaccgagggaatatatagaaagtccggcagcaccaacaagattaaggagctacggcagggactggacactgacgccgagagtgtgaacctggacgattataacattcatgtaattgcctctgtatttaaacagtggttacgcgacttgccgaaccctctgatgacattcgaactgtatgaggagttcctaagggccatgggcttacaggagcggaaggaaacaattaggggcgtatactcagtcatcgatcagttgtccagaacacatttgaatacactggagcgtcttatctttcatctggtcaggatcgctctccaggaggacaccaaccggatgtcggcgaatgccctcgcaatcgttttcgctccctgcatcctcaggtgtcctgatacaacagatcccctgcaatcagtgcaagacatcagtaagacaacaacttgtgtggaactgattgtggttgagcagatgaataaatataaggccaggctgaaagatattagttccttagagtttgctgaaaataaagctaaaacacgcctcagcctcataagaaggagtatgggcaaagggaggatcagacgcggaaactatcccggaccctcatctccagtggtggtgcgcctcccgtcagtttccgatgtttcagaggaaacactcaccagcgaggcagctatggaaacagacatcaccgagcagcagcaggccgctatgcaacaggaggaacgcgtgttgactgaacagatcgagaatctgcagaaggagaaagaggagctgacatttgagatgctcgtgctggaacccagagcaagtgacgatgaaacgcttgagtcagaagcaagcataggcacagctgactccagcgagaacttgaatatggagagcgaatacgccatatctgaaaaatccgaaagatccctcgccctgtcttctcttaaaaccgctggaaagagcgagccatccagtaagcttaggaaacaactgaaaaagcagcaggactcactggacgttgtcgacagctcagtgagcagcctgtgtctgtcaaacacagcctctagccatggtacgagaaagctctttcagatttacagcaaaagtcccttttatagagctgcatcaggcaacgaggctctagggatggaagggccactagggcagacgaagtttctggaagacaagcctcaattcatttccagggggacatttaatcctgaaaaaggaaagcaaaagttaaaaaatgtgaagaacagcccccagaagacaaaggagactccagaagggactgtgatgtcaggcagacgaaaaactgtggacccggattgcacatctaatcaacagcttgcattgtttggcaataatgaattcatggttta

SEQ ID NO: 231603 - DNA, 7859 bp, Artificial Sequence
  Description of Artificial Sequence: Synthetic coding sequence
atgaatattaacgacggtgggaggcgtagatttgaagataatgagcatactctgagaatataccccggagcaatcagtgaagggactatctattgtccaattccagcacgaaaaaactccactgccgcagaggtgatcgagagcctgattaataagttgcatctggacaagaccaaatgctacgtgttagcagaggtcaaagagtttgggggagaagagtggatcttgaacccgaccgactgtccagtccagcgtatgatgctctggcccaggatggctcttgagaataggttgtccggagaagactatagattcctgctgcgagaaaagaacctggatggttccatccattacggcagcttgcagtcctggctcagggtcactgaggagaggagaagaatgatggagcgagggtttctgccacagccccagcagaaagatttcgacgatctttgtagcctcccagatcttaacgaaaaaacactgctcgaaaatctgaggaatagatttaaacatgagaagatctacacatacgttggcagcatcctaattgtgattaatccgtttaagtttctgcccatatacaacccgaagtacgttaagatgtatgataaccatcagttaggcaagctggagccccacatctacgccgtggcggatgtcgcataccacgccatgcttcagagaaaaaagaaccaatgtatcgtcatctccggcgagagcggatccggcaagacacagagtaccaattttcttatccaccacctgactgcactctctcagaaggggttcgcttccggtgtggaacaaattattctgggcgctgggcctgttcttgaggcatttgggaatgcaaagacggcacacaacaataatagttcgagattcggaaagtttattcaggttaactaccaagaaactggaactgttctgggcgcttacgtggagaaatacctgttggagaagtcccgactcgtttaccaggagcacaacgaacggaattaccatgtgttctattacctcctggcaggcgcttctgaagatgagcggagtgcatttcacctgaaacagcccgaggagtaccattatttgaaccaaatcactaaaaaaccgctgcgacagtcctgggacgactactgctatgacagcgaacccgattgctttactgtagagggagaggacctgcggcatgattttgagaggctgcagctcgccatggagatggtcggatttctgccaaagacacgtcgacagatctttagcctgctctctgcaattcttcacctaggcaatatctgctacaaaaaaaaaacataccgtgacgactccatcgacatctgcaatcccgaagtcctgcccattgttagtgagttactggaagttaaggaagagatgctgttcgaggctctagtaacaaggaagactgtgaccgtgggagaaaagttgatactaccatataaactcgcggaagctgttacggtgcgcaactcaatggcaaaaagcttatatagcgccctcttcgattggatagttttccggatcaaccatgctcttctgaactctaaggaccttgagcacaacacaaaaacccttagtattggcgtcttggacatctttggttttgaagactatgagaataattccttcgagcagttctgcataaattttgctaacgagagattgcaacattactttaaccagcatatcttcaagttggaacaggaagaatacaggacggagggaatatcctggcacaatattgactacattgataacacgtgttgtatcaacctcatctccaagaaacctactgggctcttacatctgctcgacgaggaaagcaattttcctcaggctaccaaccaaaccctcctcgacaagttcaaacaccagcatgaggacaatagctacattgaattccccgcagttatggaaccagcctttatcatcaaacactatgccggaaaggtaaaatacggggtgaaagatttccgcgaaaagaataccgatcacatgcggccagatatagtggctttactcaggtcatcgaagaacgctttcatttcaggaatgattgggattgaccctgtggctgtgtttaggtgggcgattctccgagcattctttcgggcaatggtcgcattccgcgaggccggaaaacggaatatccataggaagacagggcatgatgataccgccccatgcgcaatcctaaagagcatggattctttttctttcctacagcatcctgtccatcagagatccctggagattcttcagcgatgcaaagaagaaaaatattccatcacccgcaagaaccctcgcacaccccttagcgacctacaggggatgaacgccttgaacgaaaagaaccagcatgacacgttcgacatagcctggaatggccgaaccgggatccgacaaagccggctgtccagtggaaccagtctgctggacaaggacggtatattcgccaactctacctcctcaaaactgttagaacgggctcacggtattctgaccagaaacaaaaatttcaaaagcaaaccggcactcccaaaacatctgttagaggttaatagcctgaaacatttgacaagactgacacttcaggaccgtatcactaaaagcctcctccacctacataagaagaagaaaccaccgtccatctcggctcaatttcaggcttctttgtcaaaattaatggaaaccctgggccaggcagaaccttattttgtgaagtgtatcaggtccaatgccgagaagttgccgctgcggtttagcgatgtcctggttctgagacagttaaggtataccggaatgctggagaccgttcggatacggcagtccgggtacagtagcaaatattcctttcaggatttcgtgagccacttccacgtgctgctgccacgcaatatcatcccatctaagtttaacattcaggacttcttcaggaaaatcaacctaaatcctgataattaccaagttggcaagacaatggtgttcctaaaagagcaggaacgccagcatcttcaggatctgctgcaccaggaagtgctgcgcagaattatactccttcagcgatggtttagagtattgctatgtagacagcactttttgcacctgagacaggcatcggtgattattcagaggttttggagaaactacctcaaccagaaacaggtgagagatgctgccgtccaaaaggatgcttttgttatggcctccgccgcagcactcctccaggcgagctggcgcgctcatttggaaagacagcggtacttggaactcagagctgctgcgatcgtgatccagcagaaatggcgagattattaccgaagacggcatatggcagcaatatgcattcaggccaggtggaaagcctaccgggaatcaaagagatatcaggaacagcggaaaaaaattatcctcctccagtctacttgcagggggttccgcgcacgccagaggtttaaggctctgaaggagcagagactgcgggaaaccaaacctgaggtcggcctggtgaatatcaagggatatggctccttggagattcagggcagcgatccaagcggatgggaagactgctcattcgataacagaataaaggcgatcgaggagtgcaagagcgtcatcgagagcaaccgcatctctcgtgaatccagcgtggactgccttaaagaatcccctaataaacagcaggaaagagctcagagccagtccggagtcgacctccaagaggacgtactggtcagggagcgtcctaggtctcttgaagatttgcatcagaagaaggtcggacgagcaaagagagagagccgtcggatgcgcgagctggaacaggcaatctttagtctggaactgctgaaggtgcggtccctgggcggaatctccccttcggaagatagaaggtggtccacagagctggtgcctgaggggcttcagtccccccgtggaactcctgactctgaaagcagccagggatcccttgaattgctgtcctatgaggagtctcagaagagtaagctggagagcgtgattagcgatgaaggtgacttgcagtttccctctcccaagattagctcctctccaaaatttgactcacgggacaatgccctgtctgcatccaacgaaacctcaagcgctgaacacctgaaggacggtaccatgaaggaaatggtggtttgcagttctgagagcatcacatgcaagccccaactgaaggactcctttattagcaacagcctgcccacattcttctacatcccccagcaggatccactcaagacgaactcgcagctcgatacaagcattcaaaggaataaactgctggaaaatgaggacaccgctggtgaggccctgactctggacattaaccgagaaacaagacgataccactgtagcggcaaagatcagatcgtgccatctttaaataccgaaagctcaaaccccgtgcttaagaaactcgagaaactgaataccgagaaagaagagagacagaagcaactccaacagcaaaatgagaaggagatgatggaacaaatccgacagcagaccgacatcctagaaaaggaacgcaaagccttcaaaacgattgagaaacccagaattggggagtgcttggtcgcgccaagttcttaccaatctaagcaaagagtagaacgaccatcttccctcctgtccctcaacactagcaataagggcgagctgaacgtgctgggctctctatcgctgaaggacgccgctctggcccagaaggactctagctctgcccacttgcccccaaaggatagaccagtgactgtcttttttgagcggaaaggatcaccttgtcagtctagtacggtaaaagaattgtccaagactgacaggatgggtactcagttaaatgtagcttgcaagctttccaacaaccgcatctctaaaagggagcacttccggccaacccagtcctattcacacaattctgatgatttatccagggaaggaaatgccagacccattttcttcacacctaaagacaatatgagcatcccccttgtttcaaaagaagccctgaatagtaagaatcctcagctgcataaggaggatgagcccgcatggaagccggttaagcttgccggaccaggacagagggaagtcgcacgacctgcccacaagaaaaaggcgcgaatggccaggaccaggtccgactttcttacacggggtacctttgcggatggggagggggatactgaagaggatgactacgacgatataattgaaccattgttgtccctggaccaggcatcgcattgcgagctcggccctgcccctagcttaggacaggcttcccattcggatagcgagatgaccagtcagaggttcagtagtgtggatgagcaggccaagcttcacaagacaatgagccagggcgaaatcactaagctggcagtccggcagaaggccagtgacagcgacattcgccctcagagggctaagatgagattctgggccaaggggaagcagggggaaaagaaaaccactcgtgttaagcctactacccagtctgaagtgtctccattattcgcaggaactgacgtgattcccgctcaccagttcccagacgagctcgcagcttatcacccgactccccctctgtcacctgagctaccagggtcctgcagaaaagagtttaaggagaataaggaaccatcccccaaagcaaaaagaaaaaggagcgtgaagattagcaacgtagccttggatagcatgcattggcagaacgatagcgtgcagatcatcgcctccgtgtctgacctgaagtctatggacgagttcctgctcaaaaaggtgaatgatcttgacaacgaggactcgaaaaaggacaccctcgtggacgttgtcttcaaaaaggccctaaaggagtttcgacagaacattttctctttctattcatctgctcttgcaatggacgatgggaaatcgattagatataaagacctgtacgccctgttcgagcaaatcctggagaaaaccatgagacttgaacagcgtgattctctgggggaatcacctgtgcgcgtctgggtgaatacatttaaggtgttcctggacgaatatatgaatgaatttaagaccagtgactgcaccgctactaaggttcccaaaacagagcgaaagaagcggaggaagaaagaaaccgaccttgtggaagagcataatggccatatctttaaagccacacagtacagcatacctacgtactgcgaatattgctcatcgttgatttggataatggatcgggcatcagtgtgtaaactatgtaaatacgcttgtcacaagaaatgttgtctcaagacaactgcaaagtgctcaaaaaaatatgacccggagttatcctctagacagtttggtgtcgaattgtctcggctcaccagcgaagatcgaaccgtgcctttggtcgtggagaagctcatcaactacatcgagatgcatgggttgtataccgagggaatctaccggaagtcaggtagcacaaataagattaaggagcttcgtcaagggctggacaccgacgctgaaagcgtgaatttagacgattacaatatccacgtgatagctagtgtgtttaagcagtggctccgggatctgcctaaccctctgatgaccttcgagctgtacgaagaattcctgagagctatgggactgcaagagagaaaggaaacgattaggggggtgtactccgttatcgatcagctgagccgaactcatctcaataccctcgagcgtctcatcttccacctggtgaggatcgctttgcaggaagacactaaccggatgtccgcaaacgccttggccattgtttttgctccctgtatcctgagatgcccggatacaactgacccccttcagtccgtacaagatatttccaaaacaacaacctgcgtggagctgatcgtggtggagcagatgaataagtacaaggccaggctcaaggatatctcctccctggaatttgcagaaaacaaggctaagacgagactgagtctgataagacgatctatgggcaaaggtaggattagacgtggtaactaccccggaccatcgtcgcccgtggtagtccgtctgccttccgtgtcggacgtgagcgaagaaacgcttacgagcgaggccgctatggagactgacattacggaacagcagcaagctgccatgcagcaggaggaacgggtactgactgaacagatcgaaaacctgcagaaagaaaaagaggagctgacttttgaaatgcttgtgctggagcccagggccagtgatgacgaaaccctggagtccgaggccagcatagggactgccgacagttctgagaaccttaacatggaaagtgagtatgccatcagcgagaagtcggaacggtcacttgccctgagcagtctgaagacagctggcaagtcagagccatcttctaagctacgaaagcagctgaaaaaacagcaggactcgctggatgtagtggatagttccgtgtcctccctctgcttgtctaatactgcatcctcacacggcaccaggaagctgtttcagatctactccaagagcccgttctatcgcgctgcgagtgggaacgaggcactcggaatggaagggccacttggtcaaaccaaattcctggaggacaagccacagttcatttcccgtgggacctttaacccagagaaggggaagcaaaagttgaagaatgtcaagaattctcctcagaaaactaaggaaaccccggagggaactgtcatgtccggtagaaggaagaccgtggatcctgactgcaccagtaaccaacagctggcactgtttgggaataacgaatttatggtcta

SEQ ID NO: 231604 - DNA, 7589 bp, Artificial Sequence
  Description of Artificial Sequence: Synthetic coding sequence
atgaatataaatgatgggggacgtcgcaggttcgaagacaacgaacacacattgcgaatatacccaggcgcaataagcgagggcaccatctactgtccaatccctgctagaaaaaactccacagccgctgaggtaatagaatctttgattaataagctgcacctcgacaagacaaagtgttatgtgctggccgaggtaaaagagtttggaggtgaggaatggatcctgaatccgaccgactgtccagttcagcgaatgatgctgtggccccgaatggccctggagaatagactcagtggcgaggactaccgattcttgctaagggagaaaaacctggatggcagcatccactacggatcactccagtcttggctgagggtgacggaagagcgcagacggatgatggagcgcggattcctcccccaaccccagcagaaggatttcgacgacctgtgctcactgccagatcttaatgaaaaaacactgctcgagaatctacgaaacagatttaaacatgagaagatttacacctacgtggggtctatcttgattgtgataaacccatttaagtttttgcctatctataatccgaagtacgtgaaaatgtacgataaccatcagcttggaaagctcgagccacacatatatgccgtcgctgacgtggcgtaccacgccatgctccagcgcaaaaaaaatcagtgtatcgtaatatcgggggagagcggttccggaaagacccaaagtaccaattttcttatccatcatctgaccgccctttcccagaagggcttcgcttcaggagtggagcagattatcctgggggctgggccagttctggaggcttttggcaatgctaagacagcccataataacaactccagtagattcgggaagtttatccaggttaactaccaagaaaccggtacagtcctgggcgcatacgtcgaaaaatacttgttagagaagtcccggttagtgtaccaagaacataacgagcgcaactatcacgttttctattatctgctggcaggggctagcgaagacgagaggtccgcttttcacctgaagcagcctgaggaataccactatctcaatcaggattgtttcaccgtcgaaggagaagatctgaggcacgacttcgagaggctccagctcgccatggagatggttggctttctgcctaagactaggagacagatcttcagtctgctttcggctatcctccacctagggaatatctgctataagaaaaagacataccgagatgattctatcgatatctgtaatcccgaagtgctccccatagtatccgagctccttgaagtgaaggaggaaatgctcttcgaagctctcgtgacgcggaaaacggtgacggtgggggagaaattgattcttccctacaagttggccgaagccgtcaccgtgcgcaatagcatggccaagtccctgtacagcgctctcttcgattggatcgtcttcagaataaaccatgcactcctgaattctaaagatctcgagcacaatactaagaccctcagtatcggggtcctggatatctttggttttgaagactacgagaacaattctttcgagcaattttgtatcaactttgccaacgagagactccagcattactttaatcaacacatctttaagttagaacaggaggaatatagaacggagggaatctcttggcacaatatagattacattgacaacacctgttgtatcaacctgatcagcaagaaacctactgggctactgcacctgctggacgaggagagcaattttcctcaagccacaaatcagaccctcctcgacaaattcaagcaccagcatgaggataacagctacatagaatttcccgcagtgatggagcccgcttttattatcaaacactacgctggaaaggtcaagtatggggtaaaagattttagagagaagaacactgatcatatgaggcccgatatcgtggctctattaaggagcagcaaaaacgcattcatcagcggaatgattggaatcgatcctgtggcagtgttccgctgggcaatccttcgtgcctttttccgggctatggtcgcattccgggaagccggaaaacggaacatccaccgcaagactggacacgatgacacggccccatgtgcaattttgaaaagcatggattccttcagttttctccagcaccctgttcatcaaaggagtttggagatcctgcagcgctgcaaggaagaaaaatacagcatcactagaaaaaatcctaggaccccacttagcgacctgcagggcatgaatgccttaaacgagaaaaatcaacacgacacttttgatatcgcgtggaacggcaggaccggaatccggcagagccgcctgagttcgggcacgagtctgctggacaaggacggaatctttgcaaattcaacatcatcaaagctcctggagcgcgcacacggcatcttgacccgcaataaaaatttcaagtccaagccagccctgcccaagcacttgctggaggtgaactcgttaaaacaccttacacgtctgaccctacaggataggatcaccaagtcactgctgcatctacataagaagaagaagcctccctcaattagtgctcagttccaagccagtctgtcaaagctgatggagactctgggccaggccgagccttacttcgttaagtgcattcgaagcaatgctgagaaactgcctcttcgcttctccgacgtactggtcctgaggcagctgcgatacacgggtatgctggagaccgttagaatcaggcagtcaggatacagcagcaaatatagcttccaggactttgtgagtcattttcacgtgttgcttcccaggaacataatccccagcaagttcaatatacaggacttcttccggaaaattaacctgaatccagacaactatcaggttggcaaaaccatggtgtttctgaaggaacaggagcgccaacacctccaggaccttttacatcaggaggtgcttcgcaggatcatcctccttcagcgctggtttagagtgttactctgtcggcagcactttcttcacttacgccaggcatcagtgattatccagaggttttggcgcaattatttgaaccagaaacaggtgagagacgccgctgttcagaaagatgcctttgtcatggctagcgctgccgctctgctgcaagcaagctggcgggctcatttagagcggcagaggtatctggaactgcgagcggcagctattgtgatccagcagaaatggcgcgattactacagacgccgacacatggctgccatctgtatccaggcgaggtggaaggcataccgagaaagcaagaggtaccaagaacagaggaaaaaaataattctgcttcaatcaacttgtagaggatttagagctagacagcgattcaaagcactgaaagaacagcgtctgagggagacaaagccagaggtgggactagttaacataaaaggatatgggagtctggaaattcagggctctgatccttcgggttgggaagattgctcattcgataatcgtattaaagccattgaagaatgtaaatcagtgatagaatccaacaggatttccagggaatcctctgtggactgtcttaaagagagtccaaataagcagcaggagcgtgctcagtctcaatcaggggtcgatctgcaggaggacgtactggtgagagagagaccccgttcgcttgaggatctgcaccagaaaaaggtggggagggcgaagcgcgaaagtagacgtatgcgagaactagaacaagcaatcttctccctagagctcctaaaggttcggtcattaggcggaatctccccctccgaggacagacgctggtcaaccgaactggtgcctgagggactgcaaagccccaggggcacgcccgacagcgagtcaagtcagggatcgctggagctcctctcttacgaggaatctcagaagtctaagttagaatcagtgatttcagatgaaggagatctacagttcccttcaccaaagattagcagcagcccgaagttcgatagccgagataacgctctgtcagcgtcgaatgagacaagttctgccgaacaccttaaggacggcactatgaaagaaatggtcgtgtgctccagcgaaagcatcacctgcaagccccagttgaaggattcctttatctcaaactccttaccaacattcttctacattccacagcaggacccactgaagacaaactctcagctggacaccagcatacaacgtaacaagcttctcgagaatgaggacacggctggggaggctcttacacttgacattaaccgtgagactcgaaggtatcactgcagtggcaaggatcagatcgtaccatccctgaacacagagtcgagcaatccggttcttaagaagttggagaaattgaataccgaaaaggaagagcgacagaaacagctacagcagcagaacgagaaggagatgatggagcaaattcggcagcagacagatattctcgaaaaggagaggaaagccttcaagacgatcgagaaaccgcgtataggcgagtgcttagtcgctcctagcagctatcagagtaagcaaagggtcgaaagaccaagttctctactgtcactgaatacttcaaacaaaggcgaattgaacgtgctcgggtcactctccctaaaggacgctgcactggctcaaaaggactctagctctgcccacttgccccctaaagatcggcctgtgacagttttcttcgagaggaaggggtcaccttgtcaaagttctaccgtgaaggagctgagtaagactgatcgcatgggaacacaacttaacgtggcatgcaagctgagcaacaaccgcattagcaaaagggaacattttcggcctacccaatcctactcccacaattctgacgacctgagcagagaaggaaatgcgagacccatatttttcacccccaaggacaatatgagcatccctcttgtttctaaggaagctctgaattcaaaaaatccacagttgcataaagaagatgaaccggcatggaagccagtgaagctggccggaccgggtcaaagggagactagccagcggttttcctctgtggacgagcaggctaaactgcacaagacgatgtcacaaggcgaaattactaaactggccgtacgccagaaagccagcgatagcgatatccgccctcaacgggcaaaaatgagattttgggccaagggtaaacaaggtgagaagaagaccacgagagtgaaacccactactcagagcgaggtgagcccactcttcgctgggactgacgtaattccagctcatcagttcccagatgaacttgctgcctaccacccaacgcctcctctgtcacctgaactgccaggttcgtgccgaaaagaatttaaagagaataaagagccttcacccaaagcaaagcggaagagatccgtcaaaatctcaaacgtagctctagattcaatgcactggcagaatgactcggtccaaattatagcctctgttagcgaccttaaaagcatggacgaattcctgttgaaaaaagtcaacgatctggacaatgaggattcaaagaaggacactttggttgatgtcgtctttaaaaaagccttaaaagagttccgccagaatatcttttccttttacagttctgcactggcaatggatgatgggaagtccattcggtacaaagacctgtacgcgctgtttgagcagatattggagaagaccatgcgcctggagcaaagggactcgctcggtgaatccccggtcagggtatgggtgaacacgtttaaggtcttcctggacgaatatatgaatgaatttaagacttccgactgtaccgccacaaaggttcccaaaacagagcgcaagaagagacgcaaaaaagagacagacttggttgaggagcataacggccatatctttaaggctacccaatactccatcccgacatattgtgaatactgttcttccttaatctggataatggacagggcgtccgtctgcaaactgtgcaagtacgcctgccacaaaaagtgttgcctcaagacgactgccaagtgctccaagaagtacgacccggagctgtcgtcccggcagttcggggtggagttgtctaggctgacctctgaagacaggacagtcccgctggttgtggagaaactaatcaactacatagagatgcacggcctgtacactgagggcatttataggaagtccggatccactaataaaattaaggaactgcggcagggcctggacacagacgcagagagtgtaaacctcgacgattataacatccacgtcattgcctctgttttcaagcagtggctccgggatctacctaaccccctgatgacctttgaactctacgaggagtttctgagagccatggggctccaggagcggaaagagactatcagaggagtctacagtgttattgatcaactttcccgaacccacctgaatacactcgagcggctgatatttcaccttgtgagaatcgccctccaggaggacacgaatcgcatgtcagcgaatgcgcttgccatcgtttttgcgccatgcatactcaggtgcccagacacaacagatcccctgcagtccgtgcaggacatctccaaaaccacaacttgtgttgagctgatcgttgtcgaacagatgaataagtataaggctcggctgaaggacataagcagtctggagttcgcagagaacaaggccaaaaccaggctgtccctgatcaggcgcagcatgggaaaaggaaggatcaggaggggcaactatccaggcccatctagccctgtggtggtgcgactgccgtcagtaagtgacgtgagcgaggagaccttgacttccgaggctgctatggaaaccgacataactgagcaacagcaagcagccatgcaacaggaggagagagtcctgacagaacagatcgagaacctccagaaagagaaggaggaactgacgtttgagatgcttgtgctggagcccagagcaagcgatgacgagacccttgagtccgaagcatccatagggactgcagactcttcggagaacctgaacatggaatccgaatacgccattagcgagaagtccgaacggagtctggcgctgtcctccttaaagactgcaggcaaatcagaaccctctagcaaattacgcaagcagctgaagaaacagcaggactccctggatgtggttgattcaagtgtgtcatcgctgtgtctgagtaacacggccagcagtcacggaactaggaagctttttcagatctacagcaaatccccattttaccgcgctgcgtctggaaacgaagccctggggatggaggggcctctgggtcaaacgaaatttctggaagataaaccccaattcatcagcaggggcaccttcaaccctgagaaagggaagcagaaactgaagaatgtgaagaatagcccacagaagactaaagaaactcctgaggggaccgtgatgtccggtcgcaggaagaccgtcgacccagattgtaccagcaatcagcaactagcccttttcggcaataatgagtttatggtgta

SEQ ID NO: 231605 - DNA, 2190 bp, Artificial Sequence
  Description of Artificial Sequence: Synthetic coding sequence
atgaacatcaacgatgggggacgcaggcgcttcgaagacaatgagcacactcttagaatttaccccggagcaatctcagagggcactatctactgccccatcccagccaggaaaaacagtactgccgctgaggtcatcgagtctctgattaacaagctgcatctggacaagactaagtgttacgtgctcgctgaagtgaaagaatttggaggggaggagtggattctcaatcctactgattgccctgtgcagaggatgatgttgtggccacggatggccctcgagaaccggttgagcggggaggactatagatttctccttcgggaaaagaacctcgatggctcgatacattatggctccctgcagtcatggcttagagtgactgaggagcgaaggagaatgatggaacgtggatttttgccccaaccgcagcagaaggactttgatgatctctgtagcctacccgacctcaatgagaagacactgttagaaaacctccggaatcggtttaagcatgagaagatctatacctacgtggggtctatcctgatagttataaatcccttcaaattcttgcccatttacaatcctaaatatgtcaaaatgtatgacaaccaccagctgggcaagctggagccacacatttacgccgtagccgatgtggcttaccacgccatgctgcagcgcaaaaagaaccaatgcatagtgatcagcggcgagtcggggtccggaaaaacgcagagcacgaacttcctgatacaccacctcacagctctgtcccagaagggcttcgcttccggcgtagagcagatcatcctgggagctggtcctgtactcgaggcattcggcaacgccaagaccgcacacaacaataacagtagtcgctttggcaagttcatccaggttaactaccaggagaccggaaccgtactaggtgcgtacgtggaaaaatacttgctggagaagagccgcctggtgtatcaggagcacaacgagagaaactatcatgtgttttactatctgctggccggagcatctgaagacgaacgatccgccttccacttgaaacaaccagaggaatatcactatcttaaccagattactaaaaagccattgaggcaatcttgggatgactattgctacgactctgaacccgactgctttaccgtagagggcgaggatttacgacatgactttgagcgcctgcagcttgcaatggagatggtgggattcctgcccaaaactcggagacagatcttttccctgctgtcagccatcttacacctcggcaatatctgttacaaaaagaagacgtatagggacgatagcattgacatttgtaacccagaagtcctcccaattgtgtccgaacttctggaggtcaaggaggaaatgctcttcgaggccttggttacgcggaagacggtcactgtgggtgagaaactcattctgccatacaaactggccgaagccgttacagtgcggaactccatggctaagtccctctattctgcactgtttgactggatcgtcttccgcattaaccatgcattactgaattctaaggacctcgagcacaacactaagacactgtcaattggcgttctggacatttttggcttcgaagattacgagaataattctttcgagcagttctgtatcaactttgccaatgagcggcttcagcattacttcaaccagcatatttttaaattagaacaagaggagtatcgcacggaaggaatcagttggcacaatatagattacattgataacacgtgctgcatcaatctgattagcaagaaacccactggactactgcacctcttagatgaagagtccaacttcccccaggccaccaatcaaaccctgctagataaattcaagcatcaacacgaagacaattcttatattgagtttccagccgttatggagccagcttttatcatcaaacattacgcaggtaaagtcaaatacggcgtgaaagattttagagagaagaatacagatcacatgcgcccagatatcgtggctctgttgcggagcagcaagaatgcctttattagcgggatgatcggcatcgatcccgtggccgtgtttcggtgggcgattcttagggcattttttagagcaatggtggcatttcgggaggctggcaaacgtaatatacaccgcaaaacaggtaagtag

SEQ ID NO: 231606 - DNA, 1509 bp, Artificial Sequence
  Description of Artificial Sequence: Synthetic coding sequence
atggacaaggctcttctctgtagtgtgtgcaaaatgacatgccacaaaaaatgcgtccacaagatccagtctcattgttcctatacctatggcagaaagggagagccaggtgttgagccagggcattttggagtctgcgttgattctcttacctcagataaggcatccgttccgattgtgttagaaaagttactggagcatgtggaaatgcacgggctgtacaccgaggggttgtacaggaaatcgggggcagcgaacaggacccgggagctccggcaggcgctgcagacagacccggctgctgtgaaactcgaaaattttccaattcatgccatcactggggtcctgaaacaatggcttagggaactcccggaaccattgatgacgttcgctcagtatggtgattttttgcgcgctgtggagctccccgagaagcaagagcagctggctgctatttatgctgtgctcgaacatctgcctgaagccaatcacaactcgcttgaacggctaattttccacctcctggccgtggccctgctggaggatgtgaataggatgagccccggagcgctcgctatcatatttgccccatgcctgttaaggtgcccagacaactccgacccgctgacctctatgaaagatgtgttaaaaattaccacatgtgtggagatgttgataaaggagcagatgcggaaatacaaagtgaagatggaagaaatcagtcagttagaggccgcagagagtatcgcatttcggaggctcagtctgcttcgacagaacgccccatggccactcaagcttggcttttcttcaccttacgaaggagtcctaaataaatcacccaaaacccgggatattcaggaagaagagcttgaggtgctgcttgaggaggaggcggcagggggtgatgaggatcgcgagaaagagattctgatagaacggatacagtcgattaaggaagaaaagcaggacatcacttatcggctccccgagttggacccgcgtgggtcagacgaagagaacctcgacagcgaaaccagcgccagtacggaaagcctcctggaagaacgggctggtaggggcgctagcgagggccctcccgcacccgcactcccctgccccggagccccaacaccttcccctctgcccaccgttgccgctcctcccaggagacgccctagctcgtttgtcactgtgcgagttaaaacacctcgaagaacccccatcatgccaaccgctaatatcaaattacccccaggccttccttcacatcttccacgatgggcacccggtgctagagaagccgctgcgcctgtgaggaggagagaaccaccagcccgtcgccctgaccagatccactcggtgtatataactccgggtgccgatctccctgtgcagggcgcactggagccattggaggaggatgggcagccacccggagccaagaggcggtactctgacccacctacttattgtctccccccagcgtccgggcagactaatggctag

SEQ ID NO: 231607 - DNA, 6068 bp, Artificial Sequence
  Description of Artificial Sequence: Synthetic coding sequence
atgtctgtgaaggaggccggatcctctggccgtagagagcaggccgcttatcatctccatatttaccctcaactgagcaccacggagtctcaagcctcttgccgtgttaccgctaccaaggatagcacaacaagtgacgtcattaaggatgcaatagcctccttacgcctggatggaaccaagtgctatgtgctggtggaggtaaaggagagcggaggggaggagtgggtgctggatgccaatgatagccctgtgcaccgtgtgcttctgtggccgcgacgtgcacaagacgaacaccctcaggaagacggctactacttcctgctccaagagcgaaacgccgacgggacaattaaatatgtacatatgcagctcgtggctcaggctactgctacacgccgtctagtcgagcggggattattacctcgccagcaagccgactttgacgacctgtgtaatctaccagagctgacagaggggaatctgctgaagaacctaaagcatcgatttcttcagcagaagatttacacatacgcaggctccattctggtagccatcaatcctttcaagtttctccccatatacaatcctaagtacgtgaagatgtacgaaaatcagcaattaggcaagctcgaaccccatgtgttcgctctggccgacgtcgcctattatactatgctgaggaaacgcgtaaaccagtgtattgtaatctccggtgagagtggcagcggtaagactcagtctacaaatttcctgattcattgtttgacggcactatctcagaaaggctacgcatccggggtggagagaactatcctcggcgctgggccagtgcttgaagccttcggcaatgccaaaacagctcacaacaacaactcctcaaggttcgggaaatttattcaagtctcatatttagagtctgggatcgtgcgcggagcagtggtggagaagtacctcttggaaaaaagtcgtctggtaagtcaggaaaaggacgagcgaaattatcacgtcttttactatcttctccttggtgtcagtgaggaggagcgacaagagtttcagttgaagcagccagaggactatttctatttgaatcaacataaccttaaaattgaagatggggaggatttgaagcacgacttcgaaagactcaagcaggccatggagatggtaggttttctccccgcaacaaaaaagcagatcttcgcagttctttcggcaattctgtatcttggaaatgtgacatataaaaagcgggcaacaggacgcgaggagggcttagaggtgggccctcccgaagttctggataccctgagtcaacttctaaaggtgaagagggagattcttgtggaagtgttgacgaaaagaaaaactgtgacagtgaatgataagctgattcttccttatagtctctctgaggcgattactgctcgagactcaatggccaagtcactgtactccgcactgttcgactggatagtgttgcgcatcaatcatgctttgctgaacaaaaaagatgtcgaagaggccgtgagttgccttagcatcggggtgctggatatattcggtttcgaagattttgaaagaaacagttttgaacagttctgcataaattatgccaatgaacagctgcagtattatttcaatcaacacatctttaaactggagcaggaagaatatcagggcgagggaatcacctggcacaatatcggctatacggataacgtcggctgtatccatctgatctctaagaaaccaacgggactgttctatttactcgacgaggaaagtaacttccctcatgccacctcacagacattattagctaagttcaagcagcagcacgaagacaacaagtattttttgggcacgcccgtcatggaacctgcttttattattcaacattttgcagggaaggtgaagtatcagatcaaagactttcgcgaaaaaaatatggactatatgagacctgacatcgtagcgctccttagaggatcggacagctcctatgtacgtgagctcataggcatggatcccgtagccgtctttcgatgggcggtgcttcgggctgccattagagcgatggctgtcttgagggaggccggacgactgcgcgcagagcgtgcagagaaggctgcaggcatgtcgtcccctggtgcccagagccacccggaagaactcccccgtggtgccagcaccccaagcgaaaaactgtacagagacctgcataatcagatgattaaatctatcaaaggtcttccctggcaaggggaggatcccaggagtcttctccagtccttgagtagactgcagaagccaagagccttcattttgaaatcaaaaggaatcaaacaaaaacagatcattcccaagaatctgctggattcgaaatcactgaaacttataatctcgatgacgcttcatgataggactaccaagtctctgctgcatcttcacaagaaaaagaaacccccatcaatttctgcacagtttcagacaagtcttaacaagctgttggaagctttaggcaaggcagagcctttctttatcagatgcatcagatccaacgctgagaaaaaagaactttgttttgacgatgaattggttttacagcagttgcgttacaccgggatgcttgaaactgttagaatcagacgctcggggtattccgcaaaatataccttccaagatttcactgagcagttccaggtcctcctccctaaggatgctcagccctgccgagaggtgataagcaccctgctggaaaagatgaagattgacaaaagaaactatcaaatcggcaaaaccaaggtgttcttgaaggaaacggaacgacaggctctccaggaaacgttgcacagagaggtggtacgaaaaatactgctcctacagtcttggtttaggatggtgcttgagcggaggcactttctgcagatgaaacgggctgcagtaaccatccaggcctgttggcgctcctaccgggtgagacgagccctggaacggacacaagccgcagtctatctccaggcctcttggcgcggatattggcaacgaaaactgtataggcatcaaaagcaatctataatccggctacaaagcctctgccgcggtcatcttcagagaaaaagcttcagtcagatgatatccgagaagcagaaggccgaagaaaaagagcgggaggctctggaggcggcacgcgctggcgctgaagaggggggacagggccaggctgccggaggtcagcaggtggctgaacagggccctgagccagccgaggacggcggacacctggcctctgaaccagaggtgcagccctctgaccggagtcctcttgaacactcctctccagagaaagaggctcccagtcccgagaagaccttgcctccacagaagacagtggccgcagagtcccatgagaaagttccctcttctcgcgagaagcgtgaatctaggcggcagaggggccttgaacacgtgaagtttcagaataagcatatccaatcgtgcaaggaggagagcgctcttagagaaccaagcagacgcgtgacacaggagcagggggtgagcttacttgaggataagaaagagagccgcgaggacgaaaccttactggtagtggagacagaggcagagaatacatctcaaaaacagcctactgaacagcctcaagcaatggctgtgggaaaggtgagtgaggagacagaaaagacgctcccgagcggcagcccacgcccagggcagcttgaacggccaacatctctggccctcgatagccgagtcagccctcctgcgccagggtcggctccagagacacccgaggacaagagcaagccatgtgggtctccacgggtacaagagaagccagactcccccggaggatccacacagattcagagatatcttgatgctgagcgcttggccagcgccgtcgaactctggcgtggaaaaaagctggtggctgcagcttctccttctgctatgctgagccaatccctggatttgagtgacagacatcgggcaacaggcgctgcacttacgcctacagaggagcggcgtacatcctttagcacttctgatgtgtccaaactgctgcccagcctcgctaaagcccagcctgccgctgagaccaccgatggggaacgcagtgctaagaagccggctgtgcagaagaaaaaaccaggagatgcctcatctttgcccgacgccggtctctctcctgggtcgcaggtcgactctaagtccaccttcaagcgcttattcctgcacaaaaccaaagataagaagtacagcctcgaaggcgcagaagagttggagaacgctgtctcgggtcacgttgtgctggaggctactaccatgaagaagggtctggaggctcccagcggacagcagcaccgacacgccgctggtgaaaaacgcacaaaagagccgggtggaaagggcaagaagaacagaaacgttaaaatagggaaaatcacggtgtccgagaaatggcgcgaaagtgtgtttagacagattaccaacgctaatgagttgaaataccttgatgaatttcttctcaacaaaattaacgatcttagaagtcagaagactcccatcgagtcgctgtttatcgaggccactgagaagtttaggagcaatatcaagactatgtattccgtgccaaatggcaagatccacgtcgggtacaaagacttaatggaaaattaccagatcgtagtcagtaatctggccactgaacggggacagaaagacactaacctagtgctcaatttgttccaaagtctactggatgagtttacaaggggttacactaagaatgattttgagccagtgaagcaatccaaagcccaaaaaaaaaagcggaagcaggaaagagctgtccaagaacacaatggacacgtttttgcctcttaccaagtgagcatcccccagagttgcgagcaatgcctgtcatatatctggttgatggacaaagcccttttgtgtagcgtctgtaaaatgacttgccacaagaagtgtgtacataaaatacagtcccactgtagttatacttacggccgaaagggcgaacctggggtcgaacccggtcactttggggtgtgcgttgactccttgacctcagataaggccagcgttccaatcgtgctcgagaagctgctcgagcacgtggaaatgcacggcctgtacacagaaggattataccggaagtcaggagccgcaaacagaactcgggagttgagacaggccctgcaaaccgacccagccgcagtgaaactagagaattttcctattcacgctattaccggcgtactcaagcagtggctgcgggaactccccgagccccttatgactttcgcccagtacggcgacttcctgagagccgtggagttaccggagaagcaggaacagctcgccgcaatctacgccgtgctggagcatcttccagaagcaaatcataatagtctagagcgtctaatcttccacctggtgaaagtggcactccttgaggatgtaaatcgaatgagtccaggagccctagccattatctttgctccctgcctgcttagatgtcctgacaattctgaccctttgacttcaatgaaagatgtcctgaaaatcaccacatgcgttgagatgctcatcaaggagcagatgcggaagtataaggttaagatggaggaaatctcgcagttggaggcggctgagagtatcgccttcagaaggctttctctgctccgccaaaacgctccctggcctctcaagctcggtttctccagcccatatgagggcgtacttaacaaatctcctaagacccgggatatccaggaagaggagttagaggtgctactcgaggaagaggccgcagggggtgacgaggatagagagaaggaaattctgattgagcgtatacaatccataaaggaagagaaggaggacataacttatcggctgccagagctggacccccgagggtccgacgaggagaacttggattccgaaacttctgctagtacggagtctctcctggaagaaagggctggaagaggcgcttccgaagggcaatatta

SEQ ID NO: 231608 - DNA, 6068 bp, Artificial Sequence
  Description of Artificial Sequence: Synthetic coding sequence
atgagtgtcaaggaagcgggatccagtggtaggagagaacaggcagcgtaccacctccatatctatcctcagctgagtactacagaaagccaagcatcctgtcgcgtgaccgccacaaaggatagtacaacatctgacgttattaaggatgccatcgccagtctgagattagacggaactaagtgctatgtcctggtcgaagttaaggagtccgggggagaagagtgggttctggatgccaacgacagtcccgtgcatcgggtcctgctctggcccagacgggctcaggatgagcatcctcaggaggatggctattatttcctgttgcaggagagaaacgccgacggaaccatcaaatatgtgcatatgcagctagtggcgcaagctacggcaaccaggagactcgtcgagcgaggcttgctgccaagacaacaggccgattttgacgacttgtgcaatttaccagagctaacagagggaaatctcctgaagaatcttaaacacaggttcttgcagcaaaagatctacacatatgcagggagcatcctcgtggctattaaccctttcaaatttctgcccatctacaatccaaaatacgtgaaaatgtacgaaaatcagcagctgggaaaacttgaaccccacgtgtttgcattggctgatgtagcttactatacaatgctgcgaaagcgcgtgaatcagtgcattgtcatctcaggcgagtccggcagcggaaaaactcagagcacaaattttctcatccattgtcttacggctctgtctcagaagggatatgcatcaggggttgagaggaccatcttgggcgctgggcctgtcctggaggcattcggtaacgcgaagactgctcacaacaacaattcttcgaggtttggaaagttcatccaggtttcctatcttgagagcggaatagtcagaggcgctgtggttgagaaatacttgttggagaagtctagactcgtgagccaggaaaaggacgagcgcaactaccacgtcttctactatcttttattaggcgtgtcggaagaggaaaggcaggagttccaactgaagcagcccgaagactatttttacttgaatcagcataatctcaaaatcgaagatggtgaagacctgaagcatgattttgaacgtctgaaacaggccatggaaatggtcggatttctccccgcaaccaagaagcagattttcgccgtccttagtgccatcctttatcttgggaacgtgacctacaaaaaacgagctaccgggagagaagagggtttggaggtgggcccacctgaagtattggacactctctctcagctgctgaaagtcaagagagaaatccttgtggaagtcttaacgaagcgcaaaaccgtgaccgttaacgacaagctgattcttccctactccttgtccgaggcaataactgctcgagacagcatggccaagtctctctatagtgctctcttcgattggatcgttctcagaatcaaccatgcactgctgaacaaaaaggatgtggaagaagctgtgagctgtctgagtatcggggtgctagacattttcggtttcgaggatttcgagaggaatagcttcgagcagttctgcatcaactacgccaatgaacagctccagtactatttcaaccagcacatcttcaaacttgaacaggaagagtaccagggcgagggtattacatggcacaatatcgggtatactgataacgtcgggtgcatccacctcattagtaaaaaacccacaggtcttttctatctcctcgatgaggagtccaatttccctcacgccacctcccaaacgctgctggctaagttcaaacaacaacacgaagacaataaatattttctgggcactccagtgatggagccagcctttattatccagcactttgcagggaaggtaaaatatcagattaaggattttagagaaaagaatatggactacatgaggcctgatattgttgctctgctgcggggttctgacagtagctacgtgcgggaacttatcggaatggatcctgtggctgttttccgttgggcagtgctgcgggctgcaatcagggccatggcggtgctgagggaagctgggcgtcttcgcgctgagagagcggaaaaggcagcagggatgagtagcccaggggctcagagccatcccgaagagctgcctcgcggagcatctaccccttctgagaaattatatcgcgatctgcataaccagatgataaagtcaattaaaggcctgccctggcagggcgaagaccctcggtctctgcttcagtcgttgtcccgcttacagaagcctcgcgcttttatcctgaagtcaaaggggatcaagcaaaaacaaatcattccgaaaaacctcttggacagcaaaagtcttaagcttattatctctatgactctgcatgataggaccaccaaatctctcctccatctacacaagaagaaaaagcctccaagcatctccgcccaattccagacgtccctcaacaagctattggaagccctgggtaaagccgagccgtttttcattcgctgtataagatcaaacgcggaaaagaaagagctatgttttgatgacgaactggtgttgcagcagctgcgctacaccggcatgctagaaaccgtaagaatacggcgaagtgggtacagcgcaaagtatacgtttcaagatttcactgagcagtttcaggtactcctgccaaaagacgcccagccatgcagggaggtcatatctactcttctggaaaaaatgaaaatcgataaaagaaactaccagatagggaagactaaagtcttcctgaaggaaaccgaaagacaggcactgcaagaaacattacatcgtgaagtagtcagaaagatcctgctgctccagagttggttcaggatggtcttggaacgacggcacttcctgcagatgaagcgcgctgccgtgactatccaggcctgttggaggtcgtaccgcgtgagacgcgcactggagagaacgcaggccgctgtttacctccaagcctcctggcggggatactggcaaagaaagctttaccggcaccagaagcagagcataattaggcttcagtctctgtgccgaggacatctacagcgcaagtccttctcccaaatgatctccgagaagcagaaggcagaggaaaaagagcgggaggccctggaagctgccagggccggagccgaggaggggggtcagggtcaagctgccggaggacaacaggtagcggagcagggaccagaacccgcagaggacggcggacacttagcgagcgagcctgaggtgcagccatcagatagaagtccgttggaacattcgtctccagagaaagaggccccatccccagaaaaaacgttgcctccacagaaaacagtggccgcagaaagtcacgaaaaggtaccctcttctcgtgagaagagggaatcccgccgacaaagaggtcttgaacatgtgaaatttcagaataaacacattcagtcttgcaaagaggagagcgcattgcgagagccctcgagacgggtgacacaggaacagggcgtgtctctgctggaggacaagaaagaatctagggaggacgagactctgttggtagtggagacagaagccgaaaatacctcccagaagcagcctacggagcaaccacaggctatggcagtaggcaaggtgagtgaggagaccgagaagaccctcccttctggttcccctaggccaggccagctggaacgacctacttctctggccctcgattcccgagtcagcccacctgcccctggcagcgctccagaaacgccagaggataagtcaaaaccctgtggtagtccccgagtgcaggagaaaccagactcacctggcggaagcacccaaattcagcggtacttagacgccgaacggctggctagcgcggtggaactctggaggggtaagaaactggtggctgccgcttctccctccgccatgttaagccaatccctggacttgagtgatcggcacagagcaaccggagctgcgcttaccccaaccgaggagcgcagaacatctttctctacaagtgacgtgtctaagctccttcccagcctggccaaagcgcaacccgctgctgaaactacagatggcgagaggtccgccaagaagccagctgtgcaaaaaaagaagcccggagacgcatcaagcctccctgatgccggattaagtcccggatcccaagtggactccaagtctacctttaaaagactatttcttcataaaaccaaggacaaaaaatactccctggagggcgcagaagagctggagaacgccgttagtgggcacgtagttttagaggcaactacaatgaagaagggactggaagctccatcaggccaacagcacagacatgccgctggcgaaaaaagaactaaggaacctggcggtaagggcaaaaagaatcgcaatgtcaagattggcaaaatcactgtcagcgagaagtggcgcgagtccgttttcaggcagatcacaaatgcaaacgagttaaagtatctcgacgagtttctgttaaacaagataaatgacctccgttctcaaaaaacccctatcgaaagtttgttcattgaagcgaccgagaagtttcggtcaaacataaagactatgtattccgtgccaaatggcaaaatccatgtgggctacaaagacttaatggagaactatcaaatcgtagtaagcaacttggcaaccgaaagagggcagaaggatactaatctagtcctgaacttgtttcagtccctcctggacgaatttacccggggatacacgaagaacgattttgagcctgtcaagcaaagcaaggctcagaagaaaaagaggaaacaagaaagggcggtgcaggaacacaatggccacgtgtttgccagctaccaagtttccatcccacagagttgtgagcaatgtctctcatatatctggctaatggacaaagctctcctttgttctgtctgtaagatgacatgtcacaagaagtgcgtgcataagatccaatcccactgctcttatacatatgggagaaagggcgaacctggggtcgagccgggtcacttcggcgtgtgcgtggatagcttgacatctgataaggctagcgtgcccattgtcctggagaaactgttggagcacgtcgaaatgcatggactgtacacggagggcctttatcgcaaatccggcgctgctaacagaacccgtgagctcaggcaagccctacagactgacccggcagcggtcaaactcgaaaacttcccaatacacgctattactggcgtgctgaaacaatggctgcgcgaactgccggaacctctcatgacctttgcccagtacggcgatttcctgcgcgctgtagaactaccagagaaacaagaacaactcgccgcaatctacgctgtgcttgagcacctcccagaagctaaccacaactctctcgagaggctgatattccacctcgttaaggtcgctctccttgaagacgttaacagaatgtctcccggagccctggccataatatttgcgccttgcttgttacgctgtcccgacaattctgatccactcacctcaatgaaagatgttctgaagataaccacatgcgtcgagatgctgataaaggagcaaatgagaaaatataaagtgaagatggaggagatcagccagctggaagctgcagaaagcattgcgttccgtcgtctaagtctactcagacaaaatgcaccctggcctctgaagttaggtttttctagcccgtacgaaggcgtcctcaataaaagccctaagacacgggacattcaggaggaggaactcgaggtgctcctcgaagaggaggccgctggcggtgacgaggaccgggaaaaggagatactgatcgaacggatccaatccatcaaggaggaaaaagaggacatcacttaccgtctgcccgagcttgatcccaggggctcagacgaagagaacctggactccgagacttcggcctcgacggagtcactgctagaagaacgggctggcagaggagcctccgagggccagtatta

SEQ ID NO: 231609 - DNA, 519 bp, Artificial Sequence
  Description of Artificial Sequence: Synthetic coding sequence
atgagttcaaaaaaggctaaaaccaagaccaccaagaagagaccacagcgagcaacctcaaacgtgttcgcaatgtttgaccaatcgcaaattcaagagttcaaggaggcatttaatatgatcgaccagaatcgcgacggctttatcgacaaagaggatctgcacgacatgttggccagcttgggtaaaaacccaacagatgcctatttagatgccatgatgaatgaggcaccgggtcctattaacttcactatgttcctgacaatgttcggcgagaagttgaacggtaccgatcctgaagatgtcattcggaatgcatttgcttgctttgatgaggaggcaactgggactatccaagaggattacctcagagagctgctgacaactatgggagacaggttcacggatgaagaggtggatgagctgtaccgcgaagctcccatcgataagaaagggaattttaattacattgagttcactcggatccttaaacatggtgccaaggacaaagatgactag

SEQ ID NO: 231610 - DNA, 1791 bp, Artificial Sequence
  Description of Artificial Sequence: Synthetic coding sequence
atggcaaccgagaatggagcagtcgagctggggattcaaaaccccagcacggacaaagcccctaaagggccaactggcgagaggccacttgcggcaggaaaggatccaggcccacccgaccccaagaaagctcccgacccacctaccctgaagaaagatgcgaaggctccggcttcagaaaagggcgacggcacactggcacagccgagcacctcgagtcagggtcctaagggtgagggtgatagagggggaggacccgcagagggaagtgcaggtcctcccgcagctctgcctcaacagaccgccaccccagagacaagcgtaaagaagccgaaggctgagcagggcgcaagcggctctcaagatccaggcaaacctagggtgggaaaaaaagctgcagaaggtcaggctgccgcacggaggggcagtcccgcatttctccattcaccaagctgccccgctatcatatcaagcagtgagaaactcctggcgaaaaagcccccttctgaagcttcagaactgacattcgaaggcgttccaatgactcactcccccactgacccaaggccagccaaggccgaggaaggaaaaaatatacttgctgaaagccaaaaagaagtcggggaaaagacccctggccaggcaggccaggccaaaatgcagggagacacaagtcggggaattgagtttcaggcagtgcctagtgaaaagagcgaggtgggtcaggcgctatgcttgaccgcccgagaggaagattgcttccagatactggacgactgcccccctccgcctgccccttttccccatcgaatggtagaattacgaactgggaatgtgagctcggagttctctatgaattcaaaggaggcccttggaggcggtaagttcggggcagtttgcacgtgcatggaaaaagcaacagggctcaaactggccgctaaggtgataaaaaaacagactcccaaggacaaggagatggtgctgctagaaatcgaggtcatgaaccaattgaaccatagaaacctgatccaactgtacgccgctattgagactccacacgaaatagttcttttcatggagtacattgagggcggtgagctgttcgaaaggatcgttgacgaagactatcatctgacggaggtggacacaatggtcttcgtgcgtcaaatttgcgatggaattctgttcatgcacaaaatgcgggtgctgcacttagacctgaaacccgaaaatattctgtgcgtgaacacaaccgggcacctggtgaaaattattgacttcgggttggccaggaggtacaatcctaacgaaaagctgaaggtaaattttggtaccccagaattcctgtcccctgaggtagtcaattatgatcagatctctgacaaaaccgacatgtggtccatgggggtgatcacgtacatgttattgtcaggtctaagcccattcctgggggacgacgatacggaaacattgaacaacgtcctaagcggcaactggtattttgacgaggaaacgttcgaagcagtgtccgatgaagctaaagactttgtgagcaatctgatagttaaggatcagcgagccaggatgaacgctgcacagtgcctcgcgcatccctggcttaataatctcgcagaaaaggcgaaaagatgcaaccgcagactgaagtctcagattcttctgaaaaaatacctgatgaagagaaggtggaaaaagaactttatcgccgtgagtgcagcaaacagatttaaaaagatctcgtcctccggcgctctaatggctctgggcgtatag

SEQ ID NO: 231611 - DNA, 1791 bp, Artificial Sequence
  Description of Artificial Sequence: Synthetic coding sequence
atggccacggaaaatggcgctgtggaattggggattcagaatcctagtacagacaaagctcctaaggggcctacgggggagaggccactcgctgccggaaaagacccaggcccaccagacccaaagaaggcacctgaccctcccacgctgaagaaggatgcgaaagcccctgcctcagaaaagggagatgggactctggcccaaccctcaacatcctcacaagggcctaagggcgaaggagatagaggcggaggtcctgccgaaggcagcgctggaccccctgccgctcttcctcagcagacagccactccagaaacatctgtcaaaaagccaaaagccgagcagggcgcatcaggctctcaggaccctgggaagcccagggtaggtaagaaggccgctgagggccaggctgcagccaggcgcggatccccagccttcttacattcaccgtcatgccccgctatcatttcaagctcagagaaactacttgctaagaaacccccttccgaagcaagcgaactgacgttcgaaggggtgccgatgacccacagccccactgatcccaggcccgcaaaagccgaggaggggaaaaacattctagcagagtctcagaaggaagtcggcgaaaagactcccggacaggctggccaagccaaaatgcagggagatacttcccggggaatcgagttccaggcggtcccgtctgagaagagcgaagtagggcaggcgctctgtctgaccgccagagaggaggactgtttccagattctggacgattgtcctcctccccctgctccattcccgcatcgaatggtggagctgaggacagggaacgtgtcaagtgagttctcgatgaatagcaaggaggccctgggcggtgggaaatttggggctgtctgcacatgcatggagaaggccaccggcctcaagcttgctgccaaggtgattaagaaacaaactcctaaggataaagagatggtactgctggagattgaagtgatgaatcaactcaaccatcgcaatctgattcaattgtacgccgctatcgagacccctcacgagatcgtcctcttcatggagtacatcgagggcggagaactgtttgagaggatcgtggacgaagactatcacctcactgaggtggatacgatggtgttcgtgcgccagatatgtgacggaatcctgtttatgcataagatgcgggtgctccatcttgatctgaagccagagaacatcctctgtgtgaacacaaccggccatcttgtgaaaataatcgatttcggtttagctcgccgatataatcccaacgagaagctgaaggtcaattttggcacgccggaattcctgagtcctgaagttgtaaattatgatcagatctcagacaaaacagacatgtggagtatgggggttattacatacatgctcctgtctggtcttagccccttccttggcgacgacgacaccgagaccctcaacaacgtgttatctggcaactggtattttgatgaggagacctttgaagccgtgagtgacgaggcgaaagatttcgtttccaaccttatagtcaaggaccagcgggctagaatgaatgcagctcaatgtctggcacatccctggcttaataacctggctgagaaggcgaagcggtgcaatcgccgattgaagtcccagattctcttgaagaaatacctcatgaagcgtaggtggaagaaaaacttcattgccgtgagcgcagccaacagatttaagaaaattagtagttctggcgctttaatggcccttggcgtatag

SEQ ID NO: 231612 - DNA, 2460 bp, Artificial Sequence
  Description of Artificial Sequence: Synthetic coding sequence
atgagcgggacgtctaaagagtctcttggccatggcggactgcctggattgggcaagacttgcctcaccacaatggacaccaagctgaacatgctgaatgagaaagttgaccagctgcttcactttcaggaagatgtgaccgagaaactccagagcatgtgccgagatatggggcatctggagcgtggcttgcatagactggaggcttcacgagcaccaggccctgggggagccgacggagtgccacacatcgacacgcaggccggatggcctgaggtgttggaacttgtaagagccatgcagcaggatgcggcacagcatggagcaagactcgaagccctgtttcgcatggtggcagcggtggaccgggcaatcgcccttgtgggagccacgtttcagaagtccaaggtggctgactttctgatgcaggggagggtgccctggagaaggggctctccaggagattctccagaggagaataaggagagggtggaagaggaaggcggtaagccaaagcatgtgctgtccacatccggggtgcagagcgatgcccgtgaaccaggggaagaatcacaaaaggctgacgtactggaaggaactgctgaacggctgccgccaattcgcgcttctggtctgggagcagatcctgctcaggccgtggtgtcccctggacagggcgatggagttcccggaccagctcaagcctttcccggtcacctcccccttccaacaaaagttgaggcaaaggcccctgagacaccaagcgagaatcttagaacagggcttgagctggctcctgcccctggcagggtgaacgtggtcagcccatctctcgaagtcgcacctggagctggacagggtgcatcatcctcccggcctgacccggagcccctggaggaaggcacaaggctcactccgggtcctggtccacagtgtccaggcccaccagggctgcccgctcaggcccgtgctacacatagcgggggagagaccccgccacggattagcatccatattcaagaaatggatacaccaggcgagatgttgatgacagggaggggatctctggggccaacactcaccaccgaggctccggcagcggcacagcccggaaagcagggaccacctgggaccgggcgatgcttacaggcacccggaaccgagcctggagaacagaccccagaaggggcacgcgagctgagccccttgcaagagagcagctcacccggaggcgtcaaagcagaagaggagcaacgcgctggggctgaaccaggcacccgcccttctctcgctaggtcagacgacaacgaccacgaggtgggagctctgggactgcagcagggcaaaagtccaggcgcaggtaatcccgaacccgaacaggactgtgccgcacgcgcacctgtgcgggcagaggcagtgagaaggatgcctcctggcgcagaggcaggatccgtggttctggacgacagcccagcaccacccgctccgttcgaacatcgcgtcgtctctgtgaaggagacctccatcagcgcagggtatgaagtgtgtcagcatgaggttcttgggggaggacgcttcggacaggttcaccgatgcacggagaagtcaacaggcctgcccctagccgctaagataataaaggtcaaatccgccaaggaccgagaagatgtgaaaaacgagatcaacattatgaaccagctgtcgcacgtcaatttgatacagctgtacgacgcctttgaaagtaaacactcatgcaccctggttatggagtatgtggacggtggcgaattattcgaccgaattactgatgaaaagtaccacttaacagagttggatgtggtcctttttacccgccagatttgcgaaggcgtgcactacctgcaccaacactacattttacaccttgatctcaagcctgagaacatactctgcgtcaatcaaaccggacatcagatcaagatcatcgacttcgggctggctcggagatataagcctcgggagaaactcaaggttaattttgggacacctgaattcttagcgccagaggttgttaattacgaatttgtgtcttttcctaccgacatgtggtctgtgggggttattacatatatgctcctctccggcctgtccccttttctcggagaaactgatgcagaaacaatgaacttcatcgtcaactgtagctgggacttcgatgccgacactttcgaaggtctgtctgaagaggctaaggattttgtgtctaggctgctggtgaaggagaaatcttgtcgaatgtccgcaacacagtgcctgaagcatgagtggctgaataacctgccggctaaagcctcacggtcaaagactaggttaaagagtcaactcttgctgcagaagtatatcgcacagagaaagtggaagaagcatttttacgtggtgaccgccgctaatagactccgaaagttcccgactagtccatag

SEQ ID NO: 231613 - DNA, 1437 bp, Artificial Sequence
  Description of Artificial Sequence: Synthetic coding sequence
atggatacgccgggagaaatgttgatgactgggcgaggttcactaggcccaaccctcacaaccgaagctccggctgctgctcagccgggtaagcagggaccgccaggaacaggacgatgcctgcaagcacccggaacagagcctggcgagcagacccctgaaggtgccagggagctcagccccctccaagagtcttctagccctggaggggtcaaggctgaagaggagcagagggcgggagctgaacctgggacacgaccaagtcttgcacgttctgacgataatgatcatgaggttggcgctctcgggttgcagcagggcaagagccctggtgccggtaaccctgagccagagcaggactgcgctgccagggccccagtgagggccgaggccgtaaggcgtatgccacctggggctgaggccggttctgtggtgcttgacgattctcccgctcctccagctccctttgagcatcgggtggtctcagtgaaagagacttcaatctctgccggatacgaggtctgtcagcatgaagttctcggcggaggcaggtttggccaggttcacaggtgcacagaaaaatccaccggtttaccgttagcggctaaaattattaaagtgaagtcagccaaagacagagaggacgtcaagaatgagatcaacataatgaaccagctgagccacgtcaacctcattcagctgtacgacgcgttcgagtctaagcactcttgcacattggtcatggagtacgttgatggaggggaactcttcgaccgaatcacagacgagaagtaccacttaactgaactcgacgtggtgttgttcactcggcagatatgcgaaggcgtgcattacctgcatcagcattacatactccacctagacctcaagcccgagaacattctctgcgtgaaccagaccggccatcagattaagatcatcgactttggtctggccaggaggtataaacctcgggagaaattgaaagttaattttggaactcccgagttcctggctcctgaggttgtgaactacgagttcgtcagtttcccaaccgatatgtggagtgtaggcgtcattacatatatgctcttgagtggcttgagcccgttcttaggagagacagatgctgaaactatgaacttcattgttaactgttcatgggactttgacgctgacacattcgaggggctgtcagaagaggcaaaagactttgtgagccggttactcgtcaaggagaagagctgtaggatgagtgctactcagtgtctcaaacatgagtggttgaataacttgcccgctaaggcctctaggtctaagacccgcctgaaatctcagctgctcttacagaagtacattgcacaacggaaatggaaaaaacacttttacgttgttacggccgctaaccgacttcgcaaattccctacgagtccttag

SEQ ID NO: 231614 - DNA, 4212 bp, Artificial Sequence
  Description of Artificial Sequence: Synthetic coding sequence
tgactgctgctagaaagctgtgagaaggagaagcaggcacttctgcagaatctgaaggaggtcgaggacaaagcctccgcctacgaagatcaactccagggacaagcacaacaggtcgagaccctccagaaggagaagcttagcgcaacatttgagggtagtgaacaggtgcatcagctggaggagcagctggaggcccgagaggcttccgttcgccgtctggctgaacatgtgcaatccctatgtgatgagcgagatctcctgcgccagcggttccaggagctaaccgagagggtggccacctcagacgaggatgtggctgaactgcgcgaaaagcttcggcgacgcgaggctgataaccagagcctggagcatagctaccagagagttagcagtcagctccagtcaatgcatactctcctgcgagaaaaggaggaagagttggaacgaatcaaagaagcacacgagaaggtgctggaaaaaaaggagcaagacttgaacgaggcgctggtgaagatggtggcactcggaagcagcctggaagagactgagatcaaactccaggccaaggaagaaattctgcggaagttcgccagtgaatcacccaaagacatggaggagcctcggtcaaccccggaggagactgaaagggacggtactctacttcctggacagcctgtgcaggcgacaagggctcccctcgggttaccccacactcgattggaagacgaggatgaggacctcggggcacccccaggggaagaatatggcgatggctctccgtctcgtgaggattcaatggtgccccctaagtccgtagaggtgctggaccgggagggccaccagcaggggacagcgaagctggatcagggagctcctggagtcaagcgtcagcgcatcagatttagcacgatacagtgccagcggtatatccaccccgagggctcggagaagacctggacatcatcaacatccagtgatacttcccaggaccgctctccaagcgaggagagtatgtcgagtgagccagcgccttccgtgctgccagccaccggggattctgatacctatttgtccattatacattccctggagaccaagctgtatgttactgaagagaagctgaaagatgtgaccgtgagactagagagtcagcagggtcaatccagggaggccctgcttgccctacaccatcaatgggcgggaaccgaggcccaattgcgggaacagctgcgcgcaagcctgctccaggtgggggctttggccagccagctggagcaagagagacaagaacgggctcggagagttgaaggtcacgtcggggagctgggcgatttccaggtgaaaaactctcaggctctgatgtgtctcgagaattgcagagagcaactgcgctccttgcccagagcttctcaggaagacgagcaggatgctagggcagcctctctggcctccgtggagtctgcgctggtttctgctatacaggctcttcaacactggccagctccagcccatggcggagccagggcacagctagagacaggtggcactgaggaaaatggcaagcccgcatcgttgcagcagtgttcccagtctgaactcactgaacaagaacaggtgcgtctgctctctgaccaaattgcgcttgaagcatcattaatatctcagattgctgatagcctcaaaaacacaacttcagacgtgtctaggatgcttcacgagatctcttggtctggccaacctccaatggagtccgccggtgcacctgtggacacgtgggctcgaaaggtgctcgtcgatggtgaattttggagtcaggtggagtcccttagaaagcacctgggaacattaggaggagaggcggtaggggcaagcggggatggtcagcagagtatacctcaggggctggcccctattctggctaacgccacttgggttcgcgctgaactctcctttgctacgcaaagcgttagagagtcctttcaccgacggctgcagtccatccaggaaactctgcgcggaactcagaccgcgctacgacaacacaaatgtctgttgcgggaaattctgggggcttaccaaactcctgatttcgaacgggtcatgcagcaggtgctcgaagcgctgaggttgcccgctggccatgaagatggggttcagttgagctgggacctgtcaccgttaggagaagtactggggagagattctgactccagccaggaaccctttgacgtcagcgatcagagcccgggagcattcgtagctatccaagaagagctcgctcagcagctgaaggagaaggcttccctgctggaggaaattgccgcagctctgccctccttaccccctgtggagagtctccgcgactgtcagaaactgctccaggtatcccaatcgctgagctataacacctgtctggggggtctgggtcagtacagttctttgctcgtgcaggacgccattatccaggcccaggtatgttatgctagctgcagaatcaggttggagtatgagaaggagcttcagttgtgtaaggagagttggcagaccagggagccaagctgttcggaacaagcacaagccgctcgcgcacttcgagaggagtatgaggagctgctgagaaagcaaaagtcagaatacttggatgtcatcgctatcgtggaacgcgagaatgctgagcttaaggcaaaagctgcacagttagatcaccagcagcagtgcttagaggacgccgaatcgaagcacagtatgagcatgttcaccttgcgcggtaggtacgaagaagagatacgctgtgtggttgaacaacttacccgcaccgaaagtactctacaagcggagcggagccgggtgttatcacagttggacgccagcgtccgggatcggcaggatatggaacgtcaccacggggagcagatccagactctggaggaccgctttcaacttaaagttagagaactgcagactatccatgaggaggagctgagaacccttcaggagcattattcccagtctctccgatgtctccaggacactctgtgtctccaccagggtccccaccccaaagcgcttcccgctcctgctcccaattggcaggccacacagggtgaggcagactccatgaccggcctccgggaacgcattcaggaactggaggcccagatggacgtgatgagggaagagcttggacataaagacctcgagggcgacgcagcgactttacgggaaaaatatcagcgcgacttagaatcccttaaggccacctgcgaaagaggctttgcggcaatggaggagacgcatcagaagaagatcgaggatttgcaacgccaacatcagcgggaactcgaaaaactgcgggaggagaaggatcgactccttgccgaggagacagcagcaacaatctctgccatcgaagccatgaaaaacgcacatcgggaagaaatggaaagggagctggaaaagagtcagagatctcagatcagttccgttaatagcgatgtcgaggcattgcgccgacagtatcttgaagaactgcaatcagtccagagggagctggaagtgctgtccgagcagtatagccagaaatgtttggagaacgcccacctcgcccaggccctggaggcagagaggcaggcactgaggcagtgccaacgggaaaatcaggagcttaatgctcataatcaggaacttaataaccgcctggccgcagagattacgcggctgcgtacattattaaccggcgacggcggtggcgaagctaccggttccccactcgcccagggaaaggatgcgtacgagcttgaggtcctgcttcgagtcaaggaatctgagattcagtacctcaagcaagaaatatcttcgctaaaggacgaactgcagaccgctttgagagataaaaaatatgcctctgacaagtacaaggatatatacactgagctctccatagcgaaagccaaggccgattgtgatatcagcagactgaaagagcagctgaaggctgcaacggaagccttgggcgagaagtctccagactccgcgactgtaagcggctacgacattatgaagagtaagagcaaccccgatttcctaaaaaaggaccggtcatgtgttacaagacagctgagaaatatccgctccaagtcgcttaaagaaggactgacagttcaagaacgcctgaagttgtttgagagcagggacctaaaaaaggactag

SEQ ID NO: 231615 - DNA, 3078 bp, Artificial Sequence
  Description of Artificial Sequence: Synthetic coding sequence
atgtctgccgcaaaggaaaacccttgcagaaagtttcaggccaatattttcaataagagtaagtgtcaaaattgcttcaagccgagagagagccatctgctgaatgacgaggatctgacccaagcaaagcctatctacgggggttggctcctattggcgcctgatgggacagactttgataacccggtccacagatctcggaaatggcagcgcagattcttcatcctgtacgagcatgggctgctgaggtatgccttagacgagatgcccaccaccttaccccagggtacaatcaacatgaatcagtgtactgatgtggtggatggtgaaggtcgtaccggccagaaatttagtttatgcattctgactcctgaaaaagaacatttcattcgggctgagactaaggagattgtatcaggatggctggagatgcttatggtttacccacggactaacaagcagaatcaaaagaagaaacggaaagtggaaccacctacaccccaggagcctggcccagcaaaagtagctgttacctcaagctctagttcctctagcagctcttcttcaatcccttccgcggagaaggtgcccactactaaatctacattgtggcaggaagaaatgaggaccaaggatcaaccagatggatcgtccctgagcccagcgcagtctccttcccagagtcagcccccagccgctagttcgcttagagagcctggactggagtccaaagaagaagagagtgccatgtcatccgatagaatggactgtggaaggaaagtaagggtcgaatcaggatacttctcactcgagaagaccaagcaggatctgaaagcggaagagcagcagctgcccccaccactgtcccccccaagccccagcacccccaaccatcggagatcccaggtaattgaaaagtttgaagcattggacattgagaaggccgagcatatggagaccaatgctgttggacccagcccaagctcagatacccgacagggcaggagcgaaaaacgcgcattcccgcgaaagcgcgacttcacaaacgaagctccgcctgctcctttgccggatgcttcggcatcccctctgtcacctcacagacgagccaaaagcctggaccgcagaagcactgaaccatccgtgacccctgatctcttaaattttaagaagggatggttaacaaagcagtatgaagacggtcagtggaaaaagcactggttcgtcctcgccgatcagtcacttcggtactacagggacagcgtggcggaggaagccgcagacttggatggtgagatagatctatccgcctgttatgacgtgaccgagtaccccgtgcagcgcaattatggcttccagattcacacaaaagagggcgaattcacactgagtgctatgacctcgggcattcgccgtaattggatccagacgataatgaaacacgtacaccccacaaccgctcccgatgtgacttcctctctccccgaggaaaagaacaaatccagctgcagctttgaaacctgtcccaggccgacagagaagcaagaggcggagctgggggagcccgatcccgaacagaaacggtccagggctcgggagcgaaggcgagaaggcaggtccaaaacttttgattgggccgaattccgaccgatacagcaagctttagcacaggagagagtaggcggtgtggggcctgcagatacccacgaacccttgcggcctgaagccgagcccggtgaactggaaagggagagagcacgcaggagggaagagaggaggaaaagattcggaatgttagacgccaccgacgggccaggcaccgaggatgcggctctgcgtatggaagtcgaccgaagtcccggacttcccatgtctgacttaaagacccacaacgtccacgtggagatcgagcagcggtggcaccaggtagaaacaactcccttgagagaagaaaaacaggtgcctatagctcctgtacacctttcctcagaggacggcggagaccggctctctacccacgaactcacaagtctgttggagaaagaactggaacaatcccagaaggaggcaagtgatttattagaacaaaaccggctgcttcaggatcagctgagggtggcgctcggtcgagagcagagtgcaagggaaggatacgtgctgcaggccacatgtgaaagaggctttgcagctatggaggagacgcaccagaaaaagatcgaagaccttcagagacagcatcagcgggaactcgaaaagttgagagaggaaaaagacagactgcttgcggaggaaaccgcggctaccatctcggctatcgaggctatgaaaaacgcacatcgcgaggagatggagagagagttggagaagagtcagagatcacagatttcctccgtgaattcagacgtggaggctttacgccgtcagtatctggaggagcttcagagcgtgcagcgggaactggaggtgttgagtgaacaatatagtcagaagtgtctggagaatgcgcaccttgctcaagctctcgaggccgagcgacaggccctcagacaatgccagagggagaatcaggagctaaacgcccacaatcaggaacttaacaacaggctcgctgccgaaattactagactgcgaaccctgctcacgggggacggcggaggagaagccaccgggtccccactggctcagggtaaagacgcgtatgaactggaggttctgctgagagtcaaagagtcggaaatccagtacttaaagcaggaaattagtagcctgaaggacgagctgcaaacagcacttagggataaaaaatacgcttccgataagtacaaagatatctacacagagcttagcatcgctaaggctaaggcagattgtgacatttcccgtctgaaggagcagctgaaagcagctacggaagccctgggtgagaaaagtccagacagcgctactgtcagtggatacgatatcatgaagtccaagtctaacccagatttcctgaagaaagacaggtcatgtgtcactcggcaactaagaaacatccgtagcaagtcagttatcgaacaggtgtcgtgggacacgtag

SEQ ID NO: 231616 - DNA, 3078 bp, Artificial Sequence
  Description of Artificial Sequence: Synthetic coding sequence
atgtctgccgctaaggaaaacccgtgccggaaattccaagcaaacatcttcaacaaaagtaagtgccagaactgtttcaaacctagagagtctcatctgctaaacgacgaggacctgactcaggcgaaacctatatacgggggttggctcctactcgccccagacggaactgatttcgacaatccggttcatcgcagtcgcaagtggcaacgcagattcttcatcctctacgaacatggtctgctgcgatatgcattggatgaaatgcccacaactctgccacagggcactatcaacatgaatcagtgcacagatgtcgtggacggagaaggacggacaggccagaaattttctctctgtatactgacaccagagaaagaacactttatccgcgctgaaaccaaagagatagtgtctggctggctcgagatgcttatggtatatcccagaacaaacaagcagaaccagaagaaaaagcgaaaggtagagccaccaaccccccaggagcctggccctgcaaaggttgccgtcactagttcctcttccagctctagcagcagttcatccattccctctgccgagaaagtccctactaccaaaagcaccctctggcaggaagagatgaggacaaaggaccagcctgacgggtctagcttaagcccagcccaatccccttcccaatcacaacctccggctgcatcttcactgagagaaccgggtctggagagcaaggaagaggagtctgcaatgtcttcagatagaatggattgcggtcgcaaagtacgtgtggaatccggctacttcagcttagagaaaacaaagcaagacttgaaagccgaagagcagcaactccctccaccgttatcccctcctagcccttccactcctaaccataggcgatctcaggtaatcgaaaagtttgaggccctggatattgaaaaagccgaacatatggaaactaacgcggtgggtccctcaccgagttccgacaccagacaagggaggtcggagaagcgcgctttccccagaaaacgggatttcacgaacgaggctcctccagctcccctcccagatgcctccgcctctccactctcccctcacaggcgggctaaaagcctggatcggaggtcaactgaaccgtccgtgactccggatctgttaaattttaagaagggctggctcacaaaacagtatgaggacgggcaatggaagaaacactggtttgtgttagccgaccaatccctgcggtattatcgagactcagtggcagaagaggcagccgatctggacggagaaatcgacctatcagcatgctatgatgtgacagaatatcccgtgcagagaaactacgggttccagattcacaccaaggagggcgaatttactctatcggccatgacgtccggcatccggaggaattggatccaaacaatcatgaaacatgttcatccaactacagcccctgatgtcactagctccctgccagaagagaagaacaagtcctcgtgctctttcgagacatgccctaggcccacggagaaacaagaggcggagcttggagaacctgacccggaacagaaacggagccgagccagagagaggcgaagggagggcaggtcaaaaactttcgattgggctgagttccgacccatccagcaggcgctggcgcaggagcgggttgggggtgtcggacctgccgatactcacgagcccttaaggcctgaggccgagccaggcgaactggaacgcgagagagctcgcaggagggaggagcggagaaaaaggttcggaatgctggatgccaccgacggccctggcactgaggacgctgctctgcggatggaggtggaccgctctccagggcttccgatgtctgacctgaagacgcacaatgtgcacgtggagattgaacaacgatggcatcaagttgagacaacccctttgagggaggagaaacaagtgcccattgctcctgtgcacctgagcagtgaagatgggggtgacagactttcaacccacgaactaacttctttactggagaaagagctcgagcagtctcagaaggaggcgagcgacttgcttgaacagaacaggctgctccaagaccaactgagagtcgccctgggcagagaacagagcgctcgggaaggctacgtgctccaggctacatgtgagcggggattcgctgcaatggaggagacccatcagaagaagatcgaggatctgcaaaggcagcaccaacgggagttggaaaaactgagggaagaaaaggacaggctcctggctgaagagactgctgctacaatttctgccatagaagcaatgaagaatgcacacagagaggaaatggaacgtgagctggaaaagtcacagaggagccagattagctctgttaatagcgatgttgaagccctgagacgacagtacctcgaagagcttcagagcgtgcagcgggagttggaggtcctgagcgaacagtattctcagaagtgtctggagaacgcacaccttgcccaagcactcgaagccgaacgccaagcattaaggcagtgccaaagggagaaccaggagttaaacgcacacaaccaggaattgaataatcggcttgctgccgagataacccggctgaggacactccttactggcgatgggggtggagaggccaccggttctcctctcgctcagggaaaagatgcctatgagttagaggtgttgttgcgagtgaaagagtccgagattcaatacctcaagcaggaaatctcgtctctaaaagatgagctgcaaaccgctctgcgagacaaaaagtacgccagcgacaaatacaaggacatctacaccgagctgtctatagccaaagccaaggccgattgcgacatctctaggttgaaggaacagctgaaggcagctaccgaagcgctcggagaaaaatcccccgatagtgcaacggtgtccggatacgatattatgaaaagcaaaagcaatccggactttctgaaaaaggacagatcctgtgtgacaaggcaactgcgcaatatccggtcgaaaagcgtcatagaacaggtgtcctgggacacctag

SEQ ID NO: 231617 - DNA, 192 bp, Artificial Sequence
  Description of Artificial Sequence: Synthetic coding sequence
atgtccgcggctaaggagaatccctgtcgcaaattccaggccaacatcttcaacaagagcaagtgtcagaactgctttaagccccgagagtctcatcttcttaacgacgaggacctgactcagcagaatacccacccactggagatgaaaaggggagcacatatttacgatgcaaggatgttcagctgctag

SEQ ID NO: 231618 - DNA, 282 bp, Artificial Sequence
  Description of Artificial Sequence: Synthetic coding sequence
atgtcggctgctaaggagaatccttgtaggaagttccaggccaatattttcaataagtcaaaatgtcagaactgtttcaagcccagagaatctcatctgctcaacgacgaagacctcacacaagccaagccaatctacggaggatggctgctccttgcacctgatggcaccgactttgataacccagtgcaccgatcccggaaatggcagcgcaggttcttcatcctttacgaacacggccttttgcggtacgcgctcgatgagatgatgagcagtcaatag

SEQ ID NO: 231619 - DNA, 3117 bp, Artificial Sequence
  Description of Artificial Sequence: Synthetic coding sequence
atgagcgctgccaaggagaacccgtgcagaaagttccaagccaatattttcaataagagcaagtgccagaattgtttcaaacctcgtgaatctcacctacttaatgacgaggacctgacccaagccaagccaatatacggtggctggctgctcctggcaccagatgggacagacttcgacaatcccgtccaccggtccagaaaatggcagaggcgatttttcatcctgtacgagcacggtctacttcggtacgccctcgatgagatgccaacgacactgccacaaggcacaatcaacatgaatcagtgtactgacgtcgtggatggtgaggggcgtaccggccagaaattctccctctgcatactgacacctgagaaagagcatttcatccgggctgaaacgaaagagattgttagcggatggcttgagatgctcatggtataccctaggacaaataagcaaaatcagaaaaaaaaacggaaagtggagcccccaaccccacaagaaccgggtcctgccaaggtggccgtcacttcttcttcaagctcatcctcgtcttcaagctccattccatctgccgaaaaggtgcccacaacaaagagtacactatggcaagaggaaatgcggacaaaagatcagcccgatggtagttcccttagcccggctcagtctcctagccaaagccaaccacccgctgctagttctctgagagagcccggattagagagcaaggaggaggaatcagccatgagcagtgaccggatggactgtggtagaaaagtcagggtcgaatccgggtacttttcactggagaagaccaaacaagatttgaaggccgaggagcagcagctccctcccccactatctccgccatcgccctctacgcccaatcacaggcgcagccaggtgatcgagaaatttgaggcactcgacatcgagaaggcggaacatatggaaaccaacgcagttggtccaagcccgtcttccgacacaaggcagggcagatctgagaagagagcgttcccacgcaagagggacttcactaatgaagccccacccgctcctctgcccgacgcttctgccagtcccttatcgccacatcgccgagcaaagagtttggatagacggtccacggagcctagtgtgacaccagatttattgaacttcaagaaggggtggctcacgaagcagtacgaggatggccagtggaaaaaacactggtttgtcttggctgaccaatctctccggtactacagggacagcgtagcagaggaagctgccgatctcgatggcgagatcgacctgtctgcctgttacgacgttactgaatacccagttcaacgcaattacggctttcagatccacacaaaggaaggcgagtttaccttaagcgccatgacgtctggcattcggaggaactggattcagacgattatgaaacacgtgcatccgaccacggcgccagacgtgaccagctctctccctgaagagaaaaacaagagttcttgcagcttcgaaacttgtccccgtccaaccgaaaagcaggaggctgagctgggcgagcccgatcctgaacagaaaagaagcagggcgagagagcgcaggcgggaggggaggtctaaaacgttcgactgggccgagttccgtcctatccagcaggccctagcacaagagcgagtaggtggcgtcggcccagcagatactcacgaaccgctcaggccggaagcagagccaggcgagctggagcgggagagagccaggcggagggaagagagaaggaagcggtttggcatgctggacgcgaccgatggccctggaacggaggatgcagctttaagaatggaagtcgacagaagcccaggcctccctatgtcggaccttaagacccacaacgtgcacgtggaaattgaacagcgttggcatcaggtagagacaacccccctccgagaagaaaagcaggtgcccatagccccagtgcacctatccagtgaggatggtggggacagactttctactcacgagttgaccagcttgctcgagaaagaactagagcagagccagaaggaggcaagcgatctcctagaacagaaccgcctgcttcaggatcaactccgagtggctcttggtcgagaacaaagcgccagagagggatatgtgttgcaggcaacctgtgaaagaggattcgcagctatggaagagactcatcagaagaaaatcgaagacctacagcgacagcaccagcgggagttggaaaagctgagagaggagaaggacagactgttagctgaggagactgctgctaccatctcagcaatagaggctatgaagaacgcacatcgagaagaaatggaacgtgaactggagaaaagccagaggagccagatcagctccgtgaactctgatgtagaggccctgagaaggcagtacctcgaagagttgcagtcagtccagcgagaactcgaggtcctcagcgagcaatacagccaaaagtgcctcgaaaatgcccatcttgcccaggcactggaagccgaaaggcaggccctccgccagtgccagagggagaaccaagagctgaatgcacacaaccaggaattaaacaacaggctggcagcggagataacgaggttgcgaacccttctcacaggcgatggtggcggtgaagcaaccggcagcccattggcccagggaaaggacgcctacgaactggaggtgcttctgcgggtgaaggagtccgagattcagtatctgaaacaggagataagctcactgaaagatgagctgcagactgctctgcgagataagaaatatgccagtgacaagtataaggacatctatactgagctgtccattgcgaaggccaaagccgattgcgacataagcagattgaaagaacaattaaaggcagcgaccgaggctctcggcgagaagtccccggacagtgcaactgtgtctggttatgacattatgaagtcaaagtctaaccccgactttctcaagaaagacagatcatgtgtgacgaggcaactgcggaacatcaggtccaaatctcttaaagaggggctgactgtccaagagaggctcaagctgtttgagagtcgcgatctgaagaaagattag

SEQ ID NO: 231620 - DNA, 3276 bp, Artificial Sequence
  Description of Artificial Sequence: Synthetic coding sequence
tagagattttccaccatccagtgtcagcgctacattcaccccgaaggcagtgagaagacgtggacatcctccacaagttcagatacctcccaggataggtcaccgagcgaagagtcgatgagttcagaacccgcacccagtgtcctcccagcaactggagattccgacacatacctatcaattatccattctttagagacaaagctttatgtgaccgaagagaaactgaaagatgttactgtccgcctcgaatctcaacagggacagagtcgcgaggccctgctagcgctccatcatcagtgggcaggcactgaagcgcagctgagagaacagctccgagctagtttactccaggtaggagctctcgccagccagttggaacaggaaagacaagagagagcccgaagagtggagggccacgtaggggagctgggcgatttccaggtgaagaacagccaagctcttatgtgtctggagaattgccgagagcagctgaggtctctccctagagcttcccaagaagatgaacaggacgcgcgagccgcttcgctggcgagtgtggagagcgcgttagtgtctgccattcaagccctccagcattggccagccccagcccatgggggagccagagcacaactagaaacagggggtacggaggagaacggcaaacctgccagtctgcagcagtgtagccagtcggaacttaccgaacaggagcaagtcaggctgctgagcgatcagatcgcactggaggcttctctgatatcccagattgccgattccctaaagaacaccacgtccgacgtgtcaaggatgctccatgagatctcatggagtgggcaaccacccatggaatcggcgggtgccccagtcgatacctgggcgagaaaagttcttgttgacggagaattttggagtcaagttgagtctctgcggaagcatctggggacccttggcggagaggccgttggcgcttcaggcgatggtcagcagagcatccctcagggccttgcgcctatcctggcaaacgcgacgtgggtaagggctgaactgagcttcgctacacaatctgtgcgggaatcctttcaccgccgtctccagtccatacaggagacacttagaggaactcagacagctctacggcagcacaaatgcctccttcgggagatactgggggcttatcagacgccggatttcgaacgggtgatgcaacaggtgcttgaagccctgcgactgccagctggacatgaagacggcgtacagctgtcttgggatctgtcgccactgggagaagttcttggacgtgactcagatagttcacaagaacccttcgacgtaagcgatcagtcaccaggcgcatttgtggcaatacaagaggaattggcgcagcagttgaaagaaaaggctagtctcctcgaggagatagccgctgccctgccgtctttacctcccgtggaaagcctacgcgattgccagaaactgctgcaggtcagtcaaagcctgagctacaatacctgcctggggggactgggccagtactcaagccttctggtgcaggatgcgattatccaagcacaggtgtgctacgcatcatgcaggataaggctagagtacgagaaagaactgcagttgtgcaaagaatcctggcagactcgagagccaagctgttccgagcaggcccaggccgctcgtgcgctgcgagaggagtatgaagagctgctccgaaagcagaaaagcgagtatctcgatgtcatcgcgattgtggagcgcgagaatgcggaattaaaggctaaagccgctcagctcgaccatcagcagcagtgtttagaagatgctgagagcaaacactccatgtccatgtttacactcagaggacggtacgaagaggaaattcgctgtgtcgtggaacaattaacccgtaccgaatctacactgcaggcagagcgatcccgcgttctcagccaactggacgcatcggtgcgagataggcaggacatggagcgccaccacggcgagcagatccaaactttagaggacaggtttcagctcaaggttcgggagcttcagaccatacacgaggaagagctgcgtactctgcaagagcactactctcagtccctacggtgcctgcaagacacgctgtgtctacaccagggaccccaccccaaggcgttacccgctcctgcaccaaattggcaggccactcagggcgaagcggattccatgacagggttacgcgagcgaatccaagaactggaggcccaaatggacgtgatgcgggaggagctgggtcacaaagaccttgagggagatgctgctactctccgcgagaaataccagcgggacctggaaagcttaaaggctacttgtgagcggggtttcgcagcaatggaggagacccatcaaaaaaaaatcgaggatctgcagcgccagcatcagcgagaactagaaaagctgagagaggaaaaggatcggctgctggcagaggagaccgctgctactattagcgccatcgaggccatgaagaacgcgcaccgggaagagatggaaagagaactcgagaagtcccagagatcccagatatccagtgtaaattctgacgtggaggccctgcgcaggcagtacctcgaagagctccagtcagttcagcgggaattggaggtgttgtccgagcagtattctcaaaagtgcctagaaaatgctcatctcgctcaggccttggaggccgaacgacaggcactgaggcagtgccaacgcgagaaccaggagctgaacgcccacaaccaagagttgaacaatcggctagcggctgaaattacacgtctccgaacactgctgactggcgacgggggtggagaggccaccggtagcccactggcgcaaggcaaagacgcctacgagctggaggtgttattaagggtgaaggagtccgagattcagtatctgaagcaggagatttctagcctcaaagatgaactgcagacagctcttcgcgataagaagtatgccagcgacaaatataaggacatttacacagagttgagtatagctaaagccaaagccgattgtgacatttcaaggcttaaggagcagttgaaggccgctaccgaagcgttaggcgaaaagagtcctgattccgccacagtctccggatacgacatcatgaagagcaaatctaaccccgactttctgaaaaaggaccggagctgcgttactagacagctcaggaacatccggtctaagagcgtcatcgaacaggtgtcctgggatacttag

SEQ ID NO: 231621 - DNA, 840 bp, Artificial Sequence
  Description of Artificial Sequence: Synthetic coding sequence
tgacaggaagccgagttaggcgagccggaccccgaacagaagcgctcgcgagcacgggagagaaggcgcgagggacgcagcaagacctttgactgggcggaatttagaccaatccagcaggcactcgcgcaggagcgagtaggcggagtgggcccagcagatacgcacgagccccttagacctgaagctgaacccggtgagttggaacgtgagcgggctcgaagacgcgaagaaaggcgtaagaggttcggaatgctggacgcaacagatggacccggaaccgaggatgccgctttaaggatggaagtcgatagaagcccgggactcccaatgtcagaccttaaaacacacaatgtgcacgtggaaatcgaacaacggtggcaccaagtggaaactacccccctgagagaagaaaaacaggtgcccatcgcccctgtgcacttgagtagtgaggatggcggtgatcgactctctacacacgagctgacgagtttgttagagaaggagctggagcagagccaaaaggaggccagcgacctgctggagcaaaatcgtctgctccaggaccagctgagggtcgccctgggacgggagcagtctgcccgagaaggctacgtgctccaaaccgaggtcgccgcatcaccctccggagcttggcaaaggctgcatagagttaatcaggacttgcagagcgaattggaggcccagtgtcagcgccaggagctcatcacccaccagatacagactttgaaacgctcctacggagaggctaaggacactattaggcaccatgaggctgagattagatctctgcaggccaggctgagcaacgccgcatag

SEQ ID NO: 231622 - DNA, 585 bp, Artificial Sequence
  Description of Artificial Sequence: Synthetic coding sequence
ctaagacaacaaaccgtagaagagttgcagagcgtccagagagagctggaagttttgagtgagcaatacagtcagaagtgtctggagaacgcccatctcgcacaagcactggaggccgaacgccaggcgctgagacagtgccagcgagaaaatcaggaattaaacgctcacaaccaggttctgctgagggtgaaggagagcgagattcagtacctaaagcaagagatctcttcgttgaaggacgagttgcagaccgcattaagggacaaaaaatacgctagcgacaagtataaagatatctacaccgagctttccatcgctaaggccaaggcagactgtgacataagccgccttaaagaacaattaaaggcggcaaccgaggccctaggcgagaaaagtcccgacagcgccactgtcagcggctacgacatcatgaagagcaagtccaatcccgactttttaaagaaggaccgctcgtgcgtcactagacaactgaggaacatcaggtctaaatccttgaaggagggactgaccgtccaggagagactgaagcttttcgaatctcgagacctgaaaaaagattag

SEQ ID NO: 231623 - DNA, 3003 bp, Artificial Sequence
  Description of Artificial Sequence: Synthetic coding sequence
atgtcagcagcaaaagaaaacccatgccgcaaattccaggccaatattttcaataagtctaaatgtcagaattgcttcaagcccagagaatcacacttgttgaatgatgaggatcttactcaggctaaacctatttatggagggtggctgctcttagcacccgacggtaccgacttcgacaatcccgtacacaggtctaggaagtggcagcggaggtttttcattttgtatgagcacggactgctgcggtacgctctggacgagatgcctaccaccctgccacagggcacaataaacatgaatcagtgcacagatgtggtcgacggagaaggccgtacgggtcaaaaattctccttgtgcatcctgacccctgagaaggaacatttcattagagccgaaacaaaggaaatagtgtcaggatggctggaaatgctaatggtgtacccacgcaccaacaaacagaaccagaagaaaaaacggaaagtggaacctcctactccacaagagcctgggcctgcaaaagttgccgttacatcaagttctagtagctcgtccagcagcagtagcatcccaagcgctgaaaaagtgccgaccactaaatcgacactgtggcaggaggaaatgaggaccaaggatcagcccgatgggtcatctctcagcccagcacagtctccttctcagtcccaacccccagccgcatcttcgttgagagaaccaggcctcgaatctaaagaagaggagtccgcgatgtcatccgatagaatggactgtggtcgaaaagttcgcgtggagtccggatattttagcctggagaagaccaagcaggacctgaaggccgaagagcagcagcttccgccaccactctcacccccttcaccctccaccccgaatcatcgtaggagtcaggtgatcgaaaaattcgaggctctagacatagagaaggcagagcacatggaaactaatgctgtgggtcctagccccagctcagacacccgccagggacgttcagagaagagagcattccctcggaagcgacctgatctcctcaacttcaagaagggctggttaactaaacagtatgaagatggacagtggaaaaaacactggtttgtgttagcagaccagtctctgaggtactacagagactctgtagcggaggaagcagccgacctcgatggcgagatcgatctgtcagcctgttacgacgttacagaataccctgtgcaacggaactacggcttccagatccatactaaggagggcgagtttactcttagcgcgatgacctccggcattcgccgaaattggattcaaacaatcatgaagcatgttcatcccaccacagctcctgatgtgacctctagcctgccggaggagaaaaacaagtcatcttgcagctttgaaacttgtccaaggcctactgagaagcaggaagccgagctgggggagcccgatcccgagcagaaaaggtctcgcgctcgcgaacgaaggcgagaagggaggagtaaaacttttgattgggccgaattcagaccaatccaacaggctctagcacaagagagggtgggaggcgtgggtccagccgatacacatgagccactccgcccagaggcagagcccggagagttggaaagggagcgcgctcggcgaagagaggaaagacggaaacgctttggcatgctcgacgctacggacggcccagggaccgaagatgcggctctacggatggaagtagaccggtccccaggcctcccaatgtccgacctaaagacacataatgtgcatgtggaaatcgaacagcgctggcatcaagttgagacaactccccttcgcgaagaaaagcaggtacccatcgctcctgtccatctgtcaagtgaagacggcggagatcggcttagtacccatgaactcacttcactgctggaaaaagagctagagcagtcacagaaggaagcaagtgacctgctcgagcagaatcgcctgcttcaagatcagctcagagtggcactgggaagggagcaatctgctcgggagggttacgtgttgcaggcgacttgcgaaaggggtttcgccgctatggaggaaacacaccagaagaagatcgaagacttgcagagacagcatcagcgcgaactggaaaaactaagagaggagaaggatcgccttcttgccgaagagaccgccgcaacaatttccgctattgaggccatgaaaaacgcacaccgcgaggagatggagagggaacttgagaagtcccaaaggtctcagatctcatctgtgaacagcgacgtcgaggctctccggagacagtaccttgaagaactgcagtcggtgcagagggaactggaggtgctgtccgaacagtatagccagaaatgcttggagaacgctcacttggcgcaggccctggaggccgaacgccaggccctgcgtcaatgccagcgcgagaatcaggagcttaatgcgcataatcaggaacttaacaatcgcctggctgccgaaatcactcggctgcgcacactactgacgggcgatgggggtggggaagctacgggaagtcctctggcccagggaaaagacgcttacgagctcgaggtgctgttgagggtgaaagaaagcgaaatccagtacctcaagcaggagattagctcactgaaggatgaactccagaccgcactccgcgataagaagtacgcaagcgacaaatacaaagacatttacacagagctgtctatcgctaaagcgaaagccgattgtgacatttctagactcaaagagcagttaaaagctgccaccgaagcacttggggaaaagtcacctgactctgcaacagtaagcggctacgacatcatgaagtcgaaaagcaatcccgattttctgaagaaggacaggtcatgtgtaactagacaacttcgaaacatcaggtcaaagtcgctcaaggaaggccttacagtacaggaacggctgaaactgttcgaatcgcgggatttgaaaaaagattag

SEQ ID NO: 231624 - DNA, 795 bp, Artificial Sequence
  Description of Artificial Sequence: Synthetic coding sequence
atggagaactacgggatagagtggcattccgtccgggattcagagggacaaaaactcttgataggtgtcggcccagaaggtatcagcatctgtaaagatgacttctctcccattaatcgtattgcctatccagtggtgcagatggcaactcaaagcggtaagaacgtctacttgaccgtgacaaaggaatccggcaactccattgtgctgctgttcaagatgatttctaccagggcggcatctggcctctatcgagccatcacagaaacccatgccttctataggtgtgacacagtaacctctgccgtaatgatgcagtactcccgagatctcaaaggacacctggcctccctttttttgaacgaaaatataaacctcggcaagaagtacgtctttgatatcaaaagaacctccaaagaagtatacgaccatgctcgcagggccctgtataatgccggagtggttgacctggtgagtcgaaacaatcagtcccccagccactcacctctaaagagcagcgaatcctccatgaactgctcatcatgcgaaggtttgtcttgccagcagaccagagtgctgcaggaaaaactgaggaagctcaaggaagccatgctgtgtatggtgtgctgtgaggaggaaataaacagtactttttgtccatgtggtcatacggtgtgttgtgaatcatgcgcagcccagcttcagagctgtccagtctgtcgaagcagagtcgaacacgtccagcacgtgtaccttcccactcacacatctttacttaatctcacggttatctag

SEQ ID NO: 231625 - DNA, 1338 bp, Artificial Sequence
  Description of Artificial Sequence: Synthetic coding sequence
atgctctgctacgtaacgagaccagacgccgtgcttatggaggtggaggtcgaagctaaagcaaatggcgaagactgcctgaaccaagtgtgtcggagactggggataatagaggtcgactatttcggactacaattcactgggagcaaaggagagagtctgtggcttaacttacggaatcgcatctctcagcagatggacggcctggccccatatcgcctgaagctgcgggtgaagtttttcgtggagccacatcttattctccaagagcagactagacatatcttcttcttgcacataaaagaagctctcctggccggacacttgctatgctcccctgaacaggccgttgagctgtctgctttgctagcgcagaccaaatttggggattataaccagaacacagccaagtataattacgaggaactgtgcgccaaggaactgtcatccgcaaccctgaatagcattgtcgccaagcacaaagagttggaagggaccagccaggctagcgccgagtatcaggtccttcagatagtgagcgccatggagaattacggcattgaatggcacagcgtaagagactctgagggacagaagcttctaatcggagtggggccagagggtatttcaatctgtaaggatgacttctctccaattaacaggatagcctacccagtagttcaaatggcaacgcaatcaggaaagaatgtgtatctgactgttaccaaagaatctgggaattcaatcgtgttactgtttaaaatgattagcactcgtgctgcaagtggtttataccgcgcaatcacagaaacccacgccttctatcgctgcgataccgttacaagcgctgtgatgatgcagtatagtagggacttgaaaggacatctggccagcttgttcctaaatgaaaacatcaacctgggcaagaagtacgtgtttgacatcaagaggacttccaaggaagtgtatgatcacgctagacgggctttatataacgcaggtgtcgtggacctggtctccagaaataaccagtcaccatcccattcaccgcttaaatcatctgagtcaagcatgaactgctcttcctgtgaaggcctgtcttgccagcagacacgggtactacaggagaaactcaggaagctcaaagaagcaatgctgtgtatggtgtgctgcgaagaggagatcaacagcacgttctgcccctgtggtcacacagtgtgctgcgagagctgtgccgcacagttgcagtcttgtcccgtgtgccgtagcagagttgagcatgtgcaacacgtctacctccctacacatacctctctgctgaatctcacagtgatctag

SEQ ID NO: 231626 - DNA, 5486 bp, Artificial Sequence
  Description of Artificial Sequence: Synthetic coding sequence
atggccgcttccgagctgtatactaaattcgctagggtgtggatccctgacccagaagaggtctggaaatccgccgaactgctgaaagactacaagccgggagataaagtactgttgttgcatctggaggagggtaaagacctggaataccatctcgatcctaaaactaaggaactgccccacctgcggaaccccgacattctggttggcgaaaatgacctgaccgccctgagctacctgcacgagccggctgtcctgcataatctgcgggtccgctttatcgattcaaaactcatttatacgtattgtggtatcgtactcgttgccatcaatccctatgagcagctgccaatttacggggaggacattatcaatgcttatagcggccagaacatgggggatatggaccctcacatattcgctgtcgctgaggaagcctacaagcagatggctagggatgaacgaaatcagtccattatagtgagcggcgaaagcggggctggaaagactgtcagcgccaagtatgccatgcgctatttcgcaactgtcagcggttctgcaagcgaagcaaacgtggaagaaaaggtactggcgtctaaccccataatggaatccatcggtaacgcgaagacgacccgcaacgataactcaagccggttcgggaaatatatcgagatcggcttcgataaacgctacagaattataggagctaacatgaggacctacctgcttgagaaatctcgagtggtgtttcaggccgaagaggagaggaactaccacattttctaccagctgtgtgcctcggcgaaattgcccgaatttaagatgctcagactcgggaacgctgacaacttcaactacaccaagcaaggtggatcacctgtgattgaaggggtcgacgacgctaaggagatggcacacacgagacaggcttgtaccttactcggtatttctgaatcccaccagatgggaatcttccgaattctcgctggaattctccatctcggtaacgtggggttcacttcccgcgacgctgattcctgtacaatcccacctaagcacgaacccctgtgtattttctgcgaattaatgggggtcgactatgaagagatgtgtcattggttgtgccatcggaaactggcgacggccactgaaacctacatcaaaccaattagtaaattacaggccactaacgctcgcgacgctctggccaaacatatctacgcaaagttatttaactggatcgtggacaatgtgaaccaggcgttgcactccgccgtgaaacagcactctttcatcggcgtgctagatatttatggattcgagaccttcgagatcaactcattcgagcaattctgcatcaactacgcgaacgaaaagctccagcaacagttcaacatgcatgtgttcaagttagaacaagaggaatacatgaaagaacaaatcccctggaccttaattgacttttacgataaccagccttgtatcaacttgattgagtcgaagctgggaatcttggatcttcttgacgaggagtgtaagatgccaaagggcaccgatgacacatgggcgcagaagctctacaatacacacctcaacaagtgtgccctcttcgaaaagccgaggttatctaataaagcgttcataatccagcactttgctgataaagtggagtaccagtgtgaggggttcttggaaaaaaacaaagacaccgtgttcgaagaacaaatcaaagtgttgaagtcctcaaagttcaagatgctccctgaactgtttcaggatgatgaaaaggctatttctcctacttccgctacctccagcggtaggacacctcttacccgcacacccgctaagcctacaaagggccgacccggacaaatggccaaggagcacaagaagactgtgggccaccagtttcgtaactctctgcacctgctgatggagaccctgaatgccactacccctcactacgtacgctgtatcaagccaaacgactttaagttcccttttacctttgacgaaaagagggctgtgcaacagcttagggcctgcggtgtgctcgagactattaggatctccgccgctggctttccgagtaggtggacttatcaagagttcttttcgcgatatcgagtcctaatgaagcagaaagacgttctttccgatcgcaaacagacatgtaaaaacgtcctggagaagcttatcttagacaaagataagtatcagttcgggaagactaagatctttttccgtgccggtcaagtggcctatctggaaaaactgcgagctgacaaactgcgggctgcctgtatcaggatacagaagacaatccggggatggctgctccgaaaaaaatacctacgaatgcggaaagccgctataactatgcagcgttacgtacgcggttaccaggcaaggtgctatgcaaagtttctgcgtcgcactaaggccgcaacaataattcagaaatattggcgcatgtacgtggttaggagacggtacaagatacggagggccgcaaccatcgttttgcagagctaccttcggggatttctggccagaaatcgctataggaaaattctgcgggagcataaggcagtcatcattcagaaacgagtgagaggctggcttgcaagaacccactacaaacgatcaatgcatgccattatctatcttcaatgttgctttcggcgaatgatggcaaagcgggagctgaaaaaactaaagatagaggcaaggtcggttgagaggtacaagaagctccacatcggtatggagaataagattatgcagctgcagagaaaagtcgacgagcagaacaaggactataaatgcttggtggagaaactgaccaatctggagggaatctacaattccgaaactgagaagctccgaagtgaccttgagcgattacagctgagtgaagaggaagccaaagtcgccaccgggagagttctgtctttacaggaagaaatcgcaaagctgcggaaggacctcgaacagacccggtcggagaagaagtgtatcgaagaacatgccgatcggtacaagcaggagacggaacagctggtctccaaccttaaggaggagaacactctgctgaagcaggaaaaggaggccctgaatcacaggatagtacagcaggccaaggagatgacagagacaatggaaaaaaagctggttgaagaaactaagcagttggaactcgacctgaatgatgaacggctgagatatcagaatctgttgaatgagtttagtcgactggaggagaggtacgatgacctgaaggaagaaatgacactgatggttcatgtacccaagcccggacataagagaaccgactctactcactcgtcaaatgagtccgaatatatcttcagcagcgagattgctgagatggaggatatcccctcccgaacggaggaaccctccgaaaagaaggtcccattggatatgagccttttcctcaagctacaaaaacgcgtgacagaactggagcaggagaaacaggttatgcaagacgaactggaccgaaaagaggaacaggtgctgcgtagtaaagctaaggaggaagaaaggccacaaattcggggagccgagctagaatacgagtccctcaagcggcaagagctggaaagtgagaataaaaaacttaagaacgaactcaacgaactgagaaaagcactatcggagaagtctgctccagaggtgactgcaccaggcgcacccgcttaccgtgtgcttatggagcagctgacaagtgtctctgaggagctagatgttcggaaggaagaggttcttattttacgcagtcaactggtcagtcagaaagaggccatacagcctaaggacgacaagaatactatgacagacagtactatcctgctggaggatgtccaaaagatgaaagacaaaggcgaaatcgcccaggcatatatcgggcttaaggaaacgaacaggctgcttgaatcacagctgcagtcccagaaaaggtcccacgagaacgaagctgaagcactgcgcggagagattcagtctctgaaagaagagaacaaccggcagcaacagttgttggcccagaaccttcaattaccccctgaggctagaatcgaagcttcacttcagcacgagattaccaggctgaccaacgagaatcttgacctcatggagcaactggagaaacaggataaaacagtgcggaaattgaagaagcaactgaaggtcttcgccaaaaagatcggagaactcgaggttggacagatggaaaatatctcccctggccaaattatcgacgagcccatcaggcctgtaaacatccccagaaaagagaaggactttcaaggaatgttagaatataagaaggaagacgagcagaaacttgtaaaaaaccttattctggagctgaagcctcgcggtgtcgccgtaaatctcataccaggtctccccgcttacatcctctttatgtgcgtgcgtcacgctgattatctcaatgacgatcaaaaagtcagaagtctgctgacctcaactattaacagtattaagaaagtcctgaaaaaacggggtgacgacttcgagaccgtatctttttggttgagcaatacctgcaggtttctacattgccttaaacagtacagcggtgaggaggggttcatgaagcacaataccagtcgacagaatgaacattgcctgacgaatttcgatttggccgagtaccgacaggtactgagcgacctggcaattcagatctaccagcagcttgtgcgtgtgctggaaaacatcctgcagcctatgattgtcagcggcatgctagagcatgagactattcaaggggtatctggcgtgaagccaactggcttgagaaaacgaacaagcagcattgcggacgaaggaacctatactctagactccatactgcggcagctgaattcctttcatagcgttatgtgtcagcatggaatggatcccgagctgataaagcaggtggttaaacagatgttttacattatcggggctatcactctcaacaatctgcttcttaggaaggacatgtgttcctggagcaagggaatgcaaatccgctacaatgtatcccaactggaggaatggcttagggataaaaatttgatgaattcaggtgccaaagagacccttgaaccattaatccaagctgcgcagctgctccaggttaagaagaaaactgacgacgacgcagaagccatttgttcgatgtgcaatgccctgacgaccgcgcagattgttaaagtcctcaatttatacactcctgttaatgaatttgaggagagggtctctgtaagtttcatccgtactatacagatgcggctcagggaccgcaaagacagtccacagctactgatggacgccaagcatatcttccctgtcacctttccattcaaccccagcagtttggccctagagactatccagatccctgcttcccttggcctgggatttatctctagagtcta

SEQ ID NO: 231627 - DNA, 5642 bp, Artificial Sequence
  Description of Artificial Sequence: Synthetic coding sequence
atgaagagcagcagtctggagactatgtttgccagggtctggatccccgaccccgaggaggtctggaagagcgcggagctgctgaaggattataagcctggggacaaggtgctcttactgcacttagaggaaggtaaagacctagagtatcatctagatcccaagacgaaggaactaccgcatctcagaaatcctgacattctggtaggcgagaacgatttaacagccctgtcttatttgcatgagcccgctgtgctgcataacttacgcgtgcgatttattgatagtaagctgatatacacatactgtgggatcgtgctggttgccattaatccctatgaacagctgcctatttacggcgaagacattatcaacgcatacagtggccaaaacatgggagatatggacccacatatcttcgcagtggctgaggaagcctacaagcagatggctcgggacgaacgcaatcaatccattattgtctcaggcgagagcggagctggcaaaactgtctcagctaagtacgccatgcgatacttcgctaccgtttctgggtcggcctctgaagctaatgtcgaagaaaaagtgttagcttcaaaccccatcatggagagtattggtaatgccaagaccacccgaaatgacaattccagccgcttcggcaaatacatcgagatcgggttcgacaagcgatacaggatcatcggtgccaacatgagaacttatctcctggagaagagtagagttgtgtttcaggccgaggaggaaagaaactatcacatattttatcagctttgcgcttccgcaaagcttcccgaatttaagatgctgcgcctgggcaatgccgacaacttcaactacaccaagcaagggggttctcctgtgatcgagggtgtggacgacgcaaaggagatggcccacacaaggcaggcttgcaccctcctgggcataagcgaatcacatcagatggggatatttcgaattttggctggcatccttcatttgggcaacgttggattcacaagccgagacgccgacagctgtaccattccccctaaacatgagcccctatgtatcttttgcgaactcatgggggtcgattacgaggaaatgtgtcactggctttgccacaggaagcttgccacagccacagagacctacattaaaccaatatctaaattacaggccacaaacgctagagatgctctcgctaagcatatctacgccaagctattcaactggatcgtcgataacgtcaaccaggctctgcacagcgctgtaaagcagcacagctttataggagtgctggatatctatggtttcgaaacatttgagattaattccttcgaacagttctgcatcaattacgcaaacgagaagctgcagcagcaatttaacatgcacgtctttaagctggaacaggaagagtacatgaaggaacagatcccatggactctaatcgatttctacgacaaccagccttgcataaatctgatcgagagtaagttgggcatactggacttgcttgatgaggagtgtaagatgccgaaaggaaccgacgatacttgggcccaaaaactgtataatacccatctcaataagtgcgccttgtttgagaaacctcgtctctctaataaagccttcatcattcagcacttcgcagataaggtagaataccaatgtgagggatttctcgagaagaataaggatacagtctttgaagaacaaatcaaggtgctgaagtcctctaagtttaagatgctacctgagctgtttcaagacgacgaaaaggcaatctcaccaactagtgcaacgtccagcggacggactccattgacacgaacaccagctaaacccacaaaaggacgtccgggacaaatggccaaggaacataaaaagactgttggccaccagttccgaaattccctacacctgctgatggaaactctaaacgctactacaccacattacgtgaggtgcataaaaccaaacgacttcaagttcccctttacatttgatgagaagcgggcagtgcagcaactacgtgcttgtggcgtgctagagactatcaggatctccgccgctggtttcccatcacggtggacttatcaggaatttttcagccgctatcgggtgcttatgaagcagaaagacgttctaagcgatcgtaagcagacttgcaaaaatgttcttgagaagctgattctggataaggataagtaccaattcgggaagacaaagatcttttttagggccggacaggtggcttatctggagaaactgcgggcagacaagctgagggcagcatgcattagaatccagaaaaccattagggggtggcttctaagaaagaaatacctacggatgcgcaaggcagcaattactatgcagcggtatgtgaggggttatcaggcacgctgctacgctaaattcctcagacggaccaaagccgctactatcattcagaagtactggcgtatgtacgttgtgagacgcagatacaaaattcgtagggcggcaacgatcgtgctacagtcgtatttgcggggtttcctggccaggaacaggtaccgaaagatcctccgcgagcataaggcggtgattatacagaagcgcgtcagaggatggttggctaggactcattataaacgaagcatgcacgccatcatatacctgcagtgttgctttagaagaatgatggcgaaaagagagttgaagaaactgaagattgaagctcgatccgtggaacggtacaagaagctccatattggcatggagaataaaataatgcaactgcagaggaaggtagacgaacagaataaagactacaagtgcctggttgagaagctgaccaacttggaaggcatatacaatagcgagacagaaaagctgcgtagcgatttagaacggctgcagctaagtgaggaagaggccaaagtagccaccgggagagtgctgtccctgcaggaagagatcgcgaagcttcgcaaggatctggagcagactaggtctgaaaaaaagtgcatcgaagagcatgccgatagatataaacaggaaacagaacaactagtcagcaacctgaaggaggagaataccctgttaaagcaagagaaggaagcacttaaccacagaattgtgcagcaggctaaggagatgacggaaacgatggagaagaagttggtggaagaaacaaagcagttggaactcgatctgaatgatgagcgtttgcggtaccagaatctattgaatgagttctcgcgcctagaagagaggtacgacgacctgaaggaagagatgacgctgatggtgcacgtccccaagcctggccacaagagaacagacagcacccacagctcgaacgaatcggagtatatcttctccagtgaaattgccgagatggaggacattcctagtagaaccgaggagccctctgagaaaaaagtccccttggacatgagtctgttccttaaattacagaagcgagtgacggagctcgagcaggaaaaacaagtgatgcaggatgagcttgatcggaaggaggaacaagtgttgcgctctaaggctaaagaagaagagagaccccagattagaggggctgagctggagtacgagtctctaaagcgccaggagctcgaatctgagaataagaagctgaagaatgaactcaacgaattgaggaaggccttaagtgagaaaagcgcccctgaggttacagcccctggagcacccgcatatagggtgctcatggagcaactcacttccgtgtccgaagaactggatgttcgcaaagaagaagtgctgatactgaggtctcagttagtatctcaaaaggaggcaatacagcccaaactccacgaaaacactatgacggactcgactatactgctggaagatgttcagaagatgaaggacaaaggtgagatcgcacaggcttacatcggcttaaaggagaccaaccggtctagcgctctggactaccatgagctaaatgaagatggggagctgtggcttgtgtatgaaggactcaagcaggccaacagactcttggagtcacagttgcagtcacagaaaagatcccacgagaatgaagctgaggccttacgcggagaaattcagtcactcaaggaagaaaataacagacaacaacagctcttggcccaaaatcttcagctgcctccagaagccaggattgaagctagtcttcagcacgaaattacaagacttactaacgagaacctgtatttcgaggaactctatgcggacgatcccaaaaagtaccaatcatatcgaatttctctgtacaaacgcatgatcgacttgatggagcaactggaaaaacaggacaagactgtgaggaaacttaagaagcaacttaaggtttttgccaagaagattggcgagctggaggtgggacagatggaaaacatttcgcccggacagatcatcgatgaacctattcggcctgtcaatatcccccgaaaggaaaaggactttcagggcatgctggaatacaaaaaggaagacgaacagaagctggtcaaaaacctgatcctcgaactgaagccacgcggagttgctgtgaatctgatcccagggcttcccgcttacattctgttcatgtgtgtgagacacgctgactacctcaatgatgatcaaaaggtccggtcactgttgaccagtaccataaactccattaaaaaggtactgaagaagcgcggtgacgattttgaaacggtgtctttctggttgagcaatacttgccgtttcctgcactgtctcaagcagtactctggagaggaagggttcatgaaacataacacatcccgccagaatgagcactgtctaacgaactttgacctagcggaatataggcaggtcctctcggacttggcaattcagatctaccaacagctggtgagagtcctggagaatattctacagccgatgatcgtctctgggatgttggagcacgaaaccattcagggagtgtccggcgtgaagcctacaggtctcagaaaaagaacgtctagtatagccgatgaaggtacatatacattggactccattttgcgtcagctgaattccttccacagtgtgatgtgccagcatgggatggatccagaactcattaagcaagttgtgaaacagatgttctatattataggtgctataaccctaaacaacctgctgctccgcaaggatatgtgtagttggtcaaagggaatgcaaatcagatacaacgttagccaactggaggagtggctgagggataagaacttgatgaattcaggcgcaaaggaaaccttggagccattgatccaagctgcacagttactgcaggtcaagaaaaaaaccgacgacgatgctgaagcaatctgctcgatgtgcaacgccctaaccaccgcacagatcgtgaaggtcttgaacttgtacactccagtgaatgagttcgaggaacgggtgtcagtcagcttcattagaactatccagatgcgactccgtgaccggaaagactccccacagctgttgatggatgccaaacacatcttcccagtcacgtttccatttaacccttcgtcccttgccttagagactatccaaatacccgcttccctgggcctcgggtttattagccgtgtgta

SEQ ID NO: 231628 - DNA, 4089 bp, Artificial Sequence
  Description of Artificial Sequence: Synthetic coding sequence
atgcacgtttttaaattggagcaagaagagtacatgaaagaacagatcccatggacactgatcgatttctatgacaaccagccctgtataaacttgattgagagcaaacttggaatactagatctgttagatgaagaatgtaaaatgcctaaggggacggacgacacctgggctcaaaagctctacaatactcacctgaataagtgcgcattattcgaaaagccgaggctgtctaataaggcgtttattatccagcattttgccgacaaggtggagtaccaatgcgaaggctttttagagaagaacaaggacaccgtgtttgaggagcagattaaggtgttgaagagctctaaatttaaaatgctgcccgagttgttccaagatgacgagaaggcaattagccccactagcgccacttcttccggtaggaccccgctgactagaacccccgcaaagcctaccaagggccgtccagggcagatggccaaagaacacaaaaagaccgttggacaccagttcagaaattccctccatttgctgatggagaccctgaatgctaccacaccacattatgtccgctgtatcaaacctaatgatttcaaattcccattcaccttcgatgagaagcgggcagtgcagcagctcagagcgtgcggagtactggagaccatacgaattagcgccgctggcttcccgagtcgttggacataccaggaatttttcagtcggtaccgcgtcttaatgaaacagaaggacgtgctgtcagacaggaaacagacgtgcaaaaatgttctggagaagctcattcttgataaagataaatatcagttcgggaaaacgaagatcttttttagagcaggccaggttgcttatctggaaaagttacgggctgacaaactccgggctgcctgtatcagaatccagaagactataaggggatggttgttacgtaagaaatacctgcggatgcggaaagccgcaattacaatgcagaggtatgtaaggggataccaggcacggtgctacgctaaattcctcagacggaccaaagctgcgactattatccagaagtactggaggatgtatgtggtcaggcggcgttataaaatccgcagagctgccacaatcgtgttgcagagctatttgcgcggattcttggcaagaaaccgctatcgaaaaatcctgagagagcataaggctgtcattatacagaaacgcgtgagagggtggcttgctcgcactcactataaaaggtctatgcatgccattatctatctgcagtgttgcttcaggcgaatgatggcaaagcgagagctgaagaagctgaagattgaagctcgcagcgtggaacgctataaaaagcttcacattgggatggagaacaagattatgcagctgcagcgcaaggtcgatgaacagaataaggattataagtgcctggtcgagaagctgactaacctggaagggatttacaacagtgagaccgagaaactcaggtctgatttggagagactgcagctttctgaagaagaggcaaaggtggccacaggtagagttctgagcctccaggaggagatcgccaaacttaggaaagatctagaacagacccggtccgaaaagaaatgtatcgaggagcatgcagatagatacaaacaagagacagagcagctcgtcagcaatctaaaagaggaaaacactctcttaaagcaggagaaggaggctctgaaccaccgaatcgtccagcaagccaaagagatgacggaaaccatggagaaaaagctggtggaagagactaagcagctggagttagatttgaacgacgagcgcctccggtatcagaacctgttaaatgagttctctagattagaagagcgctatgatgacctgaaggaagagatgacacttatggttcatgtgcctaagcctgggcataagcggacagatagcacacacagctctaatgagagcgaatatattttctcatctgaaattgccgagatggaggatattccatctagaaccgaagagccatctgagaagaaggtccctctggacatgtccctcttccttaagctccagaagagagttaccgagctcgagcaggagaagcaggtcatgcaggacgaactcgatcgaaaagaggaacaggtgctgcgctcaaaagctaaggaagaagaacggcctcagatcaggggggcagaactggaatatgagtccctcaaacggcaggagctggagagtgagaataagaagctgaaaaatgagctgaatgagctgcggaaggcgcttagcgagaagtcagctcccgaggttaccgcccctggcgctccagcatacagggttctcatggaacagttaacctctgtgagcgaagagctggacgttagaaaggaagaagtgttgatcctccgctctcagcttgtgtctcagaaggaggctattcaacccaaggatgacaagaataccatgacggatagtactatcttactggaggacgtccaaaaaatgaaagacaaaggggaaatcgcccaggcctatattggccttaaagaaacaaatcgactgctggagtctcaactccagagtcagaagaggtcacatgagaacgaggctgaggctctcagaggggaaatccagtccctgaaagaagagaataaccgccagcagcagctgctcgctcaaaatttgcaactaccacccgaagcccgaattgaggcctccctgcagcatgagatcacccgccttaccaacgagaatctggatctgatggaacagctcgagaaacaagacaaaaccgtgcgcaaactgaagaaacaactaaaggtctttgccaaaaaaattggagagctggaggtcggacagatggagaatataagtcctggccagatcattgatgaacccattcgtccggtgaatattcctcggaaggaaaaagattttcaggggatgttagaatataagaaggaggacgaacagaagttggtgaagaatctcatcctcgaactcaagccaaggggtgtggccgtcaacttgatccctgggttaccagcttatattctcttcatgtgtgtaagacacgcagactatttgaacgacgaccagaaggtccgctctctgttgacgtcaacaatcaactccataaaaaaagtgctcaagaagcggggtgatgatttcgaaacagtctcgttctggctgtcaaacacatgcagattccttcactgtctgaagcaatacagcggggaagagggcttcatgaagcacaacacttcgcggcaaaacgagcattgcctgaccaactttgatttggccgagtatcgccaggtgttgagcgacttggccattcaaatctaccagcaactcgtgagagtattggagaacattctacaacctatgattgtaagcgggatgctcgagcacgagacaattcagggagtttcaggagtcaagcccacaggactaaggaagcgtacttcttccatagctgacgagggaacatacaccttagactccatcctacgtcagctcaacagttttcatagcgtgatgtgccagcacgggatggatcccgagctgatcaagcaggtcgtgaaacagatgttctacattatcggtgctatcacccttaacaacttgttgctgcggaaggatatgtgttcttggtccaaagggatgcagattaggtacaacgtttctcagcttgaagagtggctacgcgataagaacctgatgaattcaggggctaaagagaccctggagcctctgattcaggctgcgcagctgttgcaggtcaaaaagaaaactgacgatgatgccgaggccatatgttctatgtgcaacgctttaactaccgcacagatcgtgaaggtactgaacttgtatacccccgtgaacgagttcgaagagagggtttcggtatcgttcataaggactatacagatgcggctccgagatcgaaaggactcacctcaactgttaatggatgccaagcatatcttccccgtcacattcccgttcaatcctagctccctagctctggagactattcagattcccgctagcctcgggctgggtttcattagcagagtatag

SEQ ID NO: 231629 - DNA, 5567 bp, Artificial Sequence
  Description of Artificial Sequence: Synthetic coding sequence
atggctgcctcagaactctacaccaagtttgctcgcgtatggatccctgaccccgaggaagtgtggaagtctgctgagctgctgaaggactacaagcccggtgataaagtcctgctgctgcacttggaggagggcaaggatctcgaataccacctcgatcccaagaccaaagaactccctcacctgagaaaccctgatatactggttggggaaaacgacctgaccgccctcagttatctgcatgaacccgctgttctgcacaaccttcgggtgcggttcattgatagtaaactgatttatacatactgtggcatagtgctagtggccatcaatccatatgaacagctgccaatttacggtgaagacattattaacgcctattcaggccaaaacatgggagacatggatccccacatctttgcggtagctgaggaagcatataaacagatggctcgcgacgaacgcaatcagtccattatagtgagcggggaatccggcgctggtaaaactgtgagtgctaagtacgccatgaggtatttcgccacagtgagcggaagtgcttccgaggctaatgtggaggagaaagtcctcgcatctaaccctataatggagtccatcggcaatgccaagaccacgagaaacgacaattcttccaggtttggaaagtacatcgaaatcggcttcgataagcggtaccggattattggagcgaatatgagaacctatttgcttgagaaatcccgggtcgtgttccaggccgaagaggaaagaaattaccacattttttaccagctctgtgccagcgcgaaattgcccgaatttaagatgctcaggttagggaatgccgacaatttcaactataccaagcaggggggaagccctgtcatcgagggggtggatgatgcaaaggaaatggcacacacccgccaagcgtgtacactcctgggtattagcgagagtcatcagatgggaatctttcgaattcttgctggtatactacatctgggaaacgtaggcttcacatcacgcgatgctgattcttgcactatacctccgaagcatgaacctctctgcattttttgcgagctgatgggagtggattacgaggagatgtgccactggttgtgccaccggaagctggccactgccacagaaacttatattaaaccaatatccaaactccaagctactaatgctagggacgctctcgcaaagcacatctacgccaagctgtttaattggattgtggacaacgtcaaccaggcccttcactccgccgtcaagcagcacagttttatcggtgtgttggacatatacggcttcgagaccttcgagatcaatagtttcgaacagttctgtatcaattacgctaacgagaaactgcagcaacaatttaatatgcacgtttttaaattggaacaggaggagtatatgaaggaacagattccttggaccctgatcgacttttacgacaatcaaccctgtatcaacctgatagaatctaagctcggaatcctggatttgcttgacgaggagtgtaagatgccaaaaggaactgatgacacctgggctcagaagctctataatacccatctgaataaatgcgctttattcgagaaacccagactgtctaacaaagcgttcattatccagcatttcgctgacaaagttgagtatcaatgtgaaggatttcttgaaaagaacaaggacaccgtgtttgaggaacagattaaggtgttgaaatctagcaagtttaaaatgctgcccgaactctttcaggacgacgagaaagctatttcccccacaagtgccacaagttccggcaggacacctctcaccagaactcccgctaaaccaacgaaagggaggcctggccaaatggcaaaggagcataagaagacggtgggccaccagttcaggaactcccttcatctgttgatggagaccctcaacgccacgactccccactacgtccgatgcatcaagcctaacgatttcaagttcccatttacgtttgatgaaaagagggcagtacagcagctccgtgcgtgcggagtgctggaaactatcagaatctcagcagcagggtttccgagccgctggacctatcaagaattcttttcacgatatcgtgtgctgatgaagcagaaggatgtgctgtccgatcgaaagcagacatgtaaaaacgtcttggaaaagttgattctcgataaggataaatatcaattcggcaagaccaagatctttttccgtgccggacaagtggcttacctggagaagctacgtgcagacaaattaagagctgcctgcataagaatccaaaaaacaattcgcggttggcttctccgaaagaaatatctgaggatgcgaaaggcagcgatcacaatgcagcgctatgtgagggggtaccaggctcggtgctatgctaagtttcttaggcgaacaaaagccgcaaccatcatccagaaatattggagaatgtacgtggtacgcagacgctataagatccgacgcgctgcaaccatagtcttacagtcttacctaaggggatttctcgccagaaatagataccgcaagattctgcgagagcacaaagctgtaataattcagaaaagagtgcgtgggtggcttgccagaacacactataagaggagcatgcacgcaattatttatctgcagtgctgcttccgcagaatgatggcaaaaagggagttgaaaaaactgaagatcgaagctcgcagtgtggaaagatacaaaaaactgcacattggcatggaaaacaaaattatgcagctgcagaggaaagtagacgaacagaacaaggattacaaatgcctggtagaaaaattaacgaatctcgaggggatttataatagtgaaaccgaaaagcttcggtccgatctggaacggttgcagctgtcggaggaggaagccaaggtggccactggaagggtgctgagtcttcaagaggaaatagcgaaactgcgtaaagacctggaacaaacaaggtcagagaagaagtgcattgaggaacatgcagaccggtataagcaagagacagaacagctcgtgtccaatctaaaggaggaaaacacccttctcaaacaggagaaggaggctctgaatcaccgtatcgtgcaacaagctaaagaaatgacagaaacgatggaaaagaaactcgtggaagagaccaagcagttagagcttgatctcaacgacgaacgactgagataccagaatcttctcaacgaattttccagacttgaggagagatacgacgacctgaaagaggagatgaccttgatggtccatgttcctaagcctggtcataaacgcacggacagcacccactcatccaatgaatcggagtatatatttagcagtgaaatagccgagatggaagatattcctagccggactgaggagccctctgaaaaaaaggtgcccctagatatgagcttattccttaagctgcaaaagcgggtcactgaactcgaacaggaaaagcaagtcatgcaagatgagctggatcgaaaggaggagcaggtcctccggtcaaaagcaaaggaggaggagaggccccagattagaggcgctgagctcgaatatgagtcactgaagcgtcaagaactagagtcagaaaacaaaaaactcaaaaacgagctgaacgagctgagaaaagcattaagcgagaagagtgcaccagaagtgacagcccctggagcacctgcctatagagtgctaatggagcaactgacctctgtctccgaggagcttgatgtgagaaaggaagaggtgttgatccttcgttcccagctcgtgtcccagaaagaggccattcagcctaaggacgataaaaacaccatgaccgacagcaccatactcctcgaagatgttcagaaaatgaaggacaaaggcgaaatcgcccaggcctacattgggctgaaggaaacgaacaggagttccgccttggactaccatgagctgaatgaggacggtgagctctggttggtatatgaaggactcaaacaggcgaacagattgctggagtcacagctgcagtcgcagaagagaagccacgagaatgaagctgaagccttgcggggagaaattcagagtttaaaggaagagaacaaccgccagcagcaactgctcgcccaaaaccttcagttaccccctgaagctagaatcgaggccagtttgcagcacgagataactagattaaccaatgagaaccttgacctgatggaacagctggagaagcaggacaagacagttcgcaaactgaaaaaacaactgaaagtctttgcaaagaaaattggtgagcttgaagtcggacagatggaaaatatttcacctggtcagatcatcgacgaaccgatccgccctgtcaacataccacggaaagagaaggacttccaggggatgctcgaatacaagaaggaagacgagcagaaactggtgaagaacctcattctggaactcaagccaagaggggtggctgtgaacctgatccccggtctccctgcttacatcctgttcatgtgtgtacgacatgcggattatctcaacgacgatcagaaggttagatcccttctcacctctactattaacagtattaagaaagtgctcaagaagcggggagacgacttcgagacagtcagcttttggttatctaatacttgtcggtttttacactgtctgaaacagtactctggagaagagggatttatgaagcataacacctccagacaaaacgagcactgtttgactaattttgacctggctgagtacagacaggtgcttagcgacctggccatccaaatatatcagcagctggtacgggtcctggaaaacattctgcaacccatgattgtctcaggcatgctagagcatgagactattcagggagtgagcggcgtgaagccaacaggactgcggaaacggacgagttctatagcagatgaagggacttatacactggacagtatcctgcggcaacttaacagctttcattcggtgatgtgtcagcacggaatggaccctgaactgattaagcaagtggtgaagcagatgttctatataatcggggctatcactctcaacaatctgctcctccgcaaggacatgtgcagctggtcaaagggcatgcagattcgctacaacgtttcccagttggaggagtggctgagggacaaaaacctgatgaatagcggggcaaaagaaacccttgaaccgctcatccaggcagctcagctcctacaggtgaagaagaaaacggatgatgacgcggaagcgatttgctccatgtgcaacgccttgactacagctcagattgtgaaggttttaaacctgtatacgcccgtgaacgagttcgaagagcgcgtgagcgtaagttttatacgtactatccagatgaggttgagagatagaaaggactctccacagctgctcatggacgccaaacacatattccccgtgacctttccatttaatccctcctccttggctcttgaaacaatccagatccctgccagtctcggtctgggtttcatcagccgtgtcta

SEQ ID NO: 231630 - DNA, 5558 bp, Artificial Sequence
  Description of Artificial Sequence: Synthetic coding sequence
atggctgcctctgagctgtacaccaaatttgctagggtttggattcctgatccagaggaagtctggaagtctgctgagctgctgaaggattacaagcccggagataaagtactgctcctccacttggaggaaggcaaagacctggaatatcatctcgatccaaagacgaaggaactgcctcatctgaggaatccagacattctggttggcgaaaatgatctgaccgcactaagctacttacatgaacctgccgttctgcacaacttacgcgtgcggtttattgatagcaaattaatttatacctactgcgggatcgtcctggtggccataaacccttatgaacaactcccaatatatggcgaagacatcatcaatgcctacagtgggcaaaatatgggggacatggaccctcatatttttgcagtcgctgaagaggcctacaagcagatggccagggatgagaggaatcaatcgatcattgtgagcggtgaatcaggcgcaggcaaaacggtctcagctaagtacgcaatgcgttacttcgcgactgtgagcggaagcgccagtgaagcgaacgtggaggaaaaggtgctagcaagcaatcccatcatggagtcaataggcaacgctaagactactagaaatgacaatagcagccgctttggtaagtacatcgagattggtttcgacaagcgatatcgaatcataggagcaaatatgagaacctacttgttggaaaagagcagagtagtgtttcaggctgaagaagagagaaattatcacattttttaccaactgtgcgcctctgcgaaactgcccgagttcaaaatgttgcgcctaggtaatgcagacaatttcaactatactaagcagggaggttctcccgtgatcgaaggcgttgacgacgcaaaggaaatggctcatacacgccaggcttgcactctgctaggcatctcagaaagccaccagatggggatcttccggatcctcgccggaatcctgcacctggggaacgtcggatttacctcccgtgacgctgattcatgcaccatcccacctaaacacgagccactgtgtattttttgcgagctgatgggggtcgattatgaggaaatgtgtcactggctctgtcatcggaaactagcaacagccactgagacgtacataaaacccatcagcaagctgcaggctactaacgcaagagacgctctggcaaagcatatctacgccaagctcttcaattggattgtggataatgtgaaccaggcacttcacagcgcagtcaaacagcattcttttatcggagtcctcgacatctatggatttgaaacctttgaaataaactcgttcgagcagttttgtatcaattacgcaaacgagaagctccaacagcagttcaacatgcacgtgtttaaactggaacaggaggaatatatgaaagagcagattccgtggaccctgatagacttttatgacaaccaaccatgtataaatctgatcgagtccaaactaggcattctggatttgctcgatgaagaatgcaagatgcctaagggaacagatgatacatgggctcaaaagctttacaatacgcacctcaacaagtgcgccctgttcgagaaacccaggttgtccaataaggcatttataatacagcacttcgcggacaaagtggagtaccaatgtgaggggttcctcgagaagaacaaagacaccgtatttgaggaacagatcaaagtgcttaaatcatccaaattcaagatgctgcccgaactcttccaggatgatgagaaggctattagcccgaccagtgccacttctagcggtcgcacacctctgacaaggactcctgccaagccgaccaaggggagaccaggacagatggcaaaagagcacaaaaaaactgtgggtcatcaatttcggaatagtctgcaccttctgatggaaacccttaatgcaactacaccacattatgtgcgctgcattaagcccaatgactttaaatttcctttcacttttgacgaaaaacgggcagtacagcagctccgtgcctgcggggtgctggaaacgattaggatctccgcagcagggtttccttctagatggacttatcaggaatttttttccagatatagggtgctgatgaaacagaaggatgtgctgtcagatcgaaagcagacgtgtaagaacgtgctggagaaattgatcctggataaggataaatatcagttcggaaagactaagattttttttagggctggccaagtggcttacctggagaagctgcgcgctgacaagttgcgggcagcctgcattcggatccaaaaaaccattcgaggttggctgctgcgaaaaaagtaccttaggatgaggaaggctgctattaccatgcaacgctatgtgagaggttaccaggcgaggtgctacgccaagttccttcgaaggaccaaagccgctaccataatccagaagtattggaggatgtacgtcgtccggaggaggtataagataaggcgagccgctaccatcgtgctgcagtcttatttgcgaggttttctggccagaaatagatacaggaagattctacgagaacacaaggctgtgatcatccagaagcgcgttagaggctggctggccaggacacattataagaggagcatgcatgcaatcatctacctgcagtgttgttttaggcgcatgatggctaaacgcgagttgaaaaagctcaagatcgaggctaggagtgtggagaggtacaagaaactccatatcggcatggagaacaaaataatgcagctacaacggaaggtggatgaacaaaacaaggactataaatgtcttgtggaaaaactgacaaatctcgagggaatatacaattccgagaccgagaagctcagaagcgatttggagcgactgcagctctccgaggaggaggccaaggtcgctacagggcgagtcctgtctctgcaggaggaaattgccaagttacgaaaagacctcgaacagacaagatcggaaaagaaatgcatagaggagcacgctgaccgctacaaacaggagaccgagcagttggttagcaatctcaaagaggagaatactctcctgaagcaggagaaggaggccctcaaccacaggattgtgcagcaggcaaaagaaatgaccgaaacaatggaaaagaagctagtggaggaaaccaagcagctggaactcgatcttaatgatgagcgcttacgataccagaatctcttgaatgagtttagcagattggaggaacgatacgatgacctgaaggaagaaatgactctcatggttcacgtgccgaagcccggacataagcgcacagattcaacccactctagcaatgagagcgagtatattttttcctccgagatagctgaaatggaggacattccttctaggaccgaggaaccctcagaaaaaaaagtgcccctggacatgagcctcttcctgaagctgcagaaacgcgtgacagaactggagcaggaaaagcaggtgatgcaggacgaactcgaccggaaggaggagcaagtcctgcgatccaaagctaaagaagaagaacgccctcaaattcggggtgccgagctcgaatacgagtccctgaaaagacaggagctggagtcagagaacaagaagttaaaaaatgagcttaatgagctgcgcaaggccctaagcgagaaaagcgcccctgaagtgacggcccctggggctcctgcttatcgcgtgctgatggagcagctgacctcagtttcggaggaattagatgtaaggaaagaggaggtactaatcctgcggtcgcagttggtatcacagaaggaggccattcaacccaaaaataccatgactgattccacaatcttactggaggatgtgcagaaaatgaaagacaaaggcgaaatcgcccaggcctatataggcttgaaagaaaccaacagatccagcgccctggactatcatgagctgaatgaagacggcgagctgtggctggtttacgagggactcaagcaggcaaacaggcttctcgagtcccagctccaatcccagaagcgcagccacgagaacgaagctgaagccctgagaggcgagattcagtccctgaaagaagagaacaaccgacagcagcagctgctggcgcagaatttacagttaccccctgaagccaggatcgaggctagcctgcagcatgagattacccgtctcaccaatgagaatcttgatctgatggaacagctggagaaacaggataagactgttcgtaagctgaaaaagcaattgaaggtctttgctaaaaaaataggcgaattagaggtgggccagatggagaatatttcacctgggcaaataatcgacgagccaattcgcccagtcaacattccccgaaaggaaaaggatttccagggcatgctcgaatataagaaggaggacgagcaaaaactcgttaagaatctgattttagaactgaaacccaggggtgtggccgtaaatcttatccctggactccccgcatacatcctgttcatgtgcgtgcgccacgctgattacctgaacgatgaccagaaagtgcggagcttgctgacatccactatcaatagcattaaaaaggtgctgaagaagcgcggagatgatttcgagacggttagcttttggctcagcaacacttgtcggtttctacactgcttgaagcagtacagtggcgaagagggatttatgaaacataatactagccgacaaaacgaacattgtctgaccaacttcgacctggccgaataccgccaggtgttgtccgacttggccattcagatataccagcagcttgtgcgagtcctggagaacatcctgcagccaatgatcgtgagtggtatgctggaacacgagacgattcagggtgtatcgggggttaaacccaccgggctgcggaaaaggacctcttcaatcgccgacgaggggacctacaccctagattctatccttcgtcagctgaacagctttcactccgtgatgtgccaacatgggatggatcctgagctgattaaacaggtagtcaagcagatgttttacattataggggcaataaccctgaacaatctgttactgagaaaagacatgtgctcctggtcgaaaggcatgcagattcggtacaatgtgagccaactggaagagtggctgcgggacaagaacctgatgaattctggggctaaggagacattggagccacttatccaagccgcacagctgctgcaagtgaaaaagaaaacagacgatgacgccgaagctatctgcagtatgtgtaatgcactgacgactgcccagatcgtgaaagttctgaacttgtacaccccagtgaacgagtttgaagaaagggtgtccgtgagcttcataagaacgatccagatgcgcctacgcgaccgtaaggacagtccccagttgctgatggatgcaaagcatattttccccgttacgttccctttcaacccctcaagtctggctctcgagacaattcaaatccccgcaagcctagggctgggcttcatctcccgcgtgta

SEQ ID NO: 231631 - DNA, 4376 bp, Artificial Sequence
  Description of Artificial Sequence: Synthetic coding sequence
atgtgtcactggttatgccataggaaactcgccaccgccacggagacctacatcaaaccgatttctaaattgcaagccacgaatgcaagagatgcactggccaaacacatctacgccaaactattcaattggattgtggataatgtaaaccaagccttgcactctgcggtgaagcagcatagcttcatcggggttctcgatatctatggatttgagacgttcgagattaactccttcgagcaattctgcataaattatgcaaatgagaagctccagcagcagttcaacatgcacgtattcaagttagagcaagaagagtacatgaaagaacaaatcccttggacactgattgacttttatgacaaccaaccatgtataaacctaatcgaatccaaactgggcattttagatctgctcgatgaagaatgcaagatgcctaaaggcacagacgatacatgggcacagaaactctataatacacatctcaacaaatgcgctctctttgaaaagcccaggctgagtaacaaagccttcatcatccagcattttgcggacaaagtagagtatcagtgtgaaggtttccttgagaagaataaggataccgtgttcgaagaacaaatcaaagtgctgaagtcttcaaagtttaagatgttgcctgagctctttcaggatgacgaaaaggccatatcaccaactagtgccactagcagtggccgaactccactgacaaggacccccgctaagccgacaaaggggcgtcctggtcagatggcgaaagagcataagaagacggtcggccaccagttcaggaattccttgcatctgctcatggagaccctgaatgccactaccccacattacgtgagatgcatcaaacccaacgacttcaaattcccctttacattcgacgaaaagcgagctgtccagcagttgagagcctgcggggtactggagaccatacggatctcggcggcaggattcccttcccggtggacatatcaagaattcttctcccggtacagggttctgatgaaacagaaggatgttctgagtgatagaaaacagacatgtaagaatgtactggagaagctaattttggataaagataaatatcagttcggcaagacaaagattttctttcgcgctggacaggttgcgtatctggaaaaattgcgagctgacaaactcagagcagcctgtatccgaatccagaagactatcagagggtggctgctacggaaaaaatacttgcgcatgcggaaagccgcaatcaccatgcaacgatacgtgagaggctaccaagctcgatgctacgccaaatttctcagacggacaaaggcagcaaccattattcagaagtactggcgcatgtacgtcgtacggagacggtataagatccgacgggcagcaactatcgtgcttcagtcatacctgcgcggattcctagcccgaaataggtatagaaagatcttgagggagcataaagccgtcattatccagaaaagggtccggggttggcttgccaggacacactataagagatccatgcatgccattatatacctgcagtgttgcttccgacgaatgatggcaaagagagaactgaaaaagctgaagatagaggcgagaagtgtggagcgctacaaaaaactgcacatcggtatggagaataagataatgcagctgcaacggaaagtggatgaacagaataaggattataagtgtctagtcgaaaagctgacgaacttggagggaatttacaactctgagacagaaaagctccggtccgacctggagcgactgcagctgagcgaggaggaagctaaagtggccactggtagggttcttagtctgcaggaagagattgccaagctgaggaaggatttggagcagacccggtctgagaagaagtgcattgaagaacacgcagacagatataagcaggagactgagcagctagtctctaacctgaaggaagaaaacaccctgctgaaacaggagaaggaagccctgaatcatagaatcgttcagcaggccaaggagatgaccgaaacaatggagaagaaactcgtggaagagacaaagcagttagaactggatctgaatgatgaacgtctcagataccagaacctgctgaatgaattttcaaggctggaggaaaggtatgatgatctaaaagaggagatgacactaatggtgcacgttccaaagcccggtcataaaagaaccgactctacacactcatctaacgagagcgaatacatttttagctccgaaattgcagaaatggaggatatcccttctcgaaccgaagagccatctgaaaagaaggttccactagacatgagtctatttctgaagctgcagaaacgtgtcacagagctagaacaggaaaagcaggttatgcaagacgaactggaccgcaaagaagaacaggtcctgaggtcaaaggctaaagaggaggaaaggccccagatacgcggagccgaactggagtatgagagtctgaaacgccaggagctggaatccgagaataagaagctcaagaacgagctcaatgagctgcgcaaagctctctccgagaagtccgccccagaagttacggcccctggagccccagcttatcgggtgcttatggaacagctgactagtgtgtccgaggaactcgatgtgcgaaaagaggaagtgctgatcctgcggtcccaactggtgagtcaaaaagaggccatccagcccaagcttcacgagaacaccatgaccgatagcactattctactggaggatgtacagaaaatgaaagacaaaggggaaattgcccaagcctatattgggctgaaggaaacgaaccggctgctcgagtcccagctacagtctcagaagaggagccacgagaacgaggctgaggcattgcgaggagagatccagtcgctgaaggaggagaacaatcgccagcagcaacttctggcccaaaatctccagctgcctcccgaggcccgtatagaagcaagtctgcagcacgagattacgaggctaacaaatgagaatctggatcttatggagcaacttgaaaaacaggataagacggtcagaaagctgaagaagcaacttaaagtgttcgcaaaaaagattggggagcttgaagtgggacagatggagaatattagccccggtcagattattgacgagcctattcgtccagtgaatattccaaggaaggaaaaggacttccagggtatgctggaatacaagaaggaggacgagcagaagctggtgaaaaatctcattctagagctgaagccacgcggagtggctgttaatctgattccaggtctcccagcgtatattctctttatgtgcgtgaggcatgccgattatctgaatgatgatcagaaagtgcgcagcctcctgacctccactattaattcaataaagaaggtccttaagaaaaggggggacgatttcgagaccgtgagcttctggctttccaacacttgcagattcctccattgtctgaaacagtattccggagaggagggctttatgaaacacaatacatctcgccagaatgaacattgtcttacaaattttgatttggcagaataccgccaggttctgtctgatcttgccattcaaatttatcagcagctggtcagagtcctggaaaatatactgcagcctatgatcgtaagtggcatgctggaacacgagactatacaaggcgtgagcggcgttaaaccaacgggactgcggaaacgcacaagctctattgccgatgaggggacatacactctcgattcgattctgcgacagttgaactcatttcattctgtgatgtgccagcacggaatggacccagagctcatcaaacaggttgtgaaacagatgttttacatcattggggcaatcacgctgaataatctcctgttgagaaaggatatgtgctcatggagcaagggcatgcagatcaggtacaacgttagccaactagaggagtggctgagggacaagaaccttatgaactccggggcaaaagagacgctcgaaccactcatacaggccgcacagctcctccaggtgaagaaaaaaactgatgatgacgctgaagccatttgttcaatgtgcaacgccttaacgacagcccagatagttaaggtccttaatttgtacacacccgttaacgaattcgaggaacgggtgagcgtctcattcatccgaaccatccagatgagattgcgggacagaaaggactctcctcagttgcttatggatgctaaacacatttttcccgtcacttttccttttaacccctcgtctctggcactggagactatccagatccccgcatctctaggactgggattcattagtagagtcta

SEQ ID NO: 231632 - DNA, 5562 bp, Artificial Sequence
  Description of Artificial Sequence: Synthetic coding sequence
atggctgcctctgaactgtacactaagtttgccagagtatggatccccgaccccgaggaggtgtggaagtccgccgagctccttaaagactacaaaccaggagacaaggtgttactgttgcacctggaagagggaaaagatctagaataccacctagatccaaagaccaaggagcttccgcatcttagaaacccagacatcctggtgggggaaaacgatcttaccgccctgtcatacctgcatgagccagctgtgctccataacctgagagtgcgctttatcgatagtaagctcatctacacttattgtgggatcgtgctggtagccatcaacccttatgagcagctccctatctacggggaggacattatcaatgcttattccggccagaacatgggggatatggacccccatatctttgctgtggcagaggaggcttacaagcagatggcccgtgatgagcggaaccagtctataattgtaagcggtgagtctggggcagggaagaccgtaagcgccaagtacgctatgcgctactttgcaactgtgtccgggtccgcatctgaggccaatgtggaggaaaaggtcctggctagtaatccaatcatggaaagcatcggcaacgccaaaaccacccggaatgacaattctagccgctttggcaagtatatagagatcggcttcgacaagaggtaccggataatcggcgcaaatatgcgcacctatctactggagaaaagccgagttgtgtttcaggccgaggaagaaagaaattatcacatcttctaccagctgtgcgcctctgcaaagctccccgaattcaagatgctccgtctggggaatgcggacaactttaactatacaaaacaagggggttctcctgttatcgagggggtcgatgacgccaaggagatggcgcacactagacaggcctgcacactgctcgggatcagcgagtctcaccaaatgggcattttcaggattctcgctggtatcttgcatcttgggaatgtgggtttcacatctcgcgacgcggacagttgtaccatcccccctaagcacgaaccattgtgcatcttctgcgaactgatgggggttgactatgaggaaatgtgccactggttgtgccaccggaagctggccaccgctacggagacttacatcaagccaattagtaaattgcaggccacaaatgcgcgagatgcccttgccaaacacatctatgctaaactgttcaactggatagtcgataacgtgaaccaggcgctgcacagtgccgtgaaacagcactctttcattggggtgcttgacatatatggattcgaaacttttgagattaactccttcgaacaattttgcatcaactatgctaacgagaagctacagcagcaatttaacatgcatgtgtttaagttagaacaggaggagtacatgaaggagcagataccttggacactaatcgacttctacgacaaccagccttgtatcaacctgatcgagagtaagttgggtatactggatttgcttgacgaggagtgcaagatgccaaaaggcactgatgacacatgggcgcagaagttgtataatacccatttgaataaatgcgcgctgtttgagaagcccaggctgagcaacaaagcattcatcattcagcatttcgctgacaaagttgaatatcagtgtgaggggtttttggaaaaaaacaaggatacagtgttcgaagaacagatcaaagtgttgaaaagtagcaagttcaagatgctgcccgagctatttcaggacgatgagaaggccatttccccaacttctgcgactagctcaggcaggaccccactgactagaacgcccgctaagcctaccaagggtcggccaggccaaatggccaaggaacacaagaagacagtgggacaccagttccgcaatagtttgcacttgctgatggagacactaaatgctaccacaccacattatgtccgctgcatcaaacctaatgatttcaaatttccatttaccttcgacgagaagcgcgctgtgcagcagctgagggcttgcggggttctagaaactatccggattagtgccgctgggttcccaagcaggtggacctatcaagagttcttctctcgctaccgagtgctcatgaagcaaaaagatgttctgagtgaccggaaacagacatgcaaaaacgttctggaaaagctgatactggacaaagacaagtaccagtttggaaaaaccaagatatttttccgagctggccaagtcgcatacctcgagaagttgcgagccgataagctacgtgccgcatgcattaggatccagaagacaatccgaggctggctgcttaggaagaagtatttgcgtatgcgaaaggccgcaataaccatgcagcgttatgtgcgtggctaccaggctcgatgttatgccaagtttctccggagaacaaaagctgccacaattattcaaaagtactggcggatgtacgttgtgcgaagacgatacaaaatcaggagggccgctactatagtgctgcagtcatacctgagaggatttcttgcacgcaatcgataccgtaagatcctgcgggaacataaggcggttatcattcaaaaacgagtcaggggttggctggctcggactcactacaaacgatcgatgcacgcaataatttacctacagtgctgcttccgccgaatgatggctaagcgcgagctgaaaaagctgaagattgaggcacgctccgtggagcgctataagaagttacacataggaatggaaaataaaattatgcagctccaacgcaaggtcgacgagcagaacaaagactacaagtgcttggtggagaaactcacaaatttggagggtatctacaattcagagaccgagaaactgcgctctgacctagaacggctgcagctctctgaggaggaagctaaggtggcaaccgggcgtgtgctttcactccaggaggaaattgccaaactgcgcaaggacctggagcagactagaagcgaaaaaaagtgtatcgaggaacatgcagaccgctacaagcaggaaacagagcaactggtttccaacctcaaggaggaaaacacactgctgaaacaagagaaggaggccctgaaccataggatagtacagcaggccaaggaaatgacagagacaatggaaaaaaagctcgttgaggagaccaaacagctggagttggatctaaatgatgagcgactcaggtaccaaaaccttctaaacgagttttcacggctggaagagaggtacgacgatcttaaggaggaaatgactcttatggttcacgtccccaagcctgggcacaaacgcaccgatagcactcactcttcaaacgagagcgaatacatcttcagttctgagattgcagagatggaagacatcccttctagaactgaggaaccgtctgaaaagaaggtgcctttggacatgtccctttttctcaagcttcagaagagggtgacggaactggagcaggagaagcaggttatgcaggatgaactcgaccggaaggaggaacaggtgctcagatcgaaagcaaaggaggaggagagacctcagatacggggtgctgagctggaatatgagtctttaaaacggcaggagctggagtcagagaataaaaagttgaagaacgagctcaacgaactgaggaaagctctttccgagaagtccgcccctgaggtcacagcacccggtgctcctgcctaccgagtgctgatggaacagctgacctcggtctcagaggagctcgacgtaagaaaggaggaggtcttgattctcagatcacagcttgtcagccaaaaggaagctatccagcctaaggacgacaagaatactatgacagacagcacaatcttgttagaggacgtgcagaaaatgaaggataaaggggaaatcgcgcaggcatatatcgggctcaaagagactaaccgtctgctggagtcccagcttcagtcacaaaaacggtcccacgagaacgaggctgaagcactgcgcggtgaaattcaatcgctgaaagaggaaaataaccgccagcagcagctgctggcacaaaatctccaactgccccctgaggccagaatagaggccagcctgcagcatgaaatcacgagattgactaatgagaatctgtacttcgaagaactctacgccgatgatcccaaaaaataccagtcgtacagaatctcgttgtacaagcggatgattgacctgatggaacagttggagaagcaagacaagacagtacggaagctgaaaaaacagttgaaggtgttcgctaagaagatcggcgagctggaagtaggccagatggagaatataagtcccggtcagatcatcgacgaaccgatccgccctgtaaacatccccaggaaggaaaaggacttccagggcatgttggagtataaaaaagaggacgagcaaaagctagtcaagaacctgatcctggagttaaagcctcgcggagtggcagtaaatctgatccccggactccccgcatacattttgttcatgtgcgtgagacatgccgactacttgaatgatgatcagaaggtccgcagcttactgacaagtacaatcaacagcatcaaaaaagtgctaaaaaagcgaggagacgattttgagaccgtgagcttctggctatctaatacttgtcggttcctgcactgccttaaacagtatagcggggaggaaggtttcatgaaacacaacacatccagacagaacgaacattgcctgacgaacttcgacctggctgagtatagacaagtcctaagcgacctcgcaatacagatataccagcagctggtgagggtcctggaaaatatcctgcagcctatgatcgtgtctggcatgctcgagcacgagaccatccaaggcgtcagcggcgtaaaacccactggactaagaaagcgtacatcctccattgcggatgagggtacttacacgttggattcaattctccgccaactgaatagttttcacagtgtgatgtgccagcacggcatggatcctgaactgattaagcaggttgttaagcaaatgttctacattataggcgcaatcactctgaataatctcctgctccgtaaggatatgtgttcctggagcaaggggatgcaaattaggtacaacgtcagccagctggaggagtggcttagggacaagaatctcatgaacagtggggctaaggaaacccttgagcctctcatccaggcagcccagctgctccaggtcaaaaaaaagaccgatgacgacgcggaggctatttgtagtatgtgtaatgctttaacaaccgctcagatcgtgaaggtgctgaatctgtacacccctgttaacgaatttgaagagagagtgtctgtcagttttatcagaacaatccaaatgagacttagggaccgaaaagatagtccacagttactaatggacgccaagcacatttttcccgtcacgtttccatttaacccatcttccctggctctagagaccattcagatacccgcaagcctgggactgggcttcatctcgcgcgtctag

SEQ ID NO: 231633 - DNA, 5547 bp, Artificial Sequence
  Description of Artificial Sequence: Synthetic coding sequence
atgtctgtaggggagctgtacagccagtgcaccagggtctggatccctgacccggacgaagtgtggcgcagcgccgagcttacaaaagactataaggagggcgataagagcctccagctgcgcttggaggacgagacgatccttgaataccccatcgacgtacaacgaaatcagctcccgttccttagaaacccagatattctcgtcggggagaacgacctgaccgctctaagctatctccatgaacccgctgtcctgcataatctgaaggtcaggttcttagaatcaaatcacatttacacctattgtgggattgtcttagtcgccataaacccctatgaacaattgccgatatatggacaagatgtcatttacacgtacagtggacagaatatgggcgatatggaccctcacatatttgccgttgccgaagaagcatataaacagatggctcgcgacgagaaaaaccaatccatcattgtgtccggagagagtggcgctggcaagacagtgagcgccaaatacgctatgcgctatttcgctacagtgggtgggtccgcctctgagactaacattgaagagaaggtgctggcttcaagtcccatcatggaggccattgggaatgccaaaacaacccggaacgataattcatcaagattcggtaaatatattcagatagggtttgacaaacgctatcacatcattggcgctaatatgaggacctacttgctcgagaaaagtagggtggttttccaggcggatgatgagcggaattatcatattttctaccagctgtgcgctgccgctggcctgccagaattcaaagagctcgctttaacgtcagccgaggactttttttatacaagccagggaggcgatacaagtatagagggggttgatgacgccgaggactttgaaaaaacaaggcaagccttcacgcttttgggcgtgaaggagtctcaccagatgtcaatatttaagattatcgcctctatcctccatctgggcagcgtggccatccaggcagagcgtgacggagattcatgttcgatatctcctcaggacgtctacctgtctaacttctgcaggctgttgggtgtggagcacagtcaaatggagcactggctttgccatcgcaagctcgtaaccacttcagagacctacgtcaaaacaatgagcctgcaacaggtcatcaacgcacgcaacgctctggccaaacacatttacgctcagttgtttggctggattgttgaacacatcaataaagccctgcacaccagcttgaagcagcattccttcatcggggttctggatatatatggtttcgaaacctttgaagtcaatagtttcgagcagttctgtatcaattacgcgaacgagaagctgcagcagcagttcaatagccacgtgtttaagctcgaacaggaggagtacatgaaagagcagattccctggacactcatagacttttatgacaaccaaccatgtatagatttaattgaagcaaagctgggaatcctagacttattagacgaggaatgcaaggtgccgaaagggaccgaccagaactgggctcaaaagttgtatgatagacattcttcttcacagcacttccaaaagccacgcatgtcaaatacagcctttattatcgtgcatttcgccgacaaggtggagtacttgtccgacgggtttctggaaaagaaccgcgacacggtgtacgaggaacagatcaacattctaaaggcatccaaatttccgctggttgctgatctattccatgacgacaaggacccggtgcctgcaactaccccaggaaagggttcaagctcaaaaatatctgtgcggtctgcacgcccacccatgaaagtatccaataaggagcacaagaagaccgttggccaccagtttcgcacatccctgcatttgttgatggagacactgaacgctactacacctcactatgtacgctgcatcaaaccgaatgatgaaaagcttccctttcactttgaccccaagagggcagtgcagcagctgcgcgcttgcggagtgctcgagaccatccgaatttcagccgctggatatccctctcgatgggcctatcatgatttcttcaataggtatcgcgtgttagtcaagaagcgggaactggccaacaccgacaaaaaggcaatttgccgcagcgtcctcgagaatctgatcaaggaccctgacaagtttcagtttggacgaaccaagattttcttcagggccggacaagtggcttaccttgagaagcttagggctgacaagtttaggacagcaactattatgattcagaagaccgtgagaggctggttgcagaaggtcaaatatcatcggttgaagggagctactctaactctgcagcgctattgtcggggtcatcttgcgagacgactggctgagcatctgaggcgaatccgtgctgccgtggtgctgcagaagcactaccgcatgcagcgcgcacgacaggcttatcagcgggtgcgtcgagctgcagtcgttatacaggctttcactcgggctatgtttgtgcggagaacgtaccgacaggtgctcatggagcacaaagctacaaccattcaaaagcacgttcgaggctggatggctagacgacacttccagcgtctccgcgacgccgcaatcgttatccagtgcgcctttcgcatgttgaaggccagacgtgaactcaaggcacttcgtattgaggcaaggagtgccgaacacctgaaacgtctcaacgttgggatggaaaataaagtagtccagttacagaggaaaattgatgagcagaataaagaatttaaaacactcagtgagcagctcagcgtcaccaccagcacgtacacaatggaggtagaacgccttaagaaagagctggtccattatcagcagtccccaggcgaagacaccagtctgcggttgcaggaagaggtagaatctctccgaaccgagctccagagagcgcactccgaacggaaaatactcgaggacgcgcattcgagagagaaagacgaactccgcaaacgggtcgccgacctagagcaggagaacgctttgctaaaagacgaaaaggaacagctcaataatcagatactatgccagagcaaggacgagttcgctcagaactcggtgaaggagaacctcatgaaaaaggagctggaggaggagcggtcccggtaccagaatctggtgaaagagtacagccagctggagcaacgctatgataaccttcgcgacgaaatgactataatcaagcagacaccaggccatcgacgtaaccctagtaaccagtcatcactggaatccgacagtaactatccaagcatcagtactagtgaaatcggagatactgaagacgcgcttcagcaggttgaggagattgggcttgaaaaagccgctatggatatgacggtctttctgaaactccagaagagagtgagagaactggaacaggaaagaaagaaactgcaggtccagttagaaaagcgcgagcagcaggactccaaaaaggttcaggcagagccccctcagacagatattgacctagatcccaatgctgacctggcctacaactcactcaaacgccaggagctcgagtccgaaaataaaaaactaaagaacgacctcaatgagcttcgtaaagcggtggcggatcaagctacccaaaacaattcatcccacggaagccccgatagctactcactgctgttgaatcaactgaagcttgctcacgaagagctggaggtcaggaaagaggaggtgttgatcttgagaacgcagatcgtcagcgccgatcaaagacgccttgccggaaggaacgctgagccaaacattaatgcgagaagcagctggcccaattctgaaaaacatgtggaccaggaggacgcaatcgaggcttatcacggcgtttgtcaaactaattcgaaaacagaagactggggctacctgaacgaggacggcgagctgggcctcgcttaccaaggcctgaagcaggtggcccgactcctcgaagctcagctgcaggcacagagtctggagcacgaggaggaggtagaacacctgaaggcacagctggaagcacttaaagaggaaatggacaaacagcaacagacgttctgtcagaccctcttgttatctcccgaagcccaagtggagttcggagtgcagcaagaaattagtcgcctcacaaatgagaatctggacctcaaggagttggtggagaaactggagaagaacgagcggaaattgaaaaaacagcttaaaatatatatgaaaaaagctcaagacctggaagccgcacaggcgcttgcccaaagcgagagaaagcgccatgagcttaatcgtcaggtgactgtccagcggaaggagaaagactttcaggggatgctcgagtaccacaaagaggacgaagccttgctgattcggaacctggtgacggatttgaagccccagatgctctcaggcacggtgccttgcctccctgcgtacatcctgtacatgtgtattaggcatgcagattatacaaatgacgatctcaaagtgcactcactgctgacctccacaattaatgggatcaaaaaggtgctcaagaaacacaatgacgatttcgagatgaccagcttctggctgtccaacacgtgtaggctgctgcactgcttgaagcagtacagcggcgacgagggatttatgactcagaatacggccaaacagaatgagcactgcctgaaaaatttcgacctgaccgaataccgccaggtgctctcggatctgagcatacagatttaccagcaactcataaaaatagccgaaggcgtgctccaacccatgattgtctccgcgatgctggagaatgagtctattcagggattgagtggcgttaagcctacaggctacagaaaacgctccagttcgatggctgacggggataacagttactgcctggaagcgatcattagacagatgaatgcctttcacacagtgatgtgtgatcagggcctagatcctgaaatcatactgcaagtgttcaagcaattgttctacatgatcaatgcagttaccctcaataacctgctattacgcaaggatgtatgtagttggagcactggaatgcaactgcgatacaatattagccagctggaggaatggttgcggggacgtaatcttcatcaatccggcgctgtgcagaccatggaaccactcatacaggcagcccaattgcttcagctgaagaaaaagacgcaggaggacgcggaagcaatctgctctctgtgcacttctctttcaacccagcagatagtgaagatcctgaacctgtacacgcctctcaatgagtttgaggagagggtaactgtggcattcattcgcacaatacaggcgcagctgcaggaacgtaatgaccctcagcagttgctgctagatgccaagcacatgttcccggtcttgttcccatttaaccccagttccctgaccatggattcaatccacatccccgcttgccttaacctggagtttctgaacgaggtgtac

SEQ ID NO: 231634 - DNA, 2892 bp, Artificial Sequence
  Description of Artificial Sequence: Synthetic coding sequence
atggaacacaaggctaccacgattcaaaagcacgttcgagggtggatggcaagacggcattttcagcgtctccgggacgccgcaatagtgatccagtgtgctttccgaatgttgaaggcgaggcgggaacttaaggctctccgcatcgaggctaggagcgcagaacatctcaagcgcctgaacgtcggcatggagaacaaagtggtgcaactgcagaggaagattgacgaacaaaacaaagaatttaagaccttgtctgagcaattgtctgttacgactagcacctacacaatggaggttgagagactcaaaaaggagcttgtgcattatcagcagagtcctggtgaagatacctccctaagactgcaagaggaagtagagtctcttagaacagagctgcagagagcacactccgagaggaagatcctggaagatgcacatagcagagagaaagatgaacttcgtaagcgcgttgctgatctggagcaggagaacgctctgctgaaggacgagaaggagcagctaaataaccaaatcctatgccaatccaaggatgagttcgctcagaactcagttaaagagaatctgatgaagaaggagttggaggaggagcggtcgaggtatcagaatctcgtgaaggagtactcacagctggaacagaggtatgacaacttaagggacgagatgaccataataaagcagacgccgggtcacaggcgcaaccccagcaaccagtctagcttggagtccgattccaattacccgtctatctccacttccgagattggagacaccgaggacgcactccagcaggttgaggaaattggtttggagaaagcggctatggacatgactgtctttctgaaactccaaaagcgtgtccgagagcttgagcaggaacgaaaaaagctgcaggtacagttggaaaagcgcgaacagcaagactctaaaaaagttcaggcggagccccctcagactgatatcgatctagacccaaacgcagatttggcctacaattcccttaagcgccaggaattagaatccgagaataaaaagcttaagaacgatctaaacgaactgagaaaagcggttgcagatcaggctacacagaacaactcatctcatgggtcacctgactcttacagtctccttcttaaccaactgaagctcgcccacgaagaattggaggtccggaaagaagaagtgctgattctcagaactcaaattgtatccgccgaccagcggcgacttgcagggaggaacgctgagccgaatatcaatgcacgctcctcttggcctaacagcgagaaacacgtagatcaggaggatgccattgaggcgtatcacggtgtctgtcagactaatagactgttggaagcgcagttgcaggcccagagtctagagcacgaggaggaagttgaacatttgaaggcccagctcgaggcccttaaggaggaaatggacaagcaacagcagacgttttgccagaccttactgctgtctcccgaggcccaggttgagtttggagtacagcaggagatttcacggctgacaaacgaaaacctagacctgaaggagctggtcgagaagctggaaaagaatgagagaaaactgaaaaaacaactgaaaatctatatgaagaaagctcaggaccttgaggccgcacaggcgttggcccagagcgaaaggaagcggcatgagctaaatcggcaagtaactgtgcagaggaaagagaaagatttccagggcatgcttgagtatcataaggaggacgaggcacttctgatacgaaatctggtgacggatctgaagcctcagatgctttctggtacggtcccctgccttcccgcttacatactttatatgtgcataaggcacgctgactacaccaacgacgacctaaaggtacactctctcctcacctcaactataaacggtatcaagaaagtactcaagaaacacaacgatgacttcgagatgacgagcttttggctgtctaacacttgtcgacttctgcactgcctgaaacagtattctggtgatgaaggttttatgacccagaatacagcaaagcagaatgagcactgcttaaaaaacttcgatttgaccgaataccgccaggtgctctctgacctgtctattcaaatttatcagcagctcatcaagattgcagaaggcgtacttcagccaatgatagtgtcagctatgctcgagaatgaaagcatacaggggctgtccggagtcaaaccaacggggtatcggaaaaggtccagtagcatggctgatggcgacaactcctactgtctggaagcaataatccggcagatgaacgcatttcacacggtcatgtgcgaccaaggcctcgatcctgagattattctgcaggttttcaagcagctgttttacatgatcaatgccgtgactttgaataatttgctgttacgcaaggacgtatgcagttggtctactggcatgcagttgagatataatatctctcagctggaggagtggctgagagggagaaatttgcatcagtcaggggcagtacagacaatggagccattaattcaggcagcacagctccttcagcttaaaaagaaaactcaggaggacgctgaggcaatttgctctctgtgcacctcactttctacccagcaaatcgtcaaaatccttaatctatacacacccctaaacgaattcgaggagcgcgttaccgtagcgtttatccggacgatccaggctcagttgcaagaacggaacgatccccagcagctgctccttgacgctaaacacatgttcccagtactgttcccctttaatccatctagcctcacgatggacagtattcacattccagcgtgtcttaacctggagtttctgaacgaagtgtag

SEQ ID NO: 231635 - DNA, 2163 bp, Artificial Sequence
  Description of Artificial Sequence: Synthetic coding sequence
atgcactggcctgtgacccgggagtgtaccagggtatggattcctgatcccgatgaagtgtggagatccgcagaattgacaaaagattacaaagagggcgataaatcattacagctgcgtctggaggatgagacgatcctcgagtaccccatcgatgtgcagcgaaatcagttgccgttcctgcggaatcccgacatactcgtgggcgaaaatgacctgaccgcattaagctatcttcacgaacctgccgttcttcacaacctcaaggtcaggttcctggagtctaatcacatttacacatattgtggcatcgttctggtggcgatcaacccctatgagcaactccccatttacggccaggatgttatctacacatattccggacagaatatgggtgacatggaccctcatatctttgcagtagcagaagaggcatacaagcaaatggcaagagatgagaaaaatcaatcaattattgtgtctggcgaaagtggtgcgggtaagaccgtgagcgcgaagtacgccatgagatactttgcgaccgtcggaggctccgcatccgagacgaatattgaagaaaaagttctcgccagttcgcccatcatggaggcaataggcaatgccaaaaccacccggaacgataatagttccagatttggtaaatacatccagattggattcgataaaagataccacataatcggggctaatatgaggacgtatttacttgaaaaatcccgtgtcgtattccaagccgatgatgagcgcaactaccacatattttaccagctgtgcgccgcagccggactgcccgaattcaaggagctggcattgaccagcgccgaggatttcttctatacctctcaaggcggtgatacgtcaattgagggggtcgacgatgcggaagactttgagaagacacgacaggcattcacactgttaggggtcaaggagtcacatcaaatgtctattttcaagatcatcgcgtccatccttcaccttggaagtgtggcaatccaggctgaacgggacggagatagctgttccatttctccgcaggacgtctatttgtctaatttctgccggctgctgggcgtcgaacacagtcagatggaacattggctgtgccatagaaagttggtcaccacgtcggaaacttacgtaaagacgatgagtctccaacaggtgatcaatgcacggaatgccctcgcaaagcacatctatgcccagctattcggttggatcgtggaacacatcaacaaggcccttcacacatccctgaagcaacacagctttattggtgtgctcgatatctacggcttcgagacgtttgaggtgaactcatttgaacagttttgtataaactacgcaaatgagaagctacagcagcagttcaactcccacgtgttcaaattggaacaggaggagtacatgaaagagcagatcccctggacactgattgatttttatgataaccagccttgcattgaccttattgaagccaagttgggcatcctggacttgctagacgaagagtgcaaagtcccaaaaggaaccgatcagaattgggcacagaagctgtatgaccggcatagttcgtctcagcattttcagaagcccaggatgagcaatacagcattcatcattgtgcatttcgccgataaagtcgagtatcttagcgacgggtttttggagaagaaccgggataccgtgtacgaagagcagattaacatccttaaagcgagcaaattcccactcgttgcagatctcttccacgatgacaaggacccagtgccagccaccacaccaggcaaggggagctcctccaagatctccgtcaggagcgcgagacctcccatgaaggtctccaataaagagcataaaaaaacagttgggcatcagttccgtaccagccttagtacacagcaaattgtgaaaatcttgaatctgtacacgcccttgaacgagttcgaagaaagggttacggtggccttcattaggactatccaggctcagttacaggaacgcaatgatccacagcagctcctccttgacgcaaagcatatgtttcccgtgttattccccttcaatccctcctccttgacaatggactcaatccacattcccgcatgccttaacctcgaattccttaatgaagtgtag

SEQ ID NO: 231636 - DNA, 5229 bp, Artificial Sequence
  Description of Artificial Sequence: Synthetic coding sequence
atggctgtggccgagctctacactcagtataacagggtttggatcccggaccccgaagaagtctggaaatccgcagagattgctaaggattatcgtgtcggagataaggtgcttaggcttttgttagaggatggcaccgaacttgattactccgtcaaccccgagtccctcccccctctgcgcaaccctgacattctggtcggcgagaacgatttaactgctctctcatatctgcacgaacccgctgtcctccacaacttgcgtatacggttcgccgaaagcaaactcatctacacatacagcgggatcattctcgtggcaatgaacccctataagcagctgcctatatacggcgatgcaataatacacgcctatagtggacaaaatatgggtgacatggatcctcatatattcgcagttgccgaagaggcttataagcagatggccaggaataatagaaatcaatctattatcgtctcaggggaatccggcgcaggtaagacagtctccgctcgttacgcaatgcgttatttcgccacagtttcaaagtccggaagcaatgcacatgtggaggacaaggtgcttgcctctaaccccattactgaggcagtcggtaatgcgaaaactacacgcaatgacaattcttcgcgcttcggcaagtacactgagatttcgtttgatgagcagaatcagatcatcggggctaacatgagtacatatcttttggaaaaaagccgggtcgtgtttcaatccgagaatgagcgcaactaccatatattttatcagctctgcgcctctgcgcagcagtcagaatttaaacatcttaagctaggttctgcagaggaattcaactacactcgaatggggggaaacacagtgatcgagggagtaaatgatagagcagaaatggtggagactcagaaaaccttcaccttgctcggctttaaggaggactttcagatggacgtgttcaaaatcctggccgcaatcctgcaccttggtaatgtgcagataacggccgtggggaacgaacgttcctctgtgagcgaagacgacagtcacctgaaggtgttttgcgagctgttaggactagagtccggcagggtcgctcagtggctgtgcaatcggaaaatcgtgacctcatcagaaaccgtggttaagccaatgacccgcccacaggcagtcaacgctcgggacgctctcgccaagaaaatctacgcacacctgttcgacttcatcgtggaacggatcaatcaggcactgcagttcagtggcaagcagcacaccttcattggggtcctcgacatctacggatttgaaacttttgatgtgaattccttcgaacagttctgcatcaactacgccaacgaaaaactacagcagcaattcaacatgcatgtttttaagctcgagcaggaggagtatatgaaagaggacatcccctggacactgatcgacttctacgacaaccaacccgtaatagatctgatagaggcaaagatgggaattctcgagctcttagacgaagaatgtctgctgccacatggcaccgatgagaactggctgcagaagctgtataacaattttgtcaatagaaacccactgttcgaaaaacctcgtatgtccaacacctcctttgtcatacagcattttgcagataaggttgaatacaagtgtgaaggctttctggaaaaaaaccgggacaccgtatatgacatgctggttgaaatactgcgggctagtaaattccatctctgtgccaacttctttcaagaaaaccctacacctccatcacccttcgggagcatgatcacagtgaaatcagcaaagcaggttatcaaacccaattctaagcactttcggaccaccgtgggatcaaagttcaggtcttcgctctatctgctgatggaaaccctgaatgcaacaactccacattatgtgcgctgtatcaagcccaacgacgaaaagctgcccttcgagtttgattccaagcggatcgttcagcagctgcgtgcatgcggagtgctggagacgattcgaatctccgctcaatcttatccttctaggtggacatacatagaattctacagccgctatggtattctcatgaccaagcaagaattaagtttctcagataagaaagaggtgtgtaaagtcgttcttcaccggcttatccaggattctaatcagtaccagttcggcaagactaagatattttttagggcaggtcaggtggcatacctagagaaactgcgactggacaaactgcggcagagttgcgtgatggtacaaaaacatatgagggggtggctacagcggaaaaagtttctgagagaacgcagagcggctctcatcattcagcagtatttccgaggccagcagactgtccggaaggctattacggctgtcgcactgaaggaggcctgggctgccatcattattcagaagcattgtcgcggataccttgtgcgaagtttgtatcagctgatccggatggcaacgattaccatgcaggcctacagcaggggattccttgccagaaggaggtatcgcaagatgctggaggaacataaagctgttatcttacagaagtacgcacgggcttggctggctcggaggagattccaaagcatcagacggttcgttttgaacatccagctgacttacagggtgcagagattacagaaaaaattggaagatcagaacaaagaaaaccatggcctagttgagaaattgacctcgctcgctgccctccgagcaggagacgtggagaagatacagaagcttgaggctgaactggaaaaagcagccacccaccggaggaattacgaggagaaaggtaagcgctatcgcgacgccgttgaagagaaattggctaaactgcaaaagcacaattcggaactcgaaactcaaaaggagcagatacagctcaagctgcaagaaaagaccgaggagctcaaggaaaaaatggacaatcttacgaaacaactgttcgacgacgtgcaaaaagaggagcggcagaggatgctccttgaaaaatcattcgagctgaaaacccaggactatgaaaaacagattcaatccctgaaagaggagattaaggctctgaaggacgagaagatgcagctgcagcacttggtggaaggagagcacgttacgagtgatggcctcaaggctgaggtggccagactgagcaaacaggtcaagactatatccgaattcgaaaaagagattgagttattgcaggcgcagaagatcgatgtggagaaacacgttcagtctcagaaacgggaaatgagagaaaaaatgagcgagatcaccaaacagcttctggaatcctacgatatcgaagacgtgcggtcacgcctgagcgtagaagacctggagcacctcaacgaagatggagaactgtggttcgcgtatgaaggcctgaagaaggctactcgggtccttgaaagtcacttccagagccagaaggactgttacgaaaaggaaatcgaggccctcaatttcaaggtggttcatctgagccaggagatcaaccatctgcaaaagctgttcagagaagagaatgatattaacgaaagcatcagacatgaagtcacgcggctgaccagcgaaaacatgatgatccccgatttcaagcagcagatttcggaattggagaaacagaaacaggatttggagatccgactgaacgagcaggcagaaaagatgaagggaaaactggaagagctgtccaatcagcttcaccggtcccaggaagaagagggtacccagaggaaagctctggaagcacagaatgagattcacacaaaagagaaagagaaattgattgacaagatacaggagatgcaggaagcatccgatcacctgaagaagcagttcgagactgagtccgaggtaaaatgcaacttcaggcaggaagctagccggttgaccctagagaaccgcgatctcgaagaggaattagatatgaaggacagggtgatcaaaaaactccaggaccaggttaagacactgtcaaagaccatcggtaaggccaacgatgtacacagctccagcggacccaaagaatatctgggcatgctgcaatacaaacgggaggacgaagcaaagctaattcaaaatttgatactcgacctcaaaccaaggggggtcgttgtgaatatgatcccaggattacccgcacacatcctctttatgtgtgtcagatacgccgacagcctgaatgatgccaatatgctgaaaagtctgatgaactccaccataaacggaattaagcaagtggtgaaagagcatttggaagacttcgagatgctcagcttctggcttagcaacacttgtcatttcctgaattgtctgaagcaatactccggcgaagaggagtttatgaaacataactctccacagcagaacaagaactgtttgaacaactttgatctgtcagagtaccggcagattttgtccgatgtcgctatccgcatctatcaccagttcattattattatggaaaagaatattcagccgatcatagtgccaggcatgctggaatacgagagtctgcagggaatatccggcctgaaacccaccggctttcggaagcgcagctctagtattgacgatacagatgggtacactatgacctccgttcttcagcagctgtcctacttttatacgacaatgtgccagaatggactggacccagaactggtgcggcaggcggtgaaacaactcttcttcttgattggcgcagtcaccttgaatagcctgtttctcaggaaagatatgtgttcatgtcggaaagggatgcaaatccgctgtaatataagctacctagaggaatggttgaaagataagaacctccagaactccttagcaaaggagactcttgaacctctgtcccaagcggcttggcttctccaggtgaagaaaaccacggactccgacgccaaggagatctatgaaagatgcacttctctgtctgcggtgcagattattaaaattctaaatagctacacacccatcgacgacttcgagaagcgggtcacacccagctttgtccgtaaggttcaggctctgttgaatagtagagaggactcatcacagctaatgctcgacacgaagtacctgtttcaggtcactttcccctttactcccagtcctcacgcgcttgaaatgatccagataccgtctagctttaaactaggctttttgaaccgcctttag

SEQ ID NO: 231637 - DNA, 1122 bp, Artificial Sequence
  Description of Artificial Sequence: Synthetic coding sequence
atgccctctagcacacctactgctgggcgaacatgggctatctggacccacacatacctgccgtggcaaaaaaggcacacaagtaggtggcccgacgggaaatccgaagctcaagacctagaccttctgaccctctacttgaatctgtactgtataactccggcagcagctcccgagctccctcccctgtacgtcttcgtctgcgaactagactcacagagggctcccatccctggaagcgacgcatataacgaaggggctgggggagcatatatgcgaaacaatcgcaaccagtctattatcgtgagtggagagtccggcgctggtaagaccgtctccgccagatatgccatgagatattttgccacagtgtctaagagtgggagtaacgcccacgttgaagacaaagtccttgcctctaatccaataactgaggcagtcggcaatgctaagactactcggaacgacaactcctcaagatttgggaaatacaccgagattagcttcgacgaacagaatcaaattataggcgctaatatgtcgacctacctgttagagaaaagcagagtcgtgttccagtcggaaaatgagcggaactaccatattttctaccaattgtgtgcctccgctcagcagagcgagtttaaacacctgaaacttgggtcagcagaggagtttaattacacgcgtatgggtggtaatacagtgatcgaaggggtgaatgatcgcgctgagatggtggaaacacagaagacatttactctcctgggtttcaaagaggattttcagatggacgtgttcaagatactggccgctatcctccacctgggaaatgtgcaaatcaccgctgtgggaaatgagaggtcctctgtgagcgaagatgattcccatctcaaagtgttctgcgagctacttgggctggaatccgggagagttgcccagtggctatgcaatcggaagatagttacatctagtgagaccgtcgtgaaaccgatgactcggcctcaggcagtgaacgccagagacgcgcttgctaaaaagatttatgcacaccttttcgactttattgtggagcgaattaaccaggcattacaatttagcgtgcttaaacccctcatgtag

SEQ ID NO: 231638 - DNA, 321 bp, Artificial Sequence
  Description of Artificial Sequence: Synthetic coding sequence
atgaatccatataaacagctaccaatctacggcgacgccattatccatgcgtattccggacagaacatgggcgatatggatccccacatcttcgccgtcgccgaagaggcttacaaacagatggccaggaataacaggaaccaatccattatcgtgtccggggagtccggagctggtaagactgtgtctgctcgttatgccatgcgctacttcgcaacagtatcaaaatcaggcagcaacgctcatgtcgaagacaaggtgctcgcctccaatcctataaccgaggcagtgggaaatgctaaaacaactaggaatgactag

SEQ ID NO: 231639 - DNA, 1293 bp, Artificial Sequence
  Description of Artificial Sequence: Synthetic coding sequence
atggccgtcgccgaactctatacgcagtataatcgtgtgtggatccccgatcccgaggaggtttggaagtcggccgaaatcgcaaaagactatagagtcggcgacaaagtccttcgattgctgttggaggatggcacagagttggattacagtgtcaaccccgaaagccttcccccactgcggaaccccgacatccttgttggcgaaaacgacttaaccgccttgagttacctccacgagcccgctgtgttgcataatcttcggatacgcttcgcagaatcaaaactaatctatacgtactccggcatcatcctggttgccatgaacccctacaaacaactcccaatctatggcgatgcaatcattcacgcctacagtggacagaatatgggagacatggatcctcatatctttgctgtcgctgaggaagcatacaagcagatggccaggaataacaggaatcagtccattatcgtatctggtgaaagtggtgccggtaaaaccgtctccgcacgatatgctatgaggtattttgcaaccgtgagcaaatctggaagtaatgcacacgtggaggacaaggtgttagcaagcaatccgataaccgaggccgtaggcaacgcgaagactacacgtaacgataactcaagcagatttgggaaatacacagaaatatctttcgatgaacagaatcaaattattggtgccaatatgtctacgtacctccttgaaaagtcccgtgtagtcttccaatcagagaacgaaagaaattatcacatcttctaccagctgtgtgcatctgcacagcaaagcgaatttaaacatctgaaactgggatccgcagaggaattcaactacaccagaatgggcggaaacacagtgatagaaggtgttaacgaccgggcagagatggtggaaacacagaagacttttactctgctgggtttcaaagaagatttccaaatggacgttttcaagatccttgcagccatcctccacctcgggaatgttcagataacagctgtcggaaatgaacgcagctcagtgtccgaggatgacagccacctcaaagtattctgtgagctactaggcctagagtccggacgtgttgcacagtggctgtgtaaccgtaaaatcgtaacatcctcagaaacagtggtaaagcccatgacacgccctcaggcagtcaacgctcgcgacgccctggcgaagaaaatctatgctcatttgtttgactttatagtggagaggatcaaccaagcactgcagttttcagtgctcaagccactgatgtag

SEQ ID NO: 231640 - DNA, 810 bp, Artificial Sequence
  Description of Artificial Sequence: Synthetic coding sequence
atggctgtggctgagctgtacactcagtacaaccgggtgtggatccccgatcctgaagaagtgtggaaaagtgccgagattgccaaggattatagggtcggcgataaggtgctcagactcctgctcgaggatggcacagagctcgattattctgtgaacccagaatccttaccccctctgcgcaaccctgacatcctcgtcggtgaaaacgatctgacagccctttcctatctgcacgagccggcagtcttacataacctgcggattcggttcgcagagtccaagttgatttacacctacagcgggatcattcttgtggcaatgaatccttataaacagctgcccatttatggcgatgctattatacacgcatactcgggacagaatatgggggacatggatccccatatcttcgcagtggcagaagaagcatataaacagatggccagaaataataggaatcagagtatcatagtcagcggcgaatcgggcgctgggaagaccgtctccgctagatacgccatgcgctacttcgcaaccgtgtccaaatctggttcaaatgcgcacgtggaggataaggtcctggctagcaatcctatcactgaagcagtggggaatgcgaagaccacacgcaatgataatagttcccgcttcggaaagtacacagaaatttctttcgatgagcaaaatcaaataattggtgcaaacatgagtacttatctgctggagaagtctagggtagtgtttcagggagtgcccaaaaacctgatcattcaggagtgggaagccatactaagcctgagggtctag

SEQ ID NO: 231641 - DNA, 3762 bp, Artificial Sequence
  Description of Artificial Sequence: Synthetic coding sequence
atggaggacggcaagccggtgtgggctccccatccaacagatggattccagatgggaaacattgtcgatataggacctgactctctcacaatcgaacctcttaatcagaagggcaaaacttttctcgcgttgattaatcaggtgtttccggctgaagaagattctaagaaagacgtggaggataattgtagtctcatgtatttgaacgaggccacgttgctgcacaacattaaggttaggtattccaaggataggatctatacatacgtggctaatatcctaatcgcagtcaacccgtacttcgatatccccaagatttattcatctgaagctatcaagagctatcaaggtaaatctcttggaacacgcccaccccacgttttcgcaatcgccgataaggcctttcgagacatgaaggtgttgaagatgtcacagtctataattgtctctggggaaagcggggctgggaagacagagaatacaaaattcgtgttgcgctacctaactgaaagctacggaaccggtcaagatatcgacgaccggatcgtggaggccaaccctctgctagaggcgtttgggaacgctaaaacggtgagaaataacaactcatctagatttggaaagtttgttgagattcacttcaacgagaagagctccgtggtcgggggatttgttagtcattacctgctcgaaaaatcccggatctgtgtgcagggcaaagaagagcgaaactaccacatcttctaccggctgtgtgccggagctagcgaggacattcgcgaaaaactgcacctctctagcccggacaacttcaggtacctcaacaggggatgcactcgatattttgctaacaaagagaccgacaagcagattcttcagaatagaaagtcccccgagtatctgaaggctggctctatgaaagatcccttgctggatgaccatggcgatttcatcagaatgtgtaccgcaatgaagaaaattggtctggacgatgaagaaaagctcgatctgttcagggtggtggccggagtgctccaccttgggaatatagactttgaagaggctgggagcacctctggcggatgcaatttaaaaaataagagtgctcaaagcctcgaatactgcgcggaactgctcgggctggaccaagatgacctccgtgtgtctcttaccacacgggtgatgctcaccacagctggcggaacaaagggcaccgtgatcaaggtaccgctcaaggtggagcaagccaacaacgctagagatgccctggcaaagaccgtgtattctcatttgttcgaccacgtagttaatagagtcaatcagtgctttccatttgagacaagtagttacttcattggcgttcttgacatcgccggattcgagtactttgagcacaactccttcgagcaattctgtatcaactactgcaacgagaagctgcagcaattcttcaacgagcgtatcctcaaagaagagcaagagctttatcagaaagagggcttaggagtgaacgaggttcactatgtcgacaatcaggactgcatcgatctcatagaggccaaattagtgggcatccttgacattctggatgaggaaaaccgcttgccacagccctccgatcagcatttcacctctgccgtccaccagaagcacaaagaccattttcgacttacgatacctcgcaagagcaaattagcggttcatcgcaatatacgggatgatgagggctttattattcgccactttgccggtgcagtctgctatgaaacgactcagttcgttgaaaagaataatgacgccctccacatgtcgctggaaagcctgatctgcgaaagtcgtgacaaattcatccgagaactgtttgagagctctaccaacaacaataaggacacaaagcagaaggctggaaagctgagttttatctccgtcggtaataaattcaagacacagctcaacctcctgctggataaattgcggtccaccggcgcttcattcatcagatgcataaaacccaatttaaaaatgacctcccaccattttgagggtgcccagatcctctcacagctgcagtgctcggggatggtttccgtgctagatctgatgcagggcggttaccccagcagagcctcatttcatgagctgtataatatgtacaaaaagtacatgccggacaagctcgctcggctagacccaagattattttgcaaagccttgttcaaggccttaggcctgaacgagaacgactacaagttcgggctcaccaaggtgttctttcgacccggtaaattcgctgagtttgaccagattatgaagtccgatccagatcacctagcggagctcgtcaagagagtaaaccactggctgacatgctcccggtggaagaaggtccagtggtgctctttatcggtcatcaaactgaagaacaaaatcaagtaccgggctgaggcctgtataaaaatgcagaagactatacggatgtggctgtgtaagagaaggcacaaaccacgcattgacggactcgttaaggtgggaacccttaaaaagcgtttagacaaattcaacgaagtcgtctcagtgctgaaggatggcaagcccgaaatgaacaaacagataaagaatttggagatatcaatagacacactcatggccaagattaaaagcaccatgatgactcaggagcagattcagaaggagtacgacgccctggtcaagagcagcgaagagctgttgtccgctctgcaaaaaaagaaacagcaggaagaggaggcagagaggttgcgtcgaattcaggaggagatggagaaggagaggaaaagaagagaggaggatgagaagcggaggcgcaaggaggaagaagagcgtcgtatgaagctcgagatggaagcaaagcgaaaacaggaggaggaggaacggaagaagagggaggatgatgaaaaacgaatccaggctgaagttgaagcccagcttgcccgtcagaaagaggaggaaagccaacaacaggctgttctagagcaggaacgcagagatagggaattggctctccgcatagcccagagtgaagcagagctgatttcagacgaggctcaggccgatctcgctctgagacggggaccagccgtgctcgccactaaggctgccgcaggtaccaagaaatacgatctgtcaaaatggaaatacgcggagctgcgagatacaattaatacctcttgcgacatcgagttgctcgccgcatgtagggaagagtttcaccggaggctgaaagtctaccatgcttggaaatctaagaataaaaagagaaacaccgagactgagcagcgcgctccgaaatcagtgacagattacgcccagcagaaccctgccgcacagatccccgctaggcaaagagaaattgagatgaatcggcagcaacgcttctttagaatacctttcatccgcccagcagatcagtacaaggacccccaatccaagaagaaggggtggtggtatgcccactttgatggaccctggatcgccagacaaatggaactgcaccctgacaaaccccctattctcctggtagcagggaaagacgacatggagatgtgcgaactgaatctggaagagaccggcctgacccgaaaacgcggagctgaaatactgccacggcaattcgaagaaatttgggaaaggtgcggcggaattcagtatctgcaaaatgccatcgagtcccggcaggctagaccaacttacgccacagccatgctgcagtctttgctaaagtag

SEQ ID NO: 231642 - DNA, 3858 bp, Artificial Sequence
  Description of Artificial Sequence: Synthetic coding sequence
atggaagatggtaagcctgtttgggctccgcaccctacagacggatttcaaatgggcaacatcgtggacataggcccagattcgctaaccatcgaaccgctgaatcaaaagggaaaaaccttcctggccttgattaatcaagtcttccctgccgaggaggatagcaagaaagatgttgaggataactgctctctgatgtatctgaatgaggccacacttctgcacaacattaaagtgcgctactctaaagatagaatatacacgtacgttgccaatatactcattgccgtgaacccctactttgatatacctaagatttacagtagtgaggccatcaaaagctaccaaggcaagtcccttggaacccgccctccacacgtgttcgccattgcagataaggcattccgcgacatgaaagtcctaaagatgagccagagtatcatcgtcagtggcgagagcggcgcaggaaagacagagaatacaaaattcgtcttgaggtacctcacagagtcatatggaaccggtcaggacatcgatgaccgtattgttgaagccaatcctctgctggaggcctttggaaacgcaaagacggtcaggaacaataattcctcaaggttcgggaagtttgtagaaatccacttcaatgagaagagtagcgtggtaggcggtttcgtgtcgcactacttattggagaaatcaaggatttgcgttcaggggaaagaggaacggaactatcatattttttacaggttgtgcgctggggcttccgaggatattcgggaaaaattgcatcttagcagtccagacaactttaggtacctaaatagagggtgtactagatatttcgctaacaaggagaccgacaagcaaatcctgcagaaccggaagtcacctgaatacctgaaagccggaagcatgaaggaccctctgcttgatgaccacggagatttcattcggatgtgcacagccatgaagaaaatcggattagatgatgaggagaagctggaccttttcagggtggttgctggtgtgctacacctgggcaatatagatttcgaggaagccggaagcacatctgggggatgcaatctgaagaataagtctgcccagtccttagagtactgcgccgaactgctgggactggaccaggacgatctcagggtaagcttaacaacgcgggttatgctaacaacagcgggaggtaccaagggtacagtgattaaggttcccttgaaggtagagcaagccaataatgccagggacgccctcgccaaaactgtgtactctcacctatttgaccatgtggtaaaccgcgtcaaccagtgcttccctttcgaaacgtcttcttactttattggtgtgctcgacattgccggatttgagtatttcgaacataattcctttgaacaattctgcatcaactactgcaatgaaaaactccagcaatttttcaatgaacgtatcctcaaggaggaacaggagctgtaccaaaaagaaggcttgggcgtaaacgaggtgcattacgtggacaaccaggattgtatcgacctgatcgaagctaaacttgtgggaatacttgacatcctggatgaagaaaacagactgccgcagccttccgaccagcattttaccagcgcagtgcatcagaagcacaaagatcacttccgacttacaattcctagaaaaagcaagctggcggtgcataggaacatccgggatgacgaaggattcattatcaggcacttcgccggagctgtttgttatgaaactactcaatttgtagaaaagaataatgacgctttgcatatgtcccttgagagcctgatctgtgagtctcgagacaagtttattcgtgaactgtttgagagctcaacaaacaacaacaaagatactaagcaaaaggctggcaaactgtcattcatttccgtcggcaacaagttcaaaactcagctcaacttgctgctcgataaactcaggagtaccggggcatctttcattagatgcataaagcctaacctgaagatgacaagccaccacttcgaaggcgctcaaattctgtcacagctgcagtgcagcggcatggtgagcgtgctcgacttgatgcagggcggatacccatcacgtgctagctttcacgagctatacaatatgtacaaaaaatatatgcccgacaagctcgcgagacttgatcctcgcttgttttgcaaagccctctttaaggctctcggactaaatgagaatgattataaatttggcctgacaaaggtgttcttcaggcccggtaaatttgcagagtttgatcagatcatgaaaagcgaccccgaccatttggccgaactggtaaaacgggtgaatcactggttgacatgcagccgttggaagaaggtgcagtggtgcagtttgtccgttataaagctaaagaataaaatcaagtacagggccgaagcctgtatcaagatgcagaagacgatcaggatgtggctgtgcaagcgcaggcataagcctagaatagacggcctagtcaaggtgggcactctaaagaaaagactcgataaattcaacgaggttgtcagcgtgctgaaggacggtaagccagagatgaataagcagattaagaacttagagatcagcatcgacacgctgatggccaagatcaaatcaacgatgatgacccaggagcagatccaaaaggaatacgacgccctggtcaaaagtagtgaggaactgctttccgcgctgcagaaaaaaaaacaacaggaggaggaagccgagaggcttcgtaggatccaggaagaaatggagaaggagcgcaaaagacgcgaggaagacgagaagagacgtaggaaggaggaggaggaaagacgaatgaagttggagatggaggccaagcggaagcaagaggaagaggagcggaaaaagagggaggatgatgagaaacggatacaggctgaggtagaggctcagttagccaggcaaaaggaggaagaaagtcagcaacaggccgttctggaacaagagaggagagaccgagagcttgccctgagaattgctcaatcagaggccgagttgatctccgatgaggcacaagccgaccttgcactgcggcgtaatgacggcacccgacccaaaatgacaccagaacagatggctaaagaaatgtctgagttcctgtcgagaggcccagccgtactggccacaaaagctgccgctggcactaagaagtatgatctcagcaagtggaagtacgcagagttgcgggacacgatcaatacttcctgcgacatcgaattgctggctgcgtgcagggaggagttccatcggcgactcaaagtgtatcacgcctggaagtcaaagaacaagaaacgtaataccgagaccgagcaaagagccccaaagtctgtgaccgactacgattttgccccattcttgaataacagccctcagcagaacccagctgcccaaatccctgctcggcaaagagaaattgaaatgaatcgtcagcagcgttttttccggatccctttcattcgtccggcagaccagtacaaggatccacagtctaaaaagaaaggctggtggtacgcccatttcgatggcccttggattgcgaggcagatggaattgcatcccgataaaccccctattctattggttgctgggaaagacgacatggagatgtgtgaactgaacctcgaggaaacaggcctgaccagaaagcgaggggctgaaattcttcccagacaattcgaggagatctgggaacgctgtggaggtatccagtatctccagaatgccatcgaatcacgccaggctaggccaacatatgccacagccatgctccagtccctcctcaaatag

SEQ ID NO: 231643 - DNA, 3861 bp, Artificial Sequence
  Description of Artificial Sequence: Synthetic coding sequence
atggaggatggcaagcctgtgtgggcaccacaccccacagacggctttcagatgggcaacatcgttgacatagggccagacagcctgaccattgagcctctcaaccagaagggcaagacatttctagcgcttattaatcaggttttccctgccgaggaggattctaaaaaggacgtcgaggataattgctctttgatgtacttaaatgaggctaccctcctgcataatataaaggtgaggtacagtaaagaccgcatttacacctatgtggctaacatcctcattgcagtgaacccttattttgacatcccgaaaatctactcttctgaagccatcaagagctatcagggaaagagcctgggcactcggccaccacacgtcttcgcgatcgctgacaaggctttccgagatatgaaggttttgaagatgtcccaatctatcattgtaagcggggaatcaggcgctggcaaaacagaaaatacaaaattcgtgctgagatacctcacagaatcttacggcaccgggcaagatatcgatgaccgaatcgtcgaagctaacccccttcttgaagccttcggcaacgccaaaaccgttcggaataataactcatcccgttttggcaagtttgttgaaatacactttaacgaaaagtcttcagttgtgggtggcttcgtgagtcactaccttctggagaagagccgaatatgtgtgcagggcaaagaggagcgcaattatcacattttttacagactgtgcgctggagcttccgaggatatccgcgaaaaacttcacctgtcgagtccagacaatttcaggtaccttaaccggggttgtacaagatactttgccaataaagaaactgacaagcagatcctacagaaccgaaagtctcccgagtatctcaaagccggttctatgaaagaccctttattagacgatcatggcgacttcataagaatgtgcaccgccatgaaaaagattggcctggatgatgaggagaaactggacctgttccgcgttgtggctggtgttctgcacctaggaaatattgacttcgaggaagcaggctccacctctgggggatgcaacctgaaaaataaatctgcgcaatctctagaatactgtgctgagctgctcgggttggaccaagacgacttgagagtttctttgacaacacgcgtaatgctaaccaccgccggagggaccaagggcactgtcatcaaggtgcctctgaaagtggaacaggctaacaacgcgagagacgccttagcgaagaccgtctacagtcatctgttcgaccatgtggttaaccgcgtgaatcaatgtttcccttttgagacatcctcatattttattggcgtacttgacattgcgggattcgagtatttcgagcataattccttcgaacaattctgtatcaattactgcaatgaaaagctccagcagttcttcaacgagagaatattgaaggaagaacaggaactttatcaaaaggaagggctgggcgttaatgaagtccattacgtcgataaccaggactgtatagacttgatcgaggctaagctcgttgggatactcgacatattggacgaggagaatcggctgccacagccgagcgaccagcacttcacgtccgccgtgcaccaaaagcacaaggatcattttagactgactattccaaggaaatcaaagcttgcagtccataggaacatacgagacgacgaaggtttcattatcaggcacttcgccggagctgtctgttatgagaccacgcagtttgtggagaagaacaacgacgcactgcacatgagtctggaaagccttatctgcgaatctcgagacaaattcatccgggagctctttgagtcctccacaaacaacaacaaggatactaagcagaaggccggaaaattgtcattcatctctgtaggcaacaagttcaagactcaattgaatctgctattggataagctgaggagcaccggggcttctttcatccgctgcatcaaacccaacctcaagatgacgtcgcaccacttcgaaggcgctcagatcctaagccagcttcagtgctctgggatggtgagcgttctggacctcatgcagggagggtatccctcacgggctagctttcacgaactgtacaacatgtacaaaaaatatatgcccgacaaattagcccgtctggatcctagactattctgtaaagctctcttcaaggcattgggtcttaatgagaatgactacaaatttggtttaacaaaagtcttttttcgccctggtaaattcgccgagtttgatcagattatgaagagtgaccctgaccatttagccgagctggttaaacgagtgaaccattggctcacctgcagccgctggaagaaggtgcagtggtgttcgttgagtgtcattaaattaaagaataagatcaaatacagggcagaggcctgcatcaagatgcagaaaaccatccgcatgtggctgtgtaagcgcagacataagccgagaatcgacggccttgtaaaggtcggaacactgaagaagagactggacaagtttaacgaagtggtgtctgtcttgaaggacggcaagcctgagatgaacaaacagattaaaaacctcgaaatttccattgataccctgatggccaagatcaagagcacgatgatgactcaggagcagatccagaaggagtacgacgctttggtgaaaagtagcgaagaactgttgagcgctcttcaaaagaagaagcagcaggaagaagaggccgaacgtcttcgaagaatacaagaggaaatggaaaaggaacggaagaggagagaagaagatgagaagaggcggagaaaggaagaggaggagagacgcatgaagctggaaatggaagcaaaacgcaaacaggaggaggaagaacggaaaaagcgagaggacgatgagaaaagaattcaagccgaggttgaagcccaattggccaggcaaaaagaggaggagtctcagcagcaggccgtcctggagcaggagcgcagagaccgcgagctcgcacttagaatcgcgcaaagtgaagccgagctcatctccgacgaggcccaggcagatctcgcactgcgcagatacttagatagctatccagtgactagcaaaaatgacggcacaagacccaaaatgacaccagaacaaatggctaaggagatgtccgagtttctttccagagggccagccgtcttggccaccaaggctgccgctgggaccaagaaatacgatttgtctaagtggaaatatgctgaacttagggatacaatcaacacctcttgcgacattgagctcttggctgcatgtagagaggagttccatcggagactgaaagtgtaccacgcctggaagagcaagaataaaaagcgtaacaccgagaccgagcaacgggcaccaaagtcagtcacagactacgctcagcagaacccagctgctcaaatccccgcaagacagcgagaaatagaaatgaaccggcagcagcggtttttccggatacctttcatccgacctgcagaccaatacaaagacccacagtctaagaaaaaagggtggtggtacgctcactttgacggaccatggatcgcgaggcaaatggaacttcaccccgataagccccctattctcctggtagctgggaaggacgacatggagatgtgtgagctgaacctcgaagaaacgggcttgactcgaaagcgtggagccgagatcttgcccaggcaatttgaagagatctgggaacgatgcggaggtattcaatatttacagaatgcaatagagtctcgccaggcacgacccacttacgcaacagccatgcttcagtcactgttaaaatag

SEQ ID NO: 231644 - DNA, 3789 bp, Artificial Sequence
  Description of Artificial Sequence: Synthetic coding sequence
atggaggatggtaagcctgtttgggctccacaccctaccgatggattccagatggggaacatcgtggatataggacctgatagcctcactattgagccccttaatcagaaaggcaaaactttcctggccctcataaatcaagtcttcccagccgaggaagactcaaagaaggacgtggaggataactgctcactaatgtacctgaacgaggccacgttgctgcacaatatcaaggttaggtattccaaggatagaatatatacttacgtcgcaaacatcctcatagccgtcaatccttacttcgacattcctaaaatctacagttccgaagccattaaatcttatcagggcaaaagcctgggcactagacctccccatgtcttcgctatagccgacaaggcattccgagacatgaaggtactcaaaatgtctcagagcatcatagtgtcgggtgagtccggagccggaaagaccgagaacacaaaattcgtcctacggtatttaacagaaagttatgggaccggccaggatattgatgaccgcatcgtggaggctaaccccctccttgaggcttttggcaacgccaaaaccgtccggaataataactcctcgcgctttggaaaattcgtggaaatccactttaatgaaaaatcgtcagtcgtcggtggtttcgtgagtcattatcttttggaaaaaagccggatatgtgtgcagggcaaggaagagagaaattatcacatcttttatcgtctctgcgccggtgcaagtgaggacatccgggagaaactccacctcagctcgcctgacaatttccgttacctgaatagaggatgtaccagatacttcgctaacaaagaaactgataaacagatcctgcaaaacagaaagtctccagaatacctgaaggccggttccatgaaagacccgctcctggatgaccacggagacttcatcagaatgtgtaccgccatgaaaaagattggccttgacgacgaagagaagctcgacttattccgtgtcgtggccggagtgctccatctcggaaacatagattttgaggaagctgggagcacctctgggggttgtaacctgaagaataaaagcgctcaatctctggaatattgcgccgaactgctgggacttgaccaggacgatctgagggtatctctgactacacgggtgatgctgaccactgccggtggcacaaaggggaccgtgatcaaagtgccactgaaagtggaacaggccaacaacgcgagggacgcactagccaagaccgtctattcacatcttttcgatcatgtggtcaaccgcgtcaaccagtgttttccattcgaaacctcctcttatttcattggtgtacttgatatagcgggtttcgagtacttcgagcataacagctttgagcagttctgtattaattactgcaacgagaagcttcagcagtttttcaatgagcgaatcctcaaggaggaacaagaactttaccagaaggagggactcggagtgaatgaagtgcattacgtggacaatcaggattgcatcgatctcattgaagctaagctcgtggggatcctagacatcttggacgaagaaaatcggctgccacagccatccgaccagcatttcacaagtgcagttcatcagaagcacaaagaccacttccgcctcaccatcccacgcaaatcaaagttggccgtgcaccggaatatacgcgacgatgagggctttatcatacggcattttgcaggcgctgtgtgctacgaaacaacacaatttgtggaaaaaaacaacgatgcgcttcatatgtccctcgagtccttgatctgcgagagtcgagacaaatttatcagggagctgttcgaatctagtacaaataacaacaaggatactaagcagaaagccggaaagttgtcattcatttctgtcggaaacaagtttaagacacagctaaacctacttcttgacaagttaagatcaaccggggctagcttcatcaggtgcatcaaaccaaatttgaaaatgactagccaccatttcgaaggagcccaaatactgtcacagctacaatgttctggaatggtgagcgtgttggacttaatgcagggcggataccccagccgggctagtttccacgaactgtacaacatgtacaagaaatacatgcccgacaagctggcgcgactggacccaaggcttttctgcaaggcactcttcaaggccctgggattgaacgagaacgattataagttcgggctgacaaaagttttctttcgccctggtaagtttgccgagtttgaccagatcatgaaatctgacccagaccatctcgcagaactggtgaagcgggtgaaccattggctgacctgtagtcgctggaagaaagtacagtggtgctccctgtcggtcataaagttgaagaacaaaattaagtacagagccgaggcgtgtataaagatgcaaaagacaattagaatgtggctctgcaaaagacggcacaagccgaggatcgacgggctggttaaggtagggaccttaaaaaaacgattggacaaatttaatgaggtcgtctccgttcttaaggacggtaagcctgaaatgaacaaacaaatcaagaatcttgagatatcaattgatacactcatggccaaaatcaagtcgacaatgatgacccaagagcagatccaaaaagaatatgatgcgctggtaaaatcaagtgaggaacttctttcagctttgcagaagaaaaagcagcaggaggaggaggccgagcgattgagaaggatccaagaagagatggagaaggaaaggaagagacgggaagaggacgaaaagcgccgaaggaaggaggaggaggagaggcgaatgaaactggaaatggaggcgaagaggaagcaggaggaggaagagaggaagaaaagagaagacgatgagaagcggatccaggctgaagtggaagcacagttggctcgccaaaaggaggaggaaagccagcagcaggcggttcttgaacaagagcgacgggaccgcgagcttgctctgagaatagcccagtcagaggctgagttgatctcagacgaggcccaggctgacctggcactgcgcaggggccctgcagtcttagctacaaaagctgcagctggcacaaaaaaatatgatttgtctaaatggaagtacgccgagctgcgagatacgattaacacatcgtgtgatattgaactccttgccgcatgcagggaggaatttcatcggagactgaaggtgtatcatgcgtggaagtctaaaaacaagaaacggaataccgaaaccgagcagcgagctccgaaatccgtgaccgactacgacttcgcaccatttctgaataattccccacaacagaaccccgcagcccaaatccctgccagacagagagagattgagatgaacaggcagcagagattctttcggattcctttcatccgtcccgctgaccagtacaaggaccctcagtctaagaagaaaggctggtggtatgctcactttgacggtccgtggatcgctagacagatggagctacatccagacaaaccccctatccttctggtggcgggaaaagatgatatggaaatgtgcgagttaaacctggaagagacagggctgacaaggaaaaggggtgccgagatcctcccccgtcaattcgaggagatctgggagcgctgtggcggtatccagtatttgcaaaatgcgatcgagtcacgacaagccagacctacatatgccacagcaatgctgcagagtttgctgaagtag

SEQ ID NO: 231645 - DNA, 3888 bp, Artificial Sequence
  Description of Artificial Sequence: Synthetic coding sequence
atggaggacggtaagcccgtctgggcccctcatcctaccgacgggtttcagatggggaacatcgtggacataggaccagattcgcttacaatcgagccactcaatcagaaaggcaagaccttcctcgccctcatcaatcaagtgtttcccgctgaagaggattccaagaaagacgtggaagataactgctcacttatgtacctcaatgaagctacattgttacacaacatcaaagttcgatactccaaagacaggatttatacgtatgttgccaatatcctcatagcagtgaatccatactttgatattccaaaaatatattccagcgaggctatcaaaagctaccaggggaagagtttggggactcggccaccccatgtgttcgctatcgctgacaaggccttccgggacatgaaggtcttgaagatgagccagtcaattattgtgtcgggggagagtggtgccggaaagaccgagaatacaaagttcgtactgcgctatctgaccgagtcctacggaactggtcaggacatagatgatcgtattgtggaggctaatccactcctagaggcattcggaaatgctaaaaccgtgcggaacaataatagctcgcgattcggtaagtttgttgaaatccactttaatgagaagagctctgtcgtgggaggcttcgtcagtcactatctgttggaaaaatcacgtatttgtgtgcagggaaaggaggaacgcaactaccatatcttctacaggctttgcgccggtgcgtcagaggatatacgcgagaagctccacttatctagtccggacaatttccgctacctcaaccgcggttgcactagatattttgcaaacaaggagactgataagcagattttgcagaatcgcaaatcgcctgagtacttgaaggcaggcagtatgaaggaccccctgttagacgatcacggagactttatccgtatgtgtacagcaatgaagaaaataggccttgatgacgaagaaaaactggatcttttcagagtggtggctggcgttctccacctgggcaacattgattttgaggaggcgggttccaccagtggcggatgcaacctgaaaaacaaatcagcccagagcctcgagtattgtgccgaattgctggggctggaccaagatgatctgcgcgttagcctgacaactcgcgtgatgctgactaccgccggtggcacaaaaggtaccgtgatcaaggtgccactgaaggtggagcaggcaaacaatgcccgagatgccttggcaaaaacagtgtactcgcacctctttgaccatgtggtgaacagagtgaatcaatgcttccctttcgaaacctccagttacttcatcggggtcctggatatcgcgggatttgagtacttcgagcacaattcattcgagcagttctgcataaactattgcaacgaaaaactgcaacagttttttaatgagcggatcctgaaagaagaacaggaactgtatcagaaggaaggcctgggcgttaatgaagttcactatgtggacaatcaggattgtatcgatctcatagaggctaagcttgttgggatattagatatactggatgaggaaaacagacttcctcaaccatccgatcagcactttaccagcgcagtgcatcaaaagcacaaagaccatttccgcctcacgatccctcgaaaaagcaagctggcagtgcatcgaaatattagggatgacgaaggctttataatccgccatttcgcaggagcggtctgttacgagaccacccaattcgtggagaagaacaatgatgctttacacatgagcttagaaagtctgatctgtgagtctagagacaagttcattcgtgagctgtttgaaagctctacgaacaacaataaggataccaagcagaaagccggaaagctgtcctttataagtgtcggtaacaagttcaaaacacaactgaacctgctgctggataaattgcgctcaaccggcgcttctttcataagatgcatcaagccgaatctaaaaatgaccagtcaccactttgaaggcgctcagatactcagccaactccagtgttctggcatggtgagcgtccttgatttgatgcaaggtggttatccgtcacgcgcaagcttccacgagctctacaacatgtataaaaaatacatgcccgacaagcttgcgcgacttgacccgcgtcttttttgcaaggcgttgttcaaagccctaggtctgaatgaaaatgattacaaatttgggctgactaaggtcttcttccgcccagggaagtttgcggagtttgatcaaattatgaagagtgatccagatcatctcgccgagcttgtcaaacgggttaatcactggttgacctgttcacggtggaaaaaggtccagtggtgcagcctctccgtgattaagctcaaaaacaaaattaaatatagggctgaagcatgcatcaagatgcaaaagaccatcaggatgtggctttgcaagcggcgacataagccaagaatcgacggactggtgaaagtgggcactcttaagaagcggttagataagttcaacgaggttgtgtccgttctcaaggacggaaaaccagaaatgaataagcaaattaagaaccttgaaatcagtatcgacactctgatggctaagattaagtcaacaatgatgacccaggagcaaatccagaaggagtacgatgccttagttaaaagcagcgaggaactcctgtccgcattacaaaaaaagaaacagcaggaagaagaggcagaacgcttgcggaggatccaggaagagatggagaaagaaagaaaacggagagaagaggatgagaaacgtcgcagaaaggaggaagaagaacgacggatgaagttggagatggaggcgaagcggaaacaggaggaggaggagaggaagaagcgtgaagacgacgagaagagaatccaggccgaggtcgaagcccaattggctaggcaaaaagaagaagagtcccagcagcaggcggtcttagagcaggagagaagggaccgcgagctggcactccgcatcgcacagtcagaagcggaattaatctctgacgaggcacaggccgacctggccctccgaaggtacttggactcttatccagtaacatcaaagaacgatggaactagacccaagatgacgccggaacaaatggctaaggaaatgtccgagttcctgtcccgcggacctgccgtcctcgccacaaaggcagctgcaggcactaagaaatacgacttaagtaagtggaagtatgccgaattgcgggacaccattaatacatcttgtgacatagagctcctcgccgcttgccgcgaggagttccaccgccgactcaaggtttatcatgcctggaaaagtaagaacaagaagcgcaataccgaaaccgagcagcgcgcaccaaagagcgtaacagactatgattttgctccatttttgaacaattcccctcagcagaatcccgctgcccagatacccgctcgtcagcgagaaattgagatgaacaggcaacagagatttttccgcatcccctttatccgcccagcggaccagtacaaagaccctcagagtaaaaaaaaaggatggtggtatgcccattttgacggaccatggatcgcaagacagatggagctgcaccccgacaaaccgccaattctgctcgtagccggaaaagatgacatggagatgtgcgaattgaacctggaagaaaccggtttaacccgaaagcggggtgccgagattctgcctcgacagttcgaggaaatttgggagagatgcgggggtatacagtacctgcagaatgccatagaatctaggcaagcaagaccaacctacgcaaccgccatgcttcagagtttgcttaaatag

SEQ ID NO: 231646 - DNA, 525 bp, Artificial Sequence
  Description of Artificial Sequence: Synthetic coding sequence
aagcgacgcgaggaggacgaaaagagacggaggaaggaggaagaggagcgccgtatgaaactggagatggaggccaaacggaagcaagaagaagaagagcgaaaaaaacgggaggatgatgaaaagcgcatccaggccgaagtggaggcacagctcgcacgccagaaggaggaggagtctcagcagcaggcagttttagaacaagagaggagggatagagagctggccctccgaatagcccaaagtgaggccgaactgatttcagatgaagctcaggctgacctggccctgcgatcactggattcatacccggtgacctctaagaatgacgggacacgacccaaaatgacacccggacccgctgtgctggcaacaaaggcagcagcaggcactaagaagtatgatctgtcgaaatggaaatacgctgaactgcgtgacacgattaacacctcatgtgatatcgaactattggccgcttgcagggaggagtttcatcgcagattaaaagtatatcatgcttggtag

SEQ ID NO: 231647 - DNA, 6275 bp, Artificial Sequence
  Description of Artificial Sequence: Synthetic coding sequence
gccctgctgcagaagggagaccacgtgtggatggatctcaggctcggtcaagagtttgatgtgcctatcggcgctgtggtcaaattatgcgacagcgggcaggtacaggtagtggacgatgaggataatgagcactggatctcaccgcagaatgccacccacattaagcccatgcatccgaccagcgttcacggtgttgaggatatgatccgcctgggagacctcaatgaggccggaatcctgagaaacctgctcattagataccgtgaccatttaatatacacttataccgggagcatcctggttgccgtgaacccctaccagctgcttagtatctactcacccgaacacattcgccagtacaccaacaagaagataggcgaaatgccgccacatatttttgcaatcgccgataactgctattttaacatgaagcgcaactctagggaccaatgttgcatcatctctggtgagtcaggagcagggaaaactgagtccaccaaactcatcttacagtttctggccgctatctctggccaacactcttggatcgagcagcaggtcctggaggccactcccatcttggaagctttcggcaacgccaagaccatccggaacgataattccagtcgcttcggaaaatacatcgacatccatttcaacaaacgcggtgcaattgagggtgctaaaatcgaacagtacttgctcgaaaagagccgtgtctgccggcaggctctcgatgagcgaaattatcacgtgttctactgtatgctcgagggaatgtccgaggatcagaaaaagaagctggggctcggccaggcctccgactacaattatctggccatggtcaatccacccgacctcatgtcttgcctgacaagccggacactgattacccgcggtgagacagtcagcacacccctgtcacgggaacaggccctggatgtgagggatgcctttgttaagggaatctatggcagattattcgtctggattgttgataaaattaatgctgccatctacaaaccccctagtcaggatgtgaaaaattctcgcaggtcgatcgggctgttggatatttttgggttcgagaattttgcagtgaattcttttgaacagctttgcatcaactttgccaacgagcatctgcagcaattcttcgtcaggcatgtgtttaagctggagcaggaggagtacgatttggagagcatcgactggttacatatcgagtttaccgataatcaggacgcactcgacatgatcgcaaacaaaccaatgaatattatttccttgatcgacgaggagagtaaatttcccaaattcctggaaaagaacagagacacgctccatggcgatatcatccagctcgtgcacagcagtagaaataagttcatcaaacagattttccaagctgatgtcgccatgggagctgaaacacgaaaacgaagtcccacgttgtcatcccagttcaagcggtcgcttgaattgttgatgaggaccctgggggcttgccagccattctttgtccggtgtatcaaaccaaatgagttcaagaagcctatgctttttgacagacacttgtgcgttcgccaactgaggtatagcggaatgatggaaaccatacgcatccgacgggcaggctatcctattaggtactccttcgtggagttcgtggagaggtacagagtcctcctaccaggggtgaaaccagcatacaagcagggcgacctgcggggaacctgccagcgcatggcggaagctgtcttaggcacccatgacgactggcagattggcaagactaaaatctttttgaaggatcaccacgatatgttgctagaggtggaacgcgacaaggccataaccgatagagttatcctcctgcaaaaggtaattcgtggtttcaaagaccggagcaatttcttaaagctcaagaacgccgctaccctgatccagagacattggcgcggacataattgccgtaaaaactatggcttaatgcgtctaggattcctccgtctgcaggcactgcaccgatcaagaaaactgcaccaacagtacagattggctcgtcagcgcatcatccaattccaagccaggtgccgcgcatacctggtgcgaaaagcgttccggcatcgcctgtgggcggtgctgacagttcaggcttacgcgaggggaatgattgctagacgcctgcaccagagactacgtgcagagtacctctggcgcctggaagctgagaagatgcgactggcagaggaagagaaattacggaaagaaatgtctgccaagaaagccaaagaggaggcggagcggaaacaccaagagcgcctcgcccagcttgcccgtgaagatgctgaacgggaattgaaggagaaggaagccgctaggcgcaaaaaggagttgctggagcagatggagcgcgctcggcatgagcccgtgaaccacagtgacatggttgacaaaatgttcgggttcctggggacctccggcggactccctggacaggagggccaggccccttccgggtttgaagacttagaacggggaaggcgagagatggtggaagaggatttagatgccgcactgccacttccggacgaggacgaggaggatctgtccgagtataagtttgccaagttcgcggcaacctatttccagggcaccactacccactcatacaccaggcgacccttgaagcagcctcttctctaccacgatgacgaaggggaccaactggccgcactggccgtctggattaccatactacgcttcatgggtgatttgcctgagcccaagtatcacaccgcgatgagtgacggaagcgaaaaaatccctgttatgacaaaaatctacgagacattaggtaagaaaacttacaagcgcgaactccaggcactacagggggaaggtgaagctcaactgcccgagggacaaaaaaaaagtagtgttagacacaaactcgtgcacctgacactcaaaaagaagagcaaacttactgaggaggtcacaaaacgcttacacgatggagagtctaccgtccaaggaaatagcatgttggaggatcgcccaacatctaacctggaaaagctgcacttcattattggcaacggcattcttcgaccagcactgcgggatgagatttattgccagatatctaaacaactgacccacaatcccagcaagtctagctatgcacgcggttggattctggtgtctttgtgtgtaggatgctttgcccctagtgagaagttcgttaaatacctgcgcaactttatccatgggggtccacctggatacgctccatattgcgaagagcgccttcgcaggacgttcgtcaacggtacacggacacaaccgccaagctggctggaactgcaagccaccaagagcaagaaacccattatgctccccgttacttttatggacggaactaccaaaactctgctgaccgattccgccacaacagccaaggagctgtgcaacgccctggcagacaaaatcagcttgaaagatcgattcggcttcagcctgtacatcgcactttttgacaaggttagcagtctgggttcagggagcgaccacgtcatggacgccatttctcagtgtgagcagtatgcaaaggaacaaggggctcaggagcgcaatgcgccatggaggctgtttttccggaaggaagttttcaccccctggcactcccctagtgaagataatgtggccaccaacctgatatatcagcaggtggttcggggagtcaaatttggcgagtacagatgcgagaaagaggatgatctggctgagctagctagccagcagtatttcgtcgactatggatccgagatgattcttgaacgccttcttaatctagtgcccacttacatacctgatcgagaaatcacaccactcaagaccctggagaagtgggcgcaactggccatcgccgctcataaaaaagggatatacgctcagcgcagaactgacgcacaaaaggtcaaggaggacgtggtgtcatatgcacgcttcaaatggccactgctgttctcgaggttctacgaagcatataagttctcagggccatcactgcccaagaatgacgtaatcgtcgcagtaaattggaccggcgtgtactttgtcgacgaacaggagcaagtcctgctggaactgtctttccccgaaattatggctgtcagctcctctcgcgagtgtagagtgtggcttagcctcggctgcagcgatctcggctgtgccgctccacattcggggtgggcaggtctgactccagcaggtccttgctcaccctgctggagttgccgaggtgcaaaaacaacagctccttctttcacgttggccaccataaagggggacgagtataccttcactagctccaacgccgaggacattagggacttggtggtaacctttttggagggattgagaaaacggtccaaatacgtggttgctctgcaggataaccccaacccagcgggagaggaaagcgggtttctctcctttgccaagggtgacttgattattctggaccatgacacgggcgagcaggtgatgaatagcgggtgggccaacgggattaacgaacggacgaaacagcggggagatttcccaaccgatagtgtctatgtgatgccaacagtgactatgccacccagagagatagtggcgctggttaccatgacccctgaccagcgacaagacgttgtgcggttactgcagctgcggacagcggagccagaggtgagggccaagccttatacactagaagaattctcatatgattatttcagaccccctcctaaacacaccctcagtagagtgatggtgtccaaggcgcgagggaaagaccggctctggtctcacacaagagaacccctgaagcaggccttactcaaaaaactcttgggtagcgaggaactgagccaggaagcatgcctcgcgttcatcgcagtattaaagtacatgggtgactacccatccaagcgcactcgatctgtcaacgagctgacagatcaaatctttgaaggacccctgaaggcagagcctctgaaggacgaggcgtatgtccaaattctgaagcagctgaccgataaccacatccgttactccgaggagagagggtgggaactgctttggctgtgcaccggtttatttcccccttccaacatcctgctccctcacgtgcagcggttcttgcagtcccgcaagcactgtcccctcgctatagactgtctgcagaggctccagaaggcattaagaaacgggagtcgcaagtatccccctcacctcgttgaagtcgaggctattcagcacaagaccactcagatcttccataaagtatattttcccgacgataccgatgaggcatttgaggtcgagtctagcaccaaggctaaggacttctgccagaacattgctaccaggctgctactgaaatcatccgaagggttttccctttttgttaaaattgccgacaaggtgctttccgtgcccgaaaacgatttttttttcgactttgttcgccacttgactgattggattaagaaggctagacctatcaaggatggtattgtccccagcctgacataccaggtctttttcatgaagaagctatggacaacaaccgtgcccggtaaggaccccatggctgattcaatttttcattactaccaagagctgcctaaatatctcagggggtaccataaatgcacccgtgaggaagtacttcagctcggggctttaatttaccgcgtcaagtttgaagaggacaagtcatattttcctagcattcccaaactcctgcgcgaactggtcccacaagatctgatacgccaggtgtctcccgacgattggaagcgcagcatcgtcgcctactttaacaaacacgctgggaaatcaaaggaagaagcgaaactggccttcctgaagctgatctttaaatggccaacttttggtagcgcattctttgaagtcaaacagaccaccgagcccaatttcccagagatcctattgatcgctattaacaaatacggggtcagccttattgacccaaagacaaaggatattctaacaacccacccgtttacgaagatttcaaactggagctctgggaacacctacttccatattaccattgggaacctcgtgcgcggaagcaagctcttatgtgaaacctcgctggggtacaaaatggacgacttactcactagttacatttctcaaatgttgactgcaatgagcaaacaaaggggatctcgctccggtaagta

SEQ ID NO: 231648 - DNA, 6554 bp, Artificial Sequence
  Description of Artificial Sequence: Synthetic coding sequence
gctctgctgcagaagggggaccacgtgtggatggacttgaggctgggtcaagagtttgacgtgcctattggcgctgttgtcaaactctgcgatagcggacaggttcaagtggtggatgatgaggacaatgagcactggattagcccccagaacgccacgcacataaagcccatgcatccaacatctgtgcacggagttgaagatatgatccgcctgggagatctaaacgaggccggaatcctcaggaatctgctgatcaggtaccgagaccatctcatctacacatatactggaagcattttggtggctgtaaacccttatcaattgctttccatttacagccccgagcacatccgccagtacaccaataagaagattggggaaatgccgcctcatattttcgctattgcagataactgctacttcaacatgaagagaaacagtagggaccagtgttgcatcatcagtggcgaatcaggcgctggcaagacagaaagcaccaaactgattctgcagttcctcgcagcaatttctggtcaacactcttggatcgaacagcaggtgctggaagcaacaccaatccttgaagctttcggcaacgcaaagacaattagaaatgataattcgtctcgcttcggtaagtatatagatatccatttcaacaaaagaggcgctattgaaggggcaaaaattgagcagtatctgctcgagaaaagcagggtttgccggcaagccttagacgaacgtaattatcatgtgttctactgcatgttagagggcatgagcgaagaccagaagaagaagctgggactggggcaggcatccgactacaattaccttgcaatgggcaattgtattacgtgtgaaggccgtgtggacagccaagagtacgccaatattaggtcagcgatgaaagtcctgatgttcacagatactgaaaattgggaaataagcaagcttcttgcggcaattctgcatctaggcaatctccagtacgaagcccgaactttcgaaaatctggacgcctgtgaggttctgttttctcccagtctggccaccgccgcttccctcctagaggtgaacccccctgacctcatgagctgtctgacgtcaagaaccctgattactaggggcgaaactgttagcaccccgctgtcaagagagcaggccctggatgtgcgtgacgcatttgtcaaagggatatatggtaggcttttcgtttggatcgtcgataaaatcaatgccgcaatttacaagccccctagccaggatgtgaaaaatagccggaggtcaattggccttctggacatttttggatttgaaaatttcgcagtcaactcgttcgagcagctgtgcattaatttcgccaacgagcacctgcagcaattttttgtgcgccatgtgttcaagctcgaacaggaggagtacgatctcgaaagcatagactggctccatatcgaattcaccgacaatcaggacgctttggacatgatcgcgaacaaaccaatgaacatcatcagccttattgatgaagaatccaagtttccaaagggaactgacaccaccatgctccataagctgaattcacagcacaagctgaacgcaaactacattccacccaagaacaatcacgagacgcagttcggcattaatcactttgcagggatcgtgtattatgagacccagggctttctggagaaaaaccgagacaccctccacggcgatattattcagttagtgcacagcagcagaaacaagttcataaagcagattttccaagccgatgtggctatgggtgctgagactaggaagcgtagcccaactttatccagtcaatttaaaagatcgttagaattacttatgcgcaccctgggtgcctgtcagcccttctttgtgcgctgcatcaagcccaacgaattcaaaaagcctatgttatttgatcgacatctttgcgtgcgccagttacggtacagtggcatgatggaaaccataaggatcaggagagccggttatccaatccgatattcatttgtggaatttgtggagcggtacagagtactcctgcctggggtcaagcccgcatacaaacagggcgacctgcgtggcacctgccagcgaatggcagaggcagtgctcggcacccacgatgactggcagatcggtaaaactaagatatttctgaaagaccaccacgacatgctgctcgaagttgaacgggataaggcgattacagaccgagtgattctactccaaaaagttataaggggtttcaaggacaggtccaacttcttaaaactgaaaaatgccgcaactctcatccaaagacactggcggggtcacaactgcaggaagaattatggattgatgcgcttagggttcttgaggttgcaggcgctacataggagcagaaaactgcaccagcagtaccgtctggccaggcagaggatcattcaattccaagcaaggtgcagggcatatctagttagaaaagccttccgacatcgcctatgggctgtattgacagtgcaggcttatgctcgcggaatgatcgccagacgtctgcaccaaagactgcgagctgagtatctctggcggctggaggcagagaagatgcggctggccgaagaagaaaaactgcggaaggagatgagcgccaagaaggcaaaagaggaagccgagaggaagcaccaggaacgtctggcccagttagccagggaggacgctgaaagagagcttaaggagaaggaagcggctaggagaaaaaaggaactcctggaacagatggagcgcgcaaggcatgagcccgtcaaccattctgatatggtggataaaatgtttggatttctggggaccagtggaggcctgcccggtcaggagggccaggctccttcaggatttgaggatctggagagaggacgacgagagatggttgaagaggacctggacgcggcactgcccctccctgacgaagatgaagaagatctttccgaatacaaatttgcgaagtttgctgctacatactttcagggaaccaccacccattcttatacgcgtagaccgttgaaacaaccactgctttaccacgatgatgagggcgaccagctcgctgcattggccgtgtggataactattctacgattcatgggagacctgcctgagcccaagtaccatacggccatgtctgacggcagcgagaagatacctgtgatgaccaaaatatatgagaccctgggaaaaaaaacatacaaaagagagcttcaagccctccaaggcgaaggagaggttactaaacgtctgcacgacggtgaaagcactgttcaaggtaactctatgttagaggatcgcccaacctccaacttggagaaactgcacttcataatcggcaacggcattcttcgccctgcccttagagacgagatttactgtcaaatttctaagcagctgacgcacaaccccagtaagtcatcatacgccaggggctggatattggtgagcctgtgtgtagggtgcttcgcgcctagtgaaaagtttgttaaatacctgcgcaatttcatacacggcggacctcctgggtacgccccttattgcgaagagcgactgcgccgaacgttcgtgaacgggaccaggacccagccgccaagctggctcgaactccaggccacaaagtctaaaaagccaattatgctgccagtgacctttatggatgggaccactaaaaccctgctgactgattccgcaaccacagctaaagagctgtgcaatgccctggcagataagatctcattgaaagatagatttggattttccctctatatcgctctttttgacaaagtgtcttccttgggctctgggagcgaccacgttatggatgccatcagtcaatgcgagcagtatgccaaagaacagggtgctcaagagcgtaatgccccatggcgtctgttctttcgcaaagaggtgtttaccccatggcacagcccgtctgaggacaatgttgccaccaatcttatttaccagcaggtggtgaggggtgtcaagtttggcgagtacagatgtgagaaggaggacgacctcgccgaattagcaagtcagcagtacttcgttgattatggctctgagatgatactggaaaggctgctgaacctggttcctacttacattcctgatcgggagattacccctttgaagaccttggagaagtgggcacagctcgccattgccgctcacaagaagggcatatacgcgcagagacgcactgacgcacagaaagtgaaagaagatgttgtttcctatgcgagatttaagtggcctttgctatttagtcggttctacgaagcctacaaattctcaggccctagcctcccaaagaatgatgtcatagtggccgttaattggaccggggtgtacttcgtagacgagcaagagcaggtgttgttggagttgtccttccccgagattatggccgtgagcagttcccgagagtgtcgtgtgtggctgagccttggttgcagcgatcttggctgcgccgcacctcactccggctgggccggacttaccccggcagggccttgttcaccatgctggagctgtaggggtgctaagaccacagccccttctttcactttggccaccataaaaggcgatgaatacactttcacctccagtaatgccgaagacataagggatctggtggttacttttctcgaagggttgagaaagaggagtaagtatgtggttgccctgcaagacaaccctaaccccgctggtgaagagagtggctttctgtcttttgctaagggtgatctcattatcttggaccacgacacaggtgagcaggtaatgaactccggatgggcaaacggaattaatgagcgtaccaaacagagaggagacttccccaccgactccgtctacgtgatgccaacggtgactatgccaccgagagagatcgtcgctctggtaactatgacgccggaccagagacaggatgtggtgcgcctgctccagttgagaaccgcagaacccgaagtgagagctaaaccttataccctggaagagttttcttacgactactttcgccctccgccaaaacacacactgtcccgggtgatggtcagtaaggcgaggggaaaggatcgactgtggtcacatacccgagagcccctgaagcaagctctattaaagaaactgcttggctctgaagagcttagtcaggaagcctgtttagcattcatcgcagtgctgaaatatatgggcgactacccatccaagcgcactcgatcggtgaatgaactcaccgaccagatatttgagggacctttgaaggccgaacctctgaaagatgaagcatatgtgcagatcctgaaacagctgaccgacaatcacattcgatactcggaagagagggggtgggagcttctgtggttgtgtacgggtctcttcccaccctcgaacatacttttgccccatgtacaacggttcctgcagagccgaaaacattgtccactcgcgattgactgtctgcaaagattacagaaggcgttgcgtaatggatcaagaaaatacccccctcatctggtggaggtggaggctatccagcataaaactacacagatttttcacaaagtgtattttcccgatgatacagatgaagctttcgaggtggagtcctcaacaaaagctaaagacttctgccagaacatagccactcgacttctgttaaagtcctcagaaggcttcagtctttttgtcaaaatcgcggataaggtcctgagcgtcccagagaatgacttctttttcgacttcgtgcggcatctgaccgattggatcaagaaagccagacccattaaggacggaatcgtgccctcactcacctatcaggtcttcttcatgaaaaaactgtggaccactaccgttcctggcaaagaccctatggcggactctatttttcactactatcaggaattaccaaagtatcttcgaggttatcataagtgcactcgggaggaagtgctacaattaggggcattgatataccgggtcaaatttgaagaggacaagagctattttccatctatcccaaagttactgcgtgagctggttccccaggacctgatccgccaggtgtctcccgacgactggaaacgaagtatagtggcctacttcaataaacatgcgggaaagagtaaggaggaggcaaaacttgcctttctgaaattgattttcaagtggcccactttcgggtccgctttctttgaggtgaagcagaccactgaacctaatttcccagaaattctgctcatcgcaatcaataagtatggagtgagcctcattgatcctaaaacaaaagatattctgactacccatcctttcacaaagataagcaactggagctcgggcaacacctattttcacatcaccatcggaaatctggtgagaggatccaagctcttgtgcgaaacttcactagggtataagatggacgacctcctgacctcttacatcagccagatgctgactgccatgtccaagcaaaggggatcccggtcagggaagta

SEQ ID NO: 231649 - DNA, 3609 bp, Artificial Sequence
  Description of Artificial Sequence: Synthetic coding sequence
gctctgctgcagaaaggggaccatgtctggatggacctgcggcttggccaggagttcgatgtgcctattggcgctgtggttaaactctgcgattcaggccaggtgcaagtggtggacgacgaggacaacgaacattggatctcccctcagaatgctacccacatcaagccaatgcatcctaccagcgttcatggagtggaagatatgatacgactaggggacctcaacgaggccggaatcttgcggaatttgctaattcgctatcgcgaccatcttatatacacatatacaggtagcatactggtagcagtgaatccataccagctgcttagcatttacagcccagaacatattaggcagtataccaataagaaaatcggtgagatgcctccgcatattttcgctatcgctgacaattgctattttaacatgaaacgcaacagtagggatcagtgctgtatcataagcggtgaatctggcgcagggaaaactgaaagtaccaagctaatcttgcagttcctggcagccatatctggccagcacagctggatcgaacagcaggtattggaagctacaccaatcctcgaggccttcggtaatgccaagactattaggaacgacaactcatctaggttcggaaaatacattgatattcatttcaataaaaggggggcaattgaaggagccaagattgaacagtatcttttggagaagagtcgagtgtgtagacaggcacttgatgagcgaaactaccacgtcttctactgtatgcttgaagggatgtcggaagatcagaagaaaaagttggggctagggcaggcctcggactacaactacctagcaatggggaactgcatcacctgcgagggcagagtcgattcccaggaatacgcgaacattcgcagcgctatgaaagtcctgatgttcactgacacagaaaactgggaaatatccaaactcttggctgccattcttcacctcggaaacctgcaatatgaggcacgaacatttgagaatctggacgcttgcgaggtgctgttttcaccctctctggcaaccgctgcaagtcttctggaggtgaatcccccagatctgatgtcgtgcctgacctcaagaacactcatcactagaggcgagactgtaagtacacctttatccagagagcaggcattggatgtgcgcgatgcattcgtaaaggggatttatggcaggctgttcgtttggattgtggataagatcaatgcggctatctataagccaccatctcaggatgtgaagaacagtaggcgatccatcggactcttggatattttcggatttgaaaatttcgccgtcaattcctttgaacaactgtgtatcaattttgctaatgaacacctgcagcagttcttcgtgcgccacgtttttaagttagaacaggaggagtacgacctcgaaagcattgactggctgcacatcgaattcaccgataatcaggacgctttagatatgatagccaacaagccaatgaacattatctcactgatagatgaagagtctaagttccccaaagggacagatacgactatgctgcacaagctgaactcccagcacaaactgaacgccaattatattcctccgaaaaacaaccatgaaactcagtttggcatcaaccacttcgctgggatcgtgtattatgagactcaagggtttctcgagaaaaatcgggacactttacatggcgacattattcaacttgtgcactctagccgcaataagttcataaagcagattttccaggccgacgtagccatgggcgcagagaccaggaagaggtccccaacactatcatcgcaatttaagagaagcctggaactgctaatgcgcaccctcggcgcttgccagccgttcttcgtgagatgcataaagcccaacgagttcaaaaagcccatgctgtttgaccggcacctgtgcgtgcggcagctgaggtactctggaatgatggagaccatcaggatacgaagagcgggttatcctatccgctattccttcgtggaatttgtggagaggtaccgagttctgctccccggagttaaacccgcttataagcagggggatttacgtggaacttgccaacggatggcagaagcagtgctgggtacccatgatgattggcaaattggtaagacaaagatcttccttaaagaccaccacgatatgctcctggaagtggagagggataaggctatcacggaccgcgtcatactgctacaaaaggtcatccggggtttcaaggatagatccaacttcctaaagctcaagaatgccgctaccctgattcagcgccattggcggggtcacaactgtaggaagaattacgggctcatgagattggggtttctacggctgcaagccctgcaccgatcccggaagctacaccagcaataccggctcgcacggcagcgcatcatacagttccaggctcgctgtcgagcttatctggtgaggaaagcctttcgccaccggctctgggcagtcctgactgtccaggcgtacgctcgagggatgatcgcacgtcggttgcaccagcgcctgagggccgagtacctgtggaggttagaggccgaaaaaatgcgccttgccgaagaggagaaactaagaaaggaaatgtcagctaagaaggccaaagaagaagcagaacggaaacaccaggagcggttggcccagcttgctcgcgaagatgccgaaagagaactgaaggaaaaggaggcagctcgcagaaagaaggaactccttgaacagatggagagagcgagacacgagcctgttaatcactctgacatggttgataaaatgttcggatttctaggtacctcaggtggtctgcccggtcaggaggggcaggcgccaagcggatttgaggatctcgagcgcggacgcagagagatggtggaggaagatctcgacgcagcactgccactccccgatgaggacgaggaagacctgtcggagtacaaatttgcaaagtttgcagctacatacttccaagggactactacccattcttacactagacgcccattaaagcagccactcctgtatcatgatgacgaaggcgaccagttggcagctctcgcagtgtggatcacaattcttagatttatgggtgaccttccggagccaaagtaccacacagcaatgagcgacggcagcgaaaaaattcccgtgatgactaaaatctatgaaacacttgggaagaagacctataaaagagaactccaggccctgcagggtgagggcgaagtcctgcaagcacaactgccggagggacagaagaagtcgtccgtcagacacaagctggtacatctgactttgaaaaaaaaatcaaaattgacggaagaagtcactaaaagactgcatgatggcgaatctaccgtccagggtaatagcatgttggaagaccggcctacctccaacctggaaaagctccactttatcatcggcaacgggatcttgagacccgctctgaggtcggtcccccctgagtccttactggtggccgagtggtgcctatgtcagcctagcaaacgcctgtcacaggccccaggcttcggcttcgccgcatcttag

SEQ ID NO: 231650 - DNA, 6645 bp, Artificial Sequence
  Description of Artificial Sequence: Synthetic coding sequence
gctttactgcaaaaaggcgaccacgtgtggatggaccttcggctcggccaggagtttgacgttcctatcggagctgttgtgaagctttgtgactctgggcaggtgcaggtggtggatgacgaagataacgagcactggatctcaccccagaacgctacccacattaaacccatgcatcctacaagcgtgcatggcgtagaggacatgattaggttgggcgatcttaatgaggccggaattctcaggaacctgctgattcgctaccgggaccatttgatatatacctacactggctctatacttgtggccgttaacccctatcagcttctgtcaatctactctcccgaacatatacgccagtatactaacaaaaaaattggcgagatgccacctcatatcttcgccatagcagacaattgctattttaacatgaagcggaattcccgggaccagtgttgcatcatttcgggggaatccggcgctggcaaaacggagtccacaaagctgatcctccaatttctcgccgctatctcaggccagcatagttggatcgaacagcaggtgctggaggcgacccccatactcgaagcatttggcaacgcgaaaacgattcgtaatgacaactcaagtcgctttggaaaatatattgatatccattttaataaacgaggtgccatcgagggagccaaaatagaacagtatttgcttgaaaaaagtcgggtctgtcgtcaggccttggacgagcgaaattatcacgtcttctattgcatgttggaaggcatgtcagaggatcaaaagaaaaaactgggtctgggccaggcatctgattataattaccttgccatggggaactgcataacctgcgaggggagggttgactcccaggagtacgccaatatccgctccgccatgaaagtcctcatgtttactgacactgaaaattgggagatttccaaactgctagcagccatacttcacttgggaaatctgcagtatgaggctagaacgttcgagaacttggatgcctgcgaagtgttgttctcacccagtctcgccactgccgcttcgctgctagaggtcaatccgccagatttgatgagttgtctcacatcccggactctgattacaaggggagaaacggtttcaacacccctgagcagagaacaggccctcgatgtaagggacgcctttgtaaaagggatttatggcaggcttttcgtgtggattgtcgacaagataaatgccgctatctataagcctcctagccaagacgttaagaactctcgacgtagcatcgggctgctcgacatattcggatttgaaaattttgcagtgaactctttcgaacagctgtgcataaatttcgccaacgagcacttgcagcagtttttcgtgcgccatgtttttaaactggagcaggaagagtacgatctcgaatcaatcgattggctgcacattgaatttactgacaatcaagacgccttggatatgatcgcgaataaacccatgaacataattagcctaattgatgaagaatccaaatttccaaaaggaacagacaccactatgcttcataagctcaattcacaacacaaactaaacgccaattacattccccctaaaaataaccacgaaacgcagttcggcatcaatcactttgccggaattgtgtactatgagacgcaaggatttctggaaaaaaatcgcgacacactgcacggagatatcatacagctcgtgcactccagccgaaacaagtttatcaagcaaatctttcaggccgacgtcgcgatgggcgctgaaacccgtaaacgctcgccaaccctatcctcacaattcaaacgaagtctagagttactcatgcggactctcggggcttgtcaaccattctttgtgaggtgtataaagcctaatgaattcaagaagcccatgcttttcgatcgccatctgtgcgtgcgccaacttaggtattctggcatgatggagaccattcgcatcagaagagctggctaccccatacgctactcattcgtggaatttgttgagaggtaccgagtcctcctgccaggcgtgaagcctgcttacaagcaaggcgaccttagggggacctgccagcgaatggccgaggccgttcttggcacccacgacgactggcagatcggtaaaacaaaaatcttcctgaaggatcaccacgatatgctgctggaagtggaacgcgataaggccattaccgacagagtgattctgctgcagaaggtaatccgaggcttcaaagataggtcaaatttcttaaaactgaaaaatgccgcaaccctgatccagcggcattggcgtggtcacaactgtcgcaaaaattacggccttatgagactggggttcctccggctccaggccctccacaggtcaaggaaattgcaccagcagtaccggttagctagacagcgcataatccagtttcaggctaggtgtcgtgcctacctggtgaggaaggctttcagacatagactttgggcagtgctaacagtccaggcctacgccagaggcatgattgctaggagactgcaccaacgcctcagggccgagtatctctggaggctcgaggccgagaagatgcgcctcgcggaagaggaaaagctgaggaaggagatgagcgcaaaaaaagcaaaggaggaggcggaaagaaagcaccaggagaggctggcacagctggctagggaggatgcagaaagggaacttaaagaaaaggaggcagccaggcgcaaaaaggagctgctcgagcagatggagcgagccaggcatgagcccgtcaatcacagtgacatggtcgataagatgttcgggttcctgggcacaagtggcggattacccggtcaggaaggacaagccccttctggcttcgaagacctggagaggggacggagggaaatggtggaggaagatcttgacgccgctctcccactcccagacgaagatgaagaagacttgagcgaatacaagtttgcaaaattcgcagccacctacttccaggggactaccacgcactcatacactagaaggccccttaagcagcctttactataccatgacgacgagggcgatcagctcgcggcactggccgtctggatcacaatactacgctttatgggcgacctgccggagccaaaataccacacagcgatgtcagatggttcagagaagatacccgtgatgactaagatttacgagaccctcggtaaaaagacctacaaaagagaactgcaggccctgcagggagagggagaagcccaactccccgagggacagaagaagtcttcagtgcgtcacaaattagtacacttaacactgaaaaagaagtctaagctaactgaggaggtgacaaagcggttgcacgatggagaatcaactgttcaaggcaattctatgctcgaggacagacccacgtctaatctggagaaactacactttattattgggaacggcatattgcgacctgctctgagagatgagatctactgccagatttccaaacagctgacccacaacccctcaaagagctcctacgcgaggggctggatactggtgtctttatgcgtgggatgtttcgcccctagtgagaaattcgtgaagtacctccgcaacttcattcacggcggaccccctggttatgccccttactgtgaggaaagactacgcaggacctttgtgaatgggactcgcacccaaccgccttcttggctcgaattacaagctacgaaaagtaagaagcccattatgcttccagtcacctttatggatggcacaacaaaaacccttttgactgattccgccacaacagctaaggagctgtgcaatgctctggcagacaagatcagtctgaaagatcgctttgggttctcattatacatcgccctgtttgacaaggtgtcctcactcggatcagggagtgatcatgttatggacgcgatctctcaatgtgagcaatacgctaaggaacagggcgcacaagagcgtaatgccccatggaggctgtttttcagaaaggaggttttcaccccatggcacagtcctagcgaagataatgtggctaccaacctaatctatcaacaggtggtaagaggggtgaagttcggagagtatcggtgtgagaaagaagacgacctcgccgaacttgcctcccagcagtattttgtagattacgggtcggaaatgatactcgagaggctactgaacctagtgcctacatatattccagacagggagattacgccccttaaaacgctcgaaaaatgggcccagttagccatcgcggcacacaaaaagggcatctacgcacaacgccgaaccgacgcccagaaggtaaaagaagatgtggtctcgtacgccaggttcaagtggcccctccttttttccaggttctatgaggcatataagttctctggaccctcactcccgaaaaatgacgtcatcgttgcagtcaattggacaggagtctatttcgtggacgagcaggaacaagtgctcctggaactgtccttccccgagatcatggcagtgagcagttcaagagagtgcagagtttggctctctttaggctgctctgacctcggctgcgcggctccccactctggttgggctgggcttaccccggcaggaccttgttcgccctgctggagttgtaggggggctaagaccactgcgccaagcttcacgctggctaccatcaagggggacgagtatacatttacctcttccaatgccgaggatatacgggacctcgtagtgacttttttggagggcctacggaagcgatccaaatacgtggtggcgctgcaggacaacccaaaccctgcaggggaggaaagcggctttttgagtttcgcaaaaggtgacctcatcatcctggaccatgacaccggagagcaggttatgaacagcgggtgggcaaacggcataaatgagcggaccaaacaacggggtgattttcctaccgacagcgtgtatgtaatgcccacagtgacaatgccaccacgcgaaatagtcgcccttgttactatgaccccagatcagaggcaagacgtggtccggctgctgcagctgagaactgctgagcccgaggttcgtgcaaaaccctatactcttgaggagtttagttacgattatttccggccacctccaaagcacactctcagccgcgtgatggtgagcaaagcgaggggaaaagatcgcctgtggagccacaccagggagccattgaagcaggcactgcttaaaaaactgctggggtccgaggagctgtcccaggaggcctgcctcgccttcatcgctgtgctaaaatacatgggcgattacccttcgaagcgcacaaggtcagtaaatgagttgaccgaccagatcttcgagggcccactgaaggcagagcccctcaaagatgaggcatacgtgcaaatccttaagcaactgacagacaatcacattaggtattcagaggaaagaggatgggaactcttatggctgtgtaccggactgtttccccctagcaacattctcctcccccatgtacagcggttcctgcagtcccgcaaacactgccccctcgccattgactgcctacagagactgcagaaggccctccgcaatggatctcgaaaatatccaccacacctcgttgaggtcgaagcaattcagcacaaaacaacccagatttttcacaaggtctactttccagacgatacagacgaggccttcgaggtcgagtcaagcacaaaggcaaaggacttctgtcaaaatatcgctaccaggctcctgctgaaaagcagcgaaggttttagtctctttgttaagatagctgacaaagtattgtcagtgccagagaacgacttctttttcgactttgtccgccaccttacagactggattaaaaaggcgagaccaataaaagacggtatcgtgccttcgctcacttatcaagtattttttatgaagaagctctggaccacaactgtcccaggaaaggaccctatggctgatagcattttccattactaccaggaactgcccaagtaccttagggggtaccacaagtgcacccgcgaggaggttttacagctgggcgcactgatctatagagtgaaatttgaagaggacaagtcttatttcccatctatccctaaactgctgcgtgagctggtcccacaagatctaatacgtcaggtgagccccgatgattggaagcggagcatcgtggcctactttaacaaacacgccggaaagtccaaggaggaagcaaaactggcctttctaaagttgatctttaaatggccaacttttggatctgccttttttgaggttaaacagactactgagcctaatttccctgaaatcctgcttatagctattaacaagtatggagtgagcctaatcgatcctaagactaaggatattttgactactcatcctttcacaaagattagcaattggagtagcggaaatacctacttccacattaccattgggaacctcgtccgcggaagtaagctcctttgcgagacctctctgggatacaaaatggatgatctgctaacctcatacatcagtcagatgctgaccgcgatgtctaaacagcgaggttcccggagcggcaagtaa

SEQ ID NO: 231651 - DNA, 6647 bp, Artificial Sequence
  Description of Artificial Sequence: Synthetic coding sequence
atggtaattctccagcaaggcgaccacgtgtggatggacctgcgtctcggacaggagtttgacgttcccatcggtgccgttgtgaagttatgcgatagtggccaggttcaggttgtggatgatgaggataatgagcattggatttctcctcagaatgccacacatattaagccaatgcacccaacatcagtgcacggggtcgaagacatgataaggctcggcgacctgaatgaggctggaattcttcgaaacctgctgataagatatcgggaccacctcatctacacctacactggatcaatccttgtggcggttaacccttatcagctgctgtctatctactcacccgaacatatccggcagtacaccaataagaaaatcggtgagatgcctccccacatatttgccatcgccgacaactgctactttaacatgaagcggaactctcgggaccaatgttgcattattagcggtgaatcaggggctggcaagacagagagtactaagctgatcctccagtttctggctgccatctctggccagcacagctggattgagcaacaggtcctcgaggcgactcccatcctcgaggcttttggcaacgccaagactattcgtaatgataattcctcacgattcggcaaatatatcgacattcacttcaacaagcgtggggctatcgagggggctaagatcgagcagtatctattagaaaaatcccgcgtctgcagacaggcactggatgaacgtaactaccatgttttttattgcatgctggaaggaatgtctgaagaccagaagaagaaactcggtttgggccaggcttccgactacaactatttagctatgggtaactgtataacgtgcgagggccgtgtggacagtcaggagtacgccaatattcgctccgcgatgaaagtcttaatgtttacggataccgaaaactgggagatctcaaagttgctcgccgctatcctgcacctgggcaaccttcagtacgaagcgcgaactttcgaaaacctggacgcttgcgaagtgctgttctcgccttccttagcaactgccgcatcactcctagaagtgaacccacctgatttaatgtcatgcctcacgagtcggacgctgattacgcgtggcgagaccgtcagtacccccctcagtagagaacaggcactagatgtccgagatgccttcgtgaaaggcatctatggccgactatttgtgtggattgtagataagatcaacgccgcaatttataagcctcccagtcaagacgtcaagaatagccggagatccattggtctccttgatatctttggatttgaaaatttcgctgtgaatagtttcgagcaactttgcatcaactttgccaacgagcatttgcaacagttctttgtgcgccacgtgttcaaactggaacaagaggaatatgatcttgagtcaattgactggttgcatatagaatttactgataatcaggatgctcttgacatgatcgcaaacaagcccatgaacatcatttccctcatcgatgaggaaagtaagttccctaagggcaccgatacaaccatgctgcataagctaaatagtcagcataagctgaatgcaaactacatacctccgaaaaacaaccatgaaacccagtttggcatcaatcatttcgctgggatagtgtattatgaaacacaaggatttctggaaaaaaaccgtgacactctgcatggggatatcatccaacttgtgcattcctcacgtaataaattcattaagcagatttttcaagcagacgtggctatgggggcagagactcggaaacgctcccctacactctccagccagtttaagcggtccctggaactgctcatgcgaaccctcggagcttgccagccctttttcgtacggtgtatcaagccaaacgaattcaaaaaaccaatgctgttcgacagacatctttgtgtccgccaactgcggtattccggtatgatggagacaattcgaattcgtcgagccggttatccaatccgatactccttcgtggaattcgtagagaggtatagggtcctgcttcccggagtgaaacctgcctataagcagggcgaccttcgcggaacgtgccaacggatggccgaagccgtcctcggcacccacgatgattggcagatcggtaaaacgaaaatttttctaaaagaccaccatgacatgctcctagaagtcgaacgagacaaagctatcacagaccgagtgatccttctgcagaaggtcattaggggattcaaggaccggtcaaattttctgaaattgaaaaacgccgctacccttatccagaggcattggcgcggacataattgccgcaagaactatgggttgatgaggttaggctttcttaggcttcaagcactgcatcgatcccgtaagttacatcaacagtatcggttggctcggcaacggataatacagtttcaggcgagatgtcgggcatacctcgttagaaaggccttcaggcaccgcctctgggcagtcctcaccgtacaggcctatgcgaggggtatgatcgcgagaaggctgcatcagaggctgagggccgaatacctgtggcggctagaggccgaaaaaatgagactcgcagaagaggagaagctgagaaaggagatgagtgccaagaaagctaaggaagaggctgaaagaaaacatcaggaaagactggcacaattagcacgtgaggacgccgaacgcgagctcaaggagaaggaagctgctcgccgaaaaaaggaactgcttgagcaaatggaacgggctcgccatgagcctgtcaaccattccgatatggtagataagatgttcggctttctggggacgagcggaggactccccggtcaggaaggccaggctccgtccggctttgaagacctggagagggggagacgcgaaatggtggaagaagatctcgacgccgcactgcccctgccagatgaagacgaggaagatctgtcagaatacaagtttgcgaagtttgcagctacttatttccagggcacaaccacacattcctatacgcgcagacccttaaaacagcccttgttataccatgacgacgaaggggatcagcttgccgctcttgccgtttggatcacaatcttgcgctttatgggcgatctgcctgagccaaaatatcacactgccatgagcgacgggagcgagaaaatcccagtgatgacgaagatctacgagactctgggaaagaagacatacaagagggaacttcaggcactgcaaggcgaaggagaggcccagctgcccgaaggccaaaagaagagtagcgtgaggcataagttggtccacctcacccttaaaaaaaaatctaaattgacagaggaggtcaccaaaagattgcatgacggggagtcaactgtgcagggcaactccatgctggaggatcggccaacctctaatctggagaagctgcactttattatcggcaacggcatcctgcgacctgccctacgggacgaaatttattgtcaaatcagtaagcaactcacccacaacccaagcaaaagctcttacgctagagggtggatacttgtgtccctttgtgttggctgcttcgcaccaagcgagaaattcgtgaaatacctgaggaacttcattcatggtggccctccagggtacgctccctattgtgaggaacggctgagacggacctttgttaatggaacaagaacacagcccccatcttggctcgagttgcaggctacgaagagcaaaaaacctattatgttaccagtaacgttcatggacggaacgaccaagaccctgctcaccgattcagccacaaccgccaaggagctttgcaacgccttggctgacaaaataagcctgaaagatcggttcggcttctctctgtatatcgctctgtttgataaagtgtcttcgctgggtagcggatctgaccatgttatggacgccatctctcagtgtgaacaatacgcaaaagagcaaggtgcgcaggagcgaaacgccccttggcggctattcttccgcaaggaagtgtttaccccttggcatagcccaagcgaggacaatgtggcaaccaacctcatctaccaacaggttgtgaggggcgtgaaatttggtgagtaccgttgcgaaaaggaagacgacctggcagaattggcgagtcagcaatacttcgtagattacggttctgagatgattctggaaagattactgaatctcgtacctacatatattcccgacagggagattactcccctgaagaccttagaaaaatgggcccagcttgccatcgccgctcacaaaaaagggatatatgcgcagcggcgaacagacgctcagaaggtgaaagaggatgttgtctcctacgccagattcaagtggcccctcctgttctcaagattttatgaagcctacaagttctcagggccatccctgccaaaaaacgatgtcatcgtagcagtcaattggactggagtttatttcgtggacgagcaggaacaggtgcttcttgaactgtcttttccagagatcatggctgttagcagttcgcgtgagtgtagggtttggctctctctgggttgtagtgatttaggttgcgctgcgccacatagtgggtgggccggactgacccctgctggtccctgttccccttgttggagctgcaggggggcaaagaccacggccccatcttttacccttgctactattaagggcgatgaatatactttcacgtcatctaatgctgaggacatcagggatctggtggttacattcctggagggccttaggaaaaggagcaagtacgtcgtggccctgcaggacaacccaaatcccgctggcgaggagagcgggtttctgagctttgcgaaaggtgacttgatcatcttagaccatgacacaggcgaacaggtcatgaattcgggctgggccaatggtataaacgagcgcacgaagcagagaggcgattttccaaccgactccgtgtacgtgatgcctacagtgacaatgcctccacgggagatcgtagcgctcgtgactatgaccccagaccagcggcaggatgtggttcgactattgcagctgaggacggccgagcccgaagttcgggcaaagccatacactctggaggaatttagttatgactacttcagaccaccaccaaagcataccctaagcagggtcatggtgtctaaggctcgcggtaaagacagactgtggtcccacacccgggaaccacttaagcaggccctcctcaagaaactcctgggatccgaagagctgagccaggaagcctgtctagctttcatcgctgtgctgaagtatatgggagactatccctcaaagcgaacccggtcagtcaatgagctcacggatcagatcttcgaggggccattgaaagccgaacccttgaaagacgaggcctacgtgcagattctgaaacagttgactgataaccacatcaggtactctgaagaacgcggatgggaacttctgtggctgtgcactggtctgtttcccccttcaaatattctgttgccccacgtacagcggtttctgcaaagtcggaagcactgcccactggcaattgactgccttcagaggcttcagaaagcattgcggaatggttcccgtaaatacccaccacacctggtggaagtggaggctatccagcataagacaactcagatatttcataaggtgtattttcctgatgataccgacgaggccttcgaagtggagagctccactaaagccaaagatttttgccaaaacattgcaacccgattgctcctgaaatcctcagaagggttttctctgtttgtgaagattgctgacaaagtgctttccgtgcccgagaatgacttcttctttgactttgtaaggcacttgacagactggatcaagaaggccaggcctataaaggacggaatcgttccaagtctgacataccaggtcttctttatgaaaaaactttggacaacaacagttccaggtaaggaccctatggctgattctatcttccattactaccaagagcttcccaaatacttacgcggttaccacaaatgtacaagagaggaggtcttacagctcggagcactgatctaccgcgttaagtttgaggaagataaatcctatttcccttctatacccaaattgttgagggagctggtgccccaggatttgattagacaggtctcccccgatgattggaagcgctctatcgttgcatacttcaataaacatgccggaaagtcaaaagaagaagcaaagttagccttcctaaaactaatctttaagtggccaaccttcgggagtgcatttttcgaggttaaacagaccaccgagcccaacttccccgagatcctgctaatcgctattaacaagtatggcgtgtctctaatagatcccaaaactaaggacattttgaccacacacccctttaccaagatcagtaattggtcctctggcaacacctactttcacattaccattggcaatttggtgcgtggaagtaagttgctctgtgagacctctttagggtataagatggacgatctgctcacttcttatatctctcagatgctaaccgctatgagcaagcagcgcggaagcaggtcaggtaagta

SEQ ID NO: 231652 - DNA, 3537 bp, Artificial Sequence
  Description of Artificial Sequence: Synthetic coding sequence
atggtgatcctacaacagggagaccacgtgtggatggatttgcggctgggacaggaattcgacgtccctattggagccgtggtgaaactgtgtgattctgggcaggtacaggtggtcgacgacgaggataatgaacactggatctctccccaaaatgcgacccatatcaagccgatgcatccgacttccgtgcatggggtagaggacatgatacgtctcggcgaccttaacgaagctggcatcctcaggaacctgctgatccgctatagagaccacctcatttatacatatacaggaagcatccttgttgcagtgaacccgtatcagctactgtccatctatagtcctgagcacattcgtcagtatactaacaagaaaattggcgagatgccgcctcatatctttgccatcgcggacaactgttatttcaatatgaagcgcaatagtagagatcagtgctgtattatctccggagagtccggtgctggaaagacggaatcaaccaagctgatcctgcagtttctggccgcaatttctggccagcacagctggatcgagcagcaagtcctcgaggccacaccaattttggaggcatttggtaacgcgaagactatccggaacgacaactctagccggtttgggaaatacattgacatccactttaacaagcgcggagcaatagaaggagccaagattgaacagtacttgcttgaaaagtcacgggtgtgccgacaagccctcgatgagagaaactaccacgtgttttactgcatgttggagggaatgtctgaggatcaaaagaagaaactgggcctgggacaggcctcagattataactatctagcaatggggaattgtatcacctgtgagggccgagtcgactcacaagaatacgccaatatcaggtccgcaatgaaggtgcttatgtttacagacacggagaattgggagatttccaagttgctcgccgctatcctacacttagggaacctccagtatgaggccaggacattcgaaaaccttgacgcgtgtgaagtgctcttttcgccttccctcgccacagccgctagcttattggaggtgaatccccctgaccttatgtcatgcctgacgtcccggacattgatcacgcgtggagagacagtctctactcccctcagtcgcgagcaggctctggatgtgagggatgctttcgtgaaaggcatttatggacgactgtttgtgtggattgtggataaaatcaacgccgcaatttacaaacccccatctcaggatgtcaaaaactcccggcgtagtatcgggctgctagatatcttcggctttgagaacttcgctgttaactccttcgagcagttatgcataaacttcgctaatgaacatctccagcaattttttgtgaggcatgtctttaaactggaacaggaagaatacgatctggagagtatcgactggctccacattgaatttacagacaaccaggacgcactggacatgatcgccaataagcctatgaacatcataagcctgatcgacgaggagtcaaagtttccaaagggcactgatactaccatgcttcacaagctcaactcgcaacacaagctaaacgccaactacatcccgccaaagaataatcatgaaactcaatttggaattaaccattttgctgggatagtgtattacgaaacccaagggttcttggagaagaatagagacactctccatggtgacattattcagctcgtccacagctctcgaaacaaatttatcaagcagatctttcaagcggatgtggcaatgggcgctgagactaggaaaagaagcccgaccctgtcatcacaattcaaacggtctttagagctgctgatgaggactctgggggcatgccaacctttttttgttcgctgcattaaaccaaacgagttcaaaaagccaatgctcttcgaccgtcacctgtgtgtgcggcagctccgctactcagggatgatggagacgatccgaattcggcgagccggataccctattcgctactcttttgtggagttcgttgaacgatatcgcgtcctcctgcctggggttaagcccgcttataagcagggcgacctgcgcggtacttgccagcgaatggccgaagcggtccttggcacccacgacgattggcaaataggcaaaacaaagatctttctgaaggaccaccacgatatgttactcgaggtagaacgcgataaggcaattactgatcgcgtgatcctccttcagaaggtaattcggggtttcaaagacaggtccaacttcctgaaattgaagaacgccgctactctaattcagcggcattggcgaggccacaattgccggaagaattatgggctcatgcgtctaggcttcctaagattacaggcattacacagaagtagaaagttgcaccagcagtacagacttgccagacagcgcataattcaatttcaagcacgatgtcgagcctatctggtgcggaaggccttcaggcataggctgtgggccgtgctgacggtgcaggcttatgcaagagggatgatagccaggagactgcatcaaaggttacgggctgaatatttatggcgactagaggcagagaaaatgcggctggccgaagaggagaagctgagaaaagaaatgtctgccaagaaggcgaaagaggaggctgagcggaaacaccaagaacgcctcgcgcaactggcaagagaggatgctgagcgagaattgaaggaaaaagaagccgctaggcggaaaaaggaactgctagagcaaatggaaagagctcggcacgagcctgtgaatcatagcgatatggtagataaaatgtttggattccttgggacctcaggtggtctgcctggccaagagggtcaggctccttcaggttttgaggaccttgaacgcggtagacgggaaatggttgaggaggacttggacgccgctctgcccctgcctgacgaagacgaagaagacctctccgaatacaaatttgctaaattcgccgcaacttattttcagggcacgactacacacagctacacaagaagacccttgaagcagccactgttgtaccatgacgatgaaggcgaccaactagctgctctcgccgtgtggattactattctacgttttatgggcgaccttcccgaaccaaagtaccacacggctatgtcagacggcagcgagaagatacccgtcatgactaagatctatgagacactgggaaagaaaacttacaaacgggaacttcaggcactgcagggagagggcgaagcccagttacccgaaggacaaaagaaaagtagtgtcagacataaactagtacacctgaccctcaaaaaaaaatctaaactgactgaagaagttaccaagagactgcacgacggcgagagcacggtgcaaggcaactcgatgctggaggaccgtcccacgagcaatcttgagaagctgcatttcatcattggaaatgggattctcagaccagccctgaggtccgtgcccggaggaggggacaccagagcgtag

SEQ ID NO: 231653 - DNA, 6527 bp, Artificial Sequence
  Description of Artificial Sequence: Synthetic coding sequence
atggtgatcttacagcagggggatcatgtctggatggatttgcgcttgggccaggaatttgatgtgccaattggggctgtcgtgaaactctgtgactcgggtcaggtccaagtggtggacgacgaggacaatgaacattggatttcgccgcagaatgcaacgcacataaaacctatgcaccctacctcagtgcatggagtcgaggacatgattcgcctcggcgacttgaacgaagctggtattctgaggaacttactcatcagatacagggaccatctcatttatacatataccggttcaattctggtcgccgttaacccctaccagcttctctccatctattcgccagaacacattaggcaatacacaaataagaaaatcggtgaaatgccaccccacattttcgccattgctgacaactgctacttcaatatgaagagaaattcgcgggatcagtgctgcatcatctcaggcgagagtggagccggaaaaactgagagcactaagttaattctgcagttcctcgcggctatcagtggacaacactcctggattgaacagcaagttctggaggccacccccatcctggaggcgttcggcaatgctaagactatccggaatgataatagtagccgttttggcaaatatatcgatatccactttaataagcggggtgccatcgaaggggctaaaattgagcaatacctgctagagaaatctagggtatgtaggcaggctctcgacgaaagaaattatcacgtcttttattgcatgttggaaggaatgagcgaagaccagaaaaaaaagctcggtctgggccaggccagcgattataactacctggcaatgggaaactgcattacctgcgagggacgcgtggatagtcaagaatacgccaacatcagatcggctatgaaagtcctgatgttcactgataccgaaaattgggagataagcaaactgctagctgctatactgcacctggggaacctgcagtatgaggctagaacctttgaaaatttggacgcatgtgaagtcctgttcagccccagcctcgccaccgctgcctctctcctggaagtgaaccctcccgacctaatgtcttgcctgaccagcagaacgttgattacccgaggggagaccgtctcaacccccctctctcgcgagcaggcactcgacgtgcgcgacgcctttgtgaagggaatttatggcagactgtttgtctggatcgtggataagataaacgccgctatttataaaccgccatcacaagacgtcaaaaactcccgccgtagtattggcctgctggacatcttcggcttcgaaaactttgccgtaaatagcttcgagcagctttgcatcaacttcgctaacgaacatttacagcagttcttcgtgcgccacgtctttaagctggagcaggaggagtatgacctcgagagcatagactggctgcatatcgagtttacagacaaccaagacgcattagatatgatcgctaacaaacccatgaatataatttctttaatcgacgaggagtccaaatttccaaaggggacggacacaaccatgctgcacaaactcaacagccagcacaaactgaatgccaattacattccgccaaaaaacaatcatgaaactcagtttggcatcaatcacttcgcaggaatcgtatactatgaaactcagggctttctcgagaagaaccgcgacactctgcatggggacattatccagctggtgcattcttcccgcaacaaatttatcaagcagattttccaggcagacgttgctatgggcgctgaaacccgtaagcgtagtcctaccctctcttcacagttcaagaggtctctggaactgctgatgcgcacattgggagcgtgtcagcccttcttcgttcgttgcattaagcccaatgaattcaagaaaccaatgctattcgaccgacatctgtgtgtgcgtcagcttcgctactctgggatgatggagaccattcgaatccggagagcaggttacccaataaggtattcttttgtggagttcgtggagagatacagagtgctcctaccgggagtgaagcccgcatacaaacagggggacttacgcggaacgtgccagcgaatggccgaggcagtgctcggtacgcacgacgactggcagatcggtaagaccaagatattcctaaaagaccatcacgatatgctccttgaggtagaacgggataaggcgattaccgatcgggtaatcctgttgcaaaaagtcattcggggtttcaaagaccggagtaatttcctaaagctgaaaaacgctgctactctgatccagagacactggcggggacacaactgccggaaaaattatggcctgatgcgcctcggcttcctccggctgcaggccctgcaccggtcccggaaacttcaccaacagtatagactggccagacagcggatcatacagtttcaggcaaggtgccgcgcttatctggtgaggaaagcctttcgccaccgactgtgggcagtgctcactgtgcaagcgtatgctcgcggtatgattgctaggcgcttgcaccagcgcctaagagctgagtatctctggcggctagaagctgagaaaatgcgcctcgcagaagaggagaagttacggaaagaaatgagcgcgaagaaggctaaggaggaagcagagcggaagcatcaggagaggcttgcccagttggcccgagaagacgctgagcgagagctgaaggagaaagaagcagccagaagaaaaaaggagctgttggaacaaatggaacgggctcgccacgagccagtgaaccattcagatatggtggataaaatgttcggcttcctggggacatccggcggattgccaggtcaagaggggcaagccccttctggctttgaagatctggaacggggacgccgtgaaatggtggaggaggacctggatgcggctctgccactgcccgatgaagacgaggaagatctatcagaatataaatttgcaaagtttgcagcgacctactttcagggtactacaactcattcctacactagacggcctcttaaacaacctctcttgtaccacgacgatgagggagaccagttggctgccttggctgtctggatcaccatacttaggttcatgggcgacctgcctgagcccaaatatcatacagcgatgagtgatggctccgaaaagatcccagtaatgacaaaaatttatgaaaccttgggcaagaaaacctataagagagagctgcaggccttgcagggagagggcgaagcccagttaccagaaggccaaaagaagtcatcagttcgccacaagttagtgcatttgactctaaagaaaaagagtaagcttactgaggaggtcactaaacggctccatgatggcgagtccactgtccagggaaactctatgttggaggataggccaacctcgaacctagagaaactgcactttatcatcggtaacgggattctccgacctgccctccgcgatgaaatatactgccagatatctaagcagctaacgcataatccaagtaagtcatcttacgccagaggatggatactggtatcactgtgtgtggggtgtttcgccccttcagaaaaattcgtgaagtacttgaggaacttcattcacgggggtccccctgggtacgccccatactgcgaggagaggctgcggcgaaccttcgtgaacggtacgcggacgcagcctccttcatggctggaattacaagccaccaaaagcaaaaagccaatcatgctgcctgtcactttcatggatggtacaacaaaaacactactaacagactccgctacgacagccaaagaactgtgcaacgcacttgctgacaagatctcgcttaaggacagattcggatttagtctgtacattgcactgtttgataaggtatccagtctggggtcagggtccgaccatgtgatggatgccatatcccaatgcgagcaatatgcaaaggagcagggcgcacaggagaggaacgctccctggaggctattttttcggaaagaggttttcactccgtggcattctccgtcagaggataacgttgctactaatcttatctaccagcaagtagtgcggggtgtgaaatttggcgaataccgctgcgagaaggaagatgatttggccgaactggccagccagcaatactttgtggattatggatctgagatgattttggagcgccttctcaatttagtgcccacctacatccccgacagagagattactccgctgaagactctggagaagtgggcccagttggcgatcgccgcacataagaagggcatctacgcacagaggcggaccgatgctcagaaagtaaaggaggacgtggtctcctacgctagattcaaatggccacttttgttcagccgattctacgaagcctacaagttttccgggccaagcctgcctaagaacgatgtgattgtggccgtcaattggaccggcgtctatttcgtggacgaacaggagcaagtcctgctcgaattgtctttccccgaaatcatggctgtaagcagctctagaggcgcaaaaacaacagcgccttcttttaccttggccacaatcaagggtgacgaatacaccttcaccagtagtaatgcagaagatataagggacctcgttgtgacctttctagagggcctccggaagcgaagcaagtacgtcgtggccctccaggacaatccaaacccagcaggcgaggagagcggctttctgagttttgccaagggggatttgattatcctggatcacgacaccggggaacaagtgatgaattcagggtgggccaacggaattaatgaaaggactaagcaacgcggtgactttcccaccgattctgtctatgtgatgccgacagtaactatgccccctagggagattgtagccctggtcacaatgacacccgatcagcgacaggacgtagtcagactgttgcagttgcgtacagccgagccggaggtgcgcgcaaaaccttacactcttgaagaattcagctacgactactttaggccacctccgaaacacactctctcaagagtcatggtgagcaaagctcgcggtaaggatcggctctggtcacatacacgcgagcccctcaagcaggccctgctgaaaaagcttctgggaagcgaggagctttcccaggaggcctgcttggcctttattgctgtgcttaaatacatgggggactaccccagtaagagaacgagatctgtaaacgagctgacagaccagatcttcgaaggaccactcaaggccgagcctcttaaggatgaagcctacgtgcagatcctgaaacagctcacagacaaccacattaggtactcagaagagagggggtgggagctcttgtggctgtgtaccggcctgttccctccgagtaatattttgttacctcacgttcaaagattcctgcagagtagaaagcactgccccctggccatagactgcctacaacggctgcagaaggccttgcgcaatggatcccgtaaataccccccacatctcgtcgaggtggaggctatccagcacaaaacaacccagatctttcacaaggtatatttccccgacgacacggatgaagcatttgaggtggaaagctcaaccaaggccaaagatttttgtcaaaacatcgccacgaggctcttgctcaagtcaagcgagggcttcagcctgtttgttaagatcgcagataaggtcctgtccgttcctgaaaacgattttttcttcgatttcgtaagacatctaaccgattggataaaaaaggctcgtcccattaaggatgggattgtgccaagcctaacataccaggtcttcttcatgaagaaactctggactacaacggtgcccggaaaggatcctatggcagacagcatcttccactactatcaggaactgcccaaatatctgcgcggatatcacaaatgtacacgggaggaagtgttgcagttgggggctctgatttacagagtgaaattcgaggaggataagtcttatttcccttcaataccgaagctcctccgagaactcgttccacaagacctgatccggcaggtcagtccagatgattggaagcggtccattgtcgcttattttaacaaacacgcaggcaaatcaaaagaggaggccaaactggccttcctgaagctgatttttaagtggccaacattcggaagcgctttcttcgagcagacaacagagcctaattttcctgagatcctcttaatcgctataaataagtacggggtgagccttattgaccccaagaccaaagatatcttgacaacccaccctttcacaaaaatctccaattggtccagcggtaacacttatttccatatcactatcgggaatctggtacgcggttcaaagctgttgtgcgaaacctctctgggatacaaaatggacgatctgctgacatcttacataagccagatgctgaccgccatgagcaagcagaggggaagcagaagtggcaagta

SEQ ID NO: 231654 - DNA, 2532 bp, Artificial Sequence
  Description of Artificial Sequence: Synthetic coding sequence
ggtctcagcgtgcagtggctgctggatgggctcgcctgtttttttgccagtctgcacgtgcccctcggccgagtgcagcttcatgccagtgccagagggatccaggagaaagaggacgacctggcagaattggcttcccagcaatactttgtggattatggaagtgaaatgattctagagagactgttgaacctcgtgcccacttacatccctgacagggagatcacccctctgaagacgcttgaaaagtgggcccagctagccatagccgctcacaaaaagggaatatacgcgcagcgaaggactgatgcccagaaggtgaaagaggacgtggtgtcctatgcaaggtttaagtggccactcctgtttagtaggttctatgaagcttacaaatttagcgggcctagcctccctaagaacgacgtgattgtggccgtgaattggactggcgtgtactttgtcgatgaacaggagcaggtgctcttagagctatcttttccagaaatcatggccgtcagctcaagtcggggagcaaagaccaccgccccaagtttcactctggccactattaaaggcgatgagtatacatttacgagctccaatgctgaggatatacgcgatctggtcgtgacatttctcgagggcctgcgcaagaggtccaaatatgtggtggcactacaggataaccccaatcccgcaggagaggagtccggatttctctcattcgctaagggagacctgattatcctcgatcacgacaccggggagcaggtgatgaattccggatgggctaacggtattaacgagcgtactaagcaacgcggagacttccctactgacagtgtatacgttatgcccaccgtcacgatgccccctcgtgagattgttgcgctcgtgaccatgacgccagaccagcgacaggatgtcgtccgcctcttgcagctgaggacagccgaaccagaggtcagagctaaaccctatactctggaggagttttcatatgactacttccgccctcctcctaaacatactttgagtcgggtcatggtgtctaaggcacggggaaaagatcggctgtggtcccacacccgtgaacctctaaagcaggctctgttaaaaaaattgttgggctctgaggaactgtcacaggaagcttgcctcgcctttatcgccgttctgaagtacatgggagactacccatccaagcggacccgcagcgtaaacgaactgaccgaccagattttcgaaggacctttaaaggccgaaccgctgaaagatgaggcttacgttcagattctgaagcaactcactgataatcacataagatactcagaggagaggggttgggaacttctgtggctttgtacgggcctgtttcccccttccaatattctgctgcctcacgttcaacgatttctacaatctcggaagcattgcccattggcaattgactgcctccagcgactgcagaaggcccttcggaatggctctcggaaataccctcctcatttggtcgaggtagaagcaatccaacacaagactacccagatctttcataaagtttactttccggatgatacagacgaggcctttgaagttgaatcgtcaaccaaagccaaagatttttgtcagaatattgctacccggctgttgctcaagtcatctgaaggcttcagcctgttcgtgaaaatcgctgacaaggtcttaagtgtgcccgagaacgacttcttcttcgacttcgtgagacatctcacagactggataaagaaagctcgccctattaaggacgggatagtgccttcactaacctaccaagtcttcttcatgaaaaaactgtggactacaaccgttcccggaaaggaccccatggcagacagcatcttccattattaccaggaacttcctaagtacttacggggataccacaaatgcactcgggaagaggttcttcagcttggcgctttgatctatagagtcaagtttgaagaggacaaatcatatttcccctctattcctaaacttttgcgagagttggtgccgcaggacctgattaggcaggtctcccctgacgactggaagcggtcaattgtggcctattttaataaacacgccggaaagtcaaaggaggaagctaagttggctttcctgaaacttatctttaagtggcccacgttcggatcggccttttttgaagtgaaagtgcatcatggactgctaagagcggaagaagagggaaatagagcgctcatcaaacaccgggactcatctttgggactctgggagcgtgccatggctctggacacgtgcccgggagagggcagaagggccgctccctcagccttgtcacaactctctgtgctggctggggtgtctcctggcgacaggggaacgcggagatcaagcgcatggcagtggcggcaaacttgcaagcaggcaggagtgatggaggatgggctgtgttctgataccggcgaaccctcaccaaggtggcaaagcagcgggggaagtgcagggtgcgagaaggcgagctag

SEQ ID NO: 231655 - DNA, 4167 bp, Artificial Sequence
  Description of Artificial Sequence: Synthetic coding sequence
atgagactcgggttcttgcgcttgcaggctttgcacagatcacgcaaactccatcagcagtaccgcctagctcgacagagaattatccagttccaggcgagatgcagggcatacctggtgagaaaagcattcagacaccgattgtgggccgtgctgaccgtgcaggcgtacgcacggggtatgatcgctaggagactgcaccagaggctacgcgctgaatacctctggaggctggaggctgaaaaaatgaggctggccgaggaagagaaactgcggaaggagatgtcagctaagaaagcaaaggaagaggccgagcgcaagcaccaggagcggcttgctcaactcgcccgagaggatgccgaacgagagctcaaagagaaagaggctgcaagaaggaagaaagagttacttgaacaaatggagagagcacggcacgaacctgtcaatcatagcgacatggtcgataaaatgttcggcttcctggggacgagtggcggactgcctgggcaggaaggccaagcacccagcggctttgaggacctggagcggggtagaagggagatggtggaggaggatttagatgcagcactcccccttccggacgaagatgaagaggacctgagtgagtataagttcgctaagttcgctgccacatattttcagggaacaacaacacattcttatacgcggcgacccctgaagcagcctctgttgtaccacgacgacgaaggcgaccaattagctgccctggcagtgtggattacaattctgcgatttatgggagatttgccagagccaaaataccatacagcaatgtcagacggttccgagaaaattcctgtcatgaccaaaatttatgagaccctgggcaagaagacctacaaacgggagctgcaggccttgcaaggagaaggtgaggcacagttgccagaggggcagaagaagtctagcgtccggcacaaactggtgcaccttacccttaagaaaaagtcaaagctaactgaagaagtgaccaaacggctccacgacggagagagtaccgtccagggaaactccatgctcgaagaccgacccacatcgaacctcgagaagctccattttattataggcaacggcatactccgcccagctctccgcgacgagatctattgccagatctctaaacagctcacccataaccccagtaagagctcttacgctaggggatggatcttagtaagtctttgtgtgggatgctttgccccttctgaaaagtttgtgaagtatctgcgcaattttatccatgggggtccccctggctatgctccctattgcgaggagcgcttaaggaggacttttgtgaacggcaccaggactcaacctccttcatggctggaattgcaggccacgaaatccaagaaaccaattatgttgcctgttactttcatggatggcaccaccaagaccctcctcacggacagcgcgaccacagccaaagagctgtgcaatgccttggccgataagatctcactaaaagataggtttggatttagtctgtacattgccttattcgacaaggtgtcttcgctaggttccggctcggaccatgtcatggatgctatctcacagtgtgagcagtacgctaaggagcagggagcacaggagaggaatgccccttggaggttgttctttcgcaaagaagtcttcactccgtggcactctcctagcgaggataacgtggccacgaatcttatttaccagcaggtcgtgcggggagtgaaatttggagaataccggtgcgagaaagaagatgacctcgcagaactggcttcgcagcaatattttgttgattacgggagcgagatgatactcgaacggctcttgaacctggtgcctacctacattcctgatagggagattacgccgctcaagactttggaaaaatgggcccagctggctatcgcagcacataagaaaggaatctacgcccagcggcgtaccgatgctcagaaggtgaaagaggacgtcgtctcatacgccaggtttaaatggcccctcctattttcaagattctacgaggcctataagttctctggaccttcactgccgaaaaatgacgtcatcgtggccgtaaactggaccggagtgtattttgtggatgaacaggagcaggtgctgctcgaactgtcattcccagaaattatggccgtgagtagtagcagaggggctaaaaccacagctccttcttttacgctcgcaactattaaaggagatgagtataccttcacatcttctaatgcagaagacattagagatctagttgtgacttttctcgaggggctgcggaagagatctaaatacgtcgtcgccctgcaggacaatccaaaccctgctggagaggaatccgggtttttgtccttcgccaagggggatctgatcatcctggaccacgatacaggcgagcaagtgatgaattctggatgggccaatgggattaatgaacggacaaagcagcggggagactttcctactgactccgtgtacgtcatgcccacagtgacaatgccacctcgggaaatcgtggccctagtgactatgacacctgatcaacgccaggacgtcgtgaggctgcttcagcttcgaacggcagagccagaagtcagagcgaagccctacaccctagaagagtttagctatgattatttccgccctcctccaaagcataccctgtcacgggttatggtgagtaaggcccgaggaaaggatcgactgtggagccacacacgcgagccccttaagcaggcactattaaagaaactcctgggctcagaggagctctctcaggaggcctgcctcgccttcattgcagtgctgaaatatatgggcgactacccaagtaagaggacacggagtgttaatgagctgacagaccaaatcttcgaagggccactgaaggccgaacccttaaaggacgaggcctacgtacaaatactgaagcagctaacagacaaccacataagatatagcgaggaacgtggatgggagctgctgtggctttgcactggcctgtttccaccttctaacatacttctgccccacgttcagcgctttcttcagtctcgaaagcattgtcccctcgcgatcgactgtcttcagaggctgcagaaagccctgcgaaacggtagccgaaaataccctccgcaccttgtagaggtcgaagcaatacagcataaaacgacacaaatttttcataaggtgtacttcccagacgacaccgacgaggccttcgaagttgaatcatcaacgaaggccaaggatttctgtcagaatattgcaactcggctcctcctcaaaagttcggaaggattctccttatttgtcaagatagctgacaaagtcctgtcagtgccggagaacgatttctttttcgatttcgtgaggcatctaaccgactggatcaagaaagctcgaccgataaaggacggcatagtcccgagcctgacttaccaggtattttttatgaaaaagctgtggactacgacggtcccgggtaaggatcccatggccgatagtattttccattattatcaggagctgcccaagtatcttcggggttatcacaagtgcacgcgggaagaggtgctccagctcggcgctttgatctatcgggtgaagtttgaagaggataagtcttacttccccagcatcccaaagctgctcagagagcttgtgccccaggatctgatccggcaggtgtctccggatgactggaaaaggagtattgttgcctacttcaataagcatgcaggtaaatctaaagaagaggccaagctagcttttctgaagctgatctttaagtggccaaccttcggctcagcgttctttgaggtgaagcaaaccactgaacccaattttcctgaaattttgctcatcgccattaataaatacggcgtgagtctgattgacccaaaaactaaggacattctcaccacgcacccttttactaaaattagtaactggtcgtctgggaatacctacttccatataactatcggcaatctagtaaggggatcgaaacttctctgcgagacttcactcgggtacaagatggatgacctgctgacttcctacatctcccagatgctgaccgctatgagtaagcagcgaggcagtcgtagcggaaaatag

SEQ ID NO: 231656 - DNA, 2580 bp, Artificial Sequence
  Description of Artificial Sequence: Synthetic coding sequence
atgggcaggaagttagatcttagcggcctgaccgatgatgagacagagcatgtgctgcaggtggtgcagcgggactttaatctgaggaagaaggaagaggagcgcctttctgagctgaaacagaagcttgatgaagaaggctccaagtgttccatcctcagtaaacatcagcagtttgtggagcactgctgcatgaggtgttgctcccctttcaccttcttagttaacacaaagcgacaatgtggagactgcaagtttaacgtttgtaaatcctgctgctcctaccagaagcacgaaaaggcctgggtatgctgcgtatgccagcaggcgaggcttttacgtgctcaaagtttggaatggttttacaataatgtgaagtcgcggtttaaaagattcgggagtgccaaggtcctgaagaatctctacaggaagcacagacttgagtcaggggcttgctttgacatcctgggaggatcactcttcgagtctaatctggaaaacgaaggcagtatctccggaagcgactccaccttctataggcagtcggagggacattctgtcatggatacactcgcagtggcactccgcgttgcagaggaagccatagaggaggcaatcagcaaagccgaagcctacggagattctcttgataagcagaacgaggcctcttatctcagagatcataaagaggaacttaccgaggagctcgcaacaactatcctccagaaaatcatcagaaagcagaagtctaaatccgagcagcaagtggaagaagaaccaggatggccccaccctcagagctgttctactaaggttgccgatgaagggacttctgctagccctggtgggtatagggctccagcggctctgtggaggagtcagagtgcatttagtatcaccggcgaggaagcgttaaagaccccaccagttgaggctccgtcacgtcagcccagagaccagggtcagcatcctcgcgctgagtctgcgcttccaagctggaagtcggttgatcgcttggatgaaacaaatctggctccagtactgcagagtcctgacggtaactgggttgcactcaaggacggagccccaccacccacaagactgctggcaaaacccaagtcaggaacattccaggctctcgaggtggccagcagtgtcgctagcgcttacgacgagatgggctcagactcagaagaagattttgattggtccgaggcactttctaagctgtgcccccgatcccgagctcttccacgcaatcctcagcctcagcctacgcaggcacagagctccgaccaaggcccaattgccgctagtccctcatctgctctctccccaaaccctgaagccatgtgctcggactccgagacctcttcggcagggtccagtcgcgaggtcggtcaccaggcacggcttagttggctccagcgcaaggcaccgaggaatcccgcagctgagaaaatgcgtttgcacggcgaactagacgtgaatttcaacccccagctggcttctcgcgagacatctgactcttccgaacccgaagaagctccacatacaacggaccggagagcaagaagatggcggcgagcaagactgggcagtgaagaaccttcaaaggaaccctcttcacctagcgcccagctgcgagacctggatacacaccaggtgagtgatgacctgagtgaaacagacatatcaaatgaggctcgggaccctcagacgctgactgatacgacagaggagaagcgaagaaatcgcctgtacgagttggctatgaaaatgtctgaaaaggaaacctcaagtggcgaggatcaggagtccgaacccaagactgagagcgaaaaccaaaaagagagcctatcatctgaggacaactcccagtcagtccaggaggaactcaagaagaagttctcggccgtaagcctgtgcaatatttctacagaagttctgaaggtgatcaatgcaacggaagagctgattgccggatctactggtccctgggagtccccacaagtgcctcccgacagacagaagggcatgttcccacgtggcaccgaccaggtacgtcttgacgagcagctgacctcactggaggagaacgtctacctcgccgctggaacagtttatgggctggaaactcagctcacagagctggaggatgcggctagatgcattcacagcggcacagacgagacacacttggcagacctagaggaccaggtcgcgacagctgctgctcaggtgcaccacgccgaactgcagataagtgatatcgagagtaggatcagtgctcttaccattgccggtttaaatatcgccccatgtgtccgatttacccgccgaagggaccagaaacaacggacccaagtgcaaaccatcgacacaagtcggcagcagcggcgaaaactccctgccccaccagtcaaggccgaaaaaatcgaaacatccagtgtgactactatcaaaacattcaatcacaattttattttacagggcagcagtactaacagaacaaaggagagaaaggggacaacgaaggaccttatggagcccgctttggaaagcgctgtgatgtactag

SEQ ID NO: 231657 - DNA, 2313 bp, Artificial Sequence
  Description of Artificial Sequence: Synthetic coding sequence
atgcggaaggcagcaagtgcggctagttcccgtagcaccagctccctctggtctactgctgcttgcgccgctgcaagaccctccccctcttcctccactccatcggcttctgttgagatcgcaaatagtatgagcgccagagccgctgcccctacacgatccaccaagcggccaggcagcgccgcttccgcatcaaagaggggcggtagcctcttcgagtcaaatctggagaatgaggggagcatctcaggaagcgactccacattttatcggcagtccgaaggccactccgtgatggatacgctggccgtggcactacgggtggccgaggaggcaattgaggaggccattagtaaggccgaggcatacggtgacagtctggataaacagaatgaggcatcctaccttagagaccataaggaggaactaaccgaggagctggctacgacgattctccagaagattattcggaaacaaaagtcaaagtccgagcagcaggtggaggaggaacctggatggccacaccctcaaagctgttccaccaaagtggccgacgagggaacaagcgcgtctcctggagggtacagggctccagcagcactgtggaggagccagagtgcattttccattactggggaggaggccctgaaaactccaccagtggaggcccctagccgacaacctagagatcaaggccaacacccccgagctgagagcgccttgcccagctggaaatcggtagatcgacttgatgagaccaacctcgcaccagtcttacaatcgcccgacggaaattgggtggctttgaaagatggggctccaccccctacacgtctactagccaaacccaagagcggaacttttcaagcacttgaagtggcttcaagcgtcgcttctgcctatgatgaaatggggtctgactccgaagaggacttcgattggtcagaggcattgtctaaactgtgtcctcgatctagagcgctcccccgtaatccacaaccacagcctactcaggcccagtcatcagatcaaggacccattgcagccagcccgagcagcgcactcagcccaaaccccgaggccatgtgtagtgactcagagacttccagtgccggaagctctcgcgaggtgggacaccaggccaggttgagttggctgcaacggaaggcgccaaggaacccagcagcagagaagatgcggcttcacggagagctcgatgttaatttcaaccctcagctggcatctagagaaacgagtgacagttctgaacctgaggaagctccgcacactacagaccgtcgggctcgaagatggaggcgcgctaggttaggatctgaagagccttccaaggagccatccagtccaagcgcccaactgcgcgatctcgacacgcatcaagtttccgatgatttgtccgaaaccgacatctccaatgaagcacgcgacccccagactctaacggacaccacagaagagaagaggaggaatcgtctttacgagctggcaatgaaaatgagtgaaaaagaaacctcatcgggcgaagaccaggaaagcgagccaaagactgaatctgagaatcaaaaagaaagcctatcttctgaggacaacagtcaatctgtgcaggaagagctcaaaaagaaattctcagccgtaagcttgtgcaatatctccacagaggtactgaaagtgattaacgccacagaggagctgatcgcgggttccactggcccatgggaatcccctcaagtgccacccgaccgccaaaaagggatgtttccacgcggaaccgaccaggtgaggttagacgaacagcttactagcctagaagaaaatgtctatctggccgcagggacagtgtacggcctcgagactcaactgactgaactggaggatgctgcacgctgtatacatagtggaaccgacgaaactcatcttgccgatctcgaggaccaagtagccacagcagcagctcaagtgcaccacgctgagctgcaaatcagcgatatagaatctcgcatatctgccttgacaatcgccggactgaacattgccccttgcgtgaggtttaccaggagaagagaccaaaagcaacggacccaggttcaaaccatcgacacctctagacagcagcggagaaagcttcccgctccgcctgtcaaggcagagaagattgagaccagcagcgtaaccactatcaagacttttaatcataattttatcctgcaaggttcaagtactaacaggactaaggaaagaaaggggacaaccaaggacttgatggagccagccctggagagcgcggtaatgtattag

SEQ ID NO: 231658 - DNA, 2580 bp, Artificial Sequence
  Description of Artificial Sequence: Synthetic coding sequence
atgggcagaaagcttgacctttccggactgactgacgatgagactgaacatgtcctgcaggtagtgcagcgcgatttcaacctccggaagaaagaggaagagcgactgtccgaactgaaacagaaactcgacgaagaaggatccaaatgttccattttgtctaaacaccagcagtttgtcgaacattgctgcatgaggtgttgcagtccctttacattcctggtcaacactaaaagacagtgtggcgattgcaaattcaatgtctgtaagagctgttgttcctatcagaagcatgagaaagcctgggtgtgttgtgtatgtcagcaggcaagattacttagggcccagagtcttgagtggttttataacaacgtgaagtcaaggttcaagagattcggctctgcaaaagttcttaaaaacttgtataggaaacacaggctggaaagcggagcctgtttcgacatcctgggaggcagcctgtttgagagcaatctcgaaaatgagggcagcatctcaggcagcgactctacgttctatcgacaaagcgagggtcactccgtcatggacaccctggccgttgcattgagggtggcggaagaagcaatagaggaggctatatctaaagctgaagcctacggtgacagtctcgacaagcaaaacgaagcaagttacttgagagaccacaaggaagagctgacagaggaactggccacaacgattctgcagaaaattattagaaagcagaaatccaaaagtgaacagcaggtggaggaggagcccggatggcctcaccctcagtcatgcagcactaaggttgccgatgagggaacgtctgcaagccccggtggatatcgcgcacccgctgctctgtggcgaagccagtctgccttttctatcacgggggaagaagctcttaaaacccccccagtcgaagcgccaagccgacagccgcgagatcagggacagcatccacgagctgaatcagctctgccctcttggaagagtgtcgatcggcttgatgaaacgaacctggctccagttcttcagtcgccagacggaaattgggttgccctgaaggatggcgctccgcctcccacacggcttttagccaaacccaagtcaggtaccttccaagctctagaggtggccagtagtgtagcctccgcctatgatgagatggggagtgattcagaggaagatttcgattggtctgaagcactgagcaagctgtgtccacggagtagggccctgcctcgcaacccccaacctcagcccacccaggcacagtcttccgaccaaggaccaatcgcggcatccccaagttctgcactttcacccaacccagaggccatgtgtagtgattctgaaactagttctgctggcagtagccgcgaagtaggacaccaggcaaggctgagttggttgcagcggaaagctccccgaaatcctgccgcagaaaagatgagactccatggggagcttgacgtgaattttaacccgcaacttgctagccgggaaacctctgatagctctgagcccgaggaggctccccacacaactgaccgccgtgccaggcgatggagacgggctcgcctgggttccgaagaaccgagcaaggagccatcaagtccttctgcccagctaagagatctggatacccaccaggtcagtgacgatctctcagaaaccgacatcagcaatgaagctcgggacccacaaactctgactgacactactgaggaaaagcgaagaaatcgcttgtacgagcttgctatgaagatgtcagagaaagagacctcttctggggaagatcaggaaagtgagcctaaaacagagagcgagaaccagaaagagtccttgtcgtccgaagacaattctcaatcggtgcaagaggaactcaagaagaagtttagtgccgtctccctgtgtaacattagtaccgaagtgttgaaagttatcaatgctacggaggagttgatcgccggaagcactgggccttgggaaagtccccaagtgcctcctgatagacagaaagggatgttccccaggggcactgatcaggtgagactggacgagcagcttacaagcctcgaagagaacgtgtacctggctgccggtactgtttacggcctcgaaacacagttgactgagctggaagatgccgctcgttgcatccattccgggaccgatgagacacatctggccgacctcgaagaccaggtcgcaactgcggcagctcaggtacaccatgctgagttacaaatcagtgacatcgaatccaggatttcagcattaactattgctggcctgaatattgccccttgtgtgcggtttacacgtcggagagatcaaaaacagcggactcaagtgcaaacaatcgatacctctcgccagcagagacggaagttgcccgcaccaccggtgaaagctgagaaaatcgaaacatcgagtgtgaccaccatcaaaacttttaaccacaatttcattttacaaggatcttctaccaatcggaccaaagaaagaaaagggaccacaaaagatcttatggagccagcccttgagtccgccgtaatgtactag

SEQ ID NO: 231659 - DNA, 2019 bp, Artificial Sequence
  Description of Artificial Sequence: Synthetic coding sequence
atggatacgttggccgttgccttgcgcgtggccgaagaagccatcgaggaggcaatcagcaaggccgaggcctacggagacagccttgataagcagaatgaggcttcctatctgcgagatcataaagaggaactcaccgaggaattggccaccactattctacagaagattatccgaaagcagaagagtaagtccgagcagcaggtagaggaggagcccggatggccccacccacaatcatgctcaacgaaagtggcggatgaaggaacaagcgctagcccaggcggatacagagctcctgctgctttgtggcgctcccagtccgcttttagcataacaggcgaagaagcattgaagacacctccagttgaggccccaagccggcagcctagggatcagggccagcaccctagagcagagtctgcattgccatcttggaaatcggtcgatcggcttgatgagacaaacctcgcacccgtattgcagagtcctgatggaaattgggtggcactaaaggacggtgctcccccaccaaccagactgttagccaaaccgaagtccggtactttccaggcattagaagtcgctagctccgtcgccagtgcttatgatgaaatgggttctgattccgaagaggacttcgactggagcgaggccctcagcaagttatgccctaggagcagagctctgccacgcaacccgcagccccaacccacacaggcccagtcttctgatcaggggcctatcgccgcaagccctagctctgctctgagcccaaatcccgaggctatgtgttccgactctgaaacttccagtgcagggagcagcagggaggtggggcatcaagccaggctgtcttggctgcagcggaaggcacctcgaaatcccgctgcagagaagatgcgactccacggtgagctggacgtgaacttcaatccgcaactcgcctctcgcgaaacatcggattcttcagagcccgaagaggcccctcacaccacagataggagagcacggaggtggagacgggctagactcggctctgaagagccctccaaagagccctcatccccctcagctcagctgagggatcttgacacacaccaagtctccgatgacctgtccgaaactgacattagcaacgaagccagggacccacagaccttgacagataccactgaggaaaagaggcggaatagactgtatgaactggcgatgaaaatgagcgagaaagagacgtcttctggggaagaccaggagagtgagcctaagacagaatcagagaatcaaaaagaaagcctctcttctgaggataatagccagtccgtgcaagaggagttaaagaagaaattctctgcagttagtctgtgcaacatcagtacggaggtcctcaaagtcatcaatgcaactgaggagctcatcgctggcagtacaggtccctgggaatctcctcaggtgccccctgaccgtcagaaggggatgttccctaggggcacggatcaggtgcgattagatgaacagcttactagcctcgaggagaacgtatatctggccgcaggtacagtgtatggtctggaaacacagttgacggagcttgaggatgctgcaagatgcatccatagcggcacagacgagacacacctagcagatcttgaggatcaggttgccactgctgcagcccaagtgcatcatgcagaactgcaaatctcggacattgagtctcgcatttcagctttgaccattgccggattgaacatcgccccttgcgttcgcttcacgcggagacgggaccagaagcagcgcactcaggttcagaccatagacacttctcgccagcagagaaggaagctccccgcaccgcctgttaaggctgaaaagattgaaacttctagtgtgacgacaatcaaaacgttcaaccataactttattttgcaaggttccagtaccaatcgaaccaaagaacgcaagggaaccacaaaggacttaatggaaccggcacttgagagcgccgtgatgtactag

SEQ ID NO: 231660 - DNA, 2886 bp, Artificial Sequence
  Description of Artificial Sequence: Synthetic coding sequence
atgaaatacctgttaaacttcattggccagggcccagccacatatggacccttctgcgcagagagattgcgcaggacatatgcaaacggggtgcgcgctgagccgcctacctggctcgagcttcaggctgtgaaaagtaagaaacacattccaatccaggtcatccttgccaccggagagtctctgactgtgcccgtggattcagctagcacatcaagggagatgtgcatgcatatcgctcacaagcagggcctctcagatcacttagggttctctctgcaggtggcagtgtacgacaagttctggagcctagggtctggtagagatcacatgatggacgcaatagcccgatgtgaacagatggcccaggaacggggagaaagtcaacgccagtctccttggcgaatatactttcgaaaagaattttttacaccctggcacgacagccgcgaagatcctgtctctacagagttgatctaccggcaagtcctgaggggggtgtggtccggggagtactcgtttgagaaagaggaagagctggtggaactgcttgcccgacattgttacgtccagctgggagcgtccgctgagtctaaggcggtgcaggagctgctgccatcatgtatcccccacaagctctacagaacaaagccacccgaccgttgggcaagcctagtgacagccgcttgtgctaaggctccctacacacagaagcaagtcacacctctggctgtgcgagagcaggtagtcgatgccgcaaggttacagtggcctctcttgtttagccgtctgttcgaggtgattactctctccgctttcactcttccgagtctgttggccagaccccctcctgcccaggatgccggaccggctggggaagacgccgcaggaacactattccccagaggacacggatctggacaccagcaggtgagggcgttgcgtgaggatctgttcctccacaccgaaccccatcccccagctcccggtcgaacggcccatgaagtgctgcactgggggattactcggtgtacaggatcattttctctgaagcccagaagtaccaggaaaggtcagggaagcgtccagccactcgccggtacctacctggaaggcagcttcctttgccacggaagagaactggtcgcatggcgagtccaagtggtgtgggaaggcgataagggccagtgtctggccggtgctgatccccactcacatggatccccctggatttctctcactggaaatttcagcatgcccttcgggaaaagcactcagcagtccggtacgtgcatttcaggcctctgtcaagtatacagtggtcatcatagccctctcgcgacttcgccacgctcaacggacagtataactcactctgccgacgaaaggatgtctaagcttaagcacgcagaggtgcgctggctgcgggtgagcacctggcaaagccggcagctgatctcggctctgacttttgccgtgtccttgcggtgccattgcacaccggcaactagcttgtcggctcactcacagcctcacacatgggcagcccctctgagtgcttccgagaggcctaccgttgtttcaggtctggtgttagctctggccgaacagctctgcgtgctgatccgatggcggggtctgctggtgacactgagcttcattagcagggaggcccagggagggcagcgcctgctcctcagcaccatgcatgaagagtatgaatttgtttctcccagttccgtggcgatcgcagagttagtagccttgtttctggaaggattaaaggagcgttcgatttttgccatggctctccaggatcgcaaagccacagacgacaccacattactcgcatttaaaaaaggcgaccttctggtgctgacgaagaagcagggacttctggcttccgaaaattggactctgggacaaaacgacagaaccggaaagactggcctggtgcctatggcctgcttgtacacaattcccaccgttactaagccctccgctcaacttctgagcctgctggcgatgtcacctgagaagcggaaactggctgcccaagaaggccagtttactgaacctagaccagaggagccccctaaggagaagctacacacccttgaggaattcagctacgaattctttcgtgctcccgaaaaagatatggtgagtatggctgtcctccctctcgccagggccagaggtcacctgtgggcttattcatgtgaaccgcttagacagcctctcctcaagcgggtccacgccaatgtcgacttgtgggacatcgcctgccagattttcgctacccccatacttcggtacatgggggattacccttccagacaggcttggcccactcttgagctcaccgatcagatttttacattggctctgcagcaccccgctcttcaggatgaagtatactgtcagatcctgaagcagttgacccataatagtaatcgccacagtgaggagcggggatggcaacttctgtggctgtgcacaggcctttttccaccgtccaagggattactgccccacgctcaaaagttcatcgatactaggcggggaaaactgctagccccagattgctccagacgtatccagaaggtattgcgcaccgggccaaggaagcaaccccctcatcaagtggaagtggaagccgcagaacagaacgtttctcgaatctgccataagatatatttcccaaatgacacttcagaaatgcttgaggttgtggcgaacacacgtgtcagggacgtatgcgacagcatcgcaaccagactgcagctagctagctgggaagggtgctccttatttatcaagatcagcgataaagtgatctctcaaaaggagggcgattttttttttgattcactgagagagtag

SEQ ID NO: 231661 - DNA, 6353 bp, Artificial Sequence
  Description of Artificial Sequence: Synthetic coding sequence
atgagcggctttcgcctcggcgatcacgtctggctggagccaccctccacgcataagactggagtggcaattggtggaataattaaagaagccaaacccggtaaggtgctggtcgaggatgatgagggcaaggaacattggataagagcagaggactttggagttctgagcccaatgcaccctaatagcgtccaaggcgtggacgatatgatccggcttggagacttaaacgaggccggaatggtgcacaatctactgatccggtaccagcagcacaaaatctatacgtacaccggatccatcctagttgccgtgaatcctttccaggtgttacccctgtatacattagaacaggttcagctgtactattctaggcacatgggcgagcttccaccacacgtgttcgccattgcgaacaattgctacttcagtatgaagagaaataagagagatcagtgttgtataatctctggcgaatctggggctggtaaaacagaaacaaccaaactcatcctgcaatttctggccaccatttctggacagcatagttggattgaacagcaggtactcgaagctaatcctatcttggaagcattcggcaacgccaagacaataaggaacgacaactcctcaaggtttggcaagtacattgatatctacttcaatccatcaggggttatcgaaggcgctcgaatcgaacagttcttactggagaagagccgtgtctgcaggcaggctcccgaggagcgcaactatcacattttctattgtatgctcatgggcgtgtctgccgaagataaacagcttctctcccttggcactccatcagaataccactacctcaccatggggaactgtacctcttgcgagggacttaacgatgccaaggactatgcacatatccgatcagctatgaaaattttgcagtttagcgactccgaaagctgggatgtaatcaagttgcttgcagctatcttgcacctaggcaatgtcggcttcatggcctccgtgtttgagaacctcgatgcctccgatgtcatggaaacgcccgctttcccgacagtaatgaaactcctggaggttcagcatcaagaactgagagactgtttaataaagcacacaatcctcatacggggagagttcgttacaagaagtctgaacattgctcaggccgctgatcggagggacgcctttgtgaagggcatatatgggcatctgttcctatggatcgtgaagaagattaacgcagctatctttactcctccagcccaggaccccaagaatgttcggagagctattggcctcctggatattttcggctttgagaacttcgagaacaactccttcgaacaactgtgcatcaatttcgcaaatgagcatctacaacagttcttcgtgcagcacgtttttacaatggagcaggaagagtatcgctcggaaaatatttcatgggactacatccactatacagacaaccggcctactcttgatctcctcgcccttaaacctatgtctataatcagtctgctggatgaagagtctaggttcccacagggcaccgacctcactatgctccaaaagctgaactccgtgcacgccaacaacaaagcattcctgcagccaaagaatattcacgatgctaggttcgggatcgctcacttcgcgggagaggtgtactatcaagccgaagggtttctggagaagaacagagatgtactgtccacagatatcttgacccttgtctattcctccaaaaataagttcctccgtgaaatctttaatctggagctcgcagaaaccaaactgggtcacggcactatcagacaggccaaggcaggtaaccacctgttcaaaagcgctgattctaacaagaggccatcaacattagggagccagttcaagcagagcttggaccagctcatgaaaattctcactaattgtcagccttactttatacggtgtatcaaacccaacgagtataagaagcccctgctttttgatcgcgagctgtgcctgaggcaactgcgatattccgggatgatggagacggtgcatatcagaaagagtggatttcctattcgctataccttcgaagaattctcacagcgatttggcgtcctcttgcccaatgctatgcggatgcagctgcagggtaagcttagacaaatgaccctggggatcaccgatgtctggctacgcacggacaaagattggaaggccggaaagactaagatctttctgcgggatcatcaggacacactcctggaggtccagcgatcccaggtactagaccgggctgcactgtcgatccagaaggtgctgagaggatacagatataggaaagaatttcttaggcagcgtcgcgcagcggtaaccctacaagcatggtggcgcggttactgtaatagacgaaatttcaagcttatcctggtgggctttgagagactccaggctatcgctcgatcgcagccccttgccagacaataccaggccatgcgccagcgaaccgttcagctgcaggccctgtgccggggttacctggttagacagcaggttcaagccaaaagacgagctgtggtggttatccaggctcacgctcgtggcatggcagcgaggagaaacttccaacagagaaaagccaacgcgccactggtgatcccagccgaaggccagaaatctcagggcgctctgccagccaagaaacggaggtcaatttacgacaccgtgactgataccgaaatggtcgaaaaagttttcggattcctgcctgccatgatcggcggacaggaggggcaagctagtccccatttcgaagacctcgaatcaaagacccagaagctcctcgaggtggatctcgatacggttccaatggccgaagagcctgaagaagatgtcgatggccttgctgagtacaccttccccaaattcgctgtgacctactttcagaagagtgctagtcatacacacatcagacgcccattaagatatcccctgctgtatcatgaggacgatacggactgcttggctgccctcgtcatctggaatgttatcctcagattcatgggagatttgcccgagcccgtcctttacgcacgctcaagccaacagggttctagcgtgatgaggcagatccacgatactttgggtcgagagcacggagcccaggttccgcagcacagcagaagcgcccaggttgcctcccagctgaacatcggtgaagaggctttggaacccgacggtctaggtgccgacaggcctatgtccaatctggagaaagtgcactttatagttggctatgcaattttgcgtccatcgttgcgagacgagatctattgtcagatctgtaagcagctgagcgagaactttaaaacaagttccctggcccgaggatggatcctgttatccctgtgcctgggttgttttcctcctagtgagaggttcatgaagtatcttctgaactttatcggccaggggcctgccacgtatggccctttttgcgccgagcgcctgaggcggacttacgcaaacggggtgcgggctgagccccctacttggttggaactgcaggctgtcaagtcaaagaagcacatcccaattcaggtgatactcgccaccggagagagcctgaccgtaccagttgactcggcctctacctctcgagaaatgtgcatgcatattgcgcataagcagggcctgtcagaccatctcggctttagcttgcaagtggctgtctacgacaaattttggagcctgggttctggtagagatcatatgatggacgccatcgctcggtgcgagcagatggcccaggagaggggcgagagtcaaagacagtcaccctggaggatttactttaggaaggaattctttaccccctggcatgactcccgcgaagatccggtcagcactgagctaatctaccgccaggtcttgcgcggtgtgtggtcaggagaatattcttttgagaaggaggaagagctcgtggaacttttagcacgacactgctatgtccagctgggtgccagcgccgagtctaaggctgtgcaggagttgcttcctagctgcatcccccacaagctttaccgtaccaagcctcctgaccgatgggcttccctggtcactgccgcttgcgccaaggccccttacacccagaagcaggtgaccccgctggcagtgagggagcaggtggttgatgctgcacgactccagtggcccttgcttttttcccgcctcttcgaggtgataacactgagcggtccgagactcccaaagacacaactgattctcgctgtcaactggaagggcctttgttttctcgatcagcaggaaaaaatgttgctggagctgtctttccctgaggtgatgggactggcaactaatcgcgaggctcagggcggacagcggctgctgttgagtactatgcatgaggaatatgaattcgtaagcccgagttcagtagccatcgccgagctggttgcactttttttggaaggactgaaagagcgttctatctttgcaatggccttacaagaccgcaaagcaactgatgatacaactctgctagcattcaagaaaggggacttgcttgtccttaccaaaaaacaggggctgctggcaagcgagaactggactcttggtcaaaatgaccgaacaggaaagactggtctcgtacccatggcatgcttgtacactatcccaaccgtaactaaaccttcagctcagctgttgagcctgttggccatgagccctgagaagcggaaattggccgcacaagaaggccagttcacagagccaagaccggaggagccccctaaagagaagttacatacgcttgaggaattttcttatgaattctttcgggcacctgagaaggacatggtttccatggctgtgcttcccctagcgagggcccgtggtcacctttgggcatattcatgtgagcctcttagacagccccttctcaaaagggttcacgccaatgttgacctttgggatatagcttgtcagatattcgccacaccaatcctcagatacatgggtgattaccctagccgccaggcttggcctaccctggaactgactgatcaaatctttactctggctctacagcatccagctctgcaagatgaagtttattgccaaattctaaaacagctgactcataactctaaccgccattcagaagaacgtggctggcagctgctgtggctgtgcactgggctgtttccaccctcaaagggtctgttgccccacgctcagaagtttattgatacacgccgtggaaagctgttggctcccgattgtagccgaagaatccaaaaggtcctccgcaccggccctagaaaacagccaccacatcaggtcgaggtggaggcagctgagcagaatgtgagccgcatctgccataaaatctatttcccgaatgatacatctgaaatgctagaggttgttgccaataccagagtgcgggatgtgtgcgactccatcgcgacgcgcctccagctagcctcttgggagggatgttccctgttcattaaaatctctgacaaagtgatctctcagaaagagggggactttttttttgacagtctacgcgaggtcagtgactgggttaagaagaacaaacctcaaaaagagggcgctccagtgaccttaccttatcaggtgtactttatgcgtaaactctggctgaatatttcgcctggcaaggatgtcaatgccgataccatcctccactatcaccaggaattgccaaagtacctcaggggattccataagtgttcgagggaggatgcaatacaccttgcaggcctgatttacaaagcccagttcaataatgacaggagtcagctggcatccgtccctaaaattctgcgtgagctggtgcctgaaaacttaacccgccttatgtcaagcgaggagtggaagaaaagtatcctgctggcttatgataaacacaaagacaagacagtggaagaggccaaagtggcatttctcaaatggatttgtagatggccgactttcgggtctgcctttttcgaggtgaagcagacctccgaaccttcttatccagacgttatcctaattgccatcaatagacacggagttctgctaattcatccaaagacaaaagacctgctgacaacctatcccttcaccaaaatcagttcatggtccagcggcagtacctacttccacatggcgctggggtcactcggcaggggtagccgcctgctttgtgaaacgagccttggctataaaatggacgatcttctgacgagttacgtccagcagttgctgagtgctatgaacaagcaacgcggatccaaggcgccagccctggccagcacata

SEQ ID NO: 231662 - DNA, 6350 bp, Artificial Sequence
  Description of Artificial Sequence: Synthetic coding sequence
atgtcaggcttcaggctgggagatcacgtctggctggaaccgccatcgacccacaagaccggggtggccattggcggaatcattaaggaggccaagccagggaaggtgttggttgaagatgacgaagggaaagagcattggatccgagccgaggactttggtgtgctaagccctatgcaccccaactctgtccagggggttgatgacatgatacggcttggggatctaaatgaggctggaatggtacataacctgctgatccggtaccagcagcataagatttacacgtatacaggaagtatactcgtcgccgtgaaccctttccaggtgctgcctttgtatacacttgaacaggtccagctgtactacagcagacacatgggcgagctgccaccccacgtattcgcaattgcaaataactgctacttctctatgaaaagaaacaagcgtgaccagtgctgcattatctccggcgaaagtggcgctgggaaaaccgagaccacaaagctcatcctccaatttctagcaacgatttctggacagcacagctggatcgagcagcaggttcttgaagcgaacccgatcctggaagcattcggtaatgccaagacaatacgaaatgataactctagccggttcggaaaatacatagatatctattttaaccccagcggcgtgattgagggggctagaatcgagcagttccttctggagaaatctagagtgtgccgccaggctccggaggagcgcaactaccacatcttctactgcatgctgatgggcgtgagcgcagaggataaacagctgttaagtttgggaacacccagtgaatatcactacctaaccatgggcaactgtacctcttgtgagggtctgaacgacgctaaagactacgctcacatccggagcgctatgaaaatcttgcagttcagcgatagcgagtcctgggacgttattaagctgctcgcagctatcctgcatctcggcaacgttggttttatggcgtccgtattcgaaaacctcgacgcctccgacgtcatggagacgcctgcttttccgacagtcatgaagcttctcgaggtgcagcaccaagaactccgggactgtcttatcaaacataccatcttgatcagaggggaattcgtaacgcggagtctcaatatcgctcaggccgctgatcgcagggatgccttcgttaagggaatctatgggcacctgtttttgtggattgttaaaaagattaacgccgcaatatttacgccacctgcccaggatcctaagaatgtgcggagggccattggactgctcgacattttcggcttcgaaaatttcgagaacaatagttttgagcagctttgcattaatttcgctaatgagcacctccaacaattttttgttcagcatgtctttactatggagcaggaagaataccggtctgagaacatctcctgggactatatacactatacagataacagacctacactagacctcctcgccttaaaacccatgagcattatctccctgctggacgaagagtctcgatttcctcaaggcaccgacctcactatgcttcaaaaactgaattctgtgcacgctaacaacaaagccttcctgcagcccaagaacatccacgatgctaggtttggtatcgcgcacttcgccggagaagtgtattaccaagctgaaggcttcttggaaaaaaatcgagatgttctatcaactgacatcctcacactggtttacagctccaaaaacaagttcctcagagagattttcaatctggagctggcggagaccaagctgggccacggcaccatcagacaggctaaagctggcaaccatctgtttaagtcagccgattccaataaacgtccctcaaccctcggatcacagttcaagcagtccctggaccagttaatgaagatcctgaccaattgtcaaccgtacttcataaggtgcatcaagcctaacgagtacaaaaaaccactgctttttgaccgtgagttgtgtttgagacagctgcgctactcaggtatgatggagactgtccatattcgaaagtcaggctttccaattaggtatacttttgaggaattctcacagcgcttcggggtgctgcttcctaacgcaatgaggatgcaactgcagggaaagctacggcagatgacattgggtattacagacgtgtggctccgaaccgacaaagattggaaagcgggaaaaactaagatcttcctccgggaccaccaggacactctgctggaagtccaaagatcccaggtgttggatcgggctgcgctgagtattcagaaagtgctgagagggtacaggtatcggaaagagttcctgcgccagcggcgtgcagctgtgacacttcaagcttggtggaggggctactgtaacaggcgtaactttaagctgatcctggtggggttcgaaagattgcaggcaatagcccgttctcaacccctggcaagacaataccaggccatgaggcagcgtaccgtgcagctgcaggcactgtgccggggatatttggtgagacagcaggtgcaggctaaaaggagagctgttgtggtcatacaggcccacgcccgagggatggccgcaaggagaaatttccagcaaagaaaagcaaacgccccactggtgatccctgccgagggacagaagagccaaggtgccctgcctgccaaaaagcggaggagtatttacgacactgtgacagatacagagatggtcgaaaaggttttcgggttcttgcctgccatgattggtggacaagaaggccaagcatcaccccacttcgaggatctcgaaagcaagacacagaaacttctcgaggtcgacttggacaccgtgcctatggctgaagagcccgaggaagatgtggacggcctagcagagtatacttttcccaaatttgccgtaacctattttcagaagagcgctagtcacacacacatccgaagacccctgaggtatcccctgttgtatcacgaggacgataccgactgtctggctgccctggttatatggaacgtaattctgcgattcatgggcgatctgcccgaaccagtgctctatgcacgtagctcccaacagggaagctccgtaatgcggcagattcacgatacgttaggcagagaacacggagctcaagtgccacagcattctaggtccgcccaggtggcctcccagctgaacattggcgaagaggctctggaacccgacgggttgggcgcagacaggcccatgagcaatcttgagaaggtgcatttcatcgtgggttatgccattttacgaccatcactgagagacgagatctattgtcaaatatgcaaacaactctcggagaactttaaaacctcctctctggctagaggctggattctgctttccctgtgcttggggtgcttccccccatccgaacggtttatgaagtacctactaaacttcattgggcagggacctgcaacatatggcccattctgcgccgaaagactgcgccgtacatatgcaaatggtgtgagggcggaacctccaacatggctagagttacaggcagtgaaatccaagaagcacattcctatccaggtgatattggcaaccggtgaatctctcacagtccccgtggacagtgcttccacctcacgggagatgtgcatgcacattgcccacaagcagggtctgtcagatcacctcgggttcagcctgcaggtggcagtttatgataaattctggagtttaggatctggacgtgaccacatgatggacgcaattgctcggtgcgagcagatggctcaggaaaggggcgaatcacagcggcagtccccctggcggatttatttcaggaaggagtttttcactccatggcacgactccagggaagacccagtgtctaccgagttgatttatcggcaggttctcaggggagtctggtccggagaatatagctttgagaaggaggaggaactagtggaactgctggcccgacactgttacgtccaactcggtgcatcagcagagtcaaaagctgtccaagaactgcttcccagctgtataccccacaagctgtaccgaacgaagcctccagaccgctgggcatctctcgtcactgcagcttgcgcgaaggccccttatactcagaaacaggtgacgcctctggcggtaagagaacaggtggtagacgccgctaggttgcagtggcccctgctcttcagtcggcttttcgaggtgattacactgagtgggccacggctcccgaagacccaactcatacttgcagtgaactggaaaggattgtgtttcctcgaccagcaggaaaagatgctgcttgaactctctttccccgaagtgatgggattggctacaaaccgagaagcacaaggcggacaacggctgctcctcagtaccatgcatgaggagtatgaattcgtctctcctagcagcgtggctattgcggagctcgtggcactgttccttgagggtttaaaggagaggtccatctttgccatggctctacaagatagaaaggccacggatgataccactctgctcgctttcaaaaaaggcgatttgctggtgctcaccaagaagcagggacttctggccagtgagaactggacactgggccaaaatgacagaacaggcaagaccggcctggtcccaatggcatgcctctacacaatccctactgtaactaaacccagtgcacagctcctgtccctcctcgctatgtcacccgaaaaacgcaaacttgctgcacaggaaggccagttcactgagcctagacctgaagagcctcccaaagagaagttacataccttagaggagttcagctacgaattcttccgcgctcccgaaaaagacatggtttccatggctgtgttgcccttggctcgggctcgtggacacttgtgggcttactcttgcgaaccccttcgtcaacctttgctgaaacgggtgcatgccaatgtggacttgtgggacattgcctgtcagatattcgtcgcaatcttgaggtacatgggcgattacccctctcggcaggcttggccgaccttggagctcaccgaccaaattttcaccttagcgctgcagcaccccgctctccaagatgaagtctattgccagattctgaagcagctgacgcataacagcaataggcatagtgaggaaaggggctggcaacttctctggctgtgcacaggcctgtttccaccctctaaaggtctgcttccgcatgcccaaaaatttattgatacccgcagagggaaactgctagcacctgattgctcacgacggattcagaaggtgttacggactggaccacgcaagcagcccccacaccaggtcgaagtggaggctgccgaacagaacgtctccagaatttgccataagatatacttccctaatgacacatcagaaatgctggaagtggtggcaaacacaagggttcgagacgtgtgtgattctatcgctaccaggctgcagctggcttcctgggagggctgttccctgttcatcaaaatcagtgataaggtgatttcacaaaaagagggtgatttcttcttcgattcactgcgggaagtatctgattgggtgaagaaaaacaagcctcagaaggagggcgcacctgttaccctcccgtaccaggtctatttcatgaggaagctgtggcttaacataagtcctggaaaggacgtgaacgccgatacgattttacattaccatcaggagctgcctaagtatctccgcggtttccataaatgcagtagggaagatgccatccacctggcaggactaatatacaaggctcagtttaataatgaccgatcacagctggcctctgtaccaaagatcttgagagagctggtgccggagaacctcacgcggttgatgagtagtgaggagtggaagaagagtatcctgttggcatacgacaaacataaggataaaaccgtcgaagaggcaaaagtggccttcctgaagtggatctgcaggtggcccacgttcggctcagcattctttgaagtgaagcagacaagtgagcccagctatccggacgtcatcctgatagccataaatcggcatggggtattgctcatccaccccaagacaaaggacctgctgaccacgtaccctttcacaaaaatttcttcttggagctcaggaagcacttatttccacatggccctgggatctctggggagaggtagtagattgctatgtgagaccagcctagggtataagatggacgatctgctcacctcatacgtgcagcagctactatccgccatgaataagcagagggggagcaaggctccagcccttgccagcacata

SEQ ID NO: 231663 - DNA, 6350 bp, Artificial Sequence
  Description of Artificial Sequence: Synthetic coding sequence
atgagcggcttccgcctgggcgatcatgtttggttagagcccccatccacccacaagacaggcgtggcaattggagggatcattaaggaggcgaaacctggaaaggtcctagtggaggatgacgagggcaaagagcactggatacgtgcagaggacttcggtgtcctttctccaatgcaccccaatagtgtccagggtgtcgacgatatgattcggctcggtgacctgaatgaggctggcatggttcataacttgctgattcgctaccagcagcacaaaatatacacctacaccggctccattctggttgccgtgaatccattccaagtgctgccgctctacacactggaacaggtgcaactttactacagtcgacacatgggggagctgccccctcacgtctttgccatcgccaacaactgttatttctcaatgaagcgcaataagcgagaccaatgttgcatcattagcggggaaagcggtgctggcaagaccgagaccaccaaactcatcttgcaatttttagctactattagtgggcagcactcctggatcgaacagcaggtcctagaagccaaccccattttggaagctttcggcaacgctaaaaccatccgaaatgataacagtagtagattcggaaagtacatcgatatatatttcaatcctagcggagtgatcgaaggggctcgtatcgagcaattccttctggagaagtctcgcgtatgtagacaggcccctgaagagcgcaactatcacattttttattgcatgctgatgggtgtgagcgccgaagacaagcagcttttatcattaggaacaccctctgaatatcattatttgacaatgggcaattgtacttcttgtgagggccttaacgatgcaaaagattacgcacacattcgctcagccatgaagatcttgcaatttagcgattctgagagctgggatgtgatcaaattgctggccgctatccttcacctgggcaatgtcggttttatggcttccgtattcgaaaacttggacgcctctgacgtcatggagacacccgcattcccaaccgttatgaagcttctggaagtccagcatcaggaactccgtgactgtcttatcaagcatactatcttgattagaggagaattcgtgaccagaagtcttaacatcgcacaagcagctgaccgtcgggacgccttcgtgaaaggaatctatggccacctgttcctgtggatcgtgaaaaaaatcaatgcggcaatcttcacgccacccgctcaggaccccaagaatgtgcgaagagccatcggcctgctggatatctttggttttgaaaactttgagaataactctttcgagcagctttgcatcaactttgccaatgagcaccttcaacagttctttgtgcagcatgtattcacgatggaacaagaagaatatcggtctgaaaatatctcctgggactacatacactacaccgacaaccgacccacgctggacttactcgccctcaaacccatgtcgatcatatctctgctggatgaggagtcaagatttccgcagggtaccgacctcactatgctgcagaaactcaactcagtacatgccaataataaggcgttcctgcagcctaagaacatccatgatgcgaggtttggcattgcccattttgccggtgaagtgtactatcaggcggagggttttctggaaaaaaacagggatgtcctgtctactgatattctcaccctggtgtattcatctaaaaataaattcctgcgggaaatcttcaacctcgagctggcagaaaccaaactcggccacggtacaatccggcaagcgaaagcaggtaaccacctgttcaaatctgctgactctaacaagagaccttcaaccctcggcagccagttcaagcaatcccttgaccagctcatgaaaattctgaccaactgtcagccgtatttcataagatgcataaaaccaaacgaatacaagaaacccttactgttcgaccgcgaactgtgcctgcggcaactacgatactctggaatgatggagaccgtgcatattcggaagagcggattccccataagatacacattcgaagaattctcccaacggtttggcgtccttctgccaaatgctatgaggatgcagctgcagggaaaactccggcagatgaccttggggattaccgacgtgtggctccgtacagataaggactggaaggcaggaaagactaaaatttttctgagagatcaccaggatacgctgctcgaggtacagagatcacaggtgttagatagggctgcgctatccatacagaaagtgctgcggggataccggtatcggaaagagtttctcaggcagcgacgggcagccgtgacgcttcaggcatggtggagaggatactgcaaccgcagaaacttcaagctgatcttggtgggtttcgagagactacaggctatagcaaggtcccagcctctcgctaggcagtaccaagctatgagacagcggacggtacagttgcaggccctttgccgtgggtatctggtgcgtcagcaagtgcaagccaaaaggagggctgtagttgtaatacaggcgcacgcccgaggcatggccgctcgcagaaactttcagcaacggaaagcaaacgcccctctggtgattccagccgaggggcagaaaagccagggggcacttcccgctaagaagcgcaggtcaatttacgacaccgttaccgatactgagatggtagaaaaagttttcggatttctgccggctatgataggcggacaggaaggtcaggccagcccacatttcgaggatttggaatctaagacccaaaaactactggaagttgatttggatacagtccccatggctgaggaacccgaggaagacgttgacgggctcgctgagtacacctttccgaagttcgcagtgacatattttcagaaaagtgctagtcacacacacataagaagaccactccggtatcctctgctttaccatgaagacgacacggattgcctggccgcactggttatctggaacgttatcctacgattcatgggggatctgccagaaccggttttatacgcaagatctagtcagcaggggagcagtgtgatgcgtcaaatccacgacactttggggagagaacacggggcacaggtgcctcagcattcacgaagtgcacaggttgcctcccagctgaacatcggggaagaggcactcgagcctgatggactcggggcagatagaccgatgagcaatcttgagaaagttcacttcatcgttgggtatgccatcctacgcccatccttacgtgacgaaatctactgccaaatttgcaaacaattgtccgagaacttcaagacatcatctctggcaaggggctggattctcctgtcactctgcctgggctgcttcccaccctctgaaaggttcatgaagtacctcctcaacttcatcggacagggccctgctacctacggacctttttgtgctgaaaggctcaggcgcacctatgccaacggcgtccgtgctgaaccacctacgtggctggagctgcaggctgtgaagagcaagaagcatatccctattcaggtaatcctggccaccggcgaaagcctgaccgtgcccgtggactcggcctctacttcccgagagatgtgtatgcacattgcgcataaacagggactgagtgatcacctcgggtttagtctccaggtcgcggtttacgacaagttttggtcactgggcagtggccgagatcacatgatggatgccatagctagatgtgaacagatggctcaggagcggggtgagtcccagcggcagtccccatggcgcatatacttccgaaaagagtttttcaccccatggcacgacagccgtgaggaccctgtcagcaccgagcttatctatcgccaagtgctgcgtggtgtctggtcgggagagtactccttcgaaaaagaggaggaattggtggagcttctcgcacggcactgctatgtgcaactgggtgcttctgccgaatccaaggccgtgcaggagctgctgccgagttgtattccacacaagttgtaccggactaaaccccctgacaggtgggcctctctggtgaccgcagcctgcgcgaaggccccttatactcagaagcaggtaactccattggctgtgcgggagcaggttgtcgatgccgctcgacttcagtggccattacttttctcacgcctgtttgaagtgatcaccctgtccggtcccaggttacctaagacccagctcatcttagctgtgaattggaaaggactttgttttctggaccaacaggagaagatgctcttagagctctccttccctgaggtaatgggactggccactaatcgcgaagcacaggggggacagcggctcctactttccactatgcacgaggagtatgagttcgtgagtccatcgtccgtggccatcgcggagctcgttgctctctttctggagggattgaaagagagatctatcttcgcaatggctcttcaggatagaaaagcgactgatgacacgacacttctcgcttttaaaaaaggcgatctgctcgttctgaccaaaaagcagggtcttctggccagcgaaaactggaccctggggcagaacgatcggaccggcaaaaccggcctggtacctatggcctgcctatatacaattcccactgtgacaaagccttcagctcaactcctctcgttgcttgctatgtcaccagagaagagaaagctagcagcacaggaaggacagtttaccgaaccacgtccagaggaacctcccaaggagaagttacatactctggaggagttctcttatgagttttttcgagccccagaaaaggacatggtgtccatggccgttttacccctcgcaagagcaaggggccatctgtgggcatactcctgcgagcccctcaggcaaccactgctgaaacgcgtccacgccaacgtggacctttgggatattgcttgccagattttcgttgcgatactgcgttatatgggagactacccatctcgccaggcttggcccacgctcgagctcacagatcagattttcaccctagccctgcaacatccagccctgcaggacgaggtatactgccagatactgaaacagctgacgcacaacagtaaccggcatagtgaggaaagaggttggcagctgttgtggctgtgcactggtctgttcccgccatctaaagggctgcttccacatgcccagaagtttatcgatactcgcagagggaaattattagccccagattgtagcaggaggattcaaaaggtgcttaggacaggaccaaggaagcagccccctcaccaggtggaggtggaggctgccgagcagaatgtgtcccggatatgccataaaatttacttccccaatgataccagtgaaatgctggaggtcgtcgccaatactcgtgtgcgggacgtgtgtgattccatagccacaaggcttcagctcgcatcctgggagggctgctctctgtttattaagatttctgataaggtgatcagtcaaaaggaaggggactttttcttcgatagcttgcgggaggtgtctgactgggtcaaaaagaataagcctcagaaagagggagctcccgtgactctgccataccaagtctattttatgcggaagctctggctcaatatttccccaggtaaggatgtgaacgccgatacaatcctgcattaccaccaagagcttcctaagtatttgcgtggattccacaagtgttcccgcgaagacgctattcacctcgccggacttatctacaaggcccagttcaataacgacagatctcagctcgccagcgtccctaaaatactgagagaattggtcccagagaatctgacccgactcatgtcctctgaggaatggaaaaagtccatcttactcgcttacgacaagcacaaggacaaaaccgtggaggaggccaaagttgcttttctgaaatggatctgtaggtggccgaccttcggaagcgctttcttcgaggtcaagcagacatcagagccctcataccccgatgtgatactaatcgctataaatcggcacggcgttctgctgatccaccccaagaccaaggatctgctgacaacataccctttcactaaaatttcctcttggtcctctggcagcacatattttcatatggcactcgggagccttggccgagggtcacgtttgctttgcgaaacgagcctgggctataagatggatgatctacttacttcatacgtccagcagctactctccgccatgaacaagcagcgtgggtctaaagcgcctgctctcgcttctacata

SEQ ID NO: 231664 - DNA, 4248 bp, Artificial Sequence
  Description of Artificial Sequence: Synthetic coding sequence
atgccagatcagttcgatcaggcagtggttctgaatcagctcagatactctggtatgctggaaacagtgagaattcgcaaagcaggctatgcagtgcggagaccttttcaggatttttataagagatataaggtcctcatgaggaacttggccctgcctgaggatgtgaggggcaaatgtactagtcttttgcagctgtatgacgcatccaactcagagtggcaactcgggaaaactaaagtcttcttgcgcgagagcctcgagcagaaacttgagaaaagacgagaagaagaagtcagtcacgcggctatggtgatccgagcccacgtgctcggattcctggccaggaagcagtaccggaaggtgctctactgcgttgtgataattcagaagaattaccgcgcatttcttctcagaaggcggttccttcatctcaagaaagccgcaattgtgttccagaagcagctccgcggtcagatagcaaggcgcgtgtaccggcaactgctggccgagaagagggagcaagaggagaagaagaaacaggaggaagaggagaagaagaaacgcgaggaagaggaaagagagcgggaacgggagcggcgagaggccgaactgagagcgcagcaggaggaagaaacccgtaagcagcaggaattagaagctctgcaaaaatcccagaaggaggctgaattaaccagagagctggagaagcagaaagagaacaaacaggtggaagagattttaagattggagaaagagatagaggacctccagcggatgaaggagcaacaggaattgagcctgacggaggcatcattacagaaattgcaggaaagacgcgaccaggaactgaggcggctcgaagaggaggcatgccgggctgcccaggagtttctcgagtctctaaacttcgacgagattgacgagtgtgtgaggaacattgagcgttctttgtctgtgggaagtgaattcagctccgaattggcagagtccgcctgtgaggagaagcccaatttcaacttctcccagccgtaccctgaggaggaagtggatgaaggcttcgaggcggatgatgacgcgtttaaagacagccctaatccaagcgagcatggacatagtgaccagcgaacaagcggcataagaacctccgatgattcatctgaagaagacccatatatgaatgacacagtggtgcctactagcccgagcgcggactccaccgtacttctggctccctctgtccaggactctggtagcctgcacaattcatccagcggcgaaagcacatactgcatgccacagaacgccggagacttgccgtctccagatggggactatgattacgaccaagatgattatgaagacggtgcgatcacaagtgggagtagcgtgaccttctcgaattcttacgggtctcagtggtcccccgactacaggtgcagcgtgggaacatataactcctctggtgcgtatcgcttcagcagcgaaggcgctcagtcttcattcgaggactcagaagaggatttcgattcccggttcgataccgatgatgaattatcgtatagaagagacagtgtgtatagttgtgtcactctgccttacttccactcatttctgtacatgaagggaggactgatgaactcatggaaacggcgttggtgtgtgctcaaggatgaaaccttcctctggttccgtagtaagcaggaggccctcaagcaaggatggctgcacaaaaaaggcggaggatctagcacgctgagtcgaagaaattggaagaagagatggtttgtacttagacagtcaaaactgatgtattttgagaatgacagcgaggagaagctgaaggggaccgtggaggttcgcactgccaaggaaattattgacaataccaccaaagaaaatgggatcgatattattatggctgacaggacctttcacctcatcgcagagagccccgaagacgcgtcccagtggttctctgtgttgtcacaggtgcatgctagcaccgaccaggaaattcaggagatgcatgatgagcaggctaatccccagaacgctgtcggcacgcttgatgtgggactgattgattcagtgtgcgcatcagacagtcccgacaggcccaatagttttgtcatcataaccgctaacagagtactgcattgcaatgctgacactccagaggagatgcaccattggataacccttctgcagcggtcaaagggagatacacgcgtagaagggcaggaattcatcgtaaggggttggttgcataaggaggtgaaaaattcgcctaagatgtcttcactcaagctgaagaagcgttggttcgtgctgactcataactcgctggactactataaatcctcggaaaagaacgcgcttaaattgggcaccctagtcctgaacagcctgtgctcagtcgtaccacccgatgaaaaaatcttcaaggaaacggggtattggaatgtgactgtttacggaagaaagcattgctatcgcctgtataccaagttgctgaatgaggcaactcgttggtcctccgccatccagaacgtcacggataccaaagccccaatcgacacacccacacagcagctcattcaagacattaaagaaaattgcttgaattcagacgtggtggagcagatctacaaacgcaatcctattcttcgatatacacaccaccctcttcacagcccactgttgccactgccctacggggacattaacctgaatctgctgaaggacaaaggatacactacgctgcaggacgaagccatcaagatatttaattccctccagcagctagagagtatgagtgatcctatccctattatccagggcatcctccagactggacacgacctgcgccctctgcgagacgagctgtactgccagttgataaagcagacgaacaaggtaccccaccccggatctgttggtaatctctattcctggcagattctcacatgcctctcttgcacatttctccctagtcgcggaattcttaagtacctcaaattccatctgaagcgtattcgcgaacagttccctggatctgagatggagaaatatgcactcttcacctacgaaagtctgaaaaaaaccaagtgtagggagtttgtgccatctagggacgagatcgaggctctgatccacagacaagaaatgacttcaacggtgtactgtcacggtggaggttcctgtaaaattaccataaattcacatacaaccgctggtgaagtggttgaaaaactaattcgtgggctggctatggaggacagccggaacatgttcgcgctgttcgagtacaatgggcatgtagataaggcaattgaatcccgcaccgtcgtggctgatgtactggccaaattcgagaagcttgcagcaacctcagaagtcggagatctcccctggaagttctattttaaactgtattgctttcttgatacagacaacgttcccaaggattccgtcgaattcgcttttatgtttgagcaggcacatgaagccgttattcacggacaccatcccgctccagaagagaacctgcaagtcctggcagcgttgcgcctgcagtatctgcagggggactatactctccatgcagctattccaccattggaggaggtgtacagtcttcagaggcttaaggccagaatctcccaatctaccaagaccttcacaccttgtgagcgactcgagaaacgaagaactagtttcttggaaggcaccttacggaggtcgttcagaactggatctgtcgtgaggcaaaaggtggaagaagagcagatgttagacatgtggatcaaagaggaagtgtcgagtgcacgggcatcaatcatagataaatggaggaagtttcagggaatgaatcaggagcaggccatggcaaagtacatggcactgatcaaggagtggccagggtatggttctaccctcttcgacgttgagtgcaaggaaggcggttttccacaagagctctggctgggagtctctgccgacgcggtcagtgtgtataaacgcggtgagggcagaccactcgaggtcttccagtatgagcatatattgtccttcggggcaccattggctaatacgtataagatcgttgtggacgaaagagaattactgtttgagacgtcagaagtggtggatgtcgctaaactcatgaaggcctatatctctatgattgtaaagaaaagatacagcacaacccgctccgcctctagtcagggatcttcaagatag

SEQ ID NO: 231665 - DNA, 4248 bp, Artificial Sequence
  Description of Artificial Sequence: Synthetic coding sequence
atgcccgaccagttcgaccaggctgtcgtgctgaaccagctgcgatattccggcatgctggagaccgtgcggattcgcaaggccggttatgctgtgcgcaggcctttccaggacttctacaagaggtataaggtcctaatgaggaacctggccctgccagaagacgtgaggggcaagtgcacaagcctcctgcagttgtatgatgcttccaatagcgagtggcagctgggtaagactaaggtgttcttgcgcgagagtctggagcagaaactggaaaagcgccgagaggaggaggtgtcccatgcagccatggtgatcagagctcatgtgctgggcttcctcgccaggaaacagtacagaaaggtgctgtattgcgtcgtgataatccaaaagaactaccgggcttttcttctccgtcgcaggttcctgcacctcaagaaagccgcaatcgttttccagaaacaactgcgaggccagattgcacgtcgagtctatcgccaacttctggctgagaagagggagcaggaagagaagaagaagcaagaggaggaggagaagaagaagagagaagaggaagagcgcgagagagagagagaaagaagggaggccgagcttcgagcgcagcaggaagaggagactagaaagcagcaggaattggaggctctccagaaaagtcagaaggaggctgagctcaccagggagttggaaaaacagaaggaaaacaaacaggtggaagagatccttagacttgagaaggaaattgaagaccttcagcgtatgaaggagcagcaggagctgagccttaccgaagccagcttgcaaaagcttcaagaaaggagagatcaggaactccgacgattggaggaagaggcctgccgcgcagcccaggagttcctggaatccctgaacttcgacgagattgacgaatgcgtccgaaacattgagaggtcactaagcgtcggaagcgaattttcttctgagctagctgagtccgcatgtgaagaaaaaccaaacttcaacttcagccagccttacccggaggaggaagtcgacgaaggctttgaagcagacgacgacgctttcaaggatagcccgaatcctagcgagcatggccactccgatcaacggactagcggcatcaggaccagcgatgacagcagtgaggaagacccatatatgaatgacaccgtggtccctacctctcccagtgctgatagtactgtgctcctcgccccttctgtgcaggactctggctctctccacaattccagtagcggagagtccacttactgtatgcctcaaaatgcaggagacctgccctcccccgatggtgattatgactatgatcaggatgattacgaagacggggctattacctctggcagtagcgttactttcagcaactcttatggcagccagtggtccccagattaccgctgcagcgtcgggacttataatagcagtggagcctataggtttagctcagaaggcgctcaatccagtttcgaggatagcgaggaggactttgacagcaggtttgatactgacgacgagttgtcatacaggagagacagcgtgtactcatgtgtcaccctgccctatttccactcttttctctacatgaagggaggcctcatgaatagttggaaaaggcgatggtgtgtgctgaaggatgagacctttctgtggttccgatccaagcaggaggcgctgaaacaggggtggcttcacaaaaaggggggaggcagtagcactctctcaagaagaaactggaagaagaggtggttcgtactaagacagtcaaagctgatgtacttcgaaaacgattccgaggagaagctgaagggtaccgtggaagtcaggactgctaaggaaattatcgacaatacaaccaaagaaaatggcatcgatattattatggcggaccggactttccacttgattgctgagtcccccgaggacgcctcacagtggttttccgtgcttagccaggtacacgcttccactgaccaggagatccaggaaatgcacgacgaacaagccaatccgcagaatgcagtcgggacacttgatgtaggtctgattgactcagtttgcgcctcagattcaccagacaggcccaattcatttgttattattactgctaaccgcgtgctacattgcaacgcagacacacctgaggaaatgcaccattggatcaccttactgcagagaagtaagggggacacccgagtcgagggccaggagttcatagtgagagggtggctccataaagaagtgaaaaattctcctaaaatgtcatctctcaagttgaagaaacggtggttcgtgttaacccataacagcctggattactataaaagtagcgagaagaacgcccttaaattgggcacattggtgctgaactccctgtgctccgttgtgccccctgacgaaaaaatctttaaggagactgggtactggaatgttacggtgtacggacgcaagcactgctaccgtctgtacaccaagctcctgaatgaggccactcggtggagcagtgcgatacagaatgtgaccgacacaaaggctcctatagacacccccacacaacagctgattcaggacattaaagagaactgtctcaattccgacgtggttgagcaaatctataagagaaatcctatactgagatacactcaccaccctctgcatagccctttactgccgttgccctatggggatataaacctcaatctgctgaaggataagggatacacaactctgcaagacgaggcgattaaaatcttcaactcactgcagcagctggaatctatgtccgatcctattcccatcattcaggggattctccagacggggcacgatctgaggcctctcagggacgagttgtattgtcagctcattaagcagactaataaggttccgcacccgggatctgtgggtaacctttacagttggcagattctgacctgcttatcttgcacattcctgccgagcaggggcattctcaagtatctcaaatttcacttgaagcggattcgagaacagttccccggatccgagatggaaaaatacgcgttgttcacttacgaatctctgaagaaaacgaaatgtagagaatttgtgccgtctagggatgaaatcgaagccctgattcatcgccaagaaatgacatccactgtctattgccacgggggtgggtcatgtaagatcaccataaactcgcatacaacagcaggcgaggtcgtggaaaaattgatacgcggactggcaatggaagatagccgaaacatgttcgccctgttcgaatataatggtcatgtggacaaagcgattgaatctcgcacagtggtggcagacgtgctggcaaagtttgagaagctggctgccactagtgaggttggcgacctcccctggaaattctacttcaagctttattgttttcttgacaccgacaacgtccctaaggatagtgtcgagttcgccttcatgttcgaacaggctcatgaggctgtgatccatgggcaccaccctgccccagaggaaaatctgcaggtgctcgctgccctccgactccagtatctacaaggtgactatactctccatgctgctatccctccactggaggaggtttattccctgcagaggctgaaggccagaatctcacagtctaccaagactttcacaccatgcgaacgtctggagaaacgccgaacctcctttttggagggaactctgcgtcggtcattcagaaccggatcagtagtccgccaaaaggtcgaagaggaacagatgcttgatatgtggataaaagaagaggtgtcttctgcccgtgcaagtattattgacaagtggcggaagtttcaggggatgaatcaagaacaggccatggccaaatatatggccctgatcaaggaatggcccggttatggaagcacactcttcgatgtggagtgtaaggaaggcggatttccccaggagctctggctgggcgtgtcagctgatgcagttagcgtgtataagaggggggaggggcgaccactcgaagtgttccagtacgaacacatactgtcttttggggcaccgctcgccaatacctataaaattgtggtggatgaaagggaacttctctttgaaacctccgaggtagtggacgttgcaaagctaatgaaggcttacatttctatgatcgtgaagaagcggtattctaccacccgaagtgccagttctcaaggaagcagccggtag

SEQ ID NO: 231666 - DNA, 4194 bp, Artificial Sequence
  Description of Artificial Sequence: Synthetic coding sequence
atgctggaaacggtgaggatccgcaaggccggatatgccgtgaggaggccattccaggatttttataaacgctacaaggtccttatgcgtaaccttgccctgcccgaggatgtgcggggtaaatgcacttcccttctccagctgtatgacgcatctaactctgagtggcaactgggcaagaccaaggtatttttacgagagtcccttgaacaaaagctggagaagcgccgagaggaagaagtttctcatgccgcaatggtgattagagcgcacgttttgggttttcttgctcgaaagcagtacagaaaggtgctttattgcgtggtcatcatccagaagaattaccgcgcttttctcctgagaaggcgattcctgcatctaaaaaaggctgctatcgttttccaaaaacagcttcgcggtcagattgcgcgaagggtgtataggcagctactcgctgagaaaagggagcaggaggaaaaaaagaagcaggaagaagaagagaagaaaaagagagaagaagaagagcgtgagcgggagagagagcgcagagaagcagaactgcgcgctcagcaggaggaggagacccgcaagcagcaggaacttgaggctctgcagaagtcccagaaggaggcggagctgactcgcgaattggaaaagcagaaagagaacaagcaagtggaggagatcttgcggcttgaaaaggagattgaggacttgcagcgtatgaaagagcagcaggagctgagcctgactgaagccagcttgcagaagctgcaggagcgacgcgatcaggagttgcgcagattggaggaggaggcttgcagggccgcacaggagttcctcgagtcattgaatttcgatgaaattgacgaatgcgtgcggaacatcgaacgctccttatctgtcggctcagagttctcatccgaactggccgagagcgcttgtgaagaaaagcctaatttcaattttagccagccttaccccgaggaggaggtggatgagggctttgaggccgacgatgacgcctttaaggactctcccaatccaagtgagcatggccactctgaccagcgcaccagtgggatccggacaagtgacgatagctccgaggaagacccctatatgaacgatacggttgtgccaaccagtcccagcgctgactccaccgtgctgctggccccttccgtacaagattcgggctcgctccacaatagctctagtggggaatccacctactgcatgccgcaaaatgctggcgacttgccatctccagatggcgactatgactacgatcaggacgattacgaggatggagccatcacatcaggttctagtgtgacattcagtaattcctatggatcacaatggtctccagactacagatgttctgttggaacctataacagtagcggtgcctatcgcttctcctctgagggggcacagagctcgtttgaagattcggaggaggattttgatagtaggttcgacacggacgacgaactgagctatcggcgagatagtgtgtacagctgcgtgaccctgccatacttccactcttttctctacatgaaagggggacttatgaattcgtggaagcggagatggtgcgtgctcaaagatgagacctttctgtggttcagatcgaagcaagaagccctgaagcagggatggctccacaaaaagggcggtgggagctcaacactgagccggagaaattggaagaagcggtggttcgtgctaaggcagtccaagcttatgtatttcgaaaatgattccgaggaaaagcttaaggggactgttgaggtgcggaccgccaaagaaataatcgataataccactaaggaaaacggtatcgatatcatcatggccgacaggacatttcatcttatcgcagagtctcctgaagacgcatcacagtggttcagcgtgctaagtcaagttcatgcctccactgaccaagagatacaggagatgcacgacgagcaagctaacccacagaacgctgtgggtacactcgacgtgggtttgattgactctgtttgtgcatccgactccccggataggcctaattctttcgtgattattaccgcgaaccgagtgctgcattgcaatgcagatacacccgaggagatgcaccattggatcaccctcctccaaagaagcaagggagatactcgcgtggaagggcaggagtttatcgttagaggctggctgcataaggaagtgaaaaatagtcccaaaatgagcagtctcaagctgaaaaagaggtggttcgtactcacgcataacagcctggactattacaagtcctccgaaaagaacgcactgaaactaggtacattggttctaaacagtttatgctctgtcgtgccccctgacgagaaaattttcaaagagaccggctactggaacgtaactgtgtacggccgtaagcattgttatcggttatatactaaattgctcaacgaagcaactaggtggagctcagctattcagaatgtcaccgacacgaaggcacccatcgatactcccacccagcaactaatccaggatatcaaagagaactgcctgaatagcgatgtcgttgaacagatttataagaggaatccaatcctccgatatactcatcacccactacacagtccattgctgccactaccatacggggacatcaacttaaatctcttaaaagacaaggggtacacaacgctgcaagacgaggccatcaaaattttcaatagtcttcaacagttagaatcaatgtccgaccctattcctatcatccagggcatcctgcagactggccatgatctaaggcctctccgggatgaactatactgtcagctaattaagcagactaacaaagtgcctcacccaggctcagttgggaatctgtactcctggcagattctcacttgtctgagttgcacattcttgccaagtagaggcatcctgaagtacctcaagtttcatttaaagagaattcgagagcagttcccgggatcggagatggagaagtatgcgttgttcacatacgaatcacttaaaaagaccaagtgcagagagtttgttccgtcgcgggatgaaatcgaggccctcatccataggcaagagatgacttccaccgtttattgtcatgggggaggctcctgtaagataacaatcaattcacatactacagccggagaagtcgtcgagaaattgatcagggggctcgccatggaggatagtcggaacatgttcgccctgttcgagtataacggacatgtcgacaaggccatagaatcacgtaccgtcgtggcggatgtacttgccaaatttgaaaagctcgcagctaccagcgaggttggtgatttaccctggaagttttattttaaattgtattgttttctagatacagataacgtacccaaggactcagtcgagttcgcctttatgttcgaacaggcccatgaggctgtgattcatggccaccacccagcaccggaagaaaacttacaggttctggcggctctgaggctgcaatatctgcagggggattacactctgcatgcagctatccctcctctcgaagaagtttacagcctgcagcgtctcaaggcccgaatcagccagtccacgaaaaccttcaccccctgtgagagacttgagaagcggagaacttccttcctggaggggaccctgaggagatcttttcgcaccggctcggtcgtccggcagaaggtggaagaggagcagatgctagacatgtggatcaaagaggaggtcagctccgcaagggcgagcatcatagataaatggcgcaaattccaaggcatgaatcaggaacaggccatggccaagtacatggcacttataaaagaatggcccggatacggatccacgttgttcgacgtggaatgcaaagagggcggtttccctcaagaactatggttgggcgtttccgcagacgcagtgagtgtgtacaaacgaggagaagggagacctctcgaggtattccagtatgaacacatcctgagctttggagcccctctcgctaacacctataagatagtggtggacgagcgagagcttctcttcgagactagtgaggtcgtggatgttgctaagcttatgaaagcttacatcagcatgatagtcaagaagaggtattcaactacccggtccgcaagttcacaggggagttccaggtag

SEQ ID NO: 231667 - DNA, 6176 bp, Artificial Sequence
  Description of Artificial Sequence: Synthetic coding sequence
atggataacttttttacagaaggcacacgggtctggctccgagaaaacggacaacacttcccatccacggtgaacagctgtgcggaaggaatcgttgtcttcagaacagattacggacaagttttcacgtacaaacagtctaccatcacacatcagaaagtgaccgccatgcatcccacaaatgaagagggcgtggatgatatggcatctctgacggagctgcatggagggtcaatcatgtacaacctgttccagagatacaaacggaaccagatctatacatacatcggctcaatcctggccagcgtcaatccctaccaacccatcgctgggctctatgagcccgctacaatggagcagtactccaggcggcacctaggggaattgcctccgcatatctttgctatcgcaaatgaatgctatcggtgtttgtggaagcggcacgataaccagtgcatactgatatcaggcgagtctggcgcaggcaagacagaatccacgaaattaatcctcaaattcctgtccgtgatttctcagcagagcctggaactcagcttgaaagagaagaccagctgcgtggagcgtgccattctcgagagcagtcccatcatggaggcttttggcaatgctaagacagtttataataacaatagcagccgttttggaaaatttgtgcagcttaatatctgccagaagggcaacatccaggggggtcggattgttgactatctactggagaagaaccgcgtggtgagacagaacccgggagagcggaactaccacatcttttacgccctcctggctggcctagagcatgaggagagagaggaattctatttatccacccctgaaaactaccactaccttaaccagtccggatgcgtcgaggataaaactatcagtgaccaggagtcattccgtgaagttattactgcaatggatgtgatgcaattttccaaagaggaagtacgcgaggtcagccgtctgctagcaggcattttgcaccttggaaacatcgaattcatcactgccggaggggctcaggtcagcttcaaaaccgcgctgggcaggtccgcagagttgctggggcttgaccctacccagctgactgacgccctaactcagagatcaatgtttcttagaggagaggagattttgacaccattgaatgtgcagcaagccgtggatagccgcgactctctggccatggccctctacgcctgctgcttcgagtgggtcattaagaagattaattctcgcatcaaggggaacgaggactttaagtcaattggcattctcgacatctttgggttcgagaattttgaggtcaatcacttcgagcagtttaacattaattacgcaaacgagaaactgcaagagtacttcaacaaacacatcttttcccttgagcaactagagtacagtcgcgaaggcctggtttgggaagatatcgattggatcgacaacggcgagtgtctcgatcttattgagaaaaagctgggcctcctggccctgatcaacgaggaaagtcacttcccccaggccaccgactcgacacttcttgagaaactgcactcacaacacgcaaacaaccacttttacgtgaagccacgggtcgctgtgaataattttggcgtaaaacactacgcaggtgaagtacagtatgatgtgagggggatcctggaaaagaacagggacacctttagggacgacttgctgaacctgctcagagagtctaggtttgatttcatctacgacctgttcgaacacgtgtccagtagaaataatcaggacaccttgaaatgcgggtcaaagcatcggcgtccaacggtgagcagccaatttaaagactcattgcactctctcatggccacactttcctcatccaatccctttttcgtcagatgtatcaagccgaatatgcagaaaatgcctgaccagttcgatcaagctgttgttttgaaccagctaagatactccggaatgctcgagactgtgcgtattaggaaggccggttacgccgtccggagacccttccaggacttttataaacgatacaaggtgctgatgaggaatcttgctctccccgaggacgtccgaggaaaatgcacaagcctcttgcaattgtatgatgcctctaattccgaatggcagctcggtaagaccaaggttttcctccgggaaagtctcgagcagaaactagagaagcgcagggaggaagaagtgagtcacgctgctatggtgattagagctcacgttctcggattcctggcacgaaaacagtacagaaaggtgctatactgtgtggtaattatccagaagaattatcgggcttttctgctgcggagaaggttccttcacctgaaaaaggctgcgattgtcttccagaaacagcttcgaggtcagattgcaagaagagtctaccggcaactgctggccgaaaaaagagagcaagaagagaaaaaaaagcaggaggaggaagaaaagaaaaaacgggaggaggaagagcgagaaagggaacgggagaggagagaggctgaactccgggctcagcaagaggaagaaacgcgaaaacaacaagaactggaggctctccagaagtctcagaaggaggctgagcttaccagggagttggagaagcagaaagagaacaaacaggtggaggaaatcttaagactggaaaaggagatcgaggacctccagagaatgaaggagcagcaggagctgtctttaaccgaagctagtctgcaaaaactgcaggagagacgcgatcaggagcttaggcggcttgaggaggaagcatgtagggctgcgcaagaatttttggaatctctgaattttgacgagatcgatgaatgtgtgcggaatatcgaaaggtccctctcagtcgggtccgaattttcttcagaactagccgagagtgcttgcgaagaaaaaccgaatttcaatttttcccagccctacccagaggaggaggtggacgagggttttgaggcggacgacgacgcgttcaaagattctccaaatccttctgaacacggccattccgaccagcggacaagcgggatccgaacatcagacgactcctctgaggaggatccatacatgaacgatacagttgtccctactagcccatcagctgactctacggtcctcttggcgcctagcgtgcaggactctggctccctgcacaattcgagctccggcgaatctacctactgtatgccacaaaatgcaggcgatctgccctcccccgacggtgactacgactacgatcaggacgactatgaggatggcgctattacttctgggtcttcagtaactttctccaacagctacgggtcacagtggtcccccgactacagatgtagcgtgggcacatataacagcagcggagcgtaccgattttcctccgagggcgcacagtcttcgttcgaagattctgaagaggatttcgactctcgcttcgatactgacgacgagctctcttatcgacgtgatagtgtctatagctgcgtgacccttccatatttccactctttcctttatatgaaagggggacttatgaactcatggaagcgccgatggtgcgtactgaaggacgaaacatttctttggtttaggtcaaaacaggaggctctgaagcagggatggctccataagaaaggaggcggttcctccaccctctctaggagaaactggaaaaagaggtggttcgttttgaggcagtcaaagctgatgtacttcgaaaacgacagcgaagagaaactcaaaggcaccgtcgaggtacgcactgcaaaggaaatcatcgataatacgacaaaagagaacggcatcgatatcattatggccgatcgaactttccacctgatcgccgaaagtccagaggacgcatcacaatggttctcagtactgagtcaagtccacgcctccaccgatcaggaaatccaggagatgcacgatgaacaagccaatccgcaaaacgctgttggaaccttggatgtcggcctaattgactccgtgtgtgcctctgacagccctgatagacccaattcatttgtgatcatcacggcgaatcgagtgcttcactgcaacgctgacactcctgaggagatgcatcactggattacactgctccagaggtccaaaggtgatacgcgggtagaggggcaagaattcattgtgagaggctggttgcacaaggaagtaaagaactccccaaagatgtcaagcttaaaactaaaaaagcgctggttcgtgcttacacataattctctggattactataagtcatcggagaaaaacgccttaaagctcggcacactggtattgaacagcctttgcagtgtggtgcccccagacgagaagattttcaaggagactgggtactggaatgtcacagtgtacgggaggaagcactgctaccggctatacaccaaactgctgaacgaggccacacgatggtcatccgctatccagaacgtcaccgacaccaaggctccaatcgatacccccacccagcagttgatccaggacatcaaggaaaattgcctgaactcagatgtggtcgagcagatttacaagcggaatcctatactgagatacactcaccaccctcttcattctcctcttctgcccctgccatatggggatattaacctgaacctgctcaaagacaaaggctacaccacgttgcaagacgaggcaattaagatcttcaattcgctgcagcagctcgaatctatgagtgacccaataccaatcattcagggcatcttacaaaccgggcacgatcttcggcctctccgggacgagctttactgtcaactcatcaaacagaccaataaggtaccacacccagggagcgtcggtaacctgtattcgtggcagatcttgacgtgcctgagttgtacgttcttgcctagccgcggtattctgaagtatctgaaattccatctgaagagaatccgggaacagttcccaggcagcgagatggagaagtatgccctctttacctatgagtccttaaagaaaaccaaatgtcgggagtttgtgccttcccgggatgaaatcgaggctctcattcataggcaggaaatgaccagtactgtgtattgccacggtgggggatcttgtaaaattactatcaacagccataccactgcgggagaggtggtcgagaaactcatacgaggactggccatggaggacagtagaaatatgttcgcgttgtttgagtacaacgggcacgtcgataaagccattgaaagcaggaccgtcgtagcagatgtgctggcaaaattcgagaaattagctgccacttccgaagtgggtgacctaccatggaaattttatttcaagctgtactgttttcttgacactgataacgttcccaaagacagcgtcgaattcgccttcatgttcgagcaggcccatgaggcagttattcatggtcaccatcctgctcctgaagagaatctgcaggtgttagctgcactcagattgcagtatttgcagggtgactacaccttgcacgccgctatccctcccctcgaagaagtttactctctgcaaagactgaaagctaggattagccagagcaccaaaacgttcaccccctgcgaacgccttgagaagcgacgcacctcctttctggagggaacactccgtcgaagctttaggaccggctccgttgtgaggcagaaggtggaggaagagcaaatgctggatatgtggatcaaagaagaagtttcctcagccagagcttctatcatcgataaatggcgcaaatttcagggcatgaatcaggaacaagccatggccaaatatatggccctaattaaagaatggccgggttacggctccactctattcgatgtcgaatgcaaggaaggaggtttcccgcaggaactgtggcttggagtgtccgccgatgccgtgagcgtttacaaacggggtgagggaaggcccctagaggtgtttcaatacgaacacatcctgtcttttggagccccactggccaacacatacaagattgtggtggacgagagagagcttctgtttgaaacttcggaagttgtggatgtcgcaaagctaatgaaggcatatatctcaatgatcgtgaagaagcgatacagtactacccgctccgcatcatctcaggggagctcacggta

SEQ ID NO: 231668 - DNA, 4194 bp, Artificial Sequence
  Description of Artificial Sequence: Synthetic coding sequence
atgctcgagacagtgaggatcaggaaagccggatacgctgttaggaggccgtttcaggacttctataagaggtacaaagtgctgatgcgcaacctggccctccccgaggacgtcaggggaaagtgcactagccttcttcaactgtacgatgcctctaatagcgagtggcagctcggcaagaccaaggtgtttctgcgcgaatcccttgagcagaagttggagaaaaggagagaagaggaggttagtcacgctgccatggtgataagggctcatgtgcttggttttttggccaggaaacaataccgcaaggtgctatattgcgttgtcataatccagaagaattatcgggctttcctgctccggagacggtttctgcacctgaagaaggctgctattgtgttccagaaacaacttcggggacagattgcccgtagagtctaccgccagcttctcgccgaaaagcgggaacaagaagaaaagaaaaaacaggaggaggaagaaaagaagaaaagggaggaggaagaaagggaaagggaacgtgagcgcagggaggcagaactgagggctcagcaagaagaagagactcgcaaacagcaagagttggaggctctccaaaagagtcagaaggaggctgaactaacccgggaattggaaaagcagaaagagaacaagcaggtggaagagatactgcgtctggaaaaggaaattgaagacttgcaacgaatgaaagagcagcaggagcttagtctgacagaggccagcctacagaaacttcaggagcgcagagatcaggagcttaggcgcctcgaagaggaagcctgtcgagcagctcaggagttcctcgagtcactgaatttcgatgagatcgacgaatgtgttcgaaacatcgaacgaagtctctccgtaggctccgaattttcatcggagcttgccgaatccgcatgtgaagagaaacctaatttcaatttctcacagccttatccagaggaagaggtcgacgaaggcttcgaagcagacgatgacgcctttaaggactcccccaacccctcggaacatggccactccgaccaacgcacatctggcatcagaacctctgatgatagttccgaagaagacccgtacatgaacgacaccgtcgtacccaccagcccttctgcagattccaccgtgctgttggctccgtcagtgcaggacagtgggtccctccacaacagctcatccggcgaaagcacctactgcatgccgcagaatgcgggagacttgcccagccccgacggtgactacgattacgatcaggacgactatgaagatggggctataactagcggcagttctgtaacattctccaactcctacggaagtcagtggtcccctgactaccgttgtagcgtggggacgtacaacagctcaggcgcttatcggttcagctcggagggggctcagtcttcttttgaggatagtgaggaagactttgacagtaggttcgatactgatgatgagctgagttaccgcagagatagtgtttactcttgtgtaactttgccttacttccattctttcctgtatatgaaggggggactaatgaattcgtggaaacgcaggtggtgcgttctcaaggacgagacattcctctggttcagaagtaagcaggaggccctgaagcagggctggcttcacaagaagggtggcggttcatcgacgttgtctcggagaaattggaaaaaacgttggttcgtcctgcgccagtctaaacttatgtacttcgaaaacgattcagaggagaagctcaagggaaccgtggaggtgaggacagcgaaggagatcatagacaataccacaaaggagaatggaatcgacattatcatggctgacaggaccttccacttaattgctgagtcacctgaggacgcatcccaatggttttctgtcctctcccaggtgcatgctagcacagaccaagaaatccaggagatgcacgacgaacaagcgaaccctcagaatgccgtaggcacactcgatgtgggactcatagattcggtctgcgcctcagatagtcccgatcgccctaacagctttgtcatcattaccgcaaacagggtgctgcattgtaacgcggatacccctgaagaaatgcatcactggattacactcctgcagcgtagcaagggggacacaagggtggagggtcaggagtttattgtaaggggttggttacacaaagaggtaaaaaatagtcccaaaatgtcttctctcaaactgaaaaagcggtggttcgtactgactcacaatagcctggattactacaaatctagcgaaaagaacgccctcaaattgggaacgctcgtcctgaattccctgtgcagcgtggtccctccagatgaaaaaatctttaaggagacggggtattggaatgtcaccgtctacggaagaaagcactgctacaggttatacacaaagttgctgaatgaagctacgaggtggtcttccgccatccagaatgtgacggatactaaagcccctattgatacaccaactcaacagctcatccaggatataaaagagaattgccttaactctgacgtggtcgagcaaatctacaagagaaaccctatcctgcgttatacacatcatccactgcactctcctctgcttccactgccatacggcgacatcaacctgaacctccttaaggacaaaggctacactaccttgcaggacgaggctattaagatattcaatagcctgcagcagcttgagagtatgagtgaccctattccaattatccagggcattctccagacagggcacgacctccgcccattgcgggatgagttgtattgtcaactgattaagcagactaacaaggtccctcacccgggtagcgtggggaacctgtatagctggcagatcctgacatgtttgagttgtacatttttgccatctagaggaatacttaagtacctgaagtttcatttaaaaaggattagagagcagttccccggttctgagatggagaagtatgccctattcacatatgaaagtcttaagaaaaccaaatgcagagaatttgtcccaagcagggatgagatagaagctctgattcaccgtcaggaaatgacctcaactgtttattgtcacggtggaggcagttgtaagattactatcaatagccacacaactgcgggagaggtcgtggaaaaactgattcggggtttggcaatggaggacagccggaacatgttcgccctattcgaatataatgggcacgtcgataaggccatcgagtcccggacggtagtagcggatgtcctggccaaatttgaaaaattggcggctactagtgaagtcggagatctcccttggaaattctactttaaattgtactgctttctggacaccgataatgtgcctaaagattccgtggaattcgcatttatgtttgagcaagcccatgaggctgtaatccacggtcaccatcccgctccagaagaaaatctgcaagttctggctgccctgcgactgcagtatcttcagggagactacaccctgcatgctgccattcctccactggaagaagtttattccctgcagaggctgaaagctcggattagccaatctacaaaaacattcacaccttgtgagaggcttgagaaaagacgcactagcttcctggagggaacgctccggaggagcttccgtactgggtccgtggtccgacagaaggtcgaggaggagcaaatgctggacatgtggatcaaggaagaagtgtcttccgcaagggcaagtataatagacaaatggagaaaatttcagggaatgaatcaggagcaggctatggctaaatatatggccctcatcaaggaatggcctgggtatggatccacattgtttgatgtcgagtgtaaggagggaggatttccccaggaactgtggctcggggtaagcgccgacgccgtaagcgtgtacaagcgtggtgagggccgacctttggaggtcttccaatacgaacatattctcagtttcggtgctcctctggctaacacctataaaatagtcgttgatgagcgggaactgttattcgaaacaagtgaagttgttgacgtggctaagctaatgaaggcgtatatttccatgattgtgaagaaacgttactctaccacacgaagcgctagtagtcagggcagctctaggtag

SEQ ID NO: 231669 - DNA, 552 bp, Artificial Sequence
  Description of Artificial Sequence: Synthetic coding sequence
atggagaacggagccgtgtactctcccaccaccgaagaagaccccggacctgccaggggtcccaggtctgggctcgctgcctacttttttatgggcagattgccacttctccgcagagtgctgaaaggacttcaactcttgctttctctgctggccttcatctgcgaagaggttgtttctcagtgcactttatgcggtggactttacttctttgagttcgttagttgcagtgcctttctcctgtccttgctaattttaattgtgtattgcacacccttttatgagagggtggacaccacaaaggttaaaagtagcgacttttacattaccttaggcacaggatgcgttttcctactggctagtattatttttgtttctacacatgaccggacctctgcggaaattgcagcaattgtgttcggcttcatcgcgtcctttatgttcttgttggactttatcactatgctgtatgaaaaacggcaagagagccagttgcgtaagccagaaaatacgactcgcgctgaggctcttactgaacccctaaacgcttag

SEQ ID NO: 231670 - DNA, 1437 bp, Artificial Sequence
  Description of Artificial Sequence: Synthetic coding sequence
atgctggaatttgcccagaagtattttagagatccccaacgacgcccacaggacgggctgcgcctgaaatctaaggagcctcgagagtcaagaacactggaagatatgctttgtttcacaaagacacccctccaggagtccctgatcgaactgtcagacagcagcctgtccaaaatggccaccgatatgttcttggcagtgatgaggttcatgggtgacgcacctctcaaagggcagtctgacttggatgtgctctgcaatctcctgaagctctgcggagaccatgaagtaatgcgggacgagtgctactgtcaggtagtcaagcagataacagacaacacatcatccaaacaggatagctgccagagaggttggcggcttctatacatagtcactgcttaccactcgtgcagcgaagtgttgcatcctcatctaacacgtttcttgcaggacgtgagtaggacacccggtctgccttttcagggcatcgccaaagcctgtgaacagaatctacagaaaacactgaggttcggcggacgccttgagctgccctcatccatcgaactcagggccatgctggcaggaagaagttccaagcggcagctatttctgctaccgggtgggttggagagacacctgaagatcaaaacctgcacagtggccctggatgtggtggaggaaatctgtgctgaaatggctctgaccagaccagaggctttcaatgagtacgtcattttcgtcgtcacaaataggggacaacatgtgtgtcccctcagccgtcgcgcttacatcctcgacgtggcctctgaaatggagcaggtggacgggggttacatgctctggtttagaagggtgttgtgggaccaacccttgaagttcgagaacgagttgtatgtgaccatgcactacaatcaagtcttgcctgattatctgaaagggctattttccagtgttcctgcatcccgaccttccgagcagctcctccagcaagtgagcaagctcgcctccctgcagcatcgggctaaggaccacttctacctaccgagtgtacgggaagtccaggaatatatccctgcacaattgtatcgcaccactgccggttccacctggcttaatcttgttagtcagcatcggcagcaaactcaggccctcagtccgcaccaggcacgggcacaatttctcggactattgtcagccctgccaatgttcggcagttcttttttctttatacagtcgtgctcaaatattgcagtgccagcaccttgcatcctggccattaaccacaacgggcttaattttctgtccacggagacgcacgtgtcaggcctctctctggcccttccgtcccccccatccgtcccttggtctcctactccgtccaaaaggccccgaccaccagccgctgaagcacagtttcattgcctccccccttcttag

SEQ ID NO: 231671 - DNA, 555 bp, Artificial Sequence
  Description of Artificial Sequence: Synthetic coding sequence
atgaatatgctgtcttcactgagtccgacagtagtgctacctgattaccttaaaggtctcttctcctccgtgcccgcatcccggccatctgagcagctgcttcagcaggtgtctaagttagcatccctgcaacaccgtgcgaaagatcacttctacctgccctctgtgcgtgaggtgcaagaatatattcccgcacagctctataggactacggccggatccacttggctcaacttagttagtcagcatcgccagcagacgcaagccctgtctcctcatcaggctcgcgctcagtttcttggactcctatccgctcttccgatgttcggctctagttttttctttattcaaagttgcagcaatatagccgttccagccccatgtattctggccatcaatcacaacggactgaacttcttgagtacagagactcacgtgagcggattgtcgctggccctcccctctcctcccagtgtcccatggtccccaaccccttccaagcgtccacggccacccgcagcagaagcccaatttcactgtttgccacctagctag

SEQ ID NO: 231672 - DNA, 735 bp, Artificial Sequence
  Description of Artificial Sequence: Synthetic coding sequence
atgagagatgagtgttactgccaggttgtgaaacagattacagacaacacatcatccaaacaggattcatgtcagcggggatggcgcctgctgtacattgttaccgcgtatcactcatgttccgaagttctgcatcctcatctgactcgctttctccaggacgtttccagaactcccggtctcccttttcagggcatagctaaagcctgcgaacagaatctgcaaaaaacccttcgctttggagggcgactggagctgccaagcagtatcgagctccgggctatgctcgctggtagatcttccaagcgacagttgtttcttcttccgggtgggttggagcgccatctcaaaatcaagacctgtaccgttgctcttgacgttgtagaagagatctgtgcagaaatggcactcacccgtcccgaagcctttaatgaatacgttatatttgtagtcacaaatcgcggtggcaagagcagatctacttctcagccctccagcaccgtacagaggcaggctagacccggatccacttggagtgccagcactggctctagacaccgcaggtccgcgcctactaggccagtaccatcattctgggcctcgtctgccccttatctctgctccgctcctccttccagttcaagtcgggcagcagcgaccttactgtgccagccccttgcctccttgccttcaactactatggcttcaactttttcagcacaaagactcatgtag

SEQ ID NO: 231673 - DNA, 429 bp, Artificial Sequence
  Description of Artificial Sequence: Synthetic coding sequence
atggtgaaaggcggtcaggaagcaggagggcagctgcgcgtcctgagggcttactccttcgcagacatactgttcgtcactatgccttcacaaaacatgcttgaattcaacctggccagcgaaaaagtgatacttttttctgcccgagcccaccaggtgaaaaccctggtcgatgactttatcctggagcttaagaaagacagtgattatgtggtagctgtcagaaatttcttacccgaagatcctgctctgttggcatttcataagggggatatcattcatctccagccattggaaccgcctcgggtcggatactcagctgggtgtgtggtgcgacgtaaggtggtatacctagaggaacttcggagacggggtccggattttggggtttgcccaaggacatggaatccaataaggggggcttcttag

SEQ ID NO: 231674 - DNA, 6164 bp, Artificial Sequence
  Description of Artificial Sequence: Synthetic coding sequence
atgttcaacctgatgaagaaggacaaggacaaagatggaggacgcaaggagaagaaggagaaaaaagagaaaaaggagcggatgagtgcagcagaactcaggtctctggaagaaatgagtctgcggagaggtttcttcaatctgaacaggagtagcaagcgggagtcgaagactcgactcgaaatcagtaacccaataccaattaaagttgcttctgggagcgatctccacctgaccgatattgacagcgacagtaacaggggatccgtgattctggactccggacatctgtcaactgcaagttcctccgacgacttgaagggagaagaaggctcattccggggaagcgtgctccagcgggctgccaagtttggtagtctagcaaagcagaacagccagatgattgtgaaaagattctcgttctcacagaggtcgagagacgagtccgcatctgagacaagtactccttccgaacactcggcagcaccctcaccccaggtggaggttcgcactcttgaggggcagctggtccagcaccctgggccaggcattcccaggcctgggcatagaagccgggctcctgaactggtgacaaaaaagttccccgtcgacctgaggttgcccccagtcgtccccctgccaccgcctacgctgcgagagcttgagctgcaaaggaggcccacgggcgatttcggattcagccttaggcgaactactatgcttgaccgaggccctgagggccaggcctgccgccgagtggtgcacttcgccgagcccggtgcaggtaccaaggatttggcgctaggactggttccaggggaccggctcgtggagattaatggacataatgtagaatcgaagagcagggatgagatcgtcgaaatgataagacagtcgggtgactctgtgcgactcaaagtgcaaccaattcctgagctctccgagctgtcccgcagctggctgcgctctggcgaaggtcctcggcgagaaccatcagacgccaaaacagaggagcagattgccgcagaagaggcttggaacgagacagagaaagtatggcttgtccatagagatggcttctcacttgccagtcagctcaaaagtgaggagctgaacctccctgagggaaaagtgcgagtcaagctggatcatgacggtgctattctcgatgtggatgaggatgatgtagagaaggcgaatgccccatcctgtgatagattggaggaccttgcatctctcgtgtatctcaacgaaagttcggtgctgcacacgctaagacagcggtacggcgcatctttgcttcatacctacgccggaccctctctgctggttctgggtccgaggggtgccccagccgtgtattctgaaaaagtgatgcacatgttcaaggggtgtcggcgagaagacatggccccacacatctacgcagtggcccagacggcgtatcgggctatgcttatgtctcggcaggatcagtccatcatcctgctgggctcctccggcagcggaaagaccacctcatgccagcatcttgtccagtacctcgcgaccatagccggaatttctggcaacaaggttttctccgtggagaagtggcaagctttgtacaccttgttagaagcttttggcaattccccaactattataaacggcaacgctacccggttttcgcaaatattatccttggattttgaccaggcgggacaagttgcaagcgcctctatccagacaatgttgttggagaagctgagggtcgctagacgtcctgcttccgaagcaacattcaatgttttttattaccttctggcctgcggggacgggaccctcagaaccgagctgcacctgaatcacttggctgagaacaacgtgttcggtatcgttcccctagcaaagccagaagaaaaacagaaggcagcacagcagttcagtaaactgcaagcagccatgaaggtgctgggtatatccccggacgagcaaaaggcatgctggttcatcttggccgctatctatcacctcggggcagccggtgcgaccaaagtccactctactgcgggtcggaaacagtttgcgaggcatgagtgggcccaaaaagccgcttacttactgggatgctccctggaagaattgtcctccgctatcttcaagcatcaacataaagggggaaccctgcagcgctccacctcatttagacagggacctgaagaaagtggcctgggtgacgggaccggtcctaagctcagcgcactcgaatgcctggagggaatggccgctggcctgtactccgagctgtttaccctgttggtgagcttggttaatagagcacttaaatccagtcaacactctttgtgctccatgatgatcgtcgacaccccagggttccaaaaccccgaacagggcggttcggcccgtggggcttcattcgaagaattgtgtcataattatacgcaggataggctgcagagattgttccatgaacgcacgttcgtgcaagagttggagagatacaaggaggaaaatattgaactggccttcgatgaccttgagccgccaaccgacgattcggtcgccgctgtcgatcaagcaagccatcaaagtctggttcgaagcctggcacgcacagacgaggcgagagggctcctctggttgctggaagaggaggccttggtgcccggtgcctcagaagatacgctgctagagcgccttttctcttactacggtcctcaagaaggggataaaaagggtcaatcaccacttctgcattcatctaagccgcaccactttttactaggccattcacacggcactaactgggtagaatataatgtaacgggctggttgaactacactaagcagaaccctgccactcagaacgctccaagattgctccaagactctcagaaaaagatcatctccaaccttttcttgggcagagcaggcagcgccacagtcttatcgggctctatagctgggctagaaggcggatcccagctggccctgcgtcgtgctacatcaatgcgcaaaacctttaccaccggcatggcagcagtcaaaaagaagtccctttgcattcagatgaagcttcaggtcgatgcactgatagatacgatcaagaaaagcaaactgcacttcgtgcattgttttctcccagtcgcagaaggctgggctggggagcccaggagcgcatcttcgagaagggtgtctagctcttcagaactggacctcccatcaggagaccattgcgaggccggactcctgcagctcgatgtgcctttgttgcgcacgcagctgcggggttccagacttctggacgcaatgagaatgtatagacaggggtacccagaccatatggtctttagcgagttcaggcgccgattcgacgttctggcgccacacctgacaaagaagcatggacgtaactacatcgtcgtagatgagaggagggccgtcgaggaactgctggaatgtctcgacttagagaagagttcctgttgcatggggctttcgcgggtatttttccgcgcaggaacactggcacgactggaggaacagcgggatgagcaaacgagcaggaatctaacgctcttccaggccgcttgtagaggatacttggcccgacaacattttaaaaaacggaaaatccaagacctcgctatccgttgcgtacagaagaacatcaaaaagaacaagggtgttaaggattggccctggtggaagctttttaccactgtgcggcctctgattgaggtccagctgagcgaggagcagataaggaacaaagatgaggagattcagcaactgcgcagcaaacttgaaaaagcagaaaaagagcgaaacgagctgaggttgaattctgaccgcctcgaaagtagaatcagcgaactaacgtctgaactgacagacgagcgcaataccggggaatctgcttcccagctgctggacgccgaaaccgctgagcgcctgcgtgccgaaaaggagatgaaggaactccagacccaatatgatgcactgaagaagcaaatggaagtcatggaaatggaggttatggaggcccgattaataagggccgctgaaattaatggagaagtagatgacgatgatgcagggggagagtggcgcctaaaatacgaaagagctgtcagagaggttgattttactaaaaaacgtctccagcaggagtttgaggacaagctggaagtggaacagcagaataaaagacagctggagcgccgtttgggcgatttgcaggccgactcagaggagtctcagcgggctctgcagcagctgaagaagaagtgtcagcgactgacagctgagctgcaggacacaaagctgcatttggagggccagcaagtacggaatcatgagcttgagaagaaacagcggagatttgatagtgagctttcccaggcccatgaggaagcgcaacgagagaagttgcagagagagaaactgcagcgagagaaagatatgctgttggcggaagccttcagcctcaaacaacagctagaggaaaaagacatggatatagcaggatttacccagaaggttgtatctttagaagcggagctgcaggacataagttcccaagagtctaaagacgaagccagcctggctaaagttaagaaacaactaagagatctggaggccaaagttaaggatcaggaagaggaactcgacgagcaagcaggtacgattcagatgctggagcaggccaaattgcgcctggaaatggaaatggagagaatgcgccagacacactcgaaggagatggaatcacgggatgaagaagtggaggaagccaggcagtcctgtcagaaaaaattaaagcaaatggaggtgcagttggaggaggagtacgaagacaaacagaaagttttgcgagagaaacgagaacttgagggcaaactcgctaccctctccgaccaggtcaatagacgcgatttcgaatctgaaaaaagactgaggaaggatcttaaaaggaccaaggcactcttggcggacgcccagctgatgctggaccacctcaaaaactcagcccctagcaagagagagatcgctcagttgaaaaatcagctggaggaatccgagttcacctgcgcagcagctgtcaaagccagaaaggcgatggaggttgagatagaggacctgcatctgcagatcgacgatatcgccaaggccaagaccgctctcgaggaacagctaagccggctacagcgggagaaaaacgaaatacaaaaccggctcgaagaggaccaggaagacatgaacgaactaatgaaaaaacacaaagcagccgttgcacaggccagtcgcgatcttgcacagattaacgatctgcaggcccagctcgaagaagcgaacaaagagaagcaggaactccaggagaagctgcaggcactgcagtcacaggtcgagtttctggagcaatccatggtcgataaatctctggtcagtcggcaagaggcaaaaatcagggagctggaaacgcggctggagtttgagcgtacacaagtcaagcgcttggagtcattggcgtctcgcctcaaggaaaacatggagaaattaacggaggagagagatcagcgtatcgctgccgagaaccgggagaaagagcagaataagcggctacagcgacagctgcgcgacacaaaagaggagatgggtgaattagcgaggaaagaggccgaggcctcaagaaagaagcatgaattggaaatggacctggaatcactggaagcggctaatcaaagcctgcaggccgacctgaaactagcctttaagcgcattggcgacctccaggccgcaattgaagatgagatggaatccgatgagaacgaagacttaattaattccctccaagatatggtgaccaaataccagaagagaaaaaataagctcgagggtgattccgatgtggactctgagctggaggaccgcgtggacggggtgaaatcatggctttcaaagaataaaggcccttccaaagctgcttctgatgacggtagcttgaaatcgtctagccccaccagctactggaagtctctcgcccctgataggtcagatgatgagcacgacccgttagacaatacctccaggccacgttattcccactcttacctgtcagattccgatacagaggcaaagctaaccgagaccaatgcata

SEQ ID NO: 231675 - DNA, 6008 bp, Artificial Sequence
  Description of Artificial Sequence: Synthetic coding sequence
atgtttaacctcatgaaaaaggacaaagataaggatggcggaagaaaagagaaaaaggaaaaaaaagaaaaaaaagagagaatgagcgccgctgagttgcggtcgttggaagaaatgtccctccggagaggatttttcaatctgaacagatcctcgaaaagggagtccaaaacgcgcctggagatctccaaccctatcccaattaaggttgcctccggctctgatttgcacctcactgatatcgactcagacagtaaccggggaagcgtgatcctcgattccggtcatctctctaccgccagttcgagcgacgatctcaaaggggaggagggcagtttcagaggctccgttctgcagcgcgctgcgaaattcggttctctggctaaacagaattcacaaatgatagtgaagcgcttttctttttcccagcggagcagagacgaatccgcaagtgaaacaagtaccccctctgagcactctgccgctccgtccccacaggtggaagttcgaacgctcgagggccaattagtgcagcatccaggcccaggaatacccaggccgggacaccggtctagggcacctgagctcgttacaaagaagtttccggttgacttgagacttccccctgtggttcctcttccaccgcctaccctgcgtgaacttgagctacagagacggccaactggtgactttggatttagccttcggaggacgacaatgctcgataggggtcccgaaggtcaggcatgtcgaagagtcgttcattttgccgagcccggtgctggtacgaaggacctcgcactcggattggtgcctggcgaccggctcgtagagatcaatggacacaacgttgaaagcaaaagtcgggatgaaattgtggagatgatccgacaatcaggcgatagcgtgaggctgaaggtgcaacccattcccgaactgtccgagttatcaagatcttggctccgctcaggagagggtcctcggagggaaccgtccgacgctaagacagaagagcagatcgcagccgaggaagcctggaatgaaactgaaaaggtgtggctggtgcaccgcgacggcttcagtcttgccagccagctgaaatccgaggagctcaaccttcctgaaggcaaagtaagagttaaactggatcacgatggggcaatcctggatgtagacgaagacgacgtcgagaaagccaacgcaccttcttgcgataggttagaagacctcgcatcactagtgtacctgaacgaatcaagtgtgctgcacacattgcggcagcgatacggcgcatcgctgctccatacgtacgcgggtcccagcttgcttgtgttgggaccacggggagcacctgccgtgtactcagaaaaggtgatgcacatgtttaagggttgtcgccgagaggatatggcgccacacatatacgctgtggcacagaccgcatatagggccatgcttatgtcaaggcaagatcagtcaataatcctgctgggctctagtggctcggggaagactacctcatgccagcatttagttcagtatctggccacgatcgccggaatcagcggaaacaaggtgttctccgtggagaaatggcaggcactctacaccctcctggaagccttcggcaattcgcctactattatcaacgggaatgccaccaggtttagccaaattctttcactagacttcgatcaggccggacaggtggcatctgcatccatacagaccatgctgctggagaagctgagggtggctcggcgacctgctagtgaggccacgtttaacgtattctactacctgcttgcctgcggcgacggtaccctgcgaaccgagctccacctaaatcatttggcagagaacaacgtctttggtatcgtgccgcttgctaagccagaagagaagcagaaggcggctcaacaatttagcaaactgcaggccgctatgaaggtcctggggataagcccagacgagcaaaaggcctgctggtttattctggccgcaatctaccacctgggagcagctggcgctactaaggtgcatagcacagcagggaggaaacagttcgccagacatgagtgggcacaaaaggctgcctacctgttgggttgctctctcgaggagctcagctccgctatctttaaacatcagcacaagggaggcaccctgcagcgcagtacgtccttccgtcagggacctgaggagtctggacttggcgacggcaccggtccaaaactctcagcacttgaatgtctggaaggcatggccgctggtctgtactcagagctcttcacgcttctggtgtctttggttaaccgagccttgaagtcttcacagcattcactttgctctatgatgattgtagatacacccggattccagaacccggagcagggcggttcagccaggggggcttccttcgaagagctgtgtcacaattatacgcaggatagactacagcgcttgtttcacgagaggacattcgttcaggagcttgagaggtacaaggaggaaaatatcgagcttgcctttgatgacttggagccaccgactgatgatagtgtggcagctgtggatcaggcctcacaccagagcctcgtacgatctttagcacggactgatgaagctaggggcctactgtggctcctagaggaagaagctcttgtgccaggcgcatccgaggacaccctgcttgagcgtcttttctcttactacggtccccaggaaggcgataagaaaggacagtccccattgctccattcttcaaaaccccaccactttctgctcggtcattcacacggcaccaattgggtggagtacaatgtgaccggctggttaaactatacgaagcagaaccccgcaactcaaaatgcaccacgtcttctgcaggacagccagaagaagatcatctctaacttgttcctgggaagagcaggatcagcaacagtgctatctgggagcatcgccggactcgagggaggctcccaactggcgctccgtagggctaccagtatgaggaagacctttacgactggcatggccgcagtgaaaaaaaagtcactgtgcatccagatgaagctgcaggtggatgccctgattgacacaatcaagaaaagcaaactccatttcgtgcattgctttctcccggtggcggaggggtgggctggcgaaccacgcagcgctagttcccgtcgtgtgtctagctccagcgaactggacctgcccagcggggaccattgtgaagcgggactactgcagttggacgtgcccctgctgagaacacaacttcgagggagccgcctgttggacgcaatgaggatgtatcgacagggttaccctgatcatatggtcttctcggaattcaggcggaggtttgatgtgctggcaccacatctcacaaagaagcatggacgaaattacatagtggttgacgaaaggagggccgtcgaggaattactcgaatgcctggatctggaaaagagctcttgttgcatggggctcagcagagtgttctttcgcgcaggcacgctggctaggctagaggagcagagggacgagcaaaccagtcggaacctcaccttgtttcaggccgcttgccgaggctacctggcaagacagcatttcaaaaagagaaagattcaggatctcgccattcggtgcgtgcagaagaatatcaagaaaaacaaaggcgtgaaagactggccctggtggaagttattcacgaccgtgagaccacttatcgaggtccaactgtctgaagagcagatccggaacaaggatgaggagattcagcagctgaggagcaaactggagaaggctgagaaggaacgcaatgagctccggctgaattcagaccgcctggagtctcggatcagtgagctgacaagcgaattaacagatgaacggaacacaggcgaatccgccagtcagctcctggatgctgaaaccgcagagagactgagagctgaaaaagagatgaaagaattgcagacccagtacgatgccctaaagaagcagatggaagtgatggaaatggaggtaatggaggcacggctgatccgagctgccgaaattaacggtgaggtagatgacgacgacgctggaggcgagtggcgactgaagtatgaacgggctgtgcgggaagtggatttcacaaaaaagcggctccagcaagaattcgaggataaactcgaggttgagcagcaaaacaaacgacaactagaaagaagactcggtgacctccaagccgacagcgaagagtcacagagagcccttcaacaattgaagaagaagtgccaacgattaactgctgagctccaggacaccaagctccatttagaaggccagcaggtccgtaaccacgagcttgagaagaagcaacgacgctttgattctgagctttcccaggcccacgaagaggcccaacgcgagaagctgcagagagaaaaactccagagagaaaaagacatgctgctggccgaggcgttctctctgaaacagcagcttgaagaaaaggatatggatattgccggtttcactcagaaagtcgtgtccctggaggctgaactgcaggacatttcctcgcaggagagcaaagatgaggcttcactggccaaggtcaaaaagcagcttcgggaccttgaggcaaaagtgaaggatcaggaggaggagctggacgagcaggctggcactattcagatgctcgagcagttgaagcagatggaggtgcagctggaggaggaatatgaggataagcagaaggtcctgcgcgaaaaacgagaactggagggcaaactagctactttatctgaccaggtgaacaggcgtgatttcgagtccgagaaaaggttaagaaaggatttgaaaagaacaaaggccttgctggccgacgctcagctgatgctggaccacttgaaaaattctgctccatctaagcgagaaattgcacaactgaaaaatcagcttgaggagagcgaatttacttgtgctgcagctgtcaaagcgagaaaagcaatggaggtggagatcgaagacctgcatctgcaaatagacgacattgctaaggctaaaactgccctcgaagagcagttaagtagactccagcgcgagaaaaacgagatccaaaaccggcttgaagaggatcaagaagacatgaacgaattgatgaaaaaacataaagccgctgtcgcacaagccagcagggacctggcccagattaatgatctgcaggcccagcttgaggaggctaacaaagaaaagcaggaactccaggaaaaactgcaggccctgcagagccaggtggagttcttggagcaaagtatggttgataagtctctcgtgtcccgtcaagaagccaagatccgagagcttgagaccagattagaatttgaacgtacacaggtgaagcgcctggaatccctcgccagccggctgaaggaaaatatggaaaagctcacagaagagcgcgatcagcgcattgctgccgaaaatagagagaaggaacagaataagcgactgcagcgccaactgcgcgatacgaaagaagaaatgggcgagttagcaaggaaggaggctgaagcaagccgaaagaaacacgagttggagatggatctggagagcctggaagccgctaatcagagcttgcaggctgatctgaaactcgcgttcaagagaatcggagatctgcaggccgcaatagaagatgaaatggaaagcgatgagaacgaggatttaatcaatagcgagggggactccgacgttgactccgaactggaggatcgtgtcgatggggtcaaaagctggctcagcaagaataaaggacccagcaaggcagcctctgacgacggtagcttgaagtcttcgagccccacatcgtactggaaatctttagcgcctgatcggtcagatgatgaacacgaccctctggacaacaccagcagacccaggtattcacatagctatctgtctgactccgacacagaagccaagctgacagagacgaacgccta

SEQ ID NO: 231676 - DNA, 4929 bp, Artificial Sequence
  Description of Artificial Sequence: Synthetic coding sequence
atggaggggcctagaacaacaaagttggaggggtcaagcaaagagggcagcggtccgagtcgttcacctcaacctccaacatcacccatccctcccgagacaagccagcgagccagaagtcctgctccgacacttgccatgaacggacctggggctgcaactgccgagggtttgagcgaagaggcacccgctgtctactcggaaaaagttatgcatatgttcaaggggtgcagacgagaagacatggcccctcacatttacgcagttgcgcagaccgcctaccgggcaatgctgatgagtagacaggaccagtcgatcattttgcttggcagctctggtagcggcaagacaacctcctgccagcatcttgttcagtacctggccacaatagctggcattagcggcaataaggtcttcagcgtcgagaaatggcaagcactttacaccctactggaggcattcgggaactctcccactatcattaacggaaatgccactcgtttctctcagatcctctctctggattttgaccaggctggccaggtcgctagtgcatctatacagactatgctgttggaaaagctgagggtggcccgaaggcccgctagcgaggccaccttcaatgtgttttattacttactcgcatgtggtgatggcacgcttcgcactgaactccatctaaatcatctggccgagaataatgtgtttggaattgtgcccctggcaaaaccggaggaaaagcagaaggctgctcagcagtttagcaagcttcaggctgccatgaaggtgctaggcatctcaccggatgagcaaaaggcatgctggtttattctggcagccatttaccatctcggcgcagcaggggcaacaaaggaagccgcagaggccggacggaaacagttcgccaggcatgagtgggcgcagaaggccgcatatttactgggttgtagccttgaggaactatcttccgccattttcaaacaccaacacaaaggcggtacactccagaggagcaccagcttccggcaaggccctgaagagagtggcctcggcgatggaacagggcctaaattaagcgcgctggaatgcctggagggtatggctgcaggcctgtactctgagctattcaccctgctcgttagcctagtcaatcgggcattgaaaagcagtcagcatagcctgtgctccatgatgatagttgatacgccaggttttcaaaacccagagcagggtggcagtgcacgtggcgctagtttcgaggagctgtgtcacaactacacgcaggatcgactacagagactttttcatgaacgtacctttgtccaagaactggaacggtataaggaagaaaacatcgaactcgctttcgatgatctggagccacccacagatgatagtgttgcagccgtagatcaggccagccatcagtctcttgtgcgctcccttgctcggactgatgaagccagaggtctgctgtggttgctcgaagaggaggccttggtgcccggagctagcgaggacaccttacttgagcgcctgttcagctattatggaccacaggagggagataaaaaggggcagagtcctctcctgcactcttcaaaaccacaccactttttgctgggtcactcccatggcaccaactgggtcgagtacaatgtcaccggatggttgaattacactaagcagaatccagcaacccagaacgccccacgcctgcttcaggacagccagaagaagatcatctcgaatttattcctaggacgggctgggtctgccactgtcctgtcaggatccattgcgggtctggagggcggaagtcagctggcactcaggcgggctacgagcatgagaaaaacattcacaaccggcatggcggcagtgaaaaaaaaatccctgtgcattcaaatgaagctccaggtcgacgctttaatcgacaccataaagaagtcaaagctgcactttgtgcactgttttctgcctgttgccgagggatgggcgggtgaacctaggtcagcttcctcaaggagggtcagttccagcagtgagttggatcttccatcaggtgaccactgtgaagcaggcctgctccagcttgacgtgcccctgcttcggacacagctgcgcggaagcagattgttggacgccatgcgcatgtatcgtcaaggctaccctgaccatatggtgtttagcgaatttcgtagaaggtttgatgtgctggcacctcatctgaccaagaaacacggtagaaattacatcgtagtagacgaacggagggccgtcgaggaactgcttgagtgtctggacctggagaagagctcctgctgcatggggttgtcccgcgtgttttttcgtgccggaacactcgcaaggctggaggaacagagggatgaacagaccagtcgaaatctgaccctatttcaggctgcttgtcgcggatatctcgctagacagcacttcaaaaagcgcaaaatccaggacctggccatccgttgtgtccagaaaaatataaaaaaaaataagggggtgaaagattggccatggtggaagctgttcacaaccgtccgacccctgattgaagttcagctgtccgaagagcaaattcgcaacaaggacgaagaaatccagcaactgcggagtaaactggaaaaagctgagaaagagaggaacgagttacggctgaattctgaccggctcgagtctcgcatctcagagctaacatctgaactgaccgatgagcggaacacaggggaatctgcctcacagctgctggatgcagaaaccgctgagcggctgcgggcagagaaagagatgaaagagctgcagacacagtacgacgcactgaagaaacaaatggaggtgatggagatggaagttatggaagccagacttatccgagcagccgaaatcaacggtgaagtcgatgacgacgatgcaggcggagaatggcgcctcaagtatgagagagctgtgagggaggtagactttaccaaaaagcggctgcagcaggagtttgaggacaagctcgaggtggagcaacagaacaaacggcaactggagcgacgattgggcgatttgcaggcagattcagaggagagccagagagctctgcagcaactaaagaaaaaatgtcagcgactaacggccgagctgcaagacacaaagctgcacctggaagggcagcaggtgagaaaccatgagctggagaagaagcagcgcaggtttgacagcgagctcagtcaggcccatgaggaagcccagcgggagaagctgcagagggagaaactgcagcgagaaaaggatatgcttctcgctgaggccttttctctcaagcagcagttagaggagaaggacatggacatcgccggtttcacccagaaggtcgtttccctcgaggcggaactacaagacatttcgtcccaagagtccaaggatgaggcatcgctggccaaagttaaaaagcagctgagagatctggaagctaaggtgaaggatcaggaggaagaattggacgagcaagccaaactgaggttagagatggaaatggagcgtatgcggcagacgcactccaaggagatggagtctcgcgatgaagaagttgaagaagcccgacagtcttgtcagaaaaaactcaaacaaatggaagtgcaactggaagaggagtatgaggacaaacagaaagtgctccgcgaaaaacgtgaactcgagggaaaactggccacactcagcgaccaagtcaatcgtagagattttgagtctgaaaagcgccttaggaaggatcttaaacgtacaaaggctctgctggctgatgctcagttaatgttggatcacctgaaaaattctgcccctagcaaacgggagatagcccagctgaagaatcagttggaagaaagcgaatttacctgcgcggctgccgttaaggctcggaaagctatggaagtcgagatcgaggacttacacctacaaatagacgacattgccaaagcaaagaccgctctggaagaacagctgtcaagattgcagagggagaagaatgagattcaaaaccgccttgaagaggaccaagaggatatgaacgagctgatgaaaaaacacaaggccgctgtggcgcaggcctcccgggatctcgcacaaataaatgatctacaggcacaactggaggaggccaataaagagaagcaggagttgcaggagaaactgcaagcactgcagtctcaggtcgagtttctggaacaaagtatggtcgataagtccctcgtgtccagacaggaagcgaagatccgggagctggaaactagactagagttcgaaagaacccaggtgaaacgactagagtccttagcatcgcgactgaaggagaatatggagaaactgaccgaagagcgggaccagcgaatcgccgctgagaaccgtgagaaggagcagaacaaacgacttcagcgccagctacgtgatactaaggaggagatgggtgaacttgcccgtaaagaggcagaagcaagtcggaaaaaacatgagctggaaatggatctggaatctctggaggcggcaaatcagtccctacaggccgatctgaagctcgcatttaaacggatcggggatcttcaggcagcgatagaggatgagatggaaagcgacgagaatgaagatcttattaattctgaaggagactctgacgtcgacagcgagttggaagaccgggtggacggggtgaagtcttggctttcgaaaaataagggaccctctaaggctgcgagcgatgacggttcacttaagtcttcaagtccaaccagctattggaaatccctagctcctgatcgctctgatgatgagcacgacccattggacaacacatctcggcctcggtacagccatagttatctgtcagattccgatacagaggcaaaactcacggagacgaacgcttag

SEQ ID NO: 231677 - DNA, 6164 bp, Artificial Sequence
  Description of Artificial Sequence: Synthetic coding sequence
atgttcaacctcatgaagaaggataaagataaggatggaggacggaaggagaagaaagagaaaaaggagaagaaggagcgtatgtctgccgcagaattgaggtcactcgaagagatgtcactaagaagggggtttttcaacctgaatcggtcttctaagcgcgagtctaagaccagacttgaaatatctaaccctatccctattaaagtggccagtgggtcggatcttcatctcaccgatatcgattccgatagtaatcggggtagcgtcatacttgactctggccatctttcgaccgcaagttcttctgacgacctgaaaggagaagagggatcctttagaggttcagtcctgcagagggccgctaagttcggctctctcgccaaacagaacagccagatgatcgtcaaacgtttttcattcagccaaaggtctcgagacgagtcagcatccgagactagtaccccatctgaacactcagctgctccttctccacaagttgaggtaagaaccttggagggtcagctggtgcagcatcctggaccaggaatccccagacctggacatcgttcccgggctccagaacttgtcacgaaaaaattccctgtggatcttcggctgccacccgtggtgcctctgccccctcccaccctgcgggaactggagctgcagagacgcccaacgggagactttggtttcagcctgcgtcgtacaactatgctggaccgaggcccagagggacaggcctgtagaagagtggtccacttcgctgaacccggagcagggacgaaggatctcgcactgggactggtgcctggcgaccgtctggtggagatcaatgggcacaatgtcgaatctaagtctcgcgatgaaattgtagaaatgatccgtcagagcggcgactccgtacgccttaaggttcagccgatccccgaactttctgaactgtctcgttcctggctgaggagcggcgagggaccaaggcgggagccgtccgacgccaaaaccgaagagcagattgccgctgaagaagcttggaatgagaccgagaaagtatggctggtccaccgggacggcttcagcctggcttcccagctcaaaagtgaggagctgaacctgcccgagggcaaggtcagagtgaaactggatcacgacggcgcaattctggacgtcgatgaagacgatgtggaaaaagcgaacgctccatcgtgtgatagactggaggacctggccagcttagtgtacctaaacgagagctctgtgctgcataccctccgccaacgctatggggcaagtctgctgcacacttatgctgggccaagcctgctggtgttaggtccaaggggggcacccgctgtgtatagtgaaaaagtgatgcacatgttcaagggttgccggagggaggacatggctccgcatatttacgccgtggcccagactgcatatcgagccatgctgatgtcacgtcaggaccagagcattatcctccttggatcctcaggctcaggcaaaactacaagctgtcagcatttagtgcaatacctggccaccattgctggcatctcaggcaacaaggtgttttccgtagaaaagtggcaagctctgtacactctgctagaggctttcggtaatagtccaaccattataaatggtaacgcgacccgcttttctcagattcttagtttggattttgaccaggccggacaggtggcgtccgcctccatccagacgatgttactggagaaattgcgtgtcgctcggaggcctgcatccgaggccactttcaatgtcttttattacctcctggcctgcggcgatggaaccctacggacagagctacacctgaaccatttagccgaaaacaatgtctttggcattgtgcccttggctaagccagaggaaaagcagaaggcagctcaacagtttagtaaactgcaagctgccatgaaagtactcggaatcagccccgacgagcagaaggcatgctggtttatcctcgcggcaatttaccatttgggcgctgcgggagccactaaggaggcagctgaggccggaaggaaacaatttgctcggcatgagtgggcacagaaggcagcctacttactcggttgcagcctggaagaactctcctctgctatttttaaacatcagcacaaaggcggaacgctacagaggtcgacttcctttcggcagggtcctgaggagagcggactgggggacggaaccggcccaaagctaagcgctctcgagtgccttgagggtatggctgccggtctctattccgaactgttcaccctgcttgtaagcttggtcaatcgtgccctcaaaagctcacagcacagcctttgttccatgatgatagtggacacacccggtttccagaaccccgagcagggtggctccgctagaggtgcgagttttgaggagctgtgccacaattatacacaagatcgcctgcagcgcctctttcacgaaagaaccttcgtacaggaattggagagatataaagaggagaatattgaactcgctttcgacgacctggaacctccaaccgatgacagcgttgccgctgtggatcaggctagccaccagagcctcgtgagaagtctggccaggaccgatgaagcaagaggtctgctctggctcctggaagaggaagctcttgtaccgggtgccagtgaggacactctgctggagcgtcttttttcttactacggacctcaggagggggataagaaggggcagtccccattattacacagctccaagcctcatcactttcttttgggccactcccatggtaccaattgggtcgagtacaatgttaccgggtggctaaactatacaaagcagaatccggctactcagaacgcccctagactgctccaggacagccagaaaaagattataagtaacctatttttgggtcgggctggttcggccaccgtgctgtcgggtagtatcgcaggcttggagggcggatctcagttagccctgcggagagcgaccagtatgcggaaaaccttcacaactgggatggctgccgtgaaaaagaaatccctgtgcatccagatgaagcttcaggtcgacgccctgatagacactataaagaagtcaaagctgcactttgtgcactgcttcttgcccgtggccgagggatgggccggagagccacgcagtgcctcttcacgccgtgttagctctagttctgaactggacctaccttctggggaccactgtgaggctggtcttttgcagctggatgttccactgttgcggactcagttgcgagggagtcgcctgctagacgctatgaggatgtaccggcagggctaccctgaccatatggtgttcagtgaatttagaaggaggttcgatgtgctcgctcctcacctgactaagaagcacggcaggaactatattgtggtagatgaaagaagggctgtggaggagctgctcgaatgcctagacctcgagaaaagctcatgttgtatgggactcagtagagtgttcttccgggctggtacactcgcgagactggaggagcagcgagatgagcagaccagccggaacctgacgttatttcaggcagcatgccgcggatatctggccagacagcattttaaaaaacgaaagatccaagacctcgcaattagatgtgtgcagaagaacataaagaaaaacaaaggtgtcaaagactggccgtggtggaagctcttcaccactgtgcgcccactcatcgaggtccagttaagcgaagagcagatccgaaataaagacgaggagatccagcagctcaggagcaaattagagaaggcggagaaggagcgcaacgagctacggctgaactctgatagactcgaatcgaggattagcgagttgacgtctgagctaaccgacgagagaaatacaggcgagagtgcatcccaattacttgacgcagaaacagctgaacggctgcgggctgaaaaagaaatgaaggagcttcagactcagtacgacgccctgaagaaacagatggaggttatggagatggaggtcatggaagcaagactgattagggctgccgaaatcaatggagaggtggacgatgacgatgcgggtggggaatggaggctaaagtacgagcgtgccgtgagagaagtcgatttcaccaaaaaacggctgcagcaggaattcgaggacaaactggaagtcgagcagcagaacaagcggcagctggaacgcaggctcggagatctccaggctgattccgaagaaagccaacgcgctttgcagcagctgaagaagaaatgccaaagactcacagccgagctgcaggacactaagctccacttggagggacagcaagtgcgcaaccacgagctagaaaaaaagcagcgacgctttgatagtgagttatctcaggctcatgaggaggctcaacgcgaaaagcttcagcgtgagaagctgcagcgggagaaggacatgctgctcgcggaagccttttctcttaaacagcagctggaggaaaaagacatggatattgctggcttcactcagaaagtcgtaagcctggaggcagaacttcaggacataagcagccaagaatccaaagacgaggcctccctggccaaagtgaaaaagcaactgcgagatctggaagccaaggtgaaagaccaagaagaagaacttgatgaacaagcaggtaccattcagatgctggagcaggcaaagttgcggctggagatggagatggagaggatgaggcagacgcatagcaaagaaatggagagccgggatgaagaggtcgaagaagctcgccaatcctgccagaagaaactaaaacagatggaggttcaactggaagaggagtacgaagataaacagaaggtactgagagagaagcgcgagctagaaggaaaacttgctactctgagcgatcaggtaaatcggagagactttgagagtgagaaacgccttcggaaagacttaaagcgcaccaaggcactgctggccgacgcccagctgatgttggatcacctgaagaattctgccccatctaaacgcgagatcgcacaactgaagaatcagctggaggagtctgagttcacttgtgctgcagccgtgaaggccagaaaggcaatggaagtggagatcgaggacctgcacttgcagattgacgacattgcaaaggcaaaaaccgccttggaagagcagctaagtcggctccagagggaaaagaacgagatccagaatagactggaggaagatcaagaagatatgaacgagttaatgaagaagcacaaggccgcagtcgcccaggctagccgcgatctggcccaaattaatgatctgcaggcgcagctggaagaagccaataaagagaagcaggagctgcaggaaaagcttcaagcccttcagtcccaggttgagttcctggagcaaagcatggtggacaaaagcctagtcagccgtcaggaggctaagatccgggaactcgagacacgccttgagtttgagcgcacccaggtgaaacgtttagagtccctggcgtcacgactgaaggaaaacatggaaaagctgacagaggagcgggatcagaggattgctgcggagaatcgcgaaaaggagcaaaacaaacgtctgcagcgccagcttagggatacaaaggaagaaatgggcgagcttgcaagaaaggaggctgaagcttctcgcaagaagcatgagttagagatggacctcgagagcttagaagcagcaaaccaaagcctgcaggcagacctgaaactagccttcaagcgaattggcgatttgcaggctgcaatcgaagacgaaatggaaagcgacgaaaacgaagatttgatcaattcattacaagacatggtgaccaaataccagaagagaaagaacaagctggagggtgatagcgacgttgactcagagctggaggatcgcgtagatggcgtgaaaagttggttgtcaaaaaataagggcccaagtaaggcagcctctgacgatggcagcctgaagtcgtcctcccctacatcctactggaaatccctggccccagacagaagcgacgatgagcatgatcctctggataataccagcaggccccgatattcacactcatatctgagtgattccgatacagaggccaagctgacagaaacaaacgccta

SEQ ID NO: 231678 - DNA, 2808 bp, Artificial Sequence
  Description of Artificial Sequence: Synthetic coding sequence
atgaggatgtatagacaagggtacccggaccacatggtgtttagtgagttccgacgaaggttcgatgtcttagcacctcatcttaccaagaagcatgggaggaattacatcgtcgtggacgagcgcagggctgtggaagaactgctggagtgcctggatcttgaaaagtcctcttgttgcatgggcctgtcacgagtgttcttcagagctggtacactggcacgtctagaggagcagcgggatgagcagacatctagaaacctgacacttttccaagcggcttgtcggggttacctggcacgacaacacttcaagaagaggaagatccaagacctggcaatcagatgtgtgcaaaaaaatattaagaagaacaaaggggtcaaggattggccctggtggaagctgtttaccactgttaggcccctgattgaggttcagctgagcgaagaacagatacgcaacaaggatgaagaaatccagcaacttagaagcaagctggagaaggcagagaaagaacgcaacgagctccgattgaactcagacagacttgaaagcaggatctccgaactcacaagcgagctgacagatgagagaaacaccggtgagtcagcgtctcagctcctggatgccgagactgcagagcgtcttcgcgcagagaaggagatgaaagaacttcagacacaatatgacgctcttaagaaacagatggaagtcatggaaatggaagtcatggaggctagactcattcgggctgcagagatcaacggcgaggtggatgatgacgacgctggcggtgagtggcggttaaagtacgaaagagccgtgcgggaggtcgactttacgaagaaacgactgcagcaggagttcgaggacaagttggaagtggagcagcagaataagagacaactggagcgaaggctgggggacctgcaagctgactccgaggaatcccagcgggcactgcaacagctgaaaaaaaagtgtcagcggctgacagctgagctccaggacaccaagctccatctcgaaggccagcaggtgagaaaccacgagttggagaagaagcagcgtcgcttcgacagcgagttatctcaggcccatgaggaggcacagcgtgagaaactgcagagggagaagcttcagcgagagaaggacatgttgctagcggaagcattctctctgaaacagcaactcgaggagaaggacatggacattgcagggtttacacagaaggttgtgtcactcgaagcggaactgcaggatatctcttcacaagaatctaaggatgaggctagcttagctaaggttaagaaacagctgcgcgacttggaggccaaagtcaaagaccaggaagaggagcttgatgaacaggcagggacaattcagatgcttgaacaggccaagctcaggcttgagatggaaatggagcgaatgagacaaacccacagtaaagagatggaaagtcgggatgaagaggttgaggaggcccgacaatcttgtcagaaaaagctgaagcaaatggaggtgcagctggaggaagagtacgaggacaagcaaaaggtgctgagggagaagcgtgaactggagggaaagctcgctacattgtcagatcaggtaaaccggagagattttgaatctgagaaacgtctaagaaaggatctgaagcgcaccaaagcccttctcgcggacgcgcaacttatgctggatcacctaaagaactctgcacctagcaagagggaaattgcacagctgaagaaccaactggaggaatcagagtttacatgcgccgcagcagtcaaggctagaaaagctatggaagtggaaatcgaagatctgcatctgcagattgatgatatagccaaagcaaagaccgctctggaggaacagttgagccgcctgcagagagagaagaatgagattcagaatcggctggaggaggaccaggaggatatgaacgagctgatgaaaaagcataaggctgctgtggcccaagcatcccgagacttagcccagataaatgacctgcaagctcagcttgaggaagcaaacaaggagaaacaggagctgcaggagaagctgcaggcattgcagtcgcaggtcgagtttttagaacagtccatggtcgataaaagcctggtgtctagacaggaagccaagattcgggagctggaaactagacttgagttcgagagaactcaggttaagcgcctcgaatccttagcatcccggttgaaagaaaatatggaaaaattgacagaagagagagatcaaaggatagcagcagaaaatcgggagaaagagcagaataaacggctgcagaggcaactgcgagatacaaaggaagagatgggggaactagctagaaaggaggccgaagcctccaggaaaaaacacgagctcgaaatggacctcgaaagtctggaggctgccaatcagagcctgcaggctgatctcaaacttgcttttaagaggatcggagatcttcaggccgctatcgaagacgagatggagagcgacgagaacgaggatctgatcaacagtgaaggtgattctgatgttgattcagagctggaggatcgggtggatggagtgaaaagctggctatcgaaaaacaaagggccttcaaaggccgcttccgacgacggtagcctcaaatcatcttcaccaaccagctattggaagtctttggccccagacaggagcgatgacgagcatgaccccttggacaacaccagccggccaaggtatagccactcatacctttctgactccgacacagaagccaagcttacagagacaaatgcttag

SEQ ID NO: 231679 - DNA, 6119 bp, Artificial Sequence
  Description of Artificial Sequence: Synthetic coding sequence
atgttcaacctgatgaagaaagacaaagacaaggacggcggacggaaggaaaagaaagaaaagaaggagaagaaggagcggatgtctgcagccgagttgaggagtctcgaggaaatgagtctacggagaggattcttcaatctgaaccgaagctctaaaagagaatctaaaaccaggctggagatctcaaaccccattccaatcaaagtcgccagcggttccgaccttcacctgaccgacattgactccgacagtaacaggggctccgttattctggactccgggcatctgtcaacagcttccagctccgacgacctgaagggggaagagggcagcttccgtggcagcgtgttgcaaagggctgccaagtttggaagcttagccaaacagaacagccagatgatagtgaagaggtttagcttctcccagcggtctagagatgaatccgcctccgagaccagcactcctagtgaacacagcgccgcaccttcgcctcaagtggaggttcggacgctggaaggtcaactcgttcagcaccctggacccggaattcctcgaccaggccatagaagcagggcccctgagctggtgaccaagaaattccccgtcgacttacggctccctcctgtagttcccctgccccctccaacgctgcgagaactggaactgcaacgccgtccaaccggagatttcggctttagcctgaggcggactacaatgttggacaggggccctgaaggacaggcatgtaggcgtgtggtgcatttcgctgagcccggagcaggaacaaaggacttggcgttaggtctcgtccccggagaccgactggtggaaattaacgggcataatgttgagtccaaaagcagggatgagattgtcgaaatgattagacagagtggtgattctgtgaggctgaaagtgcagcccatccccgagctgtccgagttgtcccgaagttggctgcggtccggtgagggccctcggcgtgaacccagtgatgccaaaacagaagagcagattgcggcagaggaggcctggaatgagaccgagaaggtttggctggtgcaccgcgacggttttagcttggcttctcagctcaaaagcgaagagctgaacctcccagaaggtaaagtgcgtgttaaactggatcacgatggagccatcttagacgttgatgaggacgacgtggagaaagccaacgccccatcatgtgacaggttggaagacctggcaagcttagtttatctgaacgaatcctctgtcctacacacactcagacagcggtatggggcaagcctgcttcacacctatgccggaccatccctgcttgtcctgggacctcggggtgctccagctgtatactctgaaaaagtgatgcatatgtttaaaggatgtcgcagagaagatatggcccctcacatctacgcagtggcgcagactgcctacagagctatgctgatgagcagacaggatcagtcaataatcctgctgggatcctcagggagcggcaagacgacaagctgccaacacttggtgcagtacctagctaccattgccggtatctcaggcaataaagtcttctctgttgagaagtggcaggctttatatactttgttggaagcattcggaaacagtccaaccatcattaatggtaatgctactcggttttcccaaattttgtctctggacttcgatcaagctggacaggtggcttcagcatccatccagactatgttgctggagaagctgagggtagccagacgcccagcctctgaggcaaccttcaatgtgttttattatctcctggcatgtggggatggaactctccgcactgagctgcatctcaaccatctggcagagaataacgtgtttggaatcgtgcctcttgcaaagcctgaagagaaacagaaagccgcacagcagttctccaagctgcaggccgctatgaaagtgctaggaatcagtcctgacgagcagaaggcgtgctggtttatcctggcagctatataccacttaggtgccgctggcgcaacaaaagaggcagcggaggccggaaggaagcagttcgctcgacacgaatgggcccagaaggccgcttatttgctgggttgctcacttgaggagctgtcatcagccatttttaagcaccagcacaaaggtggcacattgcagcgcagcacttcatttcggcagggcccagaggagtcaggactcggcgatggaacagggcctaaactgtcagcgctggaatgtttggagggcatggccgcaggcctgtactcagaactattcaccctgctagtgtcattagtaaatcgtgcattaaaatcttcacagcactctctgtgcagcatgatgatcgtggacacacctggattccaaaaccctgagcagggagggtctgctaggggcgctagcttcgaggagttatgtcacaattacacacaagatcgcctgcagaggctcttccatgaacgcaccttcgtgcaggagcttgaacgctataaggaggagaacatcgaacttgcctttgacgatttggagcctccaacagacgatagtgtggccgctgtggaccaagctagtcatcaatccttagtacggagcttggcacgcactgatgaagctagaggactgctgtggttgctagaggaagaggctctggtgcctggggcaagtgaggatactctgctggagcggctttttagctattatggtcctcaggaaggcgacaagaagggtcagtcacctcttctccactccagtaagccacaccacttcctgctgggacactcacacgggacaaattgggtagagtacaacgttactggctggttgaattacactaagcagaatcctgcgactcagaatgcccctaggctcttgcaagattcacagaaaaagatcatatctaacctgttcctgggccgagccggttccgctaccgtcctatctgggtccatcgcgggactcgaaggcggtagtcagctcgctttgcggagagccacatccatgagaaaaacctttactacaggtatggccgctgtcaagaaaaagagcctgtgtattcagatgaaacttcaggttgatgcgctgattgacacaataaagaaaagcaagctgcactttgtgcattgttttttgcctgtcgcagaaggctgggccggagagccacggagtgccagctcccggagagtctcctcctcaagtgaactcgacttgcctagtggagatcactgcgaggctggcctcctgcagttggacgtaccccttctgcggacacagcttcgtggctcccggcttcttgacgctatgcgcatgtaccggcaggggtatccagaccacatggtgtttagcgagttccggaggcggtttgatgtgctagcccctcacttgaccaagaagcacggcagaaattacatcgtggttgacgagagaagagccgttgaagaattgttagagtgcctcgacctagaaaaatcaagctgctgcatggggctaagccgtgtcttctttcgcgctggcacactggccagactggaggagcaacgggatgaacagactagccggaaccttacccttttccaggcggcttgccggggatatctagctcgacaacactttaagaaaagaaaaattcaagatctggctatccgatgtgtacagaaaaacattaagaagaataaaggggttaaagactggccttggtggaaactcttcactacggtgaggccacttatcgaggttcaactttccgaggagcagatccgcaataaggacgaggagatccagcagctccgatctaaactagaaaaagccgagaaagaaagaaacgagctacggttgaattctgaccgtctggagtcgagaatttcagagcttacctctgaattgaccgatgaacggaataccggagaaagtgcttcccagcttctggacgccgaaaccgccgaaagattaagagccgagaaggaaatgaaggagctgcagacccagtacgacgcattgaagaaacaaatggaggtgatggagatggaggtaatggaagcgcgactaattagagccgcagagatcaacggggaggtggatgacgatgacgcaggtggcgagtggcgcctgaagtacgaaagagcagttagggaggtggacttcaccaaaaaaaggctgcagcaggagtttgaggacaagttggaggttgagcaacagaacaagagacagctcgagcgccgacttggagacctccaagcagatagcgaggagtcccagcgggcactgcagcagctgaagaaaaagtgccagaggctcaccgccgaattgcaggatacaaagttgcaccttgaaggtcagcaggtgagaaatcatgaactagagaaaaagcagaggcgctttgactcggaactgtctcaggcccacgaagaggcacagagagagaaactacagagagagaagctgcagcgggagaaagacatgctcctggctgaggcctttagtctgaaacagcagctggaggagaaggacatggatattgctggttttactcagaaagtggtaagcctggaggcggagttgcaggacatctccagccaggaatccaaggacgaggcttccctggccaaagtcaaaaaacagctgagggacctcgaagctaaagtgaaggatcaggaagaggagctcgacgagcaggctgggacaattcagatgctggaacaagcaaagctccgactggagatggagatggaaaggatgaggcagacacactccaaagaaatggaatccagggacgaagaagttgaagaggccaggcagtcttgtcagaagaaactgaaacaaatggaggttcagctggaggaggagtacgaagataagcagaaggtactgcgcgagaagagagaactggagggaaaactcgcgacattatctgaccaggtaaataggcgggacttcgagagcgaaaaaagattgcgaaaagatttgaaacgaaccaaagcgctcctcgccgatgcacagctgatgttggaccatctgaaaaacagcgcgccaagcaagagagaaattgcccagttgaaaaaccaattggaggaaagcgagtttacatgtgcagccgctgtcaaggcacgcaaagcaatggaggtggaaatcgaggatctccatttacagatagacgacatcgcgaaggctaagactgcccttgaggaacaactaagtagacttcagcgggagaagaatgaaatacaaaaccgattagaggaagaccaggaagatatgaacgagctcatgaaaaaacacaaagcagccgtggcacaggcaagtcgcgacctggctcagatcaatgatctgcaggcccagctggaagaggctaataaagaaaagcaggagctgcaggaaaagcttcaagccctccaaagccaggtggagttcctcgagcagagcatggttgacaaatctttggtgtctagacaggaggctaaaataagagagcttgagaccagactggagtttgaacggacccaggtgaagcgacttgaaagcctggcctcacgactcaaagaaaacatggaaaagctgacagaggagcgagatcagaggatcgcagctgagaaccgtgagaaggaacagaataaaaggctccaacgtcaactgagagacactaaagaagagatgggggagcttgctaggaaggaagccgaagcctctaggaagaaacacgagttagagatggatttggaatcgctggaagccgctaatcaaagcctacaagccgacttgaagctggctttcaaacggattggcgatctgcaggcagccatcgaagatgaaatggaaagtgatgaaaacgaagacttgatcaattctgagggcgattcagacgtggatagcgagctagaggatcgagtggacggagtgaaatcttggctcagtaaaaacaaggggcctagtaaggccgcatcggatgacgggagtctgaagtcttcatctcctactagctactggaagtccctggccccagaccgcagtgatgatgagcacgaccctctggacaacacaagcaggcctcgctattcccacagttacttgtccgacagtgacacagaggccaagttgaccgagacaaatgctta

SEQ ID NO: 231680 - DNA, 6008 bp, Artificial Sequence
  Description of Artificial Sequence: Synthetic coding sequence
atgtttaatttaatgaaaaaggataaggataaggacggcggacgcaaggagaagaaggaaaaaaaggagaagaaggaaaggatgagtgccgcagagcttcgtagcctggaagagatgagtctaaggagaggctttttcaacctaaatagaagtagcaaaagagaatctaaaactcgactcgaaatttccaacccaatacctattaaggtagccagcggcagcgatcttcacctcacagatattgacagcgactcaaatcgcggaagtgttatcctcgatagtggccatctgtccaccgctagcagctccgatgacttaaaaggagaagaagggagttttagaggatctgtcctgcagcgggcagccaaattcggctccttagcaaaacagaacagccagatgattgtaaagcgcttcagctttagccagaggagccgggacgagagtgcatccgaaacgtctacaccatctgaacatagcgccgcaccctcccctcaggtcgaggttaggacgctggagggccaactggtgcagcatcctggacccggtatccctcggccaggccataggagccgggctccagagctggttaccaaaaagttcccagttgatctaagactccctcccgtagtgcctctgccacctcccactctgagggagctggaactccagcgcaggcctacgggcgacttcgggttctccctgcggagaacaacaatgctcgatcgtggtccagaggggcaggcctgtcgccgagtagtgcatttcgccgaaccaggagcaggcactaaagacctggccttaggtttagtgcccggagaccgactggtggaaatcaacggccacaatgtcgaatctaaaagccgcgacgagatcgttgaaatgattagacagtctggcgatagcgtgcggctgaaggttcagcctatcccagaactgagtgagcttagccggtcctggctccggagtggcgaaggtccacgcagggaaccctccgatgcaaagacagaggagcagatcgccgctgaagaggcctggaatgaaaccgaaaaggtctggcttgtacacagggacgggttttcgctcgccagtcagctaaagagtgaggaactgaatctgcccgaggggaaggtgagggtgaagctcgatcacgatggcgcaatcctggacgtcgatgaagacgacgtcgagaaggccaacgccccatcttgtgatagactcgaagacctggcgagtctcgtgtatctgaacgagtcttcggtgctgcataccttacggcagcgatatggtgcatccctgctgcatacttatgcgggtccaagcctactggtgctggggccacgcggagccccagctgtttacagtgagaaggtgatgcatatgtttaagggttgtaggagggaggacatggcacctcatatctacgccgtggctcagactgcttatagagcaatgcttatgtcccgccaggaccagtcaattatcttgctggggtcatctggctccgggaaaaccacaagctgccagcatctggtacaatacttggcgacaatcgcagggatctctggcaacaaagttttttcagtcgaaaagtggcaagccctgtacaccctactggaagcattcggcaactctcccacaattatcaatgggaatgctacccggttttcccagatcctttccctcgacttcgaccaggcaggccaggtggcttccgcaagtatccagactatgctcttggaaaagctgagagttgccaggcggcctgcatccgaggccacctttaacgtcttctactacctgttagcatgcggcgatgggaccctgagaacggagctgcacctgaatcacttggctgagaacaatgtttttggcatcgtgcccctcgcaaaacctgaggagaagcagaaggcggctcagcagttctcaaagctccaagccgcaatgaaggtcctgggaatcagtccagacgagcagaaggcttgctggttcatcctggcagccatataccacttaggggctgccggtgctaccaaagaggcagccgaggccggtagaaagcagttcgctcggcacgaatgggcacagaaggctgcctatctactgggatgtagtctcgaagagttatcctctgccatattcaaacatcagcataaaggcggaaccctgcagagatccacctccttccgccaggggcctgaggagtctgggctcggcgatggtaccgggccaaagctgtccgcccttgaatgcctagaaggtatggccgctgggctttattctgaactctttactttacttgtgtcactcgtgaatagagctctgaaaagctcccagcactcgctttgctcaatgatgatcgtagacacgccaggatttcaaaatcctgaacagggagggagcgcaagaggcgcatcatttgaggagctttgtcacaactatacccaagatcggctgcagagactcttccacgagagaacgttcgtgcaggaattagagcgatacaaggaggagaatatagaactggcttttgacgacctcgagcctcccaccgatgactctgtggccgcagtagaccaggcttcccatcagagcctggtccgcagcctcgcccgtaccgatgaagccagggggttactctggctcttggaggaggaggcactcgttccaggtgcttctgaggacactctcctggagagactattttcctactacggcccacaggagggcgacaagaagggacagtctccactgctgcattcatccaagcctcaccacttcttgcttggccattctcatggaacgaactgggtcgagtacaatgtgacagggtggcttaattatacaaagcagaatccggcaacgcagaacgccccacgactccttcaggactctcaaaaaaagatcattagtaatttgtttctgggacgggctgggagcgctactgtgctgtccggttctattgccggactcgagggaggctcgcaactggccttgaggagagcgacaagtatgaggaaaacatttaccacgggaatggctgctgttaaaaaaaagagcctttgcatacagatgaaacttcaggtcgatgcccttatcgacacaatcaagaaaagtaagctgcactttgtgcattgtttcttaccagtcgctgagggttgggctggcgaaccgaggtccgcatcctcacgtcgcgtgtcttcgtcctcggagctggatctgccatctggtgatcactgcgaggctgggctgttacagcttgatgtacccctcctacgcactcagctgaggggctctagactcctcgacgctatgcggatgtacagacagggatacccagaccacatggttttctccgaattccgacggcgtttcgacgttctcgcaccacacttgaccaaaaagcatggaagaaattatatagtggtggacgagcgccgagctgtcgaagaactcttagagtgtctcgatcttgagaaatcctcctgctgcatggggttgagtagggtctttttcagagccggaaccctggccaggttagaagaacagcgcgacgagcagacgagtcggaacttgactttatttcaggctgcctgccggggttatttggcccgtcagcactttaagaaaaggaaaatccaagacctcgctatccggtgcgtccagaagaacataaagaaaaacaagggtgtgaaagattggccatggtggaaactctttactacggttaggccactgatcgaagttcaactcagtgaggagcagatccgcaataaagatgaggagatccaacaactacggtccaagctggagaaagccgaaaaggaacgcaacgagctgcggctgaactcggatcgcttagagtccaggattagcgagttgacctctgagctgacagacgagcgcaataccggcgaatctgcttctcagctgcttgacgccgaaactgctgagcgtcttagagccgagaaagagatgaaggagctccagacccagtatgacgccctcaaaaagcaaatggaggtcatggagatggaggtcatggaagccaggctgatcagggctgcggaaattaatggagaggttgatgatgacgacgctggcggagagtggcggcttaagtacgagagggctgtgcgggaagtcgatttcactaagaagcgactccagcaagagttcgaagataaactcgaggtcgagcaacagaataaaaggcagttagagcgtcggctgggcgacttacaggcggacagcgaagagtcacaacgcgcattgcagcaactgaaaaagaagtgtcagaggttgacagcagaactgcaggacacgaagctgcacctggagggccaacaggtcagaaaccacgagcttgagaagaaacagaggcggttcgattctgaactcagccaggctcacgaagaagctcagcgtgagaaacttcagagggagaaactgcagcgtgagaaagatatgctactcgctgaagcattttctttaaaacagcaattggaggaaaaggacatggacattgccggattcactcagaaagttgtttctctggaggcagagctgcaggacatctcaagccaggaaagtaaagatgaggctagcttagctaaagtgaagaagcagcttagagacctcgaagccaaagtaaaagaccaagaagaggaactggacgagcaggcaggtaccattcaaatgttagaacaactcaaacagatggaagtgcagcttgaagaggagtatgaggacaagcagaaagtgctgagagaaaagcgagaactagagggcaagctggcaaccctttcagatcaggtcaataggagggactttgaatccgagaagagactgaggaaagatctgaaacggactaaagctctgctagccgacgcccaactcatgcttgaccacctgaaaaatagtgccccttcgaaacgagagatcgcccaactgaagaatcaactggaagaatctgagtttacatgcgccgctgctgtgaaagcaagaaaagcgatggaggtggaaattgaggatctgcacctccagatagacgacatcgctaaggccaaaacagcccttgaggagcaactgagccggctgcagagggagaagaacgaaatacagaaccggctggaggaggatcaggaggacatgaacgaactgatgaaaaaacacaaggccgctgtggctcaggcatcaagagatctggcccagatcaatgacttacaggcccagctagaggaagctaacaaggaaaagcaggaactccaggagaaactgcaagcccttcaatcacaggtcgaatttctagagcagagtatggtggataagagtctagtgtcgcgccaggaagcaaaaatcagggagctcgagactcgcttagagttcgagcggactcaggtgaagcggctggagagcctggcgagccgcctgaaggagaacatggagaaattgacagaagagagggatcaacgcattgcagcagaaaatagggaaaaagagcaaaacaaacgactgcagcgccagctccgtgacacgaaggaagagatgggggaattggctcggaaagaggctgaggcctctcggaaaaagcacgagctcgagatggatctggagtccttagaggcggctaatcaatctctccaagccgacctaaaattggcctttaagaggataggagacctgcaggcagccattgaagatgaaatggagagtgatgagaacgaagatctcataaattccgagggagactccgacgtggattccgaacttgaagatcgggtagacggagtgaaaagttggctctcaaaaaataaagggccttctaaggccgcaagcgacgatggttctctgaagagttcatcgccaaccagttattggaagtccctggcacccgaccgttctgacgacgagcacgatcccctcgacaataccagtaggcctagatattctcacagttacctgtcggattctgacacggaggcgaaattgacagagaccaatgctta

SEQ ID NO: 231681 - DNA, 2808 bp, Artificial Sequence
  Description of Artificial Sequence: Synthetic coding sequence
atgagaatgtacaggcagggatacccggatcatatggtattctctgagttcaggaggcgttttgatgtgctggcccctcacctgaccaaaaaacacggaagaaattacattgtggtcgatgaaaggagggcggtggaagagctcctggaatgtctggatctagagaaatcatcctgttgtatggggcttagtagagtcttttttcgggcaggaacattagcccgtttggaagagcagcgcgatgagcagacttcccggaatctcacactgtttcaggctgcctgtaggggctacctggcgcgacaacactttaaaaaaagaaagatccaagacctcgcaataagatgcgtgcaaaagaacatcaaaaaaaacaagggggtgaaagattggccatggtggaaattattcacgacagttcggcctttgattgaggtccagctgagtgaagagcagatccggaataaggacgaagagatccagcagctgcggagtaaattagagaaggctgaaaaagagcgcaatgaactgcgcctgaatagcgaccgtttggaatcgaggatttcagagctgacaagcgaactcaccgatgagcgcaatactggtgaatccgcaagccaattgctggacgccgaaactgcggaacggctacgggctgagaaggaaatgaaggaactgcaaacacagtatgatgcccttaagaaacaaatggaggtgatggagatggaggtcatggaggcccgactgatccgagctgctgagatcaacggtgaggtagatgatgacgacgccggaggcgagtggagattgaagtatgagcgcgctgttcgagaagtcgacttcacaaagaaacggctgcagcaggagtttgaggataaactggaggtggaacagcagaataaaaggcaattagaacgccgattgggcgacctgcaggctgacagcgaggaaagccagcgggcactgcaacaattaaagaaaaagtgccagcgcctgactgccgagctgcaagacaccaaacttcacctggaaggtcagcaggtccggaaccatgagctggaaaagaagcaaagacgcttcgattccgagttgagccaggctcacgaggaagcccagcgcgaaaagctacagcgcgagaagctgcagcgggaaaaagatatgttactggccgaggccttcagcctgaagcagcaactggaggagaaggatatggacatcgcgggttttactcagaaggttgtatccctggaagccgaattacaagacatcagcagccaggagagcaaggacgaggctagcttagccaaggtaaagaaacagctccgggatctggaggccaaagtcaaggatcaagaagaggaattagatgagcaggccggaaccatacagatgctggaacaggctaagcttagattggagatggaaatggagcggatgcgccaaactcactctaaggaaatggaaagccgtgacgaggaggtagaagaagccaggcagtcttgtcaaaaaaagttaaagcagatggaagtccagcttgaggaggaatatgaagataagcagaaagtgttgcgggagaagcgagagctggaaggcaaactggctaccctgtcagaccaggtgaacaggcgggattttgaatcggaaaagcgtcttcgaaaggatcttaaacgaacgaaggcgctcctggccgacgcacagctgatgctcgatcacctcaagaatagtgccccatcaaaacgcgagattgctcagctcaagaatcagttggaggagagcgagttcacgtgcgcagcagccgtcaaggccaggaaggctatggaagtggagattgaggacctgcatctgcagatagatgatatcgctaaagcaaaaacagcgctcgaagagcagttgtctcggctgcagcgggaaaaaaacgagattcaaaaccgccttgaggaggatcaggaggacatgaatgaactcatgaagaagcacaaggctgccgtagctcaggcatcgagagacctggcccagatcaatgaccttcaagcccagctggaagaggcgaacaaggagaagcaagaattacaggaaaagctccaggcccttcaatcccaggtcgagtttctggaacagagcatggttgacaagagtttggtctcaaggcaagaggcgaaaattagagaattggagacgcggctggaattcgaacgtactcaagtgaaaaggttggagagcctggccagccgactgaaagaaaatatggagaagttgacagaggaacgggaccagcgtatagccgcagagaatcgtgaaaaagaacagaataaacggcttcagaggcagcttagggataccaaagaggaaatgggcgaactggctagaaaagaagcggaggcgtcacgcaagaagcacgaactggagatggatcttgagtctttagaagccgcaaatcagtccctgcaggctgacttgaaactagccttcaagagaattggtgacctgcaagcagctatagaggacgagatggaatccgacgagaatgaggatcttataaatagcgaaggcgattccgacgtggacagcgagctggaggaccgggtggatggcgtgaagtcttggttgtctaagaacaaaggcccttctaaagccgcatccgacgacgggtctcttaagtctagctctccgactagttactggaagtccctggccccagataggtctgacgatgagcacgatcctctggataacacaagccggccacgctattcacacagctatttgtctgatagtgacacggaggctaagctgactgagaccaacgcgtag

SEQ ID NO: 231682 - DNA, 963 bp, Artificial Sequence
  Description of Artificial Sequence: Synthetic coding sequence
atgacattcgttttgctgtcatcttcccagcttgaggagcaactgtctagactgcagcgggaaaagaacgaaatacaaaaccgccttgaagaagaccaggaggacatgaatgaactgatgaagaaacacaaggctgctgtcgcccaggcctcacgagatctcgcgcagataaatgatctgcaggctcagctggaagaagccaataaagagaaacaagaactccaggagaagttgcaggccctgcagagccaggtggagttcctcgagcagagcatggtcgataagagcctggtgtctagacaagaagccaagatccgagaactggagacccggctggagttcgaaaggacacaggtcaagagactggagtcactcgcttcccgcctgaaagagaacatggagaagctcacagaagagcgagaccagaggatcgccgcagaaaacagagagaaggaacaaaataagcggctacagcgccagctcagggacaccaaggaagaaatgggggagctggctcgaaaggaagccgaagcaagcaggaagaaacacgagttggagatggacctggagagtctcgaggccgcaaaccagagcctacaggccgatcttaagcttgcgtttaaaaggattggcgatctccaggcggcaatagaagacgagatggagtccgatgagaacgaggacctgataaatagcgaaggggactccgacgtggactctgaactagaggaccgtgtggatggagttaaatcatggttatccaagaataaaggccctagtaaagcagcgagcgacgatggctccctgaagtcttccagcccaaccagctattggaagtctctcgcacccgacaggtccgatgacgagcacgaccctttggataacacatcccgtcccagatattctcactcctatctttcagacagcgataccgaggcaaaattgaccgagacaaatgcctag

SEQ ID NO: 231683 - DNA, 7703 bp, Artificial Sequence
  Description of Artificial Sequence: Synthetic coding sequence
atggccatctcatcaaggctggccttatgggagcagaagattagagaagaggacaaaagtccgcctccctcatctccaccgcctcttttttcagtgataccagggggtttcatcaaacaactcgtacggggaaccgaaaaggaagccaaggaagccaggcagcgaaagcagcttgcagtggcatcaccagagcgcgagatccccgaaatcagcatctcccaacctaactctaaatctagctcgggaaccagatccggatcgcagcagatctcacaggatgatcagtcaagctcaccagggtccagtgacatcctgggaaaggagagcgagggctctagatcccccgatccagagcagatgacttccattaatggcgagaaagcacaagaattgggctctagcgctactccaacaaaaaagacagtccctttcaagagaggcgtgcgacgcggagacgtcttgctcatggtggcaaaactggaccccgacagcgcaaagcccgaaaaaacccacccacacgacgcgccaccatgtaagacttcacctccggctacggataccggtaaggagaagaagggcgaaaccagccgcaccccatgcgggagccaagcaagcaccgagatcctggccccaaaggccgagaaaaccagaaccggaggactcggagatccaggtcaaggtacagtggctctcaagaagggggaagagggccagagcatcgtaggcaagggtcttggtacaccaaagaccaccgaattgaaagaggccgaaccccagggcaaagaccggcagggaacccgaccccaggcccagggacccggagagggcgttagacctggtaaagcagaaaaagaaggcgctgagccaactaataccgtggaaaaggggaatgtgagcaaggatgtgggttcagagggtaaacacgtgcgcccacagattccagggcgaaaatggggaggttttttgggccgtcggagtaaatgggatggcccacagaataagaaagataaggaaggcgttctcctcagcaaggccgaaaagactggagaaccccagacgcagatggaaaagacatctcaagtgcagggcgagttaggtgatgatctgcggatgggcgagaaagccggagaactcagatctactacaggcaaggctggcgagtcatgggataaaaaagaaaaaatgggacaacctcagggcaagagcgggaatgcaggcgaagctaggtcacaaaccgaaaagggttgtgaagctcccaaggaagtgtctacaatggtggagagccctgctgcacccggaaaaggcggatggccaggatctcgaggacaggaggccgaagaaccttgtagcagagcaggcgacggggcaggtgccctggagaccgagttggaaggaccttcccagcctgcactggaaaaagatgctgaaaggccaagaatcagaaaggaaaatcaggacggacctgcccctcaggaggagggaaaaggaggtcagagcagagattcagatcaggccccagaggatcggtggtacgaggccgagaaggtgtggttggcacagaaagacggttttactttggcaacagtgttaaagccagacgaagggacagccgacctccctgccggtagggtccggctgtggatagacgctgacaagacaattacagaagtcgacgaagagcatgtacatcgcgcaaacccccctgaattagaccaggtggaagacctggcctctctcatatcagtgaacgaatcttctgtgctgaataccctcctacaacggtacaaagcacagctactgcatacctgtaccgggcctgacctgatcgtgctacagccacgtgggcctagtgtgccctcggctgggaaagtgcctaagggccgaagggacggacttcctgcccacatagggtccatggcccagcgcgcatattgggccctgttgaaccagagaagagatcagtcgattgtggccctggggtggagcggggctggtaagaccacttgctgtgagcaggttcttgagcacctggtgggcatggctggctctgtggatggtcgggtgtcggtggagaagatcagggcaacattcaccgtcctccgggcatttgggagcgtcagcatggctcactccagatccgccaccagattcagcatggtgatgtctctggactttaatgctacaggacgcattacagctgcccagctgcaaacaatgctgttggaaaagagccgggtagcgagacagccggagggcgagtccaactttcttgtgttctctcagatgttggccggtctggaccttgacttgcgtactgagttgaacctccatcagatggcagactcgtcctcgttcgggatgggagtttggtcaaaaccagaggataagcaaaaggctgctgcagcattcgcacagctgcagggtgctatggagatgctgggcattagtgagtccgagcagcgcgctgtctggcgcgtcctggccgctatctaccatttaggagcagccggtgcctgcaaggtaggtaggaaacagtttatgagatttgagtgggccaactacgctgccgaggcactgggatgtgaatatgaagagttgaatacggcgaccttcaagcatcatctgcggcagattatacagcagatgacattcggaccatcccgatggggcctggaggatgaggaaacttcctcgggacttaaaatgacgggagtggactgcgttgagggtatggcgagtggcctgtatcaagaactgttcgccgctgtggttagcttaatcaacaggtccttcagctcccaccacctgagtatggcatccattatggttgtggatagccccggattccagaatccaagacaccagggaaaggaccgggctgcaactttcgaggagctctgccacaactacgcacacgaacgcttacagcttcttttctatcagagaactttcgtctctactctgcaacggtaccaggaagagggggtacctgtgcagttcgacctgcccgacccctccccaggcacaacagttgccgtggttgaccagaatccctcccaagttcgcctccctgctggcggaggtgcacaggacgcaaggggcttgttttgggtacttgatgaagaagtccacgtggagggatcatcagacagtgtggtcttagagcgtctgtgtgccgctttcgagaagaaaggtgcaggtactgagggtagctcggccctgcggacttgcgaacagcctttacagtgcgaaatttttcatcagctcggatgggaccctgttcgatatgacttgaccggctggttgcatagagctaaaccaaatctgtccgccctcgacgcccctcaggtcctccaccagtccaaacgcgaggaactgcgttcactgtttcaggccagggccaagcttcccccagtgtgccgtgccgtagctggcctcgaggggacatcccaacaagccctccagagatctcgcatggtgcggaggacttttgctagctctctagccgcagttcgacggaaagcgccttgttctcagatcaaactacagatggatgccctaacaagcatgatcaagaggtcacgcctgcattttatacactgccttgtccctaaccccgttgtggagtcccgaagtggccaggaatccccccctccaccacagccaggcagggataaacccggagcgggaggccctctggcccttgatatccctgcactgcgcgtacagctcgctggctttcacatccttgaggcccttagattgcaccggacaggttacgccgatcacatgggattgacgcggtttaggcgccagtttcaggtgctggatgccccactgctgaagaagctaatgtccacatctgagggaattgacgagcgaaaggctgtggaagaacttttggagactctggacctcgagaaaaaagcagtggcggtgggtcattctcaggtttttttgaaggccggagtgatatcacgactggaaaagcagcgggagaagcttgtgagccaatcaatcgtcttatttcaggctgcatgtaagggtttcctgagtagacaggagttcaagaagctcaaaatccgccgattggccgctcaatgtatccaaaaaaatgtagccgtatttcttgccgttaaggattggccctggtggcaattactaggaagcctacagcccctgctgtccgccacgattgggactgaacaacttagagcaaaggaggaggagcttacgacgttaaggaggaagctggaaaaatctgagaagctgagaaatgaactccgacagaacaccgatctcctggagagcaaaatagcggacctgacttctgacctggcagatgaaagatttaaaggcgatgtggcatgccaggtccttgagtccgagcgcgctgaacgattacaggcatttcgggaagtgcaggagcttaagtcgaaacacgagcaagtccagaagaagttgggcgacgtgaacaagcagctggaagaggctcagcagaagatccagctgaatgacctggaaaggaatcccactggtggagccgacgaatggcagatgcggttcgactgcgcgcagatggaaaatgaatttctgaggaaaaggctccagcaatgcgaggaacgcttggattccgaattgacggcacgaaaggagctagagcaaaagttgggtgagctgcagtcagcctacgacggagcaaaaaagatggcccaccagctgaaaagaaagtgccaccacctcacatgcgatctcgaagatacctgcgttctgttagagaaccagcaaagcaggaatcacgaattggagaaaaagcagaagaagtttgacttacagctggcccaggcccttggcgaaagtgtcttcgaaaaaggactcagagagaaggtaacccaggagaatacctctgtccgctgggagcttggccagctgcagcagcagttgaagcagaaggaacaggaggcttcccaactgaaacaacaggtggaaatgcttcaggatcataagagagaactgctgggcagcccatctctgggcgagaattgtgtcgccggacttaaggaaaggttgtggaagctggaatcaagcgccctcgaacagcagaagattcagtcccaacaggagaacacaatcaagcagctggagcaactccgtcagagattcgaactggaaattgagaggatgaaacagatgcatcagaaagaccgggaagatcaggaggaagaattggaagatgtccgccagagttgtcaaaaacgcctgcaccagctggaaatgcagctggagcaggagtacgaagaaaagcagatggtgctgcacgaaaagcaggacttggaggggctcatagggactttgtgtgaccagattggacatagggactttgatgtggaaaagcggctgcgaagggacctccgcagaactcacgctttgcttagcgacgttcagctcctcttaggcacaatggaggacgggaagactagtgtcagtaaagaggaattggagaaagttcattcccagttggaacagtctgaagcaaaatgtgaggaggcgctcaaaacacagaaggtgttgactgccgaccttgaaagtatgcattcagagctggaaaatatgactcgtaacaagtccttggtagatgaacaactttacaggctgcagttcgaaaaagctgacctactgaagcggattgatgaagatcaagatgatctgaatgaactgatgcaaaaacacaaagatcttatcgctcagagtgccgctgacatcggacagatacaggaactccagttacagctggaggaggccaagaaagaaaagcataaattacaggaacagctccaggttgcacagatgcggattgagtacttggaacaaagcacggtcgaccgggctattgtgagccgacaggaagcagtcatttgcgacctggagaacaagactgagtttcagaaagtgcaaatcaaacgcttcgaggtgttggttatacgcctgagagactctctgatcaagatgggcgaagaactgtcacaggctgccacttctgaatcccagcagagagagagttctcagtactaccagagaaggttggaggagctgaaggccgatatggaggaactggtacagagggaggccgaagcctctagacggtgcatggagttggaaaagtacgtcgaagaactggcagccgtgagacagacactgcagacggatctggaaacttctattagaagaattgccgatctacaggccgcactggaagaggtggctagctctgactcagacaccgagtcggtccagaccgcggtggactgcggtagttccggcaggaaagagatggacaacgtgtcaatcctgtcttcacagcctgaaggcagtctgcagtcttggctttcttgtaccctgtctctggccacggacacaatgagaacaccatcccggcagagcgcaaccagttcccgaatcctctctcctaggattaacgaggaagcgggagatacagaaagaacccagagcgctttagcgctgtccagggcaagatcaaccaatgttcatagcaagacctccggagataagccagtctctcctcacttcgtccgcagacagaagtactgtcattttggagatggagaggtgcttgctgttcagcgaaagtcaactgaacgtctcgaaccggcaagctctcctctggctagtaggtccactaataccagtcccttatctcgggagaagctgcccagtcctagcgcagccctgtccgaattcgttgaaggcttacgccgtaagcgcgctcagcggggacaaggatcaacactgggcctggaagactggccaacgctgcctatctaccagacaaccggggcatccacccttcgaagaggaagggcgggttctgacgagggtaacctttctcttagagtgggcgcaaagtctcctcttgagattgaaggggctgctggagggttattgcggagcactagtttgaagtgtatttcctctgatggcgtggggggtactacattactccctgaaaagtcaaagacacagttcagttcatgcgaatccttgctagagagcaggccctcgatgggacggaaactgagcagtcctactacccctagggatatgttgttgagtcctacactgagaccccgtcgtaggtgtctggagagcagcgtggacgacgccggatgccctgacctaggcaaggaacctctggtgttccagaatcggcagttcgcacatttgatggaggagccattgggctccgaccccttttcgtggaagctgccaagtcttgactacgagcggaaaaccaaagtcgacttcgacgactttctaccagcaattcgtaaacctcagactcctacctccttggccggatcggccaagggaggtcaggacggatcccagagatctagcatccactttgagaccgaggaggccaaccgatctttcctgagtggaatcaaaacaatcctgaaaaagagtcccgagcccaaagaggatcctgctcacctgtccgacagctcttcatcctcagggagtatcgtctcctttaaaagcgccgattctattaaatcccgcccaggaatacccagattggctggagatggaggggagcgcaccagtcctgaacgccgtgagcccggaacgggtcgaaaggacgatgatgtggccagtattatgaaaaaatacttgcaaaaata

SEQ ID NO: 231684 - DNA, 7706 bp, Artificial Sequence
  Description of Artificial Sequence: Synthetic coding sequence
atggctatcagttctagactcgccctctgggagcagaagatacgtgaagaagacaagagtccccctccatcctccccaccacctctgttctctgtgatacctgggggattcattaaacagttagtcagaggtaccgagaaggaggcaaaagaagccagacagagaaaacagttggcagtggcctcccccgaacgcgaaattcccgagatcagtattagccagccaaattcaaagtctagcagtgggacgcgcagcggctctcagcaaattagccaggacgatcagtctagttctcctgggagctctgatatcttgggaaaggaatctgaaggctctcgcagccctgatcccgaacaaatgacaagtattaatggggagaaggcccaggagctgggttcctctgcaaccccaaccaaaaagaccgtgcctttcaaaagaggggtgcgcaggggtgatgtactgctgatggtggctaaacttgatccagacagcgccaaacccgagaaaactcatccgcacgatgcccctccttgtaaaacctctccaccagcgactgataccgggaaggaaaagaagggcgagaccagtcgaaccccctgcggtagccaggctagcacagagattctggcccctaaagctgagaagacccgcaccggtggacttggagatccagggcagggcactgtcgctctgaaaaagggagaagagggacagagcatcgtggggaagggcctggggacacccaaaactacggagctgaaggaagctgagccgcagggcaaggacaggcaagggacccgcccacaggcccagggcccaggggaaggcgtcaggcctgggaaagcggagaaagagggggctgagccaactaataccgtagaaaaaggcaatgttagtaaagacgtgggcagcgaaggtaagcatgttcggcctcaaattccaggtagaaagtggggaggattccttggtcgcaggagcaagtgggatggccctcagaataaaaaggataaggagggtgtccttctctcaaaggccgaaaagaccggcgagccccaaactcagatggaaaaaactagccaggtgcaaggggagttaggtgatgatttgcggatgggcgagaaggccggtgagctgaggtctacaacaggtaaagccggtgaaagctgggacaagaaggaaaaaatgggccagcctcagggaaagagtggcaacgccggagaagccaggtcacaaaccgagaaaggctgcgaggcgccaaaggaggtatcaactatggtcgaaagtccagcagccccaggaaagggtggctggcctggcagcaggggacaggaagcggaagagccctgttcaagagccggagacggtgccggtgctttagagactgagttagagggcccatctcaacccgctctggaaaaggacgcagagaggccccgaattaggaaggaaaaccaggacgggccagcccctcaagaagaaggcaaaggtgggcagagccgggattctgaccaggccccagaggaccggtggtacgaggcagagaaagtttggctcgcccagaaagacggttttacactggcaacagtgctgaaacctgatgagggaaccgctgatctccctgctgggagggttcgtctctggatcgatgcggataagacaatcaccgaggtagatgaggagcacgtgcacagggccaaccctcccgagttggaccaggtggaggacctggcttcccttatcagtgtcaacgaatcaagtgtgctcaatacattattacagcgatataaggctcagctcctccacacatgtacaggtcccgatctcatagtgctgcaacccaggggaccctccgtgcctagtgccggtaaagtacccaaaggtagaagggacggactccccgcacatattggctctatggctcaacgcgcatattgggccctcctcaatcagcggagagatcagtctatcgttgcgctgggctggagtggagccggtaagactacctgctgtgagcaggttttggagcatctggttggcatggccggaagcgtagacggtcgggtttccgttgaaaagattcgcgcaactttcacagtactccgggcattcgggagcgtttcgatggcacactcccgctccgcaacacgcttcagcatggttatgtcccttgatttcaatgctacaggcaggattacagccgcacagcttcagacaatgctcctcgagaagagccgcgtcgccaggcagcccgaaggggaaagtaactttctagtcttcagccagatgctggccggactcgatctggatctgcgcactgagttgaatctgcatcagatggctgatagctcttcttttggtatgggagtgtggtctaagcctgaagacaaacagaaggctgcagctgccttcgcgcaactacagggtgctatggagatgctcggtatctctgagtcggagcagcgggcagtgtggcgggtcctggccgctatttatcatctcggcgctgcgggtgcctgcaaagtgggtaggaaacagtttatgaggtttgagtgggcgaactatgccgcagaggctttaggatgcgaatatgaagaactcaacaccgctacatttaaacaccacctgcggcaaataatccagcaaatgacttttggtccaagcagatgggggctggaggacgaggaaacatcaagcggactgaagatgacaggcgtggattgtgtggagggcatggcctcggggctataccaagaactatttgcggcagttgtgtcacttataaaccggagtttctcaagccaccacctaagcatggcctcaatcatggtggtggattctcctggcttccagaaccctcggcaccaaggcaaggaccgggcagccacttttgaggagttgtgccacaactacgcccatgaaagattacaactccttttctaccaacgaaccttcgtgtcgacgctgcagagataccaggaggagggggtgccagttcagttcgacctgccagacccttcccccggtaccactgtggctgtagtcgatcagaatccctcccaacaggtacgtcttcccgcaggtggcggtgcccaagacgccagaggactcttttgggtgctggacgaagaagtccacgtcgaggggtcatcagatagtgtcgtgcttgaaagactttgtgctgccttcgaaaagaagggcgctggtaccgaggggtcgagcgccctgcgcacctgtgagcagcctctgcagtgcgaaatatttcaccaattggggtgggacccagtacgctacgacctgacaggttggttgcacagagctaaaccgaacctgtctgcattagatgcaccacaggtcctccaccagtccaagagagaagaactgcgttccctgtttcaggcacgggctaagctccctcctgtatgccgcgctgtagccggactggaaggaactagccagcaggctcttcagcgctcccgcatggtacgacgtaccttcgcttcaagtcttgcagccgttcggcgaaaagcaccctgtagtcaaattaaactgcagatggatgcccttaccagcatgatcaaacgctctcgtctgcacttcatacattgcttggtgcccaatccagtggtggagagccggtccggccaggaatccccccctccaccccagccgggacgggacaagcccggtgccggagggccactggcactggacatcccagcgctgcgtgtgcagctggcgggtttccacattctggaggcgctgcgcttgcaccgtactgggtacgctgaccatatggggctgactaggtttcggcgacagttccaggtgctcgacgcaccactgttaaagaaactgatgagcacttctgaaggcatagacgagagaaaagccgtggaagaattactggagacccttgacctggagaagaaggcagttgctgtgggtcactcccaagttttcctcaaagcaggcgtgatctcaaggcttgagaagcagcgcgagaaactcgtgagtcagagtatcgtgctcttccaggccgcttgtaaaggatttttgtcccgccaggaattcaagaagctcaagatccgcagactggctgcccagtgcatacagaagaacgtggcagtcttcctggctgtcaaggactggccgtggtggcagttgctgggaagcctacagccacttttgagcgcgaccatcgggactgagcaattaagggctaaggaggaagaactgaccactttaagacgtaagctcgagaagtctgagaagctgcgcaatgaactcagacaaaacaccgacttactcgagagcaagattgccgaccttacaagcgatctggccgacgagcgcttcaagggagatgttgcctgccaggtcctggaatctgaaagagccgagaggctccaggcattcagggaggttcaggagctgaagagtaagcacgagcaggtgcagaaaaaactgggcgacgttaacaaacagctggaagaggcccagcagaaaattcagctaaacgatctcgaacgaaatcctacaggcggagcagatgagtggcagatgagatttgactgcgcccagatggagaacgagtttctgcgaaaacgattacagcagtgcgaggagcggttggactcagaactaaccgctcgcaaagagctggagcagaaattgggggaactccagagcgcctacgacggtgctaagaaaatggctcatcagctgaagagaaagtgtcaccacctgacctgtgacctcgaggacacatgcgtcctattggagaaccaacagtcccgaaatcatgagctggagaagaagcagaaaaaattcgatttgcaattagcacaagcgctgggcgagtctgtattcgagaaaggcctgcgcgagaaagtgacccaggagaatacaagcgtgcgctgggagctgggtcagctccaacaacagctgaagcagaaagaacaggaggctagtcaattaaaacagcaggtggagatgctgcaagatcataaaagggaattgttagggtctccatcccttggggaaaactgtgtggcaggcctaaaagagagattatggaagctggagtccagcgccctggagcagcagaaaatccagtcacagcaggaaaacactatcaagcaactcgagcagctccggcagagattcgaattagaaattgagagaatgaagcagatgcaccagaaagaccgggaggatcaggaagaagagctggaggacgttcgccagtcttgccagaaaagactccaccagctggaaatgcagctagagcaagagtatgaagagaaacagatggtgttgcatgagaaacaagacctcgaaggactgataggcacactctgcgaccagatcgggcaccgggatttcgatgtggaaaagagattgcgtcgtgacttacggaggactcacgcacttctgagtgatgtacagttattgctggggacgatggaagacgggaagacatctgtgtccaaggaagagctggaaaaggtgcacagccagttggagcagagcgaggccaagtgcgaggaagccttgaagacacagaaagttctgacggctgatcttgaatcaatgcactccgaattggagaatatgacgcgcaacaagtctcttgtcgacgaacagctatacaggcttcagtttgagaaggcagacctgctaaagcggattgacgaggatcaggacgacttgaacgagttaatgcagaagcataaggatttaatcgctcagtcagctgccgatatcggacagatccaagagctgcagctacagctggaggaggcaaagaaagagaaacacaagctccaagaacaactgcaggtcgcgcagatgagaatcgaataccttgagcagtcgactgtggaccgtgccatcgtgtcacgtcaagaagccgtaatctgcgatctcgagaacaagactgaatttcagaaagtccagatcaaaaggtttgaggtgctagtaattaggcttcgcgattctctgattaaaatgggagaagagctgagccaggccgcaacctctgagagccaacagagggagtcttcgcagtattaccagcgcaggctcgaagaattaaaagccgatatggaggagctggtgcagcgggaagctgaggcatcgagaagatgcatggagctcgaaaagtatgtggaggagctggccgctgtgaggcaaactctccagacagacttggagacaagcattagaaggattgccgatttgcaggccgcattggaagaggttgcttccagcgattccgatactgagagtgtccagacagccgtcgactgcggctcgagcggtcggaaagaaatggataacgttagtattctgtcaagccagcccgaggggtctctacagagctggctgagttgtacactctccttggcaaccgacacgatgcgcacaccctctagacagtctgcgacatctagcagaatcctgagcccgagaataaatgaagaggctggcgacactgaaagaacacagagcgcattggctctgtccagggcacgatcaactaacgtgcactccaagacgtctggtgacaagcctgtgagccctcactttgtgcgcaggcagaagtattgtcactttggtgacggagaagttcttgctgtccagagaaaaagtacagaacgtctggagcctgcatcttcgcccttggcctcccgtagtacgaacacgagcccgctctcccgtgagaagctgccatcccctagcgcagccctctctgaattcgtggagggcctccggaggaagagagcacagcgcggtcaagggtccactctcggtctagaggactggcccaccctgccaatttaccagacaacaggagcgtctaccctaaggagaggacgcgctggctccgacgagggcaacctctcactaagagttggggcaaagtcacccctggagatcgagggagctgctggaggcctgctgagatctaccagtctgaaatgtatcagttctgacggggtcgggggaaccaccctgttaccagagaagagcaagacacaattttctagctgcgaatcattgctcgagtcaagaccctcaatgggcagaaagctgtcctctcccaccaccccccgagatatgctgctgagtccaactctgagacccaggagacggtgcctcgaaagctctgtggatgacgccggttgccctgacctgggcaaagagcccctggtcttccagaaccggcaatttgctcatctgatggaggagccactgggaagcgaccccttctcatggaagctgcccagcctggactatgagaggaaaacaaaggtggattttgacgacttcctgcccgctattcggaagccccagacaccaaccagtttggctggtagtgctaagggaggacaagacgggtctcaacgatcatctatccattttgaaactgaagaggcaaacagaagctttctttccgggatcaaaaccatcctgaaaaagagcccagagccgaaggaggacccagctcacctgtctgatagctccagcagttctggctccatcgtcagtttcaaaagtgcagactctatcaagtctagaccaggaatccctcgcctggccggtgatggcggagaaagaacttcccccgaacgacgagaacctggcactggcagaaaagatgacgatgtcgccagtatcatgaaaaaatacctccagaagta

SEQ ID NO: 231685 - DNA, 7703 bp, Artificial Sequence
  Description of Artificial Sequence: Synthetic coding sequence
atggccatatcttcccgcctggccctgtgggaacagaaaattcgcgaggaagataaatcaccacctcccagctcccctccgccactgttttccgtcataccgggtgggttcattaaacagctcgttcgcggaacagaaaaggaagctaaggaggcaagacagagaaaacaactggccgtggcctcacccgaacgcgagattcctgagatcagtatatctcagcccaacagcaaaagctctagtggcacaaggtccggatctcaacagatctcccaggatgaccaaagctcgtcaccaggtagctccgatatcctcggaaaggaatccgaagggtctcgctcacccgatcctgaacagatgacctcaataaacggcgagaaggcacaggaactgggatctagcgccacccctactaagaagactgttccatttaagagaggcgttagacgcggagatgtattactcatggtcgctaagctggatcctgactctgccaagcccgaaaaaactcaccctcatgatgctcctccgtgcaaaacctctccacccgcaacagacacaggtaaagagaagaaaggcgaaacctcacggactccatgcggttctcaggccagtacagagattctcgcccctaaagccgagaagacccggaccggcggtctgggtgaccccggacaggggaccgttgccctaaaaaagggtgaagagggacaaagcatagtgggtaaaggacttggaaccccaaaaaccacggaattaaaggaggccgaaccacagggaaaagacagacagggaacaaggccccaggcccagggccctggcgagggggttcgaccaggaaaagcagagaaggagggggctgagcctactaatacagtagagaagggaaacgtaagcaaggatgtgggctcagaaggtaaacacgtgcggcctcaaatcccaggacgtaaatgggggggatttttggggaggaggtcaaaatgggatggaccacaaaacaagaaagataaggaaggagtgttacttagtaaagctgagaagaccggagaaccgcagacacagatggagaagacttcacaggtccagggagagttaggcgatgatctgcggatgggagaaaaagccggtgagcttcgctccacaaccgggaaagccggtgaatcatgggacaagaaggagaagatggggcaacctcagggaaagagcgggaatgccggagaggcaaggtctcaaaccgaaaagggctgcgaggcgcctaaggaggtatccaccatggtggagtcccccgcagcacccggaaaaggcggatggccagggtcccgcggtcaggaggccgaggaaccttgttctagggctggagatggggcaggggcactcgagaccgagttagagggaccgagccagcctgccctggagaaggatgctgagagacctcggattaggaaggaaaaccaggacggtcctgcacctcaggaggagggtaaggggggacagtccagggacagcgaccaggccccagaggataggtggtatgaagcggagaaggtctggttagcccagaaggatgggtttaccttagcaactgtcctgaagccagacgaggggaccgccgacttgccagctgggagggtacgtctatggatcgacgccgataagacaataacggaagtagatgaggagcatgtgcaccgcgcaaatccccctgaactggaccaagtggaggacctggcatccttgatctccgtgaacgaaagctctgtgcttaatactctcctgcagcgctataaggcccaactgttacacacatgcaccggcccagacctgattgttctgcaacctagaggcccaagcgtgccatctgccggaaaagtccccaagggtcgcagagatgggttgcccgctcatatagggtccatggcacaacgagcgtactgggcactgttaaatcagcggagggatcagagtatcgttgcgctgggctggtcaggcgcaggcaagactacttgttgtgaacaggttttggaacatctcgtgggtatggctgggtccgtcgacggcagggtctctgtagagaagattcgggcaacctttaccgttctgcgggcttttggctccgtctcaatggctcacagtcggagtgccactcgtttttccatggtcatgtcactggatttcaacgccactggaaggattacagcagctcagttgcagactatgctactagagaaatcaagggtggccagacagcccgaaggtgaaagcaatttcttagttttttctcaaatgctcgccggactggacctagatcttaggacagagctgaatttgcaccaaatggcagacagtagctccttcggaatgggagtgtggtccaaacctgaggataaacagaaggctgcagctgccttcgcccaactgcagggtgccatggagatgctgggaatcagtgaaagcgaacagagagccgtgtggcgagtcctggccgcaatatatcatctgggagccgctggtgcttgcaaggtcgggaggaaacagtttatgcgttttgagtgggctaattatgcggctgaggccctggggtgcgagtatgaagaattgaatacggcaacgttcaagcatcacctgcgccaaatcatccagcagatgacatttgggcctagcagatgggggctggaggacgaagagacttcatctggcctgaagatgacaggtgtagactgtgtggagggcatggcctcaggcctctaccaggagctgtttgccgcagtcgttagcctgatcaatcgatccttcagctcccatcacttgagcatggcgagcattatggtggtcgactcacccggttttcagaaccccaggcatcaaggcaaggacagagccgctactttcgaagagttatgtcacaactacgctcacgaacggctccagcttctgttctatcagagaacatttgtgtccacccttcagaggtaccaggaagagggcgtaccagtgcagttcgacctgccagacccttcccccggtactaccgtggccgttgtggaccagaacccgtcccaggtgaggctgccagccggaggtggagctcaggatgccagaggcctattttgggttctggacgaggaggtgcacgtcgaaggctcctccgactccgtggtgctggagcgtctgtgtgctgcatttgagaagaaaggagctggtaccgaaggctcaagcgcattgcgtacgtgcgagcaacccttgcaatgcgagatcttccatcagctgggatgggatccggttaggtatgatctgaccggatggctgcaccgcgcaaaacctaacctgtcagcccttgatgccccacaggtgttacatcaatccaaacgagaggagctgagatctctgttccaagcacgcgctaagctgccgcctgtttgccgagccgtcgccggtctggagggcaccagccagcaagctttgcaaagaagtaggatggtgcggcgaacctttgcatccagcctggctgctgtccgtcgaaaagccccttgcagccagattaagctgcagatggacgcgctgacaagcatgataaagcggtcccggcttcacttcatccattgcctggttccaaatcctgttgtcgaatcaagaagcggacaagagagtccgccacctcctcaaccaggccgtgacaaaccaggggctggaggtccgcttgctcttgatatcccggcacttagagtacagcttgctggcttccacatcctcgaggccctgcgacttcatcgcaccggttacgccgatcacatggggctgaccaggttccggaggcagtttcaagtcctggacgcgcctttgttaaagaaactgatgtccacgtctgaaggaatcgatgaacggaaagcagtagaggagctcctggagaccttggatctggagaaaaaggcggtggccgtgggtcatagtcaggtctttttgaaagccggagtaatctctagactggagaagcagcgtgagaaattagtgagtcagagcattgtgctgtttcaggctgcctgtaaagggttcctgagccgtcaagaatttaagaaactaaagattcggcgactggccgctcagtgcatacagaagaacgttgccgtcttcttggccgtcaaggattggccttggtggcagctgttggggtccttacagccgctgctgtcagcgaccatcggaaccgagcagctcagagcgaaggaggaggagttgacaactctgagacgaaagctcgagaagtcagagaaactaaggaatgagttgagacaaaatacggacctcctcgagtcaaaaattgctgatctgacctcagatctagctgacgagagattcaaaggagacgtggcgtgtcaggtcctagaaagcgagagggcggagcggcttcaggcttttcgggaggttcaggagctgaaaagtaagcacgagcaagttcaaaagaagctcggcgacgtcaacaagcagctagaagaggcccagcagaagatccaactgaatgatctcgaacgcaatcctactgggggagcagacgagtggcaaatgcgcttcgactgcgctcaaatggagaacgagtttcttcgaaagagactgcaacaatgcgaggagcgactggattccgagctgaccgctcggaaggagctcgagcaaaaattgggggagctgcagagtgcttatgatggcgcaaaaaagatggcccaccagcttaagcgcaaatgtcatcacctgacttgtgacctggaggacacctgcgttctcctcgagaatcagcagtcaaggaaccacgaactggaaaagaagcagaaaaaatttgatctgcagctcgcacaggcgcttggagagtccgtcttcgaaaagggtctcagagaaaaggtgacacaggagaataccagcgttagatgggaactcggccagctgcagcaacagcttaaacagaaagaacaggaagcttcccagctgaagcagcaggtggagatgctgcaggaccacaaacgcgagctcctgggcagccctagcctgggcgagaactgtgtagccggtttgaaggagagactctggaaactggagtccagcgccttggaacagcaaaagatccagagtcagcaggaaaataccatcaaacagcttgagcagctaagacagagattcgagctcgagattgaacggatgaaacaaatgcatcagaaggatcgcgaggatcaggaggaggaacttgaggatgtgaggcagtcgtgtcaaaagcgcctgcaccaactggaaatgcaactcgagcaagagtacgaggaaaagcaaatggtgctgcatgagaagcaagacctggaagggttaatcggaaccctatgtgaccagatcgggcacagggactttgatgtggaaaagcgccttcggagggacctgcgaagaacgcacgctctccttagtgacgtgcaattattattaggaaccatggaagatggcaagacctcagtcagtaaagaggaactagaaaaggtacacagccaattggaacaaagtgaagcaaagtgtgaagaagccttaaaaacccagaaggtcttaaccgcagacctggaatctatgcatagtgaactggagaacatgactaggaataagagcctggtagacgagcagctgtaccggttacagttcgagaaggccgatttactcaagcgtattgatgaggatcaggatgatctcaatgagcttatgcagaagcataaagacctaatagcccaatcagccgcagacatcggccagatccaggagctacagctgcagttggaagaagcaaaaaaagaaaaacacaaattgcaagagcagttacaggtggcgcagatgcgcatcgagtacctggagcagagtaccgtggatagggctattgtttcaaggcaagaagcggtgatctgtgatctggagaataagacagaatttcagaaagtccaaattaaaagatttgaagttctcgtgatacggctacgagactccctgatcaagatgggggaggagctctcacaggctgcgaccagtgagtctcagcagcgcgaaagcagtcagtattaccaaagacggctggaagagcttaaggctgacatggaagagctagtgcagagggaggccgaggcatccaggcgctgtatggaactggaaaaatatgtggaagaattggccgcagtcagacagactctgcagactgacttggagaccagcattcggagaatcgcagatctgcaggctgcattagaggaggttgcctctagcgatagtgacacagagtccgtccagactgctgtggattgtgggtcaagcggaaggaaagagatggataacgtgtctatcctgagtagtcagccagaggggtccctccagtcgtggttgtcatgtacactttccctggcgactgacacaatgagaactccgagtagacagtccgcgactagttcccggatcctctcgccgaggataaacgaagaggcaggcgataccgaacggactcagtcggccctggccctctcacgcgcacgctcaacaaacgtgcactctaagaccagcggggataagcccgtgagtccacattttgtgcgacgacagaagtattgtcactttggagacggcgaggtactggctgtgcagcgaaaatctacagagcgcctggagcctgccagctcacccttagcctcaaggtccactaacacttcccccctgtctcgcgaaaaacttccaagcccttcagcagccctgagtgaatttgttgaaggtttgaggcgcaaacgggcacagagggggcagggatcaaccctgggcttggaggattggcctaccctccccatatatcagacaacaggggcaagcacgctgcggagggggagggccggaagcgacgagggcaatctctcattgagggtaggcgctaagtctcccctggagattgaaggggcagcaggtggtctcctgcggagtacttcactaaagtgtatctcttccgatggagtgggcggaaccactctgttaccagagaaaagcaaaactcagttctcgtcttgcgaatctctcctggaatctaggccctctatgggccgaaaactgagctctcctacaactcctagggatatgttgctttcccctacactgcggcctcgccgacgctgtctggaatcaagcgtagatgacgcaggctgccctgatcttggaaaggagcctctggttttccagaacagacagtttgctcacctaatggaggaacctcttgggtcagaccccttctcctggaagctccccagtctggattatgaacgcaaaacaaaggttgatttcgacgactttctgcccgcaattaggaaaccccagacaccgacctctctggccggatcagccaagggagggcaagatggatctcagaggtctagtattcattttgagaccgaagaagccaataggtcctttttgtccgggatcaaaacgatcctgaaaaaaagccccgagcctaaagaagatcctgctcatctcagtgacagttccagctctagcggctccatcgtcagctttaagtctgccgactctattaagagcaggccagggatcccccgactggccggagacggtggggagagaacttcccccgagagaagagagccagggactggccgaaaagacgatgatgtggccagtatcatgaagaaatatttgcagaaata

SEQ ID NO: 231686 - DNA, 603 bp, Artificial Sequence
  Description of Artificial Sequence: Synthetic coding sequence
atgggcaacagcaaatccggagcactctcaaaggagattttagaggagctgcaactgaacaccaaatttagcgaggaggaactctgttcttggtatcagagtttcttgaaggattgcccaaccggccgtattactcaacaacagttccagagcatttacgctaaattcttccccgataccgatcccaaggcatatgctcagcatgtctttcgctcattcgactcgaacttagatgggactctggactttaaagagtatgtgatagctctgcacatgaccactgcaggcaagacaaatcaaaagctggaatgggcgttttctctatacgacgtcgatgggaatgggactatcagcaagaacgaggtacttgagatagtgatggcaatctttaagatgataaccccagaagacgttaagctgctgccagatgacgagaatacccccgagaagagagccgagaagatttggaagtactttggtaaaaatgatgacgacaaactcacagaaaaagagttcatcgaaggaactctggccaacaaagagatactgaggctcatccagtttgagccgcaaaaggtgaaggagaaaatgaagaatgcgtag

SEQ ID NO: 231687 - DNA, 1884 bp, Artificial Sequence
  Description of Artificial Sequence: Synthetic coding sequence
atgtccagcgattctgagatggccatcttcggcgaggcggcaccctttctgcgcaagtcagagagggaacggattgaggctcagaacaagcccttcgacgccaagaccagtgttttcgtggtggatcccaaggagtctttcgttaaggcaacagtgcagtccagagagggaggaaaagttaccgctaaaaccgaggccggagcgaccgttaccgtcaaggatgatcaggtgttccctatgaatcctcccaaatatgataaaatcgaggacatggccatgatgacgcacttgcacgaacccgctgtgctgtataaccttaaggagagatacgccgcatggatgatctacacctatagcggcctattttgcgtaaccgtcaacccctacaagtggctccctgtctataatgctgaagtcgttacagcataccggggaaaaaagagacaggaggcccctccccatattttcagcatcagtgacaacgcttaccagtttatgttaaccgatcgggagaatcaatccatcctcataacaggcgagagtggcgctggcaaaaccgtcaacacaaaacgggtgatccagtacttcgccaccattgctgttactggcgaaaagaagaaagaagaggtgacatccggaaaaatgcagggcacccttgaggaccagattatctctgctaatccgctcctcgaggcgtttggcaacgctaaaacggtgcgcaatgataacagttctcggtttggaaagttcatccggatccactttggcacaactggtaagcttgcctccgccgacattgaaacatatctactggagaagagccgagtcacttttcagttgaaagccgaacgcagctaccacatcttttatcagatcatgagcaataaaaagccagacctcatagaaatgttactgataactaccaatccttacgactacgctttcgtcagccagggggagataactgttccatctatcgatgaccaagaagaacttatggccactgactccgccattgaaattctcgggttcacttccgacgagcgggtttccatttacaaactcactggggcagtgatgcactatgggaatatgaaattcaaacagaaacaacgagaggaacaagccgagcctgacgggacagaagtggccgataaggccgcttatctacagaacttgaacagcgcggatttgctcaaggccctctgttaccctcgagtgaaagttggaaatgaatacgtgaccaaaggacagacagtccagcaagtttacaacgcagtgggcgctctggccaaagccgtttacgacaaaatgtttctgtggatggtgacgcggataaatcagcagctggacaccaagcaaccccgtgccaatagcgaggtggctcagtggagaacgaagtacgagacagacgcaattcagcggactgaagagttggaggaggctaaaaaaaagctagcacagcggttacaggatgccgaagagcacgtggaggctgtgaacgcaaaatgtgcatccctggagaagactaagcagaggctacagaatgaggtagaagacctcatgattgatgtggagaggaccaatgcagcttgcgctgcattagataagaagcaacggaattttgacaagattctcgccgagtggaagcagaagtgtgaggaaacgcacgctgagctcgaggcttctcagaaagaatcccggtcgctgtctactgaattatttaagatcaaaaacgcatacgaagagtcattggatcagctggagactctcaagcgcgagaacaagaatctgcagcaggagatctcagacctgaccgagcagatcgcagagggcggaaagcgaattcacgaactcgagaagattaaaaagcaggtggagtag

SEQ ID NO: 231688 - DNA, 5918 bp, Artificial Sequence
  Description of Artificial Sequence: Synthetic coding sequence
atggcccaaaaggggcagttgtccgacgacgagaaatttttgttcgttgacaagaattttattaactcaccggtcgcccaggccgactgggcagcgaaacgtcttgtttgggttccctctgagaagcagggattcgaagcggcttctattaaagaagaaaagggggacgaggtcgtagtggaactggttgaaaatggcaaaaaggtgaccgtgggcaaggatgacatacaaaagatgaacccacccaagttttcaaaagtggaagatatggccgaattgacgtgccttaacgaagcttctgtccttcataatcttcgcgagagatattttagcggactgatctacacttactccgggttattctgcgtcgtagtcaacccctacaagcatcttcccatctattctgagaagatcgtggatatgtacaaaggcaaaaaaaggcacgaaatgccccctcacatctacgctatcgcagacacagcctacaggtcaatgctgcaagacagagaagaccagtccattttatgtacaggtgagagtggggcagggaaaacggagaatactaaaaaggtgattcagtatctcgctgtcgttgccagtagccataaggggaagaaagacacctccattaccggagaattggagaaacagctgctccaagcaaatccaatattggaggcgttcggcaacgcaaagactgtgaagaacgacaatagtagtaggttcgggaagtttatccggatcaatttcgatgtgacaggttatatcgttggagccaacatcgaaacgtacctgctggaaaaatcgcgggctattcgccaggccagggatgagcggacatttcacatcttttactatatgatagcaggagctaaagagaaaatgcgctcagatctgcttctggaaggctttaacaactacacattcttgtccaacgggtttgttcccatcccagcagctcaggacgacgagatgttccaggagaccgtagaggcgatggcaattatgggattctccgaagaggagcagctctcaatcctcaaagtcgtctccagtgttttgcagctcggtaacattgtattcaaaaaggaacgcaatacagaccaggcatctatgcccgataatactgccgcacaaaaagtgtgtcatctcatgggaataaatgtgacagactttacgcgttccattctaacaccgaggatcaaggtaggaagagacgtagtgcagaaggcacagaccaaggagcaggccgacttcgccgtcgaggcattagccaaggctacttacgagcggctctttaggtggatcctaacgcgagttaataaggcactcgataagactcacaggcagggggcttccttcttagggatcctcgacatcgcaggattcgaaatatttgaggtaaattctttcgaacaactgtgcatcaattataccaacgaaaagcttcagcagctgttcaaccatactatgttcatacttgaacaggaagagtaccagcgagagggaatcgagtggaacttcatagatttcggcctggaccttcagccttgtatcgagttaatagagcgacccaacaatccccctggagtgttggctttgctggacgaggaatgttggttccccaaggccacagataaatcttttgtggagaagttgtgcaccgagcagggttcccaccctaagttccagaagccgaaacagctcaaagacaagaccgagttctccattatccactacgctggcaaggtggactataatgcatctgcatggcttaccaaaaacatggaccctctgaatgacaacgtgacaagcctgctcaacgcgagttcagataagtttgtcgccgacctgtggaaggatgttgatagaattgtcgggttggaccagatggcaaaaatgacagagtcaagcttgcccagcgcaagcaaaacgaaaaagggaatgttcagaacggtgggccagctgtataaggagcagctgggaaaactgatgacaaccttgcgcaacactacgcctaattttgtgcgatgcatcattcccaaccatgagaagcgcagcggaaagctggacgcctttctggtacttgaacaactccgatgtaatggggtgttagaaggtatacgcatctgtcgccaagggtttcccaacagaatcgtcttccaagagtttcgccagcgctacgagatattggcagccaatgctattcccaaagggtttatggacggcaaacaggcatgtatactcatgataaaagcgcttgagctagatccaaatttatacaggattggtcagtctaagatctttttccgcaccggagtgctcgctcatctcgaagaggagcgtgacctgaaaataacggacgtgatcatggcctttcaggcaatgtgccgtggctaccttgccaggaaagctttcgccaagagacagcagcaattgactgccatgaaagtcattcagcgaaattgcgctgcttaccttaagcttaggaattggcagtggtggcggctgttcactaaagtgaagcccttgctgcaagttaccaggcaagaagaggagatgcaggccaaggaggatgagctccagaaaaccaaggagagacagcagaaagccgagaacgagttaaaagaactggaacagaaacattcccagttgactgaggagaaaaatttgctgcaagaacagcttcaggcagagaccgagctatacgccgaggccgaggaaatgcgggtgcggttagccgctaaaaagcaggaactcgaagaaatcctgcacgagatggaagcaaggctggaagaggaagaggatagagggcagcagctccaggccgaaaggaaaaagatggcccagcagatgcttgatctggaagaacagttggaagaagaggaggccgctcggcagaagttgcaattagagaaagtcacggccgaggccaagatcaagaagctagaggacgagattttagtcatggacgaccagaacaataagctgagcaaggaacgcaagctgttagaggaaagaatttctgacctcacaactaaccttgctgaagaggaggaaaaagcaaaaaacttgaccaagctcaaaaacaaacacgagagcatgatttccgagctagaggtgcggctgaagaaagaggaaaaaagccggcaggaactcgagaagctgaagagaaaactggagggtgatgcatcggactttcacgaacaaattgctgacctgcaggctcaaatcgcagagctgaaaatgcagctggcgaaaaaagaagaggagctccaggccgctcttgctcgcttagatgatgaaatcgcgcagaaaaataatgccctgaagaaaatcagggagcttgaaggacatattagcgacctccaggaggatctggatagcgaacgagctgctagaaacaaggccgagaaacagaagagggatctgggggaagagctggaggccttgaaaactgagctggaagacaccctagacagcacagcgacgcagcaggagctgagggctaaacgtgagcaggaggtgactgtgctcaaaaaagcactggacgaagaaacccggtcacatgaggcccaggtgcaggaaatgcgacagaagcacgcccaggcagtggaggaattaacggagcaactagaacagtttaaacgagcgaaggctaacctggacaaaaacaagcagaccctggaaaaggagaacgccgatctggctggagaactgagggtactggggcaagctaagcaggaggtggaacacaagaagaaaaaactggaggcacaagtccaggagctgcagtccaaatgctctgatggtgagcgggcaagagcagaactgaacgacaaggttcacaagctgcagaatgaggtggaatccgttaccggcatgttaaatgaggccgagggcaaggctataaagcttgcaaaggatgttgcctctctaagctcccaacttcaggacacacaggagctccttcaggaggagacgagacagaaactgaatgtttcaactaagctccggcagcttgaggaggaacgcaactcattgcaggaccagctggatgaggaaatggaagcaaagcagaacctagagcgacacatttctaccctgaacatacagctatcggattcgaagaagaagttacaggactttgcctccacggtagaagcattggaggaaggcaagaaaaggttccagaaagagattgaaaatctgactcaacagtatgaagagaaagctgccgcatatgataaattagagaaaacgaagaaccgtctgcaacaagaattggatgacctcgtggtggacctggataaccagagacaacttgtaagtaatctggagaagaaacagagaaagttcgatcaactgctggcagaggagaaaaacatttcatcaaagtatgccgacgagagggatagagcggaggcagaggccagggagaaggaaacaaaagccctcagcctggcccgagctctcgaagaagcattagaagccaaggaggagttggagagaaccaataaaatgctgaaggccgaaatggaggacctcgtcagcagtaaggatgatgttggaaaaaacgtgcatgagctggaaaaaagcaaaagggccttagaaacgcaaatggaggaaatgaaaacacagctggaagagctggaagacgaattgcaggccaccgaggatgcaaaattacggcttgaagttaatatgcaggcactgaagggtcaatttgaaagggacttgcaggcaagagatgagcagaatgaagaaaagagacgccaactccagcgccagctgcatgagtacgagacagaacttgaggacgaacgcaagcaaagggccttagctgctgctgccaaaaaaaaattggaaggggacctgaaggacctggagttgcaggcagactccgcaattaaaggcagggaggaagccataaaacaattgaggaagctgcaggcccagatgaaggatttccagcgcgagctggaggatgcccgagcctcccgcgatgagatttttgctactgccaaggaaaatgagaaaaaggcaaaaagtctggaggcagacctgatgcagctccaggaagatcttgcagccgcagaacgggctcggaagcaagccgatctggagaaagaagaactggccgaggagctggcatcaagcctgtcaggaaggaatgccttacaggatgaaaaacggagattagaagcacgtatagcgcagctggaggaagaactggaggaagaacaggggaatatggaggccatgtccgaccgggtgcggaaggcgactcagcaggctgagcagttgagtaacgaactcgccaccgagcggagcactgcccagaagaatgagagcgccagacagcaactggagaggcagaacaaagagcttaggagcaagctgcatgagatggaaggtgctgtaaagagcaagtttaaatcaaccatcgcagcactggaggctaagatcgctcaactggaggagcaggtggaacaggaggcacgggagaaacaggcagctacgaagtcactgaagcagaaagataagaagttgaaggaaatcctcttgcaggtggaggacgagagaaaaatggcggagcagtataaagaacaggctgagaaagggaatgcgcgtgtgaaacagctcaaaagacagctggaggaagctgaagaggagagccagaggattaatgcaaacaggagaaagctccaaagagaactggatgaagccactgagagtaacgaagctatgggacgtgaagtgaatgccctgaagtcaaagctacgcaggggcaacgagactagcttcgtgccgagccgtcggtcaggaggacgtcgtgttatcgagaacgcggatggaagcgaggaagagacggataccagggacgcagactttaatggtaccaaagcatcagaata

SEQ ID NO: 231689 - DNA, 5816 bp, Artificial Sequence
  Description of Artificial Sequence: Synthetic coding sequence
atggctcagaaaggccaactcagcgatgacgagaaatttctcttcgtggacaaaaatttcatcaactctcccgtggcccaggccgactgggcagctaagagactggtctgggtaccttcagagaagcagggtttcgaggcggcatcaatcaaggaagagaagggcgatgaagttgtggtggagctagtggaaaatggcaagaaagtgaccgtcggcaaagacgacattcagaagatgaatcctccaaagttcagcaaagtcgaggacatggctgaactgacttgcctgaatgaagctagcgtgcttcacaacctgcgcgaaaggtactttagcgggttaatctatacctattctggtctcttttgcgtggtggttaacccatacaagcatttgccaatttatagcgaaaaaatcgtcgacatgtataagggaaaaaaaagacatgaaatgcccccacacatttacgcaatcgctgatacagcctatcgttcaatgctccaagaccgtgaagatcagtctatcctctgtaccggtgaaagtggggctggaaagacagagaacactaagaaggtcattcagtatctcgctgttgtcgcgtcttcgcacaaagggaaaaaagatactagcattactggggaactggagaaacagctgcttcaggccaaccccattctggaagccttcggtaatgcgaaaactgtcaaaaatgataatagcagcaggttcggtaagtttattcgcataaattttgacgtcaccggctacattgttggagcgaacatcgagacttacctgttggaaaagtctagagccatcaggcaggccagggatgaaaggactttccacatcttctactacatgatcgctggagcaaaggagaagatgcggtctgatctgctgctggagggcttcaacaactataccttcctgtccaatggtttcgttcccatccccgctgctcaggatgacgaaatgttccaagaaactgttgaggcaatggcaataatggggttttctgaggaagagcaactgtcaatcctgaaggttgtgagtagcgttttgcagcttggaaatatagtttttaaaaaagagagaaatacagaccaggcctcaatgcctgataatacggcagcccagaaggtctgtcatcttatggggatcaacgtgacagacttcacccggagcatactcacacctcgcatcaaggttggcagggacgtggtgcagaaggcacagacgaaggagcaagccgattttgcagtcgaggcgttagccaaggctacctatgagaggctgttccgctggatcctgacgagggttaataaggcacttgataagactcatcggcaaggcgcttcgttccttggaatccttgatatagcgggttttgagatcttcgaagtgaattcttttgagcagctatgcattaactataccaacgaaaagctccagcaactcttcaatcacaccatgttcatacttgaacaggaggaatatcagagagaggggatcgaatggaattttattgacttcgggctggacctgcaaccctgcattgaactgatcgagcgcccaaacaatcccccaggggtgctggctctgctcgacgaagagtgttggttccctaaggccaccgataagtcattcgtcgaaaagttgtgcacggagcagggttctcatccgaaatttcaaaagccaaaacagctgaaagataagacagagttctctatcattcattacgctgggaaagtggattataacgccagtgcctggctcacgaagaatatggaccctctgaatgacaacgtgacttccttgctcaatgcatctagcgacaagtttgtggctgacttgtggaaagacgttgacaggatcgtgggactggatcagatggctaagatgaccgaatctagcttgccatccgcttccaagactaaaaagggcatgttccgcacagtcggtcagctctacaaagagcagctcgggaaattgatgacaacgctccgcaataccaccccaaattttgttcgttgtattattccaaaccatgagaaacgatcaggcaaattggacgcctttctcgtgttggaacagctgagatgtaacggcgtactggagggcattagaatatgccggcaggggtttccaaatagaatcgtgttccaggaatttcggcagcggtacgagatacttgctgcaaacgctatccccaaaggcttcatggatggcaagcaggcctgcatcctcatgattaaggctttggagttagacccaaatctgtatcggatcggccaaagtaagatcttcttccggacgggcgtgcttgcccatctggaagaggagcgggatcttaaaattacagacgtcataatggccttccaagccatgtgccgcggttacctggcgaggaaggccttcgccaaacgacagcagcagctgaccgcaatgaaggttatccagaggaactgcgcggcttacctaaagttgcggaactggcaatggtggcgcttatttactaaagtgaaacccctgttacaagtgacgcgccaggaggaggaaatgcaggccaaggaggacgagctccagaagactaaagagaggcagcagaaggcagagaacgagttgaaagagctcgagcaaaaacattctcagcttaccgaggaaaaaaacctgctccaagaacaattgcaggcagagaccgaactatatgccgaggccgaggagatgagggtcagactcgcggcaaaaaaacaagaactggaagaaattcttcatgaaatggaggccaggcttgaggaggaggaagatcgcggtcaacagctccaggcagagcgtaaaaagatggcacaacagatgctggacctggaagaacagctcgaggaagaagaggccgcacggcagaagcttcagctggaaaaggtgaccgccgaggccaaaatcaagaaactcgaggacgaaatactggttatggatgatcaaaacaacaagctgtcaaaggagcgcaagctcctcgaagagcggatctcagacctgaccaccaatctggctgaggaagaagagaaggctaaaaacctgaccaagctgaagaacaagcacgaatcaatgatctctgagctggaagtgcgactgaaaaaggaagagaaatccaggcaggagctagaaaagctgaaaagaaagctagagggcgatgcatctgacttccacgaacaaatagccgatctccaggcgcagatagccgagctcaagatgcagctggcaaaaaaggaggaggagctgcaggctgccctagcgcgactggacgatgaaatagcccagaaaaacaacgctctgaagaagattcgggaactggagggtcatatcagtgatctccaggaagatctcgactccgagcgtgccgctaggaataaggctgagaagcaaaagcgcgatcttggggaggaactcgaagcactaaagaccgaacttgaagacactcttgattctactgctactcagcaggagttgcgtgccaagcgcgaacaggaggtgacagtgttgaagaaggcactcgacgaagagacccgctcacatgaggcccaagtgcaggaaatgaggcagaagcatgcgcaggcggtggaagagctcaccgaacagttagagcagtttaaacgagctaaggcgaacttagataagaataaacagaccctagaaaaggagaacgccgaccttgccggtgagctgcgagtgttggggcaagcgaaacaggaagtggagcataagaaaaagaaactcgaggcccaagtgcaagagctccagtcgaagtgctctgatggagagcgggcacgcgctgaactgaacgacaaggtgcacaaacttcagaatgaggtggaatctgttacaggcatgcttaatgaagccgaaggaaaagcaataaagcttgcaaaagacgtcgctagtctgtctagccagttgcaggacacccaggaacttttgcaggaggagacacgccaaaagctgaacgtgtcaaccaagttgagacagctggaggaagagcgaaattctctgcaggaccagctggatgaggagatggaggccaaacagaacctggagaggcacatctccacactgaatattcagttgagtgattccaaaaagaaactccaagactttgcaagcactgtagaagcattggaggaggggaagaaacgtttccagaaggaaattgagaaccttacccagcagtatgaagaaaaggcagccgcttacgacaaattagaaaaaaccaagaatcgcctgcagcaggagctggatgacctggttgtcgatttggataatcagcgccaactggtgagtaatctggaaaagaagcagaggaaatttgatcaactccttgccgaggagaagaatataagctccaagtatgcagacgagagggatagagcagaagctgaagctagggaaaaggaaaccaaggcgctgagccttgctcgtgcattggaagaggctctcgaggccaaggaggagttggagagaaccaataagatgttgaaagctgagatggaggatcttgtaagttcaaaagatgacgttggtaaaaacgtgcacgaattggaaaaaagcaagagggctcttgagacacagatggaggagatgaaaactcagcttgaagaactggaggacgagcttcaggccaccgaggacgctaaacttcgcctggaggtgaatatgcaggccttgaagggccagttcgagcgggacctccaggctcgcgacgaacagaacgaggaaaagaggcgacagctccagcgccagcttcacgagtacgagacagagctagaagatgaacgtaaacagcgtgccctagcagcagccgcaaaaaaaaaactcgagggtgacctgaaagacctggaactccaggctgatagcgctatcaagggcagagaagaagccattaagcagctgaggaagcttcaagcccagatgaaagattttcagcgcgaactagaggacgccagggcttccagggatgaaatcttcgctacagccaaggaaaatgaaaagaaagctaagagtctggaagccgacttgatgcagcttcaggaggacctggctgcggctgagcgcgcacgaaagcaggccgacctggaaaaggaggagctggccgaagaactagctagcagcctgagcgggaggaacgctttgcaagatgaaaaaagaagactcgaggcacgcatagcccaactggaggaggaactggaggaagagcaaggaaacatggaggctatgtcagacagagtcaggaaggccacacaacaagctgaacagctgagcaatgaactagccacggagagatcaacagcgcaaaaaaacgagtccgcccgtcaacagcttgaacggcagaacaaggagctccggtctaagttgcatgagatggaaggagccgtgaagtccaaattcaagtcaaccatcgccgcactcgaggccaaaatagcccagttggaggaacaggtggagcaggaggcacgagagaagcaagccgcaacaaagtccctgaaacaaaaagataagaagctcaaggaaatcctgctgcaggttgaagacgagcggaagatggctgaacagtacaaagagcaagccgaaaaaggaaatgctagggtgaagcagctcaagcggcaactggaggaggctgaagaggagagccaaaggattaacgccaaccggaggaaactgcagcgagagctcgatgaggctacagaatctaatgaagccatggggagggaagtcaacgccctcaaatctaagctaagagggcctcccccacaggaaacatcccagta

SEQ ID NO: 231690 - DNA, 6089 bp, Artificial Sequence
  Description of Artificial Sequence: Synthetic coding sequence
atggcccaaaagggtcaactcagcgacgacgagaagttcctctttgtcgacaaaaattttatcaattcaccagtggcccaggccgactgggccgctaagcgcctggtttgggtaccgagtgaaaagcaaggattcgaagccgcttccatcaaggaggaaaagggggacgaagtggtcgtggagttagttgaaaatggtaaaaaggtcaccgtgggtaaagatgatatccagaagatgaaccctcccaaattcagtaaggtcgaggacatggctgaactcacctgtctgaatgaagcgtcagttctgcataacctgcgggaaaggtacttcagtgggctcatctatacctattcaggactgttctgcgtagttgttaatccatacaagcacctgcccatctattctgagaaaatcgttgatatgtataagggcaaaaagcgacacgagatgcctcctcatatctacgcaattgcagatacagcatataggagcatgctgcaggatcgggaagaccagagcattctctgtaccggagaaagcggagcgggtaagaccgaaaacacgaaaaaggtaatccagtacttggcagtggtcgcctctagtcacaagggaaaaaaggacacatctatcactgagggcccttcgttctggaggggtgagctggagaagcagctccttcaggctaacccaattttggaggcattcggcaatgccaagacggtgaaaaacgacaattcatcccggtttggcaaattcattcggattaatttcgacgtgacaggttacatcgtgggtgccaacattgagacctacctgcttgagaaatctcgggcaattcgacaggctcgtgacgagcgcacttttcacatcttctactacatgatcgcaggcgctaaagaaaagatgagaagcgacctgctcttagagggatttaataattacacctttctgtccaatggctttgtccccatacctgctgcacaggatgatgagatgttccaagaaacagtggaggcaatggcaattatgggattttctgaagaggaacaactgtcaattctcaaggtcgtgagtagtgtccttcagctaggcaatatagtctttaagaaagaaaggaacaccgatcaggccagcatgcccgacaacacagccgctcaaaaagtctgtcatctgatgggaattaacgtgaccgactttaccaggtccatccttactcctagaatcaaagtgggccgagacgtggtccagaaagcccaaactaaagaacaagccgatttcgcagttgaagccttagccaaagcaacctacgaaaggctgtttagatggatactgactagggttaacaaagctctcgataaaacgcaccggcagggggcttccttccttggcatattagacattgcgggattcgagatattcgaggtgaactccttcgaacaactctgtatcaactacacgaacgagaagctacagcagctgtttaatcatacgatgttcatcctggagcaggaggagtatcagcgagaggggattgagtggaacttcatagattttgggcttgacctacagccatgtattgagttaatcgagaggcctaataatcctcccggtgtccttgccctgttggatgaggaatgctggttcccgaaagctaccgacaagtcattcgttgagaagctttgtactgaacaagggtcacacccaaaatttcagaaacccaagcagcttaaagacaagacagagttcagcattatacattatgcaggcaaagtcgattacaatgcctccgcctggctgaccaagaatatggatcccctgaatgataatgtgaccagcctactgaacgcaagttcagataagttcgtcgccgacctgtggaaagacgtcgacagaattgtcggattagaccagatggccaaaatgaccgagtccagcctcccctctgcttcaaagaccaaaaaaggcatgttccgcaccgttggccaactgtacaaagagcaactgggcaaactcatgaccacgcttcgtaacaccacacctaacttcgttcggtgcatcatccccaaccacgaaaagaggtcaggcaaactggatgcctttcttgtactggaacagctcaggtgcaacggggttctggaaggcatccggatttgtaggcaaggatttcctaatcgcatcgttttccaagagttcagacagcgctatgagatccttgccgcaaatgccattcccaagggctttatggatggaaagcaggcttgtattcttatgattaaagcgctggaacttgacccaaatctatatcgaatcgggcaaagtaaaatcttcttccggacaggagtcttggcacatctggaagaagaacgggatctgaagattacggatgtcatcatggcctttcaagctatgtgcagaggatatctggcaaggaaggcattcgcaaagcgacaacagcagctgacagctatgaaggtgattcaaaggaattgcgccgcatacctcaagcttaggaactggcagtggtggcggctgtttaccaaagtgaagccactgcttcaagtgaccagacaggaggaagagatgcaggccaaagaggatgagctgcagaaaactaaggagaggcaacagaaggctgaaaatgagctaaaggagttagagcagaaacatagccaacttacggaagaaaaaaatctgttacaagagcaactgcaagcagagacggaactgtacgccgaagcagaagagatgagagtgagattggctgccaagaagcaggagctcgaagagattctgcacgaaatggaggcacgcctggaggaggaggaggataggggccagcagctgcaagccgagcgaaagaagatggctcagcagatgttagacctcgaagagcaactagaagaggaggaggcagcacgccagaaattgcagctcgagaaagtgaccgcagaagcaaagatcaaaaagctagaggacgagatacttgttatggacgatcaaaataacaagcttagcaaagagaggaagcttctggaagagcggataagtgacctaacgactaacctcgctgaggaggaggagaaggctaagaaccttacaaaactaaagaataaacatgagtctatgatctccgagctcgaggttcggctgaagaaagaagaaaaaagcaggcaggaactggaaaaactcaaaagaaaactcgagggagatgccagtgacttccacgagcaaatcgccgatcttcaggcacagattgcagaactaaagatgcagctagctaaaaaagaggaagaactccaagcagctctcgcgagattggatgatgaaatcgcgcagaaaaataatgcacttaaaaaaatcagggagctggaaggccatataagtgacttgcaagaggacttggactccgaaagggctgccaggaacaaggcagaaaaacagaagcgagatctcggagaagagctcgaggctctgaaaactgagctagaagatacactggactccaccgccactcagcaggagcttcgagcaaaaagagaacaggaggtcacggtcctaaaaaaagctctggacgaggaaactcgtagccacgaggcgcaggtgcaggaaatgcggcagaagcacgctcaagcagtggaggaactgaccgagcagctggagcagtttaagcgggcaaaggcaaatctcgataaaaataagcagaccttagagaaggaaaacgctgacttagctggagagctgagagtgctgggacaggccaaacaggaggtggaacataagaagaaaaagttggaggcgcaggtacaagaacttcagtctaaatgtagcgacggcgaacgggctagagcagaactcaacgacaaggtgcataagttacagaacgaggtggaatccgtcacgggtatgctgaatgaggccgagggcaaagccataaaactagctaaagacgttgccagcctctcttcccaactgcaagacacacaggaactcttgcaagaggagacccgccagaaactgaacgtttctacaaaactgcgacaattagaggaagaaagaaacagtttgcaggatcagctggacgaagaaatggaggctaagcagaatttagagcgccacatatccactctaaatatacagctgagtgactctaaaaaaaagctgcaggactttgcaagtactgtcgaggcgctcgaagaagggaagaagcggtttcaaaaagagatagagaatcttactcagcaatacgaagagaaggccgcagcctacgataagctggagaagacaaagaatcgactccagcaagaactcgatgacctcgtcgtcgatctggataaccaaagacagctagtgtcgaacttagagaaaaagcagcgtaagtttgatcaactactggccgaggagaagaacatctctagcaaatacgctgacgaacgagatagagctgaggcagaggcacgcgagaaggaaactaaagccttgagtctggcccgtgctctggaggaggcacttgaagccaaagaagagttggagagaacgaataaaatgcttaaggcggaaatggaggacctcgtgtccagtaaggatgacgtggggaaaaacgtccatgagttggaaaaatctaagagggcgttggagactcagatggaagagatgaaaacccagctggaggaactcgaggatgagctccaggcaacagaggacgctaaactgcgcctcgaggtgaatatgcaggcactgaagggtcagttcgagcgcgatctccaggcaagggacgagcagaacgaagagaagcgtcgacagctacagcggcagctgcatgagtacgagacggaattggaagatgagaggaaacagagagccttggctgccgcagcaaagaaaaagctggagggcgacctgaaggatctggagttgcaggccgactctgcaataaaaggtcgggaagaggcaattaagcagctccggaagctgcaggcacaaatgaaggacttccagcgtgagttagaggacgcacgcgcatctcgggacgaaatttttgccacagctaaggagaacgaaaagaaggccaaaagcctggaggccgaccttatgcagctgcaggaggatcttgctgctgctgagagggcacgcaaacaggcggatcttgaaaaggaggaactggccgaagagttggcatcttcactcagcggtcggaatgcgttgcaggacgagaagcgcaggctcgaggctcggatagcacagctcgaagaagagctggaggaggaacaggggaacatggaggcaatgtctgatcgtgtgcgcaaggccacacaacaagcagaacaactgagcaatgagttagccacggagaggtcaaccgcacagaaaaatgaaagcgcccgtcaacagttggaaagacaaaacaaggaattaagaagcaagctccatgaaatggagggcgcagtgaaatctaaatttaagagcacgattgccgcactggaggccaagattgcccaactcgaagaacaagtcgagcaggaagcaagggagaagcaagccgctaccaaaagccttaaacagaaggataagaaattgaaagagattctcctgcaggttgaggacgagcggaaaatggccgaacaatacaaggagcaggccgagaagggcaatgctagagttaaacagttgaaacgccagttagaggaggcagaagaagagtctcagagaatcaacgctaaccggcgaaaactgcagcgggagctcgatgaagcaaccgagagcaatgaggccatgggccgagaagttaacgcgctgaaatcgaaacttcgcggacctccacatcggaagctgcgctccgatgcacctggagaggaaacccggcctttgtcgttcctcctagagggactggaggatgtcgaactgttaaagatgcagatggttctgcggagaaaacggacgttggagacgcagacttccatggagccaaggccggtaaataagcagctgtctaccgtgctccatcatggtaagaaaactaagaaccaaaataagcaaaccaagaaaacccagcagcaacccagaacgaaacagaatcccgctgattgtacata

SEQ ID NO: 231691 - DNA, 5939 bp, Artificial Sequence
  Description of Artificial Sequence: Synthetic coding sequence
atggcccagaaagggcagctctccgacgatgagaagttcctgttcgtggacaaaaacttcataaacagtccagttgcccaggctgactgggctgctaaacgcctggtttgggtcccctccgagaaacagggcttcgaggctgccagcataaaagaggagaaaggtgatgaagtggtcgtggaactagttgaaaatggcaagaaagtcaccgtcgggaaggatgatattcagaagatgaatcctcctaaattctcaaaagtcgaagatatggcggaattgacatgcctgaatgaggcttctgtgctgcacaacctgagggagagatatttttctggcctgatttacacctactccggtttgttctgtgtggtagtgaacccatacaagcacctcccgatctacagcgagaagatcgttgacatgtacaaggggaagaaacgccatgagatgcctccacacatctatgctatagccgataccgcctaccgcagcatgctccaggatcgcgaggatcagagcatactgtgtacaggcgagtcaggcgctggcaaaactgagaatactaagaaggtgattcagtacttggccgttgttgcatcctcacataaaggaaaaaaggacacaagtatcactcagggcccttccttcgcatatggagagctcgagaaacagctgcttcaggcaaacccgattctggaggcgtttggaaatgcgaaaacagttaagaacgacaactcaagcaggtttggcaaattcatacgcattaattttgatgtcactggttacatagtaggggctaatatcgagacctatctgctcgagaagagtagggcaatacgccaagcacgggacgagcggacattccatatcttctactatatgattgcaggagcgaaagaaaagatgcgatccgacctattactcgaagggttcaacaattatactttcctgtctaacgggttcgtccccattcctgctgcacaggatgatgagatgttccaggagaccgtcgaagccatggccattatgggattcagcgaggaggaacaactgtcgatccttaaggtggtgtcttcagtgcttcaactgggcaacattgtctttaagaaggagcggaatacagaccaggcaagcatgccagacaatacggctgcacagaaagtatgtcacctgatggggattaatgttacagattttacgcgttccatcctgacccccagaatcaaagtcggtagagacgtggttcaaaaagctcaaaccaaagagcaggccgactttgccgtagaggccctcgcaaaagctacctacgaacgcctgttcagatggattctgacacgtgtgaacaaggcactcgacaagacccacaggcagggagcttcatttctagggatactggatattgccggtttcgagatcttcgaagttaactcctttgagcagctctgcatcaattacactaatgagaagctccagcagctattcaatcacacaatgtttatcctggaacaagaagagtaccaaagagagggcatcgagtggaattttatcgattttgggcttgacctgcagccttgcattgaactgattgagcgaccaaacaatccgcctggcgtgctagctcttcttgacgaagagtgctggtttcccaaagctactgacaagagttttgttgagaagttgtgcactgaacaggggagtcaccccaagtttcagaagccaaagcagctgaaggataagaccgaattcagcataattcattacgccggtaaggtagattataatgcgtccgcctggctcactaagaatatggatccattgaatgacaacgtgaccagtctcttaaacgcctcctctgataaattcgtcgccgacctctggaaagacgttgacagaatagtcggtcttgaccaaatggcaaagatgaccgaaagctctctgcctagtgcgagtaaaaccaaaaaaggaatgtttagaaccgtgggacaattgtacaaggaacagctgggcaagctcatgaccacactcaggaatacgacccctaacttcgttcgatgcattattccaaatcacgagaaaagatctggcaaattagacgctttccttgttctcgagcagttgcgctgtaacggggtccttgaagggattagaatctgtaggcagggctttccgaatagaattgtgttccaggagtttaggcaacgctacgagatcttagcagccaacgccattcccaagggcttcatggacgggaagcaggcctgtattttaatgataaaagcattggaactggacccaaacttgtatcggattgggcagtctaagatcttctttcgaacaggagtgctcgctcatctggaggaggagagagatctgaaaattactgacgtcatcatggcttttcaagccatgtgtagaggctatctagccaggaaagccttcgctaaaaggcaacagcagctaacagccatgaaagtgatccagcgaaattgcgcggcatacctgaagctgcggaactggcaatggtggcgactgttcacaaaggtgaaaccccttctgcaggtgacgaggcaagaggaggaaatgcaggcaaaggaggacgagttgcagaagactaaggagaggcagcagaaagccgaaaacgagctgaaagagctggagcaaaaacatagccagctgaccgaggagaagaaccttttgcaggagcagttgcaggctgaaactgagttatatgccgaagcagaagagatgcgggtccgcctcgccgctaagaaacaggagctggaagaaattctgcatgagatggaggccagacttgaggaagaggaagatagaggccagcagctgcaggcagagcgtaagaagatggcgcagcagatgctcgatttggaggagcagttggaggaagaggaagccgcaagacagaaactccagctggagaaggtgacagcagaggctaagatcaaaaagttggaggacgaaatcctcgtaatggacgatcagaataataaactgagcaaagagcggaagctcctggaagagcgtatttctgacttgacaaccaatctcgcagaggaggaagagaaggcaaagaacctgaccaagctgaaaaataagcacgagtctatgatctctgaattggaggtgcgcctgaaaaaagaggaaaagtcaagacaggagttggagaaactgaaacgtaaactggagggagatgcaagcgatttccatgagcaaatcgctgacctgcaagcccagattgcagaattgaagatgcagcttgctaaaaaggaagaagaattgcaagctgctttggcccgacttgacgacgagattgcccagaagaataacgcgctgaagaaaatccgggaattggaggggcacatcagcgaccttcaagaggatttagactctgaacgagcagcccgaaataaagcagagaagcagaaacgcgatctgggagaagaactggaggctttgaaaacggaactggaggacacgctggatagcacagctacccagcaggaactgagagccaagcgggaacaagaggttaccgtgctcaagaaggctttagatgaggaaacccgctcccacgaggcccaggtgcaggaaatgagacagaagcatgcccaggctgtcgaagaactaacggaacaattggagcagttcaaaagagccaaagcgaacctggacaagaataagcagacattggagaaggagaatgcagatttggctggcgaattaagagtgctggggcaggccaagcaggaagtggagcataagaagaagaaactcgaagcccaggtgcaggagctgcagagcaagtgcagtgatggagagcgagccagggcggaactgaatgataaagtacacaaattgcagaatgaggtggaaagcgtgacaggcatgcttaatgaagcagaaggcaaggcaattaaacttgccaaagacgtcgctagcctgagtagtcagttacaggatacccaggaattactgcaggaagaaaccaggcagaagctgaacgttagtaccaagctgcgccagctcgaggaggagaggaattccctccaagatcagctggatgaagagatggaggccaaacagaaccttgagcggcacatctccacccttaatatacagttaagcgactccaaaaagaaactgcaggatttcgcgagtaccgttgaggcgttggaggagggaaaaaagcggtttcagaaggagatcgaaaacttgacccagcagtacgaagaaaaggctgcagcttatgacaagctggaaaagaccaaaaaccgactccagcaggaacttgacgacttagtggttgacttggataaccagagacaacttgtgtctaacctggagaaaaagcagcgaaaatttgaccagttactggcagaggaaaagaatatttcaagtaaatatgcagacgagcgcgaccgcgctgaggccgaagcaagggaaaaagagacaaaggctctctcgctggccagagcactggaagaagcactcgaggccaaagaggaactggagcggaccaataagatgctcaaagcagagatggaggatctggtcagcagtaaagatgatgtgggtaagaatgtgcacgagctggagaagtccaagcgggcactggaaacccagatggaagagatgaaaacgcagctcgaggagttagaagacgaacttcaggctactgaagacgctaagctgcgacttgaagtaaatatgcaggctctcaaaggccagttcgagagagatttgcaggccagagatgagcaaaatgaggagaagaggcgccaactgcagcgccagcttcacgaatatgagacagagctggaagatgagagaaagcagagagcactggccgcagccgctaagaaaaagctggagggcgacctcaaggatttggagcttcaggccgatagcgcgatcaaaggtcgggaggaggcaataaagcagttgagaaaattacaagctcagatgaaggacttccagagagaactggaagatgcaagggcctcccgggatgagatctttgcgaccgcaaaggagaacgagaagaaagccaaaagcctggaggccgacctgatgcagctccaggaagacctcgccgcagccgagagggccaggaagcaggccgatctcgagaaagaggagctggctgaagagctcgctagcagtttgagcggtcgcaacgccctgcaggacgaaaaacgcaggctggaagctcggatcgcacaactggaggaagagttggaagaggagcaggggaacatggaagctatgagtgatcgcgttaggaaggcaactcagcaggccgagcagctctctaatgagctagccaccgaacggagcacggctcagaaaaacgaaagcgctagacaacagctggaacgccagaataaggaactccggtcgaaacttcatgagatggaaggagccgtcaagagtaagtttaaatcgacgatagccgcactcgaggccaagatcgctcagcttgaggagcaggtggaacaggaagccagggagaagcaggcagcaaccaaaagtctcaagcagaaagacaaaaagcttaaggaaatattattgcaggtggaagatgagaggaaaatggcggagcagtacaaggagcaggctgagaaaggcaatgcgcgtgtgaaacaactcaaacggcaactggaagaagccgaagaggagagccagcgtatcaatgctaatcgtaggaaactgcagagggagctggatgaagcaaccgagagcaacgaggccatggggagggaggtcaatgctctcaagtcaaaattgagaagggggaatgagactagtttcgtcccatctcggagatccggtggacggcgagttattgagaatgcagatggaagtgaggaggaaacagacacacgagacgctgactttaacggaaccaaggcctccgagta

SEQ ID NO: 231692 - DNA, 5837 bp, Artificial Sequence
  Description of Artificial Sequence: Synthetic coding sequence
atggcccagaaggggcagcttagcgacgatgagaaatttttatttgtggacaaaaacttcatcaacagccctgtggcccaggccgactgggccgcaaagcggttagtgtgggtcccatctgagaagcagggcttcgaagccgcatcaatcaaagaggaaaagggtgacgaggtggtcgttgaactggtggagaatggcaagaaagtcactgttggtaaggacgatatccagaaaatgaacccacctaagttcagtaaagtcgaggatatggcggaactcacatgcttaaacgaagcatccgttctgcacaatctgagagaacggtatttctcgggactgatttatacgtactccgggctcttctgcgtcgtcgtgaatccctacaagcatctgccaatctactctgaaaaaatcgtggatatgtacaaaggtaagaagcggcacgagatgccaccccatatctacgcaatagccgacactgcttaccgctctatgctacaggacagggaggatcagagtatactgtgtaccggtgagagcggcgctggaaagactgagaatacaaaaaaagtcatccagtacctggcggtcgtggcatctagccacaagggcaagaaagatacatctattacgcagggtccaagcttcgcttacggtgaactagagaagcagttgctgcaggctaaccccattctcgaggccttcggaaatgccaaaacagtgaagaatgacaattcatccagatttgggaagtttatccgcatcaatttcgatgtcacaggatatatcgtgggcgctaatatcgaaacttatctccttgaaaagtcaagggcaatccgacaggccagagatgaaaggacctttcatattttctactacatgattgctggcgcaaaggagaagatgaggtccgatctgctgctagaggggtttaataattatacatttttatccaacggcttcgtccccatcccagcagcccaggatgacgaaatgttccaagagaccgtcgaggctatggctatcatgggtttctctgaggaggaacagctgagtatattaaaggtcgtctctagcgtgctgcaattaggcaacatagtgttcaaaaaagagcgcaataccgaccaagccagcatgcctgataacacggccgctcagaaggtctgccacctcatgggaatcaacgtgacagatttcacacgatccattttgacaccacgcatcaaggttggccgagatgtggtgcagaaggcccagactaaagagcaggccgactttgctgtcgaggcactggccaaggctacctacgaacggctgttccgatggatcctgactcgtgtcaataaggctctggacaaaacacaccgtcagggggctagtttcctggggatcctcgacattgcaggttttgagatcttcgaggtgaatagtttcgagcagctctgtataaactacactaacgagaagctgcagcagttgttcaaccacacaatgtttatactggaacaggaggaatatcaacgggaaggcatcgagtggaactttattgattttggccttgatctccagccctgcattgagctaatcgaacgccctaataatcctcccggtgttctggccctcttggacgaagagtgctggttccccaaggccactgataagtccttcgtggagaagttgtgcacggaacagggatcccaccccaaattccaaaaacctaaacagctcaaagacaagacagagttctctataattcattacgcaggaaaggtggactataacgcctccgcctggctaaccaagaatatggatcccctgaatgataatgtgacatcccttctgaacgcctccagtgacaagtttgtggcagatctctggaaagatgtcgacaggatagttggcctggatcagatggccaagatgaccgagtcgagcctgcctagcgcaagtaagacaaaaaagggcatgtttcgcacagtgggccagctgtacaaagaacaattaggaaaactaatgacaactctccgcaacactacccccaatttcgtcaggtgtattattcctaaccacgaaaagagaagcgggaaacttgacgctttcctcgtgttggaacagctgcgctgcaatggggtcctggaaggcatccgcatttgtagacaagggtttcctaatcgtattgtcttccaggagtttagacaaaggtatgaaatactggccgctaatgctatccccaaaggattcatggatggtaagcaagcatgcattctcatgatcaaggccctggagttggatcctaatctgtatcgaatcggacaaagcaagatcttcttccgtaccggcgtactggcacatctcgaggaagagcgggaccttaagatcacggacgtaattatggctttccaagcgatgtgccgtggttacttagccaggaaagcttttgccaaacgccagcagcagttaacagccatgaaagtgatccagcgcaattgcgccgcttatctgaagctgaggaactggcaatggtggcgcttattcaccaaggtaaagcccttactgcaggtgacaaggcaggaagaagagatgcaagcaaaagaagatgaactccagaagaccaaggaaaggcaacagaaggccgaaaatgaactgaaggagttggaacagaaacactcccaattaacagaagaaaaaaacctgctgcaggagcagctacaggccgagactgagttatatgcagaggccgaggaaatgagggtacggctggccgcaaagaagcaggagctagaggagatcctgcacgaaatggaggcccgtctggaggaagaggaggatcgaggacagcaactgcaggctgagagaaagaagatggcccagcaaatgcttgacttggaggagcagctagaggaagaggaggcagccaggcagaaactccaactcgagaaggtaaccgcagaggccaagatcaagaagcttgaggacgagatcctggttatggatgaccagaacaataagctgtctaaggagcgcaagctgctcgaggagagaatctcagatctgaccaccaacctggccgaggaagaggagaaggcaaagaatctgacgaagctcaaaaacaagcatgagtctatgatcagcgagctagaggtacggctgaaaaaagaagaaaaaagccgccaggaactcgagaaacttaagagaaaacttgagggagacgcatcagacttccacgagcagatcgcagacctgcaggcccagatagccgaactgaagatgcagctggccaaaaaggaagaggaactgcaggctgctcttgcacgccttgatgacgaaatcgcgcagaaaaataatgccctaaagaagattcgcgaactagaaggacacatctcggaccttcaggaagatctggacagcgaacgcgctgcccgaaacaaggcggagaaacaaaagcgcgaccttggcgaggagctcgaggctttgaagactgaactcgaggataccctggattccacagccacccagcaggagctcagggctaaacgtgagcaagaggtaacggtcctaaagaaagcacttgatgaagaaactcggtctcatgaggctcaagtgcaggagatgcggcagaaacacgcccaggcagtggaggagctcaccgagcagctcgagcaattcaagagagctaaagctaacctggacaagaacaagcagactctagagaaagaaaacgcggatttggccggagaactacgcgtgctgggacaagctaagcaggaagttgagcacaagaagaaaaaattagaggcccaggtgcaggagcttcagtcgaagtgttccgacggtgagagagcccgtgccgagctgaacgataaggtgcacaaacttcagaacgaggtggaaagcgttacgggcatgctgaatgaggcagagggaaaagctattaaactcgctaaggatgtagcaagtctgagttctcagctgcaggatacccaagagttgctgcaggaggagactagacagaagctcaatgtctcaacgaagctgcgccaactagaggaagagcggaacagtttacaggatcagctggatgaagagatggaggccaagcagaacttggagcggcacatctcaaccctcaacatacagctgtcagatagcaagaagaaactgcaggatttcgcctctactgtggaagccctcgaggagggaaagaagcggttccagaaagagatagaaaatctcacccagcaatacgaagaaaaggcagctgcatacgacaaactggagaagactaaaaacagacttcagcaggagctagatgatctagtagtcgacttagataatcaacggcagctggttagcaatctcgaaaaaaagcaaagaaagttcgaccagctgttggcagaagagaaaaatatatcctcaaaatacgccgacgagcgggaccgtgccgaggccgaggcgcgtgaaaaggagaccaaagccttgagtttagctcgtgccctagaggaggctcttgaagccaaggaggagctggaaaggacaaacaagatgctgaaggccgaaatggaagacctggtttccagcaaagacgacgttggcaagaatgtgcacgagctggaaaagtcaaaaagggccttggagactcagatggaagaaatgaagacccagctggaagaactcgaggacgagcttcaggcaaccgaggatgcaaagctgcggttagaagtgaatatgcaggccctcaagggccagttcgagcgggatctccaagcccgtgatgaacagaatgaggaaaaacgcagacagctccagcgccagctgcatgagtacgagacagagctggaggatgaaagaaaacagcgggctctcgccgctgctgcaaagaaaaaactcgaaggggatcttaaagacttggagcttcaggccgactccgccattaaaggacgcgaagaagccattaaacaactgaggaaactccaggcccagatgaaggatttccagcgcgaactcgaggacgctcgtgcctcaagagacgaaatttttgccacagcaaaagagaacgagaagaaggcgaaatctctggaagctgatctgatgcagctccaggaagacctcgctgctgcagagagagctaggaaacaagccgacttagaaaaggaggagttggccgaagagctggcctcctcactttcagggaggaacgccttacaggacgagaaaagacgactagaagcacgaattgcccagctggaggaggagttagaagaggagcaagggaacatggaggccatgtcagaccgggtccgaaaggccacacagcaggcagagcagctttctaatgaacttgccactgaacgtagcacagcccagaaaaatgagtcagcccgtcagcagcttgagaggcaaaacaaggagctccgaagcaaactacatgaaatggaaggggctgtgaaatccaagtttaagtccacaatcgccgcactcgaggccaaaatcgcccagctggaggagcaggttgagcaagaggcaagagagaaacaagccgctaccaagtctctcaaacaaaaggacaaaaagctcaaggagatcttgctgcaggtggaagacgaaaggaaaatggctgagcaatacaaagaacaggccgaaaaaggaaacgcacgggtaaaacaactgaaacgccagctcgaggaggccgaagaggaatcacagcgaattaatgcaaatcggcgtaagttgcagcgagagctagatgaagctaccgagtcgaatgaggccatgggcagagaggtgaacgcgctgaagagcaagctgagaggccctccaccacaggagaccagtcagta

SEQ ID NO: 231693 - DNA, 5817 bp, Artificial Sequence
  Description of Artificial Sequence: Synthetic coding sequence
atgtcttccgacgcagagatggcaatcttcggtgaggctgccccttaccttcggaagccggaaaaggagcgcatcgaagcacagaaccgtccgttcgactcgaagaaagcttgttttgtcgcagataacaaagaaatgtacgtcaaaggcatgatccagacacgtgaaaatgataaggttatcgtcaagacactcgacgataggatgctgaccctgaataatgatcaagttttccccatgaaccctccaaaatttgacaagatcgaagatatggccatgatgacacatcttcatgagcccgctgtgttgtacaacttgaaagagaggtatgccgcatggatgatatacacttacagcggcctgttctgcgtaacggtgaatccgtataaatggctgcctgtctacaagccggaggtcgtcgccgcatatcgaggaaagaagagacaggaagcccctccccacatctttagtatttccgacaacgcgtaccagttcatgctcaccgaccgtgacaaccagagcatactaattacaggtgagtctggggcaggtaaaacagtcaacaccaaacgagtgattcagtactttgctacaattgccgttactggggataagaagaaagaaactcaaccgggaaagatgcagggcactctagaggatcagattatacaagcaaatccgctgcttgaggcctttgggaacgcaaagacggtaagaaatgacaattcttccagatttggaaaatttatcaggatacatttcggcgctaccgggaagctagctagtgctgacattgagacctatctgctggagaaaagtcgtgtgacctttcagctctctagcgagcgctcttatcatatcttctatcaaatcatgtccaacaaaaagcccgagcttatagacctcctgctgatatctaccaaccctttcgatttcccatttgtttcccagggggaggtgaccgtggcttcgatcgacgacagcgaagaactcctggcaaccgataacgcaatcgatatcctgggcttctcttctgaggaaaaggtcggaatttataaactgacgggtgccgtcatgcattacgggaacatgaagttcaagcagaagcagcgcgaggaacaggcagagccagatgggacagaagttgctgacaaggccggatacttgatgggcttaaattcagctgaaatgttaaaggggctgtgttgtcctagagttaaggttggcaacgagtatgtgacaaagggccaaaacgtgcagcaagtcacaaattctgtaggagctctcgcgaaggcagtgtatgaaaaaatgtttctgtggatggtaactcggattaatcagcagttggatactaaacaacctagacagtacttcatcggagtgctagacattgccggtttcgaaatatttgacttcaattctctggaacagttgtgtatcaatttcaccaacgagaagctccaacagttcttcaatcatcacatgtttgttctggagcaagaggaatacaaaaaggagggcattgaatgggagttcattgatttcggaatggatctggccgcttgcatcgaactcatcgagaaacctatggggatcttctccatcttggaggaggaatgtatgttcccaaaggccaccgatacgtcctttaaaaataaactctatgatcaacatctcggtaagagtaataatttccaaaagcccaagccagccaaagggaaggccgaggcacatttttctctggttcactacgctgggactgtggactataacatcgccggatggctcgataaaaataaggatccattaaatgaaactgtggttggcctttaccaaaagtcgtccctcaagttactctcgttcctcttctctaattacgctggtgccgagacaggggatagcggtgggtccaaaaaagggggaaaaaagaagggatcgtcattccagacagtctccgccgtgtttcgggaaaacctaaacaaattgatgaccaatttgcggtcgacacacccccactttgtgcggtgtctcattcctaacgagacaaagactcctggggtaatggaccactacctcgttatgcaccagcttcggtgcaatggggtgctggaaggtattaggatctgccggaaggggtttcctagtcgaatactctacgcggatttcaaacagaggtacaggatccttaatgcctccgcaatacctgaggggcagttcatcgattccaaaaacgcatcggagaagcttctgaacagcatagacgtcgaccgagaacagttcagattcggtaacaccaaagtgttcttcaaggcaggactcctgggcctgctggaggaaatgcgagacgagaagctggtgactcttatgacctccactcaagcagtgtgccggggatacctcatgagagtagaattcaagaagatgatggaacgaagggatagcatattctgtatacagtacaatatccggtccttcatgaacgtgaagcattggccctggatgaatctctttttcaagattaagcccttattgaaaagtgccgaggctgaaaaagagatggcgaccatgaaggaggatttcgagaggaccaaagaggagctcgctcggtcagaggcccgtcgtaaggagctggaagaaaaaatggtctccctgcttcaggaaaaaaatgacctgcagctgcaagtgcaatccgagacggagaacttaatggacgcagaggaacggtgtgaagggctaattaagagcaagattctgctggaggctaaggtgaaagagttgacagagaggctagaggaggaggaagagatgaactctgagctagtggccaagaagcggaacctggaggacaaatgtagttctctcaagagagatatagatgacctggagctaacgctcaccaaggtcgagaaggagaagcacgcaactgagaacaaagtgaagaacttatccgaggagatgacagcacttgaggaaaacattagtaaactgacaaaggagaaaaaatcactccaggaggcacatcaacagacgcttgatgacttgcaagttgaggaggacaaagtcaatgggttaatcaaaatcaacgcaaaactggaacagcagaccgacgatctcgaaggtagcctggagcaggaaaaaaaattacgtgcagacctcgaacgcgctaagaggaagctggagggagacctgaagatgtctcaggagtccattatggatctggagaacgataagcagcaaatcgaggagaagctcaaaaagaaagagttcgaactgtcgcaactgcaagccaaaatcgacgatgaacaagttcacagcttgcaatttcagaagaagatcaaggagctgcaggctcgcattgaggaattagaagaagagatagaagcagagcataccctgcgcgctaaaattgagaaacagagaagcgacttggctagggaactggaagagatatctgaaagactcgaagaggcttccggagcaacctcagctcagattgaaatgaataagaaaagggaggctgaattccaaaaaatgagacgggatctggaggaggctacattgcagcatgaagccactgctgcaacactaagaaagaagcaggcggactcggtcgccgagctgggcgagcagatcgacaacctccagcgggttaagcagaagctggagaaggagaaatcggaattgaagatggaaatagacgacatggctagtaatattgaggccctgtctaagtcgaaaagtaatatcgagcgaacctgcagaactgtcgaagaccaatttagtgagatcaaggcaaaggacgaacagcagacgcagcttattcatgacctaaatatgcagaaggccagactccagacgcagaatggcgaactgagtcatagagtagaggagaaggagtctcttatatcgcagttaacgaagtccaaacaagcacttacccagcagctcgaggaattaaagcgccaaatggaggaagaaaccaaggcaaaaaacgccatggctcacgcattacagagctccagacacgattgtgacctgctcagagagcaatatgaggaggagcaggaggcgaaagcagaactgcaacgggctctttcaaaggccaactccgaagtggcccagtggagaactaaatacgagacagacgccatccagagaacagaggaactcgaggaggctaagaagaagctcgctcaaagattgcaggaggccgaagaaaacaccgaaacagctaattctaagtgtgcttccctggagaagaccaagcagcggctccagggagaggtcgaggatctcatgcgagatctcgagcgctcccacacggcttgtgccacactcgacaagaagcaaagaaatttcgacaaggtcctcgcggaatggaagcaaaagctagatgagtcccaggctgagctggaggccgctcagaaggaaagcagaagtttgtccacagagcttttcaaaatgcggaatgcctatgaagaggtagttgatcaactggaaaccctcagacgggagaataaaaaccttcaagaagagatctcggaccttacagagcagatcgccgagacaggcaaaaaccttcaagaagccgaaaagacaaaaaaattggtggagcaagaaaagtccgatctgcaggtggcactcgaggaggttgaaggatcactggagcacgaggagagcaagattctgcgtgtgcaattggagctgagccaagtcaagagtgaacttgacaggaaggttattgagaaggatgaggaaattgagcagctcaaacgcaattcccagagagccgctgaagcattacagtctgtgctggacgcagaaataaggagtaggaatgacgctctgcggttgaaaaagaagatggaaggcgatctgaatgaaatggagattcaactcggccattccaaccgccagatggctgagacgcagaagcacttacgtacagttcagggacagcttaaggacagccagctgcatctggatgacgcacttcggtccaacgaggatctgaaggaacagctcgcgatagtggagcgacgaaatggcctgctgctagaggaattggaggagatgaaagtcgccttggaacaaactgaacggactcgtaggttaagtgaacaagaactattggacgccagtgaccgggtgcagcttctccactctcagaacacttctctgattaacactaagaaaaagcttgaagccgacatcgctcagtgccaggcggaagtggagaactcgatccaggaatcaaggaatgctgaggaaaaggccaaaaaagctatcactgacgccgctatgatggcagaagagttaaaaaaggagcaagatactagcgcacacctagaacgcatgaaaaaaaacctggaacagaccgtgaaggacctgcaacatcgactcgatgaggcggaacagctcgcgctcaaaggcggaaaaaaacagattcagaaactcgaaaatagggtcagagaactggagaatgaactggacgttgagcagaagcggggtgcagaagcactaaagggcgctcacaagtatgagagaaaggtcaaggagatgacgtatcaggccgaggaggatcataagaatattctgagattacaggacttggtggacaagctccaggctaaagtaaagtcttataaaagacaggcagaagaagctgaggaacaggctaatacccaactttcgcgatgcagacgagtacaacacgagcttgaagaagcagctgagcgggctgacatcgctgagtcccaagtcaataagttaagagccaagtctagagacgtcggtagtcagaagatggaggagtat

SEQ ID NO: 231694 - DNA, 2001 bp, Artificial Sequence
  Description of Artificial Sequence: Synthetic coding sequence
atgctttcccatatgctgtataagaaagagaacgccattgacatcctggggtttagctctgaagaaaaggttggtatttataagctcacaggagctgtgatgcactacgggaatatgaaatttaaacagaagcagcgcgaagaacaggctgaaccagacggtactgaagtagcggacaaagctggttacctcatgggactgaatagcgcggaaatgttgaaaggtctgtgttgccccagagtcaaagtcggaaatgagtatgtcacgaaaggccagaatgttcagcaggttacaaattcagttggcgcactggcgaaagctgtatacgaaaaaatgttcttgtggatggtgactagaattaatcagcagctggataccaagcagcctcgccagtatttcatcggggtgctggatatcgccggattcgaaatcttcgattttaactctctcgagcaactgtgtattaatttcacgaatgagaagctgcaacaattttttaatcaccatatgtttgtcctggaacaagaggagtataagaaggagggaattgagtgggaatttatcgattttgggatggacctcgctgcctgtatcgaactcattgaaaaacccatgggcatcttttcaattctggaggaggaatgcatgttcccgaaagcaacagatacatcatttaaaaacaagctatacgatcagcacctcgggaagtccaacaacttccagaagccgaagcccgctaaaggaaaagcggaggcccacttttcactggtgcattatgcaggaactgttgattacaacattgccggttggttggacaagaataaagatcccctgaacgagactgtggtcggactttaccagaaaagtagcctcaagctgctcagcttcctgttctccaactacgcgggtgccgagaccggagactcaggtggtagcaagaaggggggtaagaagaaggggagctcattccaaaccgtcagtgccgtgtttcgagaaaacctgaacaaactgatgaccaacctgcggtcaacgcacccacacttcgtgcgctgccttatacctaatgagacgaagactcctggcgtaatggatcattatctcgtaatgcaccagctccgctgtaatggagtgttggaggggatcagaatttgccgcaaaggttttccatcgagaatcctctatgccgattttaagcagagatacagaatcctcaacgcgtctgccatacccgagggccagttcattgactctaagaacgcctccgagaaactcctcaacagtatcgacgtcgatcgggagcagttccggttcggcaacactaaggtgttctttaaagccggactactgggcttattagaggaaatgagggacgaaaagctggtcactttgatgacgtctacccaggcggtgtgtagaggctatctgatgcgggtcgagttcaagaagatgatggaacgaagggactctatcttctgcattcaatataacatcaggagcttcatgaacgttaaacattggccatggatgaacttattttttaagataaagcctttgctgaagagcgctgaggcagagaaagaaatggcgacaatgaaggaagatttcgagcggacaaaagaggaactggcacgtagcgaggcaaggaggaaagagctgaccgagaggctggaggaagaagaggagatgaatagtgaactcgtagctaagaagcggaaccttgaggataaatgctccagtcttaaaagggacattgacgaccttgagctgacgctgacaaaggttgaaaaggagaaacacgccaccgagaacaaggtgaagaacctcagtgaagagatgactgcgctcgaggagaacataagtaagcttaccaaggaaaagaaatccctgcaagaagcacatcagcagactttggacgacctccaggtggaggaagataaagtcaacggccttatcaagatcaacgcgaagctcgaacagcaaaccgacgacgaaggggtttag

SEQ ID NO: 231695 - DNA, 6111 bp, Artificial Sequence
  Description of Artificial Sequence: Synthetic coding sequence
atggctgccgtcacaatgagtgtgcccggacgcaaagctccccctagacccggacccgtgccagaagccgctcagccgttcctgttcacgccacggggtccttcagccggaggcggacctggttcaggaacttcgccccaggtggagtggaccgccagacggttggtctgggtgccgtcggagctccacgggttcgaagctgctgcgttacgtgacgagggagaggaagaagcggaagtcgaactggctgagagcggcagaagactccggctgcccagagatcaaatccaacggatgaacccacccaaattttctaaagcagaggacatggccgaactgacctgcctcaatgaagctagcgtgctgcacaacttgcgggaaagatactattcgggcttgatctacacctacagtggcctgttctgcgttgtgatcaatccgtacaaacaattgccaatctacacagaggctatcgtagagatgtatcgaggtaagaagagacacgaggtcccccctcatgtctacgccgttaccgagggtgcctatcgatctatgctgcaagacagggaggatcaatcaatcctgtgtactggggaaagcggcgcagggaaaactgagaacacaaagaaggttatccagtacctcgctcacgtagcctccagccccaaaggtcggaaggagccaggagtgcctgcctcagtgagtactgtgagttatggtgaactcgaacgtcagctccttcaggcaaacccgattctggaagctttcgggaacgccaaaaccgtgaagaatgataatagttctcggtttggtaaattcattagaattaacttcgatgttgctggttatatcgtaggtgccaacattgagacgtacttactagaaaaaagccgggcaatcaggcaggccaaagatgaatgttccttccacatcttttatcagctgctcggtggcgctggggagcagctgaaagccgacctgctgttagagccttgtagccattatcgctttcttacaaacggaccctcctcgtccccagggcaggagcgcgagctatttcaggagacattggagagtttgcgggtcctgggctttagccacgaagaaattatatctatgttgcgcatggtctctgctgtgctacagtttggaaacatcgcactgaaacgagagcgaaataccgatcaagcgacaatgcccgataacactgctgcccaaaaattgtgtcgcctcctggggctgggagttactgacttcagcagggcgttactcacccccagaataaaggttggaagggactacgtgcaaaaagcccagacgaaagaacaagccgatttcgccctcgaggctctggccaaggcgacctatgagcgactgtttcggtggctggttctgcgcttgaatcgagctctagacaggtctccaaggcaaggcgcatcattcctcggaatcctggacatcgcgggatttgaaatattccaacttaattccttcgaacagctctgtattaactacactaatgagaaacttcagcagctcttcaaccacacaatgttcgttctagagcaggaagaataccagagagagggcataccctggacttttctggattttggtttagacctgcaaccttgcatcgacttgatcgaacgtcccgctaacccaccgggactcttggctcttctggatgaagagtgttggtttcctaaggcgaccgataagagcttcgttgagaaagtcgcacaagaacagggcggacatccgaagtttcagcgacctcgccacttgcgtgaccaagcagacttttcagtgctgcactacgccggaaaagtcgattacaaggcgaatgaatggctaatgaagaacatggatcctctaaatgataatgtggcagcccttctgcatcaatcgacagacagactaacagctgagatttggaaagatgaacatggtgggttccagcagtttagcttcctgggttctttccccccatctcctcctggtagtgctgagagatgttctagtgccatatcgcctcccggtgtggagggaatagtgggcttggaacaggtcagtagcctcggcgatgggccacctggcggtaggcccaggcggggtatgttccggactgtgggacagctctataaagagagtttatctaggttgatggcaaccctcagcaacactaatccctcattcgtacggtgcatagtgcccaatcacgagaagagagctggcaagctagagcccagactggtgcttgaccagctcaggtgcaacggtgtactggagggcattagaatatgtagacagggcttccctaacagaatcctgttccaagagttccgccagaggtacgaaatcctgactccaaacgccattccaaagggattcatggacggtaagcaggcatgcgagaaaatgatccaggcgctggaactggacccaaacttataccgggttggtcagagcaagatctttttccgcgcaggcgtcctcgcccaacttgaggaggagcgagacctaaaggtgactgacatcatcgtgagcttccaggccgctgctcgcggttacctggccagaagagcatttcaaaaaaggcaacagcagcagagcgcccttagagtgatgcagcgaaactgcgcagcctacttgaagctgcgtcactggcagtggtggcgcctgttcacaaaagtgaagccacttctgcaagtgacccggcaggatgaagtgctgcaggccagggcccaagaactccagaaagtgcaggaattgcagcaacagagtgctagggaagtgggcgagcttcaggggagagtcgctcaattagaggaagaacgcgctcgcctcgctgaacagctccgcgcagaggcggaactgtgtgcagaagcggaagaaactcgtggacggctggcggcacggaagcaggagctggagctcgttgtgagcgagctcgaagccagggtgggcgaggaggaagagtgtagcagacagatgcagaccgagaaaaaacgcttacagcagcacatccaagaactggaagcacaccttgaggctgaggaaggagctcgacagaagctccaactagagaaagtgacgaccgaggccaagatgaaaaagttcgaagaagaccttcttttgcttgaggaccagaacagtaagctgtccaaagagagaaaactgcttgaagatcggcttgctgagttttctagccaggctgcagaagaagaggaaaaggttaaaagtctgaataaactgcgtctcaaatatgaggccacaatcgcagacatggaagatagactgcgcaaggaggagaaagggagacaagagctagagaaactgaagcgtagactggatggtgaatcatcagagctgcaggaacaaatggtcgagcagcagcaacgggcagaagagctaagagcccagctgggcaggaaggaggaggaactgcaggcagcgctagccagagcggaggacgagggaggagcgagggctcagcttctgaaaagcctgagagaagcacaggcagcactggctgaagcccaggaggatctggagtccgaacgggtcgcccgaaccaaagctgagaaacagaggagagacctgggcgaggaattggaggccttgcgaggtgaactggaggatacattggactcaacaaatgctcaacaagagctccgcagtaagcgagaacaggaagtgactgagctgaaaaaaaccctcgaggaggaaactaggatccatgaagcagcggtgcaggaactgagacagagacacggacaggcactgggagagttagctgagcagctcgagcaggccagaagggggaagggagcatgggagaaaaccagacttgccctcgaggccgaggtttcagagctccgagcagaactttcctctctgcaaacagcacgacaggaaggcgagcaaaggaggcgccgtcttgagttacagctacaagaggtacaaggaagagctggggacggggagcgggctcgtgccgaggcagccgaaaaactgcagagagcccaggcggagttggagaacgtctcgggtgccctgaacgaggctgaatccaaaaccatccggctgagcaaggagctaagctcaaccgaagctcagctccatgacgcccaggaacttttacaggaagagactagggctaagctcgccttggggtcaagagttcgtgccatggaggctgaggcagcaggccttcgggaacagctggaggaggaagccgcagccagggagcgtgcaggacgcgaactgcagacagcacaggcccaactgagtgagtggcggcgacgtcaggaggaggaagccggagctctggaagcgggagaggaggctagacggagggctgctcgggaggcagaagccctgacgcagaggttggctgaaaagaccgagacagtagaccgactggagaggggcaggcgcagactgcagcaagaacttgacgacgccaccatggacctggagcagcaaagacagctggtctcaacccttgaaaaaaagcagcgtaagttcgaccagctgcttgcggaagagaaagccgctgtacttcgtgccgtggaagagcgcgagagggctgaagccgagggaagagaacgtgaagctagggccctcagtctgacaagagccctcgaggaagagcaggaggctcgagaagagctggagagacagaaccgtgcgctgcgcgctgaactggaggctctgctttcttccaaggatgacgtgggaaagagcgtccacgaactcgagcgcgcatgccgcgtagccgagcaagccgcaaatgacctgcgcgctcaggttaccgagctcgaagatgagctgactgctgcagaggatgctaagctcaggctagaggtcaccgtgcaggccttgaagacccagcacgaaagagaccttcagggcagggatgaggctggggaggagcggagacggcaactcgccaagcaactcagggacgctgaggtcgaaagggatgaggaacgaaaacagcgaactcttgcggtggctgccagaaagaagctcgagggtgagctggaagagctcaaggcccaaatggctagtgccggacagggaaaggaggaggctgtcaagcagctgagaaaaatgcaggcacagatgaaggagctgtggcgggaggtggaggagacacggacatctagggaggagatcttttcgcagaatcgtgaaagcgagaagagactgaagggcttggaggctgaagtcctacgcctgcaggaagaactagccgctagtgatcgagctaggcgacaagcccagcaggaccgggacgaaatggcggacgaagtcgcaaatggaaatttatcgaaggctgcgatccttgaagagaagcgccaactcgagggcaggctgggccaactggaggaggaactcgaggaggaacagtccaattctgaactcttgaatgataggtacaggaagcttctcctgcaggtggaatcattgactaccgagctgagtgcggagagatccttctccgctaaggcagaaagcgggaggcaacagttggagcgccagatccaagaactgagaggcaggctgggcgaggaggacgccggtgcccgtgccaggcataaaatgacaatcgctgctctggagagcaagctcgcccaggcagaggaacaactggagcaggagaccagggagcggatcctgagcggcaagctggttcggagggccgagaaaagactcaaagaggtcgtgctgcaggtagaggaagagagacgagtggcagatcagctgagagaccaactcgaaaagggaaaccttagagtgaaacagttgaaaaggcagttggaggaggctgaggaggaagcgagccgcgcacaggctgggagacggagactgcagagagagctcgaggacgtgactgaatccgctgaatccatgaacagagaggtgacgacgctacggaaccggctcagaaggggccctcttacattcacaacaaggactgtgagacaggtcttccggctggaggagggagttgcgagcgacgaggaggctgaagaagcccaacccggatctggacccagtccagagcctgagggtagcccaccagctcatccacagtat

SEQ ID NO: 231696 - DNA, 4437 bp, Artificial Sequence
  Description of Artificial Sequence: Synthetic coding sequence
atggcagcggtgaccatgtccgttcctggcaggaaggccccaccacgtcctggacccgtgccagaggctgcccaaccttttctctttactccacggggaccatctgctgggggtggaccgggtagcggaactagcccccaggtcgaatggacagccagaagattggtttgggtgcctagtgagctgcacggatttgaggccgcagcacttcgtgacgaaggcgaggaagaggcagaagttgaactggccgagagcggccgaaggctccgtctccccagggatcagatccagcgcatgaaccctcctaaattctctaaggccgaagatatggctgagctcacctgcctaaacgaggcgtcggttttacataaccttcgcgagcgttactactctggtctgatatacacttattctggactgttttgtgttgtcattaacccttacaagcagctcccaatatatacagaggccatcgtggaaatgtataggggcaagaaacgacacgaagtacccccacacgtgtacgctgtgacagagggcgcttacaggagcatgcttcaagatcgggaggatcagtctattctctgtactggggagagcggggcaggaaaaaccgagaacaccaaaaaagttatccaatacctggctcatgtcgcgtcgagccccaaggggaggaaagaacccggagttcctggggaactagaacgccaactccttcaggctaatccaatcctggaggctttcggcaacgcgaaaacagtaaaaaatgataactcaagtagatttggcaagttcatcaggattaatttcgatgttgccggatatattgtcggcgcaaacatcgaaacctatctactcgagaaaagcagggcaataaggcaggcaaaagacgagtgtagtttccacatcttttatcagctgctgggtggagccggagaacagcttaaagctgatcttctactggagccctgctcacactatcggttcctgaccaacggtccctctagtagtcctggccaggagagagaactctttcaggaaactctggagagtctccgcgtgttagggttttcccatgaggaaattatctccatgctgagaatggtcagcgccgtgctgcagtttggcaacatagcgctgaagcgcgagcgcaataccgatcaagccacgatgcctgataacaccgccgctcagaaattatgtcgccttctgggcctgggtgtgacagacttttcacgcgctctgttgacccctcgcattaaggttggcagagactacgtacagaaggctcaaacgaaggagcaggcggatttcgccctggaagctctggctaaggctacttacgagagacttttcaggtggctggttttgagactcaacagggctttggaccgaagccctcgacagggggcatccttcctggggatactggatatagctggcttcgagattttccagcttaactctttcgagcagctgtgcatcaactatactaatgaaaagctgcagcagctgtttaatcacactatgtttgtcctggagcaagaagagtaccagcgcgagggtatcccatggacattcctcgatttcggccttgacctccagccctgtatcgacctgatagagagacccgctaaccccccaggcttgctggcactgctggacgaggagtgttggttcccgaaggccaccgataaaagcttcgtagagaaagtggcacaggagcaggggggtcatcccaagtttcagagaccaaggcatctgcgggatcaggcggacttctccgttctgcactacgccggaaaagtggattataaagctaatgaatggctcatgaaaaacatggaccctcttaatgacaatgtcgcagccctattgcaccagagcaccgaccgcctcactgccgagatctggaaggacgtcgagggcatcgttggtctggagcaggtgagcagcctgggtgatggccctcccggtgggcgacctaggcggggaatgttcagaaccgtcgggcaactctacaaggagtctctaagtcgcctcatggccactttgtcaaacaccaatccaagctttgtcaggtgcattgtcccgaatcatgagaaaagagcgggaaaattggaacccagactggtcctggaccagctgaggtgtaatggcgtgctggaaggaatcaggatatgtcgtcagggtttccctaaccgaattctgttccaagagttccgccaacgctacgaaattctcacccccaacgccatcccgaaaggtttcatggacggaaaacaggcatgcgagaaaatgatacaggcgctggagttagatcctaatctttaccgggttgggcagagcaaaatcttctttcgcgctggagtgctcgcgcagcttgaggaggaacgcgatttgaaggtaactgacattattgttagtttccaggccgcagccagggggtatcttgccagaagagccttccagaagagacagcagcagcagtctgcccttcgtgtcatgcaacgcaattgcgccgcatatcttaaactgcgacattggcaatggtggcgcctgttcaccaaagtgaagcctctgttacaggtaacaagacaggacgaggttcttcaggcacgggctcaggaattgcagaaggtgcaggaactacagcagcagagcgctcgggaggtgggagagttacagggacgagtcgcacagcttgaagaggagcgtgctagactggccgagcagctgagagcggaagccgagctgtgcgccgaagccgaagagactcggggaagactggcggctcggaagcaggaattagaactcgtcgtgtccgaactcgaggctcgggtcggcgaggaggaggagtgttcccgccagatgcaaaccgagaagaagaggctgcagcagcacatccaggaactcgaagcacacctcgaggctgaagagggcgcacgccagaagttgcagttagagaaggtcaccactgaggcaaagatgaagaaatttgaagaggatctgttgctgttggaagaccagaatagcaagctgtcaaagtccggatcatgctggaaaatagtttggccctcctcccaccctagacagctaagaagacggaggcggagcagagcgagcatttcttacgggagcaatatgcggccacagtcccaaacttggcgggatcggctacgcaaagaggagaaagggaggcaggagctggagaaactgaagcgacgcctagacggagagtcttcagagctccaggagcagatggtggaacagcaacagcgagcagaggaacttcgggctcaactaggcaggaaggaggaagagctgcaggccgctctggcgcgtgctgaggacgagggcggagccagggcccaactccttaagagcctgcgcgaagctcaggcggcactcgcagaggctcaggaagatctcgaatcagagcgggtcgcccgtactaaggccgaaaaacagaggcgagatcttggggaggagctagaagccctcagaggcgagctggaggacaccctagattccactaacgctcagcaggagctgaggtcaaagagggagcaggaagtgactgagctgaagaaaaccctggaagaagagacgcggatccacgaagctgccgtacaggagctgagacaacgccacggacaggcactgggagagctagccgagcagctggaacaagcaagacggggaaaaggagcgtgggagaagacaaggttagccttagaagccgaagtctcagagttgcgcgctgagctctcctccctacagacagctagacaggagggagagcaacgtcggcgtcgtctggagctccagctacaggaggtgcagggcagggccggtgacggggagagagcccgagcagaagccgcagaaaaactgcagagggctcaggccgagcttgagaacgtctcaggtgctctgaatgaggcagaaagcaaaactatccggctttcaaaggagctgtcttccacggaggcccagttgcacgacgcccaagagttgttgcaagaggagacgcgtgcgaagctggcgctgggatcccgggtgcgcgctatggaagcagaagcagcgggactccgagagcaactggaggaagaggcggctgcacgcgagagagcagggcgtgagctgcagaccgcacaggcccaactgtccgagtggaggagacggcaggaagaagaggccggtgctcttgaggcaggggaggaagcgaggcggagggccgcacgcgaagcggaggcgctgactcaacgcttagctgagaagactgagaccgtggatcgtctggaaagaggcaggaggaggttacagcaggaactcgacgatgcaacactcagtccggacgctttgaccgatggagcccaacctccaagttctttggacccgacaggtccatgtccacggaaccctgccctgtag

SEQ ID NO: 231697 - DNA, 5339 bp, Artificial Sequence
  Description of Artificial Sequence: Synthetic coding sequence
atggccgcagttacgatgtctgtgcccggacgcaaggcccctccaaggccgggaccagtgccagaagccgctcaaccttttttgtttacccccagaggcccatctgctgggggagggccaggatcaggcacatcacctcaggtggaatggacggcaaggcgcctggtctgggtcccgagcgaactgcatggcttcgaggccgctgcgctgcgggacgagggcgaagaagaggctgaggtcgagctggcagagtcaggcaggcggctcaggctgcccagggaccagatccagcgaatgaacccccctaagtttagcaaggcagaggatatggccgagttgacctgcctgaacgaggcttcggtactgcacaatcttcgggagcggtattacagcggactgatttacacgtattcaggcctcttctgcgttgttattaatccctataaacagttacctatctacacagaggctatcgttgagatgtatagaggtaaaaagcgccatgaagttccacctcacgtgtatgctgtcaccgaaggcgcttataggagtatgttacaggatcgagaggaccagtccattctctgtaccggggaatcgggcgcaggaaaaacagagaacactaagaaagtaatacaatatctcgcccacgtggcttccagcccgaagggtaggaaagagcctggggtacctggcgaactggagaggcagctcctgcaggctaatccgatccttgaagctttcggcaacgccaagactgtgaaaaacgataacagctcaagatttggcaagttcatcaggataaacttcgatgtggctggatatatcgtgggtgctaatattgaaacctaccttttagaaaagagccgggcaattaggcaagctaaggatgagtgctcatttcatatcttttatcagctgctcggtggcgcaggagagcagctcaaagctgatctgcttctggagccatgctcccactatcgctttctgacgaatgggccatctagctcacccggacaggagcgtgaactttttcaggaaactcttgaatcactgagggtcctggggttcagccatgaagagattatctccatgctacggatggtgtcagctgtcctccaattcggcaatatcgcactaaagcgtgagaggaacacagatcaggccacgatgcctgataataccgctgctcagaagctctgtagactccttggactcggcgtgacagacttctcccgcgcactgctaacacccaggattaaggtgggcagagactatgtgcagaaggcacagaccaaggagcaggccgacttcgcactagaggccctggcaaaagcaacatatgaacggctgttccggtggctcgtattgaggttgaaccgcgctttggatcgcagtccaagacagggagccagttttctgggtattctggacatagccggatttgaaatcttccaactcaacagcttcgaacagctctgtataaactataccaacgaaaagttgcagcagctgttcaatcacactatgtttgtgctggagcaggaggagtaccagagagagggcatcccgtggactttccttgactttggcctggaccttcaaccgtgtatcgatctgatagagaggccggctaaccccccaggacttcttgccctgctagacgaagagtgttggtttcccaaggcgaccgataagtcctttgtggaaaaagtggcacaggagcagggcggtcacccgaaatttcagcgaccaaggcatcttagagatcaggctgacttcagtgttcttcattacgcagggaaggtggattacaaagcaaatgagtggctgatgaagaacatggaccccctgaatgacaacgtggctgcactacttcatcagagcacggatcggctgacggcggagatatggaaagatgtggaaggtattgtcgggctggaacaggtgtccagcctgggcgacggtccaccgggaggtcgacctaggcgcggtatgtttcgcaccgttggtcagttgtataaagagtctctgagtaggctgatggctacgctcagtaacacgaatcccagcttcgtcagatgcattgtgccaaaccatgagaagcgcgctggaaaactcgagccacgcttagtgttagatcagttgagatgcaacggagtactggagggtataagaatatgcaggcagggattccctaaccgtattctgtttcaggaatttcggcagcgctacgagattctgacgccgaacgctatcccaaagggcttcatggatggaaagcaggcctgcgaaaagatgatccaggccttggagctggatcccaatctttatcgggtaggtcagtcaaaaatctttttcagggcaggtgtgctcgcgcaacttgaagaagaacgggatttaaaggtcactgatataatcgtgagcttccaggcagctgcccgtggatatctggccagacgcgcatttcaaaagcgacagcagcagcaaagcgcactgcgcgtcatgcaacgcaattgtgccgcttacctcaagctccggcactggcagtggtggaggctgtttacaaaagttaagccccttctacaggtgactcggcaggatgaggtattgcaggcgcgtgcacaggaattgcagaaggtgcaggaactgcaacagcagagcgccagggaggtcggcgaactccaaggccgagtggcacagctggaggaggaaagagcacgcttggcagagcagcttcgtgccgaggcggagttgtgcgccgaagcagaggaaacccgcggaagactggccgcacgtaagcaggagctggaactcgtggtgtccgaactggaggccagagttggtgaagaggaggagtgttcccggcagatgcagactgaaaagaagcgtctgcaacaacatattcaggaattagaggctcacctggaggcggaggaaggagcccgtcagaaactccagttggaaaaagtgactacagaagcaaaaatgaaaaagttcgaggaggatcttctactgttagaggaccagaattccaaactttctaagtctggcagttgttggaaaatcgtatggccaagttcccaccctcggcagctacgaagaaggaggcggagccgggcttctatttcatacgggtcaaatatgagaccacagagccagacctggagagaccgcttgagaaaagaggaaaaaggacgacaggagctagaaaagctgaagcgcagactggatggcgagtcctctgagcttcaggagcaaatggtcgagcagcagcaaagggctgaggagctcagggctcaactgggacgcaaggaagaagaattacaagcagcgttagccagagcagaggacgaagggggagctcgggctcagctgctaaagtcccttcgcgaagcacaggcggctcttgctgaggcccaggaggatctagaatccgagagagtggcacggactaaagccgaaaaacaaaggcgggaccttggcgaagagctggaggcacttagaggagaactggaggacactctggacagtactaacgcccaacaggagttgcgcagtaagcgggaacaggaagtgaccgagcttaaaaagacactggaggaggaaaccaggatccacgaggccgcagtgcaggagctccgacagcgccacggccaagccctcggtgaattggctgagcagctcgagcaggctaggcgcggaaagggagcatgggaaaaaactaggttggcgttggaggccgaagtttccgagttacgcgctgagctcagttcactgcagacagctagacaggaaggtgagcaacggaggcgacgattagagttacagttacaggaggtgcaggggagagccggagacggagagcgagcacgagccgaggctgctgaaaagcttcaaagagcccaagccgagctcgaaaatgtcagcggagccttgaatgaagccttgctctcttccaaggatgacgtgggcaagtccgttcacgaactggagagggcctgtcgggttgccgaacaagcggcaaatgatctacgcgcacaggtaactgaactcgaagatgaactgactgcagccgaggatgccaaattgcgcctggaggtcacagtacaggccttaaagactcagcatgaacgggacctccagggtagggatgaggccggtgaagaacgcagaaggcagctcgcaaagcaactcagggacgcagaggttgagcgagatgaggagcgcaaacagcggactcttgccgtcgctgccaggaagaagttggagggcgagttagaggagctcaaggctcagatggcatcggcaggacaaggcaaggaggaagcagtgaagcagctccgcaagatgcaggcacagatgaaagagctgtggcgggaggtcgaggaaaccaggacctctagagaggaaatatttagtcaaaatcgggagtcagaaaagagactgaaaggtctggaagccgaagttctaagattgcaggaggaattagctgcgtctgaccgggcacgacgccaggcccaacaggatagggatgagatggccgacgaagtggccaatgggaatctgtctaaagcagcaatacttgaggagaagcggcaactggaagggagactaggccaattagaagaagaacttgaggaggagcagtccaattctgagcttctgaatgatcgttaccgcaaattgcttttacaagtagaatctttaactaccgaactgtccgccgagaggtcgttcagcgccaaggcagaatccggcagacaacagctcgagcgacaaatacaagagctccgaggtagacttggtgaggaagacgccggtgccagagcaaggcacaagatgacgatcgcggcactggagtcgaagctggctcaggcagaggaacaactcgaacaggaaacgcgagagcgcatattgagtggcaagctggtgcgcagagccgaaaagaggctgaaggaggtggtgttgcaggtggaggaagaaaggcgcgtcgcagatcagctgagggatcagctggagaagggcaacctgagagtcaaacagctaaagcggcagcttgaggaagccgaagaagaggcttcccgtgctcaagccggtcggaggcgcttgcagcgggaactggaggatgtaacagaatcagcggaatctatgaatagggaagtgaccactctacggaatagactacgacggggtccactgacattcactacccgaactgtgcgacaagttttccgactggaagagggagttgccagcgacgaagaggccgaggaggctcaaccaggaagtggcccttcgcctgagcctgagggaagcccgcctgcccatccccaata

SEQ ID NO: 231698 - DNA, 6086 bp, Artificial Sequence
  Description of Artificial Sequence: Synthetic coding sequence
atggctgccgtaaccatgagcgtgccaggacggaaggccccacctaggcccggaccagtacccgaggccgctcaaccattccttttcaccccaagggggccatctgctggtgggggtccagggtcaggaacaagcccacaggtcgagtggaccgcgcgacgattggtatgggttccttcagaactccatggcttcgaggctgccgcactacgcgacgagggtgaggaggaggctgaggtcgagctcgccgaaagcggcaggcggctgcggctgcccagagatcaaattcagcgcatgaatcccccaaaattctccaaagccgaggacatggccgagttgacatgtttgaatgaggcatccgttctccacaatcttcgtgagcgctactatagtggactgatctatacttactccggactcttttgtgtggtgattaatccttacaagcagctgcccatatacactgaagccatagttgagatgtacagaggtaaaaaacgacatgaagtgccgccacacgtatacgcagtgaccgaaggtgcttaccggagtatgctgcaggacagggaggaccaaagcatactttgcacgggtgagagcggagccggaaaaaccgagaataccaaaaaagtgatccagtatctggcacatgtggcatctagtcctaaagggcgtaaagagccgggtgtgccaggagaacttgaacgtcagttactgcaggccaatcctattctggaagcgttcggtaacgctaagaccgtaaagaatgacaactcaagccgttttggcaagttcatcaggatcaactttgatgttgcagggtatattgtgggtgcaaatattgaaacttacctactggaaaagtccagggccatccggcaggccaaagatgaatgttcattccacatcttttatcagcttcttggcggtgccggtgagcagctaaaagcagacctactgctggagccctgttctcattaccgatttttgacaaacgggccatcatccagtccaggacaggagagggagctgttccaggagaccctagagtcattacgggtgctggggttctcacacgaagagattatctcaatgctgcggatggtctctgccgtcctccaattcggcaacattgctcttaaaagggagcgcaatacagatcaggcgaccatgcctgacaacactgcagcccaaaaactgtgtagactcttaggcctgggagtcacggattttagtagggccctccttacacctcggatcaaagttggccgtgactacgtacaaaaggcccagactaaggaacaagcagattttgccctcgaagctctggctaaggcaacctacgagcggctgttcagatggttggtcctaagactgaatagagcgcttgaccgctcaccccgacagggcgcaagcttcctgggcatcttggacatagcgggattcgaaatcttccaattaaatagctttgagcagttgtgcatcaactataccaacgagaagcttcaacagctgttcaaccatactatgttcgtgctggagcaggaggaataccagagagaaggcatcccttggacattcttggatttcgggctggacctgcagccttgcattgacctgatcgaacggccagccaatcctcccggactcctcgccctcttggacgaggaatgttggttcccgaaagcgacagataagagctttgtagagaaggtggctcaagagcaggggggacaccctaaatttcagaggcctcgtcatcttagagatcaggccgatttcagtgtactgcactacgctggaaaagtggattacaaggccaatgaatggctgatgaagaacatggatccactaaatgataatgtggccgctcttctccatcagagcactgacagacttaccgcagagatctggaaagacgaacacggaggcttccagcagttttcttttctgggttcattccccccttccccacccggaagcgccgagcggtgctcgagcgcgataagtcctcccggagtggaaggcatcgtcggattggagcaagtctccagcttaggagacggacctcccggtgggaggcccaggcgtggaatgtttaggaccgttggccaactgtacaaggagtccctctctaggctgatggccactctcagcaatactaatccgtccttcgtgagatgtatcgtgcctaatcacgaaaagagggccggtaagcttgagcccagactggtcctagaccaactacgatgcaatggcgtactcgaaggtatccgcatttgcagacagggattccccaacaggattttgtttcaggagttcaggcaaagatatgagatcctgacacctaatgcgatccccaaaggcttcatggacggaaaacaggcttgtgaaaagatgattcaggcacttgagctcgaccccaatctctaccgcgtgggtcagtccaagattttttttcgagcaggtgtactcgcccagctggaggaggagagggatcttaaggtgacggacattatagtgtcgttccaggccgcagctcggggttacctggccagaagagccttccagaagaggcagcagcaacaatcagcattaagagtgatgcaacgaaactgcgcggcttacctaaaactacgccattggcagtggtggaggctgttcacaaaggtgaagcctctccttcaggtcacgcggcaggacgaagtcctgcaagcccgtgctcaggaactgcagaaagttcaggagctccagcagcagagtgccagggaagtgggggagcttcagggacgggtggcacagcttgaggaagaacgtgccaggctggcagagcagctgagagccgaagctgagctgtgtgcggaagccgaggaaacacggggaaggttagcggctagaaagcaagaattggaattggtggtgtccgagctagaagctcgcgttggggaagaagaggagtgcagccgtcagatgcagaccgaaaaaaagaggttacagcagcacatacaagaacttgaggctcacttggaagctgaagaaggtgccagacagaagttgcagctcgaaaaagtgacaactgaggcgaaaatgaaaaagttcgaagaggatttgttgctgttggaagatcagaacagtaaattaagtaaggaaaggaagcttctcgaggataggttggccgagttcagctcccaagctgcagaggaagaggagaaagtcaagagtttgaacaaactgaggttgaaatatgaggccacgattgccgatatggaggacagattgagaaaagaggaaaagggtaggcaggaacttgaaaaactgaaacggaggctggacggtgaatccagtgagctgcaggagcagatggttgagcagcagcaaagggccgaggaattgcgagctcaactgggaaggaaggaggaggaattacaggccgctctcgctcgggcagaggatgagggcggagccagagcccaactactgaagtccctccgagaggctcaggccgcactcgccgaagcacaggaggacctggaatcagagcgggtagctagaactaaagcagagaagcagcgacgggacctgggagaggagttagaggccctgcgcggtgagctggaagatactctggatagtacaaatgcccagcaagaattgcggagtaagagagaacaggaggtcactgaactcaaaaagactcttgaagaggaaaccaggatccacgaggcagctgtgcaggagttgagacagcgccacggacaagccctcggggagctggccgagcagctcgaacaggctcgaagaggaaaaggggcttgggagaagacacgactggcgctggaggcagaggtaagcgaactgagggccgagctctcaagcctgcagacagcaagacaggagggagagcagaggcggcgtaggctcgagctgcaactccaggaggtgcaaggaagggccggagacggcgaaagggctagggcggaggctgccgagaaattgcaacgcgcacaggccgaactcgaaaacgtttccggtgctttaaatgaagctgaatcgaagaccatcagactgtctaaggagctttcttcgaccgaagcacaacttcatgatgcccaggagcttctgcaggaagagacaagagccaagctggcgttaggcagcagggtcagagctatggaggcagaggccgcaggtctgagggagcagctggaggaagaggcagccgctagagagcgcgcaggcagggaactgcagactgcccaggcccaactgtcagagtggcgcaggagacaggaagaagaagccggagccctggaagcgggagaagaggccagacgcagagccgctcgggaggcagaggccttgacccaacggctcgctgagaagaccgaaacagtggacaggcttgagcgaggtagacgcagactgcaacaggagttagatgacgcaactatggacttagaacagcagagacaactcgtgagtacacttgaaaaaaagcagcgcaagtttgaccaactgctcgccgaggagaaggctgccgtcctcagggcagtcgaagagcgggagcgcgcagaagccgaaggtcgcgagagagaggcccgagcactgtctctaacaagagcccttgaggaagagcaggaggcccgtgaagaacttgaaaggcaaaaccgagccctgagggccgagctggaagctctactttcgagtaaagatgacgtaggcaaatcagtacatgagcttgagagagcctgcagggtggctgagcaagctgctaatgaccttagagcccaagttacagaattagaagatgagctgacggcagccgaagatgccaagctccgattggaggtgacagtgcaggcgctgaagactcaacacgaacgcgacctgcagggacgggatgaggcaggcgaggaaaggcggcgacagctggctaagcaactacgagatgctgaagtggagcgggacgaggagcgaaagcagcgaactctggccgtggctgctcggaagaagctcgaaggggaactagaagagctaaaggcgcagatggcatccgctggacagggtaaagaggaagcggtgaaacagctgcgaaaaatgcaggcccagatgaaagagctgtggagagaggtggaggagacgcgcacgtcgcgagaggagatattcagtcagaatagggagtccgaaaagagacttaagggcttagaggcagaggtgctacggcttcaggaagaactcgctgcatcggaccgcgcacgccgtcaagcccagcaagacagggatgagatggcagacgaagttgcaaacgggaacctgtcaaaggctgctatcctggaggagaagcgccagctggaaggacgcttgggccagttggaggaggagctggaggaggagcagtccaattccgaactgcttaacgatagatatcgtaagcttctgctgcaggtagagtccctcaccacggagctcagcgctgaaagaagcttttccgccaaggccgaatcggggcgacagcaactggagcgtcagattcaggaactgcgaggacggctgggcgaagaagacgctggcgctagggcaaggcataagatgaccatagccgcacttgaatcaaagcttgcccaggccgaggagcaacttgagcaggaaactcgagaacgcatcctctcagggaaactggtgcggcgtgcagagaaacgacttaaggaggttgtgctgcaggttgaagaggaacgtcgggtggctgaccagctgcgtgatcagttggagaagggcaacctgagagtcaaacagctgaagcgccaactggaggaagctgaggaggaagcatctagagcacaagcaggacggcgaaggcttcagagagagctcgaggatgtgacagagagtgccgagtccatgaaccgggaagtgactaccctgagaaacaggttgaggcgtggaccgcttacgtttacaaccagaactgttcggcaggtatttagactcgaagagggcgttgcatcagatgaggaagccgaagaagcccaaccgggaagcggaccctcccccgagccagaaggctctccacccgctcatccccagta

SEQ ID NO: 231699 - DNA, 6011 bp, Artificial Sequence
  Description of Artificial Sequence: Synthetic coding sequence
atggccgcagtgactatgtccgtccccggaagaaaagccccaccgaggccaggtccggttcctgaggccgctcagccctttctttttactccacggggacccagcgcaggaggcggacccggatctggtacttcacctcaggtagagtggaccgctcgacgcctggtctgggtgccaagtgaactgcatgggttcgaggcggcagcgttgcgcgatgagggtgaggaagaggccgaggtggaactcgccgagtcaggacgtaggctgcggctccctagggaccagatccaacgcatgaatcctcccaagttctcgaaggccgaggacatggccgaattaacctgtctgaacgaggcctcagtgctccacaacttaagagaacgctactactcagggctgatttacacttacagcggcttattctgcgtcgtgatcaacccatacaagcagcttccaatatacaccgaggcaatcgtggaaatgtatagagggaagaagcgccacgaagtccctcctcacgtgtacgccgtaacagagggagcctacaggagcatgcttcaggacagagaggaccaatcgatcctgtgtactggagagtccggcgctgggaaaactgagaacactaagaaagtgatccagtatcttgctcacgtggcaagttctccaaaggggagaaaagaaccgggtgtccccgcttccgtgtcaacagtgtcctatggtgaactcgagaggcaactgctccaggccaatccaattctggaggcctttgggaacgctaagaccgtgaagaatgataatagcagccggttcggaaagttcataaggatcaactttgacgtggccggttacattgttggggctaacattgaaacatacctcttggagaagagcagggcaataaggcaagccaaagatgaatgttcgtttcatatcttctatcagctactcgggggagccggtgagcaactgaaggcagatctcctccttgaaccttgctctcactataggttcctaacaaacggccctagctcatccccagggcaggaacgggagctgtttcaggaaaccctcgagtccctccgtgttcttggtttctcacacgaggagattatctctatgctccggatggtttcagctgtccttcagttcggtaacattgccctgaaacgagagcggaatactgaccaggccaccatgccagataatacagcagctcagaagctgtgcaggctgctagggctgggcgtcaccgacttctctagagcccttctgaccccaaggatcaaggtaggcagagattatgtgcagaaggcccagacaaaggagcaggcggattttgctcttgaggcactggccaaagctacatatgaacggttgttccgttggctcgtactgcggctgaaccgcgctctggaccgcagccctagacaaggagcttcattcctggggatcctcgacattgctggcttcgagatcttccagctcaattcattcgagcagctctgcattaactacaccaatgaaaaactgcaacagttatttaatcatacaatgttcgtgcttgagcaggaggagtaccagagggagggtattccttggacttttttggatttcggcctcgacctccagccatgcatcgaccttatcgagcgtcccgctaaccccccaggactcctggctctgcttgacgaagaatgctggtttccaaaggctaccgacaaatcttttgttgagaaagtggcccaagaacaaggaggccaccccaagttccaaaggccccgtcaccttcgggaccaagccgatttctccgtgcttcattacgccggaaaagttgactacaaagcaaatgaatggctaatgaagaacatggaccctttgaatgataacgtggctgccctactgcaccagtctaccgacagactgactgcggagatctggaaggatgtggaagggatcgtggggttagagcaggttagctccttaggagacgggcctcctggaggaagaccacgccgtgggatgttcagaaccgtcggccaattgtacaaagagtctttatcccgcctgatggccaccttatcgaacactaacccatcttttgtgcggtgcattgtgcctaaccacgaaaaacgcgctggaaaattggagcccaggttggttctggaccagctgagatgtaacggcgtgctggaggggatcaggatttgtcggcagggattccccaacaggattctgtttcaagagttccgccagaggtacgagatcctaactcctaatgcgattccaaaggggtttatggacggaaagcaggcctgtgaaaaaatgattcaggctctagaattagacccgaacctgtatcgagtaggccaatctaaaatcttttttagggcgggtgtcctggcccagcttgaggaggaacgggatctgaaggttactgacatcatcgtcagcttccaggcagctgcacgagggtatcttgctcggcgagcctttcagaagcgccaacagcagcagtcggcactgagagttatgcagcggaattgcgctgcctatcttaaactgcgacattggcaatggtggcgactgtttaccaaggtaaagccactgctccaagtgacaaggcaagatgaggtgctgcaggcgagagctcaggaactgcaaaaagtgcaagaactgcagcagcagtctgcacgtgaagtgggggaactgcagggacgggtggcacagctcgaggaagagagggctaggctggccgaacagctgcgggctgaagccgagctgtgtgccgaggcagaagagaccagaggaagactagctgctaggaaacaggagctggagctagtagtgtcagaactagaggcaagggttggtgaagaggaggagtgttccagacagatgcagaccgagaagaaacggctgcaacagcatatccaggaactggaagcccacttggaagctgaggagggtgctcgtcagaaacttcaacttgaaaaagtgacaacagaggcaaagatgaaaaagttcgaagaggatctgctgctgctcgaagaccagaactcaaaactgagcaaagagcgtaaactattggaggatcgtctggctgagttttcttcccaggcagccgaagaggaagagaaggttaaatctcttaataagctcaggcttaagtatgaggccaccattgccgatatggaggataggttgagaaaggaggagaaggggaggcaagaattggaaaagttgaagagaagactcgacggggagagttctgagctgcaagagcagatggtggaacagcagcagagggcggaagaactgcgcgcacaactggggaggaaggaggaggaactacaggccgcacttgctagggctgaagatgaaggcggtgccagggcacagctgctcaaaagcctgcgggaggcccaagctgcactggccgaggcccaggaagatctggaaagtgaacgcgtagctcgcactaaggccgagaagcagcgtcgggacttaggagaagagctcgaagcattgcggggagaactcgaggatactcttgattctacaaatgcccagcaggagctccgatctaaaagggagcaggaggtgaccgagctcaagaaaactttagaggaggagaccaggatacacgaggcagcggttcaggaattaagacaaaggcacggacaggctctaggggaactcgctgaacagctggagcaggccagacgcggaaagggcgcatgggagaagacccggctggcccttgaggccgaggtgagtgagctgcgcgctgaactttcaagcttacagaccgcccgacaagagggggaacaaaggcgcagacgactggagctccaacttcaggaagtgcagggtcgggctggagacggggagagggcacgggctgaggcagccgagaaactgcaaagggcccaagccgagttagagaacgtcagtggggctttgaacgaggccgagtcaaaaacaattcgactgagcaaggagctctcgtccacggaggctcagctccatgacgcccaggagttgctccaagaggagacgcgcgctaaactggcgctaggctccagggtcagagccatggaagctgaggccgcaggcttacgggaacagctcgaggaggaagcagccgctcgcgaaagagccggacgtgaactccagacggcacaggcccaacttagcgagtggcggaggcgacaggaagaggaagccggtgcccttgaggctggagaggaagctagacgtcgagccgcaagggaagctgaggcccttactcagaggctagcagagaagacggagactgtggaccggctcgaaaggggcagaaggagactgcagcaagaattagatgacgctactatggatctagagcagcagagacagctggtgtcaacacttgaaaagaagcagagaaagtttgatcagcttctggcagaggagaaggcagccgtgctcagagccgtggaggagcgcgaacgagccgaggcagaaggaagagagagggaagcacgcgcactatccctaacccgtgctctggaggaggaacaggaggcccgtgaggagttagagagacagaatagagctctgagagcggagctggaagccctcctctcaagcaaggacgacgtcggtaaaagcgttcatgaattagagcgcgcatgccgggtggcagaacaggctgccaacgacttacgcgcacaggtaactgaattggaggacgagcttacagccgctgaagacgccaagttgaggttggaggtaacagtgcaggcactgaagacacagcacgaacgagaccttcagggcagagacgaggccggagaagagcggcgtagacagctggctaagcaactgagagacgctgaagtggaacgagacgaagaacgcaagcaaagaacactcgccgtagcagcacgcaaaaagttagaaggcgaactggaggagctcaaggcccagatggcctctgcaggccaaggaaaggaagaagctgtcaagcagctgcggaagatgcaggcccaaatgaaggaactctggcgagaagtggaagagacgaggaccagccgtgaagagatcttctcacagaatagagagtccgaaaagcgactgaagggtttggaggcagaggtgctgcggcttcaagaagagttggccgctagcgatcgagccaggagacaggctcagcaagacagggatgaaatggcagatgaggtggccaatggaaacttgagcaaagccgcaatcttggaagaaaagcgtcaactcgagggcagattggggcagctggaggaggagcttgaagaggagcaatccaattcagaactactcaacgaccggtatcggaaacttctcttgcaggtcgagagtctcaccaccgaactaagtgcagagcgctcttttagcgccaaagcagagtctgggaggcagcaactggaacgccagattcaggaactgcggggaagattgggggaagaagatgctggcgctcgtgccagacataagatgactatcgccgctctggagagcaagctggcccaggctgaagaacagttagagcaggagaccagggaaaggattctgagtggtaagctcgttagacgagcagaaaagaggcttaaggaagtcgtgctgcaggtggaggaagaacgcagagtggctgatcagctcagagatcagttggaaaagggaaatctcagagttaagcagctcaagcgccagcttgaggaagcggaggaggaggcttcgcgagcccaggcaggcaggcggcgtctacaaagagaactggaggacgtgacagagagcgccgagagcatgaatcgcgaggtgacaacgctcagaaatcggcttcgcagaggaccattaaccttcactactcggactgttcggcaggtgttcaggctggaagaaggtgttgcttccgatgaggaagctgaggaggcccagcctggctcggggccatccccggagcctgaggggagcccgcctgctcatccacaata

SEQ ID NO: 231700 - DNA, 6110 bp, Artificial Sequence
  Description of Artificial Sequence: Synthetic coding sequence
atggcggcagtcactatgagtgtgccaggcagaaaagctccacctaggcccggaccagtcccagaagctgcacagccgtttttattcactcccaggggcccatctgccggtggcggtcctggaagtggcacgtccccacaggttgagtggacggccagacgcctagtgtgggttccttctgagctgcacggcttcgaagccgctgctttgagggacgaaggagaagaggaagccgaagtggaactcgcagaatctggacggaggctccgtctgccgagggatcagattcagcgcatgaaccctcctaagttcagcaaagccgaagacatggctgagctcacgtgcctcaatgaagcctcagttctgcacaaccttagagaacggtactacagtggactcatctatacgtattccggcctgttctgtgtggtgattaacccctataagcagctgccgatctacacagaggcaatcgtcgagatgtacagaggaaaaaaaaggcacgaggtgcctccgcacgtatacgccgtgacggagggagcgtatagaagtatgttgcaggacagagaagatcagtcaattctgtgcactggcgagtcaggcgctggcaaaaccgaaaatactaagaaggtgatccaatacctggcgcatgtcgctagctcacctaagggacgtaaagaacctggggtgccagtctctaaccccgctttgggctggggcgagcttgaacggcagttgctgcaggcaaaccccatcttagaagcttttgggaatgccaaaaccgtgaagaatgataacagctcacgtttcggaaagttcatccgcatcaatttcgacgtggcaggctacatcgtcggggctaacatcgaaacgtatctgctcgaaaagagtcgggctatccggcaggcaaaggatgagtgttctttccacattttttaccagctcttgggcggagcaggcgagcagctgaaggcggacctgctacttgaaccctgtagccattatagattcctgacgaatggtccgtcctcatcacctgggcaggagcgggagctgtttcaggaaacgctggagagcctgagggttttgggattttcccacgaagagatcatctctatgcttaggatggtgtcagccgttctgcagtttggcaatatcgccctcaagagggaacggaacacagaccaggctaccatgcccgataacacggccgctcaaaaactctgcagactattagggctgggcgtgacggacttctccagggccctgctgaccccaaggattaaagtaggtcgcgactatgtccagaaggcccagacaaaagagcaggcggacttcgctttggaggctctggccaaggccacgtatgaaaggctattcaggtggctggtgcttcgtttaaaccgcgctctggatagatcccccagacaaggggcaagcttcctcggcatacttgacattgcaggctttgagatattccagctgaatagtttcgaacagctgtgtataaactataccaatgagaaactgcagcagctgttcaatcacacaatgtttgtgctggagcaggaggaataccagcgcgaagggattccctggacttttctggatttcgggttggatctacagccctgcatagatttaattgagcgccctgccaaccccccaggcctgctggccctgcttgacgaggagtgttggtttcctaaagctacggacaagtcttttgtggagaaggtcgctcaggagcagggcggacaccctaaatttcaaaggccacggcacctccgggaccaggcagactttagcgtgttgcattacgccggaaaggtcgattacaaggcaaacgagtggctgatgaaaaacatggatcctcttaatgacaacgtggctgccttactacatcaaagtacagatcggcttacagccgagatctggaaagacgaacacggaggctttcaacagttctcgttcctggggagctttcccccatctcctcctggaagtgccgagcggtgctcaagcgccattagccctcccggagtcgaaggtattgtcggccttgaacaagtgtcctctctcggggacggcccacccggtgggcgaccccgtcgcggtatgtttaggacggtcggtcaactctacaaggagagccttagccgcctgatggctacactcagcaatacaaaccctagcttcgttcgctgtatagtgccaaaccacgagaagcgtgccggaaaattagagccacgattagtgcttgatcagctgagatgtaacggagtcctggaaggtattagaatctgtaggcaagggtttcccaacagaatcttgttccaagaattccggcagaggtatgaaatcctgactcctaatgcaatccctaaaggcttcatggacggaaagcaggcctgcgaaaagatgatccaggcattggaactcgaccccaacctgtatagagttgggcagtcaaaaatcttctttagagcgggagtgctggcccagcttgaagaagagcgggatctgaaggtgaccgacattattgtcagttttcaagccgctgccaggggttaccttgccaggcgggctttccagaagcgccagcagcagcagagcgctttgagggtgatgcagcggaattgtgccgcttatcttaagctacgtcactggcagtggtggaggctcttcacaaaggtcaagccactcctacaggtgacgcgccaggatgaggtcctgcaagcccgagctcaagaattgcagaaggtgcaggaactacagcagcagagcgccagagaagttggcgaactgcagggtagagtggcccagctggaagaagaacgtgcgagactggcagaacaattgcgggctgaggctgagctgtgtgcggaggccgaagagaccagggggagactggcagcaaggaaacaggaactcgagctggtagtgagtgagctcgaggcacgcgtcggcgaggaggaggagtgtagcaggcaaatgcaaaccgaaaagaaacgactccaacagcacattcaagaactggaagcacacctcgaggccgaggagggagccagacagaagctgcagcttgaaaaggtgactactgaagctaagatgaaaaaatttgaggaagacctgctgctcctcgaggaccagaactctaagctctccaaggagcgaaaacttcttgaggatcggcttgccgaattcagttcacaagcagccgaagaggaagaaaaagtaaagtctctgaacaagttacgactgaagtatgaagccactatcgctgatatggaggaccggctgcggaaagaagaaaagggcaggcaggaattagagaagctgaagcgaagattggacggggagtcttctgaactgcaggaacaaatggttgaacagcagcagcgggctgaagaactcagggcgcagttgggtcgtaaggaggaggaactgcaggctgcactcgctagagccgaggacgaaggcggagccagggcacagcttctcaaatccctgcgggaggcccaggcagcccttgcggaggctcaagaagatctcgaatcagagcgagtcgcccgtaccaaggcagagaagcagaggagggatctcggcgaagaactagaggcattgcgcggtgagctagaggacaccctcgactctactaacgcccagcaggagctgcgtagtaaacgggaacaggaagtcaccgaactgaaaaagacactagaggaggaaactaggatccacgaagctgcagtgcaggagctgaggcaaaggcacggacaggcactgggagagctcgctgaacagttggagcaagcaaggagaggcaagggagcttgggaaaagactagactagctctggaggcggaagtctcggaactgagggccgagctcagctcgctccaaactgcccgtcaggaaggagaacaaagaagacggcgacttgagctacagttgcaggaagtacagggcagggctggggacggagagcgggcaagagccgaggccgctgagaagctgcagcgggcacaggccgaactcgaaaacgtgagtggcgcactaaatgaggcagagagcaaaacgatcagactgagtaaagagttatcgagcactgaagcacagttacatgacgcccaagagcttctgcaggaagaaacacgggcaaagctcgccctcggctcaagggtgagagccatggaagcggaggcggctggattgagggagcagctggaagaggaggcagccgcaagagaaagagccggaagggagctccagactgctcaagctcagctcagtgagtggaggagaagacaagaagaagaggccggagccttggaagccggtgaagaggccaggcgcagggctgctagggaagccgaggcactcactcaaagactcgctgaaaaaaccgaaaccgtcgatcgactcgagcgcggtaggagacggctgcagcaggagcttgacgatgcgacaatggatctggagcaacagcggcagctcgtgtcaactctagagaagaagcagagaaagtttgaccagttgttagctgaggaaaaagcggcagtactgcgggcagtcgaggagagagagcgcgctgaagccgaaggaagagaaagggaggcgagagccttgagcctgaccagagctctcgaggaggagcaggaggccagggaggaactggaacgtcaaaatagagctctgcgcgctgaactcgaagccctcctaagctccaaagatgacgtggggaaaagcgtgcacgagctggaacgcgcttgccgagtggccgagcaagcggcaaacgatctcagggcccaggtgaccgagttggaagatgaactcactgccgctgaggatgccaaactgcggcttgaggtgactgtgcaggccctgaagacccagcatgaacgcgatttgcagggtcgggacgaagccggtgaagaacggagacggcaactcgcgaaacagctgcgcgatgcggaagtggagcgtgatgaggagaggaagcagaggacacttgcggtggcagctagaaagaagctggaaggtgagctagaggagctgaaagcacagatggcgtctgcaggtcagggaaaggaagaggctgtcaagcagctgcggaagatgcaggcccaaatgaaggaactctggcgggaagtggaagaaaccaggacatcccgcgaagaaatattttctcagaaccgagaatccgagaagcgactgaaaggcctggaagcagaagtgttacggctccaggaggaactggccgcaagcgatagggccagacggcaggctcagcaggatagggatgagatggcagacgaggtggccaacggcaacctgtcaaaagccgcaatactggaagaaaaacggcagctcgaggggagattgggtcaactggaggaggaactggaagaggaacagagtaattccgagttactgaacgatagataccggaagttgctgctgcaagtggaatccctgacaaccgaattgtccgctgagcgatcctttagtgcgaaagctgaaagtggcaggcagcagctggaacgtcaaatacaagaattaaggggtcgtctgggcgaggaggatgccggagcacgggcaaggcacaagatgacgattgcggcactcgagagcaaacttgcccaggccgaagagcagcttgagcaagaaactagagagcgtatcctctccggtaaactggtgaggcgcgctgaaaaacggctcaaggaggttgtcttacaggtagaggaggaaagacgggtggcagaccagctgcgagaccagctggaaaaggggaatcttcgcgtcaaacagctcaagcggcagcttgaggaagccgaggaagaggccagccgggcacaggctggtcgcaggcgcttacaacgagagctagaggatgtaaccgaaagtgccgaatcaatgaatcgggaggttacgacactacgaaacaggctccgaagaggccctctaacgtttacaacgcgtaccgtgcggcaagtgttcagattggaggagggcgtcgcgtctgacgaagaggctgaggaagcccagccagggtcaggcccttctcccgagcccgaggggtcacctcccgctcacccgcagta

SEQ ID NO: 231701 - DNA, 5841 bp, Artificial Sequence
  Description of Artificial Sequence: Synthetic coding sequence
atggttgagagttgcctcttgaccttccgggcattcttttggtggatcgcgcttattaagatggacctaagcgatctgggcgaagcggcagctttcctgcgtaggagcgaagctgagttgctgttgctgcaggccaccgctctggatggaaagaaaaagtgctggatccccgatggtgagaatgcgtacatcgaagccgaggtgaaaggctccgaggatgacggaacagtgatcgttgagaccgccgatggagaaagcctgtcgattaaggaggacaagatacagcagatgaaccctcccgagttcgagatgattgaagacatggcaatgctcactcacctgaacgaagcttcggtgctacacacccttaagcgaagatacggtcagtggatgatttatacttactccggtctcttctgtgtgactataaacccttacaaatggctcccggtctaccagaaggaagtgatggcggcttataagggaaagaggcggtctgaggctcccccacacatcttcgccgtggcaaataatgcatttcaggacatgttgcataatcgcgagaaccagagcattttgtttacaggagagtcaggagccggtaaaaccgttaattcaaagcacatcattcagtacttcgcaacaattgctgccatgatcgagtcccgaaaaaagcagggggctctggaggatcagattatgcaagcgaacaccattctggaggcctttggaaacgcgaagacacttcggaatgacaattcatcgagattcggcaagttcattcgcatgcactttggtgctagaggaatgctttcttcagtcgacatcgatatctatctgcttgagaagagcagagtcatattccaacaagctggcgaacgaaattatcacattttctatcagatcctgtcaggacagaaagagcttcatgacctgctcttggtgtccgcgaatccgtctgactttcacttctgcagctgcggcgcagtcactgtggagagcctcgacgatgccgaggaactcctggccactgagcaggcaatggacattctgggttttcttcctgacgaaaagtatgggtgttataagttgaccggtgcgatcatgcattttggaaacatgaagttcaagcaaaagccccgagaggagcagctggaggcagacggcaccgagaacgctgacaaggccgcattcctcatggggattaattcttccgagttggtgaagtgtctcatccaccctcgcattaaagtgggaaatgagtatgtgacacgcggtcagaccatcgagcaggtcacttgtgctgtgggcgcacttagtaaaagcatgtacgagaggatgttcaaatggctagtggcacgtattaacagagccctggacgccaaactgagcagacaattctttatcggtattctcgacattactggctttgaaatcctggagtacaacagcctcgagcagctgtgcattaacttcactaatgagaagcttcagcagtttttcaactggcacatgtttgtgctggagcaggaggagtataaaaaagaatcaatcgaatgggtgagcattggattcggattggacctccaggcttgtatcgatctgatagagaagccaatgggtatactaagtatcctggaggaggagtgcatgttccctaaggccactgatttgacttttaaaaccaaattgtttgacaaccactttggtaagtctgtgcacctgcaaaaacctaagcccgataagaaaaagtttgaggcccactttgaactggtgcattacgccggtgtagtgccatacaacatttccggatggcttgaaaagaacaaggacctgctgaatgaaacagtggtggctgtctttcagaaatcttctaataggctccttgccagtctgttcgaaaattacatgtcgaccgactccgcaatcccttttggagaaaagaagcgaaaaaagggtgcttccttccagaccgtggcctctctgcacaaagaaaacctgaataagttaatgacgaatctgaagagtactgctcctcacttcgttcgttgcatcaaccccaatgtcaataagattccgggaatcctcgacccatatctggttctgcagcaactgcggtgtaatggggtcttggaagggactcgcatctgccgggaggggttccccaacagactgcagtacgcggactttaagcagagatactgtattctgaaccctcgtaccttccccaagtcgaagtttgttagttcgcggaaagcggctgaagaactgctgggatccctggaaattgaccatacccagtatcggtttggaattaccaaggtgttcttcaaagcaggatttctcggacaactcgaggcaatccgggacgaacgcctgtcaaaggttttcacgctatttcaggcacgcgctcaggggaagttaatgagaattaaattccaaaagatcttagaagaacgggacgccctcatactaatccagtggaacattcgggcattcatggcagtgaagaactggccgtggatgagattgttcttcaagatcaaaccactggttaagtcctccgaggtcggcgaagaggttgccggactgaaagaagaatgtgcccagctgcagaaggctcttgaaaagagcgagttccagagggaagagttgaaagccaaacaggtgtcacttactcaggaaaagaacgatctcatactgcaattacaggccgagcaagaaacactggctaatgtggaagaacagtgtgagtggctgatcaaatcaaagatacaactagaagctagagtcaaagagctgagtgagcgcgtggaggaggaggaagaaattaattcagagctgacagctcggggacgtaagctggaggatgaatgttttgagctgaagaaagaaatcgatgacttggaaacaatgctagtcaagtcggagaaagagaagcgcaccacggagcacaaggtaaaaaacctgaccgaagaggtagaattcctcaacgaggatattagcaagctcaatagagccgcaaaggtcgttcaagaagcccaccaacagacactcgacgaccttcatatggaggaagagaagctgtcaagcttgtcaaaggcaaatctgaaactggagcaacaggtggatgagcttgagggtgccctggaacaggaaagaaaagccagaatgaattgtgagcgcgagctacacaagttggagggtaatctgaaactgaatagagagagtatggagaacctcgagtccagtcagcgacacctggcggaagagctgcggaagaaggagctagaactgtcccagatgaactctaaggtagaaaatgaaaaggggctggtggcgcaactccaaaagacagtgaaagaactgcagacacagattaaggatctgaaggaaaagctggaagctgagagaaccactagggctaagatggagcgcgaacgcgcagatctgacgcaggatcttgcagacctgaacgaacgtctggaagaagtggggggaagctctctggcccaactggaaatcaccaaaaaacaggaaactaaattccagaagctgcacagggatatggaggaggccacgctgcacttcgaaaccacctcagcttcactgaagaagcgccacgccgactctttggcagagctggaaggtcaagttgaaaacctgcagcaggtgaaacagaagttggagaaagacaagtcagatctgcagttagaggtagacgacctgctcacccgagtggagcagatgactagagccaaggcaaacgccgaaaaactgtgcacgctgtacgaagagcgactgcacgaggctaccgctaagcttgacaaggtgactcaactggcaaatgacctcgcagcccagaaaacaaagctgtggtccgagtctggggagttcctgcgaaggttggaagagaaggaggccttgatcaatcagctctcccgtgagaagagcaacttcactcgccagatcgaggaccttcggggacagttagaaaaagaaaccaaaagtcagagtgctttggcccatgcccttcaaaaggcccagagagactgcgaccttttgagggaacagtacgaagaagaacaggaggtgaaagccgaactgcataggacactttccaaagtcaatgccgaaatggttcagtggcggatgaaatacgagaataacgtaatccagcggaccgaggatcttgaagacgctaagaaggaactcgcaatacgcctgcaggaggcggctgaagccatgggagtggccaacgccaggaacgctagcctcgaacgagcacgacatcaactacaactcgaacttggcgatgccctctctgacctcggtaaggtgagatcggccgctgctaggttggaccagaagcagttgcaatccggaaaggccctcgccgattggaagcagaagcacgaagagagccaggctctgttggatgcatcacagaaggaggttcaggcgctgtctaccgagttactgaaactgaagaacacctatgaggagtcgatcgtcgggcaggaaaccctgcgacgcgagaacaagaatctgcaagaagaaatctctaacttgacaaaccaggtgagggagggcaccaagaatctgactgaaatggagaaggttaagaagctcattgaggaggagaaaaccgaagtacaggtgaccctggaggagactgagggcgctctggagcgaaacgaatcaaagatcctccactttcagcttgagcttttagaggcaaaggccgaattggagagaaagttatccgagaaggatgaggaaatagagaatttccgacggaagcagcagtgtaccatcgattccctacaaagctccctggactctgaggctaagagccgtatcgaagtaactcgcctgaagaaaaagatggaagaagatctgaacgaaatggagctacagctgtcttgtgctaaccgccaagtcagcgaggctaccaaatcattgggccagctacagatccaaatcaaagacctccagatgcaactggacgatagcacacagttgaatagcgacctgaaggagcaggtcgccgttgctgagcgcagaaattcactgctgcaaagcgaactagaggaccttaggtccctgcaggagcaaactgagaggggccgtcgcttgtcagaggaagaactcttggaagctacggaacgcatcaatctgttctatactcagaacaccagcctcctttctcagaaaaagaagttggaggcagacgtggctcgcatgcagaaagaggcagaagaagtggtccaggagtgccagaatgccgaagaaaaagcgaagaaggctgccattgaagccgctaacctcagcgaggaactgaagaaaaaacaagacacaatagcgcacctcgaaagaactcgtgagaatatggaacagaccattaccgacctgcagaaacgcctagctgaggcagaacagatggcactgatgggctctaggaaacagattcagaagctcgaatctcgagtgcgagagctggagggcgagttggagggagagatcaggcggagcgctgaagcccaaagaggcgctcgtcggttggagaggtgtatcaaagaattgacctatcaagcagaggaagacaagaagaatctgagcaggatgcagacccagatggacaaactgcaactgaaggttcagaattataaacagcaggtcgaagtggccgaaacccaagccaatcaatacctgtccaagtacaagaaacagcagcacgagctgaacgaggtaaaggaacgagccgaagtagctgaatcccaggtcaataagctgaaaattaaggccagagagttcgggaaaaaagtgcaggaggagtat

SEQ ID NO: 231702 - DNA, 5826 bp, Artificial Sequence
  Description of Artificial Sequence: Synthetic coding sequence
atgtcttcagatagcgaactggcagtcttcggcgaggcggctccttttctacggaagtccgagcgggaacggattgaggctcagaacagaccttttgacgccaagacctcggtgttcgtcgcggaacccaaggaatccttcgtaaagggaacaatacaaagtcgagagggaggcaaggtcacagtcaaaacagaagggggtgctacacttaccgtgaaggatgaccaggtgttcccaatgaatcccccaaagtatgacaaaatcgaggacatggctatgatgacacacttacatgaaccggcagtattatataatctgaaagagaggtatgcagcgtggatgatctatacatatagtggtttattttgtgtgaccgtgaacccatataaatggctgccggtatacaaacccgaggtcgtaacagcctaccgagggaaaaagagacaggaagctcctccccacatttttagcatctcagataacgcctatcaattcatgcttacggatcgagagaatcagagcatcctgatcacaggcgaaagtggggctggaaaaactgtcaacaccaaacgagtcattcaatattttgctaccattgctgtgaccggagaaaagaaaaaggaggagatcacctccggaaaaatccagggtacactggaggatcagatcatctccgccaaccctctgttagaggcattcggaaacgctaaaaccgtgcggaacgataattcctcccgctttggcaagtttataaggatccactttggaaccacgggaaagctggccagcgctgatattgagacttacttactggagaagtcacgagtagtctttcagctcaaagcggagcgctcgtaccacatcttctatcagatcacttccaacaagaaacctgaactcatcgagatgctcctgattaccactaatccctatgactatccatttgtgtcacaaggagaaatctccgtggcttccatagacgaccaggaagaactcatggccaccgattctgcaattgacatcctgggcttcaccaatgaagaaaaggtctcgatatataaacttaccggcgcagttatgcactacggaaacctcaagttcaaacagaagcagcgcgaagaacaggctgagccagatggtaccgaagtggcggataaggccgcttaccttcagtccctcaacagcgccgacctcctcaaggcgctctgctatcctagggtgaaagtaggcaatgaatacgtaactaaaggtcagacggtcgagcaggtcagcaacgccgtgggcgctcttgccaaggccgtgtacgagaagatgttcctctggatggtggccaggattaaccagcagctggataccaaacagccgagacagtacttcattggcgtcctggatattgccggattcgaaatatttgattttaacagccttgagcagctatgcattaactttactaatgagaaacttcaacagttttttaaccaccacatgtttgtgctggaacaggaagagtacaaaaaggagggcattgaatggacatttatcgacttcggcatggatctggctgcttgtattgaactgatcgagaaaccaatgggtatcttcagcatcctcgaggaagagtgcatgttccccaaggctacagacactagcttcaagaataagctctacgatcaacacttgggaaagtctgccaatttccagaaacctaaggtcgtgaaggggaaagcggaggcccactttgcgttgatacactacgctggtgttgtcgactacaatattactgggtggctggagaaaaataaagaccctttaaatgaaaccgtagtcggtttgtaccagaagtccgcaatgaagactcttgcccagctctttagtggagcacaaacagccgagggtgagggagccggaggcggagcaaagaaggggggaaaaaagaaaggcagctctttccagaccgtgtccgctttattccgagaaaatctcaacaaactcatgacaaatcttcgctctacccatccccacttcgtgcggtgcatcattcccaatgagactaagacccccggagctatggaacatgagctggtgcttcatcaactgaggtgcaacggcgtgctcgaaggaattcgaatttgccggaaaggtttcccatcccgtatcctgtatgccgactttaagcagcgttacaaagtcctgaacgctagcgccatccctgagggtcaattcattgattctaagaaagctagcgagaagcttcttgcatccatcgatatcgatcacacccagtataaattcggccatactaaagtcttttttaaggcaggactgcttggcctcttggaggagatgagagacgacaagcttgctcagctcattacaagaactcaggctaggtgcaggggcttcctggcaagagtggaataccaaaggatggtcgaacgcagggaggcaattttctgcatacagtataacattaggtcatttatgaacgttaaacactggccctggatgaagctgttttttaaaataaaacctctcctcaaatcggccgagaccgaaaaagaaatggcgacaatgaaggaagagttccagaaaatcaaagacgagctcgcaaagtctgaagcgaagcgcaaggagttggaggaaaaaatggttaccttgcttaaagaaaagaacgacctgcaactccaggttcaggcggaagcggaggggctcgcagatgctgaggaacgctgtgaccagctaatcaaaacaaagattcagttagaagcaaaaattaaggaagtgactgaacgcgcagaagacgaagaggaaataaacgcagagctcacagctaaaaaacgcaagttggaagatgagtgcagtgagctgaaaaaggatatagacgatctggaactgacattagcaaaagtggagaaagaaaaacatgctactgagaataaggtgaagaacctaacagaggaaatggctggtttggacgagacaattgccaagttgaccaaagagaagaaggcgcttcaggaggcccaccaacagacactggacgatttgcaggccgaggaggacaaggtgaacaccctcactaaagctaagatcaagttggagcagcaagtagatgatttggaaggaagcctggagcaggaaaagaaactgaggatggacctagaaagggctaagagaaaactggagggtgatcttaaacttgctcaggagagcatcatggacatcgaaaacgaaaagcaacaactggacgagaagcttaaaaagaaagaatttgagatctcaaacctgcagagcaagattgaggacgagcaggccctgggaatacagctgcagaagaaaattaaggagctacaggcgaggattgaagaacttgaggaggagatcgaagcagagagggcttcgcgcgctaaagcagaaaagcaaagatcggacctttctcgcgagctggaagagatctctgagcggctggaagaagccggtggcgctaccagtgctcagatcgagatgaataagaagcgagaagcggagtttcaaaagatgcgacgcgatcttgaggaagccaccctgcagcatgaagccacggccgctactctgcgcaaaaagcatgcagactctgtggctgaactcggggagcagatcgataatctgcaacgcgtgaagcagaagctcgaaaaagagaagtccgagatgaaaatggaaattgacgatctggctagtaatgtagagacagtgagtaaggccaaggggaatctggagaagatgtgccgaacactcgaagatcagctgagtgagttgaagtcaaaggaggaagaacaacaaaggctgatcaatgatctgaccgcccagaggggcagactccagactgaaagcggcgagtttagtaggcagctggatgagaaagaggcccttgttagccagctcagtcgaggaaagcaagccttcacacagcagattgaggagctgaagaggcagctggaagaagaaataaaggccaagaatgctttagcccatgcattacagagctcccggcacgattgtgacctgttgagagagcagtacgaggaggagcaagaaagcaaggcagagctgcagagagctctgagcaaagccaatacggaagtagcccagtggcggaccaaatatgaaactgacgcaattcagaggactgaagagctcgaggaagccaaaaagaaactcgcgcagcgcttgcaggccgctgaagagcatgtggaggctgtgaatgcaaaatgtgcctcactggagaaaaccaaacagaggctccaaaacgaagtagaagatctgatgctggatgttgagaggaccaacgccgcatgtgcagcactggataagaagcagcgcaactttgacaaaatcctggccgagtggaaacagaaatgcgaggaaactcacgcggaactggaagcctctcagaaggaggctcggagccttggaaccgagctgtttaagatcaagaatgcctacgaagagtcgctggaccagctggagacgttgaagagagagaataagaacctgcagcaagaaatctcagatctgacagagcagattgccgaaggagggaagcgaattcatgagctggaaaagataaaaaagcaggtggagcaagaaaagtgtgagcttcaggctgcactcgaggaggcagaggcctctctcgagcacgaagagggcaagatcttgaggatccagcttgagctaaaccaagtgaagagcgaagtggacaggaagatcgctgaaaaggatgaggaaattgatcaactgaagcggaaccatattagaattgtcgaatcaatgcagagcaccctggatgctgaaattcgcagtcgtaacgatgctatccgactgaagaagaagatggagggggatcttaatgaaatggagattcagcttaaccatgccaacaggatggcagcggaggcgctgaggaactatcgaaatacgcagggcatcctaaaggacacccagatccacctggacgatgccctgagaagccaagaggacctgaaagaacagcttgctatggtcgagaggcgagcgaatctgcttcaggctgaaatcgaggaactccgagctacactggaacaaacggaaaggagccggaagatcgccgaacaagaattgctcgatgcaagtgagcgcgtgcagctcctgcacacacaaaatacctccttgatcaataccaagaaaaagttggaaaccgacatctcacaaatgcaaggcgaaatggaagatattctgcaggaagcaaggaatgccgaggaaaaagcaaaaaaggcgattaccgatgctgccatgatggccgaggagctgaagaaagagcaggatacaagtgcccatctggagcgtatgaagaagaacatggaacagactgtgaaggacctacagctgaggttagatgaggctgagcagctcgccttgaagggcggtaagaagcaaattcagaaacttgaggccagagtccgggaacttgagggtgaagttgaaagcgagcaaaaaaggaacgccgaagcggttaaagggttacgcaaacacgagaggagggttaaagaactcacgtaccagaccgaggaggaccgaaagaacatcttgagactccaggatctggtagataagttgcaggcaaaagtgaagtcttacaagcgccaagccgaagaggccgaggaacagtctaatactaacctggccaaattccggaagctgcagcacgaattggaggaggccgaggagcgcgcagacatagctgaatcacaggtaaataagctgagggtcaaaagtcgagaagtacataccaaggtgattagcgaggagtag

SEQ ID NO: 231703 - DNA, 5825 bp, Artificial Sequence
  Description of Artificial Sequence: Synthetic coding sequence
atgtcctctgattcggagctggctgtgtttggggaggccgcaccattcctccggaagtccgaaagggaacgaattgaagcacagaatagaccttttgatgcaaagacatccgtcttcgttgctgaaccaaaggagagttttgtgaagggcacaattcagtctcgggagggtgggaaggtcacagtgaagaccgaaggaggtgccaccctcacagtgaaagatgaccaggttttcccaatgaaccccccaaagtatgacaagatcgaggacatggccatgatgacacaccttcacgaaccagccgtgctatataacctgaaagaacggtacgccgcttggatgatttacacatacagtggcttgttttgtgtgacagtgaacccctacaagtggctgcctgtgtacaaaccagaggtagtgaccgcctatcggggaaaaaagcgccaggaggcacccccacacattttctctatttccgacaacgcataccagttcatgctgacggatagagaaaatcaatccattctgatcactggagagtccggggctggtaagacagtgaatacaaagcgggtgatccagtacttcgcaaccatcgcggtcacgggagaaaaaaagaaagaggaaatcacaagcggcaagattcagggtaccctggaggaccagattatttccgccaaccccctcctggaagcattcggaaacgctaaaacagttcgtaatgacaacagcagccgcttcgggaagttcatccgtattcatttcggcaccactggcaagctcgcaagtgccgatattgaaacctacttgctagagaagtcaagagtggtctttcaactgaaagctgagcgctcctatcacatcttctaccagatcacttcaaacaagaagcctgaactgatagagatgctactcatcaccaccaacccatacgactacccttttgtttcgcagggagaaattagtgtggctagcatcgatgaccaggaagagctgatggccacagatagcgccatagatatattggggttcacaaacgaggagaaagtgtcaatctacaagctcaccggcgctgtcatgcactacggaaatttgaagtttaaacaaaagcagagagaggagcaggcggagccagacggaacggaagtggctgataaggcagcctacctacagtcattaaattctgcagatcttctgaaggcgctgtgctaccctagagttaaggtaggaaacgagtacgtcacaaaggggcagactgtggagcaggttagtaatgcggtcggcgctttggctaaggctgtgtatgaaaagatgttcctatggatggtcgcccgaattaaccagcagctagataccaaacagcccagacaatactttatcggagtgctggatatcgccggattcgagatattcgacttcaacagcctggagcaattatgcattaatttcactaacgaaaagctccagcagttttttaatcaccatatgtttgtgcttgaacaggaagaatacaagaaggaagggatcgaatggacatttatcgacttcggcatggacctggcagcttgtatcgagcttatagagaaacccatgggcatcttcagtattcttgaggaggagtgcatgtttccaaaagctaccgacacgagtttcaaaaacaaactgtacgatcagcatctgggtaagtccgccaatttccagaagccaaaggttgtgaagggaaaggcggaggcccactttgcactcatacactacgctggcgtggttgactataacatcaccgggtggttggaaaaaaataaggaccccttaaacgaaactgtagttggcctgtatcagaaatctgctatgaagacactggcccagctgttttcaggggcacagaccgctgagggcgagggcgcaggtggcggagcgaagaaagggggaaagaagaagggctcatcttttcagacggtcagtgcgctgttcagagagaaccttaataagttaatgacaaacctgcgctcaacccacccccacttcgtgcggtgcatcattcctaacgagaccaagacaccaggggcaatggagcacgagctggtgctccaccaactgcgttgtaatggcgtgctggagggtattaggatctgcagaaagggattcccatcgaggatcctctacgctgattttaagcaacgatataaggtcctgaatgcttcagccatccctgaggggcagtttatcgacagcaagaaggccagcgaaaaactcttagcaagtatcgatatcgatcacacccagtacaaattcggtcataccaaagtattcttcaaagccggactgctcggtcttttagaagagatgagggatgacaaattagctcagctgataactcggacccaagcgaggtgtaggggctttcttgcacgggtggagtaccaaagaatggtcgaacgcagagaagcaatcttctgcatacagtacaacattcggtctttcatgaacgtgaagcattggccctggatgaagttgttttttaagatcaagcccctcctcaaaagcgcagaaaccgagaaggaaatggctactatgaaggaagagtttcagaagatcaaagatgaattggccaaaagcgaagcgaagagaaaggagctggaggaaaagatggtgaccctgctaaaagaaaagaacgatctgcagctgcaggtgcaggccgaagctgaaggtcttgcagacgcggaagagcggtgcgaccagcttatcaaaacgaagatccaactggaggccaagatcaaagaggtcacagagagagccgaagatgaagaagagatcaacgcagagctgacagcaaaaaagcgtaaattggaggacgagtgcagtgagttaaagaaggatatcgatgatttagaactgaccttagccaaagtggagaaggagaagcatgcgaccgagaacaaagttaagaacctgactgaggagatggctgggctggatgaaacaattgctaagctaaccaaagagaaaaaagccctgcaggaggctcatcagcaaacactggatgatctccaggcagaggaagacaaagtgaacacgctcactaaagctaaaatcaagctggagcagcaggttgacgacctggaagggtccctggaacaggaaaagaagctgcggatggatctggagcgtgccaagcggaaactggaaggtgacctaaaattggctcaggagtcaattatggacatcgagaacgaaaaacagcagttagatgagaagttgaaaaagaaggagttcgaaatcagtaacctgcaaagcaagattgaggatgagcaggcccttggcatacagcttcaaaagaagataaaggaattacaagctcgaattgaggaactggaagaggaaattgaggcagagcgcgctagccgcgctaaggcagaaaaacagcgcagcgatttgtcacgggagctggaggagatctccgagagactggaagaggcaggcggagcaacgagtgctcaaattgagatgaacaaaaagagggaggccgaatttcagaaaatgagaagggatctggaagaggctacactccaacatgaagccactgcagcgactcttcgcaaaaaacatgctgatagcgtcgccgagctcggcgaacagatagataatctccagcgcgtaaagcaaaagctggagaaggaaaagtctgaaatgaagatggagatagacgatctcgcaagtaacgtggaaaccgttagtaaggctaaaggtaacctcgaaaaaatgtgtcggacccttgaggatcagctgtctgagctgaagtccaaagaagaggagcagcaaaggttgatcaacgatctgacagctcagaggggcagactccagaccgagtcaggggagttcagtcgtcagttagacgaaaaggaggccttggtgagtcagctgtctagagggaagcaggctttcacgcagcagattgaagaattaaagagacagctcgaggaggagatcaaggccaaaaacgcattagcgcacgccctacagagcagcagacatgactgtgatctgcttagagaacagtacgaagaggaacaagagagcaaagcagagttgcaacgggcactgagtaaggcaaatacggaagtggcacagtggcgaacaaagtacgaaacagacgcaattcaacgtaccgaggagctggaggaagcaaaaaagaagctagcccaacggcttcaggccgcagaagaacatgtggaggcagtgaatgctaagtgcgctagcctggaaaagacgaagcagaggctgcagaatgaagtggaagacctgatgctcgacgtcgagaggaccaacgcagcttgtgctgctctggataaaaagcagcggaatttcgacaagatactcgcggagtggaagcaaaaatgcgaagagacccacgccgagctggaggcctctcagaaagaggcacgcagtttggggaccgagctgtttaagataaagaacgcctacgaagagagcctcgatcagcttgagactctgaaacgggaaaataagaacctccagcaggagatttccgatttaacagagcagattgcggagggcggtaagcgcatccacgaactcgagaaaatcaagaaacaggttgaacaggagaagtgcgagctgcaggccgctctcgaggaagccgaagccagcttagagcatgaagagggcaaaattctgcgtattcagctggagctcaaccaagtaaagagtgaggtggaccgaaagatcgctgaaaaggatgaagagatcgatcaattaaagagaaaccatattagaatagtggagtcaatgcagtccaccctggatgccgaaattagatctaggaatgacgcgatccgtctgaagaaaaagatggagggagatctcaatgagatggagattcaattgaaccacgccaaccgtatggctgcagaggcgctccgaaattaccgaaacacccaagggattctcaaggacactcagattcatctagatgatgccttgaggtcgcaggaggacctgaaggagcagttggccatggtggaaagacgtgccaacctgctgcaggctgaaatcgaagaattgcgggctacgctggaacagactgagcgcagccgcaaaatcgccgaacaggaacttctggatgcatcagagcgggtgcagcttctgcacacgcagaatacttcgctgattaacacaaagaagaagttggagacggatatttcacagatgcagggcgaaatggaggacatactccaggaggccaggaacgcagaggaaaaggccaaaaaagcaataaccgacgcggcaatgatggctgaggaacttaagaaggaacaggacacttccgcccacttagaacgtatgaaaaaaaacatggaacagacagtcaaggaccttcagcttaggttagatgaggcagaacagttggcgctgaaaggagggaagaaacagattcagaagttagaggcgagagtgagagagctggagggagaagtggaatccgaacagaagcgcaacgctgaggctgtcaaaggactacggaagcatgagcgacgggtgaaagagttgacttaccaaaccgaggaagacagaaagaacatcctgaggctgcaggatttggtggataaattgcaggccaaggttaagtcatataaacgtcaggccgaagaagcggaggaacaaagcaataccaacctggccaaatttcgcaaactgcagcatgaactggaggaagctgaagaacgcgcagacatcgcagagagccaggtgaacaagcttcgcgtgaagagccgggaggttcacactaaagtgatctccgaagaata

SEQ ID NO: 231704 - DNA, 549 bp, Artificial Sequence
  Description of Artificial Sequence: Synthetic coding sequence
atgtctagtgattctgagctggccgtgtttggcgaggccgcacccttcctgaggaaatccgaaagggagcgcatcgaggctcaaaaccgtcccttcgatgccaaaacaagtgtgttcgtggcggagccgaaagagagcttcgtcaaagggacaattcagagtagggagggcggaaaggtcacagtaaaaacagagggcggagctacattgacagtgaaagatgatcaggtgtttccgatgaaccctcctaagtacgacaaaatagaagatatggctatgatgacccatctgcatgagcccgctgtgctgtataacctgaaggagaggtatgcagcctggatgatatacacatattctggtctgttttgtgtgaccgttaatccttacaagtggctcccagtgtacaagcccgaagtcgtcaccgcttacagaggcaaaaagaggcaagaagccccaccccacatcttcagtataagtgacaacgcctatcaatttatgttaaccgatagggagaaccagagtatcttaataactggcgagtccggttag

SEQ ID NO: 231705 - DNA, 405 bp, Artificial Sequence
  Description of Artificial Sequence: Synthetic coding sequence
atgtccagcgacagtgagttagccgtattcggcgaggcagccccattcctgcggaaaagcgaaagagaaagaatagaggcccagaataggccattcgacgccaagacctctgtattcgtggccgagcctaaggagtcctttgtgaagggaaccatccagtcccgggagggagggaaggttactgtaaagaccgaaggtggagccaccctgacagtaaaagacgaccaggtattccccatgaacccaccaaagtatgacaaaatagaggatatggccatgatgacacacctgcatgaacccgcagtgctctacaatctgaaggagagatatgcagcctggatgatttacacctactccggcttgttttgtgtaacggttaatccgtataagtggttgcctgtctag

SEQ ID NO: 231706 - DNA, 2127 bp, Artificial Sequence
  Description of Artificial Sequence: Synthetic coding sequence
atgagcagtgattctgaattagctgtctttggggaggctgcaccattcctcagaaagagcgaaagggagcgaattgaggcccagaataggcctttcgacgctaagactagtgtgttcgtggccgagcctaaggagagcttcgtgaagggtactatccagagcagggaaggaggtaaggttacagtgaagacagaggggggagcgaccctcactgttaaggatgatcaggtattcccgatgaaccctcctaaatacgataaaatagaagatatggcgatgatgacccacctccatgagccggcagtcctttataacctgaaagaacgatacgccgcatggatgatctatacctacagcggactattctgcgtgaccgtaaatccttacaagtggctccccgtctacaaaccagaagtggtcaccgcctatcgcggaaaaaagcggcaggaggcacctccacatattttctccattagcgacaacgcttaccaattcatgctcacagacagagagaatcagtctatcctcatcactggagaatccggggctggtaaaactgtgaacaccaaaagagtgattcagtatttcgcaactattgcggtaaccggcgaaaagaaaaaggaggagattacatcgggaaagattcagggcaccttagaggatcagatcatttctgcaaaccctttgctggaggcattcgggaacgccaagaccgtcagaaatgacaacagttcccggtttggtaaatttattagaatccactttggtacaaccgggaagttagcaagcgctgacattgaaacctatctccttgaaaagtccagggttgtgttccagctgaaggccgagaggtcataccatatattctatcagatcactagtaataaaaagccagagttgattgaaatgctcctgattactaccaatccctatgattacccttttgtgtctcagggtgagatcagtgtggcttccatcgacgatcaggaggaactgatggctacggactccgctatagatattctggggttcaccaatgaagagaaagttagcatttataaactgacaggagccgtgatgcattatggaaacctgaagttcaaacagaagcagagagaggaacaagccgagccagatggaactgaggtcgctgacaaggcagcctatctccagagtctgaattctgcggatctgttgaaagccttatgctaccccagggttaaagtgggcaatgagtatgttactaaggggcaaacagttgaacaggtgtctaacgccgtgggtgcacttgccaaggccgtgtacgaaaaaatgtttctctggatggtcgccagaattaatcagcaactggacacaaaacagcccagacaatactttattggtgtattagacatcgccggattcgaaatttttgacttcaactcgctagagcaattgtgcataaatttcaccaatgaaaaactgcaacagttctttaaccaccatatgtttgtgctggaacaagaggaatacaaaaaagagggaattgaatggacctttatcgattttggcatggatctggccgcttgtatcgaactgatcgagaagccaatgggaattttttctatactggaagaggagtgtatgtttccgaaagcaacagacaccagttttaagaacaaactgtacgaccagcatctgggcaaatcagccaacttccaaaaacctaaggttgtgaagggtaaggctgaagcccactttgcccttatccactacgccggtgtcgtggattacaacattactggctggctggagaagaacaaggaccctctgaatgagaccgtcgtaggcctctaccagaaaagcgctatgaaaacactggctcaactcttctccggtgcccagacagctgagggtgagggagccggaggcggagccaagaaggggggtaaaaaaaaggggagttcattccaaacggtgagcgccctcttcagagaagaacagagtaacaccaatctggccaaatttcgcaaactccagcacgaactggaggaggctgaagagcgggcagatatcgccgagagtcaggtaaataagctgagggttaagagccgggaggtgcatacaaaggtgatcagtgaggaatag

SEQ ID NO: 231707 - DNA, 5820 bp, Artificial Sequence
  Description of Artificial Sequence: Synthetic coding sequence
atgagctcagactctgaaatggctatcttcggagaggcggcaccctttctgcggaagagcgagagagagcgaattgaggctcaaaacaaaccgttcgatgcaaaaacaagtgtattcgtggtggaccccaaggagtcttttgtaaaagccacagtccagtctagggaggggggtaaggtaactgcaaagaccgaggcgggagcaacagtgaccgtgaaggatgaccaggtgtttcccatgaacccacccaaatacgataagattgaagacatggctatgatgacccacttacatgaaccagccgtcttgtacaacctgaaggaacgttacgcagcttggatgatctatacttacagcgggctgttctgtgtgactgttaacccctataagtggctgcccgtttacaacgccgaagttgttaccgcctaccggggtaaaaagagacaagaggctccgcctcatatcttttcaatcagcgataacgcttaccagtttatgcttacagatcgggagaatcagtcgattctcattactggtgaatccggggcaggaaaaaccgtcaatactaagagggtgattcagtactttgccactattgcggttacaggggaaaaaaaaaaagaggaggtgaccagtgggaagatgcaaggaacactggaagaccagattatttcagcaaacccactcctcgaggcatttggaaatgcaaagacagtgcgtaatgacaactcctcaaggttcgggaagtttatccgaatacactttggaacgacgggcaagctggcttctgccgatatagagacttatctcctggaaaaaagcagggtcaccttccaattaaaggcagagcgctcatatcatatcttttaccaaattatgagtaataagaagcctgatcttatagagatgctgttgatcaccacgaacccatatgattatgcttttgtctcccaaggcgaaatcacagtacccagcatcgatgaccaggaggagctgatggcaacggattctgcaattgagattttaggtttcacttctgacgagcgggtttccatatacaagttaaccggcgctgtgatgcactacggtaatatgaaatttaagcagaagcaaagggaggaacaggcggagcctgatggcaccgaggttgcagacaaagccgcataccttcagaatctaaatagcgccgatctgttaaaagcgctctgctatccgagggtgaaagttgggaacgaatacgtcaccaaaggccaaacagttcaacaggtttataacgcagtcggagccctggcgaaggctgtatatgacaagatgtttctgtggatggttacccgtattaaccagcagttggatactaagcagcccaggcagtactttatcggcgtccttgacattgcagggtttgaaatcttcgattttaactctttagaacagctgtgcataaattttaccaatgaaaagctccagcagttctttaatcaccatatgttcgtgcttgagcaagaagagtacaagaaagaggggattgagtggacattcatcgacttcggcatggatctagcagcgtgcattgagctgattgagaaaccgatgggcatctttagcatcttggaagaagaatgcatgttcccaaaggccacagacacatcatttaaaaacaagctctatgagcagcacctaggaaagagcaacaacttccagaagcccaagccggcaaagggaaagccggaagcccatttcagcctgatccactatgcgggaacagttgactacaatatcgccggttggctcgacaaaaacaaagacccgctcaacgaaactgttgtcggactataccagaagtcagctatgaagactctcgccctgcttttcgtcggcgctactggagccgaggctgaggccggtggtgggaaaaaagggggaaagaagaagggttctagcttccagactgtctctgcactatttcgggaaaatttaaataaattaatgacaaacctgcgctccacgcatccgcattttgtaagatgtatcattcccaacgagaccaagacaccaggcgctatggaacacgagctggttctccaccagctgcggtgcaatggcgtgctggaaggtattcgaatctgccggaaggggtttccatcaaggattctttacgccgactttaagcagcgctataaggtgctaaacgcctccgctattccagagggccaattcatcgattcaaagaaggcatcagagaaactacttggctccatcgatattgaccacacccagtacaaatttggacacactaaagtcttctttaaggctggtctgttgggactgctggaggagatgcgcgacgagaaattagctcaactcattacccgcactcaggccatgtgcagaggatttttggcgcgagtggaatatcagaaaatggtggagcgcagagagagtatcttttgcatacagtataacgtgcgggctttcatgaacgtaaagcactggccttggatgaaactctactttaaaatcaagcctctgttaaagtcagcagagacagaaaaggagatggcaaatatgaaggaagagtttgagaagacaaaggaggaattggccaaaactgaagccaaaaggaaagaactcgaagaaaagatggtcaccttaatgcaagagaagaacgacctacagctccaggtgcaggctgaggctgactctctagccgatgctgaggaacggtgtgatcagctcatcaagactaaaatccagctggaggccaaaattaaggaggtgacagagcgtgcagaggacgaggaagaaatcaacgcagaactgactgctaaaaaacggaaactagaagacgaatgttcagaactgaaaaaggatatcgatgacctggagctcactctggccaaggttgaaaaagagaagcatgccactgaaaacaaagtgaaaaatcttactgaggagatggctggcctggacgagactatcgccaaattgaccaaggaaaaaaaagccctccaggaggctcaccagcagacactggatgacctccaggctgaggaagataaggtgaatactctgactaaggccaagatcaaattagaacaacaggttgacgatctcgaggggagcctcgaacaggagaaaaagatccggatggacttagaacgggctaagcgtaagctggaaggagacctgaaactcgcccaggagtccacgatggatattgaaaacgacaagcaacaactggatgagaagctgaaaaagaaggagttcgagatgtctggtcttcagtctaagatcgaggatgagcaggcgttgggaatgcagctgcaaaagaaaataaaggagctccaagccagaatcgaggaactcgaggaggaaattgaggcagaacgggcatcccgggctaaggccgaaaagcaaaggtcagatttatcgagggagctggaagagatttcagagaggttagaggaggctgggggagctacctccgctcagatcgagatgaacaaaaaacgcgaggcagaatttcagaaaatgcggagggatctagaggaggctacattgcagcatgaggccactgcggctacccttagaaagaaacacgcagattctgtggctgaactgggagaacaaatcgacaacctccagcgcgtcaaacaaaagctggagaaggaaaagtctgaaatgaagatggagattgatgacctcgccagcaatatggaaaccgtgtcaaaagcaaagggcaacctggaaaagatgtgccgggctcttgaggatcagttaagcgagattaagacgaaggaagaggagcagcagagattgatcaacgacctgactgcccaaagggccaggttacaaaccgagtcgggcgagtactctcggcaactggatgagaaggataccctggtctcgcagctgagtcggggaaagcaggcatttactcaacagattgaggagctgaagcgacagctggaagaggaaatcaaggcaaaaagtgctctggcacatgcattgcagagcagtagacacgattgcgatctgctgcgcgaacaatacgaagaagaacaggaagccaaagcagagttgcagagggccatgtccaaggcaaacagcgaggtagcacagtggcgcaccaagtatgaaactgatgctatacagagaaccgaggaattagaggaggcaaagaagaaactcgctcagcgacttcaagacgccgaggagcatgtggaagccgtgaatgctaagtgcgcaagtttggagaaaaccaagcagaggctacagaatgaggtcgaagatctcatgatcgatgttgaaaggacaaatgccgcttgcgctgcgctggataaaaaacaacggaacttcgacaagattttagccgagtggaaacaaaaatgtgaagagactcatgccgagctggaagcgagccagaaagaaagcaggtctcttagcaccgaattgttcaaaatcaaaaacgcctacgaggagtccttggaccagctcgagacactgaaaagggagaataagaatttgcagcaggaaatatcagacctgacagaacagatcgctgaaggtggaaagcgaattcatgaactggagaagataaagaagcaagtagagcaggagaagtccgagcttcaggcagccctggaggaggcagaggcgtccctggagcacgaggagggcaagatcctgcggatccagctcgagctgaaccaggtgaaatctgaggttgacagaaagatagccgagaaagacgaagaaatcgatcagatgaagagaaatcatatccgcatcgtcgagagcatgcagtccactctggatgcagagatcaggagccgaaatgacgccattcggctgaaaaagaagatggaaggggatcttaatgagatggagattcagctcaatcacgccaacaggatggcggctgaggcattgcgcaactacagaaatacacaagcaatcctcaaggatacccagcttcatctggatgatgctttgcgatcccaggaggacttaaaagagcaactggcgatggtcgaaagaagagccaatctcctccaagcggagatagaagaacttcgcgcaaccctggagcagacggagaggagccgtaagatcgccgagcaggagcttctggatgcatccgaacgcgttcagttgctgcatacacaaaataccagcctgatcaataccaaaaagaaacttgagacagacatatcccagatccaaggggaaatggaagacatcatccaggaagcgaggaacgcagaggaaaaggctaaaaaggccatcaccgatgccgctatgatggctgaagagctcaagaaagagcaggacacctcagcccatctcgaacgcatgaaaaagaacctcgaacagacagttaaggacctgcagcacagactggatgaagctgagcagctggctctcaagggcggaaagaagcaaattcagaagctcgaagccagagtcagagagctcgaaggggaggtcgaaagcgagcagaaacgaaacgtcgaagcggttaaaggtttaagaaaacacgagaggaaagtgaaagagctgacttaccaaaccgaagaggatagaaagaacattctgcgcttgcaggatttggtggacaagctccaggcaaaagtgaagagctataagagacaagccgaagaagccgaggaacagtccaacgtgaatctcagcaagttccgacgtattcagcacgagctggaggaggcggaagaacgcgcagacattgctgagtcacaggttaataagctgagagtcaagtcacgcgaggtgcataccaagataatttcagaggaatac

SEQ ID NO: 231708 - DNA, 5820 bp, Artificial Sequence
  Description of Artificial Sequence: Synthetic coding sequence
atgtcttctgacagtgagatggcaatttttggggaagcggcaccgttcctgaggaaatcggaaaaggaacgcattgaagctcaaaacaaaccgtttgatgctaaaaccagtgtcttcgtagtagatccaaaggaatcctacgtgaaagctatagtccagtctcgggaggggggtaaggtcacagccaagacagaggcaggggcaacagtgaccgtgaaagaagatcaagtgttctcaatgaatccacccaagtacgataaaattgaagacatggcaatgatgactcacttgcatgaaccagcagtgctctataacctgaaagagagatacgcagcttggatgatttatacatattcggggctgttttgtgttacagtcaatccatataaatggctgcctgtttataacccagaagtggtcactgcataccgtgggaaaaagaggcaggaggcgcctccccatatttttagcatctcagataatgcctaccagtttatgctgacagacagagagaaccagagcatcctcattacaggggaatctggcgctgggaaaacggttaacaccaagcgggtgatacagtatttcgcgaccatcgccgttaccggcgaaaagaagaaagaggagccagcgtccggaaagatgcaggggacactcgaggaccaaattatcagcgccaaccctttattagaggctttcggtaacgccaaaacagtgcggaacgataatagtagcaggttcggcaaatttattagaatccactttggggctaccggaaaactcgcctccgcggacatagaaacatatctcctagagaaaagtagagtgacgttccagctgaaggcagaaaggtcataccatatcttttaccagatccttagcaacaaaaagcctgagctcattgaaatgctgctgatcacaaccaatccctacgacttcgcctttgtgtctcagggagaaattactgtgccatctatcgatgatcaagaggagctgatggctacggactctgctgtggacatacttgggttcaccgccgatgagaaggtggcaatttacaagcttacaggggcagtaatgcattatggtaacatgaaattcaagcagaagcagcgggaggaacaggcggagcccgatggaacagaggtggccgacaaagctgcatacctcacctccctaaacagtgctgatcttctgaaaagcctttgctaccctagagttaaggtcggaaacgagtttgtcaccaaagggcagacagtccaacaggtgtacaacgctgtaggagccctggctaaagcaatttacgagaaaatgttcctgtggatggtgacccgaatcaaccaacagctggacacgaaacagcctcgtcagtatttcatcggagtgctcgacatcgcaggcttcgagatcttcgacttcaatagtctcgagcagctgtgtatcaactttaccaacgagaaactgcagcagttctttaatcaccacatgttcgtgctggagcaggaggaatacaagaaggaaggtatagagtgggagttcatcgattttggaatggatctcgcagcatgtattgaactgatcgaaaagcccatgggtatcttctccattctggaggaggagtgtatgtttccaaaagctaccgatacatctttcaaaaacaaactgtacgaacagcatctgggtaagtcaaacaattttcaaaagcctaagccagcgaaagggaagccagaagcccacttctcgctggtccattacgccggtacggttgactacaacattgccggatggctcgacaagaataaggaccctctaaacgagactgtggtggggttgtatcagaaatccgctatgaagacccttgccttcctgtttagtggcgcacagacagccgaagcggaagggggtgggggaaagaaggggggaaagaaaaagggcagctctttccaaactgtcagtgctctgtttcgggaaaacctgaacaagctgatgaccaatttgcgctcaactcatccccactttgtaagatgcataataccaaatgaaaccaagactccaggggctatggagcatgagctggtcctgcaccagctgcgatgtaacggggtgcttgaaggcatacgaatctgcagaaaaggcttcccaagccgcatcctctatgcagatttcaagcaaagatacaaagtactgaatgcctcggcaatcccagaaggtcaattcatcgacagcaaaaaggccagcgagaagctcttagggtctatcgaaatcgatcatacccagtataaatttggccacacaaaagtgttcttcaaggcaggtctgctggggaccctcgaggaaatgcgcgacgaaaagctggcccaactcatcaccagaacgcaggccatctgtcggggtttcttaatgagggtggaatttcgcaagatgatggaacgccgtgagagcatcttctgtatccagtataacatacgagcctttatgaacgtaaagcactggccttggatgaagctgtatttcaagattaaacccctcctgaaaagcgccgagactgagaaagaaatggcgaacatgaaggaggagttcgagaaaacaaaagaggaactggcaaaaacagaagccaaaaggaaggagcttgaggagaaaatggttacccttatgcaggagaagaacgatctgcagctgcaggtacaggccgaggctgacgcactggctgatgccgaagagcgatgtgaccagctgatcaaaacaaagattcagctcgaagcaaagataaaagaggtgaccgagcgcgctgaggatgaagaagagattaatgcggaacttacagcaaaaaaaagaaagctcgaggacgaatgttctgaactcaaaaaggatatcgatgacctcgagttgacgttagcgaaggtcgaaaaggagaagcatgctactgagaacaaggttaagaatctgacagaggagatggcaggactcgacgagacaatagccaaacttaccaaggagaaaaaggctctccaagaagcccaccagcagacgctcgacgacctgcagatggaagaagataaggttaatactcttacgaaggctaagacaaagctcgaacaacaagtggacgacttggagggctcactggagcaggaaaagaaactgtgtatggaccttgagagagctaagaggaagctggaaggagatttgaagctggcccaggagtccacgatggatacggagaatgacaagcagcagctcaacgaaaaactcaagaagaaggagttcgagatgagcaatctccagggcaaaatcgaggacgaacaggcgttggccatccaacttcagaaaaaaatcaaagaactgcaggcccgtattgaagagctggaggaagaaatcgaggcagaacgagcatcacgagcaaaggccgagaaacagaggagcgacctaagcagagagctcgaggaaatttctgagcgacttgaggaagcaggaggcgcaacttccgctcagattgaaatgaacaaaaagcgagaagcagaatttcagaaaatgagaagagacttggaggaatctaccctgcaacacgaggccactgcggcagctctcaggaaaaagcatgcggacagtgtggccgagttaggcgaacaaatcgactcactgcagagggtgaagcagaagctcgagaaagaaaagtctgaattgaaaatggagataaatgacctggcctcgaacatggaaactgtgtcaaaagccaaggcaaacttcgagaagatgtgtcgtacgcttgaggatcagctaagcgaaattaaaaccaaggaagaggaacagcagcggctgatcaacgagttgtccgcgcaaaaggccagactccacaccgagtccggcgaattttcaagacagctggatgaaaaggatgctatggtgtcccagttgtctaggggaaaacaggcgtttacacagcagattgaggagcttaaacgtcagctggaggaggaaaccaaggcaaaatcgaccttggcacacgccctgcagtccgccagacatgactgcgatttgctcagagagcaatacgaggaggagcaggaggccaaagcagaactccaaagggggatgtcaaaggccaattcagaagttgcacaatggcgaacgaagtatgagacagatgcaattcagcggaccgaggaactggaggaggcaaaaaaaaagctggcccagcgtttacaagatgccgaggagcatgtggaggccgtcaatagcaaatgcgcttcattagaaaaaacaaaacaaaggttgcagaacgaggtggaggacctgatgatcgacgtcgagagatcgaatgcagcttgcatcgctctggacaagaaacagaggaattttgacaaggtgctggcagaatggaagcaaaagtacgaggagacgcaggctgaacttgaagcctcgcagaaggagtctcgtagcctgagcaccgaactctttaaagtgaaaaacgcctacgaggagtctctcgatcacttggagaccctcaaaagagagaataaaaatctgcagcaggagatttcagacctcaccgagcagattgccgaggggggtaagcatatccacgagttagaaaaagttaagaaacagctagatcatgagaagagcgaactgcagacgtcactggaggaagcagaggcgtccctggagcacgaggagggcaaaattctgcgaatccagttagaactcaaccaggttaaatctgaaattgacagaaagattgccgagaaagatgaagagcttgaccaactcaagaggaaccacttaagggttgtggaatcaatgcagtccactctcgacgctgagattaggtccagaaacgatgccctgaggatcaaaaaaaaaatggagggtgatttgaacgagatggaaattcagctcaatcacgccaacagacaggccgctgaggcattgagaaacctgagaaacacccagggtattcttaaggatacccagctccacttggacgatgccatccggggtcaagatgatttaaaagagcaactggctatggtggagcggagagcaaacctcatgcaggcggaggtggaggaattgcgagcatctttggaaagaactgagcgtggccgaaaaatggccgagcaagagctcctcgacgccagtgaacgagttcagttactacatacacagaatacctccctgattaatacgaagaagaaactcgaaaccgacatatcgcaaatccaaggagaaatggaggacattgtgcaggaggccaggaatgccgaagaaaaggcaaagaaggcgattacagacgctgcaatgatggcggaggagctgaagaaggagcaggatacctctgctcatctggaacgtatgaagaagaacatggagcagacagtgaaagatctgcagcttcggttggacgaagcagaacagctagccttgaaaggcggaaagaaacagatccaaaagcttgaggctcgcgtccgggaactggagtcagaggtggagtcagagcagaagcacaatgtcgaggctgtcaaaggcctgcgcaagcatgagaggcgggtaaaggagctgacttaccagacagaggaagatcgtaagaatatcttaagactccaggacctcgttgacaagttacaaacgaaagtgaaggcgtataagcgccaggcagaggaagctgaagaacagagcaacgtgaatttagccaaatttcggaaactccagcatgagctggaggaggccaaggaacgtgccgacatcgccgaaagtcaggtaaataagcttagagtcaaatctagagaggtacataccaaagttatttcagaggaatac

SEQ ID NO: 231709 - DNA, 5819 bp, Artificial Sequence
  Description of Artificial Sequence: Synthetic coding sequence
atgacggatgctcagatggcagatttcggggcagccgcacagtatttgaggaagtccgagaaagagcgtctcgaggcacagacccgtccgtttgacatcaggaccgagtgctttgtccctgacgacaaggaagaattcgtcaaagcaaagattctgagtagagagggaggaaaggtgatcgctgagactgagaatggtaagaccgtgacggtaaaggaggaccaagtcctccagcagaatccacccaagtttgacaagattgaggatatggcaatgttaacattcttgcatgagccagccgtacttttcaatctcaaggagaggtacgctgcatggatgatatacacttacagcggccttttctgcgtcaccgtcaatccttataagtggctgccagtgtataacgccgaggtggtggccgcttacagagggaagaaacgttcggaggcccctccacacatcttctctattagcgataacgcttatcagtacatgctgacagaccgggaaaaccagtctattttaatcactggagagtctggcgcaggcaagaccgtgaatacaaagcgcgtgatacagtacttcgcatcaatcgctgctattggagaccgaggtaagaaggataacgcaaatgcaaacaaaggtaccctagaggatcagataatccaagccaaccctgcactggaggctttcgggaatgctaaaaccgtgcggaacgacaactctagtcgatttggtaagtttatcagaatacactttggagccaccgggaagctggcatcagctgatatcgaaacgtatctgcttgaaaagtcgagagtaattttccagttgaaggcggagcgaaattaccacatattttaccagattctctctaacaaaaagcccgagttactcgatatgttgttagtcactaataacccctatgattacgcctttgtcagccagggcgaggtgagcgttgcatctattgatgattctgaagagttgatggccactgactcggctttcgacgtgctcggcttcacctccgaagagaaggctggagtgtataagctcacaggcgctatcatgcactacggcaacatgaaatttaaacagaagcagagggaggagcaagctgaacccgacggcaccgaggacgccgataaatcggcctatctcatgggtctgaacagcgccgacctgctaaagggcctctgtcatccaagagtgaaggtgggtaacgagtacgtcacaaagggtcagagcgtgcagcaggtatactattccattggcgcactcgcaaaggccgtgtacgagaaaatgtttaactggatggtaacacggatcaacgctaccctggaaactaagcaacccaggcagtattttattggcgtcctggacattgcagggttcgagattttcgacttcaatagttttgaacagttatgtatcaattttaccaatgaaaagctccagcagtttttcaaccaccacatgttcgtcctggagcaggaggaatataaaaaggaaggtatagagtggacctttattgattttggaatggatctccaggcgtgcattgacctcatcgagaagcctatgggaatcatgagcatcctggaagaagaatgtatgttccccaaagccaccgatatgacattcaaagccaagctctacgataaccacctgggaaagtcaaataactttcaaaagcccaggaatatcaaaggtaagcaggaggctcacttttcgctcattcattacgcaggtaccgtcgactataacatcctgggctggctcgagaagaataaagaccctctgaatgagaccgtggtcgccctttaccagaagtcaagcttgaaattgatggccacactgttctcttcgtacgctaccgcagataccggtgactccgggaagtcaaagggcggaaagaagaaaggatcatcgtttcagaccgtgtcggcacttcatcgtgaaaatctcaacaaactcatgaccaacctgcgcacgacgcacccccactttgtgaggtgcatcatacccaatgaacgcaaggcacccggagtgatggacaacccactagtgatgcatcaactccgatgcaatggcgtgctggagggtatccgcatttgtaggaaaggctttcctaaccggattctgtacggcgactttaggcagaggtaccgaattttgaatcctgtggccatacctgagggccaatttatagacagtcgaaaaggtactgagaagttactttcttcactggacattgatcacaatcagtataaatttgggcatactaaagtgttcttcaaggccggactcttgggtttgctcgaagaaatgcgcgatgagcgcctctcacgcattattactaggatgcaggcacaggcaagagggcagctgatgcggattgaatttaagaagattgtcgaacgccgtgacgcgttactcgtcatccaatggaacataagagcctttatgggagttaaaaattggccgtggatgaaactctacttcaaaataaaacctctcctaaaaagcgccgagactgagaaggaaatggccaccatgaaagaagaattcggtcgaatcaaagaaactcttgaaaagtccgaggcacggaggaaggagctggaggaaaaaatggtgagtctactgcaagaaaagaatgatcttcagctgcaggtacaggctgaacaggataacctgaatgatgccgaggagcgctgcgaccagttgatcaaaaataagattcaattggaagccaaagtcaaagagatgaacgagagactagaggatgaggaggagatgaacgcggagctcaccgccaaaaagaggaagctcgaagatgaatgtagcgaactgaagaaggatatcgacgacttagaactaaccctggcaaaggtggaaaaagaaaagcatgctactgaaaacaaggtaaagaacctgacagaagaaatggctggcctagacgagattatagccaagctgactaaagaaaaaaaggcccttcaggaggcccaccaacaggcgttagatgatctccaggtggaggaggataaggtgaattctctgtccaagtcaaaggtgaagttggagcagcaagtggatgacctggaagggtctctcgagcaagagaagaaggtccgaatggatcttgaacgcgctaaacgaaaactagaaggagaccttaaattgactcaggagagtattatggatttggaaaacgacaaattacagcttgaagagaagctgaaaaagaaagagttcgacatcaatcaacagaactccaaaatcgaggacgagcaggtcctggctctccaactgcagaagaagttgaaagaaaatcaggccagaatcgaggaattggaggaagagttggaggccgagaggaccgccagagcaaaggtggaaaagctgcgctccgatctttctcgcgagctcgaggaaatcagtgaaaggctcgaagaggccggtggagccaccagcgtgcagatcgagatgaataaaaagagagaggccgagtttcagaagatgcgcagagacctcgaggaggcgacattgcagcacgaggcaactgccgcagctctccgcaaaaagcacgctgatagcgtggcggagttgggggaacaaatcgataacctccagcgagttaagcaaaagttagagaaagaaaagagcgaatttaagctggaattggatgatgtcacgagcaacatggaacaaatcatcaaggcaaaggccaatttagagaaggttagccggaccctcgaggaccaggcaaacgagtatagggtcaagttagaggaagcccagaggtccctcaacgacttcaccacacagcgggctaagcttcagaccgagaatggagagttggcgagacagctcgaagagaaggaggcactgattagtcaattgacccggggaaaactaagctacacccagcaaatggaggatttgaagcgtcaactggaagaagaaggtaaagctaagaacgcactagctcacgcccttcagagcgcacgccacgattgcgacttgcttcgggagcagtatgaagaggaaaccgaggctaaagccgaactgcagcgcgttttgagcaaagcaaacagtgaggtagctcagtggaggaccaagtatgagaccgatgctattcaaagaaccgaagagctggaggaagcaaagaaaaagctcgcacaacgcctgcaggatgcagaggaagctgtcgaagccgtgaatgctaagtgttcctcattagagaagaccaaacaccggctgcagaacgagatagaggatttgatggtggatgtagagaggagcaacgctgcggctgccgctcttgacaaaaaacagcgaaactttgataagatcctggccgaatggaaacaaaagtacgaggaatctcaatcagagctggaaagttcccagaaggaggccagaagtctcagcactgaattatttaagcttaagaacgcatacgaagagtccctcgagcacctggagacatttaaacgcgagaacaagaatcttcaggaggagatctccgacctgacagaacagctcggtgagggaggaaaaaacgtacatgaactggagaaagtgaggaaacagctcgaggttgagaagctcgaactccagagcgccctagaggaggccgaagccagcttagagcacgaggaggggaagatacttcgcgctcagctggagtttaatcagatcaaggcagaaattgagagaaaacttgcggagaaagacgaggaaatggagcaggccaagcggaatcatcagagggtcgtggactccctgcaaacatctctggatgcggaaacacgaagtcggaatgaagtgttgagagtcaaaaagaagatggagggggatctgaatgaaatggaaattcagctctcccatgccaatcggatggctgcggaggctcagaaacaagtgaaatccttacagtctttgctgaaagatacacagatacagctggacgacgctgtccgagcaaacgacgatttaaaagaaaacatcgcgattgtggaaaggagaaataacctcctgcaagcagaattagaggagctgagagcagtggtggagcagacagagcggagccgcaaattagccgaacaagaattgatcgaaacatcggaacgtgtgcaactgctgcactcacagaatacctcccttattaaccagaagaaaaagatggagagtgatcttacgcagttgcaatcagaggttgaagaggctgtacaagagtgcaggaacgccgaggaaaaggctaagaaagcaatcaccgatgcagccatgatggccgaagagttgaagaaggaacaggacacaagcgcacacctcgagagaatgaaaaagaatatggaacagacaatcaaagacctgcaacacagacttgacgaggctgagcaaatcgccctcaaggggggaaagaaacagctgcagaaactggaagcgagagtccgtgaattagaaggggaactggaggccgagcaaaagcgcaatgccgaatccgtgaaaggcatgcggaagtccgagcgacgcatcaaggaactgacttaccaaacagaggaggataaaaaaaatctgcttcggctgcaggatttggtcgacaagctgcagctcaaagtgaaggcctataagcgccaggccgaagaggcagaagaacaagcaaacacgaacctgtcgaaattccggaaagtgcagcacgagctggacgaggctgaagagagagcagatatcgccgaatctcaagtgaacaagttgcgagcgaagtcccgggatattggggctaagcagaaaatgcacgacgaagaata

SEQ ID NO: 231710 - DNA, 5819 bp, Artificial Sequence
  Description of Artificial Sequence: Synthetic coding sequence
atgaccgatgcccaaatggctgactttggtgctgctgcgcaatatctgcgtaagtccgagaaagaacggctggaggcccaaacccgcccatttgatatccgcaccgagtgttttgttcctgatgacaaagaggaatttgtgaaggctaagatactgtcacgagaaggaggaaaagtaatcgcagagaccgaaaatggcaaaacagtgactgtgaaggaagaccaggtgctgcagcagaatccccctaagtttgataaaattgaggacatggctatgctgaccttccttcatgagcccgctgtgttgttcaaccttaaggaaaggtacgccgcttggatgatatacacgtatagtggcctgttctgcgttactgtaaacccctacaagtggctccccgtctataatgccgaggttgtcgccgcttatcgcggaaagaagagatctgaggcgccaccacatattttctccatcagcgacaacgcctatcagtacatgctgacagatcgcgagaaccagagcatactgatcacaggcgaaagcggcgcaggtaagaccgtcaacactaaacgcgtcatccagtacttcgcgtctattgccgctattggagacaggggcaaaaaggataacgctaatgccaacaaaggaaccttggaagatcaaataattcaggccaaccctgctcttgaagctttcggcaatgcaaaaaccgtccgtaacgacaactcttccagattcggcaaatttatcagaatacactttggcgctacaggaaaattagcctctgctgatattgagacgtacctgttggagaaatctcgcgtgatattccagctgaaggcagagaggaattaccatatcttttaccaaattctgagcaacaagaagcccgaattgctggacatgctcctggtcacaaacaacccctacgactatgctttcgtttcccagggtgaggtatcagtagcgagcatcgacgacagcgaggaattgatggccaccgatagcgcgttcgacgtgcttggatttactagcgaggaaaaggcaggcgtgtataaattaacaggcgctatcatgcactatggcaatatgaaatttaagcagaagcaaagagaggagcaggccgaaccggacggcaccgaggacgccgataagtctgcctacctgatgggcctcaatagcgctgacctgttgaagggtctttgtcacccccgtgtgaaagtgggtaacgaatacgtcactaagggccagagtgtccagcaagtgtattacagcatcggcgctcttgcaaaggccgtttacgagaagatgtttaactggatggtaacccgcattaacgccaccctcgaaacaaagcaaccacgccaatacttcatcggcgtgctcgacatcgcgggattcgagatctttgatttcaattcctttgaacagctatgcatcaacttcaccaacgagaaactgcagcagttctttaaccatcatatgtttgttctggagcaggaagaatacaaaaaagagggaatcgagtggacctttatcgactttgggatggatctgcaggcgtgcatcgacctgattgagaagcccatgggcattatgagcattttagaggaggagtgtatgttccccaaggctactgatatgaccttcaaagctaagctgtacgataaccaccttggcaaaagcaacaactttcagaagcccaggaatattaaggggaaacaggaggcacatttctctctgattcactatgccggtaccgttgattacaacatactggggtggctggagaaaaataaagatccattgaacgagaccgtcgttgcactctatcagaagagttccctgaaactgatggcgacactgtttagctcatatgcaactgcggacacgggagattcaggcaaaagcaaggggggaaagaagaaaggcagcagcttccagacagtgtcagctctccatcgggaaaacctcaacaaattgatgacaaacctcaggaccacccaccctcatttcgttcggtgcatcatcccaaatgaacgaaaagcacccggtgttatggacaatcccctggttatgcaccaactccgttgtaatggcgttctggagggcattagaatttgtcgcaaaggtttccctaatcgcattctctacggcgatttccgacagcgatataggattctgaatcctgtcgcaattccggagggacagttcattgactccaggaaaggtaccgaaaagttgctttcaagcctcgacatcgaccataatcagtacaagtttggccatacaaaagtgttcttcaaggccggactacttggactcttagaagagatgcgagacgagcgactaagccggattataactcggatgcaggcacaggccagggggcaattaatgaggatcgaattcaaaaagatcgtggagcgcagggatgcactgctggtaatccagtggaatataagggcatttatgggcgttaaaaattggccatggatgaaactgtatttcaagattaaacccttacttaaatccgccgaaacggagaaagaaatggctaccatgaaggaagaatttggtcggatcaaagaaaccttggaaaagtcagaggcacgacgtaaagaacttgaggagaagatggtgtccctcctccaagaaaagaacgatctgcagctgcaggtacaggccgaacaggacaatctgaacgatgctgaagaacgttgtgaccagctgatcaagaacaagattcagcttgaagccaaagttaaagagatgaacgagcgactggaagacgaagaagaaatgaacgctgagctaaccgccaagaagcggaagctcgaagatgaatgctcggagctgaaaaaagatatagacgacttagaactcactcttgcaaaggtggagaaagagaagcacgccaccgaaaacaaggtcaagaacctgactgaggagatggcagggctggacgagattattgccaagctgacaaaagaaaaaaaggccttgcaggaagctcatcagcaggctctggacgacctccaggtggaggaggataaggtgaactccttgtccaaatccaaagtaaagttggaacagcaggtggatgatttggaggggagcctcgaacaggaaaagaaagtccgcatggatctggaacgagccaagcgaaaactcgagggtgatctgaaactcacccaagagtcaatcatggatctcgagaatgacaagctccaactcgaggaaaagctgaaaaagaaagagtttgacatcaaccagcagaacagtaaaatagaggacgaacaggtcctggcactgcagttgcagaagaaattgaaggaaaatcaggctcgcattgaggagttagaagaggaactggaggccgagcggaccgcaagggctaaagtggaaaaattaagaagcgatctatccagagaactggaagagattagcgagagactcgaagaggccggaggcgcaacatcagtccagattgaaatgaacaaaaaaagagaagctgagttccagaagatgcgacgagatctggaggaagccacgctccagcacgaggctaccgcggctgccctgaggaaaaagcacgcggactcagtggcagaactgggcgagcaaattgataatctccagagggtgaagcagaagctggagaaggagaagtctgagttcaaactagagctagatgatgtcacaagcaacatggagcagattatcaaggccaaggcaaatctggagaaggtgagccggacgctggaggaccaagcaaacgagtacagagtgaagctggaggaagcccagagatccctgaatgatttcacgacgcaacgggcaaagctgcaaactgagaatggggaactggctaggcagctggaggaaaaggaggctctcatcagccagctgacacgcggaaaactgtcatacacccagcagatggaggacctcaagcgtcagctagaagaagagggcaaagccaagaacgcccttgcgcacgccttgcagtcagccagacatgattgtgatctgctcagagagcagtacgaggaggagaccgaagccaaggctgaactgcagcgtgtcctttccaaggcaaacagtgaggtggcccagtggaggacaaagtacgagaccgacgccatccagcgcacagaggaacttgaggaggcaaagaagaagctcgcccagagattacaggacgctgaagaggccgttgaagcggtgaatgccaaatgctccagcttggaaaagacaaaacatagactgcaaaatgaaatcgaagacctgatggtggatgtcgagaggtccaatgctgctgctgccgctttggacaagaagcagaggaactttgataagattctggctgagtggaagcagaaatatgaggaaagtcaaagtgagctggagagctcccagaaggaggctagaagcctgagcacggagctcttcaagctgaagaacgcatatgaagagtccctggaacatctggagacctttaagagagagaacaagaacctgcaggaagaaatctcagatctgactgaacaattgggtgaaggaggtaagaacgtccacgagctggaaaaggttaggaaacagttggaagttgaaaaattggagcttcagtctgccctcgaggaagctgaagcctccctggagcacgaggaaggtaagattctccgggcacaactcgaatttaaccagatcaaagccgaaatcgagaggaagttggcagagaaggatgaggagatggagcaggccaagcggaatcatcagagggttgtcgattcgctacagacctccctggatgccgaaactaggtcaagaaacgaggtactgcgggtgaagaaaaagatggagggggacctgaacgaaatggaaatccaactcagccatgctaatcgcatggcggcagaagcccagaagcaggtgaaaagcctgcaatcccttttgaaggacacacagattcaactggatgacgcagttcgggcaaatgatgacttgaaagagaacatcgctatcgtggagcggaggaacaatctgcttcaggccgagctggaggagctgagagcagtggtggagcaaactgagagaagtcggaaactcgctgagcaggagctcatcgaaacatcagagcgcgtgcagctgctgcacagccagaacaccagtctgattaatcagaagaaaaagatggagagtgatctcacacagttgcagagtgaagttgaggaagctgtacaagagtgccgtaacgcagaggagaaagcaaagaaagccatcactgatgcagcgatgatggctgaggagctgaaaaaagagcaggacacatccgcccatctcgaaagaatgaagaagaacatggagcaaactataaaggacctgcagcaccggcttgatgaagctgaacagattgcactgaaagggggtaagaaacagttgcagaagctagaagccagagtccgcgaactggagggagagttagaggctgagcagaagaggaatgcagagtctgtgaaagggatgcggaagagcgagagacgaatcaaagaacttacttatcagactgaagaggataagaaaaacctgttgcggcttcaggacctggtggacaaactccaactcaaggtgaaggcctataagcgccaggcagaagaggctgaggaacaggccaacactaatttgagcaaatttagaaaagttcagcacgagttggacgaggccgaggagcgggcagatatcgcggaaagccaggtgaataagctccgcgctaaaagcagagacattggtgccaagcaaaagatgcatgacgaagagta

SEQ ID NO: 231711 - DNA, 5807 bp, Artificial Sequence
  Description of Artificial Sequence: Synthetic coding sequence
atgggtgactcggagatggccgtattcggggctgcagccccttacttgcgcaagtctgagaaggagaggctggaagctcaaacacggccttttgatttgaaaaaagacgtgttcgttcccgatgataagcaagagtttgtgaaagcgaaaatcgtgtcccgtgaggggggtaaagtgacagccgagactgagtatgggaaaaccgtgaccgtgaaagaggaccaggtcatgcaacagaatcccccaaagttcgataaaattgaggacatggctatgctgacttttctgcatgagccagcggtgttgtataacctcaaggaccggtacggcagctggatgatttatacttacagcggtctattttgtgtgacagtgaatccctataagtggttacctgtgtacacacccgaggtggtggctgcctacaggggtaaaaagcgcagcgaagccccaccacacatcttcagtatcagtgacaacgcatatcagtacatgcttacagaccgggaaaaccagtccatattgataacgggggaatccggtgccggaaaaactgtaaatactaagcgcgttattcaatactttgccgtgattgccgctattggcgacaggtccaagaaagatcagagccccggtaaaggtactctagaggaccagataatacaggccaatcccgctctcgaagcctttggtaacgctaaaaccgttcgcaacgataacagtagccggttcgggaagttcattcggattcactttggggctacagggaagttggcctcagctgacatagagacatatctgctggagaaaagtcgggtgatatttcagctgaaggccgaaagagattaccacatcttctaccagatcttatccaacaagaagcccgagctcctagatatgttgctgatcacaaacaatccctacgattatgcttttatctcacagggtgagactacagtggcatcaattgacgatgcagaggaactgatggcaactgacaatgcttttgatgtgctgggttttacatctgaagagaaaaatagcatgtacaaattgaccggagcgataatgcattttggtaatatgaagtttaagttaaaacagcgcgaagaacaagccgagccagatggcaccgaagaggctgataagtctgcctacctcatgggtctgaactcggcggatttgctcaaaggtttgtgccacccacgcgtgaaggtgggaaacgaatacgtgactaaaggtcagaatgtgcaacaggtgatctacgccactggggcacttgctaaggcagtatacgagaggatgttcaactggatggtgacccgcataaacgcaacattggaaaccaaacagccaagacagtactttatcggagtgttggacattgccggatttgagatcttcgatttcaattctttcgagcagctatgtattaacttcaccaacgagaaattacagcagttctttaaccatcatatgtttgtactggaacaggaagagtataaaaaggagggaattgagtggacattcatagatttcgggatggacctgcaagcttgcatcgacctgatcgagaaacccatgggcatcatgtccattctggaagaagaatgcatgttcccaaaagccactgatatgacctttaaagccaaactgttcgataatcacctggggaaatccgctaattttcagaagccgaggaacatcaaaggcaagcctgaagcacacttctcccttatccattatgcagggattgtggactataacatcatcggatggctccagaagaacaaggacccactgaacgaaaccgtggttggactttatcagaagagcagtctgaaactgttatcgaccctcttcgcaaattatgctggcgctgacgccccaatcgagaaaggaaagggaaaggccaaaaagggcagtagctttcagacggtgagtgcacttcatagagaaaacctgaataaattaatgacaaacctcagatctacccatccacacttcgtgcgctgtataatcccaaatgagacaaagagtcccggtgtcatggacaaccctctggttatgcatcagcttagatgtaacggcgtcttagaggggatccgaatttgtcgaaagggcttcccgaatcgcattctctacggcgacttcaggcagcgttatcgcattttaaatccagctgccattcctgaagggcagttcattgatagccgcaagggagcagaaaaactgctgtcctcactagatatcgatcataatcagtacaaattcggccacactaaagtgttttttaaagcaggattattgggcctcctggaagagatgcgcgacgaaagactgagccgcatcatcacaagaatacaggcccagagcaggggcgtgcttgcaagaatggaatacaagaaactcctggagagacgcgatagcctgctggtgattcagtggaacataagggccttcatgggtgtcaagaattggccatggatgaagctatactttaagattaagcctcttctcaaatctgctgagcgggagaaagagatggctagcatgaaggaggagtttaccaggctcaaagaggccctggagaagtccgaagctcgtaggaaggagcttgaggagaagatggtctccctcctgcaggagaagaatgatttacaattgcaggtgcaggctgaacaggacaatctggcagacgccgaggagcgttgcgaccagctcatcaagaataagatccaattggaggccaaggttaaagagatgaacgaacgattagaagatgaggaggaaatgaacgcagagcttaccgctaagaaaagaaagctggaggacgagtgtagcgaactgaaacgggacattgacgacttggaactgacactggcgaaagtcgagaaggagaaacacgccacagaaaataaagtgaagaatctcaccgaggagatggccggactcgacgagatcatcgctaagttaactaaagagaagaaggccctccaggaggctcaccagcaagcattggatgatctccaggcagaggaggacaaggtaaatactctgacaaaagcgaaggtcaaactggagcagcaagtggacgatttagagggctccttggagcaggagaaaaaggtgcgcatggatcttgaacgggcaaagcggaagttggagggtgacctcaagctgacccaggaaagcatcatggatctggaaaatgacaaacagcagctcgacgagcgcctgaagaagaaggacttcgagctcaacgccttaaacgcccgaatagaggacgaacaggccctgggatcccagctgcagaagaagctcaaagaactgcaagctcggattgaggagctggaggaggaactcgaagctgagagaacagcccgtgcaaaggtggaaaaactccgtagtgacctgagtagagagctggaggaaatctctgaacgcctcgaagaagcaggtggtgcaacctcggttcagatcgagatgaacaagaagcgcgaggcggagttccaaaagatgcgaagagatctcgaggaggccactctgcagcatgaagcaacggctgccgcactgcgtaagaaacatgccgacagcgtggcagaattgggagaacagattgataatttgcagcgggtgaagcagaaactagaaaaggagaaatcagaatttaaacttgaactggatgatgtcacaagcaatatggagcagatcattaaggcaaaagctaatcttgaaaagatgtgccggaccctggaagaccagatgaatgagcaccggagcaaagccgaagaaacacagcggagcgtcaacgacctaacgagccagcgggctaaacttcaaactgagaacggggaattgagccgacaattggacgaaaaagaggctctgatcagtcagctgacaagaggcaagctgacttacacgcagcagctggaggatctcaagaggcagcttgaggaggaggttaaagctaagaacgcattagcccatgccctccaaagtgccagacacgactgcgatctactaagagagcagtacgaggaggagacagaggcgaaagccgaactccaaagggttctgagtaaggcgaactcagaggtggcccagtggagaactaaatatgaaactgatgcgattcagcggaccgaggaacttgaggaagcaaagaaaaaactcgcacagcgactgcaggaggcggaagaggccgtagaagctgtgaacgccaaatgctcctctctggaaaaaactaaacacagattgcagaatgaaattgaggacttgatggtcgacgtggaaaggtccaatgccgcagccgctgccctcgataagaaacagcggaatttcgataaaattctggccgagtggaagcagaagtacgaagagagtcagtctgagctagaaagctcccaaaaggaagcacgatcgctatccaccgaactgttcaagctgaagaacgcttacgaagagagcctggaacatctggagaccttcaaacgcgagaataaaaatttacaggaggaaataagcgacctgactgagcagctgggaagctcaggtaagacgatccacgaactggagaaggtgcgtaagcagctggaagctgagaaaatggaattgcagtccgccctcgaggaagcagaggctagtctggagcacgaggaagggaagatactccgggctcaattggagttcaatcagatcaaggctgagatcgagcgtaagcttgctgaaaaggacgaggagatggaacaggccaaaaggaaccatctacgtgtggtggactccttacagaccagcctggacgcagaaactagatcacgcaatgaagcccttagagtcaagaaaaaaatggaaggggacttaaatgagatggaaatccagcttagccacgccaacagaatggcggcagaagcccagaagcaggttaaatctctccagagcctgttaaaggatactcagatccagctggacgatgcagtgagggctaacgatgacttgaaggagaacatcgcaatcgtggagaggcggaacaacctgctacaggcggagctggaggaactgcgcgctgttgtagaacagactgaacgcagtcgcaaactcgcggaacaggagttgatcgagactagcgaacgtgtgcagcttctccatagccagaacaccagcctgatcaatcagaagaagaagatggacgccgacctgtctcagctacagacagaagtcgaagaagcggtccaggaatgcagaaacgccgaagaaaaagcaaagaaggcgatcaccgacgcggcaatgatggctgaagagcttaaaaaggagcaggacacctcagcacacctggagcgcatgaagaaaaatatggagcagaccattaaggaccttcagcacaggttggacgaggcagagcagatcgctctgaaaggcggtaagaagcagctacagaaacttgaagctagagtcagggagctggaaaacgagctcgaagccgaacagaagcgcaacgcggagagcgtaaaaggtatgcgaaaaagcgagagaagaatcaaggagttgacttatcagacagaggaagatcggaagaatctgctccgcctccaagacctagttgacaaactgcagcttaaggtgaaggcctacaaaagacaggccgaagaagcagaggagcaggcaaatacaaatttgtccaagttccggaaggtacagcatgaattggacgaagccgaggagcgagcggatatcgccgagtcccaggtgaataaactgcgggcaaagtctcgggatattggcaccaaagggcttaatgaagaata

SEQ ID NO: 231712 - DNA, 5822 bp, Artificial Sequence
  Description of Artificial Sequence: Synthetic coding sequence
atgggtgactctgaaatggcagtgtttggcgctgccgcaccgtatctgcggaagagtgaaaaagagcggttggaggcgcagaccaggccattcgacctcaaaaaggacgtctttgtgcctgatgacaagcaggagtttgttaaagccaagatcgtatctagggaaggaggtaaggtcaccgctgaaactgaatatggaaaaacggtgacagtcaaggaggaccaggtgatgcagcagaaccccccaaaatttgataagatcgaagacatggctatgctaacctttctgcacgaacccgctgtgctgtacaatttgaaagatagatatggatcatggatgatttacacctactccggacttttctgcgtaacagtgaacccatacaaatggcttccagtgtacactcccgaggtggtcgccgcatatcgagggaaaaagcggtctgaggcaccccctcatatcttttctattagcgacaatgcctaccagtacatgttaacagatagagaaaaccagtccatattgattacgggcgagtctggcgctggcaagacagtgaatactaaacgagtgatccaatattttgccgtcatcgctgccatcggagacagatccaagaaagaccagagtcccggaaagggcacattggaagatcagataattcaggcgaatcccgctctggaagcattcgggaatgcgaagacagtgcggaatgataacagttcacggttcggcaagtttattcgaattcactttggtgccactgggaaattagcctcggctgatatagagacttatctcctcgagaagagccgggtgatctttcaactgaaagctgagagggattatcacatcttttaccaaatcctttctaataaaaaacctgagcttttggatatgctccttatcaccaataacccttacgactatgcttttataagccagggagagaccaccgttgcctccatcgacgacgcagaggagctgatggccaccgacaatgcttttgatgtcctcgggttcaccagcgaagagaaaaacagtatgtataagttgactggcgcaattatgcatttcggcaacatgaaatttaagctgaaacagagagaggaacaggcagagccagatggaaccgaagaagctgataagtccgcatatctgatgggactcaatagcgccgatttgttaaaaggtctgtgccaccccagggtcaaggtcggtaacgaatacgtgaccaagggccagaatgtgcagcaggtcatttatgctacaggggcactcgcaaaagctgtgtacgagaggatgttcaactggatggttacccgaattaatgccacattggaaactaagcagccacgccagtacttcatcggcgtgcttgacatcgccggattcgagattttcgactttaattcatttgaacagctgtgcattaactttacaaatgagaagttacaacagttctttaatcaccacatgttcgtgcttgaacaggaggagtacaagaaagagggcattgaatggacatttatcgattttgggatggatctgcaggcttgtatagatctcatcgaaaaacctatgggcattatgtcaatccttgaggaagaatgtatgtttcccaaggccacagatatgacattcaaggctaagcttttcgataatcatctaggcaagagtgcaaattttcagaagcctcgaaacataaagggcaaacccgaggcccacttctccctgatccactatgctggaatcgtcgactataatataatcggatggctgcagaaaaataaagatcccttaaatgagactgtggtgggcttgtaccagaagagtagtctgaagcttctgtccaccctcttcgccaattacgctggggctgatgcgcctattgagaaaggaaaagggaaagccaaaaaaggaagctcttttcagactgtgtcggccctgcatagagagaatctgaataagttgatgactaatttacggagtacacacccccacttcgtgcggtgcattatccctaatgagaccaagtcacctggcgttatggataatcccctcgttatgcatcagctccggtgtaacggcgtgctcgaggggatcagaatctgccgaaaaggatttcctaataggattctctatggggatttccggcagagatacaggatcttgaatcccgctgccatccctgaggggcaattcattgacagccggaagggcgcagaaaaactgttaagcagtctggatatagatcataaccagtacaagttcgggcacactaaagtctttttcaaggctgggcttctcgggctactggaagagatgagagacgaaaggctgagcagaatcattacgcgaatacaggctcagtctagaggtgttttagccagaatggaatacaaaaaactgctcgagagacgcgattcactgctggtgatccaatggaatatccgtgcctttatgggagttaaaaattggccatggatgaaactctactttaagataaagccgctcctaaagtccgctgagagagaaaaggagatggcatctatgaaggaagaatttacccgactcaaagaggccctggagaaatcagaagccaggagaaaagagctggaggagaagatggtgagtctgctccaggagaaaaatgatttgcagcttcaggtacaggctgaacaggacaacctggcggatgccgaggagcgctgcgatcagctcataaagaataagatacaactggaagcgaaagtgaaagagatgaacgagcggctcgaggacgaggaagagatgaatgcggagctcacagccaaaaaacgcaagcttgaggatgagtgcagtgaattgaagcgggatatcgacgaccttgagctgacacttgccaaggtggagaaggagaaacatgccacagaaaataaagtcaaaaatcttactgaagaaatggcaggccttgatgaaatcatcgccaaactgactaaagagaagaaagctttacaagaggcccaccagcaggccctggacgatctacaggctgaggaagacaaagtgaacaccttgaccaaggccaaggtgaaactcgaacagcaggtagatgacttggaaggatctctcgagcaggagaaaaaagtcaggatggacttagaaagagcaaagcgcaaattggagggtgacttgaaactcacccaggagtctattatggacttggaaaatgacaagcaacagttggacgaacggctgaaaaaaaaagactttgaactcaatgccctcaacgcgcgtatcgaagacgagcaggctcttggttcacaactgcagaaaaagttgaaggaattacaagccagaatcgaggagttggaagaggagctcgaggccgagcggaccgcaagagcaaaggtagagaagctcagatctgacctctcccgcgagttggaggagatcagtgagagactggaagaagccggaggtgccacgagcgtgcagattgagatgaataagaagcgtgaagccgaattccaaaaaatgaggcgcgatctggaggaagccaccctgcagcatgaggcaactgccgcagctctgcgcaaaaaacacgctgattctgtggcagagcttggagagcagattgacaatctgcagagggtgaagcaaaagctggaaaaagagaaaagcgaattcaagctggaactagacgacgcactgctcgggctcccgagttccaattttttgttgcccccacccctgtctgctaacctcgagaaaatgtgtcgaacgttggaggatcaaatgaacgaacacaggtccaaggctgaggagacccagaggagtgtcaatgacctgacgagtcagcgggcaaagctgcagactgaaaatggcgaactgagtcgccagctggacgaaaaggaggcccttattagccagctaactcgcggtaagctgacatacacacagcaactcgaagatctgaagcgccagctggaggaggaagttaaagccaaaaacgctcttgcccatgccttacagagcgccagacacgactgtgatctccttagggaacagtacgaggaagaaaccgaagctaaggccgaactgcagcgggtgctgtcgaaggcaaatagcgaggtcgctcaatggaggactaaatacgagacggatgctatccaaagaacggaggaactggaagaagccaaaaaaaagctggcccagcgactgcaagaggcagaggaagccgtggaggccgtgaatgctaagtgcagctcgctggaaaagacaaagcatagactccagaacgagatcgaggacctgatggtggacgtagagaggagcaatgccgctgccgctgctctggataaaaaacagcgcaatttcgacaaaatcctcgctgagtggaagcagaaatacgaggagagtcagtccgaactggagtcgtcacagaaggaagcgcgatccctatcaaccgaattattcaagctgaagaacgcgtacgaggagtccttggaacacctggaaactttcaagcgtgagaataaaaatttacaggaggaaatctccgacctgacagaacagctggggagttcagggaaaactattcacgaactagagaaggtaagaaagcaactggaagcagagaagatggaattgcagtctgccttagaggaggccgaggcttctctggaacatgaggaaggcaagatcctccgcgctcagctggaatttaaccaaattaaggcagaaatcgagaggaagctggccgaaaaagacgaggagatggagcaagctaaacggaatcatctgagagttgtcgacagtctgcagacgagcctagatgcagaaacgcggtccaggaatgaggctcttcgggttaagaagaagatggagggggatctcaatgaaatggagatccagctgtcccacgccaacaggatggctgccgaggcccaaaagcaggtaaaaagtctccagtcccttcttaaggacactcaaatccagctagatgatgccgtccgcgctaatgacgacctcaaagaaaatatcgccatcgtggaaagaagaaacaatctccttcaggcagagttggaggaactgagagctgtggtggagcagaccgagagaagtaggaagctagctgaacaagaactgattgagacgagcgaacgagtgcagcttctgcactctcagaacacgtccttgattaaccagaaaaaaaagatggacgcagacctgtcccagctgcaaacggaagtggaagaggctgtgcaggagtgcagaaacgctgaagagaaggccaaaaaggccatcacagatgctgcgatgatggctgaggaacttaaaaaggagcaggacacgtctgcgcacctggaaagaatgaagaagaacatggaacagacgatcaaggaccttcagcatcggctggacgaggcagagcagatcgctttgaagggaggcaagaagcaactacagaaactggaggcccgagtcagggagttggagaacgaactggaggctgaacaaaaaaggaatgctgaaagcgtgaagggcatgaggaaatccgagagaaggataaaagaactgacttaccagactgaggaggatagaaaaaacctgctgaggctgcaggacctcgtggataagctgcagcttaaggtgaaagcttacaaaaggcaggccgaggaggcagaagagcaggcgaatactaacttatccaaatttcggaaggttcagcacgaattagatgaagccgaagaacgggcagacatcgccgagtcccaggtcaataagctgagggcaaaatcccgggatataggcacaaaaggtctgaatgaggagta

SEQ ID NO: 231713 - DNA, 5814 bp, Artificial Sequence
  Description of Artificial Sequence: Synthetic coding sequence
atgtccgccagttctgacgccgagatggcagtcttcggggaggctgcaccctatctgcgcaagtccgagaaagagcggattgaagctcagaacaagccattcgacgccaagacctcggtcttcgttgccgaacccaaggagagctatgttaagtccacaatccagtcaaaagaagggggaaaggttacagtgaagacagaggggggtgccacactgacagtgagggaggatcaggtgttccccatgaatcctccaaagtacgacaagattgaagacatggcaatgatgactcacctgcacgagcccggagtcctttataacctgaaagagcgatacgccgcatggatgatttatacctacagtgggctgttctgtgttacagtgaatccctacaagtggctccccgtgtacaaacctgaggtggtagccgcatacagggggaagaaacggcaggaagcgcctcctcacattttctctatctctgataatgcttatcagtttatgctgacagacagggagaaccagtcaatcctgatcacaggagaatccggcgcaggcaagactgtcaatacaaagagagttattcagtactttgcgacaattgccgtaacgggcgagaaaaagaaggatgagagtggcaagatgcaaggcactttagaagaccagattatcagcgcaaatcccctgctcgaagcatttgggaacgcaaaaacagtccgcaatgacaattcctctcgcttcggcaagttcataagaattcatttcggaactacaggaaagctagcaagcgcagacattgaaacatacctgctagagaaatccagggtcacctttcagctgaaagccgagcgctcctaccacattttctaccagatcacatctaacaagaagcccgacctcattgagatgttactgattacaacaaacccctatgattacgcatttgtgtctcagggggagatcacagtaccatcgatcgacgatcaggaggagctcatggcaactgattccgccatagacatcttaggattcactcccgaggaaaaggtgtcaatatataagctgacaggggcagtgatgcactacggcaatatgaaatttaagcagaagcagagagaagagcaagcagagcccgacggaaccgaggttgctgataaggcagcctatttgcagtccctgaactcagccgacctgttgaaagctctgtgttatcccagggtaaaggtgggcaacgagtacgtcactaagggacagactgttcagcaggtgtacaacgccgtgggagccctggctaaggccgtttacgagaagatgtttctgtggatggtgaccagaatcaaccagcaactggacaccaagcagcctcgacagtattttatcggagttcttgatatagctggctttgaaatcttcgatttcaactctctagaacagttgtgcatcaacttcaccaacgagaaactacagcagttctttaaccaccacatgttcgtgttagagcaggaagagtacaaaaaggaaggcatcgaatggaccttcatcgactttggaatggacttggccgcttgcatcgaacttatcgagaagcccctgggcattttctcaatcttggaggaggagtgcatgtttccaaaagccaccgacacctccttcaagaataaactgtacgaccaacatctcggaaagagtgccaacttccaaaagcccaaggtcgtgaagggcaaagccgaggcccacttctccctgatccactacgccggtacagttgattacaatataaccggatggctggataaaaacaaggatcctctcaacgacaccgtcgtgggactatatcagaagagcgcgatgaagacgttggcatccctgttttcaacctacgcttcagccgaagccgattcgtccgccaagaagggcgcaaagaaaaaaggtagttcttttcagacggtctctgccctattcagggaaaatctcaacaaactgatgactaacttaagaagtactcacccgcacttcgtcaggtgcattatccctaatgaaaccaagacacctggcgctatggagcacgaactcgtactgcaccaactgaggtgcaatggtgtgctggagggcatccgaatttgcagaaagggattcccgtcccgcatcctgtatggcgactttaaacagaggtacaaagtgttaaacgccagtgccatcccagaaggacagttcattgattctaaaaaagcatcagaaaaactattggcgagcatcgacattgatcacacgcagtataagttcggccataccaaggtgttctttaaagcaggcctgttggggctgctggaagagatgcgggacgagaaactcgcgcaaatcattaccagaacccaggctgtgtgtaggggtttcctcatgagggtcgaataccagaagatgctgcagcgtcgagaggcactgttctgcattcagtacaacgtcagggcatttatgaacgtgaagcattggccttggatgaagctgtttttcaagataaaacccctgctcaagtcagctgagacagagaaagagatggccactatgaaagaagagttccagaagacaaaagacgaattagctaagtcggaagccaaacggaaggaattggaagagaagatggttactctcctgaaagaaaagaacgatttgcagctacaagtccagtccgaagctgattctctggctgatgccgaagaacgttgcgagcagctgattaaaaacaagatccagcttgaggccaaaataaaagaggttacagagcgagccgaggaggaggaagagatcaacgctgagctaaccgccaaaaagcggaaacttgaggacgaatgttcagaattgaagaaagacattgacgacctggaactgacactggccaaggtggagaaagagaagcacgctaccgagaataaagtaaagaatttaacagaagaaatggcagggctcgatgaaactatcgctaaactgtccaaggagaagaaggccttgcaggagacccatcagcagactttagatgacctgcaggctgaagaggacaaggtgaatattctaacaaaagctaaaaccaagctcgagcagcaagttgacgacttggagggcagccttgaacaagagaagaagctgcggatggatctcgaaagggccaagagaaagttggagggcgaccttaagctggcgcaggaaagcacgatggatatggaaaatgataagcagcagctggacgaaaagttggaaaaaaaggaattcgagatctcaaatctcatctcaaagatagaggatgagcaggccgtcgaaatacagctgcagaagaagataaaagagctccaagccaggatcgaagaactgggtgaggagatcgaagcagagagagcgtccagagccaaggcagagaagcagcggtcggacctctcgcgggagttggaggagatctccgagcgcttggaggaggctggcggtgccactagcgcccaggttgagttgaataagaaacgtgaggcggagtttcagaagctccgcagggacctggaagaggcaactctgcagcacgaggctatggtggctgccctgagaaaaaagcatgccgatagtatggctgaattgggtgagcaaattgataacctgcaaagagtcaaacagaagttggaaaaagaaaaaagcgagctgaagatggagactgatgacctgagttccaacgcggaggctattagcaaggctaagggtaacctcgagaaaatgtgccggtccttagaggatcaggtgtccgagctcaaaacaaaagaagaggagcagcagcgtctcatcaacgatctcacggcacagcgtgcccgactacagacagaggcgggtgaatattcgcgccagctggatgagaaggacgcgttagtttctcagctctctcgctctaagcaggctagtactcagcagatagaggaactgaaacatcagcttgaggaagaaactaaggctaagaacgccttagcccatgcgttgcagtcttccagacacgattgtgaccttctacgggagcagtacgaggaggaacaagaaggcaaggcagaactccagagagcgctgtcaaaggcaaattctgaagttgcacagtggcggactaagtatgaaacggacgccatccagagaactgaagagctggaggaggcaaaaaagaagctcgctcagcggctccaggaagcagaggagcacgttgaagccgtcaacgctaagtgcgcttccctggaaaagacaaaacagcggttgcagaatgaggttgaagatcttatgttggatgtggaacgatccaatgccgcatgcgccgctcttgataagaagcagcgcaatttcgataaggtattatctgaatggaagcagaaatacgaagagactcaggctgaactcgaagctagccagaaagagtccaggtccctgtcaactgagcttttcaaggttaaaaatgtgtacgaggagtctctagaccagctcgagaccctgcgcagagagaacaaaaacctccagcaggagatctctgacctgacggagcagattgcagaagggggtaagcagattcacgagttggaaaaaattaagaaacaggtcgaacaggagaaatgtgagatacaagctgcgctcgaggaggccgaagcctccttagaacacgaggagggtaagatcctgcgcatccagctggagctgaatcaggttaagagcgaggtcgaccggaaaatagcggagaaggatgaagaaatcgaccagcttaagcgcaatcacacacgcgtcgttgagaccatgcagtcgaccttggatgccgaaatccgtagccgcaacgatgccttgcgcgtaaagaaaaaaatggaaggagatcttaacgaaatggagatccaactgaatcatgctaatcgcctcgcagcagaatcactaaggaattatcggaatactcagggcatccttaaagaaactcagctgcatctcgatgatgccctgcggggtcaggaggatcttaaggagcagctcgccattgttgagcgccgagcaaatctgctgcaggctgaaatcgaggaactctgggcaacactggaacaaaccgagaggagtcgcaagattgccgaacaggagctgttggatgcatccgaaagggtgcaactgttacacactcaaaatacctccctcattaatacaaagaaaaaactggagaacgacgtgagccagctgcaatcagaggtggaggaggtgattcaggagtcacggaatgccgaggagaaagccaagaaggccattacggacgccgcaatgatggcagaagaactgaagaaggaacaggatacaagcgcgcatctggagaggatgaagaagaacctagaacagaccgtcaaggatctgcagcacagactggatgaggctgaacaactagcactgaagggtggtaagaagcaaattcagaaactcgaagctcgggttagggaactggagggtgaggtcgagaacgaacagaaacgcaacgcagaagctgtaaagggcctgcggaaacacgagcgacgtgttaaggagctgacgtatcagactgaggaggaccggaaaaacgtcctgagattgcaggatctggtggataaactgcaggccaaggtaaagagctataagagacaggccgaagaagctgaggagcaatcaaacgccaatttgtctaaatttaggaagcttcaacacgagcttgaagaagccgaggagcgggctgatattgctgagtctcaggtgaataagctccgggtgaagtcacgggaagtccacacaaagatcagtgccgagtag

SEQ ID NO: 231714 - DNA, 5813 bp, Artificial Sequence
  Description of Artificial Sequence: Synthetic coding sequence
atgtctgcatcctctgacgctgagatggccgtcttcggtgaggcggctccatacttgcggaaaagcgagaaagagagaatcgaggctcagaataagcccttcgatgcgaaaacatccgtgtttgtcgccgagccgaaagaatcctatgtgaagtcaacaatccaatctaaggaagggggtaaagttacagttaaaactgaagggggagccacactgacggtcagggaagaccaagtcttccctatgaacccgccaaaatatgacaagatagaagatatggccatgatgactcacctgcatgaaccaggagtcctctataatctcaaagaacggtacgccgcttggatgatctatacttacagcgggttattctgcgtcacggtgaacccctacaagtggctcccggtgtacaaaccagaggtcgttgccgcttatcggggaaagaagaggcaggaggccccacctcacatcttttctatttcggacaatgcatatcaatttatgcttaccgatcgagagaaccaaagcatcttgattaccggggagagtggagctggtaagacagtaaataccaagagagtgattcagtattttgcaaccatcgcagtgacaggtgaaaagaaaaaggacgagtctggaaagatgcaggggacattggaggatcagatcatcagtgcaaatcctctgctcgaagcgttcggaaacgctaaaactgtgagaaacgataactcttccaggttcggcaaattcattcgtatacatttcggtaccacaggcaagctcgccagcgcagatattgagacttaccttttggaaaagagcagagtaactttccagttaaaggctgaacggtcctaccacattttctaccagattactagcaacaaaaagcccgatctcatagaaatgctgcttatcaccaccaacccctacgattacgcattcgtttctcagggtgaaatcacggtcccttctattgatgaccaggaagaattaatggcaaccgactccgcaatagatatcctcggattcacacccgaggaaaaggtgagcatctataaactcactggagccgttatgcactacgggaacatgaagtttaagcagaaacaaagggaggaacaagcagagcccgatgggacggaggtcgctgacaaagctgcatatttacagtccctcaacagtgccgacctgctgaaagccctatgttatcccagagttaaggtgggaaacgagtacgtgactaaaggccagacggttcagcaggtgtacaatgcagttggtgccctggctaaggctgtgtatgagaagatgtttctgtggatggtgacgcgtatcaaccaacagctggatactaaacagcccaggcagtacttcatcggcgttctggacatcgctggtttcgagatttttgacttcaattcactggagcagctctgtatcaatttcacgaatgaaaagctgcaacaatttttcaaccatcacatgttcgtactggaacaggaagaatataagaaggaggggattgagtggactttcatagactttggcatggacttggctgcctgtatcgaactgatcgagaaacccctcggcatcttctccattcttgaggaagagtgcatgttcccgaaagcgacagatacatcgtttaagaacaaattatatgatcagcatctcggcaaatccgcaaactttcagaaaccgaaagtcgtcaagggaaaggccgaagctcactttagcctgatccactacgcaggcacagtggactataacatcacaggctggcttgacaaaaataaggaccccctgaacgacaccgtggtgggcctgtatcagaaatcagccatgaagaccttggcctccctcttcagtacctatgcttctgctgaggccgactcttctgctaagaagggcgctaaaaaaaaggggtctagttttcagaccgtctccgccctttttcgggagaatctgaacaagctcatgaccaatctcaggtcgacgcacccacactttgtacgctgtatcataccaaatgagaccaagacacctggggcaatggagcatgaactggtgttgcatcaactgagatgcaatggggtcctagagggaatccgcatttgtagaaagggattcccatcaaggatcctttatggtgattttaaacagaggtataaggtcctgaacgcctctgcaattcccgagggacagtttatagacagtaagaaggcttctgaaaaactcctggcgtccatcgatattgaccacactcagtacaagtttggacacacaaaggtctttttcaaggcgggactgctgggcctcctggaagagatgcgcgatgagaaactcgcccagatcattactaggacgcaggccgtgtgccgaggctttcttatgcgcgtggagtatcaaaagatgctccagaggagggaggccctcttctgcatacagtacaacgtgagggccttcatgaatgttaagcactggccctggatgaaactgttttttaagatcaaaccactgctgaagtctgctgagactgagaaagagatggcaacgatgaaggaggagtttcagaaaacaaaagacgagctggccaaatctgaggcaaagcgaaaggaactggaggagaaaatggtgaccctgcttaaagagaagaatgacctgcaacttcaggtgcaatcagaggccgattctctagccgatgcagaggaaaggtgtgaacagctgattaaaaacaagatacaactggaggccaaaattaaagaggtgacagagagagctgaggaagaggaagagataaacgcagagctcaccgctaagaagagaaaattagaagatgaatgtagcgagcttaaaaaggacatagacgacctggaactgacactggccaaagtggagaaggagaaacacgccacagaaaacaaagtgaagaatctgactgaagagatggcagggctggatgagactatcgccaagctgagcaaagagaaaaaggctttgcaggagacccatcagcagaccctggatgatctgcaagcggaagaggacaaagttaacatactgaccaaggcaaagacgaaactggaacagcaggtggatgacctcgaaggtagcctggaacaggagaagaagctccgtatggatttggaaagagccaagcgcaagctggagggggatttgaaacttgcacaagaatcaaccatggacatggaaaacgataagcagcaactggatgaaaaactggaaaagaaagaattcgagattagtaatctgatatctaagatcgaggacgagcaagctgtggaaatccagttgcaaaagaaaattaaagagttgcaagcgaggatcgaggagctcggcgaggaaatagaggcggaacgggcttcccgcgctaaggctgagaagcagaggagtgatctgagccgggagctggaggagatctctgagcgcttggaagaagccggaggggctacttccgcacaggttgagctgaacaagaagagagaagccgagttccagaagctgagaagggacctagaagaggccaccctgcagcatgaagccatggttgctgctctacgtaagaagcatgctgattctatggcggagctcggcgaacagattgacaacctgcagcgggttaagcagaagctcgaaaaagagaagagcgagctcaagatggaaaccgatgacttaagttctaatgccgaagccatatctaaagcaaaaggcaatctcgagaaaatgtgtcgttctctagaggaccaggtgtccgagttaaagacgaaagaggaggagcagcagaggcttatcaacgacctcaccgcgcagagggccagactgcagaccgaagccggtgaatactcacgccagctggacgaaaaagatgctctggtgtcgcagctctcccgctcaaaacaggcttcgacccagcagatcgaagagttgaagcaccagctcgaggaggagaccaaggccaagaatgcgctggcccatgcacttcagtccagtcgccacgattgcgacctcctgcgggagcagtacgaagaggaacaagaaggcaaagcggaactgcaacgggcactttcgaaggcaaacagcgaggtcgcccaatggaggaccaaatacgagaccgacgccatccagcgcaccgaggaattggaggaagcaaagaagaagcttgcccagagattacaggaagccgaagaacacgtggaggccgtcaacgcaaagtgtgccagtctggagaaaacgaagcagcgtcttcaaaacgaggtggaagacctgatgcttgacgtcgaacgctctaacgccgcttgtgcagccctagataaaaagcagaggaactttgataaagttctgtcagagtggaagcagaagtacgaagagacccaggctgagctcgaagcgtcccagaaagaaagtcggagcctgagtaccgaactcttcaaggtaaagaatgtgtacgaggagtccctggatcagctggagacactgcgaagagagaacaaaaatctgcaacaggagatctcggacctgaccgaacagattgctgagggtggtaaacaaatccatgagctggaaaaaattaagaagcaagtagaacaagagaagtgcgagatccaagccgcactggaggaagccgaggccagtctcgaacacgaggagggaaagatcttgaggatacagcttgagctgaaccaagtaaagtccgaggtggaccgtaaaattgcggagaaggatgaagagatcgatcagctaaaaagaaatcatacccgcgttgtcgaaactatgcagtctactctcgacgctgaaatccgatctcgcaatgacgctcttagagttaaaaagaagatggagggcgacctaaatgagatggaaattcaactcaaccatgctaatcgtctggctgcagagtctcttaggaattataggaacacacaggggattttaaaagaaacgcagctgcatctcgacgatgccctgcggggacaggaagatctcaaggagcagctggccatagtggagaggcgggcaaatctcctgcaggctgaaatagaagagctgtgggctactctggagcagacagagaggtcaaggaagatagccgagcaggagctgttggatgcatctgagcgtgtgcaactgctccacacacagaatacctcactcatcaacacaaagaaaaagctggagaacgatgtgagccagctccagagcgaggttgaagaagttattcaggagtctcgtaatgcggaggagaaggctaaaaaggctatcactgacgctgcgatgatggctgaagaactgaagaaggaacaggatacaagcgcacacctggagcgcatgaaaaaaaacttagagcagacggtaaaggacctgcagcataggcttgatgaggcagaacagctcgctcttaagggcggtaagaaacagatacaaaaattggaggcaagggtgagagagctggagggcgaggtcgaaaacgaacagaagagaaacgctgaagccgttaaagggctacgcaaacacgagcgcagagttaaggagctgacttaccagacagaggaagatcgtaagaacgtgctacgattgcaggacctggtagataaactccaggcaaaggttaaaagctacaaacgccaggcggaggaagctgaggaacagtctaacgccaacctctccaagttccgtaaattgcaacacgaactggaggaggctgaggagcgtgccgatattgctgaatctcaggtcaacaagctgagagtgaagtctagggaagtgcatactaaaattagcgcagagta

SEQ ID NO: 231715 - DNA, 453 bp, Artificial Sequence
  Description of Artificial Sequence: Synthetic coding sequence
atgagcttctcagctgatcaaatcgctgagttcaaagaagcctttctcctttttgaccgaacaggggattccaagatcactctgagtcaggtgggggacgtgctacgggcacttggaactaaccccacgaatgctgaggttagaaaagtcctaggtaacccctccaacgaggagctgaacgcgaaaaagatcgaatttgaacagtttctgccaatgatgcaggccatttctaacaacaaagatcaggccacatatgaagatttcgtggagggcctccgggtgttcgataaggaggggaacggaaccgtaatgggcgcagaactgcggcatgtgttagcaacactcggagagaaaatgaaggaagaggaggtcgaggccctcatggcagggcaagaggatagtaacggctgtattaattatgaggccttcgtgaaacacataatgagtatttag

SEQ ID NO: 231716 - DNA, 585 bp, Artificial Sequence
  Description of Artificial Sequence: Synthetic coding sequence
atggctccaaagaaagacgtaaagaaacctgtggccgcagctgccgcagcaccagcaccggctcctgcaccggcaccggcacctgcgccagcgaaacccaaagaggagaaaattgatctaagtgcgattaaaatcgagttctccaaggaacagcaggatgagtttaaagaggctttcttgctattcgatagaactggtgactcaaagataactctatctcaggtgggggatgtacttcgcgcactgggaactaacccaaccaatgccgaagtgaggaaggtacttggaaaccctagcaatgaggagcttaatgccaagaagattgagttcgaacaattcctgccgatgatgcaagccatcagcaataataaagaccaggcaacatacgaagacttcgtcgagggacttcgggtattcgataaggaaggaaatgggacagttatgggcgcagagcttagacatgtgttggcaacactcggggaaaagatgaaagaggaggaggtggaagctctcatggccggtcaggaagattctaacggttgcatcaactacgaggctttcgtgaaacatattatgtctatctag

SEQ ID NO: 231717 - DNA, 519 bp, Artificial Sequence
  Description of Artificial Sequence: Synthetic coding sequence
atgagcagtaaaaaagccaaaacaaaaactacaaaaaagcgaccacaaagggcaacttccaacgtgtttgcaatgttcgaccagtctcaaatccaggagtttaaggaagcatttaacatgatcgaccagaatcgagacgggttcattgacaaagaggacctgcatgatatgctagccagcctgggaaaaaaccccactgatgcatacctagatgcgatgatgaatgaggcaccaggtcccataaattttacaatgttcctgacaatgtttggagaaaagcttaacggaacagacccggaggacgtgatcagaaacgcttttgcctgctttgacgaggaggctaccggcacgatccaggaagactacttgagggaactgctgactaccatgggagaccgatttacagatgaggaagtggacgaattatatagagaagctcccattgacaaaaagggaaactttaattacatcgagtttacgcggatattgaaacacggagccaaagataaggacgactag

SEQ ID NO: 231718 - DNA, 519 bp, Artificial Sequence
  Description of Artificial Sequence: Synthetic coding sequence
atgtcatccaagaaagccaaaactaagaccaccaaaaagaggcctcaaagggccacatccaatgtgtttgcaatgttcgaccagtctcagatccaggaatttaaagaggctttcaacatgattgatcagaatagggacggcttcattgacaaggaggatctccacgacatgctggcctccctcggcaaaaatcccactgacgcatacctagacgctatgatgaatgaagctcctggtcctattaattttaccatgttccttacaatgttcggagagaagctcaatggcactgaccctgaggacgttatacggaatgccttcgcttgttttgacgaagaggcaacgggtacaatccaggaagactacctgagagagctgctgacaactatgggggaccgctttactgatgaggaggtcgatgaactttaccgcgaggcaccaatagataaaaagggaaacttcaactatattgagtttacgcgcatcctgaagcacggggctaaagacaaagacgattag

SEQ ID NO: 231719 - DNA, 519 bp, Artificial Sequence
  Description of Artificial Sequence: Synthetic coding sequence
atgtcctccaagaaagccaagactaagaccaccaagaaacggccacagagagcaacctccaatgtcttcgcgatgttcgatcagagtcagatccaggaatttaaagaggcctttaacatgattgaccagaacagggatggattcatcgacaaagaggacctgcatgatatgctcgctagcctcggcaagaatccaaccgacgcatatctggatgccatgatgaacgaagcccctggtcccattaatttcacaatgtttctcacaatgttcggcgaaaagttgaatggcacagatcctgaagacgtcataaggaacgcctttgcttgtttcgacgaagaggcgactggtaccatccaagaagactacctccgggagctcctgaccacaatgggcgataggttcaccgacgaggaggtggatgagctgtaccgtgaagctcccatagacaaaaagggaaattttaattacatagagtttaccaggattctgaaacacggcgcaaaagataaagacgattag

SEQ ID NO: 231720 - DNA, 519 bp, Artificial Sequence
  Description of Artificial Sequence: Synthetic coding sequence
atgtcaagcaagaaggccaagacaaagacaacaaagaagcgcccacagagagccacgtcgaatgtcttcgcaatgttcgatcagtcccagatccaggaatttaaggaagctttcaacatgattgaccagaatagagatggattcattgacaaggaggatctccacgacatgctggcctcacttggcaagaaccccaccgatgcatacctggatgcaatgatgaatgaagctcccggtccgatcaactttaccatgttcctgaccatgttcggggaaaaactcaatggaacagatccggaggacgtcatccggaatgcattcgcctgctttgacgaagaagctacgggcaccatccaggaagattatctgagggaacttcttaccactatgggagacagatttaccgatgaagaggtagacgaactctaccgggaagcccctattgataagaaggggaacttcaattatatcgagtttacgcgcattctgaagcacggcgctaaagacaaggatgattag

SEQ ID NO: 231721 - DNA, 627 bp, Artificial Sequence
  Description of Artificial Sequence: Synthetic coding sequence
atggctctcggccagaaactgttcataacaatgagcagaggcgcagggcgtctacagggcactctgtgggccctggtgttcctgggtatcctggtgggaatggtggttccatctcctgctggcaccagagcaaacaatacattactagacagcagaggatgggggacattattgtcccgatctcgggcagggctggcgggagaaattgccggagttaattgggagtccggctatctggtcggcattaaacggcaaagacgactttactgcaacgtggggattggtttccaccttcaggttctcccggatggtcgaattagcgggactcacgaggagaatccatacagcttgctcgaaatttctactgtcgaacggggagtggtgtccctgtttggagtgagaagcgccctgtttgtcgccatgaatagtaagggacgactctacgcaaccccctctttccaggaggagtgtaagttcagggagaccctgcttcctaacaactacaatgcctacgagtcagacctgtatcagggcacctatattgcacttagcaaatacggccgtgtgaaaagaggttctaaagtctctcccataatgaccgttacccactttctccctagaatctag

SEQ ID NO: 231722 - DNA, 588 bp, Artificial Sequence
  Description of Artificial Sequence: Synthetic coding sequence
atggccccaaagaagcctgagcccaagaaggacgatgccaaggcagcccctaaggccgcacccgcacctgcccctcctcctgagcctgaacgtcctaaagaggtggagtttgacgcgagcaaaattaaaatcgaatttacacccgagcaaatcgaggagttcaaggaggccttcatgctcttcgatcgtactcctaaatgcgagatgaagatcacttacggtcagtgcggagacgtattacgggctctggggcaaaatccgacccaggccgaggtgctacgcgtgctcggaaaaccacgccaggaagagttgaatacgaagatgatggactttgagacatttctcccaatgctgcaacacatctccaaaaataaggacaccggcacttacgaggatttcgtggaaggcctaagggtgttcgacaaagaggggaatggcacggtgatgggcgctgagctgcgacacgtcctggcgacgctcggagaaagactgactgaagatgaagttgaaaaattaatggctggtcaagaggactccaatggctgtatcaactacgaggcgttcgtaaaacacataatgtccagctag

SEQ ID NO: 231723 - DNA, 588 bp, Artificial Sequence
  Description of Artificial Sequence: Synthetic coding sequence
atggctcctaagaagcctgagcccaaaaaggacgatgccaaggccgctccgaaggccgctccggctcccgctccgcctcccgaacccgaacgccctaaagaggttgagtttgatgcctctaaaatcaaaatcgagtttacacccgagcaaatcgaagaatttaaagaagcatttatgctcttcgacagaacacccaagtgtgagatgaaaataacctacggacagtgcggtgacgtattgcgggcactcggacagaaccctacacaagccgaggttctgagggtcctgggaaagcctcgtcaggaggagcttaatacaaagatgatggattttgagaccttccttcccatgctccagcatatcagcaaaaacaaggatacaggaacgtatgaagatttcgttgagggtctgcgagtgttcgacaaggagggcaatggcactgtgatgggcgctgagttacgccacgtcctggccactctgggtgagcgcctgacagaggatgaggtagagaagctgatggccggacaggaagacagcaatggatgcatcaattacgaggctttcgttaaacatattatgtcctcctag

SEQ ID NO: 231724 - DNA, 141 bp, Artificial Sequence
  Description of Artificial Sequence: Synthetic coding sequence
atggcacctaagaagccggaacctaaaaaggacgacgcaaaggctgcacccaaggcggctcctgctccagccccacctcctgagccggaacgccctaaggaggtcgagttcgatgctagtaagataaaaattgagttttag

SEQ ID NO: 231725 - DNA, 594 bp, Artificial Sequence
  Description of Artificial Sequence: Synthetic coding sequence
atggccccaaagaaacctgagccaaaaaaagaggccgctaaaccagcacccgctcccgcaccagccccagcacccgcaccggcaccagcgcctgaagcaccgaaggagcctgcatttgaccctaagtccgttaagatcgatttcaccgctgatcagattgaagaattcaaagaggcatttagcctttttgatcggactcccactggggaaatgaaaataacttacggccagtgcggggacgttctcagggctctggggcagaaccctaccaacgccgaggtgctgcgtgtgctaggtaaacctaaacctgaagagatgaacgtaaagatgctcgactttgaaactttcctgccaatcttgcagcatatatctcgcaataaggaacaggggacctacgaggattttgtcgaggggttgcgggtctttgataaagagtctaatgggaccgttatgggtgcggagctgaggcacgtactcgctaccttaggcgaaaagatgactgaggccgaggttgagcagctcctagctggacaggaggatgccaacggttgcatcaattatgaggcattcgtcaaacacattatgtccggttag

SEQ ID NO: 231726 - DNA, 594 bp, Artificial Sequence
  Description of Artificial Sequence: Synthetic coding sequence
atggcaccaaagaagccagaaccaaagaaagaggccgcaaagccggcacctgcccctgccccagcacccgcaccagcccctgcacccgctccggaagcgcctaaggaacctgcatttgaccccaagtcagtaaaaatagacttcactgccgaccagatcgaggagttcaaagaggccttttccctattcgaccgtacgcctacaggcgaaatgaagatcacctatgggcagtgcggggacgtgctcagagcgctcgggcagaaccctaccaatgcagaagtcctgcgcgtgttgggcaagccaaagcccgaggagatgaacgttaaaatgttagatttcgagaccttccttcctatccttcagcacatatcccgcaataaggaacagggcacttacgaagatttcgtggagggcctgcgcgtgtttgacaaggagtcaaatggcaccgtgatgggtgccgagctccgtcatgtcctcgccactcttggcgagaagatgactgaagcagaggtagagcagctcctggcaggccaagaagacgcaaacggatgcattaattatgaggcctttgtaaaacatatcatgagcggatag

SEQ ID NO: 231727 - DNA, 264 bp, Artificial Sequence
  Description of Artificial Sequence: Synthetic coding sequence
cctgaagcaccaaaggagcccgctttcgatcccaagagcgtgaaagtgatcgggtgtccatgtcccaggtctcagtcccacggagcagtaatcgactttaccgctgatcagattgaggaattcaaggaggcttttatgggagcggaactccgccacgtcctcgcgacactcgtcattaagtccgctcctccccctaagcccacagccggagagaaaatgaccgaagcagaggtcgagcaactccttgccggacaggaggactag

SEQ ID NO: 231728 - DNA, 522 bp, Artificial Sequence
  Description of Artificial Sequence: Synthetic coding sequence
atggccagccgcaagacaaagaagaaggagggcggagcgttacgcgctcagagagctagttctaatgtgttcagtaattttgagcaaactcagattcaagagttcaaagaagccttcacgctgatggaccagaatcgggatggctttatagataaggaagatctgaaagacacatacgccagcttggggaagacaaatgtgaaagatgatgaacttgacgccatgctcaaagaagcttcaggccctatcaacttcactatgtttctgaacctgttcggcgagaagctgtctgggaccgatgccgaggagacaatcctgaacgcattcaaaatgctggaccccgatggcaaggggaagatcaataaagaatacattaagagactgctcatgtcccaggccgataaaatgacagccgaggaggtcgaccagatgttccagtttgctagcatagacgtagccggtaacctggattataaagccttgtcctacgtaatcactcacggagaggagaaggaagaatag

SEQ ID NO: 231729 - DNA, 399 bp, Artificial Sequence
  Description of Artificial Sequence: Synthetic coding sequence
atggaccagaatcgcgatgggtttattgacaaggaggatctgaaagacacatacgcttcactcgggaaaaccaacgtgaaagatgatgaactggatgcaatgctaaaggaagcctccgggcctattaacttcaccatgttcctgaatcttttcggggagaaactatctgggacagatgctgaggaaaccattctgaatgcgtttaagatgctggaccccgatgggaagggcaagatcaacaaggagtatatcaagcggctgttgatgtcccaggccgataaaatgacagctgaagaggtagaccaaatgtttcagttcgccagtattgacgtggcaggcaacctggactataaagctctgagttacgtgattacacacggggaggaaaaggaggaatag

SEQ ID NO: 231730 - DNA, 399 bp, Artificial Sequence
  Description of Artificial Sequence: Synthetic coding sequence
atggaccagaatcgcgatggctttatcgataaggaggacctgaaagatacctacgcctccctcgggaagaccaacgtcaaggatgacgagcttgacgccatgttaaaggaggcctcaggaccgataaattttactatgttcctcaatctgtttggcgagaaactgtccggaaccgatgctgaggagaccatactgaatgctttcaagatgcttgacccagacggcaaaggaaaaattaataaggaatatattaaacggttactgatgagtcaagcagataagatgacagccgaagaggtcgatcagatgtttcaattcgcctcaatcgacgttgccggaaaccttgactataaggccctgtcatacgttatcacccatggagaagaaaaagaggaatag

SEQ ID NO: 231731 - DNA, 399 bp, Artificial Sequence
  Description of Artificial Sequence: Synthetic coding sequence
atggaccagaatagagacgggttcatcgacaaagaagatctgaaagacacatatgcatccctcggcaagactaatgtcaaggatgacgagctggatgccatgctaaaagaggcaagcggacctattaattttacaatgtttcttaaccttttcggggagaaactttccggcacagatgcagaggagacaattctgaatgcgttcaaaatgttggatcctgacggaaaggggaagatcaataaggagtacattaagcgcctgctgatgagccaggcagataagatgactgccgaagaagtggatcaaatgttccagtttgccagtatagatgtcgccggtaacttggactacaaggccctttcctacgtgattacacacggcgaggaaaaggaagagtag

SEQ ID NO: 231732 - DNA, 456 bp, Artificial Sequence
  Description of Artificial Sequence: Synthetic coding sequence
atgtgtgacttcacggaagatcaaactgctgagttcaaggaggcattccagctgttcgaccggaccggagacggaaaaattctctacagtcaatgtggggacgtcatgagagctctgggccagaatcctaccaatgccgaagtcctaaaggtgctggggaatccaaagagcgatgaaatgaatgtaaaagtgctcgattttgagcacttcctaccgatgttgcagaccgtggcgaaaaataaggaccaggggacctatgaggattatgtggaggggcttagggtgtttgacaaagaggggaacggcactgttatgggcgctgaaatccggcacgtgttggtcaccctgggggagaagatgacagaagaggaagtggagatgctcgtggccggacacgaagattccaacggctgtataaactacgaggaattagtccgaatggtgctgaacggctag

SEQ ID NO: 231733 - DNA, 456 bp, Artificial Sequence
  Description of Artificial Sequence: Synthetic coding sequence
atgtgcgacttcaccgaagaccagaccgccgaattcaaagaggcattccagttattcgatagaactggagacggtaaaattttgtatagccagtgtggcgacgtcatgagagcactgggtcagaaccccactaatgctgaagtattgaaagtccttgggaatcctaaatccgacgagatgaacgtgaaagtcctggattttgagcacttcctaccaatgctgcagacagtagcgaagaataaggatcaaggtacatacgaggactacgtggaaggcctgcgggtcttcgataaagagggaaacggtaccgtcatgggggctgaaatcaggcacgttctcgttactttaggagagaagatgactgaagaggaggttgagatgctcgtcgccggacacgaagattctaacggatgcattaattatgaagcatttgtgcgccatatcctatcaggatag

SEQ ID NO: 231734 - DNA, 456 bp, Artificial Sequence
  Description of Artificial Sequence: Synthetic coding sequence
atgtgtgattttaccgaagaccagacagcagagtttaaggaggcatttcagctgtttgataggacaggggacggaaaaatcctgtacagtcagtgcggcgatgtgatgagggccctcgggcagaaccctacgaatgccgaagtgctgaaggtgctcggcaatcctaaatcggacgaaatgaatgtaaaagtgctggactttgagcatttccttcccatgctccaaaccgttgcgaagaacaaagatcaaggcacatacgaggactacgttgagggcctccgtgtgtttgataaggagggcaacgggaccgtgatgggggctgagatcaggcatgttcttgtgaccctcggggagaaaatgaccgaagaagaagtggaaatgctcgtagctgggcatgaggatagcaacggctgtattaactatgaggccttcgttcgacatatcttgtctggctag

SEQ ID NO: 231735 - DNA, 1491 bp, Artificial Sequence
  Description of Artificial Sequence: Synthetic coding sequence
atgtcctctatggaggagatacaggtagagctgcagtgtgccgacctttggaagcggttccacgacattggcaccgagatgataataactaaggccggaaggcgcatgtttcccgcaatgagggttaagattacaggcctggatccccaccaacagtattacattgcaatggacattgtccccgttgataacaagcgttataggtacgtataccactcaagcaagtggatggtagctggaaatgccgattctcctgtgcctcctagagtgtacatccacccagattcactggcatcaggggacacatggatgcggcaagtagtttcattcgataaactaaagctcaccaacaatgaactggacgaccaaggtcatataattttgcacagtatgcataagtaccaaccacgcgttcacgtgattaggaaggacttcagctctgacctgagtccgaccaagccagttcctgtgggcgacggcgtgaaaacctttaacttcccggagacagtgtttaccactgtcactgcctaccagaaccagcagattacacgcctcaagatcgaccgaaacccattcgccaaggggttccgcgattcaggacgcaatagaaccgggctggaggccatcatggagacatacgctttttggcggccacctgtgcgaacccttacttttgaagacttcacaacgatgcagaagcagcagggcggttctaccgggacaagtcccactacgtccagtactggcaccccgtctccaagcgctagctcccacctactgagcccaagctgctccccgccaacattccacctggccccaaatactttcaatgtcggatgtagggagtcgcaactgtgtaaccttaatttgtcagactaccccccttgtgcacgaagtaacatggccgcactccagagctatcccggactgtcagatagtggttacaatcggctgcagagcggcaccacgtcagccacccaaccatccgagaccttcatgccccagagaaccccctcgttgatttccgggatccccactcccccaagtcttccaggcaattcaaagatggaggcatacggcggacagctgggcagcttcccaacatctcagttccagtacgtgatgcaagctggcaacgccgcatcaagcagtagtagccctcatatgttcgggggttcccacatgcaacagagctcctacaatgcttttagcctgcataatccttataacctatacggctacaactttcccacttcgccacggctggctgccagtcctgagaagctgagtgccagccagtcaacccttttgtgttcctcgccctcaaatggggctttcggtgagaggcagtacctgccttccgggatggagcacagcatgcacatgatcagtccctctcccaacaatcagcaagcgacgaatacatgtgacggccgacagtacggcgcagtgcccggttccagcagtcagatgagcgttcacatggtgtag

SEQ ID NO: 231736 - DNA, 627 bp, Artificial Sequence
  Description of Artificial Sequence: Synthetic coding sequence
atgccccctaagaaggacgtcccagtgaagaaacccgcaggtccctccattagcaagcccgcagccaagcccgcagccgctggggctccgcctgccaaaacaaaagccgaaccagctgtgccacaagcaccccagaagacccaagagccccctgtggacctctctaaggtggtgattgaatttaacaaagatcagttggaggaattcaaggaggcttttgagctttttgatagggtcggtgatggaaagattctgtatagccagtgcggtgatgttatgagggccttggggcaaaaccctacaaacgcggaagtcttgaaggtccttggtaatccgaaatctgacgaacttaaatctcgaagagttgacttcgaaacattcctgcccatgcttcaggctgtggccaaaaatagaggacaaggaacgtacgaggactacctggaaggctttcgggtctttgacaaggaagggaatgggaaggtcatgggagctgaactgcgacatgttctgacgaccttaggggagaaaatgacagaagaggaggtggaaactgtactggcaggtcatgaggattccaacggttgcataaactacgaagcttttttgaaacacatcctctcggtctag

SEQ ID NO: 231737 - DNA, 90 bp, Artificial Sequence
  Description of Artificial Sequence: Synthetic coding sequence
atgcccccaaaaaaggacgtaccagtgaagaagcctgccggtccatccatttccaaaccagccgcaaaacccgcagccgctggcgcttag

SEQ ID NO: 231738 - DNA, 627 bp, Artificial Sequence
  Description of Artificial Sequence: Synthetic coding sequence
atgccacctaagaaagatgtgccggtgaagaagcccgctggaccctccatatcaaaaccggcagcaaaacccgcagccgcaggcgctcctccagctaagaccaaggccgaacctgcagtgcctcaggccccacagaagacccaggagccccctgtggatctaagtaaggtagtaattgagttcaataaggatcagttagaggagttcaaagaagcttttgaactgttcgatagagttggcgacggtaagatcctttattcgcaatgcggcgacgtgatgcgtgccctgggccagaatcccacaaacgctgaggtacttaaggtgctgggcaaccccaagagtgacgaactcaagagcagaagggtggatttcgaaacttttctacccatgctccaggcggtggccaaaaatagaggccaggggacttacgaagactatcttgaaggcttcagagtgtttgataaggaggggaacggcaaggtgatgggtgcagagttgcggcatgtcctcacaacgctaggcgagaaaatgaccgaagaggaggtggaaactgtgctcgcaggtcatgaagatagtaacggctgcataaattatgaagccttcctcaagcatattctgagtgtatag

SEQ ID NO: 231739 - DNA, 3477 bp, Artificial Sequence
  Description of Artificial Sequence: Synthetic coding sequence
atggctgccgttcgaggggctcctcttttatcttgtttgctggctctgttagcgctgtgtcccggagggaggccccaaaccgttttgacagatgatgagattgaggagttcctagaaggcttcctgagtgagttagaacccgaacctcgtgaggatgatgtggaagctcctccacctcccgagcccaccccccgtgttaggaaggcacaggccggtgggaagccaggcaagcgcccagggactgctgctgaagttccgcctgagaagactaaggataaaggcaaaaaagggaagaaggacaaggggccaaaagttccgaaggaatcgctcgagggttcccccagacctcctaaaaaagggaaggagaagccaccaaaagctacaaagaaaccgaaagaaaaaccccctaaggccaccaaaaagccgaaggaaaagcccccaaaggcaactaagaaacctaaagaaaaaccacctaaggcgactaaaaagccacccagtgggaaacggccacctattctagcaccatctgaaacgctcgagtggccgttgccacctccaccaagtcctgggccagaggagctgcctcaggagggaggtgctcctttgagcaacaactggcagaatcctggcgaagagacccacgtggaggctcgcgaacatcaaccagagcctgaagaagaaacagagcagccaacacttgattacaacgaccaaatcgaacgtgaggactatgaggatttcgagtacattcgccgtcaaaagcagccgaggcctcctccatcgaggcggagaagacctgaaagagtttggcctgaacccccagaagaaaaggcgcctgcccctgcacctgaggagcgtatcgaaccacccgtcaagccactgttgcctcctctgccaccggactacggcgatgggtacgtgattcccaattatgatgatatggactattatttcgggcctcctcctcctcagaaaccagacgccgagagacaaacggatgaagagaaagaggaactcaagaagcctaagaaggaggactcgtctccaaaagaagagacggataagtgggcagttgaaaagggcaaggaccacaaagagcctcgcaagggggaagagctcgaagaagagtggacccccacagaaaaagttaagtgtcctcccatcggcatggagtctcaccgcatcgaggataatcagatcagagcctccagtatgcttcggcacggcctgggtgctcagcgcggacgcctgaatatgcagactggcgcaaccgaggacgattactatgacggagcttggtgcgcagaggatgatgctagaactcagtggatcgaagttgacacccggaggaccacgcgcttcaccggcgtcattacacaaggaagagacagcagcatacacgatgattttgtgacgacattctttgtcggtttctctaacgacagtcaaacatgggtgatgtacaccaacggatatgaagagatgactttccacggaaatgtagacaaggatacaccagtactgtctgagcttccagagccggtggtggcccgtttcattcgtatataccccctgacctggaacggctccctctgtatgcgactggaagtcctgggttgcagcgtggccccagtttactcttactacgcacagaatgaagtagtggctactgatgatttggatttcagacaccactcctacaaagatatgcggcagttaatgaaagtagttaacgaggaatgtcccacaatcaccagaacttatagtctgggaaagtccagccggggtttaaagatctacgccatggaaatctcagataacccaggggagcacgagctgggcgagcccgaatttcgctacactgcaggcatccacggcaatgaggtgctgggtcgcgagttgctgctgctcctgatgcagtacctgtgccgagagtatagagatggcaacccaagggtgcggagcctggtccaggatacaagaattcatctagtgcctagcctaaaccctgacggctacgaggtagccgcacaaatgggatctgagttcggaaattgggcactgggcctgtggacagaagaggggttcgatattttcgaggacttccccgatctgaactccgtgctgtggggggcagaagagcggaagtgggtgccctaccgtgtgcccaacaacaaccttccaataccggaaaggtacctgtctcccgacgcgacagttagcacagaagttagggccataattgcatggatggaaaaaaatccgttcgtgcttggtgcaaatcttaatgggggtgagagactcgtttcctatccttatgacatggctagaacaccaacacaggagcagcttttggctgcagccatggcagccgcacggggtgaggacgaggacgaggtgtctgaagcccaagagaccccagaccacgccatcttccggtggttggctatctccttcgcctctgcccatttgacactgaccgaaccgtaccggggtggctgtcaagctcaagactacaccggcggtatgggtattgttaatggagctaagtggaatccgcgaacaggcaccatcaacgatttttcctaccttcatacaaattgtctggaactctccttttacttaggttgtgataaattcccacacgagtccgagcttcctcgcgagtgggagaacaataaggaggctcttttaacctttatggagcaggttcatcggggaatcaaaggggtagtaaccgatgagcagggcatccccattgcaaatgccactatctccgtaagcggaatcaatcatggagtgaagacagcaagcggtggcgactattggaggattctgaaccctggggagtaccgcgttaccgctcacgcagaaggctacacgccctctgccaagacttgtaacgttgattatgacatcggcgctacccagtgcaattttattttagccagatctaactggaagaggatccgtgaaattatggccatgaatggcaatagaccgatcccccatattgacccaagccgaccaatgacgccacagcagcgaaggttgcagcagcggaggctgcagcacagactgaggctccgggctcaaatgaggctgcggaggctgaatgcaaccaccactctagggcctcatacggttcctcctacactcccaccagctcctgcaaccactttaagtacaacgatcgagccttggggcctgattccacctaccactgccggatgggaagaatccgagacagagacttataccgaagtagtgacggaattcgggactgaggtcgagcccgagttcggaactaaggtggaaccagaatttgaaacacaacttgagccagagtttgaaactcagctcgaacccgagttcgaagaggaggaggaggaagaaaaagaggaagaaatcgctaccggccaggcattcccatttaccaccgtggagacatacactgtaaattttggggacttttag

SEQ ID NO: 231740 - DNA, 447 bp, Artificial Sequence
  Description of Artificial Sequence: Synthetic coding sequence
atgttcgaacaagctcaaatccaggagtttaaggaggccttctcttgcatcgaccaaaacagggacgggataatctgcaaagccgatttgcgtgagacctatagccaactggggaaagtgagtgtgccagaagaagagctggatgctatgttgcaggaggggaaaggaccaattaactttacagttttcctcactctcttcggcgagaaactgaatgggactgacccagaagaggcaattctctccgcctttagaatgtttgacccctctggcaagggagtcgttaataaagatgagttcaaacagctgctcctcacacaggctgacaagtttagccccgctgaagtcgagcagatgtttgctctgactcctatggatttggcgggaaatatcgattataaatcgctatgctacatcattacacacggtgatgagaaggaagagtag

SEQ ID NO: 231741 - DNA, 1128 bp, Artificial Sequence
  Description of Artificial Sequence: Synthetic coding sequence
atgcagaaacttcaactgtgtgtatatatatatctgttcatgctcatcgtggctggaccagtcgatctgaacgaaaattccgaacagaaggaaaatgtcgaaaaggaggggctttgcaacgcctgcacgtggaggcagaatactaaatccagtaggatcgaggccatcaaaatccaaatactgagcaagcttcgattggagacagctcctaacataagcaaggatgtcattcggcagctcctccccaaggctccacccctgagagagctgatcgatcagtacgacgtgcagcgggacgattcctccgatggctccttggaagatgacgactatcacgcgaccaccgaaactattattacgatgccaaccgaaagtgacttcttaatgcaggtcgatggaaagccgaaatgctgttttttcaaattctcctccaaaattcaatacaataaggtggtcaaggcccagttatggatttatctcaggcctgtggagacccccacaacagtgtttgttcagatcttgcgacttatcaagcctatgaaggacggaactaggtatacagggatcaggtctctcaaactcgacatgaaccccggaaccggcatctggcaatccattgatgtgaaaaccgttctacaaaattggctgaagcagccagagtctaacctgggtattgagataaaagcgctggacgagaacggccatgatctcgctgtgacatttcccggtcctggcgaggatggcctgaacccattcctagaagtgaaagttaccgatactcccaagagatcccgacgcgattttggactggattgtgatgaacactctaccgaatcccgttgctgcagatatcccctgaccgtagattttgaagcatttggctgggattggattatcgccccaaagcggtataaagctaactattgcagtggcgagtgtgagtttgtctttctccagaaatatccccatacccacctcgtacaccaggctaaccctagagggtccgctgggccttgctgtacgcctactaagatgagtcccataaacatgctatatttcaacggcaaagaacagattatttacggcaagatcccagctatggttgtcgatcggtgtggctgcagttag

SEQ ID NO: 231742 - DNA, 1497 bp, Artificial Sequence
  Description of Artificial Sequence: Synthetic coding sequence
atgtttaactacgaaagacccaaacacttcattcagtcccaaaatccctgtggctcccgactccagccaccaggcccagaaacaagctctttcagttctcagactaagcagtccagcatcattattcagcctcgtcagtgtactgagcagaggttctcagctagcagcaccttgtcgtcacacatcacaatgtctagtagtgcttttcccgctagcccaaaacagcacgccggtagcaatcctggccagcgtgtgacaacaacctataaccagagcccagccagctttttaagcagtattctgccgagtcagcccgactataattcatccaaaatcccctctgccatggatagcaactatcagcagagctctgccggacagcccatcaacgcaaagccgtcgcagacggctaacgctaagccaatcccccgtacccccgaccacgagattcagggctccaaagaggcacttattcaagaccttgaaaggaagttgaagtgcaaagacacattacttcataatggaaatcagaggctgacgtacgaggagaagatggccagaagattactgggccctcagaacgctgcagcagtgtttcaggcacaggacgattctggggctcaagacagtcaacagcataatagcgaacatgccagactacaggttcccacttcacaagtccgatccagatccacctcacgaggagatgtgaatgaccaagatgctatccaggagaaattctaccccccaagatttattcaagtgcctgagaacatgagtatcgatgaaggacggttttgccgcatggatttcaaagttagtggactccccgcacctgatgtctcatggtacctaaatggccgaacagtccaaagtgatgacttgcataagatgatcgtaagcgaaaagggcctgcacagccttattttcgaggtggtccgagccagtgacgcaggagcatacgcctgcgtagccaagaaccgcgcaggcgaagcgaccttcacggtacagctggacgttctcgcaaaggagcacaagagggccccaatgtttatctataaacctcagagtaagaaagtcctggaaggcgattccgtgaagcttgaatgtcagatcagcgctatcccacctcccaaactgttctggaaaagaaacaatgagatggtccagttcaacactgacagaatttcactgtaccaggacaacaccggtagggtaacactgctgattaaagatgtgaataagaaagacgccggttggtacaccgtgtccgcggtgaatgaagccggtgtgacgacctgcaacacaaggcttgatgtgacggcaaggcctaatcagaccttgccagcacccaaacaacttagggtgcgaccaacattctcaaagtatctcgcccttaacggaaaaggactcaacgtcaagcaagccttcaatcccgaaggagaatttcaaagattggctgcccagtccggcttatatgagtccgaggagctatag

SEQ ID NO: 231743 - DNA, 945 bp, Artificial Sequence
  Description of Artificial Sequence: Synthetic coding sequence
atggcacgacgacttctgggaccacagaatgctgcggctgttttccaggcccaggatgacagcggcgcacaagactcccagcaacacaattcagaacacgcccgtctccaggtccctacaagccaagtccggagcaggagcacgtcccgtggtgatgtgaatgatcaggatgccattcaagagaaattctacccaccacgctttattcaagtacccgagaatatgtccatcgacgagggtcgtttctgtcggatggacttcaaggtatcagggctcccagcccctgatgttagttggtacctaaatgggagaactgtacagtccgatgatctgcacaagatgatcgtgagcgaaaaaggcctgcactccctgatttttgaggtcgtacgcgcatctgatgcaggggcttacgcttgtgttgcaaagaaccgggcaggggaggccacctttacagttcagctcgacgtgctcgccaaagaacacaaaagggctccaatgtttatctacaaaccccagagcaagaaggtcctggaaggagatagcgttaagctggagtgccagattagcgctatacctccgcctaaactcttttggaagcggaacaacgagatggtgcagttcaatactgaccgaatatccctgtatcaggataataccgggcgagtgaccctgctgattaaagatgtgaacaaaaaagatgcaggttggtataccgtttccgccgttaatgaggctggtgtcaccacctgtaatacgcgccttgatgtcacagcacgccctaaccaaacattgccagcgccaaaacagctgcgtgtaagacctacatttagcaagtacctcgccctcaacggaaagggcctgaatgtcaagcaggccttcaacccggagggggagtttcagagactggcagcccagtccggcctctatgaatcagaggaattgtag

SEQ ID NO: 231744 - DNA, 357 bp, Artificial Sequence
  Description of Artificial Sequence: Synthetic coding sequence
atgtgcgacaaggaattcatgtgggctctgaagaatggcgatcttgacgaggtgaaggattacgtcgcgaagggggaggacgttaatcgaaccttggaaggaggaagaaagccactgcactacgctgccgattgtggccagttagagattctagagtttttgctgctgaaaggggcagacattaatgcaccagacaagcaccatataacccctctactcagcgccgtgtatgaaggccatgtgtcctgcgtgaaactactactgtctaaaggggcagacaagacagtgaagggtccagacgggctaaccgcctttgaggccacggacaatcaggccatcaaagccctgctgcagtag

SEQ ID NO: 231745 - DNA, 1812 bp, Artificial Sequence
  Description of Artificial Sequence: Synthetic coding sequence
atggccagcgcctcaacatcaaaatataattcccattccctggagaacgaatccatcaaaaggacgtccagggatggtgttaaccgggatctgacagaggctgtacctcgcttacccggagagacgcttattacagacaaagaagtgatttacatttgtccattcaatgggcctattaaaggcagagtgtatattaccaattatcgcttgtatcttcgctcactggaaaccgattcctccctgattctggacgtaccacttggagttatcagtcggattgagaagatggggggagccacctcacggggtgaaaacagctatggcctcgatataacatgcaaggacatgcgaaaccttcgcttcgcgctgaaacaagaagggcacagccgcagagacatgtttgaaatattaacccggtacgccttcccgctggcccattccctaccactgtttgcatttctgaacgaggagaagttcaacgttgatgggtggacagtgtacaatcccgtggaggagtacaggcgccaaggccttcctaatcaccactggaggattacatttatcaataagtgttatgagttgtgcgatacctacccggctctcttggttgtgccttatcgggcttccgatgacgatctgaggcgcgtcgccactttcaggtctagaaaccgcattcctgttctcagctggatacatcctgagaacaagactgtgatagtgcggtgcagtcaaccattagtgggaatgtcggggaagcggaacaaggacgatgagaaataccttgacgttataagggagactaataaacagatcagcaagctcaccatctatgacgcacggccttcagttaatgcggttgctaacaaggccacaggaggcggatacgaatctgacgatgcctatcacaatgccgagctgttcttcctggatattcataatatccacgtaatgcgcgaaagcctaaagaaggtcaaagacatcgtgtatcccaacgtggaagaaagtcattggttgtcgtccctggagtctacccactggctggagcacatcaagctcgtgctgaccggcgctattcaggttgctgataaagtttcctcaggcaaatcgagcgttctggtccattgctcagacggctgggaccgaaccgcccagctgacatctctggccatgttgatgctggattcattttaccgttctattgaaggctttgagattctggtccagaaagagtggatctcctttggccataagttcgcttcccgtataggtcacggtgacaaaaaccacaccgatgccgatcggtcccctatcttcttacagtttattgattgcgtctggcagatgtcaaaacagtttccaactgctttcgaatttaatgagcaattccttattattattctcgatcacctgtactcatgccggttcggcacctttctgtttaattgtgaatcagcacgtgaaaggcaaaaggttaccgagagaacagtgtccctctggtccctgatcaacagtaataaggaaaagttcaaaaacccattttacacaaaggaaataaatcgagttttgtaccctgttgcatccatgaggcacctggagttgtgggttaactactatatacgatggaaccccaggataaaacagcagcagccgaatccagtggagcagcggtacatggaactgttggcgctgcgggacgaatacattaaacgcctggaagagcttcagctcgctaacagcgctaaactgtccgacccaccaacttccccatcaagcccctcgcagatgatgcctcatgtgcagacacacttctag

SEQ ID NO: 231746 - DNA, 1701 bp, Artificial Sequence
  Description of Artificial Sequence: Synthetic coding sequence
atggcctcagcttccacttccaaatacaactcccactcactggagaacgaatcaattaaacgaacatcccgcgacggtgtgaacagggatctcaccgaggccgtgcccagactccccggagagacgctaataactgataaagaagtgatctatatttgtccattcaatgggccaataaaaggcagggtatatatcacgaactacagactgtatctgaggtctctggagacagacatgagaaatctacgctttgcactgaagcaggagggacactctaggcgtgacatgttcgaaatccttacccggtatgccttcccgctggcccatagtctgcctctgtttgcgtttctgaacgaagagaagtttaatgtggatggttggactgtttataatcccgtggaggagtaccggcgacaaggtctgcctaaccaccactggaggattacgttcattaacaagtgctacgagctgtgtgacacatatcctgccttactggtggtgccctacagggcctccgatgacgacctcagacgggtcgccacattccggtctagaaatcgtattccggtgttatcctggatacacccagaaaataaaactgtaattgtcaggtgtagtcagcccctggtgggaatgtcagggaaaagaaataaggacgacgagaagtatctggacgtcatcagggaaaccaataaacaaatttctaagttgaccatttacgacgcccgaccctctgtgaacgccgtggcgaataaagctacaggtggtggttatgagtctgatgatgcttatcacaatgccgagttgttcttcctggacatccacaacatccacgtgatgagagagtcactgaaaaaggtgaaggacatcgtctacccaaatgtggaagagagccactggctgagctcactggagtccactcattggctggagcatataaagttagtgttgacgggggcaatacaggtggctgataaagtgagttctggaaagagctcagtcctggttcactgtagcgatggatgggatcgcacagctcagttgaccagtctggctatgctgatgctggacagcttctaccgctcgatcgagggattcgaaatcctcgtccaaaaggaatggatcagctttggccacaaatttgccagccgcattggccatggggacaagaaccacactgatgctgacagaagtcccatctttctacagtttattgactgcgtgtggcaaatgtctaaacagttccccacagctttcgagttcaacgagcagttcctgattattatcctagatcacctgtattcttgcaggttcgggacatttctgtttaactgtgagtcagccagagagcgacagaaagttacagagagaacagtctctctgtggtcattaattaactcgaacaaggagaagttcaagaaccctttttacacaaaagaaattaaccgggttctctacccggttgcttcgatgagacacttagaactgtgggtaaattattatatccgctggaatcccagaatcaagcaacagcagccaaacccggtggagcagcgctatatggagctcctggccctccgggatgagtacatcaagcggctggaggagctacaactggctaattctgccaagttatctgatccccctacgagcccatctagccccagccaaatgatgccccatgtgcagacacacttctag

SEQ ID NO: 231747 - DNA, 1251 bp, Artificial Sequence
  Description of Artificial Sequence: Synthetic coding sequence
atgggcggagcgacctcgcgcggagaaaactcctacggactagacataacatgcaaagatatgcgcaacctaagattcgccctgaaacaggagggccacagtcggagagacatgtttgagatattaacccggtacgccttcccactggcccacagcctcccactttttgcttttctcaacgaggagaaatttaatgtggacggatggacagtgtataaccctgtggaggagtacagaagacagggactccctaaccaccactggcgcatcaccttcattaataagtgctacgaactctgcgacacctatcccgcacttctggtggtgccctacagagcatccgacgacgatctgcggagggttgcaacctttaggagcaggaataggatacccgttctcagttggattcatccggaaaacaaaaccgtgattgtgcgctgctcccaacccctggtcggtatgtccggaaagaggaacaaggacgatgagaaatatttggatgtgatcagggagacaaacaagcagatctcgaaactgactatttacgatgccaggcccagcgtgaatgctgtcgccaataaggcaactggcggtgggtacgagagtgatgacgcgtaccacaacgccgaactcttttttttggatatccataacatccacgtcatgcgggagtcgcttaagaaagtgaaggacattgtatatcctaacgtcgaggagtctcattggctgagttcactggagtctactcactggctggagcatataaaattggtcttgacaggcgctatccaagttgccgacaaggtgtcctccggcaagagttctgtcctggtgcactgctcagatggttgggatagaacagcccagctgactagtttagccatgctgatgctggactcgttttatcgcagcattgaagggttcgagatcctggtgcaaaaggagtggatctcttttggccataagttcgcatctagaattggacacggtgataagaaccacacagatgccgatcgaagccccatcttcttgcagtttattgattgtgtttggcaaatgagcaagcagtttccaacagcttttgaattcaatgaacagttcttgatcatcatcctggatcatctctatagttgccggtttgggacgtttctgtttaactgcgaatccgctagggaacggcaggcactgcacttccttagcctctcgctttgtcgacggttacagaaaggactcttcctctacgggcactag

SEQ ID NO: 231748 - DNA, 1467 bp, Artificial Sequence
  Description of Artificial Sequence: Synthetic coding sequence
atgcgcaacttgcgattcgcgctaaagcaggaagggcactcacgcagggacatgtttgagatcctaacacgctacgcctttccgctggcccacagccttccccttttcgctttcttgaacgaagagaaatttaatgtggacggctggactgtttacaaccctgtcgaggagtaccggcgtcaggggttgccaaatcaccactggcgtattaccttcataaacaagtgctatgagctgtgtgacacctacccggctctgttggttgtcccctatcgcgcttccgatgatgacctccggcgagtggcaaccttcagatccaggaaccggatccctgtcctgtcttggatccacccagagaataagacagtgatcgtgaggtgctctcaacccctggttggcatgagtggaaagcgcaacaaggatgacgaaaagtacttggatgtgatacgggaaactaacaagcagataagtaagttgaccatctatgatgccagaccctctgtaaatgcagtggctaacaaggcaacaggaggcggttacgaatccgacgacgcttaccataacgccgaactgttcttcctggatatacacaatattcacgtcatgagggaaagcctgaagaaggtaaaggacattgtttatcctaacgtggaggaaagccactggctctcttctcttgagagcacacattggttggaacatataaagctagttttgacaggagccattcaggtggcggacaaggtgtcgtccggcaagtcctctgtgctcgtgcactgcagtgacggctgggatagaaccgcccagctgacctcacttgccatgctgatgttagacagcttctaccgctctatagaaggtttcgagatcctcgttcagaaagagtggatctccttcggccacaagttcgcctcacgaatcggacatggggacaaaaatcacacagatgccgatcggtcacccattttcctccagttcattgactgcgtttggcagatgtccaagcagttccccactgcctttgaattcaatgaacagttcttaataatcatactcgaccacctgtatagctgtcggttcgggaccttcttgtttaactgcgagagtgcacgcgaacgccagaaagtcaccgagcgaacggtgtcgctttggtcccttatcaatagcaacaaagagaaatttaagaaccccttttacacgaaggaaattaatcgagtgctttacccggtcgccagcatgagacacctggaactgtgggtcaattattacatccgctggaatccaagaattaagcaacagcagccaaacccagtggaacagcggtacatggagctactcgccctacgggacgaatacataaaaaggctcgaggagcttcagctggccaacagtgctaagctcagcgacccaccgactagtccctccagtccgtctcaaatgatgccccatgtgcagacccacttctag

SEQ ID NO: 231749 - DNA, 1998 bp, Artificial Sequence
  Description of Artificial Sequence: Synthetic coding sequence
atggatcgtcctgctgctgccgctgctgccggatgtgaggggggtggtggcccaaaccccggacccgctggcggtcgacggccaccacgcgcagcagggggtgctacagccggaagtaggcaaccctcagtagagacactggactctcccactggtagccacgtcgagtggtgcaagcagttaatagcggctactatcagttcgcagatttcggggagcgtgacgtccgagaatgtgtcccgggattataaggccctgcgcgacgggaacaagcttgcacagatggaagaggcccctttgttcccgggtgaatctattaaagccatcgtaaaggacgtcatgtatatctgccctttcatgggagccgtatccggcactctgactgtcaccgattttaagctgtacttcaagaatgttgagcgcgatccacacttcattctcgacgtcccactgggagtcatcagtcgcgtcgaaaaaatcggcgcacagtctcatggagacaactcttgtggcatcgagatcgtgtgcaaggatatgcgaaacctgagactggcttacaagcaggaagagcaaagcaaactgggaatcttcgaaaacttgaacaagcatgcgttcccactgagcaatgggcaggctctgttcgctttcagttacaaggagaagtttcccataaacggatggaaagtgtacgaccccgtgtccgagtataagagacagggactgcctaatgagtcatggaaaatctccaaaatcaatagtaattatgagttttgtgatacttatcccgcaattattgtagtgcctacttccgtgaaagatgatgacttatcaaaagttgctgcttttcgtgccaagggaagggtgccagttctctcttggatccaccctgagtctcaggcaactatcactcgttgtagtcagccactggtgggcccaaacgacaaaaggtgtaaggaggacgaaaagtatctgcagactatcatggacgcaaacgcccagagtcacaagctgatcattttcgacgccaggcagaactccgtggctgatactaataagacaaaagggggtgggtatgagtccgaatccgcgtatccgaacgcagaactggtgttcctggaaattcacaatatacacgttatgagggagagcctgagaaaactgaaagagatcgtgtacccgtctattgacgaggccagatggctatctaatgtggacggaacgcattggttggaatatattcggatgcttctggctggcgcagtgcgcatcgcggacaaaattgagagcggaaaaacttctgtcgtggtacattgtagcgacggttgggaccggacggcccagctcacgtccttggccatgttaatgctggatagctattaccggaccatcaaaggatttgagactctggtagagaaagaatggatcagctttggccatcgatttgccctcagggttggccatgggaatgataatcacgccgacgctgaccgcagtccaattttcctgcaatttgttgactgcgtgtggcagatgacccgtcaatttccatccgccttcgagttcaacgaattattcctcatcaccattctggaccatctgtatagttgcttgttcgggacatttctttgtaattgcgagcagcagcgcttcaaagaggatgtgtatactaagactatctcactttggagctatatcaactcccaactggatgaattctctaaccccttctttgtgaattatgagaaccacgttctctaccccgtcgcttctctgtcacacttggagctatgggttaactattatgtacggtggaatccacgaatgcggccacagatgccaatccaccagaaccttaaggaattactagcagttagggcagagctccagaagagagtagaagggttacagcgagaggtagcaaccagggcagtatcctcttcatctgagagaggaagtagcccctcccattcagcgacgtctgtgcatacatcagtatag

SEQ ID NO: 231750 - DNA, 264 bp, Artificial Sequence
  Description of Artificial Sequence: Synthetic coding sequence
atggaagaggctcctttgttccccggtgaaagcattaaagcaatcgtgaaagatgtcatgtacatctgccctttcatgggtgccgtttctggcaccctcacggtgaccgacttcaagctttactttaaaaatgtggagagagacccgcactttatcctggacgtgccactgggggtgatttcacgcgttgaaaagattggtgcccaaagccatggcgacaactcatgcggcattgagattgtgtgcaaggatatgcgtaattag

SEQ ID NO: 231751 - DNA, 264 bp, Artificial Sequence
  Description of Artificial Sequence: Synthetic coding sequence
atggaggaagctccactcttccccggagagtccatcaaagcgatcgtgaaggatgtgatgtatatctgccctttcatgggcgcagtgagcggaactctgaccgtcaccgacttcaagctgtattttaagaatgttgaaagagacccacatttcattctggatgtgccactcggcgtaatctcgagagtggagaaaataggcgcacagtctcatggtgataactcctgtgggattgagatcgtgtgtaaagacatgaggaattag

SEQ ID NO: 231752 - DNA, 273 bp, Artificial Sequence
  Description of Artificial Sequence: Synthetic coding sequence
atggaggaagctccactgttccctggggaatccatcaaggcaatcgtgaaggacgttatgtatatttgtccatttatgggagccgtaagcggtaccctgacagtcaccgacttcaagctatactttaaaaatgttgagagagatccacattttattcttgatgtgccactcggagttatatccagggtggagaagatcggtgctcagagccacggcgataacagctgcgggatcgaaatcgtctgtaaggacatgcgcaacctgcgactgtag

SEQ ID NO: 231753 - DNA, 2022 bp, Artificial Sequence
  Description of Artificial Sequence: Synthetic coding sequence
atggatcgtcctgccgctgctgccgcagcaggctgcgagggtggaggtggcccaaaccctgggcctgcaggcggacgacgacctcctcgcgctgctggcggtgccactgcgggatcacggcagccatcagtggaaacgttagattcacccactggatcccatgtggaatggtgcaagcaactgatagcagccactatcagtagtcagatttccggttccgtgaccagcgagaacgtttcccgcgattacaaagtgttccggagacctgacctacgcgcacttcgagatggcaacaaactggctcaaatggaagaggcacctttattccccggagagagcatcaaggcaattgtcaaggatgtgatgtatatttgccctttcatgggcgcagttagcggaaccctgactgtcaccgactttaagctttatttcaagaacgtcgagcgggacccacacttcattctggacgtccccttgggcgtgattagcagagtagagaaaatcggggcacagtcacacggcgataattcatgcggtatagaaatcgtgtgcaaagatatgaggaacctccgcctggcctacaagcaggaggagcagagcaaactgggtattttcgagaaccttaataagcacgcctttccgttaagtaacgggcaggccttgtttgccttttcatataaggaaaaattccctatcaatggttggaaggtgtatgatcctgtgtccgagtataaaaggcaggggctgccaaacgaatcatggaagataagtaagatcaatagtaattacgaattctgcgacacctatcccgctattatcgtggttccaaccagcgtcaaagacgacgatctatccaaggtcgcagctttccgcgcaaagggaagggttccagtcctgagctggattcaccctgaatcacaagccaccatcacgcggtgttcccagcccctcgtaggacctaacgataagagatgcaaggaggacgaaaaatacctgcaaacaattatggacgcgaacgcacagagccacaagctgatcatcttcgatgcacgacagaattctgtcgccgacacaaacaagaccaagggcggtggctatgaaagtgagtcagcttacccaaacgcagaattagtgttcttagagattcataatattcatgtgatgagggaatctctgcgcaagctcaaggaaattgtgtatcctagcatcgatgaagccaggtggttaagtaatgtagacggcacacactggctggaatacatcaggatgctgttggcgggtgccgtcagaatcgccgataagatcgaatctggtaagacatcagtggtggtacactgctccgacggctgggaccgtactgcgcagctgacctcactcgcaatgctgatgctggacagctattaccgaaccatcaaaggattcgagacactggtggagaaagaatggatttccttcgggcaccgctttgctctgagagtgggacacggcaacgataatcatgctgatgcagatcgcagtcctattttcctacaattcgtcgactgtgtatggcaaatgactcgtcagttcccttctgcttttgagttcaacgagttgttcctaattactattctagatcacttgtattcatgcctattcgggacattcctttgcaattgcgaacagcaaagatttaaggaagatgtctacactaagacaatcagtctttggtcatatatcaatagtcagctcgatgaattctccaatcccttctttgtcaattatgaaaatcatgtgctgtatcccgtggcgagcctgtcccaccttgagctatgggtgaattattacgtgcgttggaatcctcgcatgcggcctcagatgccaattcatcaaaaccttaaggagctgcttgccgtgcgcgcagaactccaaaaacgcgtggaaggtctgcagcgcgaagtggccacaagagcagtgtcatcatcttcagagcgtggttcaagtccttcacatagcgctacaagcgtgcacacctctgtctag

SEQ ID NO: 231754 - DNA, 1707 bp, Artificial Sequence
  Description of Artificial Sequence: Synthetic coding sequence
atggatagacccgcagctgccgcagcggctggctgcgagggaggaggtggccctaatcccggtcctgcaggagggaggagaccacctcgagccgcaggcggagctacagctggtagccgacagccttcagtggaaactctggacagtcccactggctcccacgtggagtggtgcaagcagctgattgccgctaccattagcagtcagatcagcgggtcagttactagtgagaacgtgtcaagggactacaaggccctcagggacggcaacaaactagctcaaatggaagaggctccactctttcctggagaatccattaaggccattgtaaaagacgttatgtacatttgtccttttatgggggctgtgtccgggaccctgacggtcactgatttcaagctctacttcaaaaatgtcgagagagacccacatttcattctagacgtgcccttaggcgtgatctcccgcgtagagaagatcggtgctcagtctcatggcgataacagctgcggaattgaaattgtgtgtaaagatatgcgcaacttaagattggcatacaagcaagaagagcagtcaaagctgggtatcttcgagaatcttaataagcacgctttccccctttccaacggtcaagcacttttcgcctttagctataaggagaagtttccaattaatggttggaaagtttatgaccctgtgtctgagtacaaacgacagggtcttccaaacgagagctggaaaatttcaaagatcaactcaaactacgaattttgcgacacttatccagccatcattgttgtgcccacgtccgtcaaagacgacgacctcagcaaggtggcagctttccgggcaaagggaagagtgcctgtgctgtcgtggatccacccggagagccaggccacaatcacccgttgcagccaacccctggtgggaccaaatgataaacggtgtaaagaggacgaaaaatacctgcaaacaatcatggacgccaacgctcagtcccataagctgatcattttcgatgccagacagaacagcgtggccgacacaaataaaactaagggcggtgggtacgagagtgagagcgcctatcccaatgcagaactcgtgtttctggaaatacacaatattcacgtgatgcgggagagtttaaggaaactcaaggagatagtatatccttctattgacgaggctagatggttgagcaacgtagacggcacacactggctggagtatatacggatgttactggctggcgcagtgcggatcgctgataaaattgagagtggcaaaacctccgtagtcgttcactgtagcgatgggtgggatcggacagcgcagctgacctccctcgcaatgttgatgctcgactcttactatagaaccattaaagggttcgagacgctggtggagaaggaatggatttccttcggtcaccggtttgccttaagagttggtcacggcaacgacaaccatgccgacgccgatcggtcacccatatttctgcagttcgttgattgtgtctggcagatgacccgccagttccctagtgcgttcgagttcaacgagctttttttaataactattcttgatcatctatactcttgtctgtttggcacctttctgtgcaattgcgaacagcaaaggttcaaagaggcttggggcgctggaactcaaagggcaagaggcagcttgcgatcacgctag

SEQ ID NO: 231755 - DNA, 444 bp, Artificial Sequence
  Description of Artificial Sequence: Synthetic coding sequence
atggaggaggcccctttattcccaggggagtccattaaagcgattgtaaaggacgttatgtatatctgcccattcatgggggctgtgtctgggacgcttaccgtgaccgattttaagttgtactttaagaacgtggagagggacccccattttatacttgatgtgcctctgggagtgattagccgcgtcgagaagataggtgcgcagtcccatggggataattcctgtggaatcgaaatcgtgtgcaaggacatgcgtaatcttaggcttgcctacaagcaggaggagcagtctaaactggggatctttgagaatcttaataagcacgcctttcccctgtcaaatgggcaggcattgttcgccttttcgtataaggaaaaattccctattaatggatggaaggtgtacgatcccgttagcgaatacaagagacaggggctgtag

SEQ ID NO: 231756 - DNA, 1182 bp, Artificial Sequence
  Description of Artificial Sequence: Synthetic coding sequence
atgtacatctgccccttcatgggtgctgttagcggcacccttacagtcaccgattttaagctgtactttaagaatgttgagagagatccacatttcatactggatgtccctctgggagttatcagcagggttgagaaaatcggggcacaatcccatggcgacaatagctgtgggattgagatcgtatgcaaggacatgcgaaatttgaggttggcctacaagcaagaagagcagtcaaaactcggaatatttgagaacttaaacaagcatgctttccccctgtcgaatggccaggcactctttgctttctcttacaaggaaaagtttcctataaatggctggaaggtctatgatccagtgagcgagtataaacggcagggcctgccgaacgaatcctggaaaataagcaaaatcaactctaactacgagttttgtgacacgtatcccgctatcattgtggtacccacctccgttaaagatgatgacctgtccaaggtggctgcctttcgggcaaaaggccgagtgcccgtcctctcctggatccacccagaatctcaagcaaccataacacgatgcagtcagcctctcgtggggcctaatgacaagcgatgcaaagaggatgagaaatacctgcagactataatggatgctaacgcacaatcgcataagctcattatctttgacgccaggcagaacagcgtggctgacacaaataagatgctgttggctggggcagttagaatcgcagataaaattgagagcggtaaaacctcagtggttgtgcattgcagtgatgggtgggaccgcactgctcagcttacaagccttgctatgttgatgttggattcatattacaggacaatcaagggcttcgaaacgctcgttgagaaagaatggatctcctttggccaccggttcgcgctaagagtgggtcacggcaacgataaccacgccgatgctgatcgctccccaatatttctccagttcgtggattgcgtctggcagatgactcggcaatttccatcagcctttgaatttaacgagctgttcctgattactattctcgatcacctgtactcatgtctttttggcaccttcctgtgcaactgtgagcagcagcggtttaaagaagcttggggcgcagggacacagagggccagggggagtttgcggagcaggtag

SEQ ID NO: 231757 - DNA, 1716 bp, Artificial Sequence
  Description of Artificial Sequence: Synthetic coding sequence
atggaagaggctccacttttcccaggggagagcataaaagcaatagttaaagacgtgatgtacatatgcccgtttatgggcgcagtgagcggaacactgaccgtcacagattttaagttgtacttcaaaaacgtcgaaagggatccccacttcattctggacgttcccctgggagtgatctcacgcgtggagaagattggcgctcagtctcacggtgacaattcatgcgggatagaaattgtctgcaaggacatgaggaacctgcgattggcatataagcaggaagaacagtcaaagttgggcattttcgagaatctgaacaagcacgcgttccccttaagcaacggccaggccctatttgcctttagctataaagaaaaatttcccataaacggctggaaagtatatgatccagtgtccgagtacaagcgtcaggggctcccaaacgagagttggaagatctctaaaatcaacagcaactacgaattctgcgacacttatcccgcaataatagtggtgccgacctcagttaaggacgacgatttgagcaaagtcgccgcttttagagccaagggcagggtccctgtgctgagctggattcaccccgaatcccaagccacaatcacacgctgtagtcagccgctcgtgggtcccaacgataagcggtgcaaggaggacgagaagtacttgcagaccatcatggacgccaatgcccaatctcataagctgataatcttcgatgctcgccagaattctgtcgcagataccaataagactaaggggggaggctatgaatcagagtccgcctaccccaacgctgaactggtgtttctcgagatacacaacatccacgttatgcgggaatccctgcgaaaactgaaggagattgtgtatcctagtatcgacgaggctaggtggctcagcaatgtggatggaacacattggctggagtacatccgtatgctattggctggggcagttcggattgcagataaaatcgaatcaggcaaaacctccgtggtggtgcattgctctgatggttgggaccgcaccgctcagctcacttcactagccatgctgatgctcgattcctattatcggactattaagggttttgagacactggttgaaaaagagtggattagcttcggccatcggttcgccttgagggtggggcacggcaatgataaccacgccgatgctgatcgcagtccgatattcctacagttcgtggactgcgtgtggcagatgacccgacagttccctagcgcctttgaatttaacgagctgttccttataacaatactggatcacctgtacagttgtcttttcggcacattcctgtgtaactgcgagcaacagcgcttcaaagaagatgtgtacacgaagaccatctctctctggtcgtacatcaattctcagctggatgagtttagtaatccgttcttcgtgaattacgagaatcatgtgctatacccagttgcttcgcttagccatctggagctgtgggtaaattactacgtcaggtggaatcctagaatgaggccccagatgcctatacaccagaacctgaaggagctgttagctgttagagccgagctgcagaagcgcgtggaaggactgcagcgtgaggtggcaaccagagctgtgagctctagtagcgaacggggttcctccccctcacactcagctaccagcgttcatacatccgtgtag

SEQ ID NO: 231758 - DNA, 1092 bp, Artificial Sequence
  Description of Artificial Sequence: Synthetic coding sequence
atggacagaccggctgctgccgctgctgccggatgtgaaggtggagggggtcctaatcctggtccagctggcggtaggcgtcccccaagagctgctggcggtgccacggcaggctccagacagccaagtgtggaaacactagatagccctaccgggtcccacgtggaatggtgtaaacagctcatcgcagcaactatctcttcccagatcagtggcagtgtaacttcagagaacgttagtagagattacaaggcactgagggacggcaataagctggcacagatggaggaagcgccactgtttcccggagaaagcattaaagcaatcgtcaaagatgtgatgtatatctgtcccttcatgggagctgtttccggaacccttacagtcaccgactttaagctttacttcaaaaatgttgagcgggatccgcacttcatcttagatgtgccactcggcgtaatatctcgagtcgagaaaattggggcacagtcacacggagacaattcttgtggcattgagattgtttgcaaagacatgagaaacctgagactggcctacaagcaggaggaacagtccaagctgggaatctttgaaaacctgaataaacatgcattcccactctctaacggccaggccttgttcgcatttagttacaaagagaaattcccaattaacggctggaaggtctacgacccggtttcggaatacaaacggcaggggcttcctaacgagagctggaagatcagcaaaatcaattccaattacgaattctgcgatacctatcctgctattattgttgttcccacctccgtgaaagatgacgacttgtccaaagttgctgctttccgagcaaaaggaagggtacccgtactatcttggatacatcctgaatcccaggctactattactcggtgcagccaaccattggtcggaccgaatgacaagcggtgtaaggaagatgaaaagtacctgcaaacgatcatggacgcaaacgctcaaagccataaactgatcatcttcgatgccagacagaattcggtagccgacaccaacaaactttggtaccaggatactgcgtcgcttatggaatag

SEQ ID NO: 231759 - DNA, 1998 bp, Artificial Sequence
  Description of Artificial Sequence: Synthetic coding sequence
atggaccggccagcggcagctgccgcagccggatgcgaaggcggaggaggccctaacccaggaccagcaggaggacgccgtccaccaagggcggctggaggtgctacggcaggcagtcgccagcctagtgtggaaacgctggactctccaacgggctctcacgttgagtggtgtaagcaattgatcgcagctacgatttcatctcaaatctcgggctccgtgacttctgaaaatgtttctagagattacaaagctctgcgcgacggcaacaagcttgcacagatggaggaagctcctcttttccctggcgaatcgattaaggcaattgtgaaagacgtgatgtacatttgcccttttatgggcgcagtctcagggacgctcaccgtcactgatttcaaactctacttcaagaatgtcgagagagaccctcatttcatcctcgatgttcctttgggggtgatcagccgcgtggaaaaaatcggcgctcaaagtcatggcgataattcttgcggcattgaaattgtgtgcaaagacatgaggaacctccgcctggcatacaagcaggaagagcagtcaaaactggggatctttgaaaatctcaataaacacgctttccccctgagtaatggtcaggccctcttcgctttcagttacaaggaaaaatttccgattaatggttggaaagtgtatgatccggtcagcgagtataaaaggcagggccttccaaacgagtcctggaagatctcaaaaattaacagtaattacgagttctgcgatacgtatccagcgattatcgttgtgcctacgtccgtcaaggacgatgatctctcaaaagtcgccgctttccgcgctaaaggtcgagtacctgtgttatcctggatccatcccgaatcacaagcaactataactcggtgctcccagcccctcgtgggacctaacgataaacgatgcaaagaggacgagaagtatttacaaactatcatggacgccaatgcacaaagccacaagctgatcatttttgatgccagacagaattctgtggccgacaccaacaaaacaaaaggcggtggctatgaatccgaaagtgcttatccaaacgctgaacttgttttcctggaaattcataacatccacgttatgagggagtccctgagaaaacttaaggagatcgtatacccctccatagacgaagcccgttggttatccaatgtggacggcacccactggctcgaatatatcagaatgctactggctggcgcagtgagaatcgcagacaagattgagagtggcaaaacctctgtggtagtccattgctctgatggatgggaccggacagctcagctgacctctcttgcaatgcttatgctggacagttattaccgcacaattaagggcttcgagacgcttgtcgaaaaagagtggatcagctttggccatcgatttgcattgagagtggggcacggtaatgacaatcacgctgacgccgaccggtcccccattttcctccagtttgtcgattgcgtgtggcagatgacgaggcaattcccctcagcttttgaattcaatgaacttttcctcattacaatcctggatcacctgtacagttgtcttttcggtactttcttatgcaattgcgagcagcagcggttcaaggaagatgtttacaccaagacgattagtctctggtcttacattaactctcagctcgacgaattctctaaccccttttttgttaactacgagaaccatgttttgtaccccgttgccagtctttctcacctagagctttgggtcaattactatgtgcgttggaatccacggatgaggccccaaatgcctatccaccaaaaccttaaagagctgttagccgtaagggccgagctacagaagagagtggaaggcctccagagagaggtagcgactagggcggttagctcttcaagcgaaagaggttcttcaccctctcactcagctactagtgtgcacacatccgtttag

SEQ ID NO: 231760 - DNA, 1914 bp, Artificial Sequence
  Description of Artificial Sequence: Synthetic coding sequence
atgctgggcaaaggcgtggtcgggggagggggaggtactaaggcgccaaagccctcattcgtgtcttacgtgaggcctgaagagattcacacgaatgagaaggaagtaaccgagaaggaggtgacgctccacctgctgccaggagagcagctactctgtgaggcctcaacagtccttaagtatgtccaagaagactcttgccagcacggcgtgtacggtcggctggtgtgcacagactttaagatcgcctttcttggggacgatgagagtgctctggataacgatgagacccagttcaaaaataaggtgattggggagaacgatatcaccttacattgcgtggatcagatttacggcgtctttgatgagaagaaaaaaaccctttttgggcagctaaagaagtaccctgagaagcttatcattcattgcaaggacctccgagtatttcaattctgcctgcgctacaccaaggaagaagaagttaagagaattgtgagtgggataatccaccatacccaggcaccgaagcttctgaagcgcctttttcttttctcttacgctaccgcagcgcagaataacacggtgaccgaccctaagaaccatactgtgatgttcgatacgctgaaggattggtgctgggaactggagcggacgaagggtaatatgaagtacaaggcagtgtctgtcaacgagggatataaagtctgtgagaggcttcccgcatatttcgtagtgcccacacccctcccagaagagaacgttcagcgcttccaaggccatgggattccgatatggtgttggtcttgccacaacgggtctgctctcctcaaaatgtctgcactgccaaaggagcaagatgatgggatactgcagatccagaaatcgttcctagatgggatttacaagaccattcaccgtcctccctacgagattgtgaagacagaagacctttcatcaaacttcctctctctgcaggaaatacagaccgcttacagtaaattcaaacagctatttctgatcgacaacagcacagaattttgggataccgatatcaaatggttttcactgctggaatcaagcagctggctagatattatacggcgatgcctgaaaaaagctatagaaatcactgaatgcatggaggcgcaaaatatgaacgttctcctactcgaggaaaatgccagtgacctttgctgcctgatctcatcgctggtgcagctgatgatggacccccactgcaggactaggattgggtttcaaagtctgattcagaaagaatgggtgatggggggtcattgctttctggacaggtgtaatcatctcagacagaacgataaggaagagcaccagcggcaattgtcccttccattgacacagtccaagagctcgcccaagcgcggattttttcgcgaggaaacagaccatctaatcaagaacctgctggggaaaaggatttctaagctgatcaactcatctgatgaactgcaggataattttagggaattttacgattcatggcacagcaagtcgaccgattaccatggattgctgctgcctcacatcgaaggcccagagatcaaagtgtgggcacaacgttacctgcgatggatccccgaggcacaaatacttggcggagggcaggtggctactctgtcaaaattgctggagatgatggaagaagtgcaatccctgcaagagaaaattgatgaacgacaccactcacagcaggccccacaggctgaggctccatgcctgcttagaaattctgcgagactctctagtctctttccctttgccctgctgcagagacatagttctaagccggtactgcctacctctggctggaaagccttgggggacgaagatgatctggcaaagagggaggacgagttcgtggatctgggcgacgtgtag

SEQ ID NO: 231761 - DNA, 2082 bp, Artificial Sequence
  Description of Artificial Sequence: Synthetic coding sequence
atgctcggtaagggggtggtggggggaggaggaggcacaaaagcaccaaagccgagtttcgtaagctacgtccgacccgaagaaattcatactaacgaaaaagaggtgaccgaaaaggaagtgacgctgcacctgctcccaggtgaacagcttctatgcgaagcttccaccgttctcaaatatgttcaggaggacagctgtcagcacggggtatacggtcgattagtgtgtactgactttaagatcgccttcctgggcgatgacgagtcagccctggacaatgatgagacccagttcaagaacaaggttatcggcgaaaatgacatcacgctgcactgtgttgaccagatctatggagtcttcgatgaaaagaagaaaactctgtttggccagctcaagaagtatcctgagaaactcataatccactgcaaggacctgcgagttttccagttttgtctgcgctacacaaaggaagaggaggtgaagagaatagtgtccggcatcatccatcatacacaggcccctaaactcctcaagaggctgttcttgttctcttacgctacagcagcgcagaacaacactgtgactgatcccaaaaatcataccgtcatgtttgacacgctgaaggattggtgctgggaactcgaaaggaccaaggggaacatgaagtacaaggctgttagtgtgaatgaaggttacaaagtgtgtgagaggctcccggcttattttgtcgtccctacgccacttccagaggaaaatgtacaacgattccagggtcacggcataccaatatggtgctggtcatgtcacaacggctctgcgctcctgaagatgtcagccctgccaaaggagcaagatgacggcatcctgcaaatccagaagtcattcctggacggtatctataaaacaatccaccgccctccttatgagatcgtgaagacagaggacctcagtagcaatttccttagcctgcaggaaatccaaacagcatattccaaatttaagcagttgtttttgatcgacaactccacagaattttgggatactgacatcaaatggttttctctcctcgagagctcaagttggcttgacatcatcagacggtgcttgaagaaggccatcgagataaccgagtgcatggaggcccagaacatgaacgtccttctgctcgaggagaatgcctccgatttgtgttgtcttattagtagccttgtgcagctcatgatggacccacattgcaggacgaggatcggatttcagagcctgatccaaaaggagtgggtgatgggcggtcactgctttttggaccggtgtaatcatctgaggcagaatgacaaagaagaggtacccgtgtttttgctgtttctagactgtgtgtggcaactggtccaccagcatccgccagcattcgaattcaccgagacatacctgaccgttctctctgactccctgtatattcctatcttttccacctttttttttaactccccgcaccaaaaggacacaaacatgcatcaacgacaacttagtcttcccttgacacagagcaagtccagcccaaagagagggttttttcgtgaagaaacagaccacctgatcaagaaccttctgggaaaacgaatctctaagctgattaatagtagcgatgagttgcaggacaattttcgagaattctacgactcatggcatagtaagagcactgactaccacgggctactgctacctcacatcgagggacccgagataaaagtatgggctcaacgctaccttaggtggatccctgaggcccaaattttgggcggagggcaggtggccactctaagcaagctgctggagatgatggaagaggtgcagtcgcttcaggagaagatagacgagagacatcattcgcagcaggcgcctcaggctgaggccccttgcttactccgtaatagcgccaggctatcttcccttttcccttttgccttgctgcagagacacagctccaagcctgtgctgcctaccagcggctggaaggccctcggagacgaagacgacttggctaagcgggaggacgaatttgtggatctcggcgatgtttag

SEQ ID NO: 231762 - DNA, 2244 bp, Artificial Sequence
  Description of Artificial Sequence: Synthetic coding sequence
atgctcggaaagggggtggtgggcggtgggggtggtactaaagcgccaaagccttccttcgtctcttatgtacgccctgaggaaatacacactaatgagaaagaggtcactgaaaaggaagtcaccctgcatctcttgccaggagaacagctcctgtgtgaggctagtacggtactgaagtatgtccaggaggacagttgtcagcatggcgtttacggaaggctggtgtgtaccgatttcaaaatcgccttcctgggcgacgatgaatctgcccttgataacgacgagactcagtttaaaaacaaggtgattggagagaatgatattaccttacactgcgttgaccagatttatggagtctttgacgaaaagaagaagacgctcttcggccagctgaaaaagtatcccgagaagctgattatacactgcaaggatctccgtgtgttccagttctgccttcgctacacaaaagaagaagaagtcaaaagaattgtttctggcatcattcaccacacccaggctcccaagcttctcaagcgtctcttcctgttctcatacgcaacagcggctcaaaacaacactgtcacagaccctaaaaatcacacggtgatgttcgacacccttaaagattggtgctgggagctcgagcggaccaaagggaacatgaaatacaaagccgtgagcgtaaatgaaggttacaaggtttgcgaacggctgcctgcttatttcgttgtccctacaccgcttcctgaagagaatgtgcagagatttcaggggcatgggattccaatttggtgttggtcttgtcacaatggttctgcccttctgaaaatgagtgcattacctaaggagcaggacgatggcatcctccagatccaaaagagctttctcgacggaatttataagaccattcaccggccaccttatgaaattgtaaagaccgaagatctgtcatccaactttctttcactgcaagagatacagacggcatattccaagttcaaacagctctttcttatagacaacagtacggaattctgggacacggacattaaatggtttagcttgctggaaagttctagctggttagatataattaggaggtgtcttaagaaggccattgaaatcacagaatgtatggaagcgcagaatatgaacgttctcctgcttgaggagaacgcgtccgatctctgttgcctaatcagctctctggtgcagctcatgatggatcctcattgcaggaccagaattggattccaatccttaattcaaaaggagtgggtgatggggggtcattgttttctcgatagatgcaaccatttacgacagaacgacaaggaggaggtgccggtatttctgctcttcctggattgtgtgtggcagctggtacaccaacacccccctgcgtttgaattcaccgagacatatctgacggtgctgtccgatagtctctacattccaatttttagcacgtttttcttcaatagccctcaccagaaagacaccaacatgggtagagagggccaggatactcagtccaagcctctgaacctactcacagtgtgggactggtcagtccagtttgagcccaaagcccaaaccctattgaaaaatcccctttacgtcgagaagccaaaactggacaaaggacagagaaaaggcatgcggtttaagcatcagaggcaactaagcctgcctcttacccagagcaagtcctccccgaaacgaggattctttagggaagaaaccgaccacttaatcaagaacctgctggggaagaggatcagcaaactgatcaattcctcagatgaactacaagacaacttccgcgaattctacgacagttggcactccaagtcaacagactaccacggcctactccttccccatatagaggggccagaaataaaagtctgggcccagcgctatcttcgctggatcccggaggctcaaatcctaggaggaggccaagtcgctactctctctaaacttctcgaaatgatggaggaagtgcagtccttgcaggagaaaattgacgaaagacatcactcacaacaggctcctcaggctgaggccccatgcctcctgagaaactccgctaggctctcttcactgtttcctttcgccctgctgcaacgtcattcctctaagcctgtgctgcctacctccgggtggaaggcactgggggatgaggacgacctcgctaagcgtgaggacgagttcgtcgatctgggtgacgtgtag

SEQ ID NO: 231763 - DNA, 1953 bp, Artificial Sequence
  Description of Artificial Sequence: Synthetic coding sequence
atggcaggcgctcgcgctgcagccgctgctgcttctgccggatcctcagcatcgagcgggaatcagccaccacaggaactgggtttgggcgagttgctggaagagttctcccgcacacaataccgagccaaggatggctcaggtaccgggggtagtaaagtggaaaggattgagaagaggtgcctggagttgttcggccgagattattgtttttcggtaatacctaacaccaacggcgacatctgtggccactatccacggcatattgtgttcttagagtacgaatcctcagagaaggagaaggacacctttgagtcaaccgttcaagtaagcaaattacaggacctgattcatcggtcgaagatggccaggtgccggggaaggttcgtttgccctgtcattctgttcaagggcaagcatatttgtagatctgcgaccttagccggatggggggagctgtatggcaggagtggatataactatttcttttctggtggggcagacgacgcttgggcagacgttgaggatgtgaccgaggaagactgcgccctccgctcaggagacacacacctatttgacaaggtccgtggctatgacattaaacttctgcgttacctcagcgtcaagtatatttgcgacctgatggtggagaataaaaaggtgaagttcgggatgaatgtgacctcatcagaaaaggtggacaaggctcaaaggtacgctgactttactttactcagcatcccttatccaggatgtgagttcttcaaagagtataaagaccgggattacatggcggaaggacttattttcaattggaaacaggactatgtcgacgcccctctctcaattccggatttcctgacccactcactgaacattgattggtcacaataccaatgctgggatcttgtccagcagacacaaaactatctgaagcttcttttgagcctagtcaactcagacgacgattccggcctattagtacattgtattagcgggtgggacagaacacccctgtttattagcctccttagacttagcttatgggccgacggattgatccacacgtcacttaaaccgaccgagatattatacctgacggtggcctatgactggtttttattcggacacatgctagtggaccgtttgtctaagggcgaagaaatttttttcttttgtttcaacttcttgaaacacattacgtcagaggagttcagcgctctgaaaactcaaaggcgaaagagtctaccagcaagagacgggggattcacactggaggacatctgcatgctgaggaggaaggaccggggtagtacgacctcactcggatccgatttcagcctggttatggagtcgagccctggagcgaccggcagttttacctacgaggccgtggaactggtgcccgcaggggcacctacccaggcagcgtggagaaagagccactcttcatcgcctcagagtgtcctttggaacaggccccagccgtctgaggacagactgccatctcagcagggcctggcagaagctcgaagctcctctagctcatccagtaaccactccgataacttctttagaatgggctcaagtccgctggaagttcccaagcctcgatctgtagatcatccgcttccgggtagcagcctttctactgattatggctcatggcagatggtcaccggctgtgggtcgatccaggagcgggcagtgcttcatacggattcttctctcccatttagcttccccgacgagctgcctaatagttgcctgttggcagcactgagtgatcgtgagacccgactgcaggaggtgagatcagcttttttagctgcatactccagcaccgtcgggttgcgggctgtggctccttctcctagcggagccatcggaggacttctggaacagttcgccaggggagttgggctcaggagtatctctagtaacgccctttag

SEQ ID NO: 231764 - DNA, 1617 bp, Artificial Sequence
  Description of Artificial Sequence: Synthetic coding sequence
atggcaggagctagggcggctgccgcagccgcttccgctgggtcaagtgcgagctctggaaaccagccacctcaagaactgggcctgggcgaactgctggaggaattctcacgaacccagtatcgggcaaaagatggatccggaacgggaggctctaaagtggaacgcatcgagaaaagatgcctggagttgtttgggcgtgattactgtttctcggtgatacctaataccaacggcgacatttgcgggcactatccacgccatatcgtgtttcttgagtacgagtcttctgaaaaagagaaagacaccttcgagtcaaccgtgcaggttagtaaacttcaggacctgatccacaggtctaagatggcccgatgtaggggcagattcgtgtgtcccgtgattctgtttaaaggaaaacacatctgtagatcagccactttggccggatggggcgagctgtatggcaggagtgggtacaactactttttttctggcggagcggatgacgcctgggcagacgtagaggacgtgacagaggaagactgtgccttgagatcaggtgatactcatctgttcgacaaagttcgcggttatgacattaagctgctccggtacctgtctgtcaagtatatatgcgatctgatggtggagaataagaaggttaagtttgggatgaatgtgacgtcttcagagaaggtggacaaagctcagaggtacgctgactttactcttctaagtataccatacccaggctgcgaattttttaaagaatacaaggaccgggactacatggcggagggcctgatattcaattggaaacaagactatgtagatgctccactgagtattcctgattttctgacccacagcctgaacattgactggtctcagtaccagtgttgggatctagtgcagcagactcagaattatcttaagcttctgcttagtctcgtgaactccgacgacgacagtggcctcctggtacactgcatcagcggttgggataggaccccattgttcataagccttctgcggctatccttgtgggctgacgggctcatccatacgtctctaaaacccacagagatcttgtaccttaccgtagcctacgattggtttctcttcggccacatgctcgtggatcgattatccaagggcgaagagatcttcttcttctgttttaatttccttaagcatattacatccgaggaattctctgccctgaagacccagcgacgaaagtctctccccgctcgtgatggtggatttaccctggaggacatctgtatgttgcgaagaaaagacagggggagtaccacgtcactgggctccgacttctctctggtgatggagagctcgcctggcgcaaccggcagcttcacctacgaggccgtggaacttgttccggctggtgcccctacccaggcagcctggctcgccgcattgagcgaccgagagacacgacttcaagaagtgagatctgcttttctggctgcttatagctccacggtgggactgagagctgtcgcgccaagcccaagcggtgctatcggcggtctactcgaacagttcgccagaggggttggcctgcgttcaatctcttcaaatgcactctag

SEQ ID NO: 231765 - DNA, 1797 bp, Artificial Sequence
  Description of Artificial Sequence: Synthetic coding sequence
atggctggtgccagagcagcggcagctgccgcatccgccggatccagtgcctcctccgggaaccaaccaccacaggagcttggactgggcgaactgttggaggagttttccagaactcagtaccgcgctaaagacgggtccggtactgggggatccaaggtcgaacgaatcgagaaacgatgcctggagctgtttggtcgggattattgtttcagtgtaataccgaacactaacggggacatttgcggccactatccacgtcacatagtgttcttagagtatgaaagctcagagaaagaaaaggatactttcgagagcacagtccaggtaagtaagctccaggatctgatccataggagtaaaatggctaggtgtagaggccgttttgtttgcccagtaatcctgttcaaggggaaacatatctgccggtctgcaacgctggcaggctggggcgagctatatggcagatctggatataactatttcttcagcggcggagctgatgacgcctgggcagacgtcgaggatgtgacagaagaagattgcgccttgcggagtggagatacacatttattcgacaaagtgcgtggctacgatatcaaattgctgcgatacttgtccgttaagtatatttgcgatctaatggtcgagaacaaaaaagtgaaatttggcatgaatgtcacttcctcagagaaggtagacaaggcgcaaagatatgctgacttcaccctgctcagtatcccctatcctggctgcgaatttttcaaggaatataaggaccgggactacatggctgagggccttatctttaactggaaacaggactacgtggacgcccctctcagcattcctgactttctgacgcattccctgaatattgattggtcccaataccagtgttgggatttggttcagcaaacccagaattacctgaaactgctactttccctggtgaactctgacgacgatagtggactactcgtccactgcatttccggatgggacagaaccccactttttattagcctgctgcgcctgagcctgtgggccgatggactgattcacacgtccctgaagccaaccgaaatactgtatctgactgtggcctatgactggttcctgttcggccacatgctcgtggaccgattaagcaaaggcgaggagatttttttcttttgtttcaacttcctgaagcacataacctccgaagagttcagcgccctgaaaacccagcgcaggaagtcactgccagcacgcgacggaggttttacactggaagatatttgcatgctaaggcgaaaggaccgcggaagcaccaccagcctgggcagcgacttcagcctcgtgatggagagcagcccgggtgcaacgggcagtttcacgtatgaagccgttgaactcgtgcctgccggagccccaacccaagctgcatggcgcaagagtcactcttctagcccccagagtgtgttatggaacagaccgcagccatcagaagataggttaccatctcagcaaggcctcgccgaagctcggtcctcttccagcagcagcagtaaccacagtgataacttctttcggatgggctccagcccactggaagtacccaagcccaggctggcagcgctgtctgaccgagagacccgcctgcaggaggtaaggtccgcctttctggctgcatattcttcaactgtgggattgagagcagttgccccatccccaagtggtgctattggaggtctgttggagcagtttgcccgaggagtggggctaagatctatcagctctaacgccctctag

SEQ ID NO: 231766 - DNA, 1563 bp, Artificial Sequence
  Description of Artificial Sequence: Synthetic coding sequence
atggccggagcaagggccgctgctgcagccgcatctgccggatcttccgcttcttctggcaatcagccaccacaggagctcggtttaggggagctgctggaggagttctctaggacgcagtatagggccaaggatggttctggtacagggggaagcaaggtcgagcgtattgagaaaagatgtctcgagctatttggcagggattattgttttagcgtgattccaaacaccaatggtgatatttgcggacactaccccaggcatatcgtattcctggagtacgaaagttccgagaaggaaaaagacacattcgagagtaccgtccaggtctcgaagctgcaagacctaatccaccgttccaagatggcgaggtgccggggacggttcgtgtgcccagtaatattgttcaaaggtaagcacatttgccgctcagctacactggccggatggggagagctctatggacgtagcggctacaactattttttttcaggaggtgctgacgacgcctgggccgacgtcgaagatgttactgaggaagactgtgccttacgttccggggacactcacttatttgataaggtcaggggatatgacattaaattgttgcggtatctttcggtcaaatatatttgtgacctgatggttgagaacaaaaaggtgaagttcggcatgaacgtcacctcttcagagaaggttgataaggcacagaggtacgcagacttcacattactctcaataccatacccgggttgtgaatttttcaaagaatacaaagatcgagattatatggccgaagggctgatctttaactggaagcaagactacgttgacgctcccttatcaatccctgatttcctgactcacagcctgaatatcgactggtctcagtatcagtgttgggatttagtccaacagactcagaattatctcaagctgttgctcagccttgtcaatagcgatgatgatagcggactactcgttcactgcatatccgggtgggacagaacacctctgtttatatccctgctgagactgtccctttgggcagatgggctcatacacacatctctcaaaccaacagaaatcctgtacctcactgtagcctacgactggttcctgttcggtcacatgcttgtagacagattgtccaaaggcgaagaaatcttctttttttgttttaatttcctgaaacatatcacctctgaggagttcagcgctctgaaaactcagagaaggaagtccctccccgcacgagacgggggtttcaccctggaagatatctgcatgctcaggaggaaagaccgcggatcaacgacatcccttggaagtgacttcagtctggtgatggaatcgtctccaggcgcaactggatcttttacttatgaaagaggagctgggcctagcagaagcgctaactcaggctcgttggaagaggaaccgctaatattgagcacggagtgcccacttgagcccgctacaaccctgcgtgggcctttggctttccctgccggagccggtggtagccaggtgtttcaattattattcctgaaacccttttag

SEQ ID NO: 231767 - DNA, 1932 bp, Artificial Sequence
  Description of Artificial Sequence: Synthetic coding sequence
atggagaaatcctcctcttgcgagtctttagggagtcaacccgcagcagccagacccccaagtgtggattccctttcaagcgcaagcacgagccatagtgaaaatagcgtgcacactaaatccgcctctgtggtaagctccgactccatctccacctctgccgacaacttctcacctgacttgcgtgtcttgcgggaatctaataagctagctgagatggaggaaccacctctattgcccggagaaaacataaaagacatggctaaagatgttacttacatttgtcccttcaccggagccgtcagaggcacgctcaccgtcacaaactatcggctttactttaagtctatggagcgtgaccctcctttcgtgctggatgcctccctgggagtgataaatcgcgttgagaagatagggggagcttcctcgagaggtgagaatagctatggcttagagaccgtgtgtaaggacattcgcaatcttaggttcgcccataaacccgaaggaagaaccagacgctctatttttgagaaccttatgaagtatgccttcccagtgagcaataacttacccttatttgctttcgaatacaaagaagtgttccccgagaatggatggaagctctacgatccgttactggaatacaggcgccaaggtattcccaatgagtcctggaggatcactaaaatcaatgaacgctacgaactgtgtgatacttatcctgcgctgctggttgttcctgccaacattcctgacgaagaactgaaacgcgtcgccagctttagatccagggggagaatccccgtcctgagctggatccatcctgaaagccaggctaccatcacccgctgctcccagcccatggtgggggtctccggcaaacggagtaaagaagacgaaaagtatttacaggcaattatggattccaacgctcagtcacacaaaattttcatttttgatgcccgtcccagcgttaatgctgtcgctaataaagccaaaggtggcggatatgagtccgaagacgcttatcagaatgccgaactagtgttcttggatatccataatatacatgtcatgcgcgagagtttgcgaaaattgaaggaaatagtgtacccaaacatcgaggagacccactggctatctaacctggaaagcactcattggcttgaacacatcaagcttatcctcgccggagcccttcgcatcgcggacaaagtagagtcaggaaagaccagtgtcgtcgtgcactgctccgacggatgggaccggactgcgcagctcaccagcctggctatgctcatgttagatggctattaccgcacaatccgtggattcgaggtacttgtcgaaaaggagtggctgtcattcggacaccgattccagctgagagtcggccacggggacaagaaccatgccgacgccgacaggagtccggtcttcctgcagttcattgactgtgtgtggcagatgacccgccaattcccaacagcgttcgagttcaatgagtactttttgataacaatcctggatcacttgtactcttgtctgttcgggacctttctgtgcaatagcgagcagcagagaggaaaagagaatctaccgaaaaggacagtgagcctgtggagttatatcaacagccagctggaagacttcactaatccgctgtatggcagttattccaatcacgtcctgtatcccgtcgcttcaatgagacacctggagctttgggtgggctattacatccggtggaacccacggatgaaacctcaagagccaatccacaatcgatacaaagaattgctggcaaagcgcgcagagctgcagaagaaagtggaagagcttcagcgcgagatttccaacagaagtacaagctcatctgaacgggcatcctcgccagcccaatgcgtgacccccgtgcaaacggtagtttag

SEQ ID NO: 231768 - DNA, 1716 bp, Artificial Sequence
  Description of Artificial Sequence: Synthetic coding sequence
atggaggagcccccacttctgcctggcgaaaatatcaaggatatggctaaagacgtgacctacatctgcccatttaccggcgctgtcaggggcacattgacagtcacaaactatcggctgtatttcaagtccatggaacgggaccctccgtttgttctggatgccagtctgggagtaattaatcgcgtggaaaaaattggcggagcctcttctcgtggcgagaactcctacggcctggagaccgtgtgcaaggatattcgtaatcttcgatttgctcacaagcccgaggggagaacgcggaggtctattttcgaaaatctgatgaagtacgcatttcccgtgtccaacaatctgccgctttttgccttcgaatacaaggaagtcttccccgagaacgggtggaagctctatgatcctcttttggaatatcgaaggcaggggattcctaacgaatcctggcggatcaccaagattaatgagcgctatgaactatgcgacacctatccagcactcttggtggtgcctgccaacatcccggacgaggagctcaagagagtggcttcgtttcgctctcggggaagaattcccgtgctctcatggatccaccccgaatctcaggctacgattacgaggtgcagccaacctatggttggcgtgtcagggaaaaggtccaaggaggacgaaaagtacctgcaggctattatggacagtaacgcgcagtctcataaaattttcatcttcgatgccaggccaagtgtcaatgcagtcgccaacaaagccaaaggcggtggttacgagtcagaagacgcctatcagaacgctgaactagtgtttctggatatccacaacattcacgttatgcgcgaatccctgcggaagctgaaggaaatcgtgtatccaaatatcgaggaaacacattggctttcaaacttggagagtacacactggcttgagcatataaaactgattctcgccggagctctgaggatagccgacaaagttgagtccgggaagacgagcgtcgtcgtccactgctcagacggttgggatcgcaccgctcaattgacctctttggcaatgcttatgcttgatgggtattatcgcactatcagaggcttcgaagtgctggtggaaaaggaatggctctctttcggccacaggtttcaactcagagtgggtcatggcgacaaaaaccacgcagatgccgatagatctccggtgtttctacaatttatcgactgcgtgtggcaaatgacccgccaattccccacagcttttgagtttaatgagtactttcttatcaccatcctggaccatctgtatagctgcctgttcggcacgttcctgtgcaacagcgagcagcaaagggggaaggaaaacctgcccaagcgtaccgtgagcctctggtcatacataaattcacagcttgaggatttcactaacccactgtatggctcatattctaatcacgtactgtatcccgtggccagcatgaggcatctggagttatgggtcgggtactatatccggtggaatcccagaatgaaacctcaggaaccgatccacaatcggtataaggaattgttagccaagagagcagaactgcagaagaaagtggaagaactgcagagagagatctctaatcgatccacatccagctccgaaagagcttccagccccgctcagtgtgttactcctgtgcagactgtagtgtag

SEQ ID NO: 231769 - DNA, 1716 bp, Artificial Sequence
  Description of Artificial Sequence: Synthetic coding sequence
atggaggagccaccccttcttcctggggagaatatcaaagatatggctaaagacgtcacctacatctgtcccttcactggcgcagtccgaggtactctaaccgtaactaactatcgcctatactttaaaagtatggagagggatcctcccttcgtgctggacgcaagtctgggcgttattaatcgggtcgagaagattgggggagcctcttcccgcggagagaactcctacgggctggagaccgtgtgcaaggacatccgaaacctgagattcgctcacaaacccgagggcagaacgcggaggagcatctttgagaatctgatgaaatatgccttcccagtatcaaacaacctccccctattcgcatttgagtacaaggaggtgtttccagaaaatggctggaaactctatgaccctctgctggagtatcgcagacaaggaatcccaaacgagagctggcgcatcaccaagataaacgagcggtacgagctatgcgatacctaccccgctttactggttgtccctgctaacatccccgatgaagaactgaagcgggtcgcatcttttagatctcgcggacgcatccctgtgctgagctggatccatccagagtctcaagcgaccatcaccagatgctcccaacccatggttggagtatctggcaagcgctctaaagaggacgagaaatacctccaggctatcatggactccaatgcacagtcccacaaaatatttatttttgatgccaggccctcggtgaacgccgtggccaacaaggccaaaggaggcggatatgaaagcgaggacgcataccaaaatgctgagttggttttcctagacatccataacatccatgtaatgagggagtcgttgcgcaagctgaaagagatcgtgtatccaaatatcgaggaaacgcactggctatccaaccttgagtctacgcactggctggagcacataaagcttattctggctggggctctgagaatcgccgacaaggtcgagtcgggaaagacatcggtggtcgtgcactgttccgatggatgggatcgcaccgctcagctgacttccctggccatgctcatgctggatggctattaccgaacaattcggggattcgaagtcctggtcgagaaagagtggctctccttcgggcatcggttccaactgagggttggccacggcgataagaatcatgctgatgctgataggagcccagtctttcttcagtttattgattgtgtctggcagatgacccgtcagtttccaaccgcattcgagtttaacgaatacttcctgatcacgatcctcgaccacttatatagctgtctgttcgggaccttcctgtgcaattccgaacagcagcgtggaaaggagaacctgcctaagcgcaccgtgtccctgtggtcatatatcaatagtcagctggaggacttcacaaatccactttacggcagctattctaatcacgtattataccctgtggcctctatgcgtcacttggagctctgggtcgggtactatatcaggtggaatccacgcatgaagccacaggagcctattcacaacaggtacaaagaactgttggctaaacgcgcagagctgcagaagaaagttgaagaactgcaacgggagatctcaaatcggtcaacgtcatctagcgagcgcgcatctagccccgctcagtgtgtgactcccgtacagacagtggtgtag

SEQ ID NO: 231770 - DNA, 1716 bp, Artificial Sequence
  Description of Artificial Sequence: Synthetic coding sequence
atggaagagccacctctgctgcctggagaaaacatcaaggatatggccaaagacgtgacatacatctgtccttttaccggggcagtgaggggcactctgaccgtgacaaactaccgactttacttcaaatccatggaaagggatcctcctttcgtgctcgatgctagtcttggcgttattaacagggtggaaaagataggtggcgcatcaagcaggggtgagaacagttatggactggaaaccgtgtgcaaagacatccgaaatctgcgattcgctcataaaccagaagggcgaaccaggaggagtatcttcgagaacttgatgaaatacgcctttccagtgtccaacaatctgcccttgttcgcatttgaatacaaagaggtgttcccagaaaacggatggaaattgtacgatcccctgttagagtaccgcagacaagggatcccgaacgagagttggcgcatcaccaaaattaatgaaaggtatgaactttgtgacacttacccagccctcctggtcgtgcccgctaacatccctgacgaggaactgaagagagttgccagtttccgcagcaggggccgtatccccgtattgtcctggattcacccagaatcccaggccaccattacccggtgtagtcagcctatggtgggggtctctggaaaacggagtaaagaggacgagaaatacctccaagccataatggattctaatgcccaatctcataaaatttttatatttgatgccagaccaagcgtaaacgcagtcgcaaacaaggcaaagggaggcggatatgagtcggaagacgcataccagaatgcagaattggtgttcctcgacatccacaatattcacgtgatgagggagtcactgaggaagttaaaggaaatcgtgtaccccaatatagaagaaacacattggctatccaatctcgagagtacccattggctggagcatatcaagttgatcctggcaggcgctctacggattgccgacaaggtggagtccggaaaaacgagcgtcgttgtccactgttcagatgggtgggatagaactgcccagctgacctcactcgcgatgctaatgctcgatggatactatcgaacaataagaggattcgaggtgctggtcgagaaagaatggctctccttcggtcaccgttttcagcttagagtgggccatggtgacaagaaccacgcggatgcagacaggagccctgtgttcctacagtttatcgactgcgtttggcagatgactcgtcagtttcccactgccttcgaattcaatgagtattttcttatcacgatcctcgatcatctgtattcttgtctgtttgggacattcctgtgcaactctgagcagcagcggggaaaggagaacctgccgaagagaacagtctcactctggagctatataaactcccagttggaggatttcaccaatcctttatacggctcctattccaaccacgttctgtaccccgtggccagcatgcgccatctggagctgtgggtcgggtattatatcaggtggaatccgagaatgaagccacaagagccaattcataaccggtacaaggaattgttagctaaacgggctgaactccagaagaaagtcgaagaactgcagagggagatcagtaacagaagcacctcatctagtgaaagggcctcaagccctgctcaatgcgtgacccccgtgcagactgtcgtgtag

SEQ ID NO: 231771 - DNA, 981 bp, Artificial Sequence
  Description of Artificial Sequence: Synthetic coding sequence
atgctggccgttgccctgacaatactgtcagcatccacatcccatagcgagaactccgtccatacgaaatccgcaagcgtggtgagtagcgactccatatcgacgagcgctgacaattttagtcctgacctgcgagtcttgcgggagtccaacaaacttgctgagatggaagaacctccacttttgcccggagagaatataaaggacatggctaaggacgtaacctacatttgtcctttcactggagcggtgcggggaacactaactgtgacaaactatcggctgtactttaaatctatggaacgggatccaccttttgtgctagatgctagtctcggcgtgataaatagagtcgaaaaaatcgggggagcatcgagccggggagagaactcctacggactggaaacggtgtgtaaagacattaggaatctgagatttgcccataagcctgaaggcagaaccagacgcagcatcttcgaaaacttgatgaaatatgcattccccgtgtcaaacaacttgccactcttcgcgttcgagtacaaagaagttttccccgaaaacggctggaaattgtatgaccctcttttggaatatcgacgccagggaatccccaatgaaagctggagaatcaccaaaattaacgagcggtatgagctttgcgatacatacccagccctgctggtggtccctgccaatattcccgacgaggaactgaaacgtgttgccagtttccggagtagaggacgcattccggtgctgtcctggattcaccccgaatcccaggcaaccatcacacgatgcagccagccaatggtgggcgtctctggcaaacggagtaaggaggatgagaaatacctgcaagcaatcatggattcaaacgcccaatcccataaaatcttcatcttcgatgccagaccgagtgtgaacgcagtcgcgaataaggccaagggaggaggatatgaatcagaggatgcttattag

SEQ ID NO: 231772 - DNA, 3513 bp, Artificial Sequence
  Description of Artificial Sequence: Synthetic coding sequence
atggatgaggaaacccgccactccctcgagtgcatccaggctaatcagatctttcccaggaaacagttaattcgagaagatgaaaatctgcaggtgcccttccttgaactacacggcgaatctaccgagttcgtcggcagagccgaggacgcaataatcgctctgagtaattacaggctacacattaagttcaaggagagtctggttaacgtgccccttcaacttattgaaagcgtggagtgtcgggatattttccaactgcacttaacttgtaaggattgtaaggttatacggtgccagttctctacgttcgaacagtgtcaggagtggttgaagcgcttgaacaacgctatccgccctccggcaaagatcgaagacttgttctcattcgcctaccacgcatggtgtatggaggtttatgcctcggagaaagagcagcacggtgacctctgtcgcccaggagagcacgtgaccagccgctttaagaacgaagttgagcgtatgggattcgatatgaacaatgcctggcggatatccaacatcaatgaaaagtacaagttatgtggttcgtaccctcaggagctgattgtacccgcatggattacagacaaggagctggagtccgtatcttcctttagaagctggaagaggatccctgcggtgatctaccgccaccagtcaaatggcgctgtgatcgccagatgcggtcagccagaagtctcctggtgggggtggcggaacgccgatgacgagcaccttgttcagagcgtcgccaaagcttgtgccagcgactcaagatcttcaggttccaagcttagcacccgaaacacttctcgggacttccccaacggaggggatttgtcagatgtggagtttgattcttctctcagcaacgcctcgggtgccgagagtctggctatccagccccaaaagttgctgatattggacgctcgcagctatgctgccgctgtggccaatagagctaagggcggaggctgtgaatgtcctgagtactatcccaactgcgaagtggtctttatgggtatggctaacatccattctataagaagatccttccagtctctgcggctgctgtgcactcagatgccagaccccggaaactggctaagtgccctggagtctactaagtggctgcatcatctgagtgtgctcctgaaatctgcactgctggtggtccatgccgttgatcaggatcagcgccctgtcctggtccactgctcagacggctgggatagaacacctcagatagtcgccctagccaagctgttattagatccctactaccgaacgattgagggctttcaggtgctggtcgagatggagtggctggactttggtcacaaattcgcggataggtgcggacatggggagaatagcgatgacctgaacgagcgctgccccgttttccttcagtggcttgactgcgtgcaccagctccagcggcagtttccttgttcatttgagtttaatgaagctttcctggtcaaactggttcagcacacctattcttgcctgtttgggacattcctgtgcaacaacgctaaagaacggggtgagaagcatacgcaggaacgcacgtgctcagtgtggtcactgttgcgcgctggaaataaagcttttaagaatctgctttatagttcgcaaagtgaggctgtgctgtacccagtctgtcacgtgcggaatctgatgttatggtccgctgtatatcttccatgtccctcacccaccacaccagtggacgactcctgtgcaccatatcccgcacctggtactagccctgatgacccccctctctctcgcttgccaaagactcggagctacgacaatctcaccactgcatgtgacaacacagtccctctagctagcaggagatgttccgatcccagcctaaacgaaaagtggcaggaacacagaagatcccttgaattgtctagcctggcaggaccaggggaggatcccttatctgcagactctctgggaaagccaacccgcgttcctggaggagctgagctctccgtggcagccggagttgcagagggccagatggagaacatactgcaagaagctacaaaggaggaaagcggtgtcgaagaacctgctcaccgtgccggtattgaaatccaggagggcaaggaggatcccttgttggagaaggaaagccgcagaaaaacccccgaagccagcgctattggattacatcaagaccctgaacttggcgacgctgccctccgctcgcatctcgacatgagttggcctcttttctcccaaggcattagcgagcaacagtccggcctttctgttctgctgagctcgctccaggtaccacctagaggcgaagattctctggaggtcccggtcgaacagtttcggatcgaggagatagccgaagggagggaagaggccgtgctgcccatccccgttgatgcaaaggtgggctacgggacatcacagtcttgttcgttactgccttcccaagtgccattcgagacacgaggccctaacgtggactctagcaccgacatgctggttgaggataaggtgaagtcagtcagtggccctcaggggcatcaccgttcctgcttagttaatagcggaaaagatcgcctcccccaaacgatggaacccagtccttccgagacgtcactggtggagcgaccacaggtggggtccgttgtgcaccggacctcgttgggatcaaccttgtcgctgactcggagtccctgcgccctccccctcgccgagtgcaaggagggtttggtttgcaatggggcacccgaaactgagaatcgcgctagcgaacagccacccggactctcaacactgcaaatgtatcccactccaaatgggcactgtgccaatggcgaggccggacggtccaaagactccctgtctcgtcagctcagcgccatgagctgctcctcggctcatctgcactcacgtaacctgcaccacaaatggctgcactcccacagcgggaggccttcagctacctcttctcccgatcaaccgtctcgatcccacctggacgacgacggcatgagtgtgtatacagacacaatccagcagcgactcaggcaaattgagagcggccatcagcaggaagtagaaactctgaaaaagcaagttcaggagctgaaatcaagattagagagtcaatatctgacatctagtctgcatttcaacggcgacttcggagatgaggttatgactcgctggctcccagatcacttggccgcacattgttacgcatgtgatagcgccttttggttggccagtcgtaagcaccactgtagagacactgatcgggtcgaccaaacatggaactgcggaaatgttttttgtagcagttgctgcaatcagaaggtgccggtgcctagtcagcaactgtttgagcccagtcgcgtctgtaagtcttgctactcctctctacatcctacttccagcagtatcgacctggagctcgataagccaatcgccgctacaagtaactag

SEQ ID NO: 231773 - DNA, 3486 bp, Artificial Sequence
  Description of Artificial Sequence: Synthetic coding sequence
atggacgaggaaacgagacacagtctcgagtgcattcaggcaaatcaaatatttcctcgaaagcagttgatcagagaggacgagaacttacaagtgcccttccttgagctccacggcgagagtaccgagttcgtgggacgagctgaagacgccatcatcgccctgtcaaattatcgtctgcatatcaagttcaaagaatctctggtcaacgtccccctgcagttaattgaaagcgtggaatgtcgggacatatttcagctgcaccttacatgcaaggattgtaaagttatcagatgtcaattctccacattcgaacagtgtcaagaatggcttaagaggcttaataacgctatccggccacccgctaaaattgaggatttgttttctttcgcataccatgcctggtgtatggaagtgtatgcctcagagaaggagcagcatggggatctgtgtcgcccaggagagcacgtcacatctaggtttaagaatgaagtggagaggatgggattcgatatgaataatgcctggcggatctctaatattaatgaaaagtacaagctttgtgggagttatcctcaggagcttatcgtgccggcttggataaccgacaaggagctggaaagcgtttcctcatttagatcgtggaagaggattcctgcagttatataccgccaccagtctaacggggctgtgatcgcccgttgtggccagcccgaagtttcatggtggggttggcgcaacgccgatgacgagcacttggtccaatctgttgcaaaggcctgcgcgtcggattcacggagctctgggagcaaattgtctacacgaaatacctctcgggactttcccaacggaggagacttgtctgacgtggaatttgatagtagcctgtcgaacgccagtggggcagaatctctcgccatacagcctcagaagctgcttatactagacgcccgatcctacgccgcagcagtggctaatagggccaaagggggagggtgcgaatgtccggaatactatcctaattgtgaagtcgtcttcatggggatggccaacatccacagtattagaaggtcctttcagagcctgagactcctgtgtacccagatgcccgacccgggtaattggctctcagcgctcgagagtacgaaatggctccaccacctgtccgtgttgttgaagagcgcacttctcgtggttcacgctgtcgaccaggaccagcgacctgtattggttcattgtagtgacgggtgggatcgtactccacagattgtggcccttgccaaactcttgctggatccttactatagaaccatcgagggctttcaggtgttagtggaaatggagtggctagatttcggccacaaatttgcagacagatgtggccacggagagaacagcgatgacctgaacgagcgatgcccagttttcctgcagtggttggactgtgtgcaccagttacagcgccaattcccttgctcgttcgagttcaacgaagcctttctcgtcaaactcgttcaacacacctactcatgcctgttcggcaccttcctgtgcaataatgcgaaagagagaggcgagaaacacacacaggaacggacctgctcagtttggagcctactgcgcgcaggcaataaagcttttaagaacttactttatagcagtcagagcgaggcggtgttgtatcctgtatgccacgttcgaaacctaatgctctggagtgccgtgtacctcccatgtccgtctcctacaactccggtggacgattcttgtgcgccttaccccgcaccaggaacgagtcctgacgaccctccactctcccggctgccaaaaacacggagttatgataacctgacaaccgcctgcgacaatacggtccctctggcctccaggcggtgcagtgacccatccttaaacgaaaagtggcaggagcaccggagatccttggaactgtccagtctggcaggaccaggcgaagacccgttatccgctgacagtctgggaaagcccacacgggtgcccggaggtgccgaactgtctgtggccgctggagtggcggaaggacaaatggagaacatcctccaggaagcaacaaaagaggagagcggagtcgaggagcccgctcatcgcgcaggcatagagatccaggagggcaaggaagatcccttgctcgagaaagagtctaggcgtaagacaccggaggctagcgcaatcggcctacaccaggaccctgaattaggggacgccgctctcagaagccatttggatatgagctggccgctgttttcccagggcatcagcgagcagcaatccggtctcagtgttctgctttcttcactgcaggtcccacccagaggagaagatagtctcgaggtccctgtggaacaatttaggattgaggaaatagccgagggcagagaagaggccgtcctgcccattccagttgacgctaaggtgggatatgggacatcccagtcatgttccctgttaccctcccaggttcctttcgaaacgcggggtccgaatgtggattcctcaactgatatgctggtcgaagacaaagtgaaatctgtctctggacctcagggccatcaccgctcatgtctggtgaactccggcaaagaccgactcccgcagactatggaaccatcaccttcggagacaagcttggtcgagcgccctcaggtagggtccgttgttcacagaacaagcttgggcagcaccctgagccttactaggtccccttgtgctcttcctttggcagaatgtaaggagggcttggtctgtaatggtgctcccgaaaccgagaatcgtgcgtccgaacagccacccggtcttagtacccttcagatgtatcccacgccgaacgggcattgtgcgaatggagaagctgggagaagcaaagattctctgtcgaggcagctgagcgcgatgtcctgctcctcagcccacttgcacagcaggaatttacaccataaatggctgcatagccatagcggccgtcccagcgcaacttcatcaccagaccagccatcccgctcccacttggacgacgacggcatgagtgtgtatacagacactatccagcagagattgaggcagatcgaaagcggtcatcagcaggaggttgaaactctgaaaaaacaggtacaggagctaaaaagccggctggaatctcagtacctgacctcatctctccatttcaatggagattttggcgatgaagtgatgacacgttggttaccagatcaccttgcagcacactgttatgcgtgcgactccgccttttggctggccagtagaaaacatcactgccgcaactgcggaaacgtcttctgttcttcttgctgtaatcagaaggtccctgtgccctcacaacagctgttcgaaccatccagagtctgtaaatcatgttacagctcactgcaccccacatccagctctatcgatctggagttggataaaccaatcgctgcgacaagcaactag

SEQ ID NO: 231774 - DNA, 3597 bp, Artificial Sequence
  Description of Artificial Sequence: Synthetic coding sequence
atggacgaggagaccaggcacagtcttgagtgtatccaagctaatcagatttttccaaggaagcaactaatccgagaagatgaaaatctgcaggtgcccttcctggagctgcacggagaatccaccgaattcgtcgggagggctgaggatgccattatcgctctgtccaactaccgcctccacattaagtttaaggagtccctggtaaatgtgcccttacagctgatagagtcggtcgagtgccgggacattttccaactccacctcacttgtaaagactgcaaagtcatcaggtgtcaatttagcacattcgagcagtgccaggagtggcttaagcgtctgaacaatgctatccgtcccccagccaaaattgaggacctttttagcttcgcttaccacgcatggtgcatggaagtgtatgcgagcgagaaagaacagcatggagacctctgccggcctggggagcacgtcacgtctcgattcaaaaatgaggtcgagcggatggggttcgacatgaacaatgcatggcggatatcaaatattaacgagaaatataagctgtgcgggtcctatccacaggaacttattgtgccagcttggatcacggacaaggagctggaatctgtgagcagctttcggtcgtggaagagaatcccggctgtcatatacaggcaccagtcaaacggagcagtgatagcaagatgtgggcaacccgaggtttcctggtggggttggcggaacgcggatgatgaacatcttgtgcagagcgttgccaaagcgtgtgcctctgactcgaggtcctctggcagtaaactgtccaccagaaatactagccgcgattttcccaatgggggagatttatccgatgtggagtttgattccagcctctctaatgcctcgggtgctgagtctctcgcaattcagccccagaagctgcttatattggacgccaggtcatacgcagcagcggtggccaatcgggcaaaagggggtggatgcgagtgtccagaatattatcctaactgcgaagtggtgttcatgggaatggccaatatacactctatcaggcgatcgtttcagagtttgcggttgctttgcacgcaaatgcccgaccctgggaactggctcagtgcacttgaatccaccaagtggctgcatcacctgtccgttcttctgaagtcagctcttttggtagtgcatgcagtggaccaagaccagcggccagtgctcgtgcactgcagtgacggctgggacaggacccctcagatcgtggccttggctaagctcctgctggatccctactacagaactatagagggcttccaggtcctcgttgagatggaatggctggatttcggacataagttcgcagacagatgtgggcatggagagaacagcgatgatctgaatgaacggtgtccagtcttccttcaatggctcgactgcgtgcatcagttacaacgacagtttccgtgttcttttgaattcaacgaggcattcctggtgaaactggtccaacatacttacagctgcttgtttggaactttcctctgtaataatgcaaaagagcgcggtgagaaacatacacaggagcgaacttgcagcgtttggagcctgctgcgcgctggcaataaggctttcaaaaacctgttatattcatcacaatccgaggctgtcctttaccctgtgtgtcacgtgaggaacctaatgttgtggtcagctgtatatttaccttgcccttcccccactactccggttgatgacagttgcgctccatatcccgcacctgggacatcaccagacgatccacccttatctcggctgccaaaaacacgcagttacgataacctcactaccgcatgtgacaacacagtccctctggcctctcggcgatgttctgatccgtctttgaacgagaaatggcaagagcataggcgctcgctcgaactctcctccctggcgggtccaggcgaggatccactgagtgctgattcactagggaagcctacccgggtgcccggaggggcagagctgtcggtcgctgcaggtgttgccgaagggcagatggaaaacattcttcaagaagctactaaggaagagtccggtgttgaagagccggcacatcgggctgggattgagattcaggaggggaaagaagatcctttactggagaaagaatcaagacggaaaacgcccgaagcctcagcaattggccttcaccaggaccccgaactcggtgatgctgccctgaggtcacacctggatatgtcgtggcccctcttcagccaggggatctctgaacagcagtcaggcctcagcgtgcttctgtctagtctgcaggtcccaccccgtggtgaggactccttggaggtccccgttgagcagtttcgaatcgaggagattgcagaggggcgagaggaggccgtcctccccatccctgtggatgccaaggtaggctacgggacaagccaatcgtgtagtctcttgccatcccaggtgcctttcgagacaagaggacccaatgtggattcttctactgacatgctagtggaggacaaggtgaagagcgtgagcggtccccaggggcatcacaggagctgcttagtgaatagcggcaaggacaggctgccccagacaatggagccgagcccctcagaaacttctcttgtcgagcgacctcaagttgggagcgtggttcacagaactagcctcggaagcaccttgtccttgacaagatctccctgcgcactgcctctggctgaatgcaaggaaggcctggtgtgtaatggggcacccgaaacggaaaatcgcgcatcagaacagccgccagggctgtccaccttgcaaatgtacccaacccctaatggacactgtgctaatggcgaggctgggagatccaaggattcactctcgcgccagctctccgcaatgtcatgcagttcggcgcaccttcacagtcgaaatctccaccacaaatggctgcacagccactcaggccgaccttctgcaacttcgtcacccgatcagcctagtcggtctcatctggacgatgacgggatgtcagtgtatacagacacaatacagcagagattgagacagattgaaagtggccaccagcaagaggtggagacactgaagaaacaggtgcaggagctgaagtctcggttggaaagccagtacctcacctcttctctgcatttcaacggagacttcggagacgaagtaaccagtattcctgattctgagagcaatctggatcagaattgcctgtccagatgttccacagaaatattctccgaggccagctgggaacaggtggacaagcaggacacagaaatgactcggtggctgccagaccacctggctgcacactgttacgcgtgtgattccgcattctggctggccagccgcaaacatcactgtcggaactgtgggaatgtgttttgttcctcatgttgtaaccaaaaggtccccgtgccgagtcagcagttgttcgaaccatcaagagtgtgcaagtcctgctacagctccctccaccccacttcttccagtattgatttggaactggacaaacccatcgctgccacgtcgaattag

SEQ ID NO: 231775 - DNA, 3513 bp, Artificial Sequence
  Description of Artificial Sequence: Synthetic coding sequence
atggatgaggaaacgcgacacagccttgaatgtatccaggctaaccagatattccccagaaagcaactgattcgcgaggatgagaacctgcaggtgccatttttggaactgcacggggagtccactgaatttgttggacgggctgaggatgccattatagccctgtccaattatcgccttcacattaaattcaaggagtcattggttaatgtgccgctccagttgatagaatcggtggaatgtcgagatatattccagcttcatctgacctgcaaagactgcaaagtgataaggtgccagttttctacttttgagcagtgtcaggagtggttgaaacgactgaacaacgccatccgcccaccagcaaagattgaggacttattttcttttgcataccatgcctggtgtatggaggtgtacgcctccgaaaaggagcagcacggagatctctgtcggcctggggagcacgttactagccggttcaaaaatgaagtggagaggatggggttcgatatgaacaacgcctggagaatatctaatatcaacgagaagtacaagctgtgcggctcttatccacaggaattaatcgttcccgcttggatcaccgataaggaactggaatccgtgtcaagcttcagatcctggaagcggattcctgccgtcatttacagacaccagtccaatggagcagtcatagccaggtgtggccagcctgaagtcagctggtggggctggcgaaacgccgacgacgagcacctagttcagagcgtggccaaggcttgcgccagtgactcccgctcatccgggtccaaactgtctacacgtaacacctccagagattttcccaatgggggagatcttagcgacgtcgaatttgacagcagcctgtcaaatgccagcggtgccgaaagtctggctatccaacctcagaagctgctgattcttgatgctagatcttatgctgcagccgtagcaaaccgtgccaaggggggaggatgtgaatgcccagagtattaccctaattgcgaagtggtatttatgggcatggcaaatatacatagcattaggcgctctttccagtccctgcggttattgtgtacgcaaatgcctgaccctggcaactggctatcagccttggaatcgacaaagtggctccaccatctgtcagtgttactgaaaagtgcactcctggtggtgcatgccgtcgatcaggatcaacggcctgtgcttgtgcattgttctgatgggtgggacaggacccctcagatcgtcgctctagctaagctgctgctggacccctactaccggaccatagagggatttcaggtcctggtcgagatggaatggttggatttcgggcacaaatttgcggacaggtgcggccatggggaaaactccgatgacttgaatgaacgctgtccagtgtttcttcaatggcttgactgcgtacatcagctccagagacagtttccttgtagctttgaattcaatgaagccttcctcgtgaagctcgtccagcatacctactcatgtctcttcggaacctttctgtgtaataacgccaaggaacgtggtgagaagcacacccaggagagaacttgttccgtatggtcactgttgcgtgctggcaataaagcgttcaaaaatctgctctactcctcccagtcggaagccgttctgtaccctgtctgtcacgtcagaaatctgatgctgtggtctgctgtttatttgccctgtccgtcccccaccacccccgtcgacgatagttgtgctccataccccgctccaggcacatcccccgacgatcctccgctgagcaggcttcccaagaccaggagctacgataacctcacaacagcctgcgataataccgtcccccttgcgtcgagacgctgctctgatcccagccttaacgaaaaatggcaggagcatagaaggagcctggaactgtcctcactggccggtcccggagaggaccctctgagcgcagatagtctcggaaagcctacacgggtaccaggcggagccgagttgtcagtcgctgctggagtcgctgagggccaaatggagaatatcctgcaagaggcaacaaaggaggagtcaggggtggaggagcccgctcaccgggcaggcatcgagatccaggaggggaaggaagaccccctgctcgaaaaggaaagccgtcgaaaaaccccagaagcctccgcaatcggcctgcaccaagatcccgaacttggagatgcagccctgcggtctcatcttgatatgagctggccactgttcagccagggcataagtgagcaacagagtggactgtccgtgctccttagcagtctacaggtgcctccccgtggcgaggacagcctcgaggtccctgttgagcagttcagaatcgaggagatcgctgagggtcgggaggaggctgtgctgcccattccagttgatgccaaggtgggttacgggacttctcaatcctgctcactgctgccttcgcaagtccccttcgaaacaagaggcccaaatgttgattcttctactgatatgctcgtggaggacaaagtcaagtctgtaagtgggcctcaggggcaccacaggtcttgtctggtgaatagtggtaaagatcgactgcctcagaccatggagccctcgccatcggagacatctttggttgagcgccctcaagtcggatccgtggtgcaccgcaccagtctcgggtccaccttatcactgacgcgtagcccctgcgctttgcccctggcggaatgtaaagagggtttagtgtgtaatggcgctcccgagactgagaaccgtgcgagcgaacagcccccagggctgtctaccttgcaaatgtatccgaccccaaatggccattgcgcgaatggagaggcgggtagatcaaaggattctctgtcccgccagctgtcagcaatgtcttgcagcagcgcccacctgcactcacgtaacctgcaccacaaatggctgcattctcactctggcaggccgagcgccacgagctcccccgaccagccctcccggtcacacttagacgacgatgggatgtccgtgtacaccgacaccattcaacagaggcttcgtcagatagagagcggccatcagcaggaggtggagacacttaagaagcaggtccaggagttgaagtctcgcctggagtcccaatatcttactagctccttgcattttaatggcgattttggcgacgaggtgatgacaaggtggttgccagaccatttggccgctcactgctatgcctgtgacagcgccttctggctggcaagccggaaacaccattgtcgtgataccgatagagtcgaccagacctggaactgtggtaacgttttttgcagctcttgctgtaaccagaaagtgcctgtcccttcacagcagctgttcgaacctagtagggtgtgtaaatcctgttattcgagcttgcacccaacctcatctagcatcgaccttgagctggataagccaatcgcagccactagcaattag

SEQ ID NO: 231776 - DNA, 420 bp, Artificial Sequence
  Description of Artificial Sequence: Synthetic coding sequence
atggacgaggagacgaggcactccctggaatgtatccaggccaatcagatattcccccgaaagcagctgattagagaagacgaaaatctacaagtgcctttcttagagttgcacggtgagtcaacagagtttgttggcagggctgaggatgctatcattgccttaagtaactacagactacacatcaaattcaaagagtcccttgtcaatgtgccgcttcaactgatcgagagtgtggaatgtcgtgatattttccagctgcaccttacctgtaaagactgcaaggtgattcggtgccaattttcaactttcgaacagtgccaggagtggctgaagcggttgaataacgccatcagacctcctgctaagatcgaggatctgttttcttttgcctaccacgcctggtgcatggaggtctag

SEQ ID NO: 231777 - DNA, 3588 bp, Artificial Sequence
  Description of Artificial Sequence: Synthetic coding sequence
atgggcgaagaaggccctcctagtctagaatatatccaagccaaggacctttttccaccaaaggagctggtgaaggaggaagagaatttacaggtaccgtttaccgttctccagggcgaaggggtggaattcctgggtcgcgcagcagatgctctcattgcgatctccaattatcggcttcacattaaatttaaagactccgtcatcaatgtgccgctgcgtatgatcgactctgtggagtcaagggatatgttccagctgcacatctcttgcaaggatagcaaggtggtgaggtgccatttctcgacattcaagcaatgccaagagtggctctcccggctgagtcgggctacagccagacctgccaaaccagaggacttattcgcttttgcctaccacgcatggtgtctcggcttaacagaggaagaccagcacacccacctatgtcagccgggtgagcatattaggtgccgccaggaagcagagctcgcacgcatgggctttgacctccagaacgtgtggagagtttcacatatcaattccaactataaactgtgcccaagctatccacagaaactgttggtgcccgtgtggattacagacaaggaactggagaacgtcgctagctttcggagttggaagcggatccctgtggtcgtatatagacacctacgcaacggcgcagctatcgcaaggtgctcgcagcccgaaatcagctggtggggatggcggaacgcagatgacgagtacctggttacaagtatcgccaaagcttgcgcactggatcctggcaccagggccaccggcggtagtctcagtaccggaaataatgacacaagtgaagcctgcgatgcggattttgattcctctcttacagcctgttcaggggtagaaagcaccgccgctccgcaaaagctcctgatcctcgacgctaggagttacacggctgcagtagcaaacagagcaaagggagggggttgcgagtgtgaggaatattaccctaactgcgaggtggtgtttatgggcatggccaatatacacgcgattagaaatagttttcaatacttaagggcggtatgttctcaaatgcccgacccaagtaactggctgtctgcccttgagagcaccaagtggctacagcatctgtctgtgatgctgaaagctgccgtgctggtagccaacacagttgaccgggaaggcagaccagtattggtccactgttctgacggatgggatcggactcctcagatagttgccctggctaagattctgttggacccctattatagaactctcgaggggttccaagtgctcgtggaatcagactggttggatttcggccacaaattcggggatcgttgtggacaccaggaaaatgtggaggaccagaacgaacagtgtcccgtgttcctccagtggctcgatagcgtgcatcagttactgaagcagtttccgtgtctgtttgaattcaacgaggcgtttctggtgaaactcgttcaacatacttactcctgtctttacgggacttttttagctaataacccttgcgaaagagaaaaacgaaatatttacaagagaacctgtagtgtatgggctctgctcagagccggaaacaagaacttccataactttctttataccccatcaagtgacatggtcctacacccagtctgccatgtgcgggcactccacctatggacagctgtgtacctgcccgcaagcagtccctgtactcttggcgaggagaacatggacctgtatctgtcccctgttgcccagtcacaggaattctctggtagatccttagatagactcccaaagacccgatcgatggatgatctactgtccgcctgcgatacttcatctcccctcacccgaacgagctccgatccaaatttgaacaatcattgtcaggaggtgcgcgtggggctggaaccttggcatagcaatccggagggcagcgagacctcattcgtcgattccggcgtgggcggtcctcaacagaccgtgggcgaggtgggattgcctcctcccctgccctcttcacagaaagactacctgtctaacaagccatttaagtcccacaagtcctgcagcccgagttacaaactgctgaatactgcagtgccccgagaaatgaagtctaatacaagcgaccctgagatcaaggtgctggaagagactaaaggaccagccccagacccctcagcccaagatgaacttggtagaactctggatggcatcggcgagccaccggagcattgtccagagaccgaagccgtatctgcgttgtctaaagttatctcaaacaagtgcgatggcgtctgcaactttcctgagtcgagccagaacagccctacaggcactccccaacaggcccagccggactccatgctaggagtgcctagtaagtgtgtgctcgatcattccttgagtacagtgtgtaatcccccatctgcggcatgtcagacacctctcgatccatcaaccgatttcttgaaccaagatcccagcggctctgtggcatctatttctcaccaggagcagctatcttcggtgcccgatcttacccatggtgaggaggatatcggaaagcgtgggaacaaccggaatggccaactgctggaaaacccacggtttggaaagatgccgctggagctcgtccgcaagccgatctcccagtctcaaatcagtgagttcagcttcctcggttccaactgggactccttccagggaatggtcacatccttcccaagcggcgaggccaccccaagaagattattgagttatggctgctgctcgaaacggccaaattctaagcagatgagggccacggggccatgcttcggcggtcagtgggcgcagcgggaaggagtgaagagtcccgtgtgcagctcccatagcaacgggcactgtacaggccctggcggtaaaaatcagatgtggctctccagtcaccctaagcaggtctcttccaccaagcctgttcccctgaattgtccttcaccagtgccaccactgtacctcgatgatgacgggttgccttttcccacagacgttatacagcaccggttgcgccagatcgaagccggatataagcaagaggtggagcagctgcgacgtcaggtgagggaactacagatgaggctggatataagacactgttgcgcaccgcctgccgaaccccctatggactacgaagatgatttcacttgtctcaaagaatccgacggctcagataccgaggatttcgggagcgaccactctgaagattgcctgagtgaagcctcctgggagcctgtcgataaaaaggaaaccgaggtaactagatgggtgccggaccacatggcctcacattgctacaactgtgattgcgagttctggctggctaagaggcggcaccactgtcggaactgcggcaacgtgttttgcgctggctgctgtcatctgaagctaccaatccccgaccagcagctgtacgaccctgtgctcgtgtgcaatagctgctacgaacatatccaggtgagtcgggctcgggaactcatgtcgcagcagttaaagaagcctattgctactgcatcttcctag

SEQ ID NO: 231778 - DNA, 570 bp, Artificial Sequence
  Description of Artificial Sequence: Synthetic coding sequence
atgcctgtgtggaaactgccatggaaactcagcgaggggaaaaggcgagcccaggttgaaggggaggatctgttcccggtcgccatcagcttcgggcgtccaaaagaagtcctgcccctttatagcagtgaaagtcatcggtttacagtgctcgagcctaataccgtatctttcaattttaagttttggcgaaacatgtaccaccagtttgacagaacattgcatcctagacaatccgtcttcaatatcattatgaatatgaacgagcagaataagcagctagagaaagacattaaagatctcgagagtaagatcaaacagcgcaagaacaaacagaccgatggtatcctcacgaaagagctcctgcatagcgtccaccccgaaagccccaatttgaaaaccagcttgtgtttcaaggaacagaccttgctccccgtgaacgacgcactccgtacaattgagggctcttcgccggctgataacagatacagtgaatacgccgaagaattctccaagagtgaacccgctgtggtgagcctcgagtacggtgttgcaagaatgacctgctag

SEQ ID NO: 231779 - DNA, 1866 bp, Artificial Sequence
  Description of Artificial Sequence: Synthetic coding sequence
atggaacacatccggacaacaaaagtcgagcaggttaaacttctggacagattctcaacgtctaacaaaagcctcacagggactctataccttacggccacacacctgctttttatcgacagccatcagaaggaaacctggattctgcaccaccacatcgcttcagtggaaaaacttgcgttaaccacatcagggtgtccacttgtcattcagtgcaaaaactttcggaccgtgcacttcatcgtgccgagggagcgggattgccatgatatctataattccctccttcaactgtccaagcaggccaagtatgaagacctctatgccttctcctacaaccccaaacagaacgactctgagcgcctccaaggttggcagctaatagacctggctgaagaatacaagcgcatgggagttccaaactcgcactggcagctgagtgacgccaaccgggactacaagatatgtgagacctaccccagagagctctatgtccccagaatagccagcaaacctattatagtgggttcttctaaattccgctctaaggggaggtttcccgttctgtcctactaccaccaggataaagaggcagccatttgccgctgttctcagccactgagtggcttctctgccaggtgcctggaggacgagcacctactgcaggccataagtaaagccaatccggtgaaccggtatatgtatgtgatggatacaagaccaaaactgaacgcgatggcgaaccgggctgcaggaaaaggctacgagaatgaggataactatagcaacatccgattccagttcgtgggcatagagaacattcatgtcatgagatccagcctccagaaactgctagaggtcaacgggaccaagggcctcagcgtgaacgatttttactctggcctcgagtcatctggatggttgagacatatcaaagccgtgatggacgctgccatttttttggccaaggccatcacagtagagaatgcaagcgtgctcgttcactgcagcgacggttgggataggactagccaggtgtgctcacttgggagcttgttgttggattcttactatagaacaatcaagggattcatggttttgatagagaaggactggatctcttttgggcacaagttttccgagcgctgtgggcagctagacggtgaccctaaagaggtatcaccagttttcacccaattcctggaatgcgtctggcaccttaccgagcagttcccacaggcattcgagtttagcgaggcctttctgctacagatacatgagcacatacactcctgtcagttcgggaatttcttggggaattgccaaaaagagcgggaggagctgaaactgaaagagaaaacatactccctttggcctttcctcttggaggaccaaaaaaagtatcttaatcccctttactcatctgaaagccaccggttcaccgttctggaaccaaatactgtgtccttcaattttaagttctggcgaaacatgtatcaccagtttgataggactttacatcctcgacagtccgtatttaacattatcatgaacatgaatgagcagaacaagcagctagagaaagacatcaaagacctcgagagtaaaatcaaacagcggaagaataaacagactgacgggatcctcactaaagaactgctccacagcgttcatcccgagagcccaaatttgaaaacttccttgtgttttaaagagcagacattacttcctgtgaatgacgccctgcgaacaatagagggcagttctccagcggacaatagatactccgaatatgccgaggaattcagcaagtcggagcccgcagtggttagcctcgaatacggtgttgcccgtatgacctgctag

SEQ ID NO: 231780 - DNA, 1647 bp, Artificial Sequence
  Description of Artificial Sequence: Synthetic coding sequence
atggaacatattagaactactaaggtagaacaggtcaaacttctggatagattctccaccagcaataagtctctcacaggcactctgtatttaacagctacccatctgctcttcattgatagccaccagaaggagacttggattttacatcaccatatcgcatctgtagaaaaactggcgctcacaacatctgggtgtcctctagtaatccaatgcaaaaacttccggaccgtccactttatagtccctcgtgagcgcgattgccacgacatctataattctctgctccagctctcaaaacaagcgaagtatgaggatctctacgccttctcttacaatccaaagcagaacgactctgagaggctgcaagggtggcagctgatcgatctggcggaagaatacaaacgcatgggagttcccaattcacattggcagctttcagacgccaatagagactataagatttgtgagacatatcctcgcgagctgtatgttccacggattgcgagcaaaccaattattgtcggtagctcaaagttccgcagtaagggccgattcccagtgctgtcctactaccatcaggacaaagaggcagccatatgccgctgctctcagccattgtctggcttctcagccaggtgcctggaagatgagcatctacttcaggctatttctaaagcgaacccagtcaacagatatatgtacgtgatggacactcgccctaaattgaacgcaatggcaaacagggcagccggaaagggctatgagaacgaagacaattactccaatatcaggttccagtttgtcgggattgagaatattcatgtcatgaggtcctccctgcagaaacttctggaagttaatgggactaagggacttagtgtgaacgatttttacagtggcttagaatcctccgggtggctccgccatatcaaagctgtgatggatgccgcaattttcctggctaaagcaataactgttgaaaacgcctccgtccttgtccattgctccgacggttgggacaggacatcccaagtttgctcactcggcagtttgcttctcgactcatactataggaccatcaagggattcatggtactgattgagaaggactggatatccttcggacacaaatttagcgagcgatgcggacagttggacggtgatccgaaggaagttagccccgtattcacacagttccttgagtgcgtctggcacctgacagagcagtttcctcaggcatttgagtttagtgaggccttccttctgcagattcatgagcatatccacagttgccagtttggtaatttcttggggaactgtcaaaaagaaagagaggaattaaagttaaaagaaaagacctactccttatggccgttcttacttgaggaccaaaagaaatacttgaatcccctctattcttctgaaagccaccgctttacagtccttgaaccgaacaccgtctccttcaactttaagttctggagaaacatgtatcatcagtttgatcgcacgcttcaccctagacaatcagtcttcaacatcattatgaacatgaatgaacaaaacaaacagctcgagaaagacattaaagatctcgaatccctgacctcatatagctctttcaagatcatcgtgggccagtag

SEQ ID NO: 231781 - DNA, 1647 bp, Artificial Sequence
  Description of Artificial Sequence: Synthetic coding sequence
atggagcacattcgcactacgaaggtggaacaggtcaaattactcgacaggttcagcacttctaataaatcactgacaggcacactttatctcaccgccacgcatctgttgttcattgattcccatcagaaagagacatggatactacatcatcatattgctagtgtggagaagttagctttgacaacctctggctgtccgttagtgatacagtgtaagaattttcgcactgttcattttattgtgcccagggaacgcgattgccacgacatctataacagcctcctacagctcagcaaacaggctaaatacgaggatctgtatgcgttctcttataaccccaagcagaacgattctgagcggctgcagggctggcagctgattgacctggctgaggaatacaaacgcatgggtgtgcctaattcccactggcaactaagtgatgccaacagagactataaaatttgcgaaacttaccccagagagctgtacgtgccccgaattgcctcaaagcccatcatcgttggaagcagcaagttccgctcgaagggtaggttcccagtcctgtcttactaccaccaggataaggaagccgctatctgccggtgctctcagccgcttagcggcttcagcgcacgctgcctggaggatgagcatctcctgcaggcaataagcaaggccaatcccgtaaacaggtacatgtatgttatggacacaagacccaagctaaacgccatggccaaccgtgccgcaggaaagggttacgagaacgaggacaattatagcaatatcaggtttcaattcgtgggaatcgagaatatccacgttatgcgctcctctctccagaagttgctggaagtgaatggtacaaaaggcttgagcgtaaacgacttctactccggcctcgagtcctccggctggctgcggcacatcaaagccgttatggatgctgcaattttcctcgctaaggccattaccgtggagaacgcgtccgtcctggtgcattgctcggatgggtgggataggaccagtcaggtctgctccttggggtccctgctgttggacagctattatcggaccatcaagggcttcatggtgctgatcgagaaggactggatctcttttggtcacaagttcagcgagcggtgtgggcagcttgatggtgatcccaaagaagtatcccccgtttttactcagttcctggaatgcgtttggcaccttacggagcagttccctcaggcctttgagttcagtgaagccttcctgctacagatccacgagcacatccactcttgccagtttggcaatttcctgggaaattgccagaaagagagagaggaactgaagttgaaggagaagacatacagtctgtggccgtttctgcttgaggaccagaagaagtacctaaatccgctgtacagttcagagtcccatcggttcactgtgctcgagccgaatacggtgtcttttaatttcaagttctggagaaacatgtaccatcagttcgaccgaacactgcatccccgtcaatcagtctttaacatcatcatgaacatgaacgagcagaacaagcagcttgaaaaggacattaaggatctagaatcattcactagtttcgcagctgcgagagttattcagggccagtag

SEQ ID NO: 231782 - DNA, 1983 bp, Artificial Sequence
  Description of Artificial Sequence: Synthetic coding sequence
atggaacatattagaactccgaaagtggagaatgttcggttggtggatagagtttccccaaagaaggcggctctcgggacattatacctgactgcaacgcacgtcatcttcgtggagaattctcccgatcccaggaaagaaacatggattctgcactcacagatttcaacgatagaaaagcaggccactaccgccaccggctgccccctgttgattcgctgcaagaatttccaaataatccagctcatcatccctcaggaacgcgattgtcatgatgtgtacatctcgctaatcaggttggccaggcccgtgaaatacgaggagctgtattgcttttccttcaatcctatgctggacaaagaggaacgtgagcagggatgggtgctcatagatctgtctgaagagtatacgcgtatgggtctccccaaccattactggcagttgtcggacgttaatagggactatcgggtatgcgattcgtatcccacagaactgtacgtgcccaagtctgcaactgcccatattatcgtcgggagctccaaattccgatcccgacgacgcttccctgtgctgtcatactattacaaggataaccatgcaagcatttgccgcagcagtcagcccttaagcggatttagtgcccgttgtctcgaggacgagcagatgctgcaggcaattcgaaaggcaaatcccggtagcgactttgtgtacgtagttgacacccgaccaaaacttaacgccatggcaaatcgggcagccggaaagggctatgaaaacgaagacaattattcaaatatcaagttccagttcattgggattgaaaacattcatgtgatgcgcaatagcctgcaaaagatgctcgaggtctgcgaactgaagtctccatccatgtccgatttcttgtggggactggagaactcaggctggcttaggcatattaaagctattatggacgctggcattttcattgctaaggctgtgtcagaggaaggcgcatctgtgctggtccactgctcggacgggtgggatagaacagcccaggtgtgctctgtcgctagtctcttactggatccccattacagaacgttaaagggtttcatggttctgattgagaaagactggatttctttcggacacaaattcaaccatagatatggcaaccttgacggagatcccaaggaaatcagtccagtgattgaccagttcatcgaatgtgtctggcagctgatggaacaatttccttgtgctttcgaattcaatgaacggtttctcatccacatacagcaccatatatactcatgccagtttgggaacttcctctgcaactcccagaaagagaggcgcgagctaaaaatccaggagagaacctactcattatgggctcatctttggaagaaccgcgcagactatctgaatcctttatttcgagccgatcattcccagactcaagggaccctgcaccttcctaccacaccctgtaactttatgtacaagttttggtccggcatgtataatcgatttgaaaaggggatgcaacccaggcaatctgtaacggattacctcatggctgtaaaggaagaaacccagcagctggaagaagaattagaggcacttgaagaaagactggaaaagatccagaaggttcagctgaactgtactaaagtaaaatccaagcagtccgagccgagcaaacactcagggttttctactagcgataattccatagcaaacactccccaggactactcaggcaacatgaagtcatttccttcacggtccccttcccagggggacgaggacagcgccctgattctgactcaagataacctgaaaagctccgatccggatcttagcgctaacagcgatcaagagtcgggagttgaagatctgagctgtcgctcacccagcggaggagaacacgccccttcggaagatagcgggaaagatcgggactccgacgaggctgtttttctgaccgcatag

SEQ ID NO: 231783 - DNA, 756 bp, Artificial Sequence
  Description of Artificial Sequence: Synthetic coding sequence
atggagcaattcccttgtgcttttgaattcaacgagagattcctgatccatatccagcaccatatctattcttgtcagttcggtaacttcctttgtaactcccagaaggaacggagagaacttaaaattcaggagcggacctattcactttgggcccatctttggaagaaccgggctgattacttgaacccactgtttcgcgcagaccattctcagactcaaggcaccctccatctgccaaccacgccttgtaacttcatgtacaagttctggtccggcatgtataatcgctttgaaaagggcatgcagcccagacaatcagtcaccgactatctgatggcggtgaaagaagaaactcagcagcttgaggaggagctcgaggccctcgaagagaggctggaaaagattcagaaggtccagctgaactgcaccaaggtaaagtccaagcaaagtgagcccagcaagcattcagggtttagcacaagcgataatagcattgctaataccccgcaggattactcaggcaatatgaagtcctttccctctagatcgccatcgcaaggagacgaagatagcgccctgattctgactcaggataacctgaaatctagcgacccggatctctcagctaattcagaccaggagtccggcgtggaagatctgtcctgccgctctcccagcggtggggagcacgcccctagcgaggactctggtaaggaccgcgactcagacgaggcagttttcttaaccgcctag

SEQ ID NO: 231784 - DNA, 1668 bp, Artificial Sequence
  Description of Artificial Sequence: Synthetic coding sequence
atggaacacatcagaactcctaaagtagagaatgtcagactggtggaccgggtgtcaccgaagaaagcagctctcggtaccctgtacctgactgcaacacacgtaatattcgtcgaaaactcaccggacccacggaaggagacgtggatcctgcacagccagatttcgacgatcgagaaacaggccaccacggccactggatgccccttgctgatcagatgtaagaacttccaaattattcagctgattattccgcaggaacgtgactgccacgacgtgtatattagtctgataagactcgccaggccagtgaaatacgaggagctctattgtttctcgttcaatcctatgctcgataaagaggagagagagcagggttgggtcctgatagatctgagtgaagagtacacaaggatgggactgccgaaccattactggcaattaagtgacgtaaacagagactatcgcgtttgtgactcataccccaccgagctctacgtccccaagagtgccactgctcacataattgtggggagttcaaaatttcgctctcggagaagattccctgtgctgtcctactattataaagataaccacgcctcgatttgtcgttcttctcagcctctgtccggtttctccgccagatgcctggaggatgaacaaatgttacaagccattcgtaaggcgaaccctggaagcgattttgtttatgtcgtggacactcgcccaaaactgaatgccatggcaaaccgcgcagccggtaagggctatgagaacgaggacaactacagtaacatcaagttccagttcattggaattgaaaacatacacgtgatgaggaacagtttgcagaagatgctcgaagtttgcgagttgaaatcaccgtccatgtctgacttcctctgggggctcgaaaatagcggctggttgagacacataaaagctatcatggatgccggaatctttatcgcaaaagcagtaagcgaggaaggagcctctgtcctagttcattgctctgacgggtgggaccggacggctcaggtttgcagtgtggcatcactgctgctggacccccactacaggaccttgaaaggttttatggtgttgatagaaaaggattggatcagcttcggccataagttcaaccataggtacggcaatttagacggggatccaaaagaaatttcccccgtcattgatcaatttatcgagtgcgtgtggcagcttatggagcagtttccgtgtgccttcgagttcaatgagaggttcctcattcatatccagcatcacatttactcttgccaattcggaaacttcctgtgcaactcccagaaagagcgccgagagctgaagatacaggaaagaacttattccttgtgggcgcacctgtggaaaaatagagccgactaccttaatcctctgtttagagccgaccactctcagacgcagggtacactgcacctacctactacgccatgcaatttcatgtataaattctggtctggcatgtacaaccggtttgaaaaagggatgcaaccacgtcaaagcgtcaccgactatctgatggcagttaaggaagaaacccaacagcttgaagaagagctcgaggcccttgaagaggtgcgccatacatgcttcgtgaacctgttttctgtgctgatctcctag

SEQ ID NO: 231785 - DNA, 1773 bp, Artificial Sequence
  Description of Artificial Sequence: Synthetic coding sequence
ctggatcttctggtgccaaaggttgagaacgttaagctagtggatagatacgtgtctaaaaagccagccaacggtattctctatctgaccgctacgcatctcatttatgtcgaagccagcggcgcagccaggaaagaaacctggattgccctgcatcatattgcaacagtcgaaaaactcccgatcactagcctgggctgccctcttacactcaggtgtaaaaattttagagtggctcactttgttcttgactccgatttggtgtgtcacgaagtctatatctcactccttaaactgagccaacctgcactgcctgaagacctgtacgcattcagctataatccaaaaagctcgaaggaaatgagggagagcgggtggaagctaatcgatccaatcagtgatttcggaaggatgggtatccccaatagaaactggactataacagacgccaatataaggtttcgttttatgggcatagagaacatacacgtcatgagaagttccctccagaagttgttggaagtgtgcgagctaaagacccctactatgagtgagtttcttagcgggttagagagctccgggtggctgcgccacatcaaagccatcatggatgcaggaatcttcataaccaaagctgtaaaagtcgagaaggcgagcgtgttggtgcactgttctgatggctgggataggacggcacaagtgtgttccgtagcctcaattcttcttgatcctttttaccgtacctttaagggattgatgatattgatagagaaagaatggatttcgatgggacacaagttcagtcaacggtgcggccacctcgatggcgattcaaaggaagtctcacctatcttcactcagtttttggactgtatctggcagttaatggaacaattcccatgtgctttcgagttcaatgagaacttcctgttagagatccatgaccacgtgttttcatgccagttcgggaattttctcgggaactgtcaaaaggacagggaggatcttcgcgtatacgagaaaacgcactccgtgtggccattcctcgtccaaaggaaacccgattttcgtaaccccctgtacaaaggattcaccatgtacggtgtgctcaatccgtccactgttccctacaacatccagttctggtgtggcatgtacaatcggtttgacaagggcctccaacccaaacagagcatgctggagtccctgctcgaaattaagaagcagcgagctatgttggagacagacgttcatgaacttgaaaagaagctgaaggttagggatgaaccacctgaagaaatatgcacgtgttcccagctgggcaacatcctgagccagcatcttggctctccattgactaatcccctgggatttatggggattaatggtgacctaaacacccttatggagaatggcacgctcagtagagagggtgggctgagagcccagatggatcaggttaagtcccagggggctgacctccatcacaattgctgtgaaattgtgggaagtttgagggccattaatatcagcggtgacgtgggcatctcagaagcaatgggaatcagtggcgacatgtgtacttttgaggcaaccggattctctaaggacctggggatctgtggggctatggatatatctgaagctacgggcatcagcggcaatctgggcatcagcgaggctcgcggtttctctggggatatgggtattctgggcgatacaggaatatccaaagccagtaccaaggaggccgactattccaaacaccagtag

SEQ ID NO: 231786 - DNA, 2115 bp, Artificial Sequence
  Description of Artificial Sequence: Synthetic coding sequence
atggaccatattaccgtacctaaagttgaaaatgttaagctggtggatcgctacgtgagcaagaagcctgcgaacggaatactgtacctgaccgctacacatctgatttatgtggaagcttcgggagctgcgagaaaggagacctggatagcattgcaccatatcgcaactgtggagaagcttcctattacgtccttgggatgcccactgacgctcagatgcaaaaactttcgcgttgcgcattttgtactcgatagcgatctagtgtgtcatgaggtctatatctcactgctgaaactcagccagcccgctctgcctgaggatctgtatgcattttcatataaccctaagagttccaaggaaatgcgggaatctggctggaaactgatcgatcccattagcgactttggcagaatgggcatccctaatagaaactggactataactgatgctaatagaaactacgaaatctgttccacgtatccacccgaaattgtagttccgaagagtgtgaccctgggtactgtggttggttcgagtaaattcaggtctaaggaaagagtccctgtcttatcatacctttataaagaaaacaatgcagccatttgcaggtgctcccagcccctgtcgggtttctatacccgatgtgtagacgatgaactcctgctggaagctatcagccagacaaacccgggaagccaatttatgtatgtagtggacacaaggcctaagttgaacgccatggccaacagggcagccggaaagggttacgagaatgaagataactacgccaacatcagattccgattcatgggaatagagaacattcacgtcatgcggtcatcactgcagaagcttttggaggtgtgcgagctgaaaacccctaccatgtctgaatttttatccggtttggagagttcgggctggctgcggcacattaaggcaatcatggacgccggaatatttatcaccaaagctgtgaaggtggaaaaggcctctgtgctggtgcattgttctgacggctgggacagaaccgcccaggtgtgctctgtcgcatctatcctgctggatcctttctacaggaccttcaaaggtctgatgatcctcattgaaaaagagtggatctccatggggcacaagtttagccagcgatgcgggcacttggacggcgacagcaaggaggtgagcccgattttcactcagtttctggactgcatatggcagctgatggaacaattcccgtgcgcattcgaatttaatgagaacttcctgctggaaatccatgatcatgtgttctcttgtcagtttggcaactttttgggaaactgccagaaggacagggaagatctaagggtttacgaaaagacccatagtgtctggccttttctggtgcaacgcaaacctgatttccgcaatcctctgtataagggcttcacaatgtacggggtgttgaatccatctaccgtgccatataacatccagttttggtgcggcatgtataaccgcttcgacaagggcctgcaaccgaagcaatccatgctcgaaagtctactagaaattaagaaacaacgtgccatgctggaaaccgatgtgcacgaactcgagaagaaactgaaagtgcgtgatgagcctcccgaagaaatctgtacctgttctcagttgggaaatattctgtcgcagcatctgggatccccactgaccaatcccctcggctttatgggcatcaatggcgacctaaatacactcatggagaacggcaccctctcacgggagggcggactgcgcgctcagatggaccaagtgaagagtcagggggcagacctccaccataactgttgcgagatagtggggagcctaagagcaatcaacataagtggcgacgtcggaatctccgaggctatgggtatttccggggacatgtgcacgtttgaggccacaggtttctccaaagacttaggcatctgcggcgctatggacatcagcgaggccacaggaatatctgggaacctgggcatttccgaagctcgcggtttcagtggcgatatgggcatattgggcgacaccggcatttcaaaggcctcgacaaaagaagcagattacagcaagcatcagtag

SEQ ID NO: 231787 - DNA, 1527 bp, Artificial Sequence
  Description of Artificial Sequence: Synthetic coding sequence
tgagattccgatctggtttgccacgaggtttatataagccttcttaaactgtctcagcccgctttacccgaggatctttatgccttctcatacaatcctaaatcatctaaagaaatgcgggagagcggttggaaactcatcgacccaatctcggatttcggcagaatgggcataccgaacagaaattggaccattacagatgctaatataagattccggttcatgggcattgaaaatattcacgtgatgaggtcaagcctgcagaagctgctcgaggtgtgcgagctgaaaactccaactatgagcgagttcctaagcggtctggagagctcaggctggctcagacacatcaaggctattatggatgcaggcatatttattactaaggccgttaaagtagagaaggcctctgttctcgtgcattgctctgatggctgggatcggaccgcccaagtttgctcagtggcaagtattcttcttgaccccttttaccgcaccttcaaagggctgatgatccttatcgagaaagagtggatttctatgggacataagttcagtcagcggtgcggtcacttggatggcgacagcaaggaagtgtccccaatctttacacagtttctggactgtatttggcaactaatggagcaatttccctgtgcctttgaatttaacgaaaattttcttctggagatacatgaccacgtgtttagctgtcagttcggtaatttccttggtaactgccaaaaggaccgggaggacctgcgcgtctacgaaaagacacactcggtgtggccctttctggtccagagaaaaccagactttcgtaatcctctgtacaaaggctttacaatgtacggcgtgttaaatcctagcacagtcccctacaacatccaattttggtgcggcatgtacaaccggttcgacaagggcctgcagcccaaacagtctatgctggagtcacttctcgagatcaaaaaacagcgggcaatgcttgagacagacgtgcatgaactggaaaaaaaactgaaagttagagacgagccccctgaggaaatctgtacatgctcccaacttgggaatatactttcacagcatctcggtagccccctcacgaaccccctcggtttcatgggtatcaacggtgatctgaatactctcatggagaacggaaccctgtcccgagaggggggtctgcgagctcagatggatcaggttaagagccagggcgctgatctgcaccacaattgctgcgagatcgtcggttccctgcgggcaatcaatatcagtggggacgtgggtatcagcgaagctatggggatcagtggggacatgtgtacctttgaagctacaggcttttctaaggatcttggcatctgcggcgcaatggacattagtgaagcaacagggattagcgggaacctagggatttcagaggctagaggattcagcggggatatgggcattctgggcgacaccggaatctctaaggccagcacaaaagaagccgactattcaaaacaccagtag

SEQ ID NO: 231788 - DNA, 2082 bp, Artificial Sequence
  Description of Artificial Sequence: Synthetic coding sequence
atggatcatattaccgtaccgaaagtagagaacgttaagttagtggatcgttatgtctcaaaaaaacccgcaaacgggattctgtacttgactgccacccatctcatatatgtcgaggcttctggcgctgcaaggaaagagacttggattgctctgcatcatatcgcaacagtggagaagctgccaattacttccctgggatgccctttgacacttcgatgcaagaacttccgggtagcccatttcgtgctcgacagtgatctggtttgtcacgaagtatacatcagcctacttaaattgtcccagcccgctcttcccgaggacctttacgcttttagttacaacccaaagagcagcaaggaaatgagagagtccggttggaaattaattgaccctatcagcgattttgggcgtatgggcattcctaaccggaactggaccatcacggatgccaatcgtaattacgaaatatgtagtacctaccccccagagatcgttgtgccaaaaagcgtcactctgggtaccgtcgtcggctctagcaaattccgctcgaaggagagagtgccagtgttatcctatctgtacaaggagaataacgccgcaatctgccgatgtagtcagcccctgtctggtttttatacccgctgtgtggatgatgagctgctcctggaggcaatctcccagacaaaccctggttcgcaattcatgtacgtcgtagacacacggcctaaattgaatgctatggcaaatcgcgcagccggtaaagggtatgaaaacgaggataactacgctaatattaggttcaggttcatgggcatagagaacattcacgtgatgcgttcctcactacagaagcttctggaggtctgtgagctgaaaacacctactatgagcgaatttctcagcggcctagagtcaagcggctggctccggcacatcaaagcgataatggatgctggtatttttatcaccaaagctgttaaggtcgaaaaagcatctgtgctcgtccattgcagcgatggctgggatcggacagcccaggtgtgttcggtcgccagtattctcttagacccattctacaggacttttaagggcctgatgatctggcacttcctggtcttgatcatgagaattgtgctgcagttagctaagatgaatctgatggatatcactaagatcttcagcctgctgcaaccagacaaggaggaggaggataccgacacagaagaaaagcaggccctcaatcaggcggtgtacgataatgatagctacacccttgatcagctgctcagacaggaaaggtataagcggttcatcaacagcagaagcgggtggggggtgcccggaactccccttcggctggctgcctcctatgggcatttgtcttgcttgcaggtgttgctagcccacggcgcagatgtggattccctcgacgtcaaggctcagactcctctgttcaccgccgtttcacacggacaccttgactgcgtgcgtgtactgctggaagccggagcctcacctgggggaagtatctataataattgcagcccggtccttaccgccgctcgcgatggagcagtggcaattttgcaggagttgctcgatcatggggctgaagctaatgtcaaggccaagctgcctgtgtgggcctccaatatagcgtcctgctcagggcctttgtacttggctgctgtgtatggacatcttgactgtttccgactactcctcctgcacggcgctgatcctgattataactgcacagatcagggccttctcgcacgggtcccacgccctcgcaccctgctcgaaatttgccttcatcataactgtgagcccgagtacatccagctgctgattgacttcggcgcaaatatctacctgccttccttgtccttggacttgacttctcaagatgataagggaattgccctcctgctgcaagctagggccacaccaagatctctactctctcaggtgcgtttagttgttcgtcgagccctgtgccaagccggacagccccaggcaatcaatcagctggacatcccacctatgctaatttcatacctcaaacaccaactctag

SEQ ID NO: 231789 - DNA, 861 bp, Artificial Sequence
  Description of Artificial Sequence: Synthetic coding sequence
atgggaggagagcgttctggcgtcaggggaaacaaaatggcagcagctgagccctcacccaggcgggtcggcttcgttggagctgggaggatggcaggagcgattgcccaaggcctgattcgcgctgggaaggttgaggcccagcatatccttgcttccgctcctaccgataggaacctgtgccatttccaggcactcggatgccgcactacacactctaaccaggaggtgctgcagtcctgtttgctcgtgatctttgccactaagccgcatgtgctgcccgctgtccttgccgaggtggcccctgtggttactaccgagcacatcctcgtaagtgtcgccgcaggggttagtctttccacattggaagaactattgccaccaaacacccgtgtgctccgcgtgctgcctaacctcccctgcgtggtgcaagagggggcaattgtcatggcacgaggtaggcatgttgggtcttccgaaactaaacttctacagcacctcctggaggcatgtggcaggtgtgaggaggttccagaggcctatgtagacatccacacaggattgtctggcagtggagtcgcatttgtgtgtgcttttagcgaggcgcttgcagagggcgcagtgaagatgggaatgccatcttctcttgcacatcgtatcgcagcccagactctcttaggaactgccaaaatgctactgcatgagggtcagcatcctgctcagctgcgctcagatgtttgcactcctggagggactaccatctatggtctccacgcgctcgaacaggggggactaagggccgcaaccatgagtgctgtggaggccgcaacttgtcgggcaaaagagctgagcaggaaatag

SEQ ID NO: 231790 - DNA, 900 bp, Artificial Sequence
  Description of Artificial Sequence: Synthetic coding sequence
atgccactatctggaactcccgctccaaataagaaaagaaagtcatccaagcttatcatggagctgactggagggggtcaagaaagcagtggattgaacctgggcaagaaaatctctgttcctcgagatgtgatgttagaggagctgagcctgctgacgaatcggggatccaagatgtttaagttgcggcagatgagggtggaaaagttcatatacgaaaatcaccctgacgtcttttctgacagtagcatggatcactttcagaagttcctcccaaccgtcggcggtcagcttggaacagctggccaggggttctcgtactctaaatccaacggcaggggtggctcccaggctggaggatcggggtccgctggtcagtatggctccgatcagcaacatcacttaggcagcggctccggagccggtgggaccggcggacccgcaggacaggctggtcgaggcggtgccgcagggacagcaggtgtaggtgaaaccggctcaggcgatcaggctggaggggaaggcaaacacataaccgtcttcaaaacgtacatctctccttgggaacgtgccatgggcgtggaccctcagcaaaagatggaattgggcatcgatctactggcctacggcgctaaagcggaactgcccaaatacaaaagtttcaacagaaccgcgatgccttacgggggttacgagaaagcctcaaaacgaatgactttccagatgcccaagtttgacttgggccctttgctttccgagcctttggtgctttataaccagaatctctccaatcgtccctcctttaatcgcaccccaattccatggctttcatcaggtgagcccgtagactacaatgtagatatcggcataccgctggatggggagactgaagagctttag

SEQ ID NO: 231791 - DNA, 795 bp, Artificial Sequence
  Description of Artificial Sequence: Synthetic coding sequence
atgttgagtcacaacaccatgatgaaacagcgcaagcagcaggccaccgccatcatgaaggaagtacacgggaacgacgtcgacggcatggacctgggaaagaaagtgtcgattccccgtgacatcatgttagaggagctgtcccatctctccaatcgcggagccagattatttaaaatgcgccaaagacgatctgacaagtacacctttgagaactttcagtaccagagcagagcccagattaatcactccatcgccatgcagaatggtaaggtcgacggctcaaatctggagggagggtcccaacaggcccctttgacgccgcctaatacgcctgatcccagatccccacctaatcctgacaatatcgcccctggctatagcggaccactgaaggaaataccccctgagaagttcaatacaaccgccgtgcctaagtactaccaatccccctgggagcaagctatctccaacgatcctgaactgttggaagccctctaccctaaactattcaagcctgagggaaaggctgaattgccagattataggtcttttaaccgcgttgccactccatttggtgggtttgagaaggcgtcacgcatggttaaatttaaggtgcctgatttcgagctgctcctccttacagatccacgctttatgtctttcgttaacccgctttcaggccgtaggagtttcaatcgcacacctaagggatggatcagcgaaaacatccccatcgttatcactaccgagcctaccgatgataccaccgtgcccgaatctgaggatctgtag

SEQ ID NO: 231792 - DNA, 756 bp, Artificial Sequence
  Description of Artificial Sequence: Synthetic coding sequence
atgatccccaaggagcagaagggccctgtgatggccgcaatgggagatctaaccgagcccgtgccaaccctggacctcgggaagaaactcagtgtcccccaggaccttatgatggaggagctcagtctgcgtaataaccgcggatcgctcttgtttcagaaaaggcagcgcagggtccaaaaattcaccttcgaacttgccgctagtcagagggccatgctggcagggagtgcaaggcggaaagttaccggaactgctgagagcggcactgtcgcaaacgcaaacggcccagagggaccaaattataggagtgaactccacattttcccagcctcccctggcgctagtttgggtggcccagaaggcgcacaccccgctgctgcaccagccggatgtgtcccatccccttctgcactcgcacccggatacgcagaaccgctgaagggggtcccaccggagaaatttaaccacactgccatatctaagggctataggtgcccatggcaggagttcgtttcatatagagactatcagagcgatgggagatctcacaccccttcacccaatgattaccgaaactttaacaaaactcccgtccccttcggcggtccgctggtgggcggtacattcccacgaccaggcaccccctttataccggagcccctgagcggattagaacttcttagactcagaccgagctttaatagagtggcccagggatgggtgcggaatctacctgaaagcgaggagctgtag

SEQ ID NO: 231793 - DNA, 756 bp, Artificial Sequence
  Description of Artificial Sequence: Synthetic coding sequence
atgatcccaaaagaacagaaaggccctgtgatggccgctatgggtgatctgacagagcccgtgcccactctcgatctcggaaagaagctcagtgtcccacaggacctgatgatggaggaactctcactgagaaacaacaggggatccctcctttttcaaaagaggcaaaggcgcgtccaaaagtttacctttgaacttgctgctagtcagagagcgatgttggccggttctgctaggagaaaggtgaccggcactgccgagtccggtactgtggccaatgcaaacggccctgagggcccaaactacagaagtgaactacatatctttcctgcctctccaggcgcatcacttgggggtcctgagggagctcaccctgccgcagctcctgcaggatgcgtgccgagtccttccgcccttgctcctggctacgcagagccactgaaaggcgtgcccccagagaaatttaatcacacagccatctccaaaggttaccgctgcccctggcaggaatttgtgagttaccgtgactaccagtctgatggacggagtcacacaccaagccctaacgattatcggaactttaacaagactcctgtcccttttggagggccactagtgggaggcactttcccgagaccaggtacaccctttatacccgaaccactatccggactagagctattacgactgaggccctcctttaaccgcgtggcgcaggggtgggtgcgaaacctccccgagtccgaagaactgtag

SEQ ID NO: 231794 - DNA, 1989 bp, Artificial Sequence
  Description of Artificial Sequence: Synthetic coding sequence
atggtggtgtccgaagtggacatcgctaaagccgatccagctgcagcatcacacccattactgctcaatggcgacgctaccgttgcacaaaagaatccaggctcagtggcagagaacaacttatgctcccagtacgaggagaaagtgcggccttgcattgaccttatcgacagtctgcgggcactgggtgtcgagcaagatctcgccctgcctgccatagcagttattggcgatcagtcgtccggaaaatctagcgttctagaagccctcagtggtgtcgcactgcctcggggatccgggatcgtgacacgctgcccactagtactgaagttaaaaaagctggtaaatgaagataagtggcgtggaaaggtgtcttaccaggactacgaaattgagatttccgacgcttcagaagtcgagaaggagatcaacaaggcccaaaacgccattgcaggtgaaggtatgggtatttctcatgaactaatcaccctggaaatttcttccagggatgtgccggaccttaccttaatcgatctcccagggatcaccagggtggctgttggaaatcagcctgccgacatcggctacaaaattaaaacactgatcaagaaatatatacagcggcaggaaacaatctcactggtggtggtgcccagcaacgtcgacatcgccacaacagaggcgctgtccatggcgcaggaggttgacccagagggcgaccggacaatcggcatcctgacgaaacccgacctggtggacaaggggacagaggataaggtggtggatgtggttcgcaatttggtgttccatctgaagaagggctacatgattgttaaatgtcgtggccagcaggagatccaggaccagctctctctatcagaggccctgcagagggagaaaatcttcttcgagaaccacccttacttccgcgacctcctggaggagggcaaggctaccgtcccctgcctggctgagaagctcacgtccgagcttatcactcatatttgtaaatctctccccctcctggaaaatcaaattaaagaaactcaccagcgtattacagaagaactccagaagtacggcgtggacatcccagaagatgaaaacgaaaagatgttctttttgattgacaaggtaaatgcgttcaatcaggatatcaccgcactgatgcagggcgaagaaacagtgggagaggaggacattcgattatttacccggcttaggcatgaatttcacaagtggagtaccattattgagaacaattttcaagaaggccacaagattctgtctcggaaaatccaaaaatttgaaaatcagtatcggggtcgagagttgcccggtttcgttaattaccggacatttgagacaatcgtcaaacagcaaattaaagcgctcgaagagcctgcggttgatatgctgcacaccgttaccgatatggtgaggttggccttcactgatgtatccatcaagaacttcgaggagttttttaatctacaccggacggccaaaagtaagatcgaagacatacgagccgagcaagagcgggagggagagaagctcatcaggctgcatttccagatggaacagattgtttactgccaggatcaggtgtataggggagcgctgcagaaagtgagggagaaggagcttgaggaggaaaagaagaagaaatcttgggattttggtgctttccagtcttcttccgccactgattcatcgatggaggagattttccagcatctgatggcataccatcaggaggcgagtaagcggatctcctcccatatacctctgatcatacagttcttcatgcttcagacgtatggacagcagctacagaaggccatgctccagctgctccaggataaagacacttattcctggctgctcaaggagcgttccgatacatctgacaaacggaagtttctcaaggagcgcctcgcgcgactcactcaggcaaggaggaggctggcccagttccctggctag

SEQ ID NO: 231795 - DNA, 1989 bp, Artificial Sequence
  Description of Artificial Sequence: Synthetic coding sequence
atggtggtgagtgaggtcgatattgccaaagccgatccagcagcagcaagccatcccctgttattgaatggcgatgccactgtggctcagaaaaacccagggtctgtggccgaaaacaacctctgcagtcaatatgaggaaaaggtgcggccatgcatcgacctgatcgactccctccgggctctgggcgtcgagcaagatttggcattgccggctattgccgtgataggggatcagagctcaggtaagagcagtgtcctggaggcgttatcgggagtggctcttccaagaggatccggaatcgtgaccaggtgtccactggtgctcaagcttaaaaagctggtgaacgaagacaagtggagaggcaaggtgtcctatcaggactacgagattgagatttcagacgcgagcgaggtggaaaaagaaatcaacaaagcccagaatgccattgccggtgaagggatgggcatttcccatgagctgatcacacttgagatctctagtcgggatgttcctgacttaactctgattgatctgccaggtatcacaagggtcgccgttggtaaccagcccgcagacatcggctacaaaattaagactttaatcaagaaatatatccagcgccaagagaccatcagcctggtcgtggtcccttccaatgtcgacatagcaacaactgaagccctgtctatggcccaagaggtggaccccgaaggagaccgcactatcggcattctaactaagcccgatctggtcgataagggaacagaggacaaagtggtggacgtggttcgcaacttggtcttccacttgaaaaagggctatatgattgttaagtgccgtggccagcaggaaatccaggatcaattatcgctgagtgaagctctccaaagggagaagatcttttttgagaaccacccatacttcagggatctgctggaggagggtaaagccaccgtgccctgcctagcggaaaaactgacctctgagctgattactcacatttgtaagtcactaccacttctggaaaatcagattaaagagacacaccagcgaattaccgaggagctgcagaagtacggagtcgacatccctgaagatgagaatgagaagatgttctttttaattgacaaagtgaacgcgtttaaccaggatattactgccctgatgcagggcgaagagaccgtcggggaagaggatattaggctatttaccaggttacgtcatgaattccataaatggtctaccattatcgagaacaatttccaggaaggccataaaatcctgtctcgcaagatccagaagtttgagaatcagtatcgcggaagagagttgcctggctttgtgaactatcgcacatttgagacaatcgttaaacaacagatcaaggcattggaagagcccgctgtggatatgctccacaccgtaaccgatatggtgagactggcatttaccgacgtaagcatcaagaactttgaagagttcttcaacctacacaggaccgccaaatctaagatcgaagacatacgggctgaacaagaaagggaaggagaaaaactgattcgtctgcattttcagatggaacagatcgtttattgccaggatcaggtctaccgcggagccctccagaaagtgcgtgagaaagaactagaggaggaaaaaaaaaagaagagctgggatttcggagcctttcagagctctagtgccaccgactctagtatggaagagatttttcaacatctgatggcctaccatcaggaggcatccaagcgtatctcttctcacatccctctgatcatccagttttttatgctgcagacctatgggcagcagcttcagaaagccatgctccaacttcttcaagataaagacacttatagctggttactcaaggaacggtcagacacaagcgataagcgtaagtttctcaaggaaaggttggccagattgacacaggctcggcgtcgattagctcagttcccagggtag

SEQ ID NO: 231796 - DNA, 207 bp, Artificial Sequence
  Description of Artificial Sequence: Synthetic coding sequence
atggtcgtgtccgaggtggatattgccaaggccgacccagccgcagcttcacacccactgctgctgaatggagatgctacggtcgcccagaaaaatcctggatcggtggcggagaacaatctatgtagccagtacgaggagaaggtccgcccatgcatagacctaatcgacagcttaagggctctcggggtggaacaggatctttag

SEQ ID NO: 231797 - DNA, 606 bp, Artificial Sequence
  Description of Artificial Sequence: Synthetic coding sequence
atggtcgttagcgaggtcgacatagccaaagcagatccagcggctgcgtcgcaccccctcttacttaacggggatgccacagtcgcccaaaagaatccagggagcgtggcagagaacaacctgtgttcgcagtacgaggagaaagttagaccttgtatcgatctcattgacagccttagggccctgggcgtcgagcaggacctggccctcccagctatagcagtgattggcgatcagagttcgggaaagtcttccgttctcgaggcattgtcaggagttgccctacctagagggtctgggatcgtaacacggtgcccgctggtgttaaagctcaaaaagctggtaaatgaagacaaatggagaggaaaggtgtcctaccaggactacgagatcgaaatctccgacgcttcagaggtcgagaaggagatcaacaaagcacagaacgccattgctggagaagggatggggataagccacgagctcattaccttagagatttcttctagagatgtgcctgacttaacacttattgatcttccaggaattacacgtgtcgctgtcggcaatcagcctgcagatattggttacaaaatcaaaacgctatag

SEQ ID NO: 231798 - DNA, 81 bp, Artificial Sequence
  Description of Artificial Sequence: Synthetic coding sequence
atggtggtatccgaagtcgatattgctaaagccgaccctgccgcagcctctcatccattgctgttgaacggtgacgcttag

SEQ ID NO: 231799 - DNA, 594 bp, Artificial Sequence
  Description of Artificial Sequence: Synthetic coding sequence
atggttgtaagcgaggtcgacatagctaaggccgatcctgccgcagcttcacaccctctattactgaacggggacgccacagttgctcaaaaaaacccgggaagtgtcgccgaaaacaacctgtgctcccagtacgaggagaaggtccgaccctgcattgatttaatcgatagtctgcgcgctttgggagtggagcaagatctggcacttcctgctatcgcggtcattggagaccagagtagtggaaaatcatctgtcctcgaggccttgtcaggggtcgcgctcccacggggaagcgggatcgtcacaaggtgtcccttggtgctgaaacttaagaaacttgtgaatgaagataagtggcggggtaaggtgtcatatcaggattacgaaatcgagatatccgatgcatcggaggttgagaaagagatcaacaaggcacagaatgctatagccggtgaaggaatgggtatcagccatgaactcattacactcgagatcagctctcgggatgtcccagatctcacgttaattgacctgccaggcattacacgagtggccgtcggcaaccaacccgctgacatcggttataaatag

SEQ ID NO: 231800 - DNA, 108 bp, Artificial Sequence
  Description of Artificial Sequence: Synthetic coding sequence
atggttgtttccgaagtggatattgccaaagccgaccccgctgccgcaagccatccgctgctattgaatggtgacgcaaccgtagctcagaagaaccccggttcctag

SEQ ID NO: 231801 - DNA, 234 bp, Artificial Sequence
  Description of Artificial Sequence: Synthetic coding sequence
atggtcgtgagtgaagttgatatcgctaaagctgacccagccgcagcttctcacccattgctcttaaatggcgacgctactgtcgcacagaagaatccaggctcagtggctgagaacaatctgtgctcacagtacgaggagaaggtcagaccctgtatcgacctgatcgacagcctacgggcactgggagtggaacaggaccttgctcttccggcaattgccgttatcggttag

SEQ ID NO: 231802 - DNA, 1989 bp, Artificial Sequence
  Description of Artificial Sequence: Synthetic coding sequence
atggtggtgtccgaggtggatatcgctaaggcagacccggcagctgcctctcatccgttactcctgaacggtgacgccaccgtcgcccagaaaaaccccggatcagtggcagaaaacaacctgtgctcacagtacgaagaaaaagtccgtccatgcattgacctgatcgacagcctcagagccctgggagtcgagcaggacctcgccctcccagccatcgccgtcattggagatcaatcttccggcaaatcctcagtcttggaagcactatcaggtgtggctttgccacgcggaagcggaatcgtgactagatgcccgctggtactcaaactgaaaaaactggtaaacgaggataagtggagagggaaagtcagttatcaggactatgaaatcgagatttcggacgcctccgaggtggagaaagaaataaataaggcccaaaatgcaattgccggagaagggatggggatcagccacgagctgatcactctggagatttcaagtcgagacgtacctgaccttactctgattgatctgcctggcatcacaagggtcgccgtcggaaatcagccagcagacataggatataaaattaagacccttatcaagaagtacatccagcggcaggagaccatttctctggtcgtggtgccatctaatgtagatatcgcaacgacggaggcattgagcatggcccaagaggttgatccggaaggcgaccggacgatcggtatccttaccaaacctgatctggtcgacaagggcaccgaggacaaggttgtcgacgttgtgagaaacttagtgttccatttgaagaaaggatacatgatcgtgaagtgccggggtcagcaggagatacaagaccagctaagcctcagcgaggcgcttcagagagagaaaatcttttttgaaaaccacccttactttagggatctgctggaagagggcaaagctaccgttccatgcctcgcagagaagctgacctccgagctaatcacacatatctgtaagagcctcccccttttggagaaccagataaaagagacccaccagcgcattacggaggagctgcaaaaatacggtgtggatatccccgaggatgaaaacgagaagatgttcttcctaattgacaaagtgaacgcttttaaccaagatatcaccgccctgatgcagggagaggagactgttggcgaggaggacattaggctgtttactcgtctccgccacgaatttcacaagtggtccactataattgagaataatttccaggagggacacaaaattctatcacgaaaaatccagaagtttgagaaccagtatcgcggtcgggagctgcccggtttcgttaactatagaacttttgaaacgatcgtcaagcagcagattaaagccctagaggagccagctgttgatatgttgcatactgtcacggacatggttaggctcgccttcactgacgtcagcattaagaacttcgaggagtttttcaacttgcatcgcacagccaaatcaaagattgaggatatacgagccgagcaagagcgcgaaggggaaaagctgattcgcctccactttcagatggagcagatcgtatactgccaagaccaagtgtacagaggtgcccttcaaaaggtgcgggagaaagaacttgaagaggagaagaaaaagaaatcatgggacttcggcgctttccagagcagtagcgctacagattcatcaatggaagaaatctttcagcatttgatggcctatcaccaggaagcctccaaaagaattagctcccacatcccactgattatacagtttttcatgctgcagacctacggccagcaactccaaaaggctatgctccagctcctgcaggacaaagatacgtattcctggctcctgaaagagcggtctgacacgagtgataagagaaagttcttgaaggagaggctagctagactgactcaggctaggcgtagacttgcccagtttcctgggtag

SEQ ID NO: 231803 - DNA, 2148 bp, Artificial Sequence
  Description of Artificial Sequence: Synthetic coding sequence
atgagcaaggcccataagccatggccataccgcagacgatcacaattttcatcgcgtaaatatctgaaaaaggaaatgaactcatttcagcagcagcctcctccgttcggaacagtgccacctcaaatgatgttcccacccaattggcagggggcagagaaggacgctgctttcctggcaaaagatttcaactttctgactctgaacaaccagcctccccctgggaataggagccagcccagggctatgggacctgagaataacttgtactcgcagtatgagcagaaagtgcggccttgcatagatctgatcgactcccttagagccctgggggtggagcaagacctcgccctccccgctattgccgtaattggggatcaaagcagcggcaagtcgagtgtgctcgaagctttgtctggcgtggctctgcctagaggcagcggaatcgttaccagatgtccattggtcctgaagctgaaaaagcaaccatgtgaggcctgggcaggaaggatttcatataggaataccgaactggagctccaggaccccggacaggttgagaaggagattcataaagcccagaacgtgatggctggcaatgggaggggaatcagtcatgaactaatctccctcgaaattacatcccccgaggtaccagaccttactataatcgacctcccaggcatcacaagggtcgccgtcgataatcagccgagagacatcggcctacagattaaagcactcataaagaaatacattcagaggcaacagactataaacctggtagttgttccctgcaatgtagacatagccacaacagaggctctctctatggcacacgaagttgaccccgaaggagatcggacaatcgggatcctcacaaaacctgacctcatggacaggggaactgagaaatcagtcatgaatgtcgtgcgaaatctaacctaccctcttaaaaaggggtatatgatagtgaaatgccgaggacaacaggagataacaaataggcttagcttggcagaggccacaaagaaagaaatcaccttctttcagacgcacccttacttcagagtcctcttagaagaaggctccgctacagtgcctcggctcgccgaacggctcaccacagagctgatcatgcacattcagaagtctctgccactgctcgagggtcagatacgcgagtcccatcagaaggctaccgaagagctgcggaggtgcggggcagacattccgagccaggaagctgataaaatgttttttctcatcgagaaaataaagatgttcaaccaggacattgagaaactggttgagggggaggaggtggtaagggagaatgagacaagactctataataagatcagagaggacttcaaaaactgggtcggcatcttagccacgaatactcagaaggtgaagaacatcatccacgaggaggtcgagaagtatgagaaacagtaccgtggcaaggagctgctcgggtttgtcaattacaagacgtttgaaattattgtgcatcagtacatccagcagttggtcgagcccgctctgagcatgctgcaaaaggctatggagatcatccagcaggcatttattaacgtcgccaagaagcattttggagaatttttcaacctgaaccagaccgttcagagtactatagaggacataaaggttaagcatacagctaaggccgaaaacatgattcagctgcagttcagaatggagcagatggtcttctgtcaggaccaaatctattctgtggttttaaagaaagtgagagaggaaattttcaatccccttgggacgccgtcacaaaacatgaagttgaacagccactttccatctaacgaaagttcggtcagcagtttcacggaaataggtatccacctaaatgcatactttttggagaccagcaagcgcctggctaaccagattcctttcatcatccagtattttatgttgcgcgagaacggcgattctctgcagaaagctatgatgcagatactgcaagaaaaaaacaggtattcttggttactgcaggagcagtccgagacggccacaaagcgacgaatcttaaaggagagaatataccgtctcactcaagcacgccacgctctgtgtcagttctcctctaaagagattcattag

SEQ ID NO: 231804 - DNA, 45 bp, Artificial Sequence
  Description of Artificial Sequence: Synthetic coding sequence
atgtcaaaagctcacaaaccgtggccatacagacgccgtagttag

SEQ ID NO: 231805 - DNA, 405 bp, Artificial Sequence
  Description of Artificial Sequence: Synthetic coding sequence
atgagtaaagcccataaaccgtggccctacagaagacggagccagttttcttcccgaaaatatctgaaaaaggagatgaatagctttcagcagcaaccacctccatttgggaccgtgcctccacagatgatgtttccgcctaattggcagggtgctgagaaggatgccgcttttctagctaaagattttaactttttaaccctgaacaaccagccaccccctggtaatcggagtcagccaagagctatgggacccgaaaacaatctttactctcaatatgaacagaaggtgcgaccttgtatagatcttatagactccctgcgggctctcggggtggagcaggatctggctctgccggcaattgctgtcattggcgatcagtcttcaggcaagagtagtgtctag

SEQ ID NO: 231806 - DNA, 378 bp, Artificial Sequence
  Description of Artificial Sequence: Synthetic coding sequence
atgtcaaaggcgcacaagccttggccttatcgaaggcggagccagttcagtagtagaaagtatctgaaaaaggagatgaattcttttcagcagcagcctcccccattcggaacggttcctccacagatgatgtttccacctaattggcagggagccgagaaggacgcagcttttctagcaaaggacttcaatttcctaaccctgaacaaccagcccccaccaggaaatcgatcccagcccagggccatgggacctgaaaacaatttgtactctcagtatgaacagaaggtgagaccgtgtattgatctgattgacagcttgagggctttaggggtggaacaggacctggctttaccggctattgccgtcattggatag

SEQ ID NO: 231807 - DNA, 390 bp, Artificial Sequence
  Description of Artificial Sequence: Synthetic coding sequence
atgtcaaaagcacacaagccatggccttaccggaggcggagtcagttctcttccaggaagtatttgaagaaggagatgaactcatttcagcagcaacctcctccgttcgggacagtgccccctcagatgatgtttccacctaactggcagggggctgaaaaagatgcggctttcttggcaaaggattttaattttctgactttaaacaaccaacctcctcccggtaacaggtctcaacccagagctatgggaccggaaaacaacctgtattcacagtatgaacagaaagtccggccttgtattgacttgatagatagcctgagggccttgggagttgagcaggatcttgctttacccgcaatcgctgtgatcggtgaccagtctagttag

SEQ ID NO: 231808 - DNA, 606 bp, Artificial Sequence
  Description of Artificial Sequence: Synthetic coding sequence
atgagtaaagcccataagccatggccctatcgtcggcgttcacagttctcctccaggaaatacctgaagaaagagatgaactcatttcagcagcaaccacctccattcggcaccgtgccccctcaaatgatgtttccaccaaactggcaaggtgcggaaaaggacgctgcctttttggctaaggacttcaatttcctgactctcaacaatcaaccgccacccggaaaccggtcccagcctagggccatgggccctgagaataacctgtatagtcaatatgaacagaaagtcaggccatgtatcgatttaattgactcactccgtgccttaggcgtggagcaggatctggcactgcccgctattgcggtgatcggtgaccaatcctctggcaaaagttcggttctcgaagcgctgagtggcgtggccctgcctcggggttctgcccagaacgtgatggcaggcaacgggaggggtatctcacatgaactgatctctctcgagattacttcacccgaagtccctgatttgaccatcatcgacctgcctgggatcactagagtggccgttgataatcagcctagggacatcggtttacaggtgagttag

SEQ ID NO: 231809 - DNA, 663 bp, Artificial Sequence
  Description of Artificial Sequence: Synthetic coding sequence
atgaacatccggaacgcacgacccgaggatttaatgaacatgcagcactgtaacctgctgtgtcttcccgaaaattaccagatgaaatactatttctaccacggtttgtcctggccccaattgtcttatatcgcagaagacgagaatggaaagatcgtgggatatgtgcttgcaaaaatggaagaggaccctgacgacgtgccacatggacacataacgagtctggccgtgaagaggagtcacagacggctgggcttggcacaaaagcttatggaccaagcgtctcgagcaatgatagagaatttcaatgctaaatatgtgtccctgcatgtccgaaagagaattagtgaggtggagcccaaatattacgccgacggtgaagatgcatatgctatgaaacgagatttgacgcaaatggccgacgagctgagacggcacctcgagctcaaggagaagggcaggcatgtggtgctgggcgctatcgagaacaaggtggagtctaaagggaacagcccaccatcaagcggggaggcatgccgggaggagaagggcctagccgctgaggactctggaggcgactctaaggacctatccgaggtcagcgagacaaccgaaagcactgatgtgaaagactctagcgaagcaagcgattcagcatcctag

SEQ ID NO: 231810 - DNA, 708 bp, Artificial Sequence
  Description of Artificial Sequence: Synthetic coding sequence
atgaacatccgcaacgctcgccctgaagacctgatgaatatgcaacattgtaatctgctgtgtctccctgaaaactatcagatgaagtattatttttaccacggcctgagttggccccagcttagttatattgccgaagacgagaacggcaaaatagttggttacgtgctggcgaagatggaggaagaccccgacgacgtgccacatggacacataaccagcctagctgtgaagaggagccaccggcgattggggctggcacagaagctgatggatcaggcctcacgggctatgatagaaaatttcaacgccaagtatgtgtccctacacgtgaggaagagtaaccgagcagctctgcatctttacagtaacacactcaacttccagatctctgaagtagaacctaaatactatgccgacggcgaggatgcgtatgcaatgaagagggatctcacccagatggcagatgagctgagacgacacctggaattgaaggaaaagggtagacacgtcgtcctaggcgcaatagagaacaaggtcgagtcgaaaggaaatagtcctccctctagcggggaggcctgcagagaggagaaaggtttagccgcagaggattcaggcggtgactccaaagacctatcagaggtttcggaaactactgaaagtacagacgtcaaagattcaagcgaggcttcagattccgcaagttag

SEQ ID NO: 231811 - DNA, 396 bp, Artificial Sequence
  Description of Artificial Sequence: Synthetic coding sequence
atgaatattaggaatgccagacctgaggacctgatgaatatgcagcattgtaacctgctttgccttcccgaaaactatcagatgaagtactatttctaccacgggctgtcctggcctcagttgagctacatcgcagaggatgaaaacggcaagatcgttgggtacgtgctcgcaaagatggaggaagatccggatgacgttccccacggtcacataaccagtctggctgtgaagaggtctcaccgcaggctcggcctagctcaaaagttgatggaccaggccagtagggctatgatcgagaattttaatgccaaatatgtctccctgcacgttaggaaaaggagtgtgaaatggtcacccaatactatgcagatgggcagaactcccatgccgtag

SEQ ID NO: 231812 - DNA, 534 bp, Artificial Sequence
  Description of Artificial Sequence: Synthetic coding sequence
atgatcgtggctgaaattaagaaccgaaccaaaattcacaaggaggacggcgacattctcgcatcgaacttctcagtcgatactcaggtagcatacattctttcgcttggcgtggtgaaagaattcaggaagcatgggatcggcagcctcctcttagagtctctcaaagatcacatctcgacaacggcccaggaccattgtaaggcgatttatctgcacgttctgaccacaaacaatactgctatcaatttttacgagaaccgcgatttcaaacagcaccactatcttccatactactatagcatccggggagtgctgaaggacggattcacctacgtcctgtatatcaacggtggtcatcccccatggaccatccttgattatatccaacatctgggaagcgctcttgcaagcctgtccccttgctcaattccccatagggtgtacaggcaggcgcatagtctgctatgttcgttcctgccttggtcaggcatctcaagcaaaagcggtatagagtattcgcggaccatgtag

SEQ ID NO: 231813 - DNA, 729 bp, Artificial Sequence
  Description of Artificial Sequence: Synthetic coding sequence
atgacggaggttgtccccagctccgctttgtctgaagtcagcttacgcttgctgtgccacgatgacattgacactgttaaacatctgtgtggagactggtttcccatcgagtatcccgacagctggtatcgtgacataacatccaataaaaagttcttcagcctggccgctacatatcgcggtgcgatcgtgggaatgatcgtggctgaaataaagaatcgcactaaaatacataaggaggacggcgacatactggccagcaacttctcagtcgacactcaggtcgcatacattttaagtctgggggtcgtgaaggaatttaggaagcacggtataggcagcctgttgctggagagcctgaaggatcatatttctaccacagcccaggaccattgcaaagcaatctacctccatgtacttaccacgaataatactgccatcaacttctatgagaacagggactttaaacagcatcactatctcccttactactactctattcggggtgtactgaaagacggtttcacatacgtgctgtacattaacgggggtcaccctccctggacgattttggattacatacaacacttaggcagtgccctcgcctcgctgtcaccgtgttctatcccgcacagagtgtaccggcaggctcattcactactgtgctcttttctcccctggtctgggatcagttcgaagtccgggatagagtatagtcgcaccatgtag

SEQ ID NO: 231814 - DNA, 729 bp, Artificial Sequence
  Description of Artificial Sequence: Synthetic coding sequence
atgaccgaagtcgtgccctcaagcgccctgtccgaagtaagtttaaggctcctgtgccacgatgatatcgatacagttaaacatctgtgcggcgattggttcccgatagagtatccagacagttggtaccgtgacattacatcaaataagaagtttttttctctggccgcaacatacagaggtgccatcgtggggatgattgtggctgaaattaaaaacagaacaaagattcacaaggaggacggagacattcttgcgtcaaacttttctgttgacactcaggtggcatatatcctctccctcggagttgttaaagaattccgcaagcacggcattggatctctcttgctggagtctctcaaagatcacattagcaccaccgcacaagatcactgcaaggccatttacttgcatgtgctgaccactaataacactgcaatcaacttctatgagaacagggacttcaaacaacatcactaccttccgtattattattctattaggggcgtgttgaaagacgggttcacctatgtgctgtacatcaatgggggacatcctccgtggaccatcctggattacatccagcacctggggtcagctctggcctcattatctccttgtagtatcccccaccgcgtatacaggcaagctcattcgctactgtgcagctttctgccctggtctggcatctcctcaaagtcagggattgagtacagtaggacaatgtag

SEQ ID NO: 231815 - DNA, 573 bp, Artificial Sequence
  Description of Artificial Sequence: Synthetic coding sequence
atgactgaagtggtgccatcatcagccctctcagaagtttccttgagattactttgtcacgacgacatcgacactgtaaagcacctctgcggagattggttcccaatcgagtaccctgattcttggtacagagacataacatccaataaaaagttttttagcttggccgctacatacaggggcgctatcgtgggtatgatcgtggcagagatcaagaataggacaaaaatccacaaggaagacggcgatatcctagcctctaatttcagtgttgacacacaagtggcatatattctctctcttggagttgtcaaggaattcagaaagcacggcattgagcctcatggcctccaccccgcaccaggcctctgtacttcccagcccgaacccctccttcattccgcccagtctctgcccccaggccctcaacctgcccttcagctacccgcaatggtgggacacctttttcaagaatggcacagagttcaacctgaccacgttatgagcgcgggtcagccgccaccaggccctacactcaggcccccagcggagcctgccttcctgagtatatag

SEQ ID NO: 231816 - DNA, 750 bp, Artificial Sequence
  Description of Artificial Sequence: Synthetic coding sequence
atgttccctcgcaggaggactgagcgtaggctgggcgatactggcacaaggaagaagatcgcctacaggaaggccgtgccaggcggtcgaaaatgtggcgcttctctgagctgggaaaaatctagtcgggaatatcccgactcatggtaccgggatataacctccaacaaaaagttcttctccctcgctgctacctataggggagccatcgtgggcatgatcgtagctgagattaagaacaggacaaagattcacaaagaggatggggatatactggccagtaatttcagcgttgacacacaggtcgcctatattctctccctgggggttgtcaaggaattccgcaaacacggcattggcagtcttctcctcgaaagtctcaaagaccacatctcgaccacagcgcaagatcactgcaaggctatctacctccatgtactcactactaacaacacggcgattaatttctacgagaaccgcgattttaaacagcaccattacctgccctactactatagtataagaggcgtcctgaaggacgggttcacatatgtactttacatcaatggaggacaccccccttggacaatcttggattacattcagcacctggggagcgccctggcctctctttccccctgcagtataccacatcgtgtttataggcaggcccactctctcctctgttcttttctgccttggtcagggatttcttccaagagcgggatagaatactccagaaccatgtag

SEQ ID NO: 231817 - DNA, 492 bp, Artificial Sequence
  Description of Artificial Sequence: Synthetic coding sequence
atggccgtcattctgggtatatttggcacagtacagtatcggagcagatatcttattctatacgccgcttggcttgtgctgtgggtgggctggaacgcatttatcatttgcttctacctagaagtcgggcagctcagccaggaccgcgattttatcatgacgtttaacacttctttacaccgctcatggtggatggaaaatggtcctggctgtctagtgactcctgttctgaactccagattagccctggaggatcatcatgtcatcagcgtgaccggttgcctgctggattacccctacatcgaggctctgtcctcagcgcttcaaatcttccttgcactgttcggatttgtcttcgcttgctacgtaagcaaggtgtttctggaagaggaggatagtttcgacttcattggaggtttcgatagctatggttatcaggcccctcagaagacatcacacctgcagctgcagcccctgtatacatcaggttag

SEQ ID NO: 231818 - DNA, 624 bp, Artificial Sequence
  Description of Artificial Sequence: Synthetic coding sequence
atgggtaaatgttctggtcggtgtacactggtggccttctgctgtctgcagctggtggctgccctcgaaagacagatatttgacttccttgggtaccagtgggcaccgattttggccaatttcctgcacataatggcagtgatattggggatttttggcactgtccagtatcgctccaggtaccttatactgtatgccgcatggttggtactctgggtgggttggaacgcctttattatatgtttttacctggaagtggggcagctgagccaggaccgcgatttcatcatgacttttaacacttctcttcaccgttcgtggtggatggaaaacggacccggatgcctggttaccccagtgctgaatagcagacttgctctggaggaccatcacgtgatcagcgtaacaggttgcctcttggattacccttatatcgaagccttgagctccgccctgcaaatttttctggccctgttcggtttcgtcttcgcctgttacgttagcaaagtgttcctggaagaggaggatagcttcgactttatcggaggctttgatagctatggatatcaggctccacagaagacctcccacctccagctgcagccgctgtacacaagcggctag

SEQ ID NO: 231819 - DNA, 411 bp, Artificial Sequence
  Description of Artificial Sequence: Synthetic coding sequence
atggcggttatcctgggaattttcgggactgtgcagtaccggagcaggtacctgatccttgaccgggacttcattatgaccttcaacacctctctgcaccgcagttggtggatggagaacggacccggatgcctggtgactcccgtgctcaacagccgtcttgccttggaggaccaccacgttatcagcgtcaccggctgcctacttgattacccatatattgaagccttgtctagcgctttgcaaatattcttagctctgtttggcttcgtctttgcatgctacgtctccaaggtgttcctggaggaggaggattctttcgatttcatcgggggttttgacagctacgggtaccaggccccacagaaaacaagccatctgcagctgcagcctttgtacacttcggggtag

SEQ ID NO: 231820 - DNA, 567 bp, Artificial Sequence
  Description of Artificial Sequence: Synthetic coding sequence
atgggttactgctctggacgttgtacgttaatcttcatttgcggcatgcagctagtatgtgttttggaaaggcaaatctttgatttcttgggctatcaatgggcccctatccttgccaactttgtgcacattatcatagtgattctaggactctttggaaccatccaataccgtccgagatacatcacagggtatgcagtgtggctggtactttgggtgacctggaatgtgttcgtgatatgtttctacctggaagccggtgacctgtccaaagagacagatctaatcctgacgtttaacatctccatgcatcgttcatggtggatggagaacggacctggctgtactgttacgtcggtcaccccggctcccgactgggcacccgaagatcatcgatacattactgtctctggatgtttactggagtaccagtatatcgaggtcgcacatagcagccttcaaattgttctggctgtaagcgtaggcagtcagccattgctgctcgtaccactgggccttttttacttttgtgctaactcggttcacacaaacggtatatgtggctag

SEQ ID NO: 231821 - DNA, 627 bp, Artificial Sequence
  Description of Artificial Sequence: Synthetic coding sequence
atgggctattgctctggacgctgcacccttatctttatctgtggcatgcagttggtgtgcgtgctggagcggcagatctttgacttcctgggataccaatgggccccaattctcgccaatttcgtccatattatcatcgtgatcttagggctgtttggaaccatacagtaccggccaagatacattaccggctacgccgtttggttggttttgtgggtcacttggaatgttttcgtcatttgcttctacctggaagcgggagaccttagtaaagaaacagacctcattttgacattcaacatatctatgcatagaagctggtggatggaaaatggtcccggatgtacagtcaccagtgttacccctgctccagactgggccccagaagaccatcggtatattacagtgtcagggtgtttgctggaataccaatacatcgaggtggctcactctagtctccagatcgtgctcgctcttgctgggtttatctacgcgtgttatgtcgtcaagtgcatcactgaggaggaggatagctttgacttcatcggcggattcgactcctatggataccaaggtccacagaagacctcccacctgcagttacaacccatgtacatgtccaagtag

SEQ ID NO: 231822 - DNA, 624 bp, Artificial Sequence
  Description of Artificial Sequence: Synthetic coding sequence
atgggtattataagattcttgctgctgtactgccccacaaatatacttaccgtctgtgtcctggagaggcagatcttcgattttttgggctatcagtgggcccctatcctggccaacttcgttcatatcatcatagtcatactggggctgtttggtaccatccagtacagaccaagatacatcactggctacgctgtgtggctggtcctgtgggtgacatggaatgtgtttgtcatttgtttctacttggaagctggggacttatctaaagagaccgacctcattcttactttcaacatttcaatgcacaggtcctggtggatggagaacggtccaggatgcaccgtcacgagcgttacaccagctccagactgggctcccgaggatcaccgctacattaccgtgagcggttgcttgcttgagtatcagtatatcgaggtagcacatagttcgctccaaatcgttttagctctcgccggttttatttacgcatgttacgtggtgaagtgtatcacagaggaggaggactcctttgactttattggcggattcgatagttacggctatcagggccctcaaaagacatctcacctgcagttacagcctatgtacatgagcaagtag

SEQ ID NO: 231823 - DNA, 576 bp, Artificial Sequence
  Description of Artificial Sequence: Synthetic coding sequence
atgaaaattgtgtgtgtgctcgaacgccagatctttgacttccttggatatcagtgggcgccaatcttggcgaacttcgttcatattatcatcgtcatacttgggctgttcggaaccatccagtacagaccccgatacatcacagggtatgccgtatggttagttttgtgggtgacatggaatgtgtttgtaatctgcttctatctggaagccggtgatttgagtaaagagacggacctgattttaacattcaacatcagtatgcacagatcttggtggatggagaatggccctgggtgcactgtcacatctgtcacccccgcacctgactgggcgccagaagatcacagatacataaccgttagtggctgtctcctggaatatcagtatattgaggtggcccactctagtctgcaaattgtgttagcacttgcaggatttatctatgcctgctatgtggtgaagtgtatcactgaggaggaggactcattcgatttcatcgggggatttgacagctacgggtatcaggggccacagaaaacaagccatctgcagctgcagccaatgtatatgtag

SEQ ID NO: 231824 - DNA, 420 bp, Artificial Sequence
  Description of Artificial Sequence: Synthetic coding sequence
atgggctactgctcgggccgatgtacccttatattcatctgtgggatgcagctggtctgcgtgctggagcgccagattttcgacttcctgggttaccagtgggctcccatcctggcaaacttcgtccatataattatagtgatcctaggcttgttcggaactatccaatacaggccacgatacatcacagggtacgcggtgtggctggtgctgtgggttacgtggaatgtgtttgtgatctgtttttacctggaggccggagacctgtcaaaactcgctggatttatctacgcgtgttatgtcgtgaagtgtataaccgaagaggaggattccttcgacttcatcggcggttttgattcctacggataccagggtccccaaaagacaagtcatttgcagctccagcccatgtacatgtag

SEQ ID NO: 231825 - DNA, 594 bp, Artificial Sequence
  Description of Artificial Sequence: Synthetic coding sequence
atgggatgttgcacagggagatgttcacttatatgcctctgcgcgctccagcttgtgagtgcactggaacgtcagattttcgattttctcggcttccagtgggctcctatcctgggcaattttctgcacattatcgtggtgattttgggccttttcggaaccatccaatataggcccagatatatcatggtgtacactgtgtggacagccctttgggtgacgtggaatgtgtttatcatctgcttttacttagaggtgggtggactgtctaaagatacagacttgatgacattcaatatctcggtgcatagatcttggtggagggagcacggaccaggatgcgtgagacgtgtcctgccccctagcgcccacggcatgatggacgactatacgtacgtatctgtaactggatgtatcgtggactttcaatatctggaagttatccactctgctgtacaaattctgctcagcctggtggggttcgtctatgcctgttatgtcatctcaattagtatggaggaagaggatacttacagctgcgatttgcaggtgtgtaaacacctattcattcaaatgctccagatcatagagtag

SEQ ID NO: 231826 - DNA, 594 bp, Artificial Sequence
  Description of Artificial Sequence: Synthetic coding sequence
atgggctgctgcacaggacgctgtagcttgatctgcctatgcgcactacagctggtatccgccctggagcgacaaatcttcgacttcctcggctttcagtgggcacctatactggggaacttcctgcatataattgtggtgatactcggcttgtttggcaccatccagtacagaccgcgatatattatggtctacaccgtctggacagcattgtgggtgacctggaatgtctttatcatctgcttttatttggaggtgggaggactgtcaaaagatacagaccttatgacctttaacatcagcgtccatcggtcctggtggcgtgaacatggccctgggtgcgttagacgagtgctccctccaagcgcccacgggatgatggacgactatacatacgtgtctgttacaggctgcatcgtggattttcaataccttgaagtcatccattcagctgtccaaatcttactgtccttagttggctttgtgtatgcttgttacgttatctccatctcaatggaagaagaggacacgtactcatgtgacctgcaagtgtgcaaacatctgtttatccagatgctccagatcatcgagtag

SEQ ID NO: 231827 - DNA, 486 bp, Artificial Sequence
  Description of Artificial Sequence: Synthetic coding sequence
atgggttgctgtaccggacgctgttctttgatatgtctgtgtgctttacagctggtaagctgggtgtttgaccgtcagatcttcctgctctcattccagtgggctccaatcctcggcaacttccttcacataatcgtggtgattctcggcctcttcgggacaattcagtaccgtccccgatacataatggtttatacagtttggaccgccctgtgggtgacctggaacgtttttattatttgtttctatctggaggtgggaggcttaagtaaggacactgacctgatgacatttaacataagtgtgcatcgatcatggtggagagaacacggacctggttgcgttcgccgtgtcttgccccctagcgcgcatggcatgatggatgactatacatacgtgtcagtcactggctgcattgttgacttccaatacctggaggtaattcacagcgccgtgcagattctcctgtccatattcttcctgtag

SEQ ID NO: 231828 - DNA, 627 bp, Artificial Sequence
  Description of Artificial Sequence: Synthetic coding sequence
atgggtagttgctcaggtcgatgcgctttggtagtgctctgcgcctttcagcttgtcgcggctctggagcgacaggtgttcgacttcctcggctatcagtgggcccctattttggccaatttcgttcatatcattatcgtcatcttgggactgttcgggaccatccagtatagacttcggtatgtcatggtgtataccttatgggccgctgtgtgggtgacatggaatgtatttataatttgcttctatctggaggtgggtggcttgttaaaagactctgagcttcttacatttagcctgtcgaggcaccgctcttggtggcgggaaaggtggcctggatgtcttcacgaggaggtccccgctgtgggcctaggcgcaccccacggccaagcccttgtatcaggagccggatgtgccctggagccctcatacgtggaggcgctacattcctgtcttcaaatattgatcgctctgctgggctttgtttgcggttgccaggtggtttccgtgtttaccgaagaggaggactcattcgatttcatagggggtttcgaccctttccccctgtatcatgtcaatgagaagccctccagtctgctgagtaaacaggtataccttccagcctag

SEQ ID NO: 231829 - DNA, 267 bp, Artificial Sequence
  Description of Artificial Sequence: Synthetic coding sequence
atggccgagtccagaggtcgattatatctgtggatgtgcctcgcagcagccctagcaagtttcctgatgggatttatggtgggttggttcataaaacctctgaaggagactactaccagtgtccgctaccatcagagcatacgctggaagctggtctcagagatgaaagctgagaacattaaatcttttctcagatcattcactaaactcccacacctggcagggactgagcagaattttctattagcaaaaaagatccagacttag

SEQ ID NO: 231830 - DNA, 2223 bp, Artificial Sequence
  Description of Artificial Sequence: Synthetic coding sequence
atggccgagtcacggggacgactgtatctttggatgtgtctggctgccgctctggcgagcttcctcatgggttttatggtaggatggttcattaaaccactaaaagagacaacaacttctgtgcgctaccatcagtccatccggtggaagcttgttagcgaaatgaaagccgagaatataaagagttttttgaggagttttaccaagctgcctcacctggctggaactgagcagaactttctgttagccaaaaagattcagacccagtggaaaaaatttggactagactcagcaaagctggttcattatgacgtgttactttcatatcccaacgagaccaacgccaattacatttctatcgtcgatgaacacgagactgagatcttcaagacctcatacctggaaccaccgcctgatgggtatgagaacgtgactaacatcgtgccaccttataacgcctttagtgcccagggaatgccggagggagaccttgtgtatgttaactatgcaaggactgaggatttctttaaactggaacgcgagatgggcatcaattgtacaggcaaaatcgtgatcgcaaggtacgggaaaatcttccgtggtaacaaggtcaagaatgcaatgctggccggagcaatcggaataatcctttactccgaccctgccgattatttcgcacctgaggttcagccctatcccaagggatggaatctgcccggaaccgccgctcagcgcggaaatgtcttgaatctgaatggagcaggggaccctctgacaccgggatatcccgcaaaagaatatacctttagactggacgtcgaggaaggcgttggcatcccccgtatccccgtccacccgatcgggtacaatgatgccgagattctcctacggtaccttggtgggattgcccctcctgataaatcctggaaaggagctctgaatgtaagctatagcatcggcccaggattcacaggctctgactcctttcgcaaagtgaggatgcacgtttacaatatcaacaaaataacgcgcatttataacgtcgtgggcaccattcggggttccgtcgagccagatcgctacgtgattctgggcggacacagggatagctgggttttcggggcaattgatcctactagcggggttgccgtcttgcaagagattgcgagatcttttggcaaactcatgtctaagggctggcgacctcgcagaacaatcatcttcgcttcctgggacgccgaggaattcggactgctgggatctacagaatgggcagaggagaatgtgaaaatcctgcaggagaggtcaatcgcctatattaattctgattcctccatagaaggtaactatacactgcgcgtggactgtacccccttactgtaccagttagtgtataagctaaccaaagagatcccatccccagacgatggattcgaaagcaaatcattatatgaatcttggctggagaaggacccctcaccagaaaacaagaatctgccacgcattaataaactgggcagcggttctgacttcgaggcttactttcagcgtctgggaattgcctctggccgagctaggtacacgaaaaacaagaagacagataaatacagcagttatcccgtgtatcacaccatctacgagacctttgaactagtagaaaaattttacgaccccacctttaaaaagcagctgagcgtagcccaattacgcggtgcactggtctacgagttggtcgactccaagattatcccttttaatatccaagactatgctgaggctttaaagaactacgccgcaagcatttataatctctctaagaagcacgatcagcaactgaccgatcacggtgtttccttcgattccttgttttctgccgtcaaaaacttctcggaagcagctagtgattttcacaaacggctgattcaggtcgacttaaataatccaatcgccgtgcgcatgatgaatgaccaactgatgctactggagcgagcctttatcgatcctctggggctgcccggtaaactgttctaccgacacatcatatttgccccttcgtcccacaacaaatatgccggtgaaagctttcccggaatttacgatgcgatttttgatatcgagaacaaagccaattcccgcctagcctggaaagaagttaaaaagcacatttccatcgcagcctttactattcaggctgccgcaggcactctgaaggaagtgctctag

SEQ ID NO: 231831 - DNA, 1635 bp, Artificial Sequence
  Description of Artificial Sequence: Synthetic coding sequence
atgcagtggacgaaagttttaggacttggcttgggagccgctgcccttctggggctgggcattatcctcggacatttcgccattcctaagaaagcaaactccctggcccctcaagatctggacctggagattctggaaaccgtcatgggacagttggacgcccaccggataagggaaaatttgcgagaactgtctcgggagcctcacttagcaagttcgcccagggacgaggatctcgtgcagttattactccagagatggaaagaccctgaatctggactggactcagccgaggcatccacatatgaggttctgctctcttttccgtcgcaggaacaaccaaatgtggtagacatcgtaggtccgaccggaggaatcattcatagttgccaccggaccgaggagaatgttaccggcgagcagggcggacctgatgtggtccaaccctatgccgcttacgcccctagcgggactccgcaggggctgctggtgtacgcaaacaggggagcggaggaggacttcaaggagctccagacccaggggataaagctggagggcaccatcgctctgactaggtatggcggagtcgggaggggcgctaaagccgttaacgcagcaaaacacggggtggccggagtgctcgtgtatacggaccccgctgatatcaatgatggtctgtcttcacccgatgaaacgtttccgaatagctggtatttacctccttctggtgtcgaaagaggatcttattacgagtacttcggcgatccactaacgccataccttcccgctgttccatcaagtttccgagtcgacctagccaacgtctcagggttccctcctatccctacccagcctatcggctttcaagatgctcgagacctgctgtgcaatctgaacggaaccctggccccagccacctggcagggcgctctggggtgccactatcgcctgggcccaggtttccggccagatggtgattttccagctgattcacaggtgaatgtcagtgtgtacaaccgtctggagctgcgcaactccagtaatgtacttggcataattaggggggctgtagagcctgatcgctacgtactatacggcaaccaccgggattcttgggtgcatggcgctgttgatccttcaagcggcaccgcggtgctcctggagctgagtcgggtgttgggaaccctgctgaaaaaaggcacctggcgaccccgaaggtcaatcgtgttcgcttcatggggtgccgaagaattcggattgattgggagcacggagtttactgaagagttttttaacaagctccaggagagaactgtggcatacatcaatgtggatatctcagtgttcgccaatgcaactttgagggtccagggaacaccccctgtgcagtcagtggtcttttccgcaacaaaagagattcggtcccccggaccgggagatctttctatttacgacaactggatcagatattttaataggtcatcgccggtgtatgggctggttccacgggcaagattgcagccgggaagtacccctccaacaacgcagcccctgacccctctaaccatgtggacttctttctggaccagggcctccgctgccattaggttgtggcctggccaaagaggggtgtag

SEQ ID NO: 231832 - DNA, 1569 bp, Artificial Sequence
  Description of Artificial Sequence: Synthetic coding sequence
atgcagtggaccaaagttttggggttgggcctgggcgctgctgctctcctgggactgggtatcatcctgggacatttcgccattcctaagaaagctaatagccttgcaccccaagatttggacttagaaatcctagagactgtgatggggcaacttgatgctcataggatacgggagaatctgcgggaattgagccgagaaccccatctggcgagctctcccagagatgaggacctggtgcagcttctcctccagcgctggaaagatccagaaagcggcctggacagcgccgaggcatctacatacgaggtcctgctatcctttcccagtcaggagcagccgaacgttgtcgacatcgtgggacccaccggtggaataatccatagctgtcataggacagaggaaaatgttacaggagaacagggaggccctgacgtcgtccaaccatacgctgcctatgccccttcaggtacccctcaaggcctactggtgtatgcgaaccgaggtgcagaggaggactttaaggagcttcaaacccagggcatcaagctggaaggcactatcgcgcttactaggtacgggggagtaggccgaggagcaaaagctgtgaacgcagccaagcacggagttgccggagttctggtctacaccgatccagcagatattaacgacggtttgtctagccccgacgaaacctttcctaattcatggtatcttcctccgtcgggagtggaaaggggatcatattacgaatatttcggagatccccttaccccatatttgcccgctgttccatcttcatttcgcgtcgatctggctaatgtgagcggcttccctcctattccgactcagccaattggtttccaggatgccagggatttactgtgtaatctgaatgggaccttggcccctgctacctggcagggcgctctcggctgtcactatcggctcggcccagggttcagaccggatggcgatttccctgccgatagccaggttaatgtgagcgtttacaatcggctggagctaaggaattcaagcaacgttttaggcatcatccgaggcgctgttgaaccggatcggtatgttttatatggaaaccatagggatagctgggttcacggggcagttgaccccagctcagggaccgctgtccttcttgagctgtccagagtgctcgggacccttcttaagaaaggcacatggagaccgaggcgttccattgtgttcgcatcatggggagctgaggagtttggcctgatcgggtctaccgagttcacagaggagttttttaacaaactccaagagcgcacggtcgcgtatatcaacgttgacatttctgtttttgcgaacgccacacttcgcgttcaggggactccaccggttcagtccgtggtattcagcgccactaaggagatcaggtcgcctggaccgggtgatctctcaatctatgacaactggatccgctacttcaaccgatctagccctgtctatgggttggtgccccgtctgcagcagccaagcggatgtggacccgactctggcgaatgcgattcccctgcccagtag

SEQ ID NO: 231833 - DNA, 2223 bp, Artificial Sequence
  Description of Artificial Sequence: Synthetic coding sequence
atgcagtggacaaaagtgctgggtttaggactgggggcagctgcgttgctgggcttgggtattatcctgggtcatttcgcaattcctaaaaaggccaactcccttgcccctcaggatctggacctcgagattctcgaaacggtcatgggccaactggacgcccataggatccgcgagaatctccgcgaactgagccgggaaccccacctagcttcatctcctcgagacgaagacctggtacagttgctgctacagcgctggaaggaccccgagtcaggcctagactcagctgaagcctcgacctacgaggttttactgtctttcccaagtcaagagcagccaaatgtcgttgacatcgtcggtccgactggtgggatcattcactcatgccaccgtactgaggagaatgtgacaggagagcagggaggtccagatgtagtccaaccgtacgccgcatacgcgccaagcggcaccccccaaggactcctggtttacgcgaacagaggtgctgaagaggattttaaggagttgcagacacaaggcatcaagttggagggcacgatcgccctgacccgctatgggggagttggacgcggtgccaaggccgtgaatgccgcaaaacacggggtagctggcgtactagtctatactgacccagctgacatcaatgacggcctttccagtcccgatgagacctttcccaattcctggtatctgcctccctccggagtagaacgaggctcttattacgagtattttggcgaccccctgacaccatatctgccagccgttccttcatccttccgagttgatttggctaacgtttcgggcttcccgcctatccccacacaacccattgggtttcaggatgcacgagatctgttatgtaatctgaatggaacactagcacccgctacttggcaaggagccctgggctgtcattatcggcttggaccaggattccgaccggatggcgattttccagctgactctcaagtgaacgtgtccgtgtataacaggttagaattgagaaattcatccaacgtgctggggataatcagaggagccgtggaacccgaccgctacgtgttgtatggcaaccaccgggattcatgggttcacggcgctgttgatccgtcgtccggtaccgccgtgctcctggagctctccagagtcctcgggactctcctcaaaaaggggacgtggagacctaggagaagcatagtcttcgcatcatggggcgctgaagagttcggactgatcggtagcacggagttcacagaggaattcttcaataagctgcaggagaggacggtcgcttatattaacgtggacattagcgtttttgctaatgcgacactgagggtgcagggcacacctccggtgcagtccgtggtgttcagtgccaccaaggaaattcgttctccaggacccggagatttgagtatttacgacaactggatcaggtactttaatcgtagcagccccgtatatggccttgtgcccagtctcggatccttaggtgccggatccgactacgctcctttcgtgcacttcctgggaatctccagcatggatatagcgtatacctatgacagaagcaagaccagcgcacggatctatcccacataccacaccgccttcgatacatttgactacgttgacaaattccttgaccccggattctccagccaccaggctgtggccaggaccgcagggagtgtcatcctgcggctgagcgactccttcttcctgccacttaaggtcagcgactatagtgaaacgctgcgcagctttctgcaggctgcacaacaggacctgggcgcactattagagcagcattcgatatctttagggcctttggtcaccgctgtcgagaagttcgaagcagaagctgcagccctcggccagcggatttctaccctccagaagggctcccctgacccccttcaggtgagaatgctgaatgaccagctcatgctgctggagaggacctttctcaaccctcgggcattcccggaagagaggtactactctcacgtgctgtgggcccctaggaccgggtccgttgttacttttccaggcttatccaatgcatgtagcagagctcgggacactgctagcggttctgaggcctgggcagaagtccagaggcagcttagcatcgtggtcacagcactcgagggggctgctgctactctcaggcctgttgcagacttatag

SEQ ID NO: 231834 - DNA, 2220 bp, Artificial Sequence
  Description of Artificial Sequence: Synthetic coding sequence
atgcagtggacgaaggtgctgggtctggggcttggcgcagcagcactactgggtctgggaatcatacttgggcatttcgcaattccgaaaaaggccaatagcctagccccacaggacctggacctggagatcctcgaaacggttatggggcaattggatgctcaccggattcgagagaatcttagagaacttagcagggaaccgcacttggccagtagtccacgggacgaagaccttgtgcagctgctgttgcaaaggtggaaggacccggaaagcggacttgattccgccgaagccagtacatacgaggtactgctttcctttccgtctcaggaacaacccaacgtggtggatatagtcgggccaacaggcggaatcattcatagctgtcatcgaaccgaggaaaatgtcacgggggagcaggggggacctgacgtggtccagccgtacgctgcatatgcacctagcggcacacctcagggactgctcgtatacgcgaacagaggtgctgaagaggattttaaggagttgcagactcagggcataaagctagagggcactatcgctctcacgcgttatgggggagtcggaaggggtgctaaggcggtcaacgcagctaagcatggtgtggctggggtgttagtttatacagacccagcggacattaacgacggactcagctctccagatgagacattccccaactcctggtatcttccccctagtggcgtagaacggggaagctattatgagtacttcggggatcccttaactccttacctgcctgctgtccctagcagctttagggtggacttagccaatgtgagcggttttcccccaatccccacgcagccaatcgggtttcaggacgctcgtgatctgctgtgtaaccttaacggtaccctggccccagccacgtggcagggagccttagggtgtcattatagactggggccaggattccggccagacggagactttcctgcagacagccaggttaatgtgtctgtgtacaaccgattagaactgcgcaatagcagcaacgtgctgggtattatcaggggggcagtcgaaccagatagatacgtgctgtatggaaaccatagggattcttgggttcatggagccgtggatccatcatccggaaccgctgtgctgctggaattatcccgtgtcctaggcaccctgctgaaaaagggtacatggaggccacgaagatctattgtgtttgcttcctggggagccgaagagttcggactaatcggcagcaccgagtttactgaagaattcttcaacaagctgcaggagagaaccgtggcgtacataaatgttgacatctctgtctttgctaatgccaccctgcgggtccagggcacaccgcctgtccagagcgtggtgtttagtgctactaaggagatcagatccccaggaccaggagacttgagtatttatgataattggatcaggtattttaaccggagctccccagtgtatggattggtcccctcccttgggtccctgggtgccggttccgactacgcccctttcgtgcactttctcggaatttcttcgatggatattgcttatacgtacgatcggagtaagacaagcgcaagaatctacccaacttaccacactgcgttcgacaccttcgactatgtggacaagtttctcgacccaggtttcagctcccaccaagccgtggcccgaaccgccggttcagttatactacggctgtcagatagtttttttctgccactgaaagtgtcagattatagtgagactctgagatcttttctccaagctgctcagcaagatctcggcgcactcctcgagcagcactccatatcattaggaccactcgtgaccgctgtggagaagttcgaagctgaggctgctgcgctgggacagaggattagcaccctgcaaaaagggtccccagatcccttacaggtccgcatgctaaacgaccagctgatgcttctggagcgaacctttctaaacccaagggcttttccagaagaacggtattatagccacgtgctgtgggccccaagaggcctcagaagccatatacccggattgagcaacgcatgtagtagagccagggacacagcatcagggtctgaggcctgggctgaggtgcaaagacagctgtcgatcgtagtgacggcactggaaggcgctgccgcaacactgaggccggttgctgatttatag

SEQ ID NO: 231835 - DNA, 405 bp, Artificial Sequence
  Description of Artificial Sequence: Synthetic coding sequence
atggagatctctaagaaaatcaaaacacagtggacatccctgggcctggaggatgtacagtttgtgaactactcagtgctgctcgacttgcctgggccaagtcctagcacagtgacactgagctccagtggccagtgtttccatccaaacggacaaccatgtagcgaggaggcccgaaaggatagctcccaggacctgttgtattcttacgctgcctacagcgctaagggcactctgaaggcagaagtcattgacgtctcctacggcatggcagatgatctgaagcgtattcgaaaaattaagaatgtcactaatcagatcgcactactgaaactgggtaaactgcctcttctgtacaagatgaaagtgctcgacaaagctgaccaaaccagtcctctgtattag

SEQ ID NO: 231836 - DNA, 2388 bp, Artificial Sequence
  Description of Artificial Sequence: Synthetic coding sequence
atgggggagaacgaggcgtcactacccaatacctctctacagggcaagaaaatggcttaccagaaagtccatgcagaccaacgcgctccgggtcattcgcagtatttggacaatgacgacttgcaggccacagcacttgacttggaatgggatatggagaaggagctggaagagtccggcttcgatcagttccagctggacggggctgagaaccaaaacctgggccattcagagactatcgacctgaacctggacagcattcagccagccacctctcccaaagggaggtttcagaggctgcaagaagagagtgactatatcactcactataccaggtcagcaccaaaatccaaccgatgcaacttctgtcatgtgttaaaaattctatgcactgccacgatcctcttcatcttcggcatcctaatcggctattacgtccatactaactgcccctccgacgccccttcatcaggaactgtcgatccccagttgtaccaggagatcctcaagacaattcaggccgaggatatcaagaagagcttccggaacctggtccaactatacaagaatgaggatgatatggagatcagcaagaagattaaaactcaatggacatccctcggactggaggacgtacagttcgttaactattccgtgttgctggacctgcctggcccatccccctcgacggtgactctgtcttctagtggtcagtgctttcaccctaacggacagccttgctcggaggaggctcgcaaggatagttcacaggacctgctttatagctacgctgcttatagcgccaaggggactttaaaagccgaggtgatagacgtgtcctacggaatggctgatgatcttaaacgtattagaaagattaagaatgtgactaaccagattgctctgttgaagctcggcaaactccccttgctgtataagctgagctcattggagaaggctgggtttggtggggtgctcctgtatattgacccttgcgatctcccaaagaccgtcaacccaagccacgacacattcatggtgtcccttaatcccggaggcgacccttctactcccggatatccctccgtggacgaaagcttccgccagagtcgatccaatctgacatcactcctcgtgcaacctatatccgccccactcgtggcaaagctcatttcaagcccgaaggctcggactaagaatgaggcttgctcaagtcttgaattgcctaacaacgagatccgagtagtctccatgcaggttcagactgtcactaagctgaagaccgtgacgaatgttgtgggtttcgtaatgggtctgactagccccgatcggtatataatcgtgggaagtcatcatcacactgcccactcatataatggacaggagtgggcatcgagtaccgcaattattactgcatttatccgagccttgatgtccaaagtgaagaggggctggcgcccagaccgcactatcgtgttttgcagctgggggggaactgcgttcggtaatatcggctcctacgaatggggcgaagacttcaaaaaagtccttcaaaagaacgtggtggcatatatctctctgcacagccctattcgtgggaatagtagtctgtacccagtggcttcgccttcgttgcagcagctggttgtggagaaaaacaacttcaattgtactcggagggcccaatgcccagagaccaatattagctccatacaaatccagggggatgcggactatttcatcaaccacctaggtgtgcctatagtgcaatttgcgtacgaagatattaaaaccctggaagggccatctttcctgtccgaggccaggttctccacacgtgctacaaagatagaggaaatggatcccagctttaacctgcatgaaaccattaccaagctctctggggaggtgatacttcagattgcgaacgagcccgtactcccattcaacgcccttgatatcgccctggaggtacagaataatctgaagggagaccaacctaacacccatcagctgctggcaatggccctccgactgagagaaagtgccgaactgttccaatcagacgagatgcgtcctgccaatgatcctaaggagagagctcctatcagaatccgtatgttgaatgatatcttgcaagatatggaaaaaagctttttagttaagcaggcaccccctggattttatcggaacatactgtaccacctggacgaaaaaacgtcaagattttctatcctcatcgaggcttgggagcattgtaagccgctggcgagtaacgagacgctgcaggaagccctgagcgaagtgctgaattctatcaatagcgctcaggtgtatttcaaagctgggctcgacgtgttcaagagcgtgctagatggcaagaattag

SEQ ID NO: 231837 - DNA, 1236 bp, Artificial Sequence
  Description of Artificial Sequence: Synthetic coding sequence
atgctcctcaagacagtccttctgctcggccatgttgcacaggtgttgatgcttgacaatgggctgctgcagactccgccaatgggatggctggcttgggagcgatttcggtgtaacatcaactgtgacgaagacccgaaaaattgcataagcgaacagttatttatggaaatggccgatagaatggctcaagatggctggagagatatgggatacacctacctgaatatcgatgactgttggataggcggaagggacgcatctggcagactcatgcctgatcctaagcggtttccgcacggcatccctttcctggctgactacgtccattcgctagggttaaaacttggtatttatgccgatatgggcaattttacttgcatgggctatccagggaccacgctggacaaagtcgttcaggacgcgcagaccttcgcagagtggaaggttgacatgctgaaattggacggctgcttctctactcccgaggaaagagctcaggggtatcccaaaatggccgctgcactcaacgcgacagggcgtccaatcgcgttttcatgctcctggcctgcatacgagggcggtttgcctcctcgggtgaattactctctccttgctgatatctgcaacctctggcgaaattatgacgatattcaggacagttggtggagcgtgcttagcatcttaaattggttcgtggagcaccaggacatcctgcaaccggtggcgggacctggccattggaacgaccctgatatgctgcttatcggaaatttcggcctttccctggaacaaagtcgggcacagatggcactgtggacagtgctggctgcaccactgctcatgtccaccgatctcagaacgatttctgcacagaacatggacattctgcagaacccactcatgatcaagattaatcaggatcccctaggaatccagggccgtaggatacacaaagaaaaaagcttaattgaagtttacatgagacccttatccaacaaggcctctgcacttgtgttcttctcctgcaggacagatatgccataccgataccactcttctctcggacagctgaattttactggtagcgtgatctacgaagcccaggatgtgtacagtggagatattatctccggactccgagacgagaccaacttcaccgtaatcatcaacccttccggagtggtgatgtggtatctgtaccccataaaaaaccttgagatgtctcagcagtag

SEQ ID NO: 231838 - DNA, 1236 bp, Artificial Sequence
  Description of Artificial Sequence: Synthetic coding sequence
atgctgcttaagacagtcctcttgttgggccacgtagcacaggtgctgatgctggataacggcctcttacagaccccccctatgggatggctcgcttgggagagattcagatgcaatatcaactgcgatgaagaccctaagaattgcatttcagagcagttattcatggagatggccgaccggatggctcaagatggctggagagacatgggctatacgtatctgaatatagatgactgctggatcgggggtagagacgcatcaggtcgcttgatgccggacccgaagcggttccctcatggaatcccgtttctggcagattatgttcactcactgggcttgaagctcggtatctatgctgacatggggaattttacttgcatgggctatcccggtaccactttggataaggtggtgcaggatgcgcagacctttgctgagtggaaagtcgacatgttgaaacttgatggatgcttctcgactccagaagagcgggcacagggctacccaaagatggctgccgcactaaacgcaacaggtcgaccgattgccttctcttgtagttggccagcatacgaaggagggctgcctccacgggtcaactacagcctgctggctgacatttgcaatctttggcgaaactacgacgatatccaagatagctggtggtcagtactgtcaatcctcaactggttcgtcgagcatcaggacatcctccagcctgtggcaggtcccggtcactggaacgacccggacatgctactgatcgggaattttggccttagcctcgagcaaagccgggcacaaatggccctgtggaccgtgctggctgctcctctcctgatgtctactgatctacgcacaatcagcgctcagaacatggacattctgcagaacccactgatgattaaaattaaccaggatccactgggcattcagggaaggcgtatccataaggagaagtcattgattgaggtgtacatgaggccattgagcaacaaagccagcgcacttgttttcttttcctgtagaaccgacatgccttatcgctatcacagttcactcggtcagctgaattttactggaagcgtgatttacgaagctcaagacgtgtactccggggacataatttccggccttagagatgagaccaatttcactgttattatcaacccctctggcgtggtgatgtggtatctttaccccataaagaatctggagatgtcccaacagtag

SEQ ID NO: 231839 - DNA, 1236 bp, Artificial Sequence
  Description of Artificial Sequence: Synthetic coding sequence
atgttgctgaaaaccgtgctactgctcggacacgttgctcaagtactgatgctcgataacggcctcctacagacacctcctatggggtggctagcctgggagcgtttcaggtgcaacattaattgtgacgaagatccaaagaattgcatctccgaacagctgttcatggaaatggccgacaggatggctcaagatggttggcgcgatatgggttacacttatcttaacatagatgactgctggattggcggacgtgacgcttctggtcgtctcatgccagatccaaagaggttcccgcatgggatcccctttctcgcagactatgtgcacagtctgggtcttaagctggggatctatgcagacatgggaaatttcacatgcatgggatacccgggaactaccctcgataaagtggtgcaagacgcgcagaccttcgctgaatggaaagtggatatgctgaaactggacgggtgtttctccacccctgaagagagggcccaagggtacccaaaaatggccgctgcactgaacgcaactggacggccaatcgcatttagctgcagttggccggcttatgagggtggacttccacctcgcgtgaattactcactgcttgcagacatctgcaatctgtggagaaactacgatgacattcaggacagctggtggagtgtgctgagcattttgaattggttcgtggaacaccaggatatactgcagccagtggcgggtcccggtcattggaacgacccagacatgctgctaataggaaatttcgggctgagtctcgagcaaagtcgcgctcagatggctttgtggacagtgctagccgctcctctgttgatgtctaccgacctccggacgatctctgctcagaacatggatatacttcaaaaccccttgatgatcaagatcaaccaagaccccttggggattcagggaagaagaatccacaaggaaaaaagtttgatcgaagtgtacatgcgaccactttcgaataaggcttctgccttggtgtttttttcttgtcggaccgatatgccataccgctatcactcttctctggggcagctgaactttaccggttctgtaatctacgaagcccaggacgtgtactccggcgacattatttctggccttcgggacgagactaatttcactgtgataatcaatccttctggagtggttatgtggtacctgtatccgatcaagaatcttgaaatgtcacagcagtag

SEQ ID NO: 231840 - DNA, 1035 bp, Artificial Sequence
  Description of Artificial Sequence: Synthetic coding sequence
atggctgcaatctacggaggggtagaaggcggtggcacaaggagtgaggtcttacttgtttctgaagacgggaagatactcgccgaagccgacggcctgtccacaaaccattggctaataggtaccgacaagtgcgtggagcgaatcaatgagatggtgaatagggcgaagaggaaggctggcgtcgatcccctcgttcccctgagaagcttgggactctcactatcgggtggagatcaagaggatgccggaaggatcctgatcgaggaactgcgagaccggttcccttatcttagcgaaagctatctgatcactacagacgctgctggttcaattgcaactgctacaccggacggcggagtcgtcttgatttcaggcacagggtccaactgtaggctgatcaacccagatggctcagaatctggctgcgggggatggggccacatgatgggagatgaagggagtgcctactggattgcccaccaagctgtgaagattgtgtttgacagcatagataatctggaagcagcccctcatgatattggatatgtgaagcaggcaatgttccactactttcaggtgcccgataggcttgggatcttgacacatctgtaccgggactttgacaaatgccgtttcgccggtttttgccgcaagatcgctgagggcgcacagcagggggaccctctttcccggtatattttccgcaaggctggagagatgctgggcagacacatcgtggctgtgctgccagagatcgatcccgttctgttccagggaaagatcggattgccaatcctgtgtgttggaagtgtttggaaatcctgggaactgctgaaagaggggttcctcctcgctctgacacagggtagggagatccaagcccagaatttctttagcagtttcactttgatgaaactgcgccattcatctgctcttggaggcgcttccctcggggcacggcacatcggccacctgttacctatggattatagcgcaaacgccatagccttctactcttacacatttagctag

SEQ ID NO: 231841 - DNA, 1173 bp, Artificial Sequence
  Description of Artificial Sequence: Synthetic coding sequence
atgcggaccagaaccggctcacagctcgctgcacgcgaggtgaccggatccggggcagtgcctagacagctggaaggtcgccgttgtcaggctggcagagacgctaacggagggacaagctccgacgggagctcctccatggcagcgatttatggaggcgttgagggtgggggtactaggtctgaagtgcttctggtatcggaggatggcaaaatcttggccgaagccgatggcttgagcacaaatcactggctgatcggcactgataaatgcgtcgaaaggatcaatgagatggtgaacagggctaaacgcaaggccggtgtggatcctcttgtgcccttgcgttccctgggcctgtccctgtctggtggtgatcaggaggacgcagggaggatcttgattgaggagctgagagatcgttttccctatctgtccgagtcatacttgattacaaccgatgcggctgggtcaatcgccacggccactccggacggaggcgtcgtcctgataagcggcaccggatccaattgccgactgatcaacccggatgggtccgaatccggttgtggaggatggggacacatgatgggggatgagggctcagcatattggatagcccatcaggcagttaagatcgtgttcgattccatcgataacttggaagcggctccacatgatataggatatgtgaagcaggccatgtttcattattttcaagtgccagatcgtctcggcatcctcacccatctctatcgggactttgataaatgcagatttgctggcttttgtaggaaaatcgcagagggtgcccaacagggggacccactgtcgcggtatatttttcgcaaggccggagagatgttaggcaggcacattgtcgcagtgttacctgaaattgaccccgtgctttttcagggaaaaattggcctgcctatcctctgcgtcggcagcgtatggaagtcatgggagctgcttaaggaagggttcctgctcgcgttgacacagggtcgcgagatccaggctcagaattttttttccagctttacgcttatgaaactgcgacacagctctgctctgggtggcgcatccctgggggcaagacacattggtcacctgctgcctatggactatagcgctaacgccattgctttctactcctacacattctcttag

SEQ ID NO: 231842 - DNA, 1548 bp, Artificial Sequence
  Description of Artificial Sequence: Synthetic coding sequence
atggccactagcacaggcagatggctgctacttcggctcgccttattcgggttcctgtgggaggccagtggcggtctcgacagtggagcatcccgcgacgacgatctgctactgccatacccaagggcgagagcacgtttgcctcgtgattgtacacgggtccgtgcaggcaaccgagaacatgaatcatggccccctccacccgctacccctggcgctggtggattggctgtcagaacatttgtaagtcacttcagggaccgggcagtggccggacacctaaccagagccgtggagcctctgagaacatttagcgttctggaaccaggtgggccaggcggatgcgctgctcgcagacgggctaccgtagaagagacagctagagccgcagactgccgagtagctcagaacggaggcttctttcgtatgaactcgggagaatgtctggggaatgtcgtctccgacgagcgtcgggtttcctcaagtggcggtctccagaatgcacagttcgggattcgaagggacggcactctggtgaccgggtacctgtccgaagaagaggtgctggataccgaaaatccctttgtgcagctgttgagtggtgtcgtgtggctcatccgcaacggtagtatttatatcaatgaaagtcaagccacggagtgcgacgaaacacaagaaaccgggtctttcagtaaatttgtgaacgttatttcagccagaaccgctataggccatgaccggaagggacagcttgttctcttccacgctgatgggcagaccgaacagcgaggaatcaacctctgggagatggccgaattcctgctcaaacaggacgttgtgaatgcgataaacctggatggaggaggctcagctaccttcgttctgaatggcaccctggcctcctatccctccgatcactgccaagataacatgtggaggtgccccagacaggtgtctactgtggtgtgcgttcacgagcccagatgccagcccccagactgtcatggtcacggaacctgcgtcgacgggcactgtcagtgtactgggcacttctggagaggtcctggctgcgatgagctggattgtggtcccagcaattgcagtcagcatggcctttgcactgaaactggatgtcgatgcgacgcgggttggactggctcaaattgttccgaagagtgtcccctagggtggcacggtcccggttgccagcggccttgcaagtgtgaacatcactgcccgtgtgaccctaaaactggcaactgttcagtctcccgggtcaagcagtgcctgcagccccctgaagcaaccctgcgggcaggcgaacttagcttctttacccgaaccgcttggttagcgcttacccttgcgctcgcctttttactgcttataagcaccgcagctaatctgtctctgcttttaagtcgcgcagagcggaaccggaggctgcatggtgactacgcctaccatcctctacaggaaatgaatggtgagcccctcgccgctgagaaagagcagcctggaggggctcataaccctttcaaagactag

SEQ ID NO: 231843 - DNA, 1446 bp, Artificial Sequence
  Description of Artificial Sequence: Synthetic coding sequence
atggcaacttctactggtcgatggctcctgctccggttggccctgtttggttttctctgggaggctagcgggggactcgattcaggtgctagccgcgatgacgatctgctgttaccataccccagagcccgagctcgcctgcccagggattgcacccgggtaagggcgggtaatagggagcatgaatcctggccacccccaccagccacacccggagccggaggcctggccgttaggacgtttgtatcacactttcgggaccgagctgtagcaggacacctgacacgggctgtagaaccactacgtacttttagcgtgttggaaccgggagggccaggaggatgtgcagctagaaggagggctacggtggaggagacagcgcgagccgctgattgtcgcgtggcccagaacggaggcttttttcggatgaacagcggtgagtgcctgggcaacgtggtgtctgacgagagaagggtgtcctcatccgggggtctgcaaaatgcccagttcggaattaggcgtgatggaacattggttaccggctatttatccgaggaggaggtattagatactgagaacccgtttgtgcagctgctcagcggcgtagtctggttgatccgcaacggcagtatttacattaacgaatctcaggccaccgagtgtgatgaaacgcaggaaactggaagcttctctaagttcgtaaatgtgatatccgcaaggactgctattggccacgaccggaagggtcagctggtacttttccacgcagatggacaaaccgagcagagagggatcaacctttgggagatggctgagtttcttctcaagcaggatgtggtaaatgccattaacttggacggcggaggctctgccactttcgtcttgaacggtacactggcttcctatcccagcgaccactgccaagacaatatgtggaggtgcccgcgacaggtgtcaactgtcgtgtgcgtccacgaaccaagatgtcagcctcccgactgtcacgggcacggtacctgtgtagacggtcattgtcagtgtactgggcatttctggcggggtccaggctgtgacgaactcgattgcggtccttccaattgctcccaacacggactatgcactgagaccggatgcaggtgcgacgccggatggacaggaagtaattgttccgaggtgaagcagtgcctccaacctcccgaagcgaccctgcgtgcgggtgagctatccttcttcactcggactgcgtggctagcccttactttggctctcgcttttttgctgctgatatctactgctgctaatctgagtctcctgctgtctcgagccgaaagaaaccgccgattgcatggggattacgcataccacccactccaggagatgaacggagagcctctggccgcagagaaagagcagcccggaggcgctcataacccctttaaagactag

SEQ ID NO: 231844 - DNA, 2514 bp, Artificial Sequence
  Description of Artificial Sequence: Synthetic coding sequence
atggctgagcctagtcaggctcccacccccgctcccgctgctcagccacgtcctctacagagccctgcgccagcgcctactcccacgccggcaccctctcccgcatcagctccaattcccacaccaacacctgctccagccccagcacctgccgctgcccctgcaggatccacaggcacaggcggacccggagtcgggtccggcggagcaggatccgggggagaccccgctaggcccggattgagccagcagcagagagcctcacagcggaaggcacaggtccgaggcctccctcgagctaaaaaattggagaaactgggcgtgttttcagcttgcaaggctaatgaaacctgtaaatgtaacggctggaaaaaccctaagcccccaaccgccccacgaatggatctgcagcagccagccgcaaacctctcggagctctgccgatcctgcgaacatcctctggccgatcacgtgagtcacctagagaacgtgagtgaagacgaaatcaatagattgctggggatggtggtcgatgtcgaaaacctttttatgtccgtgcacaaagaggaagacacggatactaagcaggtctacttttaccttttcaagctgcttcggaagtgtatcctgcagatgacccgcccagttgtggagggatctctagggagcccacctttcgagaaacccaacatcgagcagggggtgcttaacttcgtccagtacaagttttctcacctggcgcctcgggaacgccagaccatgtttgagctcagcaaaatgttcttgttatgcctcaattactggaaattagaaacacccgctcagtttagacagaggtctcaggctgaggacgtggctacatataaggtaaactataccagatggttgtgttactgccacgtgcctcagagctgcgatagtctccctcgctatgaaaccactcatgtattcggcagatcccttctccgctccatcttcacggtgaccaggcgccagttactggagaagttcagagtggagaaagacaagttggtacctgaaaagcggaccctgatcctgacgcatttcccaaagttcctgtctatgctagaagaggagatctatggggcaaacagcccaatttgggaatccggctttactatgcccccatccgaagggacccaactggtgcccagacctgcctcggtctcagcagccgtggttcctagcacccctatcttcagtcccagcatgggtggcggatccaactcctccctaagtttagattctgcaggcgctgaaccaatgcctggggaaaaaaggactctgcccgaaaacttgactctggaggacgctaaaaggctccgggtgatgggcgatattcccatggagttagtaaacgaggtcatgctgaccatcacggaccccgcagccatgcttgggccagaaacctccttattgtctgctaacgcggctcgagacgagaccgctcgcctggaggagaggcgtggcatcatcgagttccatgtaatcggcaattccctcactcccaaggctaaccgacgcgtcctgctctggttggtcgggttgcagaatgtattctcgcaccagttacctcggatgcccaaagagtacattgctaggctcgtgttcgatcctaaacacaaaacactggcgctcatcaaagatggtagggtcatcggcggaatctgcttcaggatgtttccgactcagggcttcaccgagatcgtgttttgcgcagtcacttccaatgagcaagtgaagggatacggcacccacctgatgaatcatttgaaggaatatcatatcaagcacaacatcttgtacttcctcacgtatgccgatgagtacgccattgggtattttaaaaagcaggggttctctaaggatataaaggtgcccaagagtagatacctaggttatattaaggattacgagggggctaccctcatggaatgtgaacttaatcccaggatcccctacaccgagctgagtcatattatcaaaaagcagaaggagattataaaaaagctaatcgagcgcaagcaagcacagatccggaaggtgtaccccggactgagctgtttcaaggagggggtcaggcagatacccgtcgagagcgtaccagggataagagaaacagggtggaagccgttgggtaaggagaagggtaaagaactgaaggatcccgatcaactatatactaccctcaagaatctcctcgcgcagatcaaatcccatcccagtgcctggcctttcatggaaccagttaaaaagagtgaagccccagactattatgaagttatacgttttcccattgacctgaaaaccatgacggagaggctgagaagtagatactatgtgactcggaaactttttgtagccgatctgcagcgcgtgatcgcgaactgtcgggagtacaatcccccagacagcgaatactgtcggtgcgccagtgcacttgaaaagtttttttattttaaactgaaggaggggggtctgatcgataagtag

SEQ ID NO: 231845 - DNA, 1260 bp, Artificial Sequence
  Description of Artificial Sequence: Synthetic coding sequence
ccacagtgctgcttgcacagtagaggtatgttccctaggctgtccccggtagatacggaggccgtctggttgctccagggttggctgttccagcaccagccccaattttggggaccggcacagattagagctgtcctgggcgctgtgccacgaggtcgactcctggtactggacctctttgccgagagccagccggtttacacccgcaccgcttcttttcaaggccagccttttatatggtgtatgctccacaactttggaggcaatcatggactatttggagccttagaagccgttaacggcggacctgaggcagcacgactgtttcccaactcgaccatggtggggaccggtatggccccagaaggaatcagccaaaacgaagtcgtgtatagtctgatggccgagcttgggtggcgcaaagatccggtgcctgatctcgctgcttgggttacttccttcgccgcacgaaggtatggtgtgagccaccccgacgccggtgccgcttggcgactgctgctgcgtagcgtttacaactgttcaggggaagcctgccggggacataataggagtccccttgtgagacgtccttccctgcagatgaacaccagcatttggtataatagaagtgatgtatttgaagcctggcgactgctcctgacgagcgcacctagcttggccacctccccggcttttaggtatgatctcctggatttgaccagacaggccgtgcaagagcttgtttccctttattacgaggaggccagatcagcatacctcagcaaggaactcgcctcactcttgagggccggtggagtgctggcttatgagttgctgccagccttggatgaagtcctggccagtgatagtcgttttttgctgggctcctggctggaacaggcgagggctgctgctgtgtccgaagccgaggctgacttctacgaacagaactctaggtatcagctaacgctgtgggggccagagggtaatatcctcgactacgcaaacaagcagcttgcaggactggtggcaaactattacacccctcgctggcgcttatttctggaggcattggtcgattccgtggctcagggaatcccttttcagcagcatcagttcgacaagaatgtattccagctcgaacaagctttcgtgctctcgaaacagagatacccttctcagccaaggggagacaccgtcgacctcgccaaaaaaatctttcttaaatattacccccgttgggtggcaggctcatggtag

SEQ ID NO: 231846 - DNA, 963 bp, Artificial Sequence
  Description of Artificial Sequence: Synthetic coding sequence
atggcttttccaaagaagaagttacagggcctggtggccgctacaattaccccaatgaccgaaaacggcgagatcaatttctcagtgatcggtcagtatgtggattacctcgttaaagagcagggcgtgaagaatattttcgttaatgggactaccggagagggcctgtctctttccgtgagtgagagacgtcaagttgccgaggaatgggtgacgaagggtaaggacaaactcgatcaagttatcattcacgtcggggcactttccttgaaagaaagccaggaactagcccaacatgcggcagaaatcggagccgacggaattgctgtcattgcgcctttctttctaaagccctggaccaaagacattttgattaacttcctaaaagaggtcgcggctgccgctcccgcattgcctttctattattatcacatacctgcgctgacgggggtgaagattcgggcagaagaactgctcgatgggatattggacaaaattcctaccttccagggcctaaagttttcggacaccgatctgctagactttggtcagtgcgtcgatcagaaccggcagcagcagttcgcctttctgtttggcgtggatgagcagctgttgagtgccctggttatgggagcaactggcgctgtcggtagtacctacaattacctcggaaagaagacaaaccagatgctggaagcatttgagcagaaggatttttccttggcgttaaattatcagttctgcatacagaggttcataaatttcgtcgttaagctcggcttcggggtttcacagaccaaagctattatgacgttggtgtctggcatcccgatggggccacccaggctgcctctgcaaaaagccagccgtgagttcactgactctgcagaggccaaactgaagagccttgattttctgagcttcactgatctaaaggatggaaaccttgaggcaggttcatag

SEQ ID NO: 231847 - DNA, 330 bp, Artificial Sequence
  Description of Artificial Sequence: Synthetic coding sequence
atggccttcccaaaaaagaagctccaggggttagttgccgcaactataaccccaatgactgagaacggcgaaataaacttcagtgtaattggccaatatgtggactacttggtcaaggagcagggtgttaaaaacatatttgtgaacggaactaccggcgaaggactctccttgagtgtgagcgaacgcaggcaggtggccgaggagtgggtcactaaagggaaggacaagagcaaccaccacaagctcggaacaattcgcactacacagtctcggagatcctcttttagacgccaattgaaggcgtggcatagcggatcccacctgtag

SEQ ID NO: 231848 - DNA, 558 bp, Artificial Sequence
  Description of Artificial Sequence: Synthetic coding sequence
atgagccgggcaccgggtatcctggcaagttggcggcgagcgccttctctgtcagtgcaaaagggatctcagaccgccaggcacacatgtcacccagaggtgcccttgggtaattgcttcctccctgtctacaaggcgagccccctgactgtgacgaggttatgggcagagcgactggaccaagtaattattcacgttggagccctctctcttaaagaaagccaggagctggcccagcatgccgcagagattggcgcagacggcattgcagtgatcgctccgttcttcttaaagccctggacaaaggacatcctcatcaatttcctcaaggaggtggctgcagccgctccagcactacctttctattactaccatatccctgcactgacaggcgtgaaaatcagagcggaggagttgttggatggtatactcgacaaaatccccacttttcagggactcaaattttcagatacagatctgttggactttggacagtgtgtggatcagaaccgccagcagcagtttgcgttcctgtttggtgtagacgagcacctttag

SEQ ID NO: 231849 - DNA, 723 bp, Artificial Sequence
  Description of Artificial Sequence: Synthetic coding sequence
atggcatttcccaagaagaagcttcaaggactggtcgccgcaaccattactcccatgacggaaaatggggagatcaattttagcgtcataggccagtatgtagactatctcgtcaaagaacagggagtaaaaaatattttcgtgaacggaaccactggagaaggactgagtctatcggtgagcgagcggaggcaggtcgctgaggagtgggtaaccaaggggaaggataaactcgaccaggttataatacacgtcggagccctgagcctgaaggagtcccaggaacttgctcagcacgcagctgagatcggagctgatggcatcgccgtaatcgccccatttttcctcaaaccctggacaaaggacatactgattaattttctcaaagaggtagctgcagctgccccagccttgcccttttactattatcatatccctgccttgacaggggtgaagatcagagcagaagagctgttggacgggatcctcgacaaaattcccacctttcaggggctgaagttctccgatactgacctcctcgacttcggccagtgtgtggatcagaacaggcaacagcagttcgcgttcctcttcggggtggatgaattctgtatccagaggtttattaattttgtggtgaaattggaaaattccaagctgaaagtgagcaaaaaccagagaacactgccattaggaacgactaatttcccgtttttgcattag

SEQ ID NO: 231850 - DNA, 963 bp, Artificial Sequence
  Description of Artificial Sequence: Synthetic coding sequence
atggcattccccaagaagaagctacagggcttggtggcggctacgataactcccatgaccgaaaatggcgagatcaatttcagcgtcatcggtcagtatgttgactacttggtgaaagagcaaggtgtcaagaacatcttcgtcaacggtacaaccggcgaggggcttagtctttctgtcagcgagagacgccaggtggccgaagagtgggtgaccaaggggaaagacaaattagaccaagtgatcatccatgtgggagccctgagtctcaaggaaagtcaagaattggctcagcatgccgctgagatcggagcggacggcatagctgtaattgccccattttttctgaagccctggacaaaggatattctcattaacttcctcaaagaggttgcagccgctgccccagcgctcccattctactactatcatatccctgccctgacaggcgtgaaaatccgcgctgaggagctcctggatggaatcttggacaagatacctactttccaggggctcaagttttctgatacggatctgttggacttcggacagtgcgtcgaccagaaccgccagcagcagttcgcgtttctgtttggggtggatgaacagctcctgagcgcgcttgttatgggtgctacgggagccgttggttccacttacaattacctgggcaaaaagacaaaccagatgctcgaggccttcgagcaaaaagatttctcattagcgctgaattatcaattttgcatccagagatttatcaactttgttgtcaagctgggatttggcgtctcccagacaaaagccatcatgaccctcgttagtggaatacctatggggcctcctcgtctcccgctgcaaaaagcgtcgagggaatttaccgacagcgctgaggcgaagctgaaatctctggactttctgtcttttaccgatctgaaggatggcaatctcgaggccggatcatag

SEQ ID NO: 231851 - DNA, 906 bp, Artificial Sequence
  Description of Artificial Sequence: Synthetic coding sequence
atgagtcgcgcaccaggaatcctggcgtcctggcgccgagccccaagcctcagtgtccagaagggctctcagactgcacgacacacttgtcatccagaagtgcccttagggaactgtttcctacctgtgtacaaagcctcaccgctcacagtgactcggctgtgggccgagaggctggaccaagttattatccatgtaggggctctctcattgaaagagagtcaggaactcgcccagcacgcagccgaaatcggtgcagatggcatcgctgtgatagcccctttcttcctgaagccttggacaaaagacatcttgattaactttttgaaagaagttgctgccgcagctcccgctctccctttttactactatcacatccctgccttgactggtgtgaaaatacgggctgaggaactgttagacgggatcttggacaagatccctactttccagggcttaaaattttctgacacagaccttttggattttggacaatgtgtagatcagaatcggcagcaacaattcgcattccttttcggggtcgatgagcagttgctgagtgccctagttatgggcgctactggggctgtgggcagcacctacaattacctgggcaagaaaacaaatcagatgctggaagcgttcgaacaaaaggatttcagcctggccttgaactaccagttctgcatccaaaggttcatcaacttcgtagtaaaactcgggttcggtgtgagccagaccaaggcgattatgactctggtgagtgggatacctatgggacctcctcggttgcccctgcagaaagcgtcccgggagttcaccgatagcgcggaggccaaactcaaatcactggacttcttgagtttcacagacttgaaagacggaaatcttgaggccggaagctag

SEQ ID NO: 231852 - DNA, 723 bp, Artificial Sequence
  Description of Artificial Sequence: Synthetic coding sequence
atggcttttccaaagaaaaaattgcaagggctggtagcagccacgatcactccgatgaccgagaatggggagattaatttctctgtcatcgggcagtatgtggactatttagttaaagagcagggggtgaagaacatcttcgttaacgggacaaccggagaggggctaagcctttctgtgtccgaaagacgccaagtagctgaagaatgggtgaccaagggtaaagacaagctagatcaggtgattatccatgtgggagcactttccttgaaagaaagccaggagcttgcccagcacgccgctgagatcggtgccgacggcatagccgtaattgcccctttcttcctcaagccctggacaaaggatatcctgatcaacttcctgaaggaagtagccgcagcagcacccgctctgccattctattactatcacattcctgccctgactggtgtaaagattcgcgctgaagaactgttagatggcatcctggataaaattcctactttccagggcctcaagtttagcgataccgatctgctagactttggccagtgcgtcgatcagaacagacagcagcagtttgcttttcttttcggggtagatgaattttgcatccagagatttataaactttgttgtcaaattggagaattcaaaactcaaggtgtccaaaaaccaacgaacacttccactgggaactacaaatttccccttcctccactag

SEQ ID NO: 231853 - DNA, 624 bp, Artificial Sequence
  Description of Artificial Sequence: Synthetic coding sequence
agagaaggtcaaaaaggcagccagacagccagacacacgtgccacccggaggtgcctctcggtaactgttttctacctgtgtacaaggcctcacctcttaccgttactaggctgtgggccgagcgattggaccaggttataatccacgttggtgccttgtcattgaaggaatctcaggagctggcacaacacgccgcagagataggtgccgacggcattgcggtcatagcccctttctttctcaagccctggacaaaggatatattgattaacttcctcaaggaggttgccgctgcggcacccgcattaccattttattattatcacatccctgccctcaccggagtgaaaactaccgtagaatgctccggagatggctcaaattggagttcaggccagttctgcatacagcgattcatcaattttgtggtgaaactgggctttggcgtctcacagactaaggccattatgacgcttgtgagtggcattccgatgggtccacccaggttgcctctgcagaaagcctcgagggagtttacggactctgcagaagctaagctcaaatctcttgatttcctttcattcacagacctcaaggacggcaatctggaggctggaagttag

SEQ ID NO: 231854 - DNA, 747 bp, Artificial Sequence
  Description of Artificial Sequence: Synthetic coding sequence
atgggactgagtagagttcgggcagtttttttcgacttggataatacactcattgacaccgctggagcctctcgacgtggtatgttagaagtgattaaactgttgcagtcgaagtaccactacaaggaggaggctgagataatttgtgataaggtccaagtcaaattgtccaaggagtgctttcacccctacaatacttgcattacagacctgagaacttcgcattgggaggaggcaatccaggagaccaagggaggggctgccaatcggaagttagccgaggagtgttacttcctctggaagtcaacgaggctccaacacatgactctcgccgaggatgttaaagctatgctaacggagctgcggaaggaggtgagattacttttgttgacgaacggggaccggcagacccagcgggagaagattgaggcttgcgcttgccagtcgtatttcgacgctgtagtggtcggaggagaacagcgcgaggagaagcctgccccatcaatcttctattattgttgtaacctcctgggagtccagccgggagactgcgtgatggtcggcgacactctcgagaccgatatccaggggggtctgaatgctggactgaaggcaacagtgtggattaataaaaatggaatcgtccctctgaagtccagcccagttccccattatatggtcagctcagtgcttgaactccctgctcttctgcagagcatcgactgcaaagtgagcatgagcacctag

SEQ ID NO: 231855 - DNA, 1515 bp, Artificial Sequence
  Description of Artificial Sequence: Synthetic coding sequence
atggctgcccaagcactggccctgcttcgggaggttgcacggctggaggctcccctcgaggaactgcgggctctacactcagttctgcaggccgttcctctcaatgagttgaggcagcaagccgcagagctcaggcttggaccactcttttccctgctgaacgagaaccaccgagagaaaactaccttatgtgtctctatcctggagagactgctgcaggccatggaaccagtccacgtcgcacgcaaccttcgagttgatttacagagaggtttgatccatcccgacgactcagttaaaatcctcaccttaagccagatcgggcgaattgttgagaacagcgatgcagtcactgagatactgaacaacgctgagctgctgaagcagatcgtctactgcattgggggagaaaacctgtctgttgctaaggccgcaatcaaaagtctctctaggatttccctcacacaggccggtctcgaggcccttttcgaaagtaacctgcttgacgatctcaaaagtgttatgaagacgaacgacattgttcggtaccgagtctacgagttgatcatcgagatatcctcagtgtctccagagtcactgaattattgtacaacatctggtttagtgactcagcttctgagagagcttaccggcgaagatgtgctggttagagcaacatgtattgagatggtgacctctctggcttacacacaccatggacgccaatacttagcccaggagggggtgatcgaccaaatttccaacattattgtgggtgctgacagcgatcccttctcgagcttttacctaccgggattcgtgaaattcttcgggaacttggctgtgatggatagcccgcagcagatttgtgagcgctacccaatcttcgtcgagaaagtatttgagatgattgaaagccaagacccaacaatgataggggtggccgttgatactgtgggaatactcgggtccaatgtggaggggaagcaggtgttgcagaaaaccgggactcgattcgagcgactgctgatgcgaatcggccaccaaagcaagaacgctcccgtggagctaaaaattagatgtctggacgcaatttcctctcttttgtatctgccacccgagcagcagacagatgacctcctccggatgacagagtcttggttcagttctttgtccagagaccccctggagctctttcgcggaatttccagtcagccctttcccgagctgcactgcgcagccttgaaagtctttaccgctatagctaatcagccctgggcccagaaactgatgttcaacagcccaggatttgtcgagtacgtcgtggacagatccgtggagcatgacaaagcatctaaagatgctaaatatgaacttgtaaaggcacttgccaactccaaaacaattgccgaaatcttcggcaacccaaattacctgcgcctgaggacctacctgagcgaaggtccttattacgtgaagcccgtgtccacgactgcggtcgagggtgcagaatag

SEQ ID NO: 231856 - DNA, 423 bp, Artificial Sequence
  Description of Artificial Sequence: Synthetic coding sequence
atggttcttgtgctagattattctgggagacccatggtgatcagtagcggaatgcaaagcatggacactatgaagcaagtgtatcagatcgtgaaaccactgaatcctaacttttgtttcctgcagtgcacctctgcataccctcttcagcccgaggacgtgaacctccgtgtcattagcgaatatcagaagctctttccagatattcccatcgggtactctggccatgaaaccggtatcgccatttccgttgcagcagttgcccttggcgctaaggtgttggagcggcacatcacactggacaagacctggaagggttccgaccatagcgcctcccttgagccgggagagctggctgagctcgtgaggtccgtcagactggttgagcgcgctttgggtagccctactaaacaactcttgtag

SEQ ID NO: 231857 - DNA, 348 bp, Artificial Sequence
  Description of Artificial Sequence: Synthetic coding sequence
gaagacgtgaacctgcgtgttatatcagagtaccaaaagctcttcccagacataccgataggctatagcggccatgagactggcattgccatttctgttgcagcggtggccctgggagcgaaggtgctagaacgccatattaccctggacaagacttggaagggatctgaccatagtgccagccttgagcctggcgagctcgcggaactagtgagaagtgtcagactcgttgaaagagccctgggaagccccacgaagcaactgctgccatgtgagatggcttgtaatgaaaaagtgtgcccggctggtttgtacagtgtactcctgccctgtgttgagaagggatag

SEQ ID NO: 231858 - DNA, 873 bp, Artificial Sequence
  Description of Artificial Sequence: Synthetic coding sequence
atggatattgaagcatatctggaacgaattggctacaagaagtcgagaaacaagctagatctggaaactctgaccgacatcttacagcatcagattagggcagtgcctttcgagaatctgaacatccactgcggggatgcaatggacttagggttggaggccatctttgatcaggtcgttcgacgaaataggggcggatggtgtctgcaagttaatcatctgctttattgggctttgacgaccattggctttgaaaccaccatgctcggtggttacgtttacagtacccccgctaagaaatactccacgggcatgatccacctacttttgcaggttactatagatgggcgtaactatatagttgatgcaggtttcggcaggtcctatcagatgtggcaacctttagagttgatcagcggcaaagaccagccgcaagttccttgcgtcttccggcttactgaggagaatggattttggtaccttgaccagatcaggagggagcaatatattcccaatgaagagttcctgcatagcgaccttctggaggactctaaatacaggaaaatctactcttttactctaaagccacgtactattgaggatttcgaatccatgaatacctacctgcagacatccccctcctcggtgttcacatcgaagtcattctgctccctgcagactcccgacggagtacattgcttggttggcttcactctgacacatcggagattcaattataaggataacaccgaccttatagagtttaagacacttagcgaggaggagatcgagaaagtcctcaaaaacatcttcaacatctccttgcaaagaaaactcgttccaaagcacggggataggttcttcacaatctag

SEQ ID NO: 231859 - DNA, 873 bp, Artificial Sequence
  Description of Artificial Sequence: Synthetic coding sequence
atggatatcgaggcctatctggagcgtatcgggtataagaagagtaggaataagctcgacctcgaaaccctgactgacatcttgcagcatcagattcgggctgttccttttgaaaacttaaacatccattgtggggatgccatggacctgggcctggaagcaatcttcgaccaagtcgtacggcgaaaccgaggcggttggtgtctgcaggtgaatcatctgctctactgggctcttactacaattggcttcgagaccactatgctggggggatacgtttatagtacaccagcgaagaagtactctactggaatgatccacctgcttctacaagtgaccattgacggtagaaactacatagtggatgctggatttggcaggtcctatcagatgtggcagcccttggagcttatttctggcaaagatcagccccaggtcccatgcgtttttcggctcacggaagagaatggcttctggtacctggaccagattagaagggagcagtacatccccaacgaggagtttttgcattccgacctgctggaagacagtaaatatcgcaaaatctactcctttacactgaaacctcggactatcgaggacttcgagtctatgaatacttacctccaaacctctccttctagcgtatttacaagtaaaagtttctgttccctacaaacgcctgacggcgtgcactgtctcgtgggattcacactgacacaccggaggttcaactacaaagacaataccgatttgatagagtttaagacgctgtcagaagaagaaatcgaaaaggtcctcaaaaatatcttcaacatctctctgcagcgcaaacttgttcctaagcatggagatcgcttctttacgatttag

SEQ ID NO: 231860 - DNA, 873 bp, Artificial Sequence
  Description of Artificial Sequence: Synthetic coding sequence
atggacattgaagcgtacctcgaacgtattggctataaaaagagccgtaataagttggacctggaaacccttacagacatcctgcagcaccagatacgtgccgtgcccttcgaaaatctcaatattcactgcggggacgcgatggatctaggactggaagctatattcgatcaggtggttcgacggaacagaggcggttggtgtcttcaagtcaatcacctcttatactgggcactcaccaccattggttttgaaaccacgatgctagggggttacgtttattcgacgcctgcaaaaaagtactctaccggcatgatacacctcttattacaggtgactattgacggcaggaattacatagtggacgccggattcggcagatcttatcaaatgtggcaacccctggagcttatttctggcaaggatcagccccaggtgccttgtgtctttcggctcaccgaagagaacggcttctggtacctggaccagattagacgggaacagtatataccaaacgaagaattcctccatagcgacttgctggaggacagtaagtataggaagatctacagtttcaccctgaaaccgaggacaattgaagatttcgagagcatgaatacctacttgcagacttccccctcaagcgtcttcacatctaagagtttttgttcattgcagacacctgacggggtgcattgtttggtagggttcaccttgacacaccgacgcttcaattacaaagataatactgacttgattgagtttaaaactttgagtgaggaggagatcgaaaaggtgctaaaaaacatctttaacattagcctccagcggaaactcgtgcctaagcatggtgaccgtttttttacaatctag

SEQ ID NO: 231861 - DNA, 873 bp, Artificial Sequence
  Description of Artificial Sequence: Synthetic coding sequence
atggacatcgaggcttatctggagcggattgggtacaagaaatccagaaataagctggatttggaaacattgactgacatccttcaacaccagatcagggctgtcccttttgagaatctcaatatacactgtggcgacgctatggatctcggactcgaagctatctttgaccaggttgtgcgcaggaaccggggaggatggtgtctccaggtcaaccacctgctgtattgggcattaaccaccattggcttcgagaccaccatgcttggcggatacgtgtacagcacgcccgcaaaaaaatatagtaccggcatgatacatttgttactacaagttaccatcgatggcaggaactatattgtcgacgcaggcttcggaagatcatatcagatgtggcaacctctggaattgatctccggcaaagatcagccacaggttccctgtgtgtttcgccttactgaagaaaacggattctggtacctcgaccagatcagacgggaacagtatatccccaatgaagagtttctgcattccgatttattggaagactccaaataccggaagatttactcttttacgctaaaacctcggactattgaggactttgaaagtatgaatacatacctgcagacctcaccgtccagtgtatttacctctaagtcgttctgctctctccaaacacccgacggcgtgcattgcctggtggggtttacactgacccacaggagatttaattacaaggataatactgatctaattgagttcaaaacactgagcgaagaagagattgaaaaagtgcttaaaaacatctttaatatttctctccagcggaaattggtgccgaaacacggtgatagatttttcaccatctag

SEQ ID NO: 231862 - DNA, 873 bp, Artificial Sequence
  Description of Artificial Sequence: Synthetic coding sequence
atggacattgaggcgtatctggaacgaatcggctacaaaaaatctcgcaacaagctcgacctggaaacgctgaccgacatccttcagcatcagattcgcgcagtgccgtttgaaaatttgaacattcattgtggtgacgccatggacctcggtctggaggcaatctttgaccaagtggtacggagaaatcgcggaggatggtgtctccaggtgaaccacctcctatactgggccctgacaaccattggattcgagacaaccatgctgggcggttatgtctattctactccagcgaaaaaatacagtaccggaatgatccacctgctcctacaggtaacgatcgatggcaggaattatatcgtggatgccggatttggcaggagctaccaaatgtggcaaccgctggaattgatttccgggaaggatcaaccccaagtgccatgtgtgttccgccttacagaggaaaatggtttctggtacctcgatcaaatccggagggagcaatacattccaaatgaggagtttttacattccgatctgttggaagactccaagtaccgtaaaatctatagctttaccctaaagccacgcactatcgaggattttgagtctatgaacacttatctgcagacctctccttccagcgtgttcacttctaaatccttctgctctttacagaccccagatggcgtgcattgcttagtggggtttactcttacccacaggagattcaattacaaggacaatacagacctcattgaattcaagacactgtccgaggaagagattgagaaggtcctgaagaatatcttcaacataagtctccagaggaagctcgtgccaaagcatggcgaccgtttctttaccatatag

SEQ ID NO: 231863 - DNA, 873 bp, Artificial Sequence
  Description of Artificial Sequence: Synthetic coding sequence
atggatatcgaggcctacctggagcgtattggctacaaaaagagcaggaacaagttggacctggaaactctcactgacatcctccagcaccagatcagagcagttcctttcgagaatttaaatatacattgcggtgacgctatggacctgggacttgaagccatttttgatcaggtggtgcgtcgaaaccgaggtggatggtgcctgcaggtaaatcacttgctgtactgggccctgactacaatcggattcgaaaccactatgttggggggatatgtctacagcacccccgctaaaaagtacagcacgggaatgattcacttgctattgcaggtcacgattgatggcaggaattatatagtcgacgctggcttcggaaggtcttaccagatgtggcagcccctggagctcatctctggcaaagaccaaccacaagtcccttgcgtttttcggctgacagaggaaaacgggttctggtacctggaccaaatccggcgtgagcaatacatccccaacgaagagtttttgcactcagacctcctcgaggactccaaatatcggaagatctattccttcaccctgaagcctcgcactatcgaagattttgagagcatgaacacttacttgcagacatctccctcatccgtctttacttctaaaagtttttgctcgttgcagaccccagacggcgtgcactgcttagtggggtttactctgacgcacaggcgatttaactacaaggacaacactgatcttatcgaattcaagacactaagcgaggaggagattgaaaaggtcttgaagaacatctttaacatctcactgcagaggaaactggtccctaagcacggtgaccgatttttcacgatttag

SEQ ID NO: 231864 - DNA, 873 bp, Artificial Sequence
  Description of Artificial Sequence: Synthetic coding sequence
atggacatagaggcataccttgagaggatcggatataagaaatcccggaacaagctggatttggaaacgctcaccgacatccttcagcaccagatccgggcagttccgttcgaaaatcttaacatccattgcggagacgccatggacctggggcttgaggccattttcgatcaggtcgtgcgacgcaataggggcggatggtgtttacaagtgaatcatctattgtactgggctctgaccacaataggctttgagacaacaatgttggggggatacgtatattccacaccagccaagaaatactctacgggcatgatccacctgctgcttcaggtgaccattgacggacgaaattacatcgtcgatgccggatttggacggtcttaccaaatgtggcagcctctggaactgatctctggtaaggaccagccccaggtaccatgtgtgtttcgccttactgaggagaacggcttttggtaccttgaccagatccgccgagagcagtatattccgaatgaggagttcctgcacagcgatctcctcgaggacagtaagtacaggaagatttacagctttacactgaaacccaggaccatcgaagattttgagtccatgaatacttatcttcaaacctccccatcatccgtttttaccagtaagagcttctgtagcctgcagacgccagacggggttcattgcttggtgggtttcactctgacccaccgaagattcaactataaagacaatactgatttgatcgaatttaagacactgagcgaggaggagatcgagaaagtgctcaagaacatcttcaacatcagcctccagaggaaactcgttccaaagcatggggatcgattcttcaccatatag

SEQ ID NO: 231865 - DNA, 1059 bp, Artificial Sequence
  Description of Artificial Sequence: Synthetic coding sequence
atgctccttctgctcctgcacaaggaggcagctctggagccacagggaccagctgtcgggtacaactcccttcccgtgagcgatgatcaccacgtgagcggcattcaggccagaaaaaaacagcagagtgtcttctggatcaagacggaagatcagcctaccttcaacctcttaagaaagggaattatggacatcgaagcttacctggagaggattggatacaaaaaatcgcgaaacaagctggacctcgagaccctcaccgacatccttcagcaccagattagagctgttccctttgaaaatcttaatatccattgtggcgacgccatggatctgggactcgaggcaattttcgaccaggtcgtgcgtcggaatagaggtggatggtgcctccaggttaatcatctgctttactgggctctgaccaccatcggctttgagaccactatgctcggaggatacgtctacagcactccagcaaaaaaatacagcaccggcatgattcacttactgcttcaggtaacaatcgacgggaggaattatatcgtagatgctggcttcggcaggtcttaccaaatgtggcagcctttagagctgatctcaggcaaggatcagccgcaggtaccatgcgtgttccgtctcaccgaagaaaacgggttctggtatctggaccagatacggagggaacagtatatccccaatgaagagttcctccattccgacctcttggaggactccaagtaccggaaaatttacagcttcactttaaagcccagaacaatcgaagacttcgaatcaatgaacacatatctacagacctctccaagcagcgtgtttacaagcaaaagtttctgctccctgcagactcctgacggggttcactgtctggtgggctttacattaacacacagacggtttaactataaggacaatactgacctgatagagtttaaaacactctccgaggaggaaatcgagaaggttcttaaaaatattttcaacatttccctgcagcggaagctagtcccgaagcatggtgatcgtttcttcactatctag

SEQ ID NO: 231866 - DNA, 873 bp, Artificial Sequence
  Description of Artificial Sequence: Synthetic coding sequence
atggacattgaggcttactttgagcgcattgggtataaaaattctagaaataagctcgacctcgagacgcttaccgacatccttgaacaccagatcagagccgtcccattcgaaaatctaaacatgcattgtggtcaggctatggagctcggcctagaagctatcttcgatcatatcgtgaggagaaatagggggggatggtgcctgcaggtgaatcagctgttgtactgggccttgacaactattggctttcagaccactatgctcggaggttacttttacatacctccagtaaacaaatatagtacgggaatggtgcatctcctactccaggtaaccatagacggaagaaattatatcgtggacgccggatctggatcgtccagtcaaatgtggcagcctcttgaactcataagtggcaaggaccagccccaggtgccatgtatcttctgccttactgaggaacgtggcatctggtacctcgatcaaattagacgtgagcaatacattaccaataaagaatttctgaattctcatttgctgccgaaaaaaaaacaccagaagatatacctgtttactctggaaccccgtaccatcgaggactttgagtcaatgaatacatatctgcagaccagccccactagtagctttataaccacgtcattttgctcattgcaaacccctgagggagtgtattgcttggtaggcttcatcctgacgtatcgtaaattcaactataaagacaataccgacctggttgagtttaaaacccttaccgaagaagaggtggaggaagttctgagaaacatttttaaaatatcccttgggcgtaatctcgtcccaaaacctggcgatggctcgctgaccatctag

SEQ ID NO: 231867 - DNA, 684 bp, Artificial Sequence
  Description of Artificial Sequence: Synthetic coding sequence
atggccccatgtcacataagaaagtatcaggagtccgatcgtcagtgggttgtcggcctgctctctcggggtatggccgagcatgcgccagctacattcaggcaactgctgaaactgccacgaacacttatcctgctcctcggtgggcctctggctctccttctcgtaagcgggtcctggctactcgccttggtgttctccattagcctgttccccgctctgtggttcctggctaagaagccctggactgagtacgtggacatgactttgtgtacagatatgtcagacattaccaaatcctacctgagcgaacggggatcctgtttttgggtcgccgagagcgaggagaaggttgtgggtatggtcggcgcacttccagtggacgatcctactctgcgcgagaagaggctgcaactgttccatttgttcgtggactcggaacatcgcaggcagggaattgcaaaggcgttagtgaggacagtgttacagttcgcacgagaccagggttactccgaagtgatccttgataccggcacaattcagctttccgcaatggccctgtaccaatccatgggattcaagaagacaggccaatccttcttctgcgtctgggcgcgattggtcgccctacacaccgtgcatttcatctatcacctacctagttctaaagttggatctctctag

SEQ ID NO: 231868 - DNA, 405 bp, Artificial Sequence
  Description of Artificial Sequence: Synthetic coding sequence
atggctgacattgagcagtattatatgaagccgccaggctcatgcttttgggtggccgttcttgacggcaatgttgtgggcatagtggccgcaagagcccatgaggaagacaacaccgtggagttgctcagaatgtctgtggattcccggtttcgagggaagggaatcgccaaagcactagggcgtaaagtgctcgagttcgctgtggtacataattattctgccgtcgttttgggaaccactgctgttaaggtggctgctcacaagctgtacgaaagcctgggtttccgccatatgggcgcaagtgatcattacgtcctccctggcatgacgctctctcttgccgagagactcttttttcaggtacgataccaccggtacaggctccagttgcgagaggaatag

SEQ ID NO: 231869 - DNA, 909 bp, Artificial Sequence
  Description of Artificial Sequence: Synthetic coding sequence
atgcattgcggccctcctgacatggtttgtgagacaaagattgtagcggcagaagatcacgaggccctgccaggagctaaaaaagacgctctgctagcagcggctggcgcaatgtggcctcccttgcccgcagcaccaggccctgcggctgcgccacccgcaccgcctccagcaccagtggcccagcctcatggcggtgctggcggtgccggtccccctggcggaagaggggtgtgcatccgtgagtttcgagctgctgagcaggaggccgctagaagaatcttttacgatgggatcatggaaagaatccccaatacggctttccgtggactgcgacaacatccacgggctcaactcttgtacgccttgcttgctgcactgtgttttgcagtgagtagatcgctcctccttacatgtttggttccagccgctttgttgggactgagatattattactcacgaaaggtgatccgcgcttatcttgaatgcgctttgcacactgacatggccgacatcgagcagtactacatgaaaccgccaggaagttgcttttgggtggccgtgctggatggaaatgtggttggtatcgtcgcagcacgcgctcatgaggaagacaacaccgtcgagctactccggatgagtgttgattctaggtttcggggaaagggcatcgcgaaagcactcggaaggaaggtgctcgagtttgcagtcgtacacaactactcggcagtggtgctagggacaacagcagtcaaagtggcagcccacaaactttatgaatccctgggttttcgtcacatgggagcttcagatcactatgtgctccccggtatgaccctgtcccttgccgaacgcctgttttttcaggtaaggtatcatagatatcgattgcaattaagggaagagtag

SEQ ID NO: 231870 - DNA, 1182 bp, Artificial Sequence
  Description of Artificial Sequence: Synthetic coding sequence
atggacgaaaacgaatccaaccaaagcctgatgactagcagccagtaccccaaagaagctgtgcgtaaacgccagaatagtgctcgaaactccggtgcatcggattcttcaagattcagtcggaaaagcttcaaattagactatagactggaagaagacgtcacaaaaagcaaaaaggggaaggatggcagattcgtgaatccctggccaacatggaaaaacccttcaattcctaacgttctgaggtggctgattatggaaaaggatcactccagtgttccttccagcaaggaagagctggacaaagagcttccagtgctcaagccctactttatcaccaacccagaggaggcgggtgttagagaggccggtctgcgcgtgacttggcttggacacgcgactgtgatggtggaaatggatgaactcatatttctgactgacccaatctttagctcccgcgcttcacctagtcagtacatgggcccaaagagattcaggaggagcccgtgcaccatctctgagttaccccctatcgacgcagtgcttatttcccataatcattatgatcacctggattataattctgttatcgccctgaatgaacggttcggtaatgagcttcggtggttcgtaccactgggcctcctcgactggatgcagaagtgtggatgcgaaaacgtcatcgaactcgactggtgggaagagaattgcgtgccagggcatgacaaagtaaccttcgtgttcacaccttcccaacattggtgtaagaggaccctcatggatgataacaaagtcttgtggggcagttggagcgtactgggtccatggaaccggtttttttttgccggtgacactggctattgtccagcatttgaagagattggaaaacggttcgggccattcgatctggctgccatccccatcggtgcctatgagccaagatggttcatgaaataccagcatgtggaccccgaggaggccgtgcggatacacactgacgttcagaccaaaaagtctatggccattcactgggggactttcgcactggctaatgagcactaccttgaaccgcctgtcaagcttaacgaggcattggagcgatatgggctgaatgccgaggatttctttgttctgaagcacggagaaagccgatacttgaacaacgacgatgaaaatttctag

SEQ ID NO: 231871 - DNA, 375 bp, Artificial Sequence
  Description of Artificial Sequence: Synthetic coding sequence
atggacgaaaacgagagcaatcagtctctcatgacgtcctcccaatatccaaaggaggcagtaaggaagaggcagaacagcgcccgtaacagtggagccagcgatagtagcagattctctcgcaagtcatttaagctagactacaggttggaggaagacgtcaccaagagcaagaaaggcaaagatggacgattcgtaaatccatggcctacatggaagaacccctccattcccaatgtgctacgctggctgattatggaaaaggaccattcgtctgtcccttccagcaaggaagaacttgacaaagagctccctgtcctcaagccatactttattactaatccagaggaggctggcgtgagagaagcaggatag

SEQ ID NO: 231872 - DNA, 1182 bp, Artificial Sequence
  Description of Artificial Sequence: Synthetic coding sequence
atggacgagaatgagtcaaatcagtctctcatgacgtcaagtcaataccccaaggaggccgtgcgcaagaggcaaaactctgcacggaactccggggcaagtgacagttctagattttcccgtaaatcttttaagctcgattaccgcttagaagaagatgtcacaaagagcaagaaaggcaaggacgggagattcgttaatccatggccaacatggaaaaatcccagcatcccaaacgtgttgcggtggctcatcatggagaaagaccacagctcagtcccatcaagtaaagaagagctggataaggaactgccagttctgaagccgtattttatcaccaaccccgaggaggccggagtaagagaggcgggtctgagagtcacctggcttggtcatgctaccgtgatggtcgagatggatgagttgatcttcctcacagatcctatcttttcgtcccgcgcttctccttcccagtacatgggacctaaacgtttccgtcggagtccatgtacaatatcagaacttcctcccattgatgccgtgctgattagtcataaccactatgatcatctggactataatagtgtcattgccctcaacgaaagattcggaaacgagttgaggtggttcgtccccctcggcctgcttgactggatgcagaagtgtggctgtgaaaatgtgatcgaactggactggtgggaagagaattgcgtgccgggtcatgacaaagtcacattcgtctttacgcctagtcagcactggtgtaagagaaccctcatggatgataacaaggtattgtggggatcctggtctgttctcgggccttggaatcggttttttttcgccggtgacaccgggtactgtcccgctttcgaggaaatcgggaaacgattcggtcccttcgatctggccgcaatccccataggcgcttacgaaccacggtggttcatgaaatatcagcatgtggaccccgaggaagccgtgcgtatccacacagatgtccagacaaagaaatctatggccatacattggggtacctttgcattggctaacgagcactatctagaacccccagtgaagcttaacgaagcccttgagagatacggcctgaatgctgaggactttttcgttctaaaacacggcgaatcaaggtacctaaataacgacgatgagaatttttag

SEQ ID NO: 231873 - DNA, 18 bp, Artificial Sequence
  Description of Artificial Sequence: Synthetic coding sequence
atggacgagaacgagtag

SEQ ID NO: 231874 - DNA, 1182 bp, Artificial Sequence
  Description of Artificial Sequence: Synthetic coding sequence
atggacgagaatgagagcaaccaatcccttatgacgagtagccaatacccgaaggaggccgtccgcaagaggcaaaactccgccaggaactccggagcgtctgattcatcacgattctccaggaagtccttcaagctagattaccgactggaagaagatgtaactaagtcaaaaaagggcaaggatggtaggttcgtcaatccatggccaacctggaaaaacccaagtatcccaaacgttttgaggtggctgatcatggagaaagaccattcttccgtgccttctagcaaggaggagctagataaggagctcccggtgctcaaaccctacttcatcacaaacccagaggaggctggagtgcgggaggccggtctgagggtcacctggcttgggcatgccacggtaatggtagaaatggacgaactcattttcctgacagaccctattttttcatcccgagcctcaccctcacagtacatggggccaaaacggtttagaagatcaccctgcaccatctctgagctgcctcccatcgacgccgtactgatatcacacaatcattacgatcatctcgattacaatagcgtgatcgcacttaatgagagattcggcaatgagctccggtggtttgttcctctggggctgctcgattggatgcagaaatgtggctgcgaaaacgtgattgaactcgattggtgggaggagaactgcgtgcccggacacgataaagtgactttcgtgttcactccttctcagcactggtgcaaacgtacgcttatggatgataataaagtactttggggctcttggagtgtgcttggaccatggaatagattcttctttgccggagataccggttactgtcccgcatttgaggagatcggaaagagattcgggccttttgacctcgctgcaatcccaataggcgcatacgaacccaggtggttcatgaagtaccaacacgttgacccagaagaagcagtgcgaattcatacggatgttcagactaagaaaagcatggccatccattggggtacgttcgctctcgctaatgaacattatcttgagccccctgttaagctcaacgaggcactcgagcgctacggcctgaacgccgaggacttcttcgttctaaagcacggagagagccgttatcttaacaatgacgacgagaacttctag

SEQ ID NO: 231875 - DNA, 1401 bp, Artificial Sequence
  Description of Artificial Sequence: Synthetic coding sequence
atggcacgtcggagggagctgaagcggtgtttgcagctgctggccagttctgctgagccggctcgcagggccagagtgcgaaagaaccctagtgcgtgtagaggaaggccctcacggtatgcggctgcgctatgcgcaggcacgctgtggcccgaggccgctgagctgcgaaggcgagccctgccagcaacacctagcgcctcgtcctctccaaaagacatggacgagaacgaaagtaaccaatcgctcatgacaagctctcagtaccctaaagaagcagttcggaagcgacagaacagtgcccgaaatagcggggcaagcgatagctcgcgttttagtaggaagtccttcaagcttgattatagactcgaagaggatgtgacaaagagcaaaaaaggaaaggatggacgctttgtgaacccttggcctacttggaaaaaccctagtattcctaatgtcttgaggtggctgatcatggagaaggatcattcaagcgtgccatcgagcaaagaagagctggataaagaactgccagtccttaagccatacttcattaccaaccccgaggaagcaggcgttagggaggcaggtctacgcgtgacgtggctggggcacgccactgtgatggtcgagatggatgaactgatatttctgacagatcctatcttctcatcgcgggcaagtcccagtcagtacatgggacccaagcggtttaggcgcagcccctgcacaatttcagaactcccccctatagacgccgtgctgatttcacataaccactatgatcaccttgactataacagcgtgattgcactgaatgaaaggttcggaaatgaactccgttggttcgtccctctgggcctcctggactggatgcaaaagtgcggctgtgaaaacgtcatcgaactagactggtgggaggagaattgtgtcccaggacatgacaaggtcacatttgtgtttaccccctcacaacactggtgcaaaaggactctgatggacgataacaaggtcctgtggggcagctggtctgtcctaggtccatggaatcggtttttcttcgcaggtgacacgggttattgtcccgcttttgaagagattggcaagcgatttgggcctttcgacctggctgccattcccatcggtgcttatgaaccaagatggtttatgaaataccagcatgtggaccccgaagaggcagtccgtatccatacggacgttcagactaagaagtcaatggctatccattgggggacatttgccctggcaaacgaacattacctggaacctcctgtgaaattgaatgaggcactcgagaggtatgggctgaacgcagaggacttctttgtgctgaaacacggagaatctcgctatctgaataacgacgatgagaacttctag

SEQ ID NO: 231876 - DNA, 1182 bp, Artificial Sequence
  Description of Artificial Sequence: Synthetic coding sequence
atggacgagaacgagtccaatcaaagcctgatgacttcgagtcagtatcctaaggaagctgtgaggaagagacagaactccgcacgaaactcaggcgctagcgacagcagcaggttttcacgcaagtcctttaagttagactacaggctggaggaagacgtcacaaagtctaaaaaaggcaaggacggcaggttcgtaaacccctggcctacctggaagaatccctccataccaaatgtgctgcggtggctgatcatggagaaggaccacagctctgttccgtcttctaaggaggagctggacaaagagctgcccgtgctcaaaccctacttcattaccaatcccgaagaagctggcgtccgcgaagcaggattaagagtcacctggttggggcacgctaccgtgatggtggaaatggacgaattgatcttcctcacagatcctatcttctcaagtcgtgcatccccttcccagtacatgggcccaaaaagatttagacggtcaccgtgtacaatcagcgaacttccgcctatcgacgcggtgctgatcagccacaaccattacgaccatctggactataattccgttatcgcacttaatgagcgtttcggtaacgagctacgatggtttgtgccattaggcctgctggactggatgcagaagtgtggctgcgagaacgtgattgagctggactggtgggaagagaactgcgttcctggacatgataaagtgacgttcgtatttaccccctcccagcactggtgcaaacgcacacttatggacgataacaaagttttgtgggggtcttggtccgtgctgggcccatggaacagattcttcttcgctggtgacacaggatactgcccagccttcgaagagattggtaagaggttcggacccttcgatttggccgctataccgataggcgcatatgagccacgctggttcatgaaatatcagcacgttgacccagaggaggccgtgaggatacacaccgatgtgcagaccaaaaagagcatggcaatccactggggtacatttgccctggcaaatgagcactaccttgagccgcctgtaaaactgaacgaagccctcgagcgctacgggctcaatgctgaggattttttcgtcctgaagcacggagaaagtagatatcttaataacgacgacgaaaacttttag

SEQ ID NO: 231877 - DNA, 2199 bp, Artificial Sequence
  Description of Artificial Sequence: Synthetic coding sequence
atggagcgccaggtgctcttatccgagcccgaggaggctgctgctctgtaccgcggtctctctaggcagccagctctgtcagccgcttgcctgggacccgaagtaaccacacaatacggcggacagtaccgtaccgtccatactgagtggacacagagagatttggaacgtatggagaacataaggttttgtcgacagtatttggtgttccatgacggagacagtgtggtattcgccggtcccgcaggcaattccgtcgaaacgcggggtgaacttctgagcagagagtcccctagcggaaccatgaaggctgtgctgagaaaagctggtgggacagggcctggtgaagagaagcagtttctggaagtttgggagaagaatcgcaaactcaaaagtttcaatctgtctgcgctggaaaaacatggacccgtctacgaggatgactgctttgggtgtcttagttggagccacagcgagactcatctgttgtatgtagccgagaaaaaacgcccaaaagccgagtcgtttttccagaccaaagcgttggatgttagtgcaagcgacgacgaaattgctcgccttaaaaaacctgaccaggcaattaagggcgaccagttcgtcttctacgaagattggggcgagaacatggtttctaaatctatccctgtgttgtgcgtcctcgacgtggagagcggcaacatttccgtgttggaaggtgtcccagaaaacgttagtcctggccaagccttttgggcacctggtgacgccggagtggtgtttgtcggctggtggcatgagccctttagacttggtataaggttctgtacaaatcggcgtagtgccctatactacgtggaccttatagggggtaaatgcgaactactgtctgacgactccctggcagtatccagccctcggctctctcctgaccaatgtagaatcgtttatctccagtacccttctctgatcccccaccatcagtgctctcagctctgtctctatgattggtacactaaggtgacctccgtcgtggtggacgtggtgcccaggcagcttggggaaaatttttccggaatttactgtagcctcctgccactaggatgctggtccgccgattcacaaagggtcgtattcgattccgcgcagagatctcgccaggatctgttcgccgtggatacacaagtcggaaccgtgacctctctgaccgctggcggtagtggtggaagctggaagctgctgacaatcgaccaagatctgatggtcgcccagttttccacccctagccttcctccaactctcaaggttggctttttgccttccgctggcaaggaacagagcgtgttatgggtttctttggaggaagctgagccaattcctgatattcactggggaatccgcgtgctgcagccccctccggagcaggagaacgtgcagtatgcaggccttgacttcgaagccattttgcttcaacctggctctcctccggataaaacacaggtgcctatggtggtgatgccccacggcggtccgcactcgagctttgtcaccgcatggatgctgttcccggcaatgctgtgtaagatgggcttcgcggtgctgctcgtcaactatcggggttctaccggcttcggccaggactccatactgagtcttcccggtaatgtcggccaccaggacgttaaagatgtacaatttgcggtggaacaggtgctgcaggaggagcactttgatgcgtcacacgtcgccctgatggggggatcccacggagggttcatatcctgtcatcttattggtcaatatcctgagacctatagggcctgtgtggcaaggaacccagtgatcaatatcgcctccatgctaggctctactgacatccctgactggtgcgtggtggaggccggattccctttttcttctgattgcttacctgatctgtcagtatgggccgaaatgctcgacaaatcaccaattcgatacattcctcaagtgaagacaccgctcttactgatgctgggacaggaggatagaagagtaccattcaaacagggaatggagtattatcgggctctgaaaacccggaatgtcccagtgaggctcctgctgtaccctaagtccacccacgccctgtcagaggtggaggtcgaatccgattcattcatgaacgccgtgctgtggctacgaacacacctcggttcgtag

SEQ ID NO: 231878 - DNA, 1833 bp, Artificial Sequence
  Description of Artificial Sequence: Synthetic coding sequence
gtgctgaatcgcttacagagcaagtatggctctctgtacaggagagataacgttatcctctccggaacgcacacccactctggcccagccggttattttcagtatacggtatttgttattgccagcgaagggttcagtaaccaaacgttccagcacatggtgacaggcattctgaagagtatcgatatagcccacactaatatgaaacccggaaaaatcttcataaacaaagggaatgtggatggggtgcagatcaatcgtagcccgtacagctacctgcagaaccctcagtctgagcgcgctagatatagctctaacactgataaggagatgatcgtcctgaagatggtcgacctgaatggcgacgatttgggtttaatttcctggttcgcaatccaccctgtgagcatgaataactctaatcatctggtcaatagtgataacgtgggctacgcctcttacctgcttgaacaggagaagaacaaaggatatctccccggacaaggcccattcgtggcagcctttagctcttcaaacctgggagatgtgtcaccaaacatcctcgggccacggtgtatcaacacaggcgagtcttgtgataatgctaattcaacgtgccccatagggggaccctctatgtgtatcgcaaagggacccggacaagatatgttcgattccacccagatcatcggtcgagctatgtaccagcgagccaaagagttgtacgcttcagccagccaggaagtgacagggccactggcttctgcccaccaatgggtggacatgactgacgtcaccgtgtggctgaattccacacatgcttcgaagacctgcaaaccagcactggggtactcatttgcagctggaacaatcgacggcgtggggggtcttaattttacgcagggcaagaccgaaggtgatccattctgggatacgatcagggaccagatattagggaagccgagcgaggaaatcaaagagtgtcataagccgaagcctatcctcctgcacacgggagagttaagtaagccccatccctggcacccagacatcgttgatgtgcagataatcaccttgggcagtctggctataactgccatcccaggagagtttaccaccatgagtggtagacggctgagggaggccgttcaagccgaatttgctagtcacgggatgcaaaacatgacagtcgttatctccgggctgtgtaatgtgtacacacattatataaccacatacgaggagtaccaggcacaaaggtacgaggcagcatctactatctacgggccacataccttgtccgcctacatacagttgttcagaaatctcgcaaaggcaattgccaccgacacagtggcaaacttgagccgcggacccgaacctcccttttttaagcaactcattgtgcccctgattccttctatcgttgacagggctcccaagggcagaaccttcggcgacgtcctgcagccggcaaaacccgaatacagagtcggtgaagttgccgaagtaatatttgtgggcgctaatcctaaaaacagcgtgcagaaccaaaatcatcagaccttccttactgtggagaagtatgaagcaactagcacatcctggcaaatcgtgtgcaacgatgccagttgggagaccagattctactggcataagggtctcttgggcctcagcaatgccaccgtggagtggcacatcccagatacagcccagccgggtatctatcgaatcaggtacttcggccataatcgaaaacaggacatcttaaaacccgctgtaattctttcattcgaggggaccagtccggctttcgaggtagtcaccatctag

SEQ ID NO: 231879 - DNA, 1869 bp, Artificial Sequence
  Description of Artificial Sequence: Synthetic coding sequence
atggatagtgagaagtcatctgaatggcgatctgatgtgctgaaccggctccaatcaaagtatggcagtctgtacagaagggataacgtgatactgtcaggcacccacacccactcgggccctgcgggatatttccagtataccgttttcgttatcgccagcgagggattttcaaatcaaacatttcagcatatggttacaggcatattgaaaagcattgacatcgctcacacaaacatgaagcctggaaagatcttcatcaacaaaggtaacgtcgatggcgtacagattaaccgctcaccctattcttacctccaaaacccacaatccgagagagcaagatatagcagcaatactgacaaggagatgatcgtcctgaagatggtggatttaaatggagatgatttaggtctgatcagttggttcgccatccatcctgtctcaatgaacaacagcaatcatctggtgaactcagataacgtaggttacgccagctatttacttgagcaggaaaagaataaggggtacctacctgggcaaggcccattcgtcgccgctttctcgtcatcaaacctgggtgacgtcagccccaacatcctcggaccccgttgtattaacactggagagtcttgcgacaatgcaaacagcacttgccccataggcggaccgagtatgtgtatcgctaagggtcccggacaagatatgttcgactccacacagataatcggcagggcaatgtaccagcgcgctaaggaactttacgcgtcagcctcacaggaagtgacgggccctctggctagcgcccaccagtgggtggacatgaccgacgtaacagtgtggttgaacagcacccacgcctctaaaacctgtaaaccagccctgggttactcctttgctgcgggtacaatagatggagtgggcggtctcaactttactcaaggaaagacagaaggggatccgttctgggacacaatcagggatcagattcttgggaaacctagtgaagaaatcaaagagtgccataaacccaaacccattctcttgcatacaggcgaattgtcaaaaccacatccttggcaccccgatattgtcgatgtgcagattatcactctgggctcgctcgcaatcactgctatccccggagaatttacaacgatgtccgggagacgcctgcgggaggctgtgcaggccgaattcgcaagccacgggatgcagaacatgaccgtggtcatcagtggcctgtgtaatgtttatacacactacattactacatacgaggagtatcaggcccagcgctacgaggcagcaagcacaatttacggaccgcacaccctgtcagcgtacattcagctcttccggaacctcgccaaggctatcgccacggataccgtggcaaatctgtcccggggacccgagccccctttttttaaacaactgatcgtgcccctgattccctccatagtcgatcgcgcaccaaagggccgaacttttggcgatgtgctgcagcctgccaaacctgaatacagagtgggggaggtggctgaggtaatctttgttggtgccaatccgaagaattccgtacagaatcagaatcaccagacctttctgaccgtcgaaaaatacgaggcaacttcaactagctggcaaatcgtctgtaacgatgccagttgggagactcgattttattggcacaagggcctgctcggactgtcaaatgcgactgtcgagtggcacattcccgacaccgcccagcctgggatataccgaattcggtacttcgggcataacagaaaacaagacattttgaaacctgcagtcattctttctttcgagggtacgtctccagcattcgaagtggtgactatctag

SEQ ID NO: 231880 - DNA, 1341 bp, Artificial Sequence
  Description of Artificial Sequence: Synthetic coding sequence
atggagatggagcaagaaaaaatgactatgaacaaagaactttccccagacgcggcagcatattgttgctccgcctgtcatggggatgagacctggagttacaaccatccaattcgtgggagggctaagagcagatccctctccgcaagtcctgccctgggctccaccaaggagttcaggagaacccgctctctgcatggtccgtgcccagtgactacattcgggccaaaggcctgtgttctgcagaatcctcaaacaataatgcacatccaagatccagcctcccaaagactgacctggaataagtccccaaaatctgtgctggtcattaaaaaaatgcgggacgccagcctgctgcaacctttcaaggaactttgtacacatttaatggaagagaatatgatcgtctacgtggagaagaaggtgctggaggatccagccatcgcgagcgatgagtctttcggagccgtcaaaaaaaagttctgcacgtttagggaggattacgacgatatctcaaaccagatcgatttcattatctgccttggcggtgacggaacgctactgtatgcgagtagtctgtttcaaggaagcgtgcctcccgtcatggcatttcacttagggtcactgggcttcctcactcctttctcttttgagaacttccagtctcaggttacccaggtcatagaggggaacgccgctgtggtactgaggtcccgactcaaggtgagagtggtgaaagaactcagaggtaaaaagactgcagttcataatgggttaggcgagaacggaagtcaggccgcaggcttggatatggacgtgggaaaacaggctatgcagtaccaggtcctgaatgaagtagtgattgaccgtggaccatccagttatttgagcaacgtggacgtgtatctcgatggccatctgatcaccacggtgcagggtgacggagtaattgtgtccacaccgacaggctctaccgcttacgccgctgctgctggtgcttcaatgattcatcctaacgtacccgctataatgataacacccatctgtccccatagcctgagctttcggcctatagtggtccctgccggagttgagttgaaaataatgctgtcacctgaggcccgaaataccgcatgggtgagcttcgacggaagaaaacggcaggagatccgacacggagactctatcagtattacaacaagctgctaccccctaccctccatatgcgttagggatcccgtctccgactggttcgaaagcttggcccagtgtctgcattggaacgttagaaagaaacaggcacactttgaggaggaggaagaggaagaggaggaggggtag

SEQ ID NO: 231881 - DNA, 1341 bp, Artificial Sequence
  Description of Artificial Sequence: Synthetic coding sequence
atggaaatggagcaagaaaagatgacgatgaacaaggagttatcacctgacgccgctgcctactgttgcagcgcctgtcatggggacgagacttggtcttataatcatccaataagaggtcgagcaaaatcacgatccttgagcgcctcccccgcacttggttctacaaaggaatttcggaggacccggagtctgcacggaccatgtccagtcacaacattcgggccaaaagcctgtgtgctgcagaacccccagacaatcatgcacatccaagatcccgcaagccagaggctcacctggaacaagtctccaaagtctgttctggttataaagaaaatgagggatgctagccttctgcagccttttaaggagctctgcacacatttaatggaagaaaatatgatcgtgtacgtagagaagaaggtgttggaggaccccgcaatcgccagcgatgagagcttcggcgctgtcaaaaagaaattctgcacattccgcgaggactatgatgatattagcaaccaaattgattttatcatttgcctgggtggcgatggaactctcctttatgcttccagcctgttccaagggtcggtgccaccagtgatggcctttcacctgggatccctgggatttctgacccctttctcattcgaaaattttcaatcacaggttacccaggtcatcgaggggaatgccgctgtggtgctgcggtcacgcctcaaggtgagagttgtaaaagaactgaggggtaagaagactgccgtgcataatggcctgggggaaaacggttcccaggcggctggcctggatatggatgtgggcaaacaggccatgcagtatcaagtgcttaatgaagttgtgatcgaccgaggccctagcagctacctgagtaacgtggatgtttacctggacggacacctgatcaccacggtgcagggggacggcgtgatcgtgagtacacccacaggatctacagcatacgctgctgcagcaggagcaagcatgattcaccccaacgtacccgcaattatgatcacgcctatttgtccccacagcctgagctttcgtcccattgtggtcccagccggtgtcgaattgaagataatgttgtcacctgaagccaggaatacggcatgggtgtcctttgacggccgtaaacgccaggagatccggcacggagactccattagcatcaccacgtcgtgctatccattacctagcatatgtgtgagggatccagtgagcgactggttcgaatctctggcccagtgccttcattggaatgtgagaaagaaacaggcacacttcgaggaggaggaggaagaggaggaggaggggtag

SEQ ID NO: 231882 - DNA, 1245 bp, Artificial Sequence
  Description of Artificial Sequence: Synthetic coding sequence
atgggaagacccagggtgaggcaggcgtggcccggttgctgtggccatacgggaaggctgccggctgggagaggttacttggcaagccacatgtgtgaccccgcaggcgctgagttaattggcgatggaatgtccgaccccactcctccttccaatgcatgcaccggacacatccaggacccagcttctcagcgccttacttggaacaagagcccaaagtctgtcctcgtcattaaaaaaatgagggacgccagtctactccagcctttcaaagagctctgcactcacctgatggaggaaaatatgatcgtttacgtggagaaaaaagtgctcgaggatccagccatcgcttcagatgaatctttcggcgctgtgaagaagaagttctgcacctttagagaggactacgacgatatctccaaccagatagattttatcatttgcctgggaggggatggtacacttctctacgcatctagcctgtttcagggcagtgttccaccggttatggccttccatttggggtccctcggcttcctcacccctttttcctttgagaacttccagtcgcaggtgacccaggtgatcgagggtaacgccgcagtggtcctcagatcacggttgaaggttcgcgtggtgaaggaacttagaggtaagaaaaccgctgttcataacggattaggggagaacggtagtcaggctgcaggcctcgatatggatgtagggaaacaggcaatgcaatatcaagtgctcaacgaagtggtgatcgaccgtggcccatcttcctatctgagcaatgtcgatgtctacctggacggacatttgattaccactgtccagggcgacggggtgattgtttccacgcccacgggttcaaccgcttatgccgcagctgctggggcatccatgatacatcccaacgtaccagccataatgataaccccaatatgtccccattctctgtcttttaggcccatagtggtccctgctggggttgaactcaagataatgttaagcccagaggcccgaaacaccgcttgggtctcattcgacggccgtaagcggcaggagatcaggcatggagattcaataagcatcaccacatcttgctacccattgccgtcgatttgtgtgcgggatcccgtgagtgactggttcgagtccctggcccagtgcctccattggaacgttcggaagaaacaggcccatttcgaggaggaggaggaggaagaggaggaaggatag

SEQ ID NO: 231883 - DNA, 1776 bp, Artificial Sequence
  Description of Artificial Sequence: Synthetic coding sequence
atggagatggaacaggagaagatgaccatgaacaaagaactctcgcccgacgctgcggcttactgttgcagcgcatgccacggagatgagacatggtcctacaatcatcccatacggggacgcgcaaagtcgcgatccctgtctgcctcccctgctttggggtcgaccaaagagtttcgtcgcacccgcagcttgcacgggccatgccctgtcactaccttcgggcctaaggcctgtgtcttgcaaaacccgcagaccattatcgccacccccttgagcctggccagccagctcctgccctcgcctgccgtgtcacacagcggacagggtggcgtaacaggccaggttcacgtgctcccacagccatcagaccagggggttctaagtggcccacgcgctgcccgtggccagacagcacctcaggaggaggctgtgactcaggaggaagtcgaggcactcgtgtgtgggcacacacagcgatgggtgcctggaccagtctatgatgctgctgccggtggctcgggctgggctcagctctcccttcgcgctggaatgggagtcgggcaggctactggccacatccaggatccagcctcgcagcgacttacgtggaataagtcgcccaagagcgttttggtcatcaagaaaatgcgtgacgctagtctgctacaaccattcaaagagctgtgtacacatctgatggaggcgcgaggggctggcggaaagggagcttggggagcccatggcgtcggaggggctagtatccacataactgccccaagagtgggctcagctggaggcatgtctcgtcttgccctgtgcttccaggagaatatgatagtttatgttgagaaaaaggttctggaagaccccgctattgcctccgacgagagtttcggcgcagtgaaaaagaagttctgtacattcagagaggattatgatgatattagtaaccagatagattttatcatatgccttggaggagacgggactctcctgtacgcgtcaagcctgtttcagggcagtgtccccccagtcatggcattccatctcggaagtctcgggttcctgacgccatttagcttcgaaaactttcagtcccaggtgacacaggtgatagaagggaacgcagctgtcgtcctgagatcaagacttaaggttcgcgtggttaaggaactgcggggaaagaagactgctgtccacaacggcctgggagagaatggcagccaggccgctgggctcgacatggacgtggggaagcaggctatgcagtaccaggtactcaatgaggtcgtcatagaccggggaccttcttcctatctctcaaacgtagatgtgtatctcgacggacacctcattaccacagtacagggagatggcgtcatagtgagcacgccaactgggtccaccgcatatgcagcagccgcaggcgcaagtatgattcatccaaacgtccctgctattatgataactcccatttgccctcatagcctgagcttccgccctattgtggtgcctgccggagtcgaactaaagattatgctgagtcctgaagccagaaatacagcgtgggtgagttttgacggcagaaagcgccaggagatccggcatggcgattctatctcaattactactagctgttacccccttccatccatctgtgtccgcgaccctgtgtcagattggtttgagtctctggctcagtgccttcactggaacgttaggaagaagcaagcccattttgaggaggaggaggaggaagaggaagaggggtag

SEQ ID NO: 231884 - DNA, 1776 bp, Artificial Sequence
  Description of Artificial Sequence: Synthetic coding sequence
atggaaatggagcaggaaaaaatgaccatgaataaagaacttagccccgacgcggcagcatactgctgcagtgcttgtcatggcgatgaaacatggagttataatcaccccatacgcggacgggctaagagtcgctcactttccgccagcccggcattgggttctactaaggaattcaggagaacccgatctctgcatgggccatgccctgtgacaacttttgggccaaaggcttgtgttctccagaatcctcaaactatcatcgccacgcccctttctctcgcatcccagctgttgccaagcccagccgtgtctcactccggacagggtggcgttactggtcaagtccatgtgttaccccaaccttcagaccaaggtgtcctatctggtcccagagctgctcgtggccaaacagcccctcaggaagaagccgtgacgcaggaggaagtcgaggccctcgtgtgcggccacacccaacggtgggtgccgggaccagtgtatgatgcagccgcagggggtagcggatgggcccagttgagcttacgcgctggaatgggcgtcgggcaggcaactggacacatccaggatcccgcatcccagcgcctgacctggaataaaagtccaaaatcagttttggtgattaagaaaatgcgagacgcctcccttctccagccattcaaagaattgtgtacccatttgatggaggcgagaggtgccggtgggaaaggcgcatggggcgcacacggcgtgggcggtgcctcgatacatattaccgcccctagagtcggttctgcaggcggaatgtccagactggcactttgcttccaagaaaacatgatcgtgtacgtggaaaagaaggtacttgaagaccctgccatcgccagcgacgaatctttcggagctgtgaagaagaagttctgcacgttccgcgaggactacgacgacattagcaaccagattgactttatcatttgcctcgggggagatggaacactgctctatgcctcatcacttttccaagggtctgtgccgccagttatggcgtttcacctcgggagtttgggcttcctgacaccattcagtttcgagaatttccaaagccaagtaactcaggtgatcgaggggaacgcggctgtggtgctccggtccaggctcaaagttagagtggttaaggagctgcgcggaaagaagacagccgtgcacaatggcctcggagagaatggatcccaggcagcagggctggacatggatgtggggaaacaggccatgcaatatcaggtgctgaacgaagtggttattgacagaggtcccagctcttacctctccaacgtcgacgtataccttgacggtcacctcatcactaccgttcaaggggatggcgtaatcgtgtctacaccgaccgggtccactgcgtatgccgcagccgctggtgcatcaatgatccacccgaatgtaccggctatcatgatcacccctatatgcccacacagcctgtctttcagacccattgtggttccagctggagttgagctgaagatcatgttgtctccagaagctaggaatacggcctgggtctctttcgatggaagaaaaaggcaagaaattcgtcacggagattcaatctcgatcacaacaagctgctatcctctgccttctatttgcgttcgtgatccagtgtctgactggttcgaatctctggcccaatgtctgcactggaatgtgcgcaagaagcaggcccatttcgaagaggaggaagaggaagaagaagagggatag

SEQ ID NO: 231885 - DNA, 621 bp, Artificial Sequence
  Description of Artificial Sequence: Synthetic coding sequence
atgggcaggcccagagtgcgtcaggcgtggccaggctgttgcggccataccgggcgacttccagccggacggggatacctagcgagtcacatgtgtgacccggcaggagccgagcttattggagatgggatgagcgaccccacacctcctagtaatgcctgtactggccatattcaagacccagcatctcaacgcctgacttggaataagagccctaagtccgttctggtgatcaaaaaaatgagagacgccagcctactccagcctttcaaagaactgtgtactcacctgatggaggagaacatgattgtgtatgtggagaagaaggtgctggaagaccccgcaattgcttccgacgagagtttcggtgccgtgaaaaagaagttctgcacatttagggaggactatgacgacattagcaaccagatcgatttcatcatttgcctgggaggagacggcactctgttgtacgcctcttctctgtttcagggaagtgtgccccctgtgatggcgttccacctgggcagtctcggattcctgactccattttcttttgaaaatttccagagccaggttacccaggtcattgagggtaacgcagctgtagtgttgcggtcgtag

SEQ ID NO: 231886 - DNA, 2121 bp, Artificial Sequence
  Description of Artificial Sequence: Synthetic coding sequence
atgggcagaaaagtcactgtggcaacctgcgctctgaaccagtgggcattggattttgaggggaacttacaacggattctgaaatcaatcgagatcgctaagaacagaggagcccgttatcggttagggccagagcttgaaatctgtggatacgggtgttgggatcactactatgagtcggacaccctgctccatagttttcaggttctcgccgcactcgtggaatcaccggttacccaggacataatctgtgatgtgggaatgccggtgatgcaccgcaatgtgcgctataactgtagggtgatatttctaaatcggaagattctgctgatacgcccaaaaatggcactggcaaatgagggaaactacagagaacttaggtggtttaccccctggtcaaggtcaaggcatactgaggagtatttcctgccaagaatgattcaagatttaaccaagcaggagactgtcccattcggagacgctgtgcttgtgacatgggatacctgtattgggagcgagatctgcgaagagctatggactccccactctccacatatcgacatgggcctcgacggtgtggaaataatcaccaatgccagtggctcacatcaggtgttgcggaaggccaacaccagagttgatttagtaacgatggtcacctctaagaacggtggcatctacctactcgccaatcagaaaggttgtgacggagaccgcttgtattacgacggatgtgctatgatcgcgatgaatggctctgtgttcgcccaggggtcccagttctcactcgatgacgtggaagtgctcaccgccacactggacttagaagacgttaggtcatatcgggcagagatttcctctaggaatctagctgcgagcagggcgtcaccctatcctcgtgttaaagtcgacttcgcgctttcttgtcacgaagatctcttagccccaatctcagaaccaatagaatggaagtaccacagtcccgaggaagaaatttcgttggggcctgcatgctggctgtgggattttttgcggcgatctcaacaagcaggcttcctactccctctttccggaggagtagacagcgccgcaacagcatgtcttatttacagtatgtgctgtcaggtctgtgaggcggtaaggtctggaaacgaagaggttttggccgatgtccgcaccatcgtcaatcagatcagttatacgccacaggatccaagggatctgtgcggcagaattctaaccacatgttatatggcatccaagaattcctctcaggaaacctgtacccgagccagagaactcgctcagcagatcggaagccatcacatttcattaaatattgaccccgctgtgaaggccgtgatgggcatcttctccctggtgactggcaagtctcccttgttcgctgcccatggtggatctagcagagagaacttagccctgcagaatgtccaggctaggattcgaatggtcctggcctacttgtttgcccagctgagcctatggtcacgaggggttcacggaggattgctggtgctgggttctgctaacgtagacgaatctcttttgggatacctgacgaagtacgactgttcaagcgccgatatcaatcctatagggggaataagcaaaaccgatttgagagcattcgtgcagttttgtatccagagattccagttgccagctctgcagtccattctgttggcccctgccacagccgagcttgagcccctcgcagatggccaggtaagccagactgatgaggaagatatgggcatgacttacgccgagctgtccgtgtacggaaagttgaggaaagtggcaaaaatgggtccgtatagtatgttttgtaaactgctgggaatgtggagacacatttgtaccccacgccaggtcgctgacaaggtgaagaggtttttctcaaagtacagcatgaatcgccataaaatgaccaccttaacccccgcataccatgctgagaactatagtcccgaagacaatcggttcgaccttagaccattcctgtataacacctcttggccctggcagttcagatgtattgagaaccaagtgttgcagttggagcgagctgaaccacaaagtctggacggtgtcgactag

SEQ ID NO: 231887 - DNA, 1341 bp, Artificial Sequence
  Description of Artificial Sequence: Synthetic coding sequence
atgggcatctccggccaggaggttctgaccgcaactctcgacctagaggacgtgaggagttaccgagccgaaataagctcacgtaacctcgctgctagtagggcgtcaccctaccctcgggtgaaagttgatttcgcactttcatgccatgaggatctcctcgccccaatctctgaacctatcgaatggaaatatcattctcctgaggaagaaatcagtctgggacctgcatgctggctttgggatttcctgcggaggagtcagcaggccggatttttgctgcctctcagcgggggtgtggacagcgccgctactgcttgtcttatctacagtatgtgctgccaggtctgtgaagcagtacgcagtgggaacgaggaggtgctcgccgatgtccgcacgattgtgaaccagatctcctataccccacaggaccctagggacttatgtggcaggattcttacaacgtgttacatggcctcgaagaattcttcccaggaaacctgtactcgcgcaagggagctcgcgcagcagatagggtcacaccatatctctctgaatatcgaccctgcagtgaaggcagttatgggaatatttagcttggtcactggcaaatcccctctctttgctgctcatggcggtagttctcgtgagaacttggccctgcagaacgtgcaggctcgaatccgtatggtcctggcctacttgtttgcgcaactcagcctttggagtcgcggagtccatgggggtcttttggtgctcggctccgccaacgtggacgaatcgttactcggctacctcaccaaatatgactgcagctccgcagatattaatcccattggtggaatctccaagacggacctgcgagctttcgttcaattttgcatccagagattccaactgcctgccctgcagtccattctcctcgctcctgcaacagctgagctcgagcctctcgccgatggccaggtctcacagaccgacgaagaggacatgggaatgacttacgccgaactttccgtgtacggaaaactcaggaaggtcgccaagatgggaccatattcaatgttttgtaaacttctcggtatgtggcggcatatatgcactcctagacaggtggccgacaaagtaaagagattctttagtaaatatagcatgaataggcataagatgacaacactcactcctgcctaccatgccgaaaactattcacccgaagacaaccgtttcgaccttaggcccttcctgtacaatacttcatggccctggcagttccgttgcatagaaaaccaggtgcttcagcttgagcgggctgaaccccagagcttggatggagtggactag

SEQ ID NO: 231888 - DNA, 1122 bp, Artificial Sequence
  Description of Artificial Sequence: Synthetic coding sequence
atggaacccgctgtgagcgagcctatgcgcgaccaagttgcaagaacacacctcacagaagatactccaaaggtgaacgcagatatcgaaaaggttaaccaaaaccaggcaaaaaggtgcactgtgatcggcggttccggctttttgggacagcatatggttgagcagctgctggccagagggtacgcagtgaacgtctttgatatacagcagggttttgacaatccccaggttcgatttttcctcggagatctgtgtagcagacaggatctgtatcctgcactgaaaggcgtcaatacagtcttccattgtgccagtcctccccctagttctaataacaaggagcttttttatcgggtgaactacatcggtacaaaaaatgtaatcgaaacttgtaaagaggccggagtacagaaactgatcctgacttcttccgccagcgtgatttttgagggcgtcgatattaagaatggaacggaagacttgccctacgctatgaaaccaatcgactattacaccgaaactaaaatcttacaggagagagccgttctgggcgcaaatgaccccgaaaagaacttcttgaccaccgcaattaggccgcacggcatctttggtcccagggaccctcagctggttcctatcttaattgaggctgccagaaatgggaagatgaaattcgtaataggaaacggaaagaatctggtggattttacttttgtggaaaacgtggtccacggacatatcctggccgcagagcagctctcacgggactctactcttggcggtaaggcattccatattacaaacgacgagcccattccattctggacgttcctgtctaggatccttactgggctaaactatgaggcccctaagtatcatataccatactgggtagcatattatctcgcactgctgctatctctacttgtgatggttattagtcccgtgattcaattgcagcccaccttcacaccaatgcgcgtcgccctggcgggtacatttcattactacagttgtgagcgcgcaaagaaggctatgggatatcaacctttagtgacaatggacgacgccatggagcgaacagtccagtcctttaggcacttgcggagggtcaagtag

SEQ ID NO: 231889 - DNA, 765 bp, Artificial Sequence
  Description of Artificial Sequence: Synthetic coding sequence
atggagcctgccgtgagtgagccaatgagggaccaggtggctcgcacccatcttactgaggatacccccaaagtgaatgccgacattgagaaggtgaaccagaatcaagccaagcgctgcaccgttattggaggctctgggtttttgggccagcatatggtggaacagctgctggccaggggctacgccgtgaacgtcttcgacatacaacagggcttcgacaacccccaggtgcgattcttcctgggggatctttgctcgcggcaggatctgtaccctgccctgaagggcgtcaacacagtgttccattgtgcatcaccccctcccagcagcaataacaaagagttgttctacagagtgaactacatcgggacaaagaacgtgattgagacttgtaaagaagcgggagtgcagaaactcattctgactagcagcgctagtgtcatctttgaaggggtcgacatcaagaacgggactgaagacctgccatatgccatgaagcccatagactactatacggagactaaaattcttcaggagcgcgctgtgctaggggctaacgatcccgaaaagaactttttgaccacagctataagacctcatgggattttcggccctcgggacccacagctggtgcctatcctgatcgaagcagcgagaaatggaaagatgaagttcgttatcggaaacggcaaaaacctggtggacttcactttcgtagagaatgtggtacacgggcacattctggctgccgagcaattgtag

SEQ ID NO: 231890 - DNA, 1122 bp, Artificial Sequence
  Description of Artificial Sequence: Synthetic coding sequence
atggagcctgcagtgtctgaaccgatgagagaccaagttgcaagaacccacctgacggaggatacaccaaaagtgaacgcggatatagagaaggtgaatcaaaatcaggccaagaggtgcaccgttattggaggttccggcttccttggacagcacatggttgaacaactcctcgccagggggtatgccgttaatgtgtttgacatccagcagggtttcgataacccacaggtcaggttcttcctcggggacctgtgcagcaggcaggatttataccccgctctgaagggcgttaacacagtgtttcactgcgctagccctcctccaagctcgaacaataaagagctattctacagggtcaactacatcggaacgaagaatgtgattgaaacctgtaaggaagccggagtgcagaagctcattctaacatcttctgcatcggtgatctttgaaggcgtggatattaagaacgggactgaggatctcccttatgccatgaagcccatagactattacaccgagactaaaattctgcaagagcgggctgttctgggtgctaatgatccagaaaagaatttcctaacgacagcaataagaccacatggcatatttggcccacgcgatccacaattggttccaatcctgatcgaagctgcgagaaacggtaagatgaagttcgtgatcggcaatggtaaaaacctcgtggacttcacatttgtagagaatgtcgtgcacggacacattcttgccgctgaacaattatcacgggattctacacttggaggcaaagcatttcatataacaaatgatgaacccatacccttctggaccttcctgtcacggatcttgactggactaaactacgaggctcccaagtatcatatcccttattgggtagcctactatctcgctctgctcctttctctcctggtgatggtcatctctccagtgatccagctccagcccactttcaccccaatgagagtcgccctcgcaggcaccttccactactactcctgtgagcgcgctaaaaaggctatgggctaccagccgctcgttactatggacgatgccatggagagaaccgtgcagtcatttcggcacctgcggcgagtgaaatag

SEQ ID NO: 231891 - DNA, 825 bp, Artificial Sequence
  Description of Artificial Sequence: Synthetic coding sequence
atggtgggtcggagggccctcatcgtgctggcccacagcgaacggacaagtttcaattatgctatgaaggaggctgcagcggcagccctgaagaagaaaggctgggaagttgtagagagtgatctgtacgccatgaattttaatcctatcattagcaggaaagatataacaggcaaactaaaagatcccgctaactttcaatatccagccgaatcagtgcttgcctacaaagagggccatctaagccccgacattgtcgctgagcaaaaaaagcttgaagccgcagacctggtgatcttccagtttcctctgcaatggttcggcgtgccagccattttgaaaggatggttcgagagggtgttcattggcgagttcgcttacacttacgctgcgatgtatgacaagggcccatttagatcaaaaaaagccgtgctgtcaataacgaccgggggaagcgggtctatgtactctctccaaggcatacacggagacatgaacgtcatcctctggcccattcaaagcgggattctgcatttctgtggcttccaggtcctggagcctcagctgacctattcaattggccacacgcccgctgacgccaggatccagatcttggaaggttggaaaaaacggctggaaaacatttgggacgagactccactctattttgctccttcatccctttttgacctcaattttcaggccggatttcttatgaagaaggaagttcaggatgaggagaagaacaagaagttcgggttgagtgtcggccaccacctgggcaaaagtatccctacagataaccaaattaaagcaaggaaatag

SEQ ID NO: 231892 - DNA, 711 bp, Artificial Sequence
  Description of Artificial Sequence: Synthetic coding sequence
atggtgggccgtcgggcactgatcgttcttgcccatagcgaacggactagcttcaattatgccatgaaggaagcagcagccgctgccctgaaaaaaaagggctgggaagtggtggagagcgatctatacgccatgaattttaaccctattataagcagaaaagacatcacagggaaactgaaggacccagcgaactttcagtacccagccgaaagtgtgctggcttataaggaaggtcacctatctccggacattgtggctgagcagaagaagctggaagccgctgacctcgttatctttcagtcgaaaaaagcggtcctatctattacaaccggcggatctggaagtatgtattctctgcaggggatccacggcgacatgaatgtgatactctggcctattcagtccggtatcctccacttctgcggctttcaggtgttggagccccagctgacttattccatcggacatacaccagccgatgctcggatccagatacttgagggatggaagaagaggttggagaatatttgggacgaaactccgctgtattttgctccctcttctttgtttgatctgaatttccaagccggatttctcatgaaaaaagaagtgcaagacgaggagaagaacaaaaagttcggcttgtccgtggggcaccacctgggaaaatctatccctactgacaaccagatcaaagccagaaaatag

SEQ ID NO: 231893 - DNA, 723 bp, Artificial Sequence
  Description of Artificial Sequence: Synthetic coding sequence
atggtcggacgccgtgcattaattgtgcttgcccattcggagcggacttcctttaactatgcaatgaaggaggcagcagccgcagcactgaagaagaagggctgggaagtggtggaatccgatctttatgcaatgaactttaacccgatcattagcaggaaagacatcaccggtaaactgaaggacccggcaaactttcagtaccccgctgagtccgtcctggcatataaagagggccatctcagccccgatattgtcgccgagcaaaaaaaacttgaagctgcggatctcgttatcttccagtttccccttcagtggtttggtgtgccagccatcctgaagggctggttcgagcgcgtgttcattggggaatttgcctatacctacgctgctatgtacgataagggcccattcagaagcgggatcctgcatttctgtggctttcaggtgcttgaacctcaacttacctacagcattggacatactcccgctgatgctagaatccaaattctggagggatggaagaagcgtcttgaaaacatctgggacgaaacacccttatactttgctccttcttccttgtttgatctgaactttcaggccggtttcctgatgaagaaggaggtccaagatgaggagaaaaataagaaatttggattaagtgtcggtcatcacctgggcaaatcaatacccactgacaaccaaatcaaagctcggaaatag

SEQ ID NO: 231894 - DNA, 609 bp, Artificial Sequence
  Description of Artificial Sequence: Synthetic coding sequence
atggtggggagaagagccttgatcgtgctggcacactccgaacgtacaagcttcaattatgccatgaaagaagccgcagctgccgctctcaagaagaaaggatgggaggtggtggagtctgatttgtatgccatgaacttcaaccccatcatctcgcgcaaagacatcacaggcaagctcaaggatccagctaatttccagtatccagcagagtccgtgctggcatacaaggaggggcatctgtcacccgatattgtggccgaacagaaaaagttagaagcagccgatcttgtgatatttcagagcgggatcttacatttttgtggcttccaggttttggagccacaactgacatacagtattggccacacgcccgctgacgctagaatccagattcttgaaggctggaagaaacgccttgagaacatatgggatgagacacctctctacttcgcacctagtagtcttttcgatctcaatttccaagcaggctttctgatgaaaaaggaagtgcaggatgaagagaagaacaagaaattcggcctcagcgtgggccaccacctggggaaaagcatccccacagataatcaaattaaggctcgaaagtag

SEQ ID NO: 231895 - DNA, 696 bp, Artificial Sequence
  Description of Artificial Sequence: Synthetic coding sequence
atggccggaaaaaaagtgctgatcgtttacgcccatcaagagcctaaatcttttaatggatcactgaaaaacgtcgcggttgacgaattgagtcgacaggggtgcactgtgacagtatctgacctgtatgccatgaatctcgagcccagagccacagataaagatattactggaaccctatcaaatcccgaggtgtttaattatggcgttgagacacacgaggcttacaagcagcgatctctagcttcagacataacggacgagcagaaaaaggtgagagaagctgacttagttattttccagttccctctatattggttttcggtccccgctatcctcaaaggatggatggaccgagttctttgccagggattcgcttttgatattcccggattttacgattctgggctcttgcagggcaaactggccctactgtctgtgaccaccggaggcaccgccgagatgtacacaaaaaccggagtgaacggcgattcacgctattttctttggcccctgcagcatggcactctgcatttttgcggctttaaagtgttagcaccgcaaatctcttttgccccagaaatcgcctcagaagaagagagaaagggcatggtggccgcatggagtcaaaggcttcaaacgatttggaaggaggaacctattccctgtactgcacactggcacttcggccagtag

SEQ ID NO: 231896 - DNA, 696 bp, Artificial Sequence
  Description of Artificial Sequence: Synthetic coding sequence
atggccggaaaaaaggtcctcatcgtctacgctcatcaggaacccaagtctttcaacggatccctgaaaaatgttgcagtcgacgagctgagcaggcaggggtgcaccgtaacagtctccgatctatatgcgatgaatctcgagccacgggcaactgacaaagacattaccggcactctctccaaccctgaggtctttaattacggggttgagactcacgaggcatataaacaaagatctcttgctagcgacatcacggacgaacagaaaaaggttagggaggctgacttagtcatctttcaattcccactatattggtttagtgttcccgcaattctcaagggatggatggatcgagttctatgccagggctttgcatttgacatacctggattttatgactcaggcctgttgcaaggtaagctcgcactgttaagcgtgacaactggaggaacagctgaaatgtatacaaaaaccggtgtgaacggggatagccgctactttctgtggccattacagcatggcactctgcacttttgtggcttcaaggtgcttgctccccaaatttctttcgccccagagattgcttccgaagaagagcggaagggcatggtggcagcttggtctcagcggctgcagaccatctggaaagaggaacctatcccttgtaccgctcactggcacttcggacagtag

SEQ ID NO: 231897 - DNA, 582 bp, Artificial Sequence
  Description of Artificial Sequence: Synthetic coding sequence
atggccggtaaaaaggtgctcattgtgtatgcccaccaggagcccaagagctttaacggcagtctgaagaacgtagccgtggatgaactcagccgacagggttgtacagtgactgtctcagacctgtatgcaatgaacttagaacctagggctacagacaaggacataacaggcaccctttctaatccagaggtgttcaactatggtgtggagacccacgaggcttataaacagaggtccctggcatcagacataaccgacgagcaaaaaaaggtccgcgaagctgacttagtcatctttcaaggaaaactcgcccttctcagcgttactactgggggaactgcggaaatgtataccaaaacaggcgtcaacggcgactcccgctacttcctgtggcccctgcagcacgggaccttgcatttctgtggattcaaggtcttggcacctcagatcagcttcgccccagagattgcctctgaagaggaacgtaagggcatggtggcagcttggtcccagcgactacagacgatttggaaggaggaacccatcccatgtactgctcactggcactttggacaatag

SEQ ID NO: 231898 - DNA, 582 bp, Artificial Sequence
  Description of Artificial Sequence: Synthetic coding sequence
atggcaggaaagaaagtcctcatagtctacgctcatcaggaacctaaaagtttcaatggcagcctgaaaaacgttgcggttgacgaacttagcagacaagggtgcactgtgacggtcagcgacttgtatgccatgaatttagaaccgcgagcaaccgataaggacattacggggacactgtctaaccctgaggtcttcaactatggagtggaaactcatgaagcatacaagcagcgcagtctggcatcagatattactgatgaacagaaaaaagtgagagaagccgacctggtgatatttcagggaaagcttgccctcctatcagtgactactggagggacggccgagatgtacactaaaactggagtgaatggtgactctagatatttcctctggccgctccagcatggcaccttgcatttctgcggatttaaagtactggcacctcagatatcattcgcccctgagattgcctcggaagaagagagaaagggaatggttgctgcttggtcacagaggttgcagactatttggaaagaggagccaatcccatgtacagcacattggcattttggacagtag

SEQ ID NO: 231899 - DNA, 696 bp, Artificial Sequence
  Description of Artificial Sequence: Synthetic coding sequence
atggcaggcaaaaaggttctgattgtatacgcacaccaggagcccaagtcttttaatggctccttgaagaatgttgccgttgacgagctttcccggcagggctgcaccgtgactgtttcggatctgtacgctatgaaccttgaaccaagggctaccgataaggatataacaggaaccttgagcaacccagaggtgttcaactacggagtcgagacacacgaagcttataagcagagaagcctggcctccgacataactgacgaacagaaaaaggttcgtgaagcagatttggtgatctttcagtttcccttgtactggttctccgtgcccgctatcttgaaggggtggatggaccgggtgctctgccagggattcgctttcgacattcccggattctacgattcaggtctgctgcagggcaaattggccctcctgtccgttactactggtggcacggccgagatgtatactaaaaccggagtcaacggcgacagccgctacttcctgtggccccttcaacatggcacactgcacttctgcggatttaaagtgctcgcaccacagatctctttcgcccctgagatcgccagcgaagaggaacgtaaaggaatggtggcggcttggagccaacggctccagactatttggaaagaagagcctatcccttgtacggcccattggcatttcggccagtag

SEQ ID NO: 231900 - DNA, 420 bp, Artificial Sequence
  Description of Artificial Sequence: Synthetic coding sequence
atggcaggcaagaaggtcttgattgtctatgcacaccaagagcccaaatctttcaatggcagcctgaaaaatgtggcagtggacgagctgagtaggcaggggtgtaccgtcaccgtaagtgacctgtatgcaatgaacctggagccgagagcaactgataaggacatcacgggtacactgtctaatcccgaagtttttaactatggggtggaaacccacgaggcgtataagcaacggagtctggcttctgatattaccgacgagcagaaaaaggtacgagaggcagacctcgtaattttccagtttcccctgtactggttttctgttcccgctatcctgaaaggctggatggatagagtgctttgccagggattcgcctttgacatcccaggattctatgactccggactactccagtag

SEQ ID NO: 231901 - DNA, 420 bp, Artificial Sequence
  Description of Artificial Sequence: Synthetic coding sequence
atggccggaaaaaaggtgctgattgtctacgcccaccaagagcctaaatcttttaatggttcccttaaaaacgtagctgtcgatgagttgtctcgccagggctgcacagtaactgtgtccgatctgtatgcaatgaacttagaacccagggctacagataaagatataaccggaaccctgagcaaccctgaggtctttaattacggcgtggaaacacatgaggcctataaacagaggagtcttgcgagcgatatcacagatgagcaaaagaaggtgcgcgaggccgatttggtgatctttcagttcccactgtattggttttctgtacctgcaatcctgaagggctggatggaccgcgtcctttgccagggcttcgccttcgatataccaggcttctacgactccgggctgctccagtag

SEQ ID NO: 231902 - DNA, 192 bp, Artificial Sequence
  Description of Artificial Sequence: Synthetic coding sequence
atggcgggaaagaaggtcttaatcgtttatgcgcatcaggaacccaagagctttaatggtagtctgaaaaacgtggcagtggacgaattgtcacgtcagggatgcacagttaccgtgagtgacctgtatgcaatgaatcttgagccacgtgccactgacaaggacattacggggactctgagcaacccctag

SEQ ID NO: 231903 - DNA, 483 bp, Artificial Sequence
  Description of Artificial Sequence: Synthetic coding sequence
accccgggactaaagcagtcaagccacctgtccttgtggagttcttgggactatcgcctgctagattcactcaaaagagactacgccggaaagcctcagcctcccattaaaagtgaacgacgcaatccaccctcatacgcaatggcgggtaagaaggtcttaatagtgtacgcacatcaggaaccaaagagctttaatggtagccttaagaatgtggctgtggatgagttgagccgtcagggatgtactgtgacagtgtctgacctctacgccatgaatctggagccaagagcaaccgacaaggatatcaccggaacattaagcaatcctgaggtgtttaactatggggtagagacacatgaggcctataaacagcgctccctggcttctgatatcacagatgaacagaagaaagtgcgtgaagctgacctggtgatttttcagatgctgtccactgagctgtccctcacttcaagatgttag

SEQ ID NO: 231904 - DNA, 231 bp, Artificial Sequence
  Description of Artificial Sequence: Synthetic coding sequence
atggcagccgctgccgcatcaaggggcgtgggggcaaaactgggcctgcgggagatccgaatccacctgtgccagaggtctcctgggagccagggcgtcagagactttattgaaaagagatatgtcgaactgaaaaaggccaatcctgatctccctattctgatccgcgagtgcagcgatgtccagccgaaattgtgggctaggtacgcatcgcgggtccagaactcctag

SEQ ID NO: 231905 - DNA, 213 bp, Artificial Sequence
  Description of Artificial Sequence: Synthetic coding sequence
atgtggttcgagatcctccccggattatccgtcatgggtgtctgcctgctgatccccggtctcgctactgcctacattcaccgattcacaaatggaggaaaggagaagcgggttgcccactttgggtaccactggtcactgatggagcgtgacaggagaatctcgggcgtggaccggtattatgtttcaaaaggactggagaatatcgactag

SEQ ID NO: 231906 - DNA, 1068 bp, Artificial Sequence
  Description of Artificial Sequence: Synthetic coding sequence
atggccctcaggcttctgaagctggcggctacttcagcatcagcaagagtggtcgcggcaggcgctcagcgtgtcaggggtatccatagtagcgtacagtgcaagcttcgttacggcatgtggcattttcttcttggggataaggcatccaaaagactaactgagcggtccagggttataacggtcgacggaaatatttgcaccggcaaaggcaagctcgctaaggagatagcagagaagttggggttcaagcactttccggaggctggcatacattacccggatagtaccacaggggacgggaagccgctagcaaccgactataatgggaactgtagcctggaaaagttctatgatgaccccaggtcaaacgacgggaacagctatcggctgcagtcttggctgtactccagtcgcctcctgcagtactctgacgcactggaacacctcttaacaacaggacaaggagtggtgctggagcgtagcatcttcagcgacttcgtgtttctcgaagcgatgtataaccagggctttattcggaaacagtgtgtggaccattataatgaggtcaagagcgtgactatctgtgattatctgcctcctcatctggtaatttacatcgacgtaccagttcctgaggtccaacggaggatccagaagaagggcgacccacatgagatgaagattacaagcgcctatctgcaggatattgagaatgcgtacaaaaagacctttttgccagagatgtcagaaaagtgcgaagtgttgcagtattccgcaagagaggcccaggattcaaaaaaggttgtcgaggacatcgagtacctaaaattcgacaaaggaccatggctaaaacaggataatcggactctctaccaccttcgacttcttgtgcaggacaagttcgaagtcctcaactatacatcaatcccaattttcctcccagaagtgaccataggagcgcaccagactgaccgggtactgcatcagttcagggagctgccgggacgaaaatactctccaggatacaacacagaggtaggagacaagtggatctggctgaaatag

SEQ ID NO: 231907 - DNA, 1068 bp, Artificial Sequence
  Description of Artificial Sequence: Synthetic coding sequence
atggccctgcgcctcctaaagctcgccgctaccagtgcatcagctcgggtcgttgccagagcaccatcagcatggagaggcatccatagctctgtgcagtgtaagcttagatacgggatgtggcatttcctattgggggacaaggcctcaaagcgcctgactgagcggtcacgagtgatcactgtcgacggaaatatctgcactggcaagggcaagcttgccaaggagatagctgagaaactgggcttcaaacatttcccagaggctggcatacactatccggacagcactaccggcgatggcaagcccttggcaacagactacaacggaaattgcagcctcgagaaattctacgacgatcctagatccaatgatggcaactcctacagactacagtcttggctctactcttctaggctgctgcagtattctgatgccttggagcacctcctgacaacaggtcagggggtggtgcttgagaggtctattttcagcgatttcgtgttcttggaggccatgtacaaccaggggttcattagaaaacagtgtgtggaccactataacgaggtaaagagcgtaacaatttgcgactacctgcctccccatctggtcatctacatcgacgtccccgtcccagaggttcagaggaggattcagaaaaaaggggacccccacgagatgaagattacatccgcatatctacaagacatcgagaatgcctataagaaaaccttcttgccggaaatgtccgagaagtgcgaggtgctgcagtactccgccagggaagctcaggacagcaagaaggtggtggaagacattgaatatctgaaatttgacaaaggaccttggcttaaacaagataaccgcactttgtatcacctcagactgctcgtccaggataaattcgaggttctcaactacacatccatacccatattcctgcccgaggtcacgattggggctcatcagactgatagagttctgcatcagttcagagagctcccaggcagaaagtactcacccggatataataccgaagtaggagacaagtggatatggttgaagtag

SEQ ID NO: 231908 - DNA, 426 bp, Artificial Sequence
  Description of Artificial Sequence: Synthetic coding sequence
atggcccctaaagtgtttaggcagtactgggatatccccgatggaaccgactgccatcgcaaggcttatagcacaacttcaatcgccagtgtggcagggcttaccgccgcagcttacagggtgaccctgaaccctcccggtacctttctagaaggcgtagccaaggtgggccagtacacttttaccgccgctgctgtcggggctgtgtttggcttgaccacctgtatttcagcacacgtgcgcgagaagcccgatgatccactgaattacttcctcggaggttgtgctggcggactgacactgggtgcccgtacccataattatggcattggagcagctgcatgtgtttacttcggcattgcggcatccctggtcaagatgggaaggctagaaggctgggaggtgttcgcaaagccaaaagtctag

SEQ ID NO: 231909 - DNA, 687 bp, Artificial Sequence
  Description of Artificial Sequence: Synthetic coding sequence
atggcaccaaaggtgttccgtcagtattgggacatccctgatggaaccgactgccacaggaaggcttactctaccacgtccatcgcctctgtagcgggtctcaccgccgcagcctaccgggtgacgctgaatcctcccggaactttcctcgagggcgtggccaaggttggacaatataccttcacagctgccgctgtgggcgctgttttcggcctgaccacctgtattagcgcacacgtgcgggagaagcccgacgacccattgaactatttcttaggaggttgtgccggaggtttgacactgggggctcggaaaaccggtagtcattgcgtggttcaggccggtctgaagcttttagctagtagcagcccgcatacatcggcctcacagtccgctgggatcattggcatgagccactgtgtgcaaagattttgggtgcctagctcttccgcctgcctggaggttctcagcggtgagtccacagatgtccacgcgtgttcaagtactcgcggagcatgtaattctagcggaagtcggcctctgcctgaactgggagctcgagcgtctggaagcctcaggaaaggaggacatacacatccggcaccaaggggggctggtgctctaactccagtgcaggcactgatcgagagccttttaaatacactgggctccaaccccagaacctag

SEQ ID NO: 231910 - DNA, 684 bp, Artificial Sequence
  Description of Artificial Sequence: Synthetic coding sequence
atgcaagaaccacgcagagtgaccccctgcctcggcaaacgaggagtcaaaacaccccagctgcagcctgggtccgcattcctgccgcgagtacgtcgtcaatcttttcccgcaagatctgactcctatacaaccgtgagggatttcctcgcggtgccaaggacaatttctagcgccagtgcgaccctgatcatggccgtggccgtgagtcacttccggcctgggcctgaggtgtgggacaccgcctccatggctgcaagcaaggtgaagcaggatatgccacctcctggtggatacggtccaatcgattacaagaggaatctcccgcgtagaggcttgagcgggtatagcatgttggcaatcggcatcggcacgctcatttatgggcactggtctataatgaagtggaaccgggaacggaggagactgcagatagaggacttcgaggccagaatcgcactgctgcctctcctgcaagcagaaaccgacagacggaccctgcaaatgctgagggagaacctggaggaggaagcaattatcatgaaggacgtgcccgattggaaagtcggggagagtgtattccatactacccggtgggtgccccctctaattggggaactttacggcttacggacaactgaggaagcattgcacgccagtcacgggttcatgtggtacacctag

SEQ ID NO: 231911 - DNA, 435 bp, Artificial Sequence
  Description of Artificial Sequence: Synthetic coding sequence
atggccgctagtaaggtcaagcaggatatgccacctcccggaggttatggacctatcgattacaagcgcaatctgccgagaagagggctttccggatattccatgttagcaataggaattggtacccttatatacgggcactggagcatcatgaagtggaatcgggaacgacgcaggttgcagatagaagacttcgaagccaggattgccctgctcccccttcttcaagccgagaccgaccggaggacactgcagatgctcagggaaaatcttgaagaggaagctattatcatgaaggacgtaccagattggaaagtgggcgagagtgtgttccacaccactaggtgggttccgcctttaatcggggagctctatgggttaaggacgacggaagaggcgctacacgcttcgcatgggtttatgtggtatacctag

SEQ ID NO: 231912 - DNA, 300 bp, Artificial Sequence
  Description of Artificial Sequence: Synthetic coding sequence
atggctgccgctgccgctagcaggggagtgggcgcaaaactggggctacgggagattagaatccatttgtgccagagatcccccggatcccagggtgttagggatttcatcgaaaaacgttatgtggaactgaaaaaggctaaccccgacctacctatcctcattcgggaatgttcggacgtccagcccaagctgtgggccagatacgcttttggccaggagactaatgtccctttgaataatttctccgctgaccaggtaactcgcgcactggaaaatgtgctgtccggcaaagcttag

SEQ ID NO: 231913 - DNA, 720 bp, Artificial Sequence
  Description of Artificial Sequence: Synthetic coding sequence
atggccggtgtgttgaaaaaaaccactggcctggtgggcctggccgtgtgtaatactcctcacgaagtgtgcacctttgtgttgagtagcttcctcaattcccaggggcgtcttaacagttgtcattttgcatactgcagagtaaacggcattcagatgtttcaagccttgaattacaagccgagggaattgcttaggcacggcagatgtccaccaactagcctgatccggtgccatatatttatatacttctgtcacgacctgttcataaaaccagttttcctgcttacctttagcctgacattcagctggctgcatctgtgcctgctactaagtgctcctagccagatatacatatctgtatttcacctcttttccctgccatatcggttctgtttgggagccctggactacatttacctgggcctgctcaaagtgttgcctccatttcctagcgtgaggtcattcccttcagtttttacgaatgtcttcattaaaaagacccataagtttttcattctcctcgtgcccagtatcataacaccctttttgtgttttacactgcagattacacaaaaatcctacctgtatttcctccagtttctttcatacagtcccctcaacgcgctctctcacccctggaggttttctagctccccaataatcagcatgctgccgaacccgatggtatcgtcttactttagcccgtctttaacatag

SEQ ID NO: 231914 - DNA, 351 bp, Artificial Sequence
  Description of Artificial Sequence: Synthetic coding sequence
atggccggtgtgctgaagaaaaccaccggactggtgggcctcgctgtgtgtaatacccctcacgaacggctgagaattctgtataccaagattctggatgtgctcgaggaaatcccaaagaacgctgcctacaggaagtatacggaacagattactaacgagaagctcgccatggtcaaagcggagcccgacgtgaaaaagcttgaggaccagctgcagggcggacaacttgaggaggtgatcctccaggccgagcatgaactgaacctggccagaaagatgagagagtggaaactgtgggaacctctggttgaagagcctcccgcagaccagtggaagtggccgatttag

SEQ ID NO: 231915 - DNA, 351 bp, Artificial Sequence
  Description of Artificial Sequence: Synthetic coding sequence
atgccttaccgcgttggtcagacaacaggcttggttggcttggcggtttgtaataccccccacgaaagactcagaattctctacaccaaaatcttggatgtactggaggaaataccaaaaaacgctgcgtatcgcaagtacacagaacaaataacaaacgaaaaactcgccatggtgaaagccgaaccagacgttaaaaagctcgaggaccaactgcagggaggtcagctggaagaggtgattcttcaggccgagcatgaactgaatctggccagaaaaatgcgcgaatggaaactctgggagcccctggtagaggagcctccagccgaccagtggaaatggcctatatag

SEQ ID NO: 231916 - DNA, 465 bp, Artificial Sequence
  Description of Artificial Sequence: Synthetic coding sequence
atggggaaggacattcgaccgagatcagctagggcagcgtgcaagggcgtcggcctgtggagtggctgcttcggaaagatggcgggaagcggggttcggcaagccactagcacagcctccacattcgtgaaacccattttttccagggacatgaatgaggcgaagagacgggtaagagaactttaccgtgcctggtaccgcgaggtcccaaacacggtccatcagtttcaactggacattacggtgaagatgggtcgtgacaaggtgagggagatgtttatgaagaacgcgcatgttaccgatcctcgggttgtcgatcttctcgtcattaagggaaagatcgaactcgaggaaaccatcaaagtgtggaagcagagaacccacgtgatgcggttttttcacgagaccgaagcccctagaccaaaagatttcttgtctaagttctacgtcggccatgacccgtag

SEQ ID NO: 231917 - DNA, 342 bp, Artificial Sequence
  Description of Artificial Sequence: Synthetic coding sequence
atggctagcgcaacacgactgattcagcgtcttcgcaactgggcgtccgggcacgatttacagggcaagctgcagctccgttaccaggaaatatcaaaacggactcagcctcctccaaagcttcccgtgggcccatctcacaaactttcaaataactactactgcacaagggatggccgaagggaatcggttccaccctctattattatgagttctcagaaggccctggtttccggaaaacccgctgaaagctccgccgtcgcagctactgagaaaaaggccgttacccctgcccctcccatcaagcgctgggagctcagttcagatcagccttacttgtag

SEQ ID NO: 231918 - DNA, 519 bp, Artificial Sequence
  Description of Artificial Sequence: Synthetic coding sequence
atgccaggtatcgtggagctccccaccctcgaagaactcaaagtggacgaggttaaaatttctagcgctgtgttgaaagcggctgcccatcactatggcgcacagtgtgacaaaccaaataaggagtttatgttgtgtaggtgggaggaaaaggatccgaggaggtgccttgaagaaggaaagctagttaataagtgcgccctggacttcttccggcagatcaaaagacattgcgccgaaccatttaccgaatactggacgtgcattgattacactggccaacagctctttaggcattgtcgtaagcaacaagccaagtttgatgaatgcgtcctggacaaactaggctgggtcagacctgacctcggagagctctctaaggtaacaaaagtaaagacagaccgcccactccccgagaacccataccactccagaccacgaccagatccaagtcccgagattgaaggcgaccttcagcctgccacccacggctcacgattttacttctggaccaaatag

SEQ ID NO: 231919 - DNA, 387 bp, Artificial Sequence
  Description of Artificial Sequence: Synthetic coding sequence
atgcccggaatcgtggagctgcccaccctggaggaactgaaagtggatgaggtcaagatctcatctgccgttctgaaagctgcagcacaccattatggcgctcagtgcgacaaacctaacaaggaatttatgttatgcaggtgggaggagaaggatcctagaaggtgtctggaggagggaaagttggtgaacaaatgtgccctggacttcttccgccaaatcaaacgccactgcgcagagcctttcactgaatattggacctgtatagactatacaggacagcagctgtttagacactgtcgtaaacagcaagccaaatttgacgaatgcgtgctagataaactagggtgggtcagacctgatcttggggaactatccaaaggatag

SEQ ID NO: 231920 - DNA, 1134 bp, Artificial Sequence
  Description of Artificial Sequence: Synthetic coding sequence
atggccgctgctgctcagtcgcgggtagtgcgagtgttaagcatgagtcggagtgccataaccgcgattgctacgtctgtctgtcacggaccgccttgccgccagctccatcatgcgctgatgccacatgggaagggaggtaggagcagcgtttccgggattgtcgctaccgtttttggcgcaacaggcttcttggggagatacgtcgtgaatcaccttggaaggatggggtctcaagtaatcataccttatcgttgtgataaatacgacatcatgcacctgagaccaatgggggatctgggtcaattactgttcctggaatgggatgctcgggataaggacagtatacgaagagtggtccagcactcgaacgtagttattaatttgatcgggcgagattgggagaccaaaaattttgatttcgaagacgtgttcgtgaaaattccgcaggcaattgcgcagctctccaaggaagcgggagtggaaaagtttatccatgtgtctcatttaaatgctaacatcaaaagctcgtctcgatatctgagaaataaagccgtcggtgaaaaggtggtgcgggatgcctttcccgaggctatcatagtgaaaccgtccgatatctttggtcgcgaagacaggttcctaaatagctttgcttctatgcatagattcggccctatcccgcttggatcgctggggtggaagaccgtcaaacaacctgtttacgtggtggacgtgtcaaaaggaatcgtcaacgccgtgaaagacccggacgctaatggaaagagttttgctttcgtgggaccctccagatacctgttgttccatctagtgaagtatatttttgcagtggcccacaggctgtttctgccattccccctccctctgttcgcctatagatgggtggccagggtgttcgaaataagcccgttcgaaccgtggattacacgggacaaggtcgagagaatgcatattaccgacatgaagctcccacatcttcctggcctggaagatcttgggatccaggcgacgcctttggagctgaaggcgatcgaggttctacggcgtcataggacctatcggtggctaagtgccgaaatagaggatgtcaagcccgcaaaaactgtgaacatctag

SEQ ID NO: 231921 - DNA, 984 bp, Artificial Sequence
  Description of Artificial Sequence: Synthetic coding sequence
atggccttggtgcacaagttgttgagagggacttattttctgaggaaattttctaaaccaactagcgcgttgtaccccttcctcggcattcggttcgccgagtactccagctcactgcagaaacctgtggcatcgcccggaaaagcatccagtcagcgtaagacagagggcgaccttcaaggggaccaccagaaggaggtggcattggatattacgtctagcgaagagaaacctgacgtttccttcgataaggccatccgggacgaagctatctaccatttccgattactgaaagatgaaatcgttgatcactggcggggacccgagggccatcctctgcatgaagtattgctagagcaagcgaaagtcgtatggcagtttcggggaaaggaggatctggataaatggaccgtgaccagcgacaagacaataggtggacggtcagaagtattcctcaagatggggaaaaacaaccagtctgctctcctttacggcacactgagctctgaagcaccacaggacggagagagcacgcgcagcggctattgtgcgatgatcagcagaatacctagaggcgcatttgagcgcaaaatgagctatgattggagccagttcaacacgctgtacctgagggtccgtggagatggcaggccgtggatggtgaacatcaaagaggataccgattttttccagcgtactaaccagatgtattcgtactttatgttcactcgaggtggcccttactggcaggaagtcaaaattcccttttcaaagttcttcttttctaatcgtggaaggatcagggacgtgcagcatgagctgcccctggacaagatttcgagcataggcttcacccttgcagacaaggtggacggacccttctttctggaaatcgactttatcggtgtattcactgacccagcacataccgaggagttcgcgtacgagaactctcctgagctgaatccccgacttttcaagtag

SEQ ID NO: 231922 - DNA, 576 bp, Artificial Sequence
  Description of Artificial Sequence: Synthetic coding sequence
atggccctggttcacaagctgctgcgaggcacgtatttcctccggaaattctccaaacctacgagcgccctttacccgttcttgggcatcaggtttgccgaatacagctcatccttacagaaacctgtggcatcaccaggaaaagcatcctcacaaagaaagacggagggagacttgcagggagaccatcaaaaagaagtcgcactggacattacctcctcagaggaaaagccggacgtttcctttgataaggccattagggatgaagccatttaccatttcaggctgctcaaagatgagatagtggaccactggcgtgggcctgagggtcatcctttgcacgaggtgctcctggagcaagcaaaagtcgtctggcagttccgaggaaaggaggatctcgataaatggacggtaacgagcgacaagacaattggtggaagatctgaagtgtttctaaagatggggaagaataatcagagtgccctattatacgggacactgtcgagtgaagccccacaggatggagagagtacccggagcggatactgtgcgatgatttctcgtatccctagatag

SEQ ID NO: 231923 - DNA, 630 bp, Artificial Sequence
  Description of Artificial Sequence: Synthetic coding sequence
atggcgctggttcacaaattgttacgtggtacgtacttccttcggaaattttccaagcccacttcagcactgtatccgtttctgggcatacgtttcgctgaatactcatccagtctgcagaagcccgtagccagccctgggaaggcatccagtcaacgaaagaccgaaggtgatcttcagggcgaccaccagaaagaagttgccctagatattaccagctcagaggaaaaacctgatgttagctttgacaaagcgattcgcgatgaggcaatataccattttcggctgctgaaagacgagattgtggatcactggagggggcctgagggtcatcctcttcatgaggttctgttagaacaagccaaagtcgtttggcaatttaggggcaaggaggatttggataagtggacagtcactagtgacaagaccatcggtggaaggtctgaagtttttctcaaaatgggaaaaaacaaccagagtgccctgctatacggcacgctcagtagtgaggcccctcaggacggggagtcaactaggtcggggtactgcgctatgatatctcgaatcccccgaggtgcctttgagagaaagatgtcttatgattggtcccaattcaacaccctttattag

SEQ ID NO: 231924 - DNA, 510 bp, Artificial Sequence
  Description of Artificial Sequence: Synthetic coding sequence
atgggctggtcccaggatctgtttagggctctgtggcgctccctgtcacgagaggtgaaggagcacgtgggtacagatcagttcgggaacaagtactattacatcccccagtacaaaaactggcgcggacagacaatccgcgagaagcggatcgtcgaggccgctaataaaaaggaggtggattatgaggcaggcgatatcccgacggaatgggaagcttggattcggcgaacccggaagacccctcccacaatggaggagatcctgaagaatgaaaagcatagggaagaaataaagatcaagtcccaggacttttacgagaaggagaaattactcagtaaagaaacctccgaggaactgctgccgccaccagtgcagacccaaattaaagggcatgcatccgcaccttacttcgggaaagaagagccatccgtcgctcccagctccactggcaaaactttccagcccggtagctggatgcctcgagacggaaagtctcacaatcagtag

SEQ ID NO: 231925 - DNA, 384 bp, Artificial Sequence
  Description of Artificial Sequence: Synthetic coding sequence
atgtatatcgacagctataacagccgtggatttatgattaatggcaatagggttcttggtccttgcgccctactcccccattcggtcgtccaatggaacgtcggatcccaccaagacataaccgaagactctttcagcttattctggctattagagccaagaatcgagattgttgtcgtgggtaccggagatcgtaccgagaggttacaaagccaagtcttgcaggccatgcgacagaggggcattgccgtcgaagtgcaggacaccccaaacgcctgtgcaactttcaacttcctgtgccacgaggggagagtgacaggggctgctctgataccccctcccggtggaacctcgctcacaagcctgggacaagcggctcagtag

SEQ ID NO: 231926 - DNA, 555 bp, Artificial Sequence
  Description of Artificial Sequence: Synthetic coding sequence
atggccacagccttagcactgagatctctgtaccgtgctaggcctagcttgcgttgtccacctgtcgaactcccgtgggcccctcgccgtggccacaggctgtcaccagccgatgacgaactctaccaacggaccagaatttcactgctccaaagggaggctgcacaagcaatgtatatcgactcatacaattccagggggtttatgattaacgggaatcgggttctgggtccttgcgctctgttgccgcatagtgtggttcagtggaatgtaggctcacatcaggatattacggaagactctttcagcctgttctggctgctcgaacctcgaattgagatcgttgtggtgggaaccggcgatcggactgaacggctgcagtcccaggtcctccaggccatgcgacagagggggatcgcggttgaagtacaagatacacccaatgcatgcgccaccttcaatttcctgtgccatgaaggccgagtgacaggcgctgctctaattccaccaccaggcggtacctccctcactagccttggccaagcagcacagtag

SEQ ID NO: 231927 - DNA, 384 bp, Artificial Sequence
  Description of Artificial Sequence: Synthetic coding sequence
atgtatatagattcctacaacagccgcggatttatgataaatggaaaccgcgtccttggtccatgtgccttgctgccgcacagtgttgtacaatggaatgtaggatcccatcaggacatcactgaggattcattcagcctattttggcttttagagccgagaatcgagattgtcgtggtaggcacgggtgatcgcacagaacgccttcagagtcaggttcttcaagcgatgcggcaacggggaatcgccgtcgaggtgcaggacacaccaaacgcctgtgccacgttcaacttcctgtgccatgaggggagggtaaccggcgctgccctgattcccccacccggtggtaccagcctgacatcgcttggacaggccgctcagtag

SEQ ID NO: 231928 - DNA, 384 bp, Artificial Sequence
  Description of Artificial Sequence: Synthetic coding sequence
atgtacattgatagctataactcaaggggcttcatgataaatggaaatagagttctgggcccatgtgcactcctgccccattcggtcgtgcagtggaatgtcggatctcaccaggacattaccgaggattcgttttctctattctggctcctggaaccacgtatagaaatcgtcgtggtgggcaccggggatagaaccgagagactccagagtcaggtgctgcaagcaatgaggcagcgaggaatagccgttgaggtccaggacacgcccaatgcatgcgctaccttcaacttcctgtgtcacgagggcagggtgaccggcgcagcactgattccccctccaggcggaaccagcctgacgtcccttggtcaggcagcccagtag

SEQ ID NO: 231929 - DNA, 528 bp, Artificial Sequence
  Description of Artificial Sequence: Synthetic coding sequence
atgggcgctctggtcattcgaggcatacggaatttcaatctggaaaacagagctgaaagagaaatttcaaagatgaaaccttctgtggcacctaggcacccctccactaactccttattgcgcgagcagatatcgctgtatcccgaagttaaaggggagatagccaggaaagatgagaagctactgtcgtttctgaaggacgtctacgtcgactcaaaggaccctgtgtctagcctgcaagtcaaggcggctgagacctgccaggagccgaaagagttccgtctgcctaaggaccatcacttcgacatgataaatatcaaatctattcccaagggcaagatctctatagtcgaagcccttacattactgaacaaccacaagctgttccctgaaacttggaccgccgaaaaaatcatgcaggagtatcaacttgagcagaaggatgtcaacagcttgctaaagtactttgtaacctttgaggttgaaatttttccgcctgaggacaagaaggccatccgatctaagtag

SEQ ID NO: 231930 - DNA, 519 bp, Artificial Sequence
  Description of Artificial Sequence: Synthetic coding sequence
atgccagactcttgggataaggacgtttatcctgaacctcctcgcaggactcccgtacagcctaacccaatagtgtatatgatgaaggcgttcgatctgatcgtggacaggcccgttactctggtgcgggagtttatcgaacgtcaacacgccaagaaccgttattactactatcacagacagtacaggcgtgtacctgacatcactgagtgcaaggaagaggacattatgtgcatgtacgaggctgaaatgcagtggaagcgcgactacaaggtcgaccaagagatcatcaatattatgcaggatagacttaaggcatgccagcagagggaaggtcagaactatcagcagaactgcataaaagaagtcgaacaattcacacaagttgccaaagcctaccaggacaggtatcaggacctgggcgcttactctagcgcaagaaaatgtttggcaaagcagaggcaacggatgctccaggagaggaaggccgcaaaagaggccgcagctgctacttcctag

SEQ ID NO: 231931 - DNA, 507 bp, Artificial Sequence
  Description of Artificial Sequence: Synthetic coding sequence
atgccagatagctgggacaaagacgtatatcccgaacctccaagacggacgccagtccaacccaaccccattgtgtatatgatgaaagccttcgacttgatcgttgatcgtcccgtgacactagtgcgagaatttattgagcgccagcacgccaagaatcggtattattactaccaccgtcaatacaggagggtaccagatatcaccgagtgcaaggaggaagacattatgtgcatgtacgaggcagagatgcagtggaaaagagattacaaagtggatcaggaaataattaacatcatgcaggaccgactgaaggcatgtcaacagcgggagggacagaattaccaacagaattgcataaaggaggtggaacagtttactcaggttgcaaaagcttaccaggaccgatgtgcttgccccacgcaccctcaacctccaaccattctcttacgccctggaggccagaatcactgcaagagttcccttccatcccttgtccttacatag

SEQ ID NO: 231932 - DNA, 492 bp, Artificial Sequence
  Description of Artificial Sequence: Synthetic coding sequence
atggccgctgggctgttcggactttctgccagacgattgctggccgctgctgccacgaggggcttgcccgcagctcgagtgcggtgggagagctctttttctcgcaccgtcgtggcaccttcagcggtggcgggaaagagacctcccgaaccaactacgccctggcaagaagatccggagcccgaggacgaaaatctatacgagaaaaacccagactctcatggctacgataaggatccagtactggacgtatggaatatgcgactggtatttttctttggagtgagcatcatcttagttttggggagtactttcgtggcatacttaccagattataggtgtactggatgtccacgcgcatgggacggcatgaaagaatggagcaggagggaggcggagcgtcttgtgaagtatcgagaagcgaatgggctgcctattatggaaagcaattgctttgatccttctaaaattcaactccctgaagacgaatag

SEQ ID NO: 231933 - DNA, 462 bp, Artificial Sequence
  Description of Artificial Sequence: Synthetic coding sequence
atggccgctggcttattcggactgagtgcgaggcgtctgcttgccgctgctgccacccgcggactgccggcagctcgtgtgagatgggagtctagtttctcacggaccgtggtggcaccaagcgcagtcgccggaaagcggccacccgagcctactacaccgtggcaggaggatcctgaaccagaggacgagaacctctacgaaaagaatccagacagccatggctacgacaaggacccagtgttagacgtttggaatatgcgactggtgtttttcttcggggtcagtatcatcctggttctggggtcaacatttgtcgcgtacttgcccgattatagaatgaaggagtggtcacgcagagaagcagaaaggctggtgaaatacagggaagcaaatgggttgcccatcatggaatcaaattgctttgaccccagcaagatccaactacccgaagacgaatag

SEQ ID NO: 231934 - DNA, 474 bp, Artificial Sequence
  Description of Artificial Sequence: Synthetic coding sequence
gctgccccaagcgtgatggctgcaggactctttggcctatcagcccgacgcttactggccgcacgtcgcaggggccttccggcagcccgtgtgcggtgggaatcctccttcagtcggacggtggttgctccctctgccgttgccggtaagaggccaccggagccaactactccgtggcaagaggacccagagcctgaagacgaaaacctctacgagaagaacccagacagccatgggtacgacaaagaccctgtgttggacgtgtggaacatgcggttagtgtttttctttggggtctccattattctagtgctgggaagcacgttcgtcgcttatctgcctgactacagaatgaaggaatggtcacggagggaggcagagagactggtgaagtaccgggaagcaaatggtctgcccatcatggaatccaactgttttgacccctccaaaatccagctccccgaagacgaatag

SEQ ID NO: 231935 - DNA, 297 bp, Artificial Sequence
  Description of Artificial Sequence: Synthetic coding sequence
atggcccacgaacacgggcacgagcatggtcatcataagatggaactacccgattatcgacagtggaagattgagggaacccccttggaaacaatccaaaagaagttggccgcaaaagggctcagggatccttgggggaggaacgaagcctggcgttatatgggcggattcgctaaatccgtgtccttctcggatgtcttcttcaaaggctttaaatggggctttgccgcttttgtcgtggctgtgggggctgaatattatctggagagtctaaataaggacaaaaaacaccattag

SEQ ID NO: 231936 - DNA, 297 bp, Artificial Sequence
  Description of Artificial Sequence: Synthetic coding sequence
atggcccacgagcatggccacgaacatgggcatcacaaaatggagttgccagactatcgacagtggaagattgagggcactccattagaaacgattcaaaaaaagctggctgccaaaggcctcagagacccgtggggacggaacgaggcttggcgctacatgggcggattcgctaaatcagtctctttctctgatgtctttttcaagggcttcaagtggggatttgcagcattcgtggtggcagtaggcgcagaatactatctggaatccctcaacaaggacaaaaagcaccattag

SEQ ID NO: 231937 - DNA, 198 bp, Artificial Sequence
  Description of Artificial Sequence: Synthetic coding sequence
atggcccacgagcacgggcatgaacatggacatcacaagatggagctccctgattatcgccagtggaaaatagagggtacccccctggaaacaatccagaaaaaactggccgctaaaggtctgcgcgatccttgggggagaaacgaagcctggcgttatatgggcggattcgccaaatctgtgagtttttcagactag

SEQ ID NO: 231938 - DNA, 297 bp, Artificial Sequence
  Description of Artificial Sequence: Synthetic coding sequence
atggcccatgaacatggtcacgagcacggccaccacaaaatggaattaccagattatcgacagtggaagatagagggcaccccactggagacgatacagaaaaaactggcagccaaggggctccgggacccctgggggaggaatgaagcatggcgctatatgggaggatttgctaagtccgtcagcttctctgatgtcttcttcaagggctttaaatggggttttgccgcatttgtagtagctgttggtgccgagtattatctggagtccctcaataaagacaaaaaacatcactag

SEQ ID NO: 231939 - DNA, 741 bp, Artificial Sequence
  Description of Artificial Sequence: Synthetic coding sequence
atgaccacgggggattgctgccacttgcctgggtccctgtgcgactgctccggctctccggctttctcaaaggtggtggaggctaccgggttggggcctccgcaatacgtagcacaagtgacatcacgtgatggcagactgctgtcaactgtaatcagggctcttgacacaccgagtgatggcccattttgcaggatctgtcacgagggagctaatggggagtgcctgctgtccccttgcggctgcacagggacactaggagcagtccacaaatcctgcctggaaaagtggctctcaagttctaacacttcatattgtgagttgtgtcataccgaattcgccgtggagaaacgacctagacctctaaccgaatggttaaaagaccctgggcctcggacagaaaagcgcaccttgtgctgtgacatggtctgttttctttttatcactcctctagcagctattagcggatggttgtgcttgagaggcgctcaggatcatttgcggctgcattcccagcttgaggccgtcggcctgattgctttgaccatcgcattgttcaccatctacgttctgtggacactggtgagtttccgatatcactgtcagttatattctgagtggaggaaaaccaaccagaaggttcgactcaaaattagagaggccgactcaccagagggcccacaacactcacctctggccgctggactcctgaagaaggtggccgaagagacgcccgtttag

SEQ ID NO: 231940 - DNA, 561 bp, Artificial Sequence
  Description of Artificial Sequence: Synthetic coding sequence
atggccgtggccagagccggagtcctgggcgtgcaatggctccagcgcgcaagcagaaacgtaatgcctctgggggcaagaaccgcatcacatatgactaaggatatgttcccagggccatacccccgtacccccgaggaaagggcagctgctgcgaaaaagtataatatgcgcgtggaggactacgaaccatacccagatgacggcatggggtatggagactaccccaagttgccggatagatcacaacacgaacgcgacccctggtatagttgggaccagcctggtctacggttgaattggggggaaccaatgcactggcatttagatatgtacaacaggaaccgtgtagatacaagtcccactccagtgtcctggcacgtcatgtgcatgcagctgtttggattcctggcctttatgattttcatgtgttgggtaggagatgtgtacccagtctaccagcccgttgggcctaaacaatacccatacaataacctgtatctggaaaggggtggggacccaagcaaggagcccgagagggtcgtgcactacgagatttag

SEQ ID NO: 231941 - DNA, 519 bp, Artificial Sequence
  Description of Artificial Sequence: Synthetic coding sequence
atggcagtcgccagggcgggagtcctaggcgtgcaatggctacaacgcgcaagcagaaacgtgatgcccttaggggcaagaacagcttcccatatgacaaaggacatgttcccagggccttaccctagaacccctgaggaacgggctgccgctgccaaaaaatacaatatgcgcgtggaggattacgagccctaccctgatgacggcatgggatatggtgactaccccaagctccctgaccgcagccagcacgaacgcgatccatggtattcatgggatcagccaggattgcgcttgaattggggcgagccaatgcactggcatctggacatgtataaccgtaatcgggtcgacacctccccgacacctgtgagctggcacgtgatgtgtatgcagctcttcggttttttagcatttatgatctttatgtgctgggtgggagacgtctaccctgtctatcaaccagtatgtcgtcaccactttagttataatctgggattcctcagtgctctggggtag

SEQ ID NO: 231942 - DNA, 468 bp, Artificial Sequence
  Description of Artificial Sequence: Synthetic coding sequence
atgactaaggacatgttccctggcccttacccacggacccccgaggaaagagccgcagcggctaagaagtacaatatgagagttgaggactacgaaccctatcccgacgacggaatgggctatggggactacccgaagcttccagaccggtcccagcatgaaagggacccttggtacagttgggatcagcccggactgcggcttaattggggtgaacccatgcactggcaccttgacatgtacaataggaacagagtagacacgagccccactcctgtgagctggcacgtgatgtgcatgcagttgttcggatttctggcgttcatgatattcatgtgttgggtgggagacgtctatccagtgtaccagccggtgggacccaagcaatacccgtacaataatttgtacctagaaagggggggtgacccgtccaaggagccagagagggtggtgcattacgaaatctag

SEQ ID NO: 231943 - DNA, 519 bp, Artificial Sequence
  Description of Artificial Sequence: Synthetic coding sequence
atggctgtggctagggccggagtgctgggagtgcagtggctgcagcgggctagcaggaatgtcatgccccttggggcacgaacagccagtcacatgacgaaagacatgttccctggcccataccccagaactcctgaggagcgcgctgctgccgctaaaaagtacaacatgcgcgtggaagattatgaaccctaccccgacgacggcatgggatatggcgattatcccaaactgcctgatcggtctcaacatgaacgggacccatggtactcttgggatcagcccggattaagacttaactggggtgaaccaatgcactggcatctcgatatgtataacagaaatagggtggacacatcccccacccccgtgtcatggcacgtcatgtgtatgcagctgtttggatttctggcctttatgattttcatgtgctgggtgggcgacgtgtacccagtttatcaacccgtttgccggcaccatttctcatataatttaggcttcctgagtgccttgggctag

SEQ ID NO: 231944 - DNA, 540 bp, Artificial Sequence
  Description of Artificial Sequence: Synthetic coding sequence
atggcgttcctcgcctctggcccatatcttacccaccagcagaaagtcctgagactttacaaaagagcgctgcgccacctcgaatcctggtgtgtccaaagggacaaataccggtactttgcctgtttgatgagggctcgcttcgaggaacataagaatgagaaggatatggcaaaggccacccagttgctgaaggaggccgaggaagaattttggtaccgccagcacccgcaaccatatatctttcccgattcaccgggtggaactagttacgaaaggtatgattgttataaagtgcccgaatggtgtttagacgattggcatccttctgaaaaagccatgtaccccgactacttcgccaaaagggagcagtggaagaaactgcgcagagagtcatgggagcgggaggtgaaacagctgcaggaagagacaccaccgggaggtccactgaccgaagcgcttccgcctgcgagaaaggagggcgaccttcctcctctgtggtggtatatagtaacgagaccacgggagcggccaatgtag

SEQ ID NO: 231945 - DNA, 471 bp, Artificial Sequence
  Description of Artificial Sequence: Synthetic coding sequence
atggccagccgagtactgtcagcatatgtcagtagactcccagctgctttcgctcctctccccagggtcaggatgttagccgtcgccagaccattgtccacagctctgtgcagcgcaggcacacaaacccggttggggactctccaaccggctcttgtgcttgcgcaggtgcccggacgggtgacacagctctgccggcagtactctgatatgcccccacttactttagaaggaatccaggatcgcgtcctttatgtactgaagctttatgataagatcgatcccgagaaactctctgtgaatagccactttatgaaagacctcggcctggatagtctggatcaagtggaaatcattatggccatggaagatgaatttgggtttgagattccagacattgacgccgagaagctgatgtgcccgcaggagatcgttgactacatcgctgacaagaaggacgtctatgagtag

SEQ ID NO: 231946 - DNA, 231 bp, Artificial Sequence
  Description of Artificial Sequence: Synthetic coding sequence
atggccccatcagccctcctcaggccactctcacggctgctagcacccgctcgcttgcccagcggcccttccgtgcggtccaaattctatgtgcgcgagcctcctaacgctaagccagattggctgaaagtgggcttcactttgggcaccaccgtattcctgtggatctatttgattaagcagcataacgaagatatccttgaatataaacggaggaatggacttgagtag

SEQ ID NO: 231947 - DNA, 231 bp, Artificial Sequence
  Description of Artificial Sequence: Synthetic coding sequence
atggccccttcagccctactgcgccctctctcaagactattagcgccagccaggctgccttccggtcccagcgttcgctcaaaattttacgtgcgtgaacctcccaatgctaagccagactggctcaaagtggggttcacgctcgggaccacagtctttctctggatctacctcatcaagcagcacaatgaagacatcctggaatataagcgcaggaatgggctggaatag

SEQ ID NO: 231948 - DNA, 231 bp, Artificial Sequence
  Description of Artificial Sequence: Synthetic coding sequence
atggcacccagcgctttattgagacccctatctagactactggctccggctcgactcccaagtggccctagcgtaagatccaagttctacgtcagagagcctccaaacgctaaaccggattggctgaaggtaggcttcaccctgggtactacagtgtttctctggatctatttgattaaacagcacaatgaggatattctggagtataaaaggagaaatggtctggaatag

SEQ ID NO: 231949 - DNA, 231 bp, Artificial Sequence
  Description of Artificial Sequence: Synthetic coding sequence
atggccccatctgctttactgagaccgctctcacgcctgctcgcacccgcaagacttccctccgggccatcggtcaggagcaagttctacgtcagagagcctcctaatgctaagcccgattggctgaaagtgggttttacactgggcactacggtcttcctatggatttatcttatcaagcagcacaatgaagacatactggagtacaagagacgcaatggcttggagtag

SEQ ID NO: 231950 - DNA, 231 bp, Artificial Sequence
  Description of Artificial Sequence: Synthetic coding sequence
atggcaccttctgcacttttacggcctctttcccgtctgctagccccagccagactgccatctggccctagcgtgaggtctaagttctatgtccgagaaccacccaatgccaaaccagattggctgaaagtcggattcactctcggaactactgtgtttctgtggatttatctgataaaacagcataacgaggatatcttggagtataagaggaggaacggccttgagtag

SEQ ID NO: 231951 - DNA, 231 bp, Artificial Sequence
  Description of Artificial Sequence: Synthetic coding sequence
atggctccctctgccctgctccggccattaagccgtttgctggcacctgcaaggctgccttccgggccatccgtaagatctaagttctacgttagagagcccccaaacgcaaaacctgactggctcaaggtgggatttaccctggggacgaccgtttttctgtggatatacctaatcaaacagcacaacgaggacattctggagtataagagacggaatggactggaatag

SEQ ID NO: 231952 - DNA, 231 bp, Artificial Sequence
  Description of Artificial Sequence: Synthetic coding sequence
atggctccttcagcactcctccgacccctcagccgcctcctggcgccagcacggctgccatcgggcccatccgtgagaagcaagttttacgtccgcgagcccccaaatgccaagccagattggcttaaggtgggctttacgcttgggactacagtttttctgtggatttatctaatcaaacagcataacgaggatatcctggaatacaagaggagaaacggactggagtag

SEQ ID NO: 231953 - DNA, 231 bp, Artificial Sequence
  Description of Artificial Sequence: Synthetic coding sequence
atggcacccagtgccttgctgaggccactaagtcgtctccttgcgcctgcaagactcccctccgggccttcggtgaggtccaagttctacgtccgggagcctcctaacgcaaagcccgattggcttaaggtgggctttaccctgggaaccaccgtcttcctgtggatctacctcataaaacaacacaatgaggacatcctcgaatacaagagacgtaacgggctcgagtag

SEQ ID NO: 231954 - DNA, 915 bp, Artificial Sequence
  Description of Artificial Sequence: Synthetic coding sequence
atgatctacaccatgaagaaggtccatgctctatgggcatcagtttgtctcctgttgaatctggccccagcacccctgaatgctgacagtgaagaggatgaagagcatactattataacagacaccgaattaccgcctctgaaactgatgcacagcttctgtgccttcaaagccgatgatggcccttgcaaggccatcatgaagagattctttttcaacatctttacaagacaatgtgaggaattcatctacgggggatgcgagggcaaccagaacaggtttgaatctcttgaagagtgcaagaaaatgtgtacgcgagacaacgcaaatcgcatcatcaaaacaactctgcagcaggagaaacctgatttctgctttctcgaagaagatccgggaatttgccgcggatacattaccaggtatttctataacaaccagactaaacagtgcgagcggtttaaatatggtggctgcctggggaatatgaataacttcgaaaccctcgaagagtgtaagaacatttgcgaggacgggccaaatggcttccaagtcgataactacggcacccagctgaacgcagtcaataattcgctgaccccccagtcaactaaggtgccgagtctgttcgaatttcacggcccatcctggtgcttaacccctgcggaccgcggattgtgtagggctaacgaaaatcgtttttattacaattctgtgattggaaagtgcaggccctttaagtactcaggatgcgggggtaacgaaaacaacttcacgtcaaagcaagaatgcctgcgggcttgtaagaaggggttcatccaaaggattagtaaagggggtctaatcaaaacaaagaggaagcgcaaaaagcagcgcgtcaaaatcgcctatgaggaaatcttcgtcaagaacatgtag

SEQ ID NO: 231955 - DNA, 2013 bp, Artificial Sequence
  Description of Artificial Sequence: Synthetic coding sequence
atgcaaatcccacggttctgctaccacgaaaggctaagcgtagccggtaactgtaggatgtgcctggtcgaaatagagaaagctcccaaggtggtcgccgcttgcgcaatgcctgtcatgaaggggtggaatatcctgaccaactccgaaaaatcgaagaaggcaagggagggcgtgatggaattccttctcgccaatcatccacttgattgtcctatctgtgaccaggggggtgagtgtgacctccaggatcagtctatgatgtttgggaatgacagatcccggtttttggagggaaaaagggccgtggaggacaagaacatcgggcctctggtcaaaaccattatgactcgctgtatccagtgtacccgctgcattaggtttgcaagtgagatagcaggggtcgacgacctcggaacaaccggaagaggaaatgacatgcaggtcggaacgtacattgagaagatgtttatgtcagagctatccgggaatatcatcgacatctgccctgtgggagccctgacctcaaaaccgtatgcgttcacggcgagaccatgggaaacccgcaagaccgagagtatcgacgttatggacgctgttgggtccaacattgtcgttagtactagaaccggcgaggtgatgcgcattctccctcgaatgcacgaggatattaacgaggagtggatatcagacaagacaaggttcgcctacgacgggcttaagcgacagcgcctaactgaacctatggttcgcaacgagaagggcctgctgacgtatacaagttgggaagacgctctttctagggttgctgggatgcttcaaagctttcagggtaaagacgttgcagccattgccggtgggttggtggacgctgaggcgcttgtggcactgaaggacttgcttaaccgcgttgactcagatacactatgcacagaggaggtattccccaccgcgggtgcaggcacggatttacgcagcaactacctcctgaataccaccatcgccggagtcgaagaggcagacgtagttctgctggttggcactaaccctagatttgaggcccctttgttcaatgcacggattcgcaagtcatggttgcataacgacctcaaggtcgccctgatcggctcccccgtcgatcttacctacacgtatgaccatctcggagactctcctaaaatactgcaggacatcgcctccggctcccaccctttctctcaggtgctgaaggaagctaagaaacctatggtggttctgggttccagcgcactccaacggaatgacggagctgccatcctggcagcagtctcaagcattgcccagaaaataagaatgaccagcggagttaccggtgactggaaggtgatgaacatactgcacagaatagcctcccaggtggcagctcttgatctgggatacaagcccggtgtggaggcaattcggaaaaacccacctaaggtactgtttttgctgggtgctgatggaggatgtatcacaagacaggacctgcccaaggactgtttcatcatctaccaggggcaccatggcgacgtgggggcacccatagccgacgttatcttaccaggggcagcttacaccgagaagagcgccacatacgttaacacagaaggtagggcacaacagacaaaagtggctgtcacaccccctggcctggccagggaagactggaagataatccgggctcttagcgaaattgcaggaatgacccttccttacgatacactggaccaagtgcgcaatcgcttggaagaagtctcaccgaatttggtgaggtacgacgatatagagggagccaattatttccagcaggctaatgagctctcaaaactcgtgaatcaacagcttctcgccgaccccctggtccccccacagttgactattaaagacttctatatgactgatagcatctctagagcttctcaaaccatggctaagtgtgtgaaagcagtaaccgagggagctcaggcggtcgaggaaccttctatctgttag

SEQ ID NO: 231956 - DNA, 1851 bp, Artificial Sequence
  Description of Artificial Sequence: Synthetic coding sequence
atgtgggaaggcgtcatggagtttctcctggcaaatcatccgttggattgcccgatctgcgaccaaggaggagaatgcgacctccaggatcagtccatgatgtttggaaacgacagatcccgcttccttgaagggaagagggccgtagaagataagaacataggtcccctcgttaagaccatcatgacccgttgtatccagtgcactcgctgcattcgattcgcgtcggagattgcgggagtggacgatctaggtacgactggcaggggaaatgacatgcaagtggggacgtacatagaaaagatgtttatgtccgaactcagcggcaacatcatagatatttgtcccgtcggggctctgacgtctaagccctatgcattcactgccagaccgtgggagacccgtaaaacggagtcaatcgacgtgatggacgccgtggggtcaaacattgtcgtgtcaacccgtacgggcgaagtgatgagaatcctgcccagaatgcatgaggatatcaatgaagaatggatttcagacaaaacccgctttgcttacgacgggctgaagaggcagaggctgaccgaacctatggtgcggaacgaaaaggggcttttgacttatacatcgtgggaagacgcactgagcagagtggcgggaatgctgcagagcttccagggtaaggacgtcgccgctatcgcgggtggactagtggatgcagaggccttagtagctctcaaagatttgctcaatcgcgtggacagcgacactctctgcaccgaggaagtgtttcctacagctggcgctgggaccgatctcagaagcaattatctccttaatactactatcgccggtgtggaagaggcagacgtcgtgctgctggtcggcaccaacccgcgtttcgaggcacccttatttaacgcgagaatccggaaatcatggctccacaacgatttgaaggtggccttaattggcagccctgtagatctgacctacacatacgatcatctcggtgactcccctaaaatcttgcaagacattgcttctggcagccaccccttcagccaagtgctgaaagaagcgaagaagccgatggtagtcttgggctctagtgccttgcagcggaacgacggcgcagcaatcctggccgcagtatcaagcatcgcacagaagatcaggatgactagcggggtgacaggcgactggaaggtgatgaacatccttcaccgcatagcttcccaggtcgctgctctagacctgggctacaaaccaggcgttgaagctatacgcaagaatccccctaaggtcttatttctgctaggggcagacggaggctgtatcacccggcaagatctgccgaaagattgcttcatcatatatcagggacaccacggagacgtgggagctccgattgccgacgtgatcctgcctggcgctgcctacactgagaagtctgcaacgtacgttaacacagagggcagggcccagcagacaaaggtcgctgttacacccccaggactcgctcgagaagattggaagattataagagcgctaagcgaaatcgcgggtatgacactaccgtacgatacacttgatcaggttcggaatcggctagaagaggtgagccctaacctggttcggtacgacgatatcgaaggggctaactacttccagcaggcgaatgagctctccaaacttgtgaaccaacaactgctcgctgacccactcgttccccctcaattaaccatcaaagacttctatatgacggactccattagcagggcttcccagaccatggctaaatgcgtgaaagccgttacagagggcgcacaggcagttgaggagccctctatatgttag

SEQ ID NO: 231957 - DNA, 2076 bp, Artificial Sequence
  Description of Artificial Sequence: Synthetic coding sequence
atgctgcgcatcccagttcgaaaggctcttgtgggcctcagcaaatcacccaaaggatgcgtgaggacaaccgcgacagccgcttcgaatctcatagaagtgtttgtcgacggccagtcagtgatggtcgagccaggcacaacagtactccaagtggtggcagcatgtgcaatgccagttatgaaaggctggaacattctgacaaactcagagaagtccaaaaaggccagggagggggttatggagttccttctggccaatcaccccctggactgcccgatctgcgaccagggtggcgagtgcgacctgcaggaccagtccatgatgttcgggaacgatcgctcaagattcctcgaagggaaaagagccgtcgaggataaaaatattggcccactagtcaagactattatgactcgatgcatccagtgtactcggtgtatcagattcgccagcgaaatcgctggcgtagatgacctgggcacaaccggcaggggaaacgatatgcaggtgggaacatacatagagaaaatgtttatgtctgagctgtccgggaacatcatagatatttgccctgtgggtgcgttaacttctaagccctacgcttttactgctcgcccatgggagactaggaaaactgagagcatagatgtgatggatgctgttggaagcaatatcgtggtgtccacccggacaggagaggtaatgcggatcctgcccagaatgcacgaagacatcaatgaggaatggatctcagataagacccgatttgcctatgatggtctcaagcggcagcggctcaccgagccaatggtccgaaacgaaaaggggctgctgacttatacctcatgggaagatgccttgagccgtgtggccggaatgctgcagtcttttcagggcaaagacgtcgccgcaatcgccggtggcctagttgacgctgaagccctggtggccctaaaggatttgcttaaccgagtagactctgacaccctgtgtactgaagaggtatttcctacagcaggcgcaggtacagaccttcggagtaattatcttttgaacaccaccatcgccggagttgaggaggccgacgttgtgctgctagtgggaacaaaccctagattcgaggcgcctctattcaatgctagaatccgaaaatcatggttgcacaatgatctgaaagtggccctcataggaagcccagtggacttaacatacacttacgaccatctgggcgatagcccaaagattttgcaggacattgcctcaggttcacatccattttcgcaagtgctaaaagaagccaagaaacccatggtcgtgttagggtcctcggccctgcagcggaatgacggcgctgctatcctggcggcagtgtctagcattgctcaaaaaatcaggatgaccagcggggtcacaggcgattggaaggtcatgaatattctccacaggattgccagtcaggtggctgctctcgacttgggatacaagcccggtgtggaggccatccggaaaaatcccccaaaagtgctctttttgctgggggcagacggcggttgcatcactagacaggatctgccgaaagattgcttcattatctaccagggccatcacggagatgttggggctccaatagctgatgtaatactgccaggggcagcttataccgaaaaaagtgctacatatgtgaatacggagggccgagcccagcagactaaggttgcagtcaccccccctggcttggccagggaagattggaaaattatcagagccctttctgagatcgcaggcatgacgctgccttacgacacactggatcaggtgcgaaacagactcgaggaagtgagcccaaatttggtgcggtatgatgatatcgagggagccaattacttccaacaggccaacgagctgtctaaactggtcaatcagcagcttttagccgaccctctcgtgcccccacaacttacaattaaggacttctatatgacggattctataagtagggcgtcccagacaatggcaaaatgcgttaaggccgttacagagggggcacaagcggtggaggaaccatccatctgctag

SEQ ID NO: 231958 - DNA, 2184 bp, Artificial Sequence
  Description of Artificial Sequence: Synthetic coding sequence
atgctaagaataccggtgcgaaaagctttggtcggcctgtcaaagtctccaaaggggtgcgtcagaacgactgccacagccgcaagcaatttgattgaagtgtttgtggacggccagtccgtgatggtggaacctgggactaccgtgctgcaagcctgcgaaaaggtcggaatgcagatcccccgtttctgttaccacgaacgcctgtctgtggctggcaactgcagaatgtgccttgtggagatcgaaaaagccccaaaagtggtcgctgcctgcgccatgcccgtgatgaagggatggaatatactgaccaatagcgagaaaagcaagaaagcgagagaaggagtcatggaatttttgttagcgaatcaccccctggattgccccatctgtgaccaggggggagaatgtgatctgcaggatcagtcaatgatgttcggtaatgacagatctagatttctcgagggcaaaagagctgtcgaggataagaacattggtccactggtcaagactatcatgactaggtgtatccagtgcacaaggtgcatcagatttgcatctgagattgccggagtggacgatctgggaaccacggggagaggcaacgacatgcaggtgggaacttatattgaaaaaatgttcatgtccgaattgtctggaaacataatagacatctgtccagtcggggcacttacaagtaagccctacgctttcaccgccagaccttgggagactagaaagacagaaagcatagacgtgatggacgccgtcggaagtaatatcgtggtatccaccagaacaggagaggtcatgagaatactgccccgtatgcacgaagatatcaacgaggaatggatttcagataagacccggttcgcctatgatggactcaagagacagagacttaccgaaccgatggttagaaacgaaaagggtttgctgacatacacctcttgggaagacgcattgtcccgcgtggccggaatgctgcaatctttccaggggaaggatgtcgccgcaatcgcgggaggactggtggatgctgaggccctggtggctctgaaggacctgctgaatcgggtggactccgatactctttgtacagaagaggtgtttccaactgccggagccggaactgatctgagatccaattatctactgaacactactatcgccggtgtagaagaagctgacgtggtactgctagtaggaacaaatccaaggtttgaagcacctctgtttaatgctcgcatacgcaagtcctggctgcataatgacctaaaggtcgcccttatagggagccctgtggacctgacatacacgtacgatcacctgggagatagcccgaaaatcctgcaggacatcgcctccggatcacatccattttctcaagtcttgaaagaggcgaaaaaacccatggtggtgctcggcagttcagctttacagcgcaacgatggggctgctatacttgccgcagtatcatccatagcacagaagatccggatgacatccggagtaactggggattggaaagtgatgaacatcttgcaccgcattgcaagtcaggtggccgcactggatcttggatataaaccaggggttgaggccattcggaagaaccctccaaaggttctgtttctcctcggggctgacgggggttgcattactcggcaggatctacctaaggactgctttataatttaccagggccatcacggcgacgtgggtgctccaatcgccgatgtaatactgcccggagcagcttatactgagaaaagtgcgacatatgtcaacactgaaggaagagcccagcaaacaaaggtggccgttacgccacccggattggccagggaagattggaaaatcattcgagccctcagcgagatagccggaatgacgctgccatacgatacactggaccaggtgcggaacagactcgaggaggtctcccctaacttggtccgttacgacgatattgagggcgcaaattacttccagcaggccaatgagttgtccaagctcgtgaaccagcagctgctggccgaccctttggtgcccccacaactgacaattaaggatttctacatgaccgactccattagccgcgcatcccaaactatggcgaaatgtgtcaaggccgtcacggagggcgcacaggcggtcgaagaacccagcatctgctag

SEQ ID NO: 231959 - DNA, 393 bp, Artificial Sequence
  Description of Artificial Sequence: Synthetic coding sequence
atgctgcgcatcccagtcagaaaagccttggttgggttgagtaagtcccccaaaggatgtgtgagaaccactgctacagcggcttcgaatttaattgaggtctttgttgacggacaatccgtgatggtggaacctgggactaccgtcctgcaggcttgcgaaaaggtgggcatgcagataccacggttttgttaccacgagcggctctccgtggctgggaactgtaggatgtgcctggttgagattgagaaagcacctaaggtcgtcgctgcctgcgccatgcctgtcatgaagggatggaacattctgaccaactcagagaaatcaaaaaaggccagggaaggcgtgatggaattcctgctggccaaccacccgctggattgccctatctag

SEQ ID NO: 231960 - DNA, 2226 bp, Artificial Sequence
  Description of Artificial Sequence: Synthetic coding sequence
atgcgtatacgcggtagctccggaacgttgagccgcataaatatgctaaggattccagttagaaaggcattagttggtttgagtaagtcaccaaaagggtgcgttcgaactaccgcgacagctgcctcaaacctgatcgaggtatttgtcgatggccagagcgttatggtcgagccagggaccaccgttttgcaggcgtgcgagaaggttggcatgcagatccctaggttctgttaccacgaaagactcagcgtggccggaaattgccggatgtgcctcgtggaaatcgagaaggcccctaaggttgtcgcagcctgtgccatgccagtgatgaagggctggaatatcttgactaactctgagaaatctaagaaagcacgagagggggtgatggagttcctcctggctaaccacccgctcgattgccccatttgtgatcaaggcggagagtgtgacctacaggatcagagtatgatgttcgggaacgatcgttctaggttcttggagggtaaaagggcagtggaagacaaaaacattgggccattagtcaagacaattatgaccagatgtatacaatgtacacgatgtattcgcttcgcaagtgaaatcgctggggtggatgacctagggaccacaggcagagggaacgacatgcaggtaggtacatatatagagaagatgttcatgtcagagctttctgggaatattatagacatctgtccagtgggcgcacttacatcaaagccttacgccttcaccgctagaccttgggagacgcggaaaaccgagtccatcgacgttatggacgcagtcgggtccaacatcgtcgtctctacgcgcaccggagaggtgatgcgaattctgccaaggatgcacgaggatattaatgaagagtggatcagcgacaaaacacgatttgcttatgatggcctgaaacggcaacgactgacagaaccgatggtgagaaatgagaagggattactgacatacacgtcttgggaagacgctctgtccagggtagccggaatgttacagtcgtttcagggaaaagatgttgcagcaattgccggaggactggtggacgcggaggctctggtggcattgaaggacctgttaaacagggtggactctgacacattatgcaccgaggaagtgttcccaaccgcgggtgcaggtactgacctgaggagtaactacctgctgaacacgaccatcgctggcgtggaggaggcagacgtagttctactcgtgggcacgaatcccaggtttgaggcaccactcttcaatgccagaatcaggaagagttggctccacaatgacctgaaggtggcactcattggatcaccggttgatcttacatacacatacgaccacttaggcgacagccctaagatcctccaggacattgcctcaggctctcaccccttcagccaggtgctgaaggaggcaaagaaacctatggtggtccttgggtcatccgctctgcagcggaacgatggggcagcaattctcgcggcagtttctagtatagcccagaaaataagaatgacttcaggtgttactggcgactggaaggtcatgaacatcctacacagaatcgcctcacaagtggccgctcttgatttgggatataaacccggtgtagaagcaattcgaaaaaaccctccgaaagtgctgtttctgctgggcgctgacggaggctgtattacccgacaggatttaccaaaggactgcttcatcatctaccaggggcaccacggcgatgttggagcgcctattgccgatgtcattctgcccggagccgcatacaccgagaagtcggccacctatgttaatacagagggcagggcccagcagacgaaggtggccgtgaccccgccagggctcgctcgcgaggattggaagattatcagagctctgtccgagatagctggaatgactctgccatacgatacattagaccaagtaagaaaccgactggaggaggtgtctcctaatctggtccggtacgacgatattgagggggcaaattattttcagcaggccaatgagctctctaagctggtgaaccaacagttgcttgcagatcctctggtgccgcctcagctaactattaaagacttctacatgacagattccatcagcagagctagtcaaactatggccaaatgtgtgaaggcagtgacagaaggcgcacaggcagttgaggagccttcgatatgctag

SEQ ID NO: 231961 - DNA, 1836 bp, Artificial Sequence
  Description of Artificial Sequence: Synthetic coding sequence
atggagttcttgctggcaaatcatcctctggactgccccatttgcgaccagggcggagagtgcgacctccaggaccagtccatgatgttcggaaacgatagatcccgattcttggagggaaagcgggcagtggaggacaagaacataggtccactggttaaaactattatgacgaggtgtatccagtgtacacgctgtattcgtttcgcttcggagatcgcgggagtggacgatttggggacaacaggacggggaaatgacatgcaagttggaacctacatcgaaaagatgtttatgtctgaactgtctggaaacatcattgatatttgcccggttggtgccttgactagcaaaccgtacgcctttaccgcccgtccctgggaaactcgaaagaccgagtccattgacgtgatggatgcagtggggagcaacatcgttgtctcaacccgcacgggtgaagtcatgcgcattttgccccgaatgcacgaagacatcaacgaagagtggatttccgataagacacggttcgcatatgatggccttaagaggcagaggctcacggagcctatggtgcgtaatgagaagggcttgcttacctatacatcgtgggaggacgctctttcccgagttgcaggcatgctgcagtcctttcaaggcaaggacgtggccgctatcgcagggggattggtggatgctgaggcactcgtcgctctgaaggatttactgaaccgagttgattccgacaccttatgtactgaggaggtattccctacggctggtgcgggtactgatctgcgatcaaattatttgctgaatacaacaatcgctggcgtggaggaagccgacgtagtacttttggtcggaacaaatccaaggtttgaagcgccactgttcaatgcacgcatacgaaagtcctggctccacaatgacctgaaggtcgcactgatcgggtctccagtggatctaacctacacgtatgatcacctcggcgatagcccgaaaatcctacaggatatcgcatccgggagccacccctttagtcaagtcctgaaggaggccaaaaagccaatggttgtcctaggctcttccgctcttcagcgcaatgatggagcagccattcttgcagccgtgagctcaatcgcccaaaaaatccgaatgacaagtggcgttacaggagattggaaggtgatgaacatcctgcaccggattgcatcacaggtcgctgctctggacctggggtacaagccgggagtggaggccatcagaaaaaatcctccaaaagttctcttcctattgggggctgatggcggatgcattacacgccaggatctgccaaaagactgcttcatcatttatcaggggcaccatggggacgtgggtgcaccaatcgcggatgtgatactgcctggagctgcctacactgaaaaaagtgcaacctacgtgaacacagaaggcagggcccagcagaccaaggtggctgtcacacctcccggactcgcccgagaggactggaagatcattagagcgctgtccgagatcgcaggcatgaccctgccttacgataccctggatcaggtccggaaccgcttggaggaggtatccccaaatctggttcgatacgatgatattgaaggcgctaactatttccagcaggccaacgagctgagtaagctggtgaaccaacaattgctggcagaccccttggttccccctcagttaacaatcaaggacttttatatgactgactctattagtcgagcttcacaaacaatggcaaagtgcgtgaaagccgtgactgaaggggctcaggctgtggaagagccgtctatctgctag

SEQ ID NO: 231962 - DNA, 1392 bp, Artificial Sequence
  Description of Artificial Sequence: Synthetic coding sequence
atggccgctctgcgcgcactttgcgggttccggggtgtggccgcacaggtactgcggcctggagccggagtccggttgcccattcaaccttcgcgcggtgtgagacagtggcagcctgacgtcgaatgggcccaacaattcggtggtgccgtgatgtatcccagcaaggagaccgcccattggaaaccgccaccatggaatgacgtcgatccgcctaaggacaccatagtgaagaacattaccctgaatttcggtcctcagcatcccgcagcgcacggggtgcttaggctcgtgatggagctgagcggggagatggttcgtaagtgcgatccccacattggactgctgcatcgcggaaccgaaaaattgatcgaatataaaacttatctgcaggccctgccctacttcgatcggctggactacgtgtcaatgatgtgcaatgaacaagcctattctctcgccgtggagaaactgcttaatattcgccctcctccacgagctcaatggatcagagtgttgtttggcgagattactcgcttgctcaatcacatcatggccgtgacaacacacgcacttgacttgggcgctatgacgcccttcttctggctcttcgaggagcgggaaaagatgtttgagttttatgaaagggtgtcgggggcacgcatgcacgctgcctacatccgtcctggcggtgtgcatcaggatctacctctcggcctcatggatgacatctaccagttcagcaagaatttttcgctccgtctcgacgagctggaggagctcctgacaaataatcgcatttggcgcaaccggaccatagatatcggagtggtgacggccgaggaagccctgaattacgggttctccggagttatgctgcggggatcaggaatccagtgggatctgcgcaagacacagccatatgatgtgtatgatcaggtcgaattcgacgtgcccgttggctccaggggtgattgttacgacaggtatctatgccgtgtcgaagagatgcgccaatccctccgcataattgcccagtgtttaaataaaatgcctccaggtgagattaaagtggacgatgccaaggtctccccgcctaaacgtgccgagatgaagacgagcatggaatctctgatccaccatttcaagctatacacggaaggataccaagtcccacctggcgctacatataccgccattgaggccccaaagggtgaatttggagtgtatctcgtgagcgatggctcatcacgaccttacagatgcaagattaaggctcccggatttgcgcatcttgctggactcgataagatgtccaaggggcacatgctggctgatgtagttgccataataggtactcaggatatagtctttggcgaggtcgatcggtag

SEQ ID NO: 231963 - DNA, 1374 bp, Artificial Sequence
  Description of Artificial Sequence: Synthetic coding sequence
atggctgcacttagggcattgtgtgggttccgaggcgtggccgcacaggtgctgcgcccaggcgcaggcgtgcgcttaccaatccagcccagcaggggcgtgcgccaatggcaacccgatgtggagtgggctcagcagttcggtggagcggtgatgtatccaagcaaggagaccgctcattggaaaccaccaccttggaatgatgtagatcctcccaaggatacgatcgtcaagaatattacactgaatttcggcccacagcaccctgccgcacacggggtgctcaggctagtgatggaactttccggtgaaatggtccggaaatgtgacccccatatcggcctcctgcacagaggaacagaaaagctgatagaatacaaaacatacctccaagctctcccctactttgacaggctggattatgttagcatgatgtgtaacgagcaggcatactcactggctgtggagaagctcttgaacatccggccacctcctcgagcacaatggatacgcgttctctttggcgaaatcactaggctgctgaatcatattatggcagtcactactcatgcccttgacttaggcgctatgacacctttcttctggctgttcgaagaacgtgaaaagatgtttgaattttacgaaagggtgtccggcgcaagaatgcacgccgcatatatccggccaggtggcgtgcaccaggacctgccattaggcctgatggatgacatctatcagttcagcaagaattttagcctgcgcctagacgaactggaagagttgctgacaaataatagaatttggcggaaccggactatcgacattggagtagtcaccgctgaggaggccctaaattacgggttctccggggtgatgttaagaggttctggcatccagtgggacttgcgtaagacacagccctacgatgtgtatgatcaagtggagttcgacgttccagtcggctcgagaggtgactgttatgaccgctacctatgtagggtcgaggagatgcgccagtctctacggattatcgctcagtgcctgaataaaatgccgccaggcgagataaaagtcgatgacgcaaaagtgtcacccccaaagagagctgagatgaaaacttctatggagagtctgattcaccactttaagctgtacacagaagggtatcaagtgccccctggcgctacttacacagccatcgaggcacctaaaggcgaatttggcgtctacctcgtgagcgacggaagctcccgaccatacagatgcaaaatcaaggcccctggcttcgcccacttagccggtctggacaaaatgagtaaagggcacatgctggccgacgttgtcgcgatcattggaaccagacccatcgtgtag

SEQ ID NO: 231964 - DNA, 696 bp, Artificial Sequence
  Description of Artificial Sequence: Synthetic coding sequence
atggaactgtccggcgagatggtgcgcaaatgcgacccccatatcgggctgctgcatagaggaaccgagaagcttattgagtataagacctacctgcaggccctgccctattttgatcgcctggactacgtgagcatgatgtgtaacgaacaggcatacagcttggcggtggagaagttactgaacatcaggcccccaccacgagcacagtggattcgcgtgctctttggcgagataactcgtcttctgaaccatattatggcggtgacaacacacgcccttgacctaggcgcaatgacaccgttcttctggctcttcgaagagagggagaagatgtttgaattttacgagcgtgtgagtggcgcacgaatgcacgctgcctacatcagaccgggaggggtccatcaggaccttccattgggtttgatggacgatatataccagttttcaaagaacttttctctacggctcgatgaactcgaagaactgttgactaacaatcggatatggaggaacagaaccattgatatcggagtggtcacagccgaagaggcgcttaattacggtttctcgggagttatgctccggggttccggcatccagtgggacctgaggaagacccagccatacgacgtatacgatcaagtggagttcgatgtaccagttggttctagaggggattgctacgatcgctag

SEQ ID NO: 231965 - DNA, 162 bp, Artificial Sequence
  Description of Artificial Sequence: Synthetic coding sequence
atgtttgaattttacgagagggtgtctggtgctcggatgcatgcggcatatataaggcctggaggggtccaccaagacctgccactcgggctgatggacgatatctaccagttcagtaagaactttagtctccgcttggatgagctggaagaggtgagctag

SEQ ID NO: 231966 - DNA, 795 bp, Artificial Sequence
  Description of Artificial Sequence: Synthetic coding sequence
atggcagctgccgctgtagctcgtctgtggtggcgaggcattttgggagccagtgccttgacacggggaaccggaaggccctctgtgctcctgctgcctgtccgacgggaaagcgctggggctgacaccaggcccaccgtcagacctaggaacgatgtggcccataaacaactatcagcatttggtgagtacgtggcagagattctgcccaaatacgtgcagcaggtgcaggtgagctgcttcaacgagctggaggtctgtatccatccagatggcgtcattcctgtactgaccttcctgcgcgaccacacgaacgcccaattcaagtccctggtggacctgaccgcagttgatgtgcccactagacaaaacagattcgaaattgtgtacaacctcctgtcactgagatttaactccaggatcagggtgaagacatacactgatgagctgacccctatcgaatcggctgtcagtgtgttcaaggctgcgaactggtacgagagggagatttgggacatgtttggggtcttttttgccaaccatcccgacctacgacgcatcctcacagattacggctttgaaggccaccccttcaggaaggatttcccgctgtctggttacgtcgagctccggtatgacgacgaagtgaaacgagtcgtcgcagaaccagtggaactagctcaggaatttcgtaagttcgacctgaactccccttgggaggccttcccagtctaccgacagcctcccgagtccttaaagctggaggctggcgacaagaagccagatgcaaagtag

SEQ ID NO: 231967 - DNA, 528 bp, Artificial Sequence
  Description of Artificial Sequence: Synthetic coding sequence
atggcggctgtgtccatgtcagtggtactcaggcagaccctctggcgccgtcgagccgtcgcagtggccgcattgagcgtgtcacgcgttcccacgagatctctacgcacaagtacctggcggttggcacaagaccagacacaggatacccaacttatcacagtggacgagaaattggacattaccacactcacaggcgttcctgaggagcacatcaaaacccgcaaggtgcgaatctttgtgccggctcgtaacaatatgcagtctggcgttaacaacaccaaaaagtggaagatggaattcgataccagagaaaggtgggaaaatccactgatggggtgggccagtaccgctgatcccctctccaacatggtgcttacattctctaccaaagaagatgctgtgtccttcgcagagaagaacggatggtcttatgacattgaagaacgtaaagtgcccaagccaaaaagcaagagctatggcgctaacttttcttggaacaagcgcacccgcgtgtcaaccaaatag

SEQ ID NO: 231968 - DNA, 321 bp, Artificial Sequence
  Description of Artificial Sequence: Synthetic coding sequence
atgcctttccttgatatccagaagagatttggcctgaacattgacaggtggctaaccatccagtccggtgagcagccatataaaatggccggaaggtgccacgcatttgaaaaagagtggatagaatgcgcacatggaatcggctacacgagggcagaaaaggaatgtaagattgagtacgatgacttcgtcgaatgccttttacgtcagaaaaccatgcgacgcgctggaacaatacgcaaacagcgggacaagcttattaaagaaggtaaatacactccaccacctcaccatatcgggaagggggagcccagaccttag

SEQ ID NO: 231969 - DNA, 321 bp, Artificial Sequence
  Description of Artificial Sequence: Synthetic coding sequence
atgccatttctggatattcagaaaagatttggcttgaatattgataggtggctgaccattcagtcaggagagcagccttacaaaatggccggacgttgccacgccttcgaaaaggagtggatagaatgcgcccacggaatcggctacaccagggcagagaaggaatgcaaaatagaatatgacgactttgtggagtgtctgctcaggcagaagacgatgcgcagggctgggactatcagaaaacagagggataaactgattaaagaaggtaagtacacccctccccctcatcacattgggaaaggcgagccacgaccctag

SEQ ID NO: 231970 - DNA, 375 bp, Artificial Sequence
  Description of Artificial Sequence: Synthetic coding sequence
atggccgcagccatgaccttttgcaggttattgaatcggtgcggggaggccgctcgctctctgccactcggggcacggtgcttcggagtcagagtctcgccgaccggagagaaggttacacacactgggcaggtatatgacgataaggactaccgccgaattagattcgtgggtcgccagaaagaggtgaatgagaacttcgctatcgatctgatagccgagcagccggtctctgaggtcgagaccagggtgatagcctgtgacgggggaggaggggcactggggcaccccaaagtttacatcaacctagataaggagacaaagacaggtacctgtggttattgtgggttgcagttccgtcaacaccatcattag

SEQ ID NO: 231971 - DNA, 1560 bp, Artificial Sequence
  Description of Artificial Sequence: Synthetic coding sequence
atggccccaatacctaagaccgtgggcagaatcaagcttgactgctcacttagaccttcttgcccgttggaagtcgcggctgcccctaagctatgtaaagaattcggcccagaagactatggggaagaggatatcgtggacttcttgaggagactggttgagtctgaccctcaggggctgcaccgcattcacgtagatggcagcagtggacggctccagctgtggcaccatgattacctgctcggccatcttgacgatgaaggcaaatccactgggcagagtgatcgagggaagggcgctgaaggtctgggaacttattgtggcctgagaaagtcctttttatatcccccacaagagtctgagccttgcccccagtcgcctagcgcctcggccaccttcccctctgttagcgactccctcctgcaggtcgcgatgccacagaagttattggtgaccgaggaggaggcaaataggttagccgaagaactcgtggccgaagaagaaaggatgaaacaaaaagccgagaaaaagcggctgaaaaagaaaaggcaaaaagagcggaagcgacaggaacggttagagcagtattgcggcgaacctaaggcatccaccaccagcgatggggatgagtctcctccatcctccccaggaaatcccgtgcaagggcaatgcggagaggaggaagatagtctggatttgtcttccactttcgtctctctggctctgcggaaggtgggagactggccactgagtgccaggcgagaaaagggcctcaaccaagagcctcaggggcgaggattggccctgcaaaaaatgggacaggaagaggagtcccctccacgggaagagcgcccacagcagtcccccaaagttcaggcttcaccaggattgctcgcggctgccttgcaacagagccaggagctggccaaactggggaccagcttcgcacaaaatggcttttaccacgaggccgtggtgctgtttacccaggccttgaaacttaaccctcaggatcacaggctgtttgggaacaggtcgttctgtcatgagcggttgggccagcctgcttgggctctcgcggatgcccaagttgccctgacgttaaggcccggatggccgcgagggctgttcagattaggcaaagcccttatgggcctacagcggttccgagaggccgctgctgtttttcaggagaccttaagaggagggtcacagcctgacgctgctagagagttgagaagttgccttctccacctgacccttcaggggcagcggggtggcatttgtgctccacctcttagtccaggtgccctgcagcccctaccccatgcagaattagctccgtcaggcctcccgtcccttaggtgtccgcgatcaacggcgttacgctcgcctggactttcaccacttctccactacccctcctgtcacaggtcacatccaaaccagccattgtcccagacgcaatcacgcaggcctcaccctttgaagccacaagatccgtcaaaaggctgggacatacttggtctcggtcttcaacacctgtcccaggcgaggtag

SEQ ID NO: 231972 - DNA, 621 bp, Artificial Sequence
  Description of Artificial Sequence: Synthetic coding sequence
atggctgttctctcggctccaggtctgcggggatttaggattctaggcctacgatcctccgtgggcccagcagtgcaggcgaggggagttcaccaatcagtcgctacagacggaccatcctccactcagcccgctctacccaaggctcgggcagtagctcccaagccatctagcaggggagaatacgtggttgcaaagctggacgaccttgttaactgggctaggcggtcctctttatggcctatgacattcggtctcgcctgctgcgccgtggaaatgatgcacatggccgcaccacggtacgacatggacaggttcggggttgtgtttagagcgtcccctaggcagtcggacgttatgatcgtggccggtactttaaccaacaagatggcccctgccttgaggaaagtttacgaccagatgcccgagcctcggtacgtggtctctatgggaagctgcgcaaacggcggaggatattaccattattcctacagtgtcgtgcgcggatgtgaccgaatcgtgcccgtggatatttacatcccaggcagagccggaaccgcgcctccaacaagagagctggagactggccctgcccctcatggcgcacgtcgtcctctgtag

SEQ ID NO: 231973 - DNA, 885 bp, Artificial Sequence
  Description of Artificial Sequence: Synthetic coding sequence
atggccgttttgagtgccccaggcctcagaggctttcggatccttgggctccgctcaagtgtgggaccggcagtacaggccaggggagtccaccagtctgtggcgactgatggtccatcatcaactcaacctgccctgcctaaggcccgagctgttgcacctaagccttcatctaggggcgagtacgttgtcgcaaagctggacgacctggtgaattgggcaagaagagtgtcgacgatgtcctgtcgaccgtccagttctgccagggcctcgcttcacacccacaggcatactcatacacatactaacgtccagacacggacccatactacacatgcctgtaccctgacatgtgcacacgtacacgcctcttcccacgtctggactgacgtatacaccgaccacacacacacacacgctcataatgcccacatgcataccaggactcacgcacatctgcatacacacgcacatactagcacttgcgctcatacgctcgcacatattcatacctgcacactcgctctgatgcacacccatgcccacatttacacctgcactagaacactcgctcatacgtgtacctacatgcactcgcacgctcatacctgcaccctgacacacatgcacaccaggccatgcgttgatacgtgcatgtgtgcgtgctggcacgcttgtacacaggcccattccctcatgcacacacatccatgcggaaggggcgcagggaggacgctgccagaagcaccagtgctggcctggtggccagttgtgccttcagaggattcagatccagctggcgacgatcctagtgtaagcgtgatcctgttcttggcttcagtgtgcagctcatgtttctcatttaaggtgaaagcggtgttctag

SEQ ID NO: 231974 - DNA, 645 bp, Artificial Sequence
  Description of Artificial Sequence: Synthetic coding sequence
atggctgttctgagcgctcccggactgaggggttttaggattttagggcttaggagtagcgtgggacctgctgtgcaggcacgcggagtacatcaatccgtggcgaccgatggtcccagcagcacccaacctgctttgccaaaagcccgagccgtcgcacctaagcctagttcccggggagagtatgtggttgccaagctggatgatcttgtcaactgggcacgacggagttccctatggcccatgacttttggattggcgtgctgtgcagttgagatgatgcatatggccgcaccaagatacgatatggatagatttggagttgtcttcagagctagcccacgtcaatctgacgtgatgatcgttgcgggaacacttacgaataagatggccccagccttgcggaaatctagtcttcggcctgatgccggagcagctctccgcggtctgcatggagaactgcgacagagacgcagattgcttcctctgtttttgctgggaggcgaaggcctccgaccacacagagcaagagggcaccttcacccacgcctgccaacaacagcagaggctctgctgtacggcatcctccagcttcagcgcaagatcaagagggaaaggagactgcaaatttggtatcgcagatag

SEQ ID NO: 231975 - DNA, 621 bp, Artificial Sequence
  Description of Artificial Sequence: Synthetic coding sequence
atggccgtgctgtccgccccaggtctgagaggcttcagaatactgggcctcagatccagcgttggtccagcggttcaagctcgtggggtgcaccagagcgtggccaccgacgggccatcatctacccagcctgctttacccaaggccagagccgtcgccccaaaaccgtcttccaggggcgagtacgtggtcgccaaattagacgacctcgtcaattgggccagaagaagctccctttggcccatgaccttcggcctggcatgttgtgccgtggagatgatgcatatggccgcacccagatatgatatggatcgctttggcgtggtgttccgagcgtcaccacgtcagtcagacgttatgatcgtggccggtacccttacaaacaagatggctcccgctctaagaaaggtgtacgatcagatgcctgaaccacggtacgtggtctcaatgggaagctgtgctaatgggggagggtattaccactattcttactctgttgtaaggggctgtgataggattgtaccggtggacatttacatacctggcagggccggaacggcccctcctacccgagagttggaaacgggccctgcaccacatggcgcacggagacccctatag

SEQ ID NO: 231976 - DNA, 633 bp, Artificial Sequence
  Description of Artificial Sequence: Synthetic coding sequence
atgagatgcttgaccacccccatgttactgcgggctctggctcaggccgctcgcgcagggcctcccggaggacgaagcctgcactcgtctgccgtggccgctacatacaaatacgtcaacatgcaggatcctgaaatggacatgaagagtgtcacagaccgggctgcaagaacactgctgtggaccgagctgtttagggggctcggaatgactttgagttacctctttagggaacctgcaaccatcaattatccctttgagaaggggccactgtctcccagattccgaggggagcatgcactgaggagatatccatctggggaagagagatgcatcgcctgcaagttatgcgaggcaatctgccccgctcaagcaatcacgatcgaagccgaaccccgagccgatggttccaggagaactactagatacgacattgacatgaccaagtgcatctattgtggcttttgtcaggaagcatgtcccgtggatgctatcgtggagggaccgaactttgagtttagcacagaaacccacgaggagttactgtacaacaaggagaagctgctcaataacggcgataagtgggaggcggagattgcagcgaatattcaggcggattacctgtaccgctag

SEQ ID NO: 231977 - DNA, 375 bp, Artificial Sequence
  Description of Artificial Sequence: Synthetic coding sequence
atgcggtgtcttactaccccaatgctgcttcgagctttggctcaagcagctagagccggtcctcctggtggccgaagcctgcacagcagcgccgtagcagctacgtacaagtatgttaacatgcaggatcctgaaatggacatgaagtctgtgactgaccgcgcagcacgaaccctgctgtggacagagctgtttcgtggcctaggcatgacgctgtcatacttgttcagagaacccgctactattaattatcctttcgaaaagggaccactctctcctcgatttcggggagagcatgcccttagaagataccctagcggggaagaacgctgcatcgcctgcaaactctgtgaggctatctgccccgcacagtag

SEQ ID NO: 231978 - DNA, 333 bp, Artificial Sequence
  Description of Artificial Sequence: Synthetic coding sequence
atgcggtgtctgacaacccccatgcttcttcgagcactggctcaggccgcacgtgcaggccctcctgggggacggtctctgcacagtagcgcggtggctgcaacgtataagtacgttaacatgcaggatcccgagatggacatgaaaagcgtgactgatcgcgctgccagaactttgctgtggaccgaattgttcaggggcttaggcatgacactgagttacttgttccgcgagcccgcaactatcaactaccccttcgaaaaagggcctctttccccccgtttccgcggtgaacatgccctgcggagatacccttcaggcgaggagagatag

SEQ ID NO: 231979 - DNA, 555 bp, Artificial Sequence
  Description of Artificial Sequence: Synthetic coding sequence
atgagatgcctaaccacccccatgctgctgagagcacttgcccaggctgccagagctggccctcctggaggaagatctctccatagctccgccgttgccgctacatacaagtacgtaaacatgcaggaccctgagatggacatgaagagcgtaaccgaccgggcagctcggacactcctctggaccgagctgtttcgcggactgggcatgacgctaagttacctgtttcgtgaacctgccactatcaattacccttttgagaaggggccactcagccccagatttagaggcgaacacgcactacgccgatatcccagcggcgaagaaaggtgtattgcttgtaagctctgtgaggcaatttgcccagctcaggcgatcacaatcgaagccgagcctcgcgctgacggttccagacggactacaaggtacgatattgatatgaccaaatgtatctactgtgggttctgccaggaagcatgtcccgtcgatgccattgtggaggggcctaacttcgagtttagtactgaaacacacgaggaacttttgtataattag

SEQ ID NO: 231980 - DNA, 195 bp, Artificial Sequence
  Description of Artificial Sequence: Synthetic coding sequence
atgactaagtgcatttactgtggattctgccaagaggcctgccctgtcgacgcaatcgtggaaggccctaacttcgagttttctacggaaacacacgaggaattactgtacaataaggagaagctattaaacaacggggacaaatgggaagcggaaatcgcagcgaacattcaagcagattacctatatcgatag

SEQ ID NO: 231981 - DNA, 1395 bp, Artificial Sequence
  Description of Artificial Sequence: Synthetic coding sequence
atgctggccacccgacggttgctggggtggtccctccccgctagggtgtccgtgcgattcagcggggacacaacagcccctaagaaaacaagctttggcagccttaaggacgaggatcgcatttttaccaacttatacggacgtcacgactggcggctgaaggggtctctctcccgtggggactggtacaaaacgaaggagatattgctgaagggtccagactggatcctcggtgaaatcaagacctccggccttcgcggaaggggtggcgctggcttccctactggcctgaagtggagctttatgaataagccaagtgacggccgacccaaatacttggtagtcaacgctgacgagggagagcctgggacatgcaaggatagagaaatcttgcgacatgacccccacaaactgctggagggctgtcttgtcgggggacgcgcaatgggcgcaagggctgcctacatctacattagaggcgagttctacaacgaagcaagcaatctgcaagtagccatccgggaagcttacgaggctggcttaatcggaaaaaatgcatgcggcagtgggtacgacttcgacgttttcgttgttcgcggtgcaggcgcatacatttgtggtgaggaaactgcccttatcgaaagtatcgagggaaagcaaggaaagcccaggttgaaaccccctttcccggcagatgttggagtcttcggatgtccaaccacggttgctaacgtcgaaacggtagctgtgtcacctaccatctgtcgaagaggcggtacgtggttcgccggttttgggagagaaagaaattcgggaacgaaactgtttaacattagcggccatgtgaaccatccgtgcaccgtggaagaagagatgtccgtccccttgaaggagttgattgaaaagcacgctgggggagtaaccgggggatgggacaatctgctggcagttatccctgggggatccagcacccctctgatcccaaagagtgtgtgcgagaccgtgctgatggatttcgatgctctggttcaggcacaaacaggactcgggaccgctgctgtgatcgtcatggaccgtagcacggatattgtgaaggcaatcgcacgtctgattgagttctataagcatgagtcatgcgggcagtgtaccccttgtagagagggagttgattggatgaacaaggtgatggcgcgatttgtccgcggagacgccaggcccgctgaaatcgactcgttgtgggagattagtaagcagatcgaaggccataccatctgcgctctgggagatggagccgcttggccggtgcagggtctgataaggcactttcggccagagttggaagagaggatgcagcggttcgctcagcagcatcaggctcgacaggccgcatcatag

SEQ ID NO: 231982 - DNA, 1374 bp, Artificial Sequence
  Description of Artificial Sequence: Synthetic coding sequence
atgctcgctacaaggcgactgcttgggtggagtctgcctgcacgggtttccacagcgcctaaaaagacctccttcggaagcctgaaagacgaagatcggatatttaccaacctctatgggcgtcacgactggagactgaaggggtctttgtccagaggcgactggtacaagacaaaggagattctgctgaaaggaccagattggatcctgggcgaaataaaaacctccggcttgcgcggacggggaggcgctgggttccccaccggactgaaatggtcctttatgaacaagccctcagatggacgcccaaagtatctcgttgtgaatgccgacgagggcgagcctggtacatgcaaggacagggaaattctccggcacgatccacacaagctgctggaggggtgtctcgtcggaggacgggctatgggcgctcgagccgcttacatatatatccgcggagaattctacaacgaagctagtaatcttcaggttgctattagggaagcctacgaagctgggctgattggcaagaacgcatgtggatcagggtacgacttcgacgtgttcgtggtgcgcggtgccggtgcctatatttgcggggaagaaacggctctcattgagagtatagaaggtaagcaaggcaaacccaggctgaagcctcccttccctgccgatgtgggagttttcgggtgtcctactacagtcgcaaatgttgaaaccgtagccgtttctccaacaatctgcagacgaggtggaacatggtttgccggtttcggcagggagcgcaatagcggtacaaagctcttcaatatcagcggccacgttaatcatccatgcactgttgaagaggagatgagcgttccattgaaagaactcatcgaaaaacacgcaggtggcgtgactggcggttgggataaccttctggcagtgattcctgggggtagttctacccctcttatccccaaatccgtgtgcgagaccgttctaatggattttgatgccctggtgcaggctcagaccggacttggcaccgctgctgtgattgttatggatcgcagcacggacatcgtgaaggcaattgctcgcctcattgaattttacaaacacgagagttgcggacaatgtaccccttgtcgggaaggcgtcgactggatgaacaaggtgatggcccgttttgtaagaggcgacgctcgcccagccgagatcgattcgctatgggagatttcaaaacagatcgagggccacacaatatgcgcgctcggcgacggagctgcttggcctgtgcagggtctcatccgccatttcaggcctgagctcgaggagagaatgcagcggtttgctcagcagcatcaagccagacaggctgcgagttag

SEQ ID NO: 231983 - DNA, 1008 bp, Artificial Sequence
  Description of Artificial Sequence: Synthetic coding sequence
atgctggcaactcgaaggttgcttggctggtctctccccgctcgggtgtccgtgcggttttctggagatacaactgcaccaaagaagacttcttttggcagtcttaaggatgaagatagaattttcacaaatttgtacggcaggcatgattggaggctgaaagggagcctaagccggggagattggtacaaaactaaggagatactgctgaaaggccctgactggatcctgggggagatcaagaccagcgggctgaggggcaggggcggagcaggcttccctaccggattgaagtggagttttatgaataaaccttcggacggttcacctaccaccgtggctaatgtggagaccgtagccgtgagccccaccatctgtcgtagagggggaacctggttcgctggctttggccgtgagagaaacagcggaacgaaactgtttaatatctcaggtcacgtgaatcacccttgtacagtcgaagaggagatgagtgtgcctctcaaggagctgatcgagaagcacgccggtggtgtcaccggagggtgggacaaccttctcgcagtgattccgggaggtagcagtacaccactcattccgaagtcagtgtgcgagacagtgttaatggatttcgatgccttagtccaggctcagactggcctgggtaccgctgcagttattgttatggataggagtacagatatcgtgaaagccatcgcaagattgattgagttctataagcacgaatcttgcggacagtgcaccccatgtagagaaggcgtggactggatgaacaaggtcatggcccgattcgttaggggcgacgcccgacccgctgagatagactcattgtgggagatcagcaagcaaattgaaggtcacactatttgtgctctcggggatggagccgcatggccagtccagggattgattcgacattttcgccctgagctcgaggagaggatgcaaaggtttgcgcagcaacaccaggccaggcaggcggcttcttag

SEQ ID NO: 231984 - DNA, 1368 bp, Artificial Sequence
  Description of Artificial Sequence: Synthetic coding sequence
atgttggccacgcggcgtttgttggggtggagtttgcccgctagaacagcccctaaaaagacaagcttcggatctctgaaagacgaggacaggatcttcactaatctgtacgggagacatgactggagactcaagggatccctctccaggggtgactggtacaaaaccaaggagattctgctgaagggcccagactggatactcggggaaattaagacatctggccttcgcggtcgcggaggcgctgggttccccaccggactaaagtggagcttcatgaacaagcccagtgacggtcgacccaaatatctggtcgtaaatgcggacgagggcgaacctggcacatgcaaagatcgcgagattctgcggcacgacccacacaagttgctggaaggatgtctggtagggggtcgggctatgggtgccagggccgcatacatatatattagaggcgaattttataatgaggccagcaatctgcaagtcgctattagagaagcctacgaggcgggacttattggaaaaaacgcttgcggatctggttatgactttgacgtttttgtggtcagaggcgctggcgcttacatttgcggagaggagacagcactcattgaatctatcgagggaaaacagggaaagccacgattaaaacctcccttccccgctgacgttggtgtcttcggatgccctacaacggtcgcgaacgtcgagacagtggctgtctccccgacaatttgtcgcagaggcggaacctggtttgcaggctttggtcgggagcgaaacagcgggactaaactctttaatatctccggacacgtgaaccacccatgtaccgtagaagaagaaatgagtgtgcccctcaaggaactaattgagaagcatgcagggggagttacgggagggtgggataatctactagcggtaatccccggtggctctagcacgccactgattcccaaatcagtctgcgaaaccgttttgatggacttcgacgcactggtgcaggcccaaactggcctcggcaccgccgctgtcatcgttatggaccgtagtaccgatattgttaaggcaatcgcacgcctgatcgaattttataagcatgagagctgcggtcagtgcaccccttgccgtgaaggggtcgattggatgaataaagtcatggccagattcgtacgcggtgatgcccgacccgcagaaattgactccttgtgggagatcagcaaacagattgagggccacaccatttgcgctcttggggatggtgccgcatggcccgtccagggactgatccgtcacttcagaccggaactggaggaacggatgcagcggttcgcacagcagcatcaagcccgtcaggcggcatcctag

SEQ ID NO: 231985 - DNA, 1092 bp, Artificial Sequence
  Description of Artificial Sequence: Synthetic coding sequence
atgaataagccatccgacggcaggcctaagtacctggttgtgaatgccgacgaaggtgaaccgggaacatgtaaggatcgggaaatcctgcgccatgatccccataagcttctggaggggtgtttagtgggtggacgggctatgggtgcccgagcagcttacatttatattcgaggcgaattctataacgaagccagtaatctacaggtggcgatcagggaggcctatgaggccggtctgatcgggaagaacgcgtgtggttcaggctacgacttcgacgtgtttgtggtccggggagcaggagcttatatatgtggcgaagagacagctctgatagaatcgatagaggggaaacaaggcaagcccagactcaagccacctttccctgccgacgtcggcgtcttcggctgcccaaccactgtggctaacgtggagacagtggccgtcagccctacaatatgtaggagggggggaacctggttcgccggttttggacgagaacgcaattcggggactaagttattcaacatttccggccatgtcaatcacccctgcacagttgaagaagagatgagtgttcctttaaaggaactaatcgagaaacatgctgggggtgtcacaggaggatgggacaatctgctggccgtaatccctggaggaagctcaacccctctgattcccaaatcagtttgcgagaccgtgctaatggacttcgatgcccttgtgcaagcccaaactggcctgggcacagccgcagtgatagtcatggacaggtctaccgacatcgtcaaggccattgcccgtctgatagagttttataagcacgagtcctgtggccagtgtactccttgtagagagggggtggattggatgaataaagtgatggcccgtttcgtccgcggagacgctagacctgcggaaattgattccctttgggaaataagcaaacagatcgaggggcacaccatttgtgcactaggagacggcgcagcgtggccagtgcaaggactgatccggcatttcagacccgaattggaggagcgaatgcagaggttcgcccaacaacaccaagccaggcaggctgcaagttag

SEQ ID NO: 231986 - DNA, 750 bp, Artificial Sequence
  Description of Artificial Sequence: Synthetic coding sequence
atgtttttttcggccgctctcagagccagagccgctggactgaccgcacattggggccgtcacgtccgcaacttacacaaaacggtgatgcagaacggcgctgggggagcactatttgtccatcgtgacacaccagagaacaaccctgatacgccgttcgactttacccccgagaactacaaacgcatcgaggccatcgtcaaaaactacccggagggccataaggccgcagccgtcctccctgtactggaccttgcacagaggcagaacgggtggctcccaatttcagccatgaataaagtcgctgaggtacttcaggtgcctcccatgagagtatacgaagttgcaacattttatacaatgtataatcggaaacctgtgggaaaataccacatccaggtatgtaccacaactccgtgtatgttgcggaacagcgactccatcctggaggccattcagaagaagttaggtattaaagtgggagagaccaccccggacaaactgtttactttgattgaggtggaatgtcttggagcgtgcgttaatgcccctatggttcaaatcaacgacaactactacgaggacttgaccgctaaggatatagaggagatcatcgatgagctgaaggccggaaagataccaaagcctggccctaggtccggacgatttagttgtgaacccgctggtggactcactagcctaaccgagccccctaagggtccaggttttggcgttcaagccggtctatag

SEQ ID NO: 231987 - DNA, 327 bp, Artificial Sequence
  Description of Artificial Sequence: Synthetic coding sequence
atggccgctccctgcctgctccgccaaggacgcgctggtgccctgaagacaatgctacaggaggctcaggtctttcgcggattggcctctaccgtctccttgtcagcggaatccggcaagtctgaaaaggggcagccccagaattccaagaaacaatctccgcctaagaaacccgcaccagtgcccgctgaaccctttgacaacacaacttacaagaatctgcagcatcatgactattcaacctatacctttctagatctgaatctggaattgagtaagttccgcatgccccagccttcctctgggagagagagccccagacattag

SEQ ID NO: 231988 - DNA, 1422 bp, Artificial Sequence
  Description of Artificial Sequence: Synthetic coding sequence
atggcagctccatgcctccttcgacagggacgcgctggcgctctgaaaacaatgctccaggaggcccaggtgtttcgaggtctggcatccacggtaagccttagcgccgagtctggcaaaagtgagaagggacaacctcagaatagcaagaaacagagtccgccaaaaaatgtggttgaacctaaagagcggggtaaattgctggctacacaaaccgccgcagagttgagcaaaaatctgtcctccccaagctcctacccaccagcggtcaacaagggccgaaaggtggcatcaccatcccccagtggcagcgttttatttacagacgagggagtgccgaagttcctctctagaaagaccctggttgagttccctcagaaggtactctcccctttccgcaagcagggcagcgattcggaagctcgtcaagtgggcaggaaagtgaccagtcccagctcatcctctagctcttcctcgtctgacagtgagagtgacgacgaagctgacgttagcgaggtcactcccagagtggtcagcaaaggaagggggggactgcggaagcccgaggcctcacacagtttcgaaaatagggcacctagagtcacggtgagcgcaaaagaaaagactttgctgcagaaacctcatgtcgatatcacagaccctgaaaaaccacaccaaccaaagaagaaggggtctcccgcaaaaccctcagaggggagagaaaacgctcgtcccaagacaaccatgcctaggtctcaggtcgatgaggaatttctgaagcagtctcttaaggaaaaacagcttcagaagacctttcgcttaaatgaaatagataaggaatctcaaaagccattcgaggtcaaaggccctctgcccgtgcacaccaaatcaggtctgagcgcccctcccaaaggaagtcctgcacctgccgttctggccgaagaggcgcgagccgagggtcagctgcaagcatcacctcctggcgctgcagagggccacctcgaaaaacctgtgcctgagccacagaggaaagcagctcctcccctgcctagaaaagagactagcggaactcagggtatagaggggcacctcaaaggcggacaggcgatcgtggaggatcagatccccccttccaatctcgagacagtgccagtcgagaacaaccatggtttccacgagaagaccgccgctctgaagctcgaggccgagggagaggccatggaagacgccgctgcccctggcgatgataggggtgggacgcaggaacccgctcctgtacctgcagaaccattcgacaacaccacttacaagaacttgcagcatcacgattattccacatacacgttcctagatctcaacctggaactgagcaaattccgaatgcctcagccatcctctggcagagaaagtccaaggcactag

SEQ ID NO: 231989 - DNA, 339 bp, Artificial Sequence
  Description of Artificial Sequence: Synthetic coding sequence
atgcttcaggaagcccaggtgttcagaggcctcgcttccactgtatcgctgtctgccgagagtggcaaaagcgagaaaggccagccccagaactccaaaaagcaaagtcccccaaagtccgtaccaacaccacataggcgttacagcccctgcggagactggaaggatgcctcgtctctgaagcctgcacctgtgcccgctgagccttttgataacaccacttataaaaatctgcagcatcatgactatagcacctacaccttcttggatctgaatctcgaactgtccaagttccggatgccccagccttcttcaggaagagagtcacctcgccactag

SEQ ID NO: 231990 - DNA, 2223 bp, Artificial Sequence
  Description of Artificial Sequence: Synthetic coding sequence
atggaaaagctgggtgtcgaacccgaggaggagggaggtggtgacgatgacgaagaagacgctgaggcttgggccatggagttagccgatgtgggtgccgcagccagtagccagggagtccacgatcaggtccttcccacgccaaatgcctcaagccgagtaatcgtgcacgttgatttggattgcttctatgcacaggtggagatgatctctaaccctgagctgaaggacaagcccctaggcgtccagcagaaatacctggtggttacttgtaattatgaggccagaaaactcggtgtgaaaaagctcatgaacgtgagagatgctaaagaaaagtgcccacaactcgtgttagttaacggggaagacctcacacgctaccgtgagatgtcctacaaggtcacagagttactcgaagagtttagtcccgtcgtggagcgcttggggttcgatgaaaatttcgtcgacctgaccgagatggtggagaagcggctccagcagttgcagtctgacgagctttctgccgtcacagtgtctggacacgtctataacaaccagtccattaaccttttagatgtgctccatatccggctgctggtggggtcccagatcgctgccgagatgagagaggctatgtacaatcagctaggactgaccgggtgtgctggggttgctagtaataaactgctggcgaaactggtcagtggggttttcaaaccaaatcagcaaacagtgcttttaccagaatcgtgccagcacctgattcattcgttgaaccacataaaggagatcccaggcataggctataagaccgcaaagtgtttggaagccctgggaatcaattctgtcagggatctacagactttttctcccaaaattttagaaaaggaacttggcatctccgtggcccagaggattcagaagctatccttcggcgaagataactcccctgtcattctttccggaccgcctcagagcttttcagaggaggatagttttaaaaagtgctctagtgaagttgaggctaaaaacaaaatcgaggagctgctggcctcactgcttaaccgggtttgccaggatggcagaaagccacatactgtgcggttgatcatccgtcgatactcctccgaaaagcactatggaagagagtcacggcagtgtcccatccctagtcacgtcatccagaaactcggtacaggaaactacgacgtgatgacccctatggtcgacattctgatgaagcttttcagaaatatggtaaacgtcaagatgccatttcacttgacattgttgagcgtctgtttctgtaatctgaaggcactgaacacagcaaagaaaggtctgattgattattatctgatgccttccctgagcacaacaagtaggtcaggaaaacactctttcaagatgaaggatacacacatggaagatttcccaaaagacaaggagacaaacagggattttttgccatccggcagaatcgagtcaactagaacccgagagagcccgctggacaccacaaattttagtaaggagaaggacatcaatgaattcccgctttgttcccttccagagggagtcgaccaagaagtctttaaacagctgccagtcgatatacaggaggagatcctgagtggaaagagtcgcgagaagttccagggaaaggggagcgtgtcttgccccctgcatgcctcgagaggcgtcttatcatttttcagtaaaaaacagatgcaggacattcctattaacccgcgagaccaccttagcagcagcaagcaggtgtccagcgtgagcccctgcgagccgggtacctccggcttcaattcctcaagctcctcctatatgtccagtcagaaggattatagctactatctcgataaccgcctgaaggatgaacgcatcagccaggggccaaaggaaccccaaggcttccactttacgaatagcaatcccgctgtgagcgcctttcactcatttcctaaccttcagtccgagcaactttttagcagaaaccatactaccgattcacacaagcagacagttgccacagactcccacgagggactaacagagaaccgggaacccgactcagtcgatgaaaagataacctttccatccgatatagacccacaggtgttctacgaacttccagaagctgttcaaaaagagctactcgccgagtggaaaagagcgggatctgatttccatatcggtcacaaatag

SEQ ID NO: 231991 - DNA, 540 bp, Artificial Sequence
  Description of Artificial Sequence: Synthetic coding sequence
atgaataagcgcggtttctctatggaggttggccagtacatttttgtgaactgcccctccatctcactgctggagtggcatccattcacgctgaccagtgcccctgaagaggatttttttagtattcatatccgagcagcaggggactggaccgagaacttgatcagggcctttgagcagcagtacagtcccattcctaggatcgaagtggacgggccattcggaacagcatccgaggacgttttccagtatgaggttgctgtactggtgggagccggaatcggcgtgacccctttcgctagtattctgaaaagcatctggtacaaattccagtgcgctgatcataacttgaagactaaaaagatctacttctattggatttgcagggaaaccggcgcattcagctggtttaataatctgctcactagcctggaacaggaaatggaggagttgggcaagtctttacgcaaatgttgtcatcggtatagtagtttagatccaagaaaggtccaattttactttaacaaagagaatttctag

SEQ ID NO: 231992 - DNA, 1584 bp, Artificial Sequence
  Description of Artificial Sequence: Synthetic coding sequence
atgggcaactgggtggtcaatcactggttctcggtcttgttcctcgtcgtttggctaggtctcaatgtcttcctcttcgtggatgcctttctaaagtacgagaaagctgataagtactactacacgcgaaagatccttggtttttgctcccgaaccctgcgaaagcagctcgaccacaatttgacctttcacaagctcgtggcctatatgatatgcctccatacggcgatccacattattgcacacctgttcaactttgactgctacagtcggagcaggcaggccactgatgggagcctggcttccatcctctctagtttgtcacacgacgaaaaaaagggtgggtcttggcttaaccccatacaatctagaaataccaccgtggagtatgtaactttcactagcattgccggactgactggcgtcatcatgacaattgccctaatcctaatggtcactagtgctacggagtttatacgcagaagttacttcgaagtgttctggtatacccatcatctgttcattttctacattctcggcctcggcatccatggcatcggcggtatcgtcagaggtcagactgaggaaagcatgaatgagagccatcctcgcaaatgcgcagagtccttcgaaatgtgggatgatagagactcacattgcagaaggccgaaattcgagggtcacccgcctgagtcatggaaatggattctggctcccgtaattctgtatatttgtgaaagaatcctgcggttctaccggtctcagcagaaggtggtaataactaaggttgtgatgcacccgagtaaagtgctggagctgcagatgaacaaacgcggattctctatggaagtgggtcaatacattttcgtgaactgcccaagcatctccctcttggagtggcacccctttacacttacctcggcccctgaagaggatttcttcagcattcacatacgagccgctggagattggacggagaacctgatccgcgcattcgaacagcagtacagtccaattcctagaattgaagtcgatggtcctttcggcacagcaagtgaagacgtattccagtacgaggtagcagtccttgtgggagcagggattggagtgaccccttttgccagcatccttaaaagcatctggtataaatttcagtgtgctgaccataatctcaaaactaagaagatctatttctactggatatgtcgggaaaccggtgccttttcctggttcaacaatctattgaccagcttagagcaagagatggaagaactgggcaaggtgggattcctgaactatcggttatttctcacaggatgggactctaatatcgtaggccacgcagcattaaactttgacaaggcgaccgatatagtgaccggacttaaacaaaaaacgtccttcggacgtccgatgtgggataacgagttttccacgattgctacaagccaccctaaatccgttgtgggcgtcttcctgtgtggccctcgcacgctggccaaatcgctgaggaaatgttgccaccgctactctagtctggatcctcgaaaggttcaattttactttaacaaggagaatttctag

SEQ ID NO: 231993 - DNA, 579 bp, Artificial Sequence
  Description of Artificial Sequence: Synthetic coding sequence
atgggcaattgggtggtcaaccactggttctcagtgcttttcctggtggtctggctgggtctgaacgtgttcctgtttgtggacgctttccttaaatacgaaaaggccgacaagtactactacacaagaaagatcctagggagcaccctggcgtgtgctcgtgccagcgctctttgtctgaattttaatagcaccctgattcttctgcccgtctgtcggaacctgctgtcatttttacgcggaacgtgtagcttttgtagtagaaccctgcgcaagcagttagaccacaatctcactttccataagcttgttgcatacatgatatgcctgcacactgccatccacatcatcgctcacctgtttaactttgattgttattcgcgttccaggcaggcaactgacgggagcctggccagtattctgagttccctaagtcacgatgagaagaaaggcggatcatggctgaaccccattcatcctcacataaccccgaccgtctacatgttcacggttactttcgacatggtgctcagcagtgtgaattctaacctgttcctgttcctgctcattaaaaagtag

SEQ ID NO: 231994 - DNA, 579 bp, Artificial Sequence
  Description of Artificial Sequence: Synthetic coding sequence
atgggaaactgggtggttaaccactggttctcggtgcttttcctggtagtctggcttgggttaaacgttttcctctttgtggacgcattcctcaaatatgaaaaagccgacaaatactattatactcgaaagattcttggttccacactggcatgtgcccgagcatccgctctgtgcctcaacttcaactcaactctgatactgctgcctgtttgtcgcaatttactctcttttctgcggggaacatgctccttctgctcaaggactctccgcaagcagttggaccacaacctgacgttccacaagctggtcgcgtacatgatctgcctgcacaccgctattcatatcatagcccatctgttcaacttcgactgttactcgcgatctcgccaggcgactgacgggagccttgcaagcatcttaagctccctctcacacgatgaaaaaaaaggcggttcttggctgaacccgatccacccgcacataacccctaccgtttacatgttcaccgtaacattcgacatggttcttagctcagtgaatagtaatctgttcctgtttctcttgattaagaagtag

SEQ ID NO: 231995 - DNA, 1695 bp, Artificial Sequence
  Description of Artificial Sequence: Synthetic coding sequence
atggggaattgggtggtgaaccactggttctctgtgctgtttctggtcgtgtggttgggactgaacgtgtttttattcgttgatgcctttctgaagtatgaaaaggctgacaagtactattatacaagaaagatactgggctccacactcgcatgtgccagagccagcgccttgtgcctgaatttcaatagcacgctgattcttctcccggtttgcaggaacctactgtccttcctcagaggtacatgtagcttctgctccagaacgctgagaaagcagcttgatcacaatctcacttttcacaagctggtggcctatatgatttgcctccacaccgctatacacatcatcgcacacctatttaacttcgactgctactccagaagccggcaggcaacagacgggagcctggccagcatcttatctagtctctcacacgatgaaaaaaagggtggctcttggctaaatccaattcagtcccggaataccactgtggagtatgtgaccttcacttctatagcagggctgactggagtgatcatgaccattgctttgatcctcatggttactagtgccaccgaattcattagacgctcctatttcgaggttttctggtacacccatcatctgttcattttctatattcttgggctcgggatccacggaatcggaggcatagtgcggggacagacagaggagtccatgaatgaatcacaccccagaaagtgtgccgagagctttgaaatgtgggatgacagagactcacattgccggagaccaaagttcgagggtcatccccctgagtcatggaagtggattcttgccccagtgatattgtacatatgcgagagaatccttaggttctaccgctcacagcagaaggtggtgattaccaaggtggtcatgcatccatcaaaagtcctcgagctccaaatgaacaagagaggcttcagtatggaagttggacagtatatcttcgtcaattgcccaagcatttctttactggagtggcatcccttcaccttgacaagcgcccctgaggaagatttttttagtattcacattagagccgctggcgattggacagagaacctgataagggcattcgaacagcaatatagccccattccaaggatagaagttgatggtccctttggaacagcctccgaagacgttttccaatacgaagtggcagtgcttgttggtgctggtatcggggttacaccgttcgcctctatacttaagtccatatggtacaagtttcagtgtgccgaccacaatctgaagaccaagaagatctatttttattggatctgtcgcgaaactggggctttctcgtggtttaacaacctacttacaagcctcgaacaggaaatggaggagctgggaaaggtaggatttctgaactaccggctctttttgacagggtgggattcaaatatagtgggccatgctgcacttaacttcgacaaagctacggacatagtaacgggtctcaagcaaaaaacctccttcggcagacccatgtgggacaatgagtttagtaccatcgcaacttcgcaccctaaatccgttgtgggagtgttcctgtgcggaccacggacgctggccaagtctttgaggaaatgctgccaccgctattcctctctagatcccaggaaggttcaattctacttcaacaaagagaacttttag

SEQ ID NO: 231996 - DNA, 528 bp, Artificial Sequence
  Description of Artificial Sequence: Synthetic coding sequence
taattttccatggaagttggacaatatatttttgtgaattgtccgtctatctcgctgcttgaatggcacccatttacactcaccagcgccccagaggaggactttttttccattcacattagagccgcaggagactggacagagaacctcatcagggcatttgagcagcagtactctcccatacctcggatcgaggtggacggtccctttgggacggcatcagaggatgtttttcagtacgaggttgccgtgcttgtgggcgcagggattggtgtaaccccattcgcttctattttaaagagcatctggtataaatttcagtgtgccgatcacaatctcaagaccaaaaagatctacttttattggatttgcagggagacgggtgccttcagttggtttaacaacctgctcacctccttagaacaggagatggaagagctgggcaagagtcttcggaagtgctgtcaccggtattcctctcttgatcctcgtaaagtccagttttactttaacaaagagaacttctag

SEQ ID NO: 231997 - DNA, 1707 bp, Artificial Sequence
  Description of Artificial Sequence: Synthetic coding sequence
atgatgggctgctggattctaaatgagggtctgagcacaatactggtcctgtcctggctgggtatcaatttttacctcttcatcgataccttttactggtatgaagaggaggaatcatttcactacacacgggtgatcttgggatccactctagcatgggcacgggctagcgctctgtgcctgaacttcaactgcatgcttattcttatccctgtgtccaggaacctcatatctttcatccgtggaacaagtatttgctgtcgtggcccatggcgtcggcaactggacaagaatctcaggttccataagttggttgcctacggcattgccgttaacgccaccatccacattgtcgcgcacttcttcaacctggagcgctatcattggagccagtccgaagaagctcagggattgctcgccgctctctccaaacttggtaacactcccaatgagtcttacctaaatcccgtccgcacattcccaactaatactactacggaactgctccggaccattgctggagtcaccggacttgtaatctccttggccctggtcttaatcatgacttctagcaccgagttcattagacaggctagttacgagctgttttggtatactcaccacgtgtttatagtgtttttcttatctctggctattcacggcacgggccgaattgtgaggggccagactcaggattccctttctctgcataatatcactttctgccgcgaccggtatgcagagtggcaaactgtagctcagtgtcccgtccctcagtttagcggcaaggaaccctccgcatggaagtggattttaggccctgttgttttgtatgcttgtgaacgcatcatacggttttggcgcttccagcaagaggtcgtcattacaaaggtggtctcacatccatctggagtactagagttgcatatgaagaagagggggtttaaaatggcaccagggcagtacatcctggtccagtgtccggcaatcagttccctcgagtggcatcctttcacgttgactagcgccccacaggaggacttttttagtgttcatattagagccgcaggtgattggactgctgccctgttggaagccttcggtgctgaaggccaggccctccaggaaccttggtccctgccacgcctagccgtcgatggcccttttgggacagcactcacggatgtgttccattaccccgtgtgcgtttgcgtggcggctggaatcggggtgacacccttcgcagccttgttgaagagtatatggtacaaatgcagcgaggctcagaccccattgaaactgtctaaggtgtacttctactggatatgccgcgacgctcgagcatttgaatggtttgccgacctacttctcagtctggaaactagaatgagcgagcaaggcaagacgcattttttaagttaccacattttcctcaccgggtgggatgagaatcaggccctgcacattgcgctccactgggacgagaacaccgacgtgattaccggactaaagcagaagactttctacggacgaccaaactggaacaatgagtttaagcagatcgcttataaccacccaagttctagtatcggggtattcttctgcggtccaaaggccctgagtcgcaccctgcagaagatgtgtcacttgtattcatccgccgatccaaggggtgtgcacttctactacaataaggaaagtttctag

SEQ ID NO: 231998 - DNA, 1737 bp, Artificial Sequence
  Description of Artificial Sequence: Synthetic coding sequence
atggccgtttcatggagatcttggctcgcaaacgaaggcgtgaagcatctgtgcctgttcatctggctctccatgaatgttttactcttttggaaaacctttctgctctacaaccaagggcctgagtatcactatcttcaccagatgctcggcttgggcctgtgcctgtcccgcgcatctgctagcgtcttgaatctgaattgtagcctgattctgctaccaatgtgccggactcttctcgcttacctgcggggttctcagaaggtaccctcccggaggaccaggcggctgctggataagtcccggacctttcacatcacctgcggagtcaccatatgcattttctctggcgtgcacgtcgccgctcatctggtgaatgcactgaacttttccgtgaactattccgaggattttgttgaacttaatgcggctaggtatcgcgacgaagatccacgcaagcttcttttcactacggtgccgggtctgaccggggtgtgtatggtagtggtgttgttcctaatgattacagcaagtacatatgcgattcgtgtttctaactacgacatcttttggtatactcataacctcttttttgtcttctatatgcttctgaccctgcatgtgtcagggggtttgcttaagtaccaaacaaacttggacacacaccctccgggatgcatcagtttaaaccgcaccagcagccaaaacatctctctgccagagtactttagtgagcactttcacgaaccatttcccgaagggttcagcaagccagcggagttcactcagcataagttcgttaaaatttgtatggaagaacctcggtttcaggccaattttccccaaacatggctgtggatctctggtcccctatgcctgtactgtgctgaaaggctgtaccggtacatccgctctaataagccagtcaccatcatctctgtaatgtcccatccttccgatgtcatggaaataaggatggtgaaggagaatttcaaagcccgtccaggacagtacattacactacattgcccttccgtgtcggcactggaaaatcaccccttcactctgacgatgtgtcccacagagactaaagccacatttggcgtacacctcaagattgtaggcgactggacagaacggtttagggatctgttattgccacctagttctcaagacagtgaaatacttccgtttatccagtccaggaactaccctaaactgtatattgatggccctttcggctccccttttgaagaatccctgaattatgaagtgagcctctgtgttgcagggggaataggtgttactccttttgcgtccattctcaacacactgttggatgattggaagccttacaaactgcgaaggctttacttcatctgggtgtgcagagatatccaatcctttaggtggttcgctgatctcctgtgcatgctccataataaattctggcaagagaaccgaccagactatgttaatattcagctgtacctgagccagacagacgggatccagaagatcatcggtgaaaaatatcatgccctcaactctcggctgttcattggcagaccgcgatggaagttgctcttcgatgagattgcaaagtataaccggggaaaaactgtaggggtgttttgctgcgggcctaattcgctttctaagacactgcacaagttatctaaccaaaataacagctacggaactagattcgagtacaataaagagagcttttcctag

SEQ ID NO: 231999 - DNA, 1665 bp, Artificial Sequence
  Description of Artificial Sequence: Synthetic coding sequence
atgaatgtgctgctgttctggaaaacttttctgttgtataatcaaggacccgaataccactatctccaccagatgctgggactgggactttgcctatcccgagcatctgcctccgttctcaacctcaactgttcactgatactgctcccaatgtgtcgcacactacttgcctacctcaggggcagccagaaggtgccatcacgaagaaccaggaggctgctggacaaaagtagaacattccacataacctgtggagtcaccatttgtatctttagcggtgttcatgtggctgcccacctcgttaatgccctgaatttttcagtgaactattctgaagacttcgtagaattgaatgcagctcgttaccgagacgaagaccctcggaagctgctctttaccaccgtaccaggcctaactggcgtctgtatggttgtggtgctatttctgatgattactgcatcaacatacgcgatacgagtgtccaattatgatatcttctggtacactcacaatctcttttttgtgttctacatgctgcttacattgcatgtctcaggtggtcttcttaagtatcagaccaacctggacacacatccacccggttgcataagcctcaaccggacaagtagccagaacatctcactgcctgagtattttagcgaacactttcacgagccgtttccggaaggcttcagtaagcctgcagaattcactcagcacaagtttgtcaaaatttgcatggaggagccgagatttcaggcgaactttccgcagacttggttgtggatttccggacccctgtgcctgtactgcgctgaacggctgtatcgttacattcgctctaataaaccggtgaccattatctctgttatgagccacccttctgacgtgatggaaattagaatggtgaaggagaatttcaaggccaggccagggcagtatataacactgcactgcccttccgtgtctgctttggaaaaccacccgttcactctcaccatgtgtcctacagaaaccaaggctaccttcggcgtccaccttaagattgttggagactggaccgaacggtttagagatctgttacttcccccatcttcacaggactctgagatattgccatttatacagagcaggaactacccaaagctctacatagacgggccattcggatcccccttcgaagagtcattaaactacgaggtctccctatgcgtcgctggcggaatcggagtcaccccctttgcaagcatcctcaatacattgctggatgactggaaaccatacaaactaaggcgtctgtacttcatctgggtttgtcgcgacatccagtcctttcgatggttcgccgacctgttatgcatgttgcacaacaagttctggcaggaaaacaggcccgactacgttaatatacagctctacctgtcgcagactgacggcatccagaagattatcggcgagaaatatcacgccctgaactcccgcctattcatcgggagaccccgatggaagttgctgtttgatgagatagccaagtataacagaggtaagaccgtcggcgtgttttgttgtggacccaatagtctgtccaagaccttgcacaagctgagtaaccagaacaactcttacgggaccaggttcgagtataataaagagtctttctcatag

SEQ ID NO: 232000 - DNA, 816 bp, Artificial Sequence
  Description of Artificial Sequence: Synthetic coding sequence
atggcagtctcatggaggtcttggctggccaacgaaggtgtcaagcacctgtgcctgttcatttggcttagtatgaacgtgcttctgttttggaagaccttcctgctgtataaccagggacccgaataccactatctacatcagatgctgggatgtcctaccgagacaaaggccactttcggcgtgcacttgaagatcgttggagactggacagaaagatttcgagatctccttttgccaccttcgagccaagactccgagatcctgccttttatccagtccaggaattaccccaagctgtacatcgatggccctttcgggtcaccttttgaggagagtctgaattacgaggttagtctatgtgtcgctggaggtatcggggttacaccttttgcgtccatcctgaacacgctcctagacgattggaaaccctacaaactgaggaggctgtattttatttgggtctgtcgcgacatacagagtttcaggtggtttgctgacctcctgtgcatgctccataataaattttggcaggagaacagacccgattatgtgaatattcagctgtatctgagccagacagacggaattcagaagatcatcggcgagaaatatcacgccctcaactccagactgttcattgggaggcctcgctggaaactcctgttcgacgagattgccaaatacaatcgaggaaaaactgtcggcgtgttctgttgtggccctaactctctcagcaaaaccttgcacaaactctctaatcagaacaactcgtatgggacccgctttgaatataacaaagagagcttcagttag

SEQ ID NO: 232001 - DNA, 165 bp, Artificial Sequence
  Description of Artificial Sequence: Synthetic coding sequence
atggcagtgagttggcggagctggcttgccaatgaaggcgtcaaacatttgtgcctcttcatttggctaagtatgaatgtcttgctgttctggaagacctttttactgtacaaccaggggcctgagtatcattatctgcatcagatgcttggagaactcagctag

SEQ ID NO: 232002 - DNA, 1800 bp, Artificial Sequence
  Description of Artificial Sequence: Synthetic coding sequence
atgggcgagatgtggaggaagagagaagaggtcatcttccgggagtattcattttctttttacccactgaatattttcgcacctttcgttctttttcctgactacttctgcctgctgggatttatctggcttagcatgaatgtcctgttgttctggaagacatttctcctctacaatcaagggccagaatatcactatttacatcagatgctggggcttggtctgtgtctgagccgggctagcgccagcgttctgaacctcaattgctccctgatcctgttgcctatgtgtcgaaccctgctagcttatctacggggatcgcaaaaggttccatctcggaggactcgaaggttgctggataaatccagaactttccacataacttgcggtgtgaccatctgtatcttctccggggtccatgtggctgcgcacctggtgaatgccttaaacttctcagtaaactattccgaagacttcgtcgaactgaacgctgctcgttaccgggatgaggaccctcggaaactgctgtttaccaccgtcccaggcctcactggggtgtgtatggtcgtggtgttgttcttgatgatcacagcctcaacatacgccatccgggtgagcaattatgatattttttggtatacacataacctcttctttgtgttctacatgctgctgactttgcatgtgtccggaggactcctgaagtatcagactaacctggatactcacccccctggttgcattagcctgaacaggacttcctcacaaaacatttcgttgcccgaatacttctcggagcactttcatgagccttttcccgaaggattcagcaaaccggctgagtttacccaacataaatttgtcaaaatctgcatggaggagccgaggttccaggccaacttcccccaaacttggttgtggataagcggcccactgtgcctgtactgtgccgagaggctttaccggtatatccgcagcaataaaccagttaccataatttccgtgatgagccatccttccgacgtaatggagattcgtatggtgaaagagaacttcaaggctcggcctggccagtacattaccctgcactgccccagcgtgagtgcgctcgagaaccacccctttaccctgaccatgtgccctacggagaccaaggccacctttggcgtgcatctgaaaatcgtgggcgactggactgagcgtttccgcgatctattacttccacccagcagccaagattcagagatcctcccattcattcagtctaggaattacccaaagctatacattgatggcccatttggatctcccttcgaagagtcactcaactatgaggtgtctctttgcgtggctggcggtattggggtgacaccctttgcaagtattctgaacaccctgctggacgattggaaaccttacaagttgaggcgcctctactttatttgggtgtgtcgagatattcagtcctttagatggtttgctgatctcctctgcatgctgcataacaagttctggcaggagaatcgccctgactatgtgaacatccaattatacctaagccagactgatggcatccagaagattatcggggagaagtatcacgcgcttaacagtcgactgtttattggccgtccgaggtggaagctgttgtttgatgagatagcaaagtataacaggggaaagaccgtaggcgtattctgctgcgggccaaactctctcagcaagacccttcataagttaagcaaccagaacaattcctatgggacccgctttgaatataataaggagtcattcagctag

SEQ ID NO: 232003 - DNA, 1665 bp, Artificial Sequence
  Description of Artificial Sequence: Synthetic coding sequence
atgaatgtgctactcttctggaaaacttttttgctgtataatcaggggcctgagtatcattatctgcaccaaatgcttggacttggcctctgcctatcccgcgcaagcgcatctgttctgaaccttaactgctccctgatcctattaccaatgtgccgaacactcctggcatatcttagaggatcacagaaagtaccctcccggcgtactaggagactgctggacaagtcaagaaccttccacataacttgcggcgtgactatctgtattttcagcggagtccacgtggccgctcacctcgtcaacgcacttaacttctccgttaactactcggaggattttgtggaattaaatgcggctagatacagggatgaagatcccagaaagctgctgttcacaacggtgcctggcctgacaggcgtatgcatggtcgtcgttctttttctgatgattactgcttctacctacgccatccgtgttagcaattatgacatcttctggtatactcacaatttgttttttgtgttctacatgctgctgacactccatgtgtcggggggtcttctgaagtaccagactaacctcgacacgcacccacccggatgcatctcccttaatcggacaagctctcagaacatttctctccctgagtacttcagcgagcacttccatgagccattcccagaaggattttctaagcccgctgaatttactcaacataaattcgtcaagatatgcatggaggaacccaggttccaggccaatttccctcaaacgtggctttggattagtgggcctctctgcctctattgcgccgagagattgtacagatacataagaagtaataagcctgtgaccattatcagtgttatgtcacaccccagcgacgtcatggaaattcggatggttaaggagaacttcaaagctaggcccggacagtatattacattacactgcccaagcgtctctgctctcgagaatcacccctttactctgaccatgtgccccaccgagacgaaagccaccttcggtgtgcatctcaaaattgtgggtgactggacagagcgattccgcgacctgcttttgcccccttcaagtcaggacagtgagattctgcctttcatccagagcaggaactatccaaaattgtacatcgacgggccattcgggagcccttttgaagagtcactcaattacgaggtttcattatgcgttgctgggggaatcggggtaacgccgttcgcaagtatactgaatactctgctggacgactggaagccgtacaagctgcgccgtttgtattttatttgggtgtgtcgcgatattcagtcttttcggtggtttgctgatttactttgcatgctacacaacaagttttggcaggaaaaccgaccagattacgtgaacatacagctctacctgagccagacggatggcatacagaaaattatcggtgagaagtatcacgctctgaacagcaggctgtttatcggacgtcctaggtggaaattgcttttcgacgaaatcgctaaatataatagaggtaagactgtcggtgtgttttgctgcggtcccaacagtctgagcaaaacacttcacaagctgtctaaccaaaacaactcctacggcaccagatttgagtataataaggagtcctttagctag

SEQ ID NO: 232004 - DNA, 1665 bp, Artificial Sequence
  Description of Artificial Sequence: Synthetic coding sequence
atgaacgtgcttctgttctggaaaactttcctgctgtataatcaaggaccagagtaccattacctgcaccagatgctggggcttggtctctgcctatctcgggcttcagcatctgtcctgaacctcaactgttcactgatattgttgccaatgtgtcgcaccttgctggcatacctacgtggcagccagaaggtaccttcaagacggacaaggcgcttactcgacaaatcccgcacctttcatatcacttgtggggttactatctgcatattcagcggagttcacgtagcggctcatttggttaatgctcttaacttctccgtgaactactctgaggactttgtggaactcaacgcggctcgatacagagatgaggacccacgaaagctcctctttaccacagtgccgggattgacgggagtttgtatggtggtagtgttatttctaatgataacggcttcaacttacgctatcagagtttccaattatgacatcttttggtacacgcataacctgttcttcgtgttctacatgctgctcactctgcacgtatcagggggattactgaagtatcagactaaccttgatactcacccacccggttgtatatcattgaacaggacaagcagtcagaatatctcgttgccggagtacttcagcgaacacttccatgagccgtttcccgagggattctctaaaccagctgagttcacacagcataagttcgttaagatatgcatggaagaaccgaggtttcaggcgaatttcccacagacctggctatggatctccggcccactgtgcctgtattgcgcagaacgactgtataggtacattaggagcaataagcctgttaccataatctccgttatgagtcaccctagtgacgtcatggagattcggatggtcaaggaaaactttaaagcccgtcccggacaatatatcacccttcattgtccaagtgtctccgccctggaaaaccacccattcaccctgaccatgtgccccaccgaaaccaaggctactttcggtgtgcacctgaagatagtaggcgattggaccgagcgcttccgggatctgctgcttccaccttcatcccaagactcagaaattttgcctttcatacagtcaaggaactatcctaagctttacatagatgggccatttggatccccctttgaagagagcctgaattacgaggtgtcactctgtgtggcaggaggaataggtgtgacgccctttgcctccattctgaacaccctgcttgatgactggaagccgtacaagctccggaggctgtatttcatttgggtctgccgcgatatacagtcatttcgttggtttgccgacctgttatgcatgctgcacaacaaattctggcaagagaatcggcctgattatgtcaatatccagctgtatctctctcagaccgacggtattcaaaagataattggcgagaaataccacgccttaaattcgagacttttcatcggccgaccccgatggaaattgttgttcgatgaaatcgctaaatataatcgtggtaagactgtgggagtgttttgctgtggtcccaatagcctgtctaaaacattgcataagctcagtaaccagaataactcttacggtactcgtttcgaatataataaggagagctttagctag

SEQ ID NO: 232005 - DNA, 696 bp, Artificial Sequence
  Description of Artificial Sequence: Synthetic coding sequence
atggcggtctcatggcgatcttggctggccaacgaaggtgttaagcacctatgtctattcatctggctgtcgatgaacgtgctcctgttctggaagaccttcttactctacaatcagggccctgagtaccattaccttcaccagatgctaggatgccccacggagaccaaggccacttttggggtccatctgaagattgtgggggactggactgaacgctttagagatctcctcctgcccccatcatcccaggattccgagatcctccctttcattcaaagccgaaattacccgaaggatgattggaagccatataaactccggaggctgtacttcatctgggtatgccgagacatccagagtttccgctggtttgccgatttgctctgcatgctacacaataaattctggcaggagaatcgcccagattatgtgaatatccagttatacctgtctcaaaccgacggcattcagaaaattattggagagaaatatcatgcactgaattctaggcttttcatcggcagacctcgatggaagctgctgtttgatgaaatagccaagtacaatcgtgggaagactgtgggcgtcttctgctgtgggccaaactcactgtcaaagaccctgcacaaattgtcaaatcagaataacagttatggaacaagattcgagtacaataaggagagctttagttag

SEQ ID NO: 232006 - DNA, 1617 bp, Artificial Sequence
  Description of Artificial Sequence: Synthetic coding sequence
atggctgtgagctggaggtcgtggctggctaacgagggggtgaaacatctgtgtctctttatttggctgtctatgaacgtccttctgttctggaaaacgtttctgctctataaccaagggcctgaatatcactacctgcaccaaatgttgggtctgggactctgtctgtctcgggcaagcgcctctgtgttgaaccttaattgtagcctcatcctgctcccaatgtgtcgaacgcttctcgcctatcttaggggcagtcaaaaggtcccttcccgcaggaccaggagacttttggacaaatccaggacttttcatatcacttgcggggtgacgatatgcattttttcgggcgttcatgttgcggctcacctggtaaatgccttaaatttcagtgtgaactactccgaggactttgttgagctgaatgccgcacggtaccgtgacgaggatcctaggaaattgctgttcacaaccgtacccggtctgacaggagtgtgtatggtcgtggtgttattcctcatgattacagcatccacctacgcaatccgcgtatctaattacgatattttttggtacactcacaacctgttttttgttttttacatgttattaacacttcacgtgagcggcggtttgctaaaataccagaccaatctcgatacccacccgccaggatgcatttctctcaacagaacttccagccaaaacatctcactgcccgagtacttttcagagcacttccacgagcccttcccagagggtttttctaagcctgccgaatttactcagcacaagtttgtcaagatatgtatggaggagcctcgattccaggccaattttcctcaaacctggttatggatcagcggtcctttgtgcttatactgtgctgaaagactgtatcggtacatccggagcaataagcctgtgactattattagtgtgatgagccatccgtccgatgtaatggagattcgtatggtgaaggagaacttcaaggctaggcctggccagtacatcacgttgcactgtccaagcgtctcagcacttgagaaccatccatttactctgaccatgtgcccaaccgaaacgaaagccaccttcggagtgcatctgaaaatcgtgggcgattggacagagcgattccgcgacctccttctacctccctcctcgcaggatagcgagattcttcccttcattcagtcaagaaactatcctaaggacgactggaaaccttacaagcttcggagattatactttatttgggtgtgccgtgacatacagagcttcagatggttcgccgatctgttgtgcatgttacacaacaaattctggcaggagaacaggcccgactatgtgaacatccagctgtacctttcacagactgatggcatccagaagattatcggagagaagtatcacgccttgaattccagactctttatcggtcggccacggtggaagctgctgttcgacgaaatcgccaaatacaatcgtgggaaaaccgtgggggttttttgctgtggccctaattctttaagcaaaaccctacacaaacttagtaaccagaataatagctatggcactcgctttgagtataacaaagaatccttctcgtag

SEQ ID NO: 232007 - DNA, 1665 bp, Artificial Sequence
  Description of Artificial Sequence: Synthetic coding sequence
atgaacgtgctattgttctggaaaacattcctgctctacaaccaaggacctgagtaccactacctacatcaaatgcttggcctggggttatgcctctctcgtgctagtgcaagcgtgctgaacctgaactgttctctgattctcctgcctatgtgcagaacgctattggcttacctccgaggttctcagaaagtcccctctagacgaacacggaggctgctggacaagtcccggacctttcatatcacctgcggggtaaccatctgtattttctccggtgtgcacgtggcggctcacctggtaaacgccctgaatttctcggtcaattatagtgaagattttgttgagctgaatgccgctcgataccgcgacgaggacccacgaaaacttctatttaccacagtccccggtctgacaggcgtctgtatggtggtagtcctattcttgatgattacagcctccacctacgctattcgagtttctaactatgatatattttggtatacacacaacctgttctttgtcttttacatgctgctaaccctacatgtttccggtggactcttgaagtatcagactaatctggatactcatccacctggttgcatcagtcttaaccgaacgagcagccagaacattagtctaccagagtacttttctgagcactttcatgagccattccctgagggctttagcaagcccgctgagtttactcagcacaagttcgttaaaatctgcatggaggagccaagattccaagcaaacttcccacaaacttggctgtggatcagtgggcctctctgcctttactgcgcagaacgcttgtaccgttacattcggtcaaacaaacccgttactattataagcgtcatgagccacccctcggacgtgatggagattaggatggtgaaggagaattttaaggccagacccggtcagtacataacactgcattgtcccagtgtgtccgccctggagaaccacccgttcacactgaccatgtgcccgaccgagactaaggcgacattcggcgttcacctgaagatagtcggtgattggaccgagcggtttagggacctgctgctgccaccctcctcccaggattccgagatcttaccatttatacaatccagaaattacccaaagctgtatattgacgggccttttggttcacccttcgaggagagcttgaattatgaggttagtttatgtgttgcgggaggtatcggagtgacccctttcgccagtatcctgaacaccttattggacgactggaagccttataagctgagacgtctgtacttcatttgggtgtgccgggatatccagtcattcaggtggtttgctgacttactctgcatgttgcataataaattctggcaggagaaccggcctgattatgttaatatccagctgtatttaagtcaaacggacggcatacagaaaatcatcggtgaaaagtaccacgctcttaatagccggttattcatcggtcgaccacgatggaagctactattcgacgaaatcgccaagtataaccgtggcaagacagtgggcgtcttttgttgtgggcctaattccctctcaaagaccctgcacaagctgtctaatcagaacaactcatacggaacccgctttgaatataacaaagagtccttctcctag

SEQ ID NO: 232008 - DNA, 1665 bp, Artificial Sequence
  Description of Artificial Sequence: Synthetic coding sequence
atgaatgtgttgctcttctggaagacgttcctcctctacaaccagggtcctgagtatcactatctgcaccagatgctgggcttgggtttatgcctgtcccgggcatctgcctctgtcctgaatcttaattgcagtctgatcctccttccaatgtgtcgaacgttgttggcttatttgcgaggttcacagaaggtgccttcgaggcgtacacgacgcctgctcgataagtcgagaactttccatataacatgcggagtaactatctgtatattcagcggagtccatgtagcagcccatctggtcaacgccctgaacttctccgtgaactatagtgaagacttcgtggaactcaacgccgctcggtatagagacgaggaccccaggaagcttctgttcaccacagtgcccggtttaacaggagtttgtatggtggtggtcctgtttctgatgatcactgcttctacatacgcaataagggtgtcgaattatgacatcttttggtacacccacaatctgtttttcgtcttctacatgttactgacgcttcacgtctctggcggactcttgaaatatcagaccaatctcgatacccatcctcctggctgtatatctctcaatcggaccagttcccagaacatatctctcccagagtatttttccgagcattttcacgagcccttccccgagggcttttcaaagcccgcagaattcacacagcataagttcgttaagatatgcatggaggagccccgttttcaggctaattttccacagacgtggctctggatctctggacctttatgtttgtactgtgctgagcgcttatacaggtacattcggtcgaataaacccgtcaccatcatctccgttatgtcccatcctagtgacgtaatggagattcgcatggtgaaggaaaattttaaggccaggcccggtcagtatatcactctgcactgtccttctgtctccgctctagagaatcaccccttcactctgacaatgtgcccaacagagacaaaagccacttttggtgtccaccttaaaatcgttggcgattggacagagagattccgtgatttgctactaccaccatccagccaggactcggagatccttccgtttatccagtctcgtaactatcccaagctttacattgacggaccgtttggaagtcccttcgaagagagtctcaattatgaggtgtccctgtgcgtggccggaggtatcggagtgactcctttcgcctccatcctcaatactctgctggatgactggaaaccgtacaaactccgacggctctacttcatttgggtctgtagggatatccaaagcttcagatggttcgccgacctcttgtgtatgctgcacaataagttttggcaagaaaatagacctgactacgtgaacattcaactttacctgagccagacagacggaattcagaaaattattggggagaaatatcatgctctcaacagcaggctcttcatcggcagacctaggtggaagctactgttcgacgagattgcaaagtacaatcggggaaagactgtgggtgtgttttgctgtgggccaaacagcctgtccaagacactgcataaactttcaaaccagaataattcctatgggacccggtttgaatacaacaaggaatcattctcttag

SEQ ID NO: 232009 - DNA, 2193 bp, Artificial Sequence
  Description of Artificial Sequence: Synthetic coding sequence
atggcctttgtgtgcgccggtctctcagacacaatgtccgcagaggaggacgctagatggttgaggtgggtgactcagcagttcaaaactattgccggagaggacggggaaatctctctgcaggagttcaaggccgctctccatgtcaaagagtctttctttgccgagcggtttttcgctctgttcgactctgatcgatccggcacaatcaccttgcaggagctgcaggaagcattgacgctgctgattcacggctcccccatggataaactgaagtttctcttccaagtttatgacatcgacggctctgggtctatcgatcccgacgaactgcggaccgttctgcagtcttgcctgcgggagtcagctattagcctgcccgatgaaaagttggaccagttgacactcgccctgttcgagtcagccgatgcagatggtaacggagccatcacatttgaggaattacgagacgagctgcagcgtttcccaggtgtgatggaaaaccttacgatctccgccgctcactggttaacagcccctgcaccacgcccacgtccgcgaaggcctcggcagctgacaagagcctattggcataaccacagatcccagctgttctgcctcgctacatatgcaggactgcatgtcctcctctttgggttagccgcatccgctcatagggaccttggcgctagcgtcatggtggcgaagggctgcgggcagtgtctgaatttcgattgttcgttcatcgccgttctcatgttgcggagatgtttaacatggcttagggccacttggctggcccaggtcttacccttggatcagaatatccagttccaccagttaatggggtatgttgtggttggactgagtcttgtgcacactgttgcccatacggtaaactttgtgctgcaggctcaggccgaagccagtcctttccagttttgggagctgctgcttaccacacggccaggcattggttgggtgcacggctccgccagccccaccggcgtcgcccttctgctgttgctgctgctaatgttcatttgcagcagcagctgtattaggagatctggccactttgaagtcttctactggacgcatctgtcttacctgctggtttggctgctcctgattttccacggcccaaatttttggaagtggctcctggtgccagggatcctcttttttcttgaaaaagctattgggctcgcagtgtcaaggatggctgccgtgtgcatcatggaggtgaacttactgccgtccaaggtgactcacctgctgatcaaaaggccgcctttcttccattaccggcctggagactatctctatttaaatatcccaactattgccaggtacgagtggcacccattcactataagctctgcccctgagcagaaggacaccatttggctacacattcgctctcagggacaatggaccaatcggttgtacgagagcttcaaagcgagtgatccacttggtagaggaagcaagcggctgtcaagatccgttaccatgcggaaatctcagagaagctctaagggcagtgaaatcctgttggagaaacataagttttgcaatatcaaatgttatatagacggaccttacggaactcccaccagacggatctttgcgtctgagcacgccgtccttatcggcgctggaatcggaatcacgccttttgcctccattttgcaatctattatgtatcggcatcagaagcggaaacacacatgcccgtcctgtcaacactcgtggatcgagggggtgcaggacaacatgaaactgcacaaagtggatttcatttggattaatagggaccagcgctcttttgaatggtttgtgtcactgctaacaaagctcgaaatggatcaggcagaagaagctcagtatgggaggtttctggaactgcacatgtacatgacttctgctctcgggaaaaatgatatgaaagccatcgggctgcagatggcgctggatctcctggccaacaaagaaaaaaaggatagtatcacaggcctgcagacacgcacacagccaggcagaccggattggtccaaggtgttccaaaaggtggccgctgaaaagaagggaaaggttcaggtgttcttctgcggctcaccagccctggcaaaggtgctgaagggacattgcgagaaattcggctttcggttcttccaggaaaacttctag

SEQ ID NO: 232010 - DNA, 2298 bp, Artificial Sequence
  Description of Artificial Sequence: Synthetic coding sequence
atgaatacatccggagaccccgcacagaccggaccagagggttgtcggggtactatgtccgccgaggaggatgcccgatggctgcggtgggtgactcagcaatttaagaccatcgccggagaggacggggaaatatcactgcaagaatttaaggctgctttacatgtcaaagaatcattctttgcagagagattctttgccctgttcgactcagatcggtccggcacgatcacgctgcaggagctgcaggaagcgttaacgctgctcatccatggatctccaatggacaaactgaagttcctatttcaggtgtatgacattgatgtgtgtgctcgacaaggcgcttccgcagggactgaatggggtgcaggagctggcccacactgggcctcgtcacccctagggaccggatctggctcaatcgaccctgacgaactccgcacagtgctccagtcctgtcttagggaaagcgccatttctttgccagatgaaaaactcgaccagctcactctggccctgtttgagagcgctgatgcggacgggaatggggcaatcacatttgaagaacttcgcgacgaactccagagattccccggagtcatggaaaaccttaccatcagtgccgctcactggttaacggcccctgccccacgtcccagaccgaggaggccacggcagcttaccagggcctactggcacaatcatagaagccaactattttgtcttgctacatatgccggactgcacgtgctcttgtttggactggccgcatccgcacaccgcgacctgggcgcaagtgtcatggtggccaaaggctgtggccagtgtctgaacttcgattgtagtttcatcgctgtgctgatgctcagacgctgcttaacatggctaagggctacttggctcgcccaggtcctgccattggatcagaatattcagttccaccagctgatgggctacgtggtggttggtctgtccctggttcatacggttgcccataccgtcaacttcgttctccaggcgcaagctgaggcctcgccctttcagttctgggagctgctgttgaccacaaggcctgggatcgggtgggtgcatggatcagcgagtcccacaggcgtggctttgttactgttactccttctgatgttcatctgctccagctcttgcatcagacgctctggacatttcgaggtgttctactggacacatctctcatacttgcttgtctggctgcttctgatctttcacgggccaaatttttggaaatggctgctcgtccccggaatcttgttttttttagagaaggctataggactggcagtgagtcgtatggctgctgtctgcatcatggaagtgaatctcctgccatctaaagtgactcatcttctgataaagcgtccacctttcttccattacagacctggcgactacttgtatctgaacattcctacaatagctcgatacgagtggcatccttttacaatcagctctgcccctgagcagaaggatacgatttggctccatattcgatcccagggccagtggacaaacaggctttacgagagttttaaagcaagtgatcctctgggtcgcggttctaaaaggctatcacgctcggttaccatgagaaagagccagcgatcctcaaaggggtccgaaatattgctcgaaaaacataagttttgtaatattaagtgctatatagacgggccatacgggacgcctacgcgccgaatatttgcgtctgaacatgccgttcttattggagcaggaataggaataaccccttttgcatctatcctgcagtccatcatgtaccgacatcaaaagcgtaaacatacttgcccttcctgccagcacagctggatagaaggtgtgcaggacaatatgaagctacataaggtagatttcatctggatcaacagagaccagcgttcctttgaatggttcgtgagtctcctgacaaagctggagatggaccaggcagaagaggctcagtatgggaggtttcttgaattgcacatgtatatgacctctgccctagggaagaatgacatgaaggccattgggctgcagatggccctagatttgttggccaataaagagaagaaagactctattactggcctgcaaacaaggacacaaccaggacgccctgattggagcaaggtctttcagaaggtggccgctgaaaagaagggtaaggtgcaggtgtttttctgcgggagccctgccctcgccaaggtgcttaaggggcactgcgagaaatttggtttccgcttttttcaggagaatttttag

SEQ ID NO: 232011 - DNA, 2214 bp, Artificial Sequence
  Description of Artificial Sequence: Synthetic coding sequence
atgaacacatccggagacccagctcagactgggcctgaaggctgccgtggcaccatgtctgccgaggaggatgctcgatggttgcgctgggttactcagcaattcaagactatagcaggggaagacggggagatttctctccaggagtttaaagccgctctgcacgtcaaagaatcctttttcgccgagcgctttttcgccctgttcgattctgataggtccgggactattacattgcaggaattgcaggaggcattaacattgctgatccacggatctccaatggacaaactcaagtttctttttcaagtgtacgatattgacggatctggttcgattgatccagatgagctgagaacagtgctgcagtcctgcctgagggagagcgcaatctcgctgcctgacgaaaagttagaccagctcacgttggccctcttcgaaagcgccgacgctgacggaaacggagcaatcacattcgaggagctcagggatgagctacagcgttttcctggggtcatggagaacctcaccatatccgcagcgcactggctgaccgccccagcgcctagacccagacctcggcgacccaggcagctcactcgcgcatactggcacaatcacaggtctcagctcttctgtctggccacttacgctgggcttcacgtactcctgtttggcctggccgcatccgcccatagggacctgggggcttccgtgatggtggcaaaaggatgtggccagtgcctgaacttcgactgttcttttatagcagtgctcatgctcagacggtgtcttacatggctgagggctacatggttggcccaggtgctgccactggatcagaacatccaatttcaccagttgatggggtatgtggtggtcgggctttctcttgttcataccgtcgctcacaccgttaacttcgtcctccaggcacaggccgaggcttcacctttccaattctgggagctcctgctgacaacacggcctgggattgggtgggtccatgggtcagcgtccccgacgggcgtggcactgctgctgctgctgctactgatgtttatctgctctagcagttgtatccggaggagtggccactttgaggtgttttactggactcacctttcctacctgcttgtgtggttactgctgatttttcacggacccaacttctggaagtggcttctggtgcctggcatattgtttttcttggagaaagcgataggcctcgcagtctctaggatggcggcagtgtgcattatggaggtcaacctgctgccttctaaggtgacacatctgctaatcaagaggcccccattctttcattacagaccgggagactacctgtatttaaatattccaaccatagcacggtacgaatggcatcccttcacaatctcgagcgcacctgaacagaaagacactatttggctgcatataaggagccaggggcaatggacgaaccggctatacgagtcttttaaagcatccgacccactggggagaggttctaagaggctatctagaagcgtgaccatgcgtaaaagccagcgcagtagtaagggatctgaaattctgctggagaagcacaagttttgtaacataaagtgctatatcgacggtccatatggaacacctacaaggcggatttttgcttccgaacatgctgtgctgattggagctggcatcggaatcacccctttcgcttctatactccagagcatcatgtatcgccaccagaaaagaaagcacacttgcccttcttgccagcattcctggatagagggggtgcaggataacatgaagctgcataaggtggatttcatttggatcaatcgggaccagcggagcttcgagtggttcgtgagcttgctgacaaaactagagatggatcaagctgaggaggcccagtatggtagattcctagagcttcacatgtacatgacctctgcgctgggaaagaacgacatgaaagctattggactccagatggccctcgacttactggcaaataaggaaaaaaaagattcaattacaggattgcagactcgcactcagcccggaaggccagactggtctaaggtcttccagaaagtcgctgctgagaaaaaagggaaagtccaagtcttcttctgtggatctcccgctttagctaaggtgcttaagggacactgcgagaaattcgggttccgattctttcaagagaatttttag

SEQ ID NO: 232012 - DNA, 4419 bp, Artificial Sequence
  Description of Artificial Sequence: Synthetic coding sequence
atggataatgccctcttctgcctcgcggcagtgtctaacttagacattgagtccaagttatccgtgtactacagggctccatggcaccaacagcggaacattttcttgccagctacgcggccaccgtgcgtggaagagctacacaggcatgcacgtcaaagccttcaggccctacgcagggagcaccgcagcaggagcgaccggagagagcagagagcggctgcgcctctgtcaattgccgctcctccgctcccagcttacccacctgctcatagccagagacgacgggagttcaaagataggcactttctgacttttaactcaacgcgtagtccctcaccaaccgaatgctgtcacatgacaccatggagcagaaagagccaccctcccgaagatgaggatacggacgtgatgttgggccagaggccaaagaaccccatacacaacataccatctactctggataaacaaaccaactggtcgaaagctcttcctctgcctacacccgaggagaagatgaagcaggacgcacaggtgatcagcagctgcataatcccaataaacgtgaccggggtaggctttgatcgggaggcttctattagatgctctctggttcactcacagagtgttctgcagaggcgccgtaagttacgcagaaggaaaactatctcaggtatacctcgcagggtgcagcaggaaattgacagtgatgaaagccctgtggcgcgagagaggaatgtaatcgtgcacactaacccagacccctctaatactgtcaaccgcatatcagggacacgtgatagcgagtgccagaccgaagacatcttgatcgctgccccatcacgccgaaggatacgggcacagagaggtcagtcaatcgctgccagcctgagtcactctgcaggaaacatctccgcgcttgcggacaagggcgataccatgttcacccccgctgtaagctccaggactcgcagtagaagtctacctcgggagggaaatcgagggggtgacgccgaaccaaaagtgggagctaaacctagtgcctatgaggaaggcgagagctttgtcggagatcatgaaaggaccccaaacgacttctccgaggcaccttcgagtccatctgctcaggaccatcagccaacgctcgggttggcctgctctcaacacctgcatagcccccaacacaaactttcagagagaggtcggtcacggctgtcccggatggccgcagatagcggaagttgcgatataagttcaaatagcgatactttcggcagtccgatccactgcatttccaccgcgggtgtactgctatctagccacatggatcaaaaggatgaccaccagtcctcatcaggtaactggagcggatcctctagcacctgtcccagccagacatcagaaactattccccctgcagcaagcccaccactcactggttcaagtcattgtgattcggagctctctctcaatacagcacctcatgcaaatgaggacgcgagtgtgttcgtgacagagcaatataacgaccacttggacaaagttcgcggtcatcgggctaatagcttcacgagcacggtggctgacttgctggatgaccccaacaatagtaataccagtgacagcgagtggaattatttgcaccaccaccatgatgcgagttgtagacaggactttagccccgagcgacctaaggccgattcactgggatgtccaagtttcacctccatggctacttacgacagctttctggagaaatctccctctgataaggctgacaccagtagccatttcagcgtggacactgaggggtattacaccagcatgcatttcgactgcggactgaaaggcaacaagagctatgtatgtcattacgccgctctgggcccagagaacggtcaaggagtaggtgcatccccgggactcccagactgcgcatggcaggactacctcgaccataagaggcagggccgaccgagcatttcattcaggaagcctaaggcgaaaccgacacccccaaaacgttcttctagcctgaggaagagcgacggaaacgccgatatttcagagaaaaaggaaccgaaaatatcatctggtcagcacttgcctcatagctcacgcgagatgaagttaccactggacttcgcgaatacaccctcccggatggagaacgcgaacctgcccactaaacaggaacccagttggatcaaccagagtgagcagggaattaaagagccacagttggatgcctccgacattcccccattcaaggacgaggtggccgaatccacccactacgctgatctctggctgttaaatgacttaaagacaaacgacccataccggtcgctgtctaatagttccaccgcaacaggaaccacggttattgagtgtataaaatcccctgagtcgtcggagagccagaccagccagagtgaatctcgcgctacaacaccatccctgccttctgtggacaatgaattcaaactggcttccccagagaaattggctgggctggcatccccaagctccgggtacagcagccaatccgaaacccctacctcttcatttcctaccgcattttttagtggccctctttcacccggtgggagcaagcgtaagccaaaggtgcctgaaaggaaatcctccctacagcagccttcactcaaggatggcacaatctctttatctaaggatctcgaactgcccatcatccctcctacccatctcgacctaagcgctctgcacaatgtgctcaacaagccctttcaccacaggcaccccttacacgtgttcacccataataaacagaacaccgtcggggaaaccctccgatctaaccctcccccaagtctggcaattacgcctacgatcctcaaatctgtaaacttacgttcaataaataagtcggaagaagtgaagcagaaggaagaaaacaacacagacctcccatacctcgaagagtctacactgaccacagctgccctgagcccatccaagattcggcctcacaccgcaaacaaatctgtttcacgacagtactccaccgaggacacaatcctgtccttcctcgattcttccgctgtggaaatgggcccagataagctgcatctcgagaagaactcaactttcgacgttaaaaatagatgcgacccagaaactataactagcgctgggtcatcactattggacagtaacgtgacgaaagatcaggtgcggaccgaaaccgagcccatccccgaaaacactccgaccaagaactgcgcgttcccgacagaggggttccagagggtatccgcagccaggccaaatgatctggatggtaagatcatacagtatggtcctgggcctgacgaaactcttgaacaggtgcaaaaggccccaagcgccggtctcgaagaggtggcacaacccgagtcggtcgatgtcatcacaagtcagagtgattctcctactagagccaccgatgtttccaatcaattcaagcaccagttcgttatgtctcgccatcatgataaggtgcctggaaccatcagttatgagtcagaaatcacatccgtaaatagtttccccgaaaagtgctcgaaacaggaaaatatcgccagcggaatatcagccaaatctgcttccgacaattctaaagccgaagaaactcagggaaatgtggacgaggcctcactcaaggaaagctccccgagcgacgactctatcatctctcctctgagtgaggatagccaagcggaggccgagggtgtctttgtctccccgaacaagcctcgcaccaccgaagacctcttcgcggtgatccacagatctaagcggaaggttttaggacggaaagatagtggtgacatgtctgtgagaagcaaatcccgggcaccactgagctctagcagctcttctgcctcttcaattacttcccctagcagcaatgtgaccactcctaattcccagcgctcaccaggactgatttatagaaatgcgaaaaagtccaatacgtccaacgaggagttcaaactactcttacttaagaagggttcaagaagcgacagttcttataggatgtccgcaactgagattcttaaatccccaattctgcctaaaccaccgggagagctcaccgccgagagccctcaatctacagatgatgctcaccaagggagccagggtgccgaagccctgtcaccgctcagcccctgttcccccagggtgaacgcagaagggttcagctctaagtcattcgccacgagtgcatccgcccgagtgggtagaagtagagcacctccagccgcaagtagtagcaggtactcggttcgctgccgtctgtacaacaccccaatgcaggctatctccgagggggagaccgagaatagcgacgggagcccccatgacgatcggtcgtcccagtcctctacttag

SEQ ID NO: 232013 - DNA, 4892 bp, Artificial Sequence
  Description of Artificial Sequence: Synthetic coding sequence
atgcccttcgccaagcgcatcgtcgaaccacaatggctttgccgccaacggcgacccgcaccaggacccgctgtcgacgcaagcggaggctcagcggagcctccaccacctctgcagcccccaggaaggagagacctggacgaggtagaggcccctggccctgaagaaccagcacgggcagtccccgctccttctgggctgcctcccccacctcctccgctgcctgcaccagcggaccagactcagcctcctcatggggaggcgagcgtggcaggagaagagagcaccgcaggcatcccagaggctgctcctgccgctggggaggcttccagcgcagcagcagccgctgctgtactgctcatgctggacctatgcgcagtcagtaacgctgccctggccagggttctgcgccagctctcagacgtggcaagacatgcatgcagtctgtttcaggaactcgaatccgatattcagctgactcacagacgcgtctgggctctgcaggggaaacttggcggagtccagcgggtcctgagtaccctcgatcctaagcaggaggccgtgcccgtgtctaatctggatattgaatctaagctgtctgtctactaccgcgcaccgtggcaccaacagcggaatatctttttgcccgctacccgaccaccttgcgtagaagagctccatagacatgctaggcagagcctacaggcgctcagacgagaacaccgctcacggtcagacaggagagagcaacgtgccgctgccccactttctatagccgcacctcctttgcctgcgtaccctcccgcacattcacaacgaagaagggagtttaaggatcggcattttcttacatcacaccctcccgaggacgaagacaccgatgtgatgttgggccagcgccctaagaaccctatccacaacatcccatctactcttgacaaacaaaccaattggtccaaagctctgcccttgcccactccggaggaaaaaatgaagcaggatgcccaggtaatctcgtcatgtattattcccatcaatgtaaccggcgtcgggttcgatagagaggcttctattcgatgttcgctcgtccattcacaaagcgtgctgcaacgtagacgtaagcttaggaggagaaagaccatttccggcatccctcgtcgggttcagcaggagattgactccgacgagagccccgtggcgagggaacggaacgtaattgtgcacactaatccagacccctctaataccgttaatcggatctccggcactagagattcggagtgccagaccgaggatattttgatagccgctccatcccggaggaggatcagagcccaaagagggcagtccattgccgcatctctgagccactccgccggaaatatctcagctctggcagacaagggcgacaccatgtttacacccgctgtcagctcccgaaccagatcgcgcagcctgccacgcgagggaaacaggggtggggatgcagagccaaaagtcggcgctaaacctagcgcctacgaagaaggggaatctttcgtgggagaccatgagagaacaccaaatgattttagtgaagccccttcaagcccatccgcacaagaccatcagccaacattgggcctggcctgttcccagcacctgcattctcctcaacacaagctttcagagagggggagatccagacttagtcgcatggcagccgacagcggctcttgcgatatcagctccaattctgacacattcggctcccccatccattgtatatcaacagccggagtcctgctgtcgtctcacatggatcagaaggatgatcaccaatcctcatccgggaactggtctggcagcagcagtacctgcccatcccagacgagtgagacgataccgcctgcggcatccccccctctgaccgggagctcacattgcgattccgaacttagtttgaatacagcccctcatgccaacgaggatgcttctgtgttcgtcaccgagcagtacaacgaccacctagataaggtaagagggcaccgggctaatagctttactagcacggtggcggaccttctggacgatcccaataactccaacacctcggacagcgagtggaactatctgcaccatcatcatgatgcctcctgccggcaggacttttctcctgagcgcccaaaggcagattcactcgggtgccccagtttcacatctatggctacatacgacagttttctggagaagtcacccagtgataaggcagatacatcgagccacttcagcgttgacaccgagggctattacacatcgatgcacttcgattgtgggcttaagggcaacaagtcgtatgtgtgccattatgctgcgctggggcctgaaaatgggcagggggtcggcgcaagcccgggtctccctgactgtgcctggcaggactatctcgatcataagcgccagggacggccaagtatttccttccggaagcctaaagccaagccaaccccgccaaagcgcagctcttcactccgaaagtctgacggaaatgcagatatatcagagaagaaagagcccaagatcagctccggacagcacttgccccatagcagccgcgagatgaagctgcccttggacttcgccaacacaccctcccgcatggagaatgctaatctccctacaaaacaggagccaagctggatcaaccaatcagagcaaggaatcaaggaaccccagctcgatgctagcgacatccctccttttaaagacgaggtcgcagagtccacacactatgccgacctctggctccttaacgacctaaagactaatgacccataccggagcctgagcaactctagtacagcaaccggtactaccgtcatagaatgcataaaatcacccgagagctctgagtcacaaacatcacagtctgaaagccgggctaccaccccttctctgccttccgtggacaacgaatttaagctcgcatcaccagagaagctggctggtctggccagtcctagttctggttacagcagtcaatccgaaaccccaacatccagctttccgacggcttttttcagcgggccattgagtccaggaggatctaaaagaaagcctaaagtgccagagagaaagagttcactccagcagcccagtctgaaggatggcacaatcagcctctccaaggacctggaactccccataatccctccgactcacctcgacctctccgcgctgcataatgtactgaataagccattccaccatcggcacccacttcatgtgttcacccataataagcagaacactgttggagaaactctgcgatccaatcctcccccttcactggcaataactccaacgattttgaaatcggtgaatcttaggtccatcaacaaatcggaagaggttaagcagaaggaagagaataataccgacttgccctatcttgaagagagcactctgaccaccgcagcactctctccaagtaagatcaggcctcacaccgccaacaagtcggtctctcgccagtatagcaccgaggatactattctcagctttctggatagttcagctgtggaaatgggccctgataaactgcacttggagaaaaacagcacattcgatgttaagaatagatgcgaccccgagacaatcacatccgcgggaagcagcctcttggactcaaacgtgacaaaagatcaggtgagaactgaaacagaacctattccagagaacacccctactaagaattgtgcattccccaccgaagggttccagagggtcagcgccgctaggccaaacgacctcgatggcaagatcatccaatacggacctggcccagacgagaccctcgagcaggtccaaaaggcgccatcagctgggctcgaggaggttgcccagcctgagtccgtggatgtgatcacatctcagtcagactcacccacacgcgcaactgacgtgagtaatcaattcaagcaccagtttgttatgagccgacatcatgacaaggtccctggtacgatcagctacgagagtgagatcacctctgtcaattcctttcctgaaaagtgctcgaaacaagaaaatatcgcttcagggatttctgctaagtcagccagcgataactctaaagcggaggagactcaggggaatgtggacgaagcgagcctcaaggagtccagcccgtctgacgacagcatcatttcaccactgagcgaggatagccaggcggaggcagaaggggtgtttgtcagcccaaataagccacgtacaactgaggacctctttgcggtgatacaccgttcaaaaaggaaggtcctagggaggaaagattccggagacatgtccgtgcgctctaagagtcgagcccctctcagctcctcatcttcatccgctagctcaattacctccccatccagcaacgtcacaacccctaatagccagcgctctcctggacttatctatagaaacgccaaaaagtccaatacgtcaaacgaggagtttaagctgctcctgctaaagaagggctcgagaagcgattcgtcttatcgaatgtcagctactgagatcctcaagtccccaatactccctaaacctcccggtgagcttaccgccgagagcccacagagtaccgacgatgcccaccaggggtcacaaggtgctgaggcattgtcccccctgtctccttgctccccccgagtaaatgccgaaggttttagcagcaagagctttgcgaccagtgccagcgctcgggtcggcagaagccgcgctccacccgctgccagcagctctagatatagtgtccgttgccggctgtataatacccctatgcaggccatttcggagggcgagacagagaacagtgacggctccccacatgatgataggtcctctcagtcttcaaccta

SEQ ID NO: 232014 - DNA, 4425 bp, Artificial Sequence
  Description of Artificial Sequence: Synthetic coding sequence
atggcgctggcttgttgtatgcctaagaacgccgctgtgagcaatctcgacatcgaatctaaactctctgtgtactacagagctccatggcaccaacaaagaaatatattcctgccagccactcgtccgccttgtgttgaagaacttcatcgtcatgcgcgacaatccctgcaggccctaaggcgagaacaccgatcaaggtcggatagacgggagcagcgcgcagccgcaccactgagcattgctgccccacctctcccagcgtatccccctgcccatagtcagcggaggagggaattcaaggacagacacttcctgacctttaactcaactcggtcccctagcccaaccgaatgctgtcatatgacaccatggtctcggaagtcgcatccacccgaagatgaagataccgatgttatgctgggccagaggcctaaaaacccaatccataacatcccatccaccttagacaaacagacaaattggtcgaaggctctcccgctgcccacgcccgaagagaaaatgaaacaggatgcccaggttatcagcagctgtataatccccattaatgtcacaggggtggggtttgatcgggaggcctccattcgctgctctctggttcatagccagtccgtattgcaaaggcgaaggaaactcaggcgtaggaaaacgataagcggaatcccaaggcgggtgcagcaggagatcgattcagatgagagccccgtggccagagagaggaacgtaatagtgcatacaaacccggatcccagcaacacagtgaaccggatctcaggcaccagagatagcgaatgccagaccgaggacatattgattgcggcaccatccaggcggagaattagggctcaacgcggacagagcatcgccgcttctctgtcacatagcgctggcaacatcagtgccttggcagacaaaggcgacaccatgttcacaccagctgtaagctcacgcacaagatcacgatctctgccgagagagggcaaccgcggtggtgatgcagagcctaaggtcggagctaaaccaagcgcatacgaagagggcgagtcttttgtcggggatcacgaacggacaccaaacgactttagcgaggccccatcctcacccagcgcccaggaccaccagccaactcttggcctcgcctgctctcagcacctgcatagcccccagcataagctatctgagagggggagaagtagactcagcagaatggccgctgactccggcagttgcgacattagctcaaactccgacacgtttggatcacctatccactgcatctctactgccggtgtcttgctgagttcacacatggaccagaaagacgatcatcagtccagcagtggcaactggtccgggagctcatctacctgcccaagccagacatccgagacgatccctccagccgcttcgcctcctctcactggatccagtcattgcgacagcgagctctccctgaacactgcccctcacgctaacgaagacgcgtctgtgtttgtgacagaacaatataacgatcatctggacaaggtgaggggacatcgagctaactccttcacaagtaccgtagccgatctgcttgacgacccaaacaactcaaacaccagcgactctgaatggaattatctccaccaccaccacgatgcctcttgccgccaggatttctcaccagagcgaccaaaagctgactcgctcggctgtccgagctttaccagcatggcgacatacgatagcttcctcgagaaatcaccttcagacaaagccgacacttccagccacttttccgtggatactgaggggtattatacctccatgcattttgactgtggactgaaaggaaataaatcatatgtctgccactatgccgctctgggacctgagaacggccaaggtgtgggggcatctcctgggctgcctgactgcgcctggcaagactacctggaccataagagacagggccgtcctagtatctccttccgtaagcctaaagccaagcctacgccacccaaacgatcttcttcgctgcgaaagagcgatggaaacgctgatatatctgagaaaaaggaaccgaaaatctcctccgggcagcacctgccccactcttcccgggagatgaaacttcccttggactttgccaatacacccagccggatggagaatgcgaacctgccgaccaagcaggaaccctcttggatcaaccagagcgaacagggcatcaaggagccacagttggatgcaagtgatattcccccattcaaagatgaagtagctgagagtacgcattacgcagacttatggctgttgaacgatcttaagacgaacgatccatataggagcctgagcaattcaagtacagcgactggcactactgtgattgagtgcattaagtctccagagtcttctgagtctcagacctcccaaagcgaatcccgcgcaactacccccagcctgcctagcgtggacaacgaatttaagcttgctagtccggaaaagctggcaggactggcaagtccatcttcaggctatagctcccagagcgagacacctacctcatcctttcctaccgcattcttctctggacctttgtcccctgggggttctaaacgtaagccaaaagtgcctgagaggaagtcctctttacaacagccaagcctgaaggacggaactatttctctttcaaaggacctggaactgccaattattccccctactcacctggacctgagtgctctccacaacgttcttaacaaacctttccaccataggcaccccctgcatgtgttcactcacaataagcaaaatacagttggggagactctccgctccaacccacctcccagcctagcaatcactccaactatactgaaaagcgtgaacctccggagcatcaacaagtcagaggaagtaaagcagaaggaagaaaacaacaccgacctcccttacctcgaagagagcacactgactacagccgctctctccccgtctaaaatacggcctcacacggcaaacaagagcgtgtctaggcagtatagtacagaggataccattctgtcttttctggactcgagtgccgtggagatgggacctgacaagctacatctggagaaaaactcaacgtttgatgtgaagaaccggtgtgaccctgagactatcacaagtgccggatcatccctacttgatagcaatgtcacaaaagaccaggtgagaaccgaaactgagccaatcccagagaatacccctaccaagaactgtgcttttccgacagagggctttcaacgggtttctgcagctcggcctaatgacttagatggaaaaataatccagtacggcccaggtccagacgagacacttgaacaagtccaaaaggcaccttccgcaggtctggaggaggtggcacagccagaaagtgtcgatgtcattacctcacagagcgacagtccaactagagccacggatgtgagtaatcagttcaaacaccagtttgtaatgtctcggcaccatgacaaggtgccaggcaccattagttacgagtctgagatcacaagcgtgaactcctttccagaaaaatgcagcaagcaagaaaatatcgctagcggtatcagtgctaaatctgccagcgacaatagcaaggctgaggaaacccagggtaatgttgatgaggcatccctcaaggagtccagtcctagtgacgattccatcattagccccctgagtgaagactcccaggcggaagcagagggtgtgttcgtgagcccgaacaagccacgaaccaccgaagatttgttcgccgtcatacacaggtcaaaacgaaaggtgttaggtaggaaagattcaggtgatatgtccgttcgttcaaagtcacgggcacccctgtcatcctccagtagtagtgctagtagcattacctcacctagttcaaacgtgaccactccaaattcccagaggagcccaggactgatttataggaatgcaaaaaagagcaatacgagcaacgaggagttcaagctgttgttgctgaagaagggcagcagatctgactcttcctaccgaatgtccgccacggagatcctaaaaagtccgatcctgcctaaaccaccaggtgagctcaccgctgagtcgccacagtcgactgacgacgcccatcaaggcagtcagggggcagaagctctgtccccccttagtccatgctctcctcgagtgaacgccgaaggttttagcagtaaatcattcgcaacatctgccagcgccagggtggggagaagccgcgctccaccagccgcatcctcgagccggtacagcgtccgatgccgcctatacaatacacctatgcaggcaatttctgagggggaaaccgaaaattcagatggttccccccatgatgaccgctctagtcagtccagtacttag

SEQ ID NO: 232015 - DNA, 255 bp, Artificial Sequence
  Description of Artificial Sequence: Synthetic coding sequence
cccgagcttcaagtttgcgtattttgtcgaaacaacaaggaggccatggcactatacacgactcacatcttaaagggacctgatgggcgtgtgctctgccccgtgctccggcgttacacatgcccactgtgcggagcgagcggcgacaatgcacacaccataaaatactgcccccttagcaaggtcccccctcctccagctcgccctcccccaaggagcgcacgggacggtccgcctggaaaaaaactcagatag

SEQ ID NO: 232016 - DNA, 879 bp, Artificial Sequence
  Description of Artificial Sequence: Synthetic coding sequence
atggaggcatttccctgggctcccagaagcccgaggcgtgggagggctccacctcctatggcccttgtgccaagtgctaggtatgtgagtgcaccgggtccagcccatcctcagccgttctcttcttggaatgactacctgggcctggctacattgatcactaaagctgtcgacggggaacccagattcgggtgcgctagaggagggaacggaggcggtggctcccctccctcttcctctagctcatcgtgttgctctccccacacaggagccggacccggagccctggggcctgccctcgggccacccgattacgatgaagatgatgacgacgactctgatgagccaggctctcgtggcaggtatctcggctctgcactcgagcttagagcgttagaactctgtgcagggcctgccgaagcaggtctgctggaggagagatttgcggagttaagtccctttgccggtagggctgccgcagtgctgctggggtgcgcccctgctgccgcagccgctgccacaacgacctctgaagccaccccgagggaggaaagggcacctgcctgggccgctgaacccaggctccacgctgcatcaggagctgcagctgcacgactgttaaagcctgagctgcaggtatgcgtattctgccgcaataataaagaagctatggcactgtacacaacccatattctgaaaggacccgacggacgcgtcctttgtcccgtcctgcgcagatacacctgccccctgtgcggcgcttctggagataatgcccatacaatcaagtactgtcccctttccaaagtgccaccacctccagctcgtcctcctcctcgttcggcgagggacggtcctcctggcaagaagctgaggtag

SEQ ID NO: 232017 - DNA, 3456 bp, Artificial Sequence
  Description of Artificial Sequence: Synthetic coding sequence
atgctgagacgcgtgacagtcgctgctgtttgcgcaacgcggagaaaactttgtgaggcaggcagggagctggcagccctatggggaatcgagacaaggggcagatgcgaagacagtgcggcagctcgaccttttcccatactggccatgccaggtaggaacaaggctaagtctacctgcagctgccctgatttgcaaccaaacggacaagaccttggtgaaaacagtcgcgtggctcgactgggcgcagatgaaagcgaagaggaaggacgacggggatccctctcaaacgccggagacccggagatagtcaagtcaccctccgaccccaagcagtacagatatattaagctccagaacggcctacaggccttactgatatccgatttgtcaaacatggaaggcaagactggaaacacgacagacgatgaggaggaagaggaggtcgaagaagaagaagaagacgacgacgaggacagtggtgccgaaattgaagatgacgatgaagaaggcttcgacgatgaagacgagtttgatgacgagcacgacgatgatttggacacggaggacaatgaactggaagaactggaagagcgggcagaggccaggaagaagacgacagagaagcaatctgccgcagcactgtgcgttggcgtcggatcctttgccgatcctgatgacctgcctggcctggcgcactttctggaacatatggtcttcatgggtagtctcaagtacccggatgaaaacgggtttgatgcattcttaaaaaagcacgggggtagtgataatgccagcacagattgtgagcgtacggttttccagttcgacgttcagcgcaaatactttaaagaggccctagacaggtgggcccaatttttcatccacccgctgatgatcagggatgccattgacagagaggtggaagccgtggatagtgaataccagctggcaagaccctctgatgctaatcggaaagagatgcttttcgggtccctggctaggcctgggcatcccatgggtaagtttttctggggaaatgccgaaactctcaagcacgagcccagaaaaaataatatcgatacgcacgcaagattacgcgagttctggatgagatactactcctcccattacatgacactcgtggtgcagagcaaggaaacgctagatactctggagaagtgggtgaccgagatcttctcccagattccaaacaacggcctcccaagacctaacttcggccacctgacagatccatttgacactcccgcattcaacaaattatatcgcgtggtgcctattagaaagatccatgccctgactataacctgggcgcttcccccacaacagcagcactacagagtgaaaccactgcactacatttcctggcttgtgggtcacgaaggcaagggatccattcttagttttttaagaaagaaatgttgggcgctggcactttttgggggtaacggagaaaccggcttcgagcagaatagcacgtacagcgtcttcagtatcagtatcacccttactgacgaaggctacgaacacttttatgaggtggcctacacagtgtttcagtatttgaaaatgctgcagaagctgggtcccgagaagaggatctttgaggagattaggaaaattgaagataacgagttccactaccaggaacagacggacccggtcgaatatgtggagaatatgtgtgagaatatgcagctctacccactacaggacattctgacaggcgaccagctgctgttcgagtacaaacccgaggtgattggagaggctttgaaccagctcgtaccacagaaggccaatttagtacttctgtccggagctaacgagggcaagtgcgatctcaaggagaaatggtttggtacccagtattccatcgaggatatagaaaacagctgggccgaactgtggaactccaactttgagctcaatccagatctgcatcttcccgcagagaacaagtatatagccacagattttacccttaaagctttcgactgtcccgaaaccgaataccccgttaagattgttaatacacctcagggctgcctgtggtacaaaaaagataacaaattcaagattccaaaagcttacataagattccacttaattagccccctgattcagaagtcggccgcaaatgtagtgctgtttgacatctttgtcaacatcctgacccacaacctggctgagccagcgtatgaagcagacgtagcccagctcgagtataagttggtcgctggagagcatggcttaattattcgtgtgaaagggtttaatcataagttaccacttttgtttcaactgattattgactatttagccgaatttaacagcaccccagccgttttcacaatgatcactgagcagctgaagaaaacatattttaatatactgattaaacccgaaacactggctaaggatgtcagacttctgatcctggaatacgctagatggagcatgatcgataagtatcaagccctcatggacggcctcagtctcgagtcgctgttgtcctttgtcaaggagtttaagagtcagctatttgttgaaggactcgtacagggaaatgtgacaagtacggaaagcatggactttctgaagtacgtagtcgataaacttaatttcaagcccctggagcaagaaatgcccgtccagtttcaagtggtggagttaccatcaggacaccacctctgtaaagttaaagccctgaataaaggggacgccaacagcgaagttacagtttattaccagagcggaaccaggtcactccgggaatatacactgatggagctgctggttatgcacatggaggagccatgtttcgactttctgaggaccaagcaaacattgggctatcatgtgtaccccacatgtcgcaacactagtggcattctgggcttcagcgtcacagtcggaacacaagctacgaaatacaactctgaagtagtcgataagaaaatcgaggaatttcttagctccttcgaagagaagattgaaaatctgacagaagaggccttcaacacgcaggtaacagcccttatcaagctgaaagagtgcgaggatacacacctgggcgaagaggtggacagaaactggaacgaggtggtcacacagcagtacctttttgatcggctggcgcatgagatcgaggctctcaaaagtttctccaagagcgacttagtgaactggttcaaagcccatagaggacccggatctaagatgcttagtgtccatgtagtgggctacgggaagtatgagctggaggaggacgggacccctagcagtgaggatagtaattctagctgcgaagtgatgcagcttacttacctgcccacatccccgctgctggccgattgcatcatcccgattacggacattagagctttcacgacaacgctaaaccttctgccgtatcacaagatagtgaagtag

SEQ ID NO: 232018 - DNA, 3660 bp, Artificial Sequence
  Description of Artificial Sequence: Synthetic coding sequence
atgctacgaagggtcacagtcgcagctgtgtgcgcaaccaggcgtaaactttgcgaagctgggcgtgaactggcagccctgtggggcattgagacaagaggtaggtgtgaggatagcgcggcagctcgccctttcccaatcctagcgatgccaggtcgcaataaggcaaaatcaacttgcagctgcccagacctgcagcccaacgggcaggatctcggagaaaactccagagtggcgagactaggcgcagatgagtctgaggaagaaggccgtagaggctccctgtcaaatgcaggggatccagaaatcgtcaagtcacccagcgatcctaaacaatatcgctatatcaagctgcagaatggcttgcaagcactactgatcagtgatctgagtaatatggagggcaagacaggcaacacaacagatgacgaggaggaagaggaagttgaggaggaggaggaggacgatgatgaagacagtggcgctgagatcgaagacgatgacgaagaggggtttgacgacgaggacgaatttgatgatgagcacgatgacgacctggataccgaagataatgaacttgaggaactggaggagagggccgaagccaggaagaagaccacagagaagcaacaactgcaaagtctgtttctcctgtggtccaagctgactgaccgtctttggtttaagagcacatatagcaagatgtcctcaacccttctcgtagagacaagaaatctgtatggtgtcgtcggcgcagaatcacgctctgcgccagtacaacatcttgcaggctggcaggcagaggaacagcagggcgaaaccgacacggtgctctcagccgctgccttgtgcgtgggagtgggatctttcgccgaccctgatgatctgcccggactggcacattttcttgagcatatggtctttatgggaagtttgaagtatccggatgaaaacgggttcgacgcgttcctcaaaaagcacgggggtagcgataatgcaagcacggactgtgaacggacagtgttccagtttgacgtccagcgtaagtattttaaggaagccctggacagatgggcacagttcttcatccaccctctcatgatcagggatgccatcgaccgagaggtcgaagctgttgacagtgaataccagctcgctaggccatctgacgccaacaggaaagaaatgctgttcggtagtctggcaaggccgggacaccccatgggcaagtttttttggggcaacgctgagaccctcaaacacgagcccaggaaaaacaatattgacactcatgccaggctccgcgagttctggatgagatattatagtagtcactatatgaccctggttgttcagagcaaagaaactctggacacgctcgagaagtgggtcacggaaattttttcacagatcccaaacaacggccttccacgacctaatttcggccaccttacagaccctttcgacactccagcttttaataagctgtatcgcgtcgtgcccattcgaaagattcacgctttgactattacctgggccctgccgcctcaacagcaacactacagggtgaagcccttgcattatatatcatggctcgtaggtcacgaggggaagggctctatccttagtttcctgaggaaaaaatgttgggcccttgccctgtttggcggtaatggtgaaactggctttgagcaaaatagcacgtacagtgtgttttccatttctatcacactgaccgatgaggggtatgagcatttttacgaagtagcttacacagtttttcagtacctaaaaatgctgcagaagcttggcccagagaaacggatctttgaggagatccgcaagatcgaggacaacgagtttcattatcaggaacagacagacccggtggagtacgtggagaatatgtgcgagaacatgcagctctacccattgcaagacattttgaccggggaccagcttctgttcgagtacaaaccagaggttattggggaggccctcaaccagctcgtgccccagaaggcgaacctggttctcctgtcaggcgctaacgaaggaaagtgcgacttgaaagagaagtggttcgggacccagtactcaattgaagatatcgaaaatagctgggctgagctctggaactctaatttcgagttaaatcctgaccttcacttaccggcagagaacaaatacatcgctaccgacttcaccctgaaagcttttgactgcccagagactgaataccctgtgaagatcgtgaatacacctcaagggtgcctttggtacaaaaaagacaacaagttcaagattcctaaggcctacattagatttcacctgatttctcctctgatccaaaaaagcgccgcaaatgtggttttatttgacatctttgtaaacatcttgacccacaacttagccgagcctgcttatgaggccgacgtggcccagctcgagtataaactcgtagccggagagcatggtctcataattagggtgaaagggtttaatcacaagttgcccttattattccaattgatcatcgactacctggcagaatttaacagtacccccgcagtgtttacgatgatcactgaacagttgaagaagacatacttcaacattctgatcaagccagaaacattagccaaagacgtgcggctgctaatcctggaatacgcaagatggagcatgatcgacaaataccaggcactcatggatgggctatccctggagtctctattgtctttcgttaaagagttcaagtcccagctatttgtggaaggcctcgtccaaggtaacgtgacaagcaccgagagcatggactttctgaaatacgtggtcgataagttgaatttcaaacccctcgagcaggaaatgcctgtgcagtttcaggtggtggagctgcccagtggccaccacttatgcaaagttaaagcgttgaacaagggtgatgccaattccgaagtcacagtatattatcagtcaggcacccggagcctgcgggagtatactttgatggagctgctggtgatgcacatggaggagccttgtttcgacttccttagaactaaacagactctgggctaccatgtctacccaacctgcaggaatacctccgggatcttgggatttagtgtgacagtcgggacccaggccacaaaatataacagtgaagtagtagacaaaaagattgaggagtttttgagctcattcgaagagaagattgaaaacctgaccgaggaggccttcaatacccaggtaaccgctctgattaagttgaaggaatgcgaagacacacacctgggagaggaggtagacaggaattggaacgaggtggtgactcagcaatacctctttgatcgccttgcacatgaaattgaggcactgaagtcttttagtaaatcagaccttgtaaattggtttaaggcacatagaggacctggaagtaaaatgctgtctgttcatgtggtaggttacggcaaatatgagttagaagaggatggtaccccttcttcggaagactccaactcaagctgtgaggtgatgcagctgacgtacctgcctaccagccccctgctggcagactgcatcatccctataactgacatcagggcctttaccaccacccttaatctgttgccctaccacaaaatcgtgaaatag

SEQ ID NO: 232019 - DNA, 1662 bp, Artificial Sequence
  Description of Artificial Sequence: Synthetic coding sequence
atgcttcagaaacttggacccgagaagcgaatctttgaggaaataagaaaaatcgaagacaacgaattccactaccaggaacagactgaccccgtggaatacgtggaaaatatgtgtgaaaacatgcaactttaccccctccaggacatcctgaccggcgatcaactgctgttcgaatataagcccgaagtaataggggaagcattaaatcaactggtcccgcaaaaagctaatctggtcctcctcagtggagccaatgagggaaagtgcgatctcaaggagaaatggtttgggactcaatattcaatcgaagacattgaaaatagttgggcagaactctggaactcaaatttcgagctcaacccggacctccacctcccggctgaaaacaagtacatcgcatatatacgctttcaccttatttcccccctgattcagaaatcagctgcaaatgtggtgctttttgatatatttgtcaatatcctgacccacaacctcgccgagcccgcttatgaggccgacgtggcccagttggagtataagcttgtcgccggagaacacggactgatcatcagggtgaagggtttcaaccataaactgcctctgctctttcagctgatcatcgactatctagccgaatttaatagcactcctgcggtgttcaccatgatcactgagcagctaaaaaagacgtatttcaatatcctaattaagcccgagaccctcgcaaaggatgtgagactgctgattctagagtatgctcggtggagcatgatcgataaataccaagccttaatggatgggctatcccttgagagcctgctaagttttgtgaaggagtttaaaagtcagctcttcgtggaaggcctcgtccagggaaatgtcacaagcactgaaagtatggacttcctgaagtatgtggttgataaactgaacttcaaacccttggagcaggagatgccagtgcagtttcaagtagtcgaactcccatccgggcaccacctgtgcaaggtcaaggccttaaacaagggcgacgctaacagcgaagtgacagtttattaccaatccggaaccagatcgttgcgggagtatacgttaatggagctcttggtcatgcatatggaagaaccctgtttcgactttttgaggaccaaacagactcttggcagcgaggtggtggataaaaagattgaagaatttctgtcctcattcgaagaaaaaatcgagaacctcaccgaggaagcttttaacacccaggtgactgctttaataaagttgaaagagtgtgaagatacacacctcggcgaggaagtcgaccggaactggaatgaggtcgtcacacagcagtacctctttgaccggctggcacatgagatcgaagcactcaaaagtttcagtaaaagcgatcttgtgaactggtttaaagcgcaccgaggacctggttcgaaaatgctgtcagtgcatgtggtcggctatggcaagtatgagctggaggaagacggcaccccatcctctgaggactccaactcctcttgcgaagtcatgcaactgacctatctaccgacctcaccactgctggcggattgcattatccctatcacagacatccgtgcctttacgaccactcttaatttgctgccctatcacaagattgtcaaatag

SEQ ID NO: 232020 - DNA, 1617 bp, Artificial Sequence
  Description of Artificial Sequence: Synthetic coding sequence
tgaaaaattgaggacaacgaattccactaccaggaacagaccgacccggtcgagtatgttgagaacatgtgtgaaaacatgcaactctatcccctgcaagacatcctaactggagaccagttactttttgaatacaagcctgaggtcatcggagaagccctgaatcagcttgtgccgcagaaagcaaacttagtgctattatctggggcaaacgaaggcaaatgtgacttgaaagagaaatggtttggcacccagtactctatcgaagacatcgagaacagctgggcagagttatggaactccaattttgaactcaaccccgatctgcacttgccggcagagaataaatatatagcttacatacgttttcacctcatcagtcctcttatccaaaaatctgccgcaaacgtagtcctgtttgacatctttgtgaacatcctgacgcataatctggcagagcccgcttatgaggctgatgtcgctcagctcgagtacaagttggtcgccggagagcacggcctaattatacgcgtgaaaggttttaaccacaagctgccccttctcttccagttgattatcgactatctggccgaatttaacagcactcccgcagtatttaccatgatcaccgagcaactgaaaaagacatacttcaacatcctaataaagcctgagacattggccaaagacgttcggttactgattctggaatatgctcgttggtccatgatcgacaaataccaggcgctcatggatggactgtccctcgagagtctcctgtctttcgtgaaggagtttaagtcacagcttttcgtggagggactcgtgcaagggaacgtgacctctacagaatccatggatttcctcaagtacgttgtggacaaattaaacttcaagccgttggaacaggagatgccagttcagttccaggtggtggagctccccagtggacatcatttgtgcaaagtgaaggccctcaataaaggggacgcgaattcggaggtcaccgtttattaccaatccggaacgagaagccttagagaatacaccctgatggagctgctggttatgcatatggaggaaccctgcttcgatttcctgaggaccaagcagactctgggatccgaggtagtcgacaagaaaatcgaggaatttctgagcagttttgaagagaagatcgagaaccttacagaggaggctttcaatactcaagtgacggcgctcataaagctaaaggagtgtgaggatacccacttgggagaagaggtggatcgcaactggaatgaagttgtgacccagcaatatctgttcgacagactcgcccacgagatcgaagccttgaagtcattcagcaagtccgacctggtgaactggttcaaggcccatcgaggcccaggcagcaaaatgctgtctgtacatgttgttggctatggcaagtacgagctggaggaggatggcactccttccagcgaggactctaacagcagctgcgaggtgatgcagctgacatatctccccacctctccactgcttgctgactgcataatccccatcaccgatattcgcgcttttacaactaccttgaaccttctcccataccacaagatcgttaagtag

SEQ ID NO: 232021 - DNA, 3264 bp, Artificial Sequence
  Description of Artificial Sequence: Synthetic coding sequence
atggagggtaaaacaggcaacactaccgacgatgaggaggaggaagaagtcgaggaggaggaggaagacgacgatgaggactccggggcagagattgaggacgacgacgaagaagggtttgatgacgaggacgagtttgacgacgaacacgatgatgatctcgacacagaggacaacgagcttgaggaactcgaggagagggccgaagcaaggaagaagaccactgaaaagcaacagctgcagagtctcttcctgctgtggtctaaattgaccgacagactttggttcaaaagcacttatagcaagatgagttccactctattggtggagacacggaacctttacggagtggtgggggcagagtctaggagcgccccagtgcagcacttagctggctggcaggctgaggagcagcagggcgagactgatacagtgctgagcgccgctgctctgtgcgtgggcgtggggagctttgccgacccagacgaccttcctggcctggctcactttctggagcacatggtgttcatgggaagtctgaagtaccccgacgagaatggatttgatgcattcctgaagaagcacgggggaagcgataacgcctcgactgactgcgagcgaaccgtgttccagttcgacgttcagagaaagtattttaaggaggccttggatcgatgggcacaattttttattcatcccctgatgatcagagacgcaatagatcgagaggtagaagccgtagattccgagtaccaattagccaggccaagtgatgctaacagaaaagagatgttgttcggatccctggccagacctgggcaccccatgggtaagtttttctggggaaatgcagaaacactcaaacacgagccccgtaagaataacatcgatacacatgcacggttaagagagttctggatgcgctactattcgtcacactacatgaccctagtggtacagtcgaaggagactctggataccctggagaagtgggtgacagaaattttcagccagattcccaacaacgggctaccaagaccaaatttcggacacctaacagatccattcgacactccggcatttaacaaactttaccgtgtcgttccaatccgtaaaatccatgccctcaccattacatgggctcttcccccacagcagcaacactacagggtgaagcctctgcactacatctcctggttagttggtcacgagggcaaaggtagcatcctatcttttttaaggaaaaaatgttgggcccttgcgctgtttggcggtaatggggaaaccggcttcgaacagaactcaacgtatagtgtgttttccatctcaatcacactcaccgatgagggatatgaacatttttatgaggtggcttacaccgtctttcaatatcttaaaatgttgcagaaactgggacccgagaaacgaatttttgaggagatacgtaaaatcgaagacaatgagttccattaccaggagcagactgatcctgtcgaatatgtggagaacatgtgcgaaaatatgcaactgtacccactccaggatatcctaacaggcgatcagctgttatttgagtacaaaccagaggtcattggagaggcactgaatcagctcgtcccgcagaaggcaaacctggtgttgctttcaggggcaaatgaaggaaaatgtgacctaaaagagaagtggttcggcactcagtactctatcgaggacatcgagaattcttgggccgaactttggaatagcaattttgaactgaatcccgacctgcacctgcctgctgagaataaatacatcgccacagactttaccttgaaagcctttgattgccctgagacagaataccccgtaaagattgtaaatactcctcaggggtgtttgtggtacaaaaaagacaacaaattcaaaattccaaaggcttacattaggttccatcttatcagccctctgattcagaagagtgccgcaaatgttgttctgttcgacatcttcgtgaatatattaactcacaatcttgctgaacctgcctacgaggctgacgtagcccagctggaatataagctagtcgccggagaacacgggctgatcattcgagtcaaaggtttcaaccacaaactcccattactgttccagctcatcatcgactacctggccgagtttaactccacgccagcagtctttactatgataactgaacagctgaaaaagacatacttcaatatcttgattaagcccgagacactcgccaaggatgtgcgcttgctcatcttggagtacgctaggtggtccatgattgataagtatcaggccctgatggacggcctgagcctcgagagtctgttaagctttgtgaaggagttcaagtctcagctttttgttgagggtcttgtccaggggaacgtgaccagtaccgagagcatggactttctgaaatatgtggtggacaaactgaattttaagccactcgagcaggaaatgccagtgcagttccaggtggtcgagctaccctcggggcaccatttgtgcaaagtgaaggccctgaacaagggtgacgccaactccgaggttaccgtgtactaccaatctgggacacggagtctaagagaatatacgttgatggagctgctggtcatgcacatggaggaaccatgctttgactttctgcggactaagcaaaccctgggataccacgtgtatcccacctgcaggaatacatctggtatcttggggttttccgtgactgtcgggacgcaagcaactaagtataacagcgaagtggtggataaaaagatcgaagaattcctttccagttttgaggagaaaatcgaaaacctgactgaggaagcctttaacacccaggttacagccctaattaaattaaaggagtgcgaggacacacatttaggagaggaagtggacaggaattggaacgaagtggtgacccagcaatatctgttcgatcgactggctcacgaaatagaggctctgaagagctttagtaaatcagatctcgtgaactggttcaaagcgcaccggggacctgggtcaaagatgctctctgtgcatgtcgtaggatacgggaagtatgagctggaggaggacggaacaccatccagtgaggattctaatagctcatgtgaggtgatgcagctcacatatctccccacgagccctttgttggccgactgcatcataccaatcacagacatcagggcatttacaacaacattgaatctgctgccttaccacaagatcgtgaagtag

SEQ ID NO: 232022 - DNA, 2244 bp, Artificial Sequence
  Description of Artificial Sequence: Synthetic coding sequence
atggagggtaagaccggtaataccaccgatgatgaagaggaagaggaggttgaagaggaggaagaggacgacgatgaggacagcggtgctgaaatagaggacgatgatgaggaagggttcgacgatgaagatgagttcgatgatgagcacgacgatgatcttgatactgaggacaatgagctcgaagagttagaagagagggcggaagccagaaagaaaactacagagaagcagagtgccgcagccttatgcgtgggggtggggagctttgcagaccccgatgacctgcctggcctcgcgcatttcttggagcacatggtgtttatgggatctttgaaatacccggatgagaacggttttgatgcgttcctcaagaaacatggtggatctgataacgctagtacggattgcgaacgcacagttttccagttcgatgtgcaaagaaagtactttaaagaagccctggacaggtgggcacagtttttcatccaccctctgatgattcgggacgccattgacagagaggttgaagccgtagatagcgagtatcagctggctagaccgagcgacgcaaaccgaaaggaaatgttgtttgggtcattggctaggcccggacacccaatggggaaattcttctggggtaatgccgagaccctgaaacacgaacctcgcaaaaacaatatcgatacccacgcgagactccgtgagttttggatgcgatactactctagccattatatgacactggtggttcaaagtaaggagaccttagatactctggaaaagtgggtgacagagattttcagccagattccaaacaatggcctgccacgccctaattttggtcatctgaccgacccttttgatacaccggcttttaacaaactgtacagggtggtccccatcaggaagattcacgccctgaccattacatgggccctgcccccacagcagcagcactatagagtgaagccactccactacatctcttggttggttggccacgagggtaagggttcaatcctttctttccttagaaagaaatgctgggccctggctctgttcgggggtaatggagaaaccggatttgaacaaaattctacgtattcagttttttccattagcataactctgaccgacgagggctacgaacatttttacgaagtggcttacaccgtgtttcaatacctgaaaatgctccagaaattagggcctgagaagagaatatttgaggagattcgcaaaattgaggataatgaattccattaccaggaacagaccgaccctgtggaatatgtggaaaatatgtgtgagaatatgcagttgtaccctctgcaggacatactaaccggtgaccagctgttgtttgaatataaacccgaggtgatcggggaggccctgaaccagttagtgccgcagaaagccaatctcgtgctgctttctggtgcgaacgaaggcaaatgtgatctgaaagagaaatggtttgggacgcagtattcgatcgaagatattgaaaactcttgggccgaattgtggaattcaaatttcgaactcaaccctgacctgcacctgcctgccgaaaataaatatatcgccacagattttaccttgaaagccttcgactgccctgaaaccgaatatcccgtgaagatcgtgaataccccccagggttgcctgtggtataaaaaagacaataaatttaaaattcccaaggcttacatccgttttcacctcatctcccctttgattcagaaatccgctgccaatgtggttctgtttgatatattcgttaacattctcacgcacaaccttgctgagcctgcatacgaggcggatgtggctcagttagagtataaactcgtggctggggaacatggactcattatcagggtgaagggttttaatcacaaactgccactgttgtttcagcttattatagactatttggcagaatttaacagtacccctgcggtgttcacaatgattaccgagcagctgaagaagacctactttaatatcctaattaaacccgaaaccttggcaaaggacgtgcgattgttgatcctggagtacgccagatggtccatgattgacaaatatcaggcactcatggacggtttgagtttggaaagtctcctctcattcgtgaaggaattcaagtcacaattgtttgttgagggcctggtccaaggtaatgtcaccagcacagtactttgtcagtgggctcaggactcggagacttag

SEQ ID NO: 232023 - DNA, 3447 bp, Artificial Sequence
  Description of Artificial Sequence: Synthetic coding sequence
atgctccgtagagtcaccgttgctgccgtttgtgctacacgaagaaagctgtgcgaagccggtcgagaactggctgcgctgtggggaatcgagacaaggggcagatgcgaggacagtgccgcagctagaccctttccgattctcgcaatgcccggaaggaataaggcaaagagcacatgctcctgccctgacctacaacctaatggccaggatctcggcgagaactcgcgcgtcgccaggctaggcgctgatgagagcgaagaagagggtcgtaggggaagcctttccaatgctggtgacccggaaatcgtcaagtcacctagtgacccaaagcagtaccgatatataaagctgcagaatggactccaggcccttctcatctcagacttatcaaatatggaagggaagaccggaaacaccaccgatgatgaggaagaagaggaagtggaggaggaagaggaggatgatgatgaggactccggagctgagatcgaggatgacgatgaagagggcttcgacgacgaggacgagttcgatgatgaacacgatgacgacctcgacaccgaggacaatgaactggaggagctagaagagagggcagaggcacggaaaaagaccaccgagaagcaaagtgctgcagccctgtgcgtcggagttgggtcatttgctgaccctgacgacctgccagggttagctcacttccttgaacatatggtgttcatgggttccttaaagtacccagatgagaacggatttgatgcatttctcaaaaagcacggcggaagcgataacgccagcactgattgcgagaggacggtgttccagttcgatgtgcaacggaaatacttcaaggaagccttggatcgctgggcccagttctttattcaccctcttatgattagggacgccatcgatagagaggttgaggcagtggactccgaataccaactggctcgtccatctgatgccaatcgaaaggaaatgctgtttggcagcctcgctcgacccggtcatccaatgggcaagttcttctggggcaacgcggagactttgaagcacgaacctcgaaagaacaacattgatactcacgcaagattacgggagttctggatgagatattatagttctcactacatgaccctggtggtacaaagtaaggagacacttgatactctggaaaagtgggttacagaaatattttctcaaatacctaacaacggcctgcctcgtcctaattttggccacctgacggatccatttgatacacctgcctttaataagttgtaccgggtggtaccaattcgcaagatccatgcactgactataacctgggccctcccacctcagcagcagcactatcgggtgaagcctctgcactacatctcttggcttgttggacatgagggtaaggggtctatactatccttcctacgtaagaagtgctgggcactggccctctttggaggcaacggtgaaaccggcttcgaacagaattcaacatactcagtgttttctatttccatcactctgacagacgaaggctacgagcatttctatgaagtcgcctacacggtcttccagtatcttaagatgctgcaaaaactcggccctgaaaaacggatcttcgaggaaattcggaaaatcgaagacaatgagtttcactaccaggagcagacagatccagtggaatacgtggaaaatatgtgtgagaacatgcagctctatccacttcaggatatcctcacaggagatcagttgttgtttgagtacaagcctgaggtaataggtgaggcactgaaccaactggtgccccagaaggcgaatctagtcctgttgtccggcgcaaatgaggggaagtgtgatctcaaagaaaagtggttcggcacacagtattccattgaagacatcgagaatagctgggcagagctttggaacagcaatttcgagctaaaccccgatctccatctcccggcagagaataaatatattgctacggacttcactttgaaggcgttcgactgtcctgagaccgagtatcctgtgaagatagtcaacacccctcaggggtgcctgtggtataaaaaggataacaagtttaagatccctaaagcttatattcggttccaccttatttcacctctgatacagaagtcagcggctaatgtcgtgctgtttgatatattcgtcaacatcctgacacataatctcgccgaacccgcttatgaggcagacgtggcacaacttgagtacaagctggtagcaggcgaacatgggctcataatccgcgtcaagggctttaatcacaagttgcccctgttattccaactgatcatcgattacctcgccgagttcaattcgactcccgcagtattcacaatgattaccgagcaactgaaaaaaacatacttcaatatcctcatcaaaccagaaaccctggcaaaggacgtgcgactgctcatcttagaatacgctaggtggtccatgatcgataagtaccaggctctaatggatgggctgtcactggaatctcttttgtcctttgtgaaagaatttaaatcccagttgttcgtggagggtttggtgcaagggaatgtaacttctactgaatctatggattttctgaagtacgtggtcgataagctaaatttcaagcctctggaacaagagatgcccgtccagttccaggtggtcgaactgccctccgggcaccatctgtgcaaagtcaaggccctcaacaagggggatgcaaactccgaggtcacagtttattaccagagcggcactaggtctttacgagagtacaccctcatggagctactggtcatgcacatggaggaaccctgctttgattttttgcgcactaagcagacactgggatatcacgtctatcctacttgcaggaacacttcaggtatattgggcttcagcgtgactgtcggcacacaggccacaaaatataatagtgaagttgtcgacaaaaagatcgaggaatttctgtcctcatttgaggagaagattgagaacctcaccgaggaggccttcaacacccaggttactgccctgattaagctcaaggagtgcgaggatacacatttgggagaagaggtggataggaattggaatgaggtggttacacagcagtacctgtttgatagacttgctcatgagatcgaagcgctcaagagtttctccaagagtgacctcgttaactggtttaaagcacatagaggtcccggaagcaagatgctgtccgtgcatgtagttggctacggcaagtatgagctcgaggaagacgggaccccttcctctgaggattctaatagtagttgcgaggtgatgcagctcacatacttgcctacttcccctctcctggctattgtctcttctcctctgctgatttccggcctgtcacagcagcactcgacattctccccaactatcaagtag

SEQ ID NO: 232024 - DNA, 1587 bp, Artificial Sequence
  Description of Artificial Sequence: Synthetic coding sequence
atgggagccgcagccagtagacgtagagccctgcgatctgaggccatgtcctcagtagctgctaaggtgcgcgcagcacgggcttttggggagtatctttcccagtcacatcctgaaaacaggaatggggctgaccacctactggcagatgcgtattcaggccatgatgggagcccggaaatgcagcccgctcctcaaaacaaacgccgactgtcattggttagtaatggctgttatgagggaagcctgtccgaggaaccttctatcagaaaacccgcaggcgaagggcctcaaccgagagtctacaccattagtggcgaaccagcccttctacctagtccagaagcagaggccatcgagctggctgtggtcaaagggaggaggcaaagacatccccaccaccactcccagcctctgagagccagcccaggcggttctcgagaggatgtgagccgaccatgccagtcctgggcgggaagccgccagggcagtaaggagtgtcctggctgcgctcaattggctcctggtccaactcctcgggctttcggtctggatcagccacccctcccagagacctcggggagaagaaaaaagcttgaaaggatgtatagcgtggatcgagtgtctgatgatatccccatcaggacttggttcccaaaggagaatttgttttcattccagacagcgacaacaacaatgcaggccgtttttagaggatacgctgaacggaagcgtaggaagcgtgaaaacgacagtgcaagcgtgatccagagaaacttcaggaagcacctcagaatggtgggaagtagacgggtcaaggctcagaccttcgcggagagacgggagcggtccttttctcggagctggtccgaccctacccccatgaaggccgatacttcccatgacagtcgcgattcttctgatctccagtccagccattgtaccctcgacgaggctttcgaggatctagactgggacaccgaaaagggcctggaagcagttgcctgcgacactgaaggctttgtgcctcccaaagtcatgctcatctccagtaaggtgcctaaggccgagtatatccccactatcattcgcagggacgatcctagcattattccaatcttgtacgaccacgagcacgccacattcgaagatatcctggaggaaattgaacgcaaactgaacgtctaccacaagggtgctaagatctggaagatgctcatcttctgccaggggggaccaggccatctttaccttttgaaaaacaaagtggcgacctttgcgaaggtggaaaaagaggaagatatgatccatttctggaaaaggctctcacgcctcatgtctaaggtgaacccggaacccaatgtcattcacataatggggtgttatattctcggtaaccccaatggcgagaagttgtttcagaatttgaggacactgatgaccccgtacagagtgacattcgaaagccccctggaactttctgcgcagggcaaacagatgatagagacttacttcgacttccgattatatcgtttgtggaaatccaggcagcattccaaactcctggattttgacgatgttctttag

SEQ ID NO: 232025 - DNA, 984 bp, Artificial Sequence
  Description of Artificial Sequence: Synthetic coding sequence
atgtacagcgtggaccgagtgtctgacgacatcccaattcgcacttggtttccaaaggagaacctcttctccttccagaccgccacaacaaccatgcaggcagtgtttcggggttatgccgaaaggaagcggagaaagcgggagaacgacagtgccagcgtcattcaaagaaacttccgaaagcatctgagaatggtgggaagcagaagggtgaaagctcaaacatttgcggaacggagagagagatctttttctaggtcctggagtgatcctacccctatgaaggctgataccagccatgattcacgtgactcatcagatctgcagtctagtcattgtactctcgatgaagcctttgaggacctagattgggacactgagaaaggattagaggcagtggcctgtgacacagaggggttcgtcccgcctaaggttatgctcataagctcaaaggtgccaaaagccgagtacatcccaacaatcattcggcgtgatgaccctagcattatcccaatactttatgaccacgaacatgcgacctttgaagatattctcgaggagattgaaaggaaacttaacgtgtaccacaagggggctaagatctggaagatgcttatcttttgccagggcggaccgggtcatctgtatctcttaaaaaataaggtggccacattcgcaaaggtagagaaggaagaagatatgatccatttctggaaacgcttgtcccgtctgatgtcgaaggtgaatccggagccgaatgtgatccatatcatggggtgctacatcctgggcaaccctaacggggagaagctgttccagaatctgagaactcttatgactccctaccgcgtgacctttgagagccccttggagctctccgcccaagggaaacagatgatcgaaacctattttgatttcaggctttacaggctgtggaaaagccggcagcattcaaagttactagattttgatgatgtgctgtag

SEQ ID NO: 232026 - DNA, 438 bp, Artificial Sequence
  Description of Artificial Sequence: Synthetic coding sequence
atggtgggctcccggcgagtgaaggcccagacattcgctgagcgcagggagcgctctttttctaggagctggtctgatcctacacccatgaaggcagatacaagtcacgattctcgcgactcgtctgatttacagtctagtcattgcactctggacgaggcgttcgaggaccttgactgggatactgagaagggtctggaggcagtggcgtgtgacacggaaggatttgtgccacctaaggttatgctgatctcctcgaaggtccccaaggcagaatacatccccactataatccgcagagatgacccaagtattatacccattctgtacgtgtctccagccccaggtctgcctcctacagacgccctattgagaccacatcccggaccagcccctgcccctcaggtcccccgtgttctctggcgttgctggttgtag

SEQ ID NO: 232027 - DNA, 1587 bp, Artificial Sequence
  Description of Artificial Sequence: Synthetic coding sequence
atgggggctgccgcatctcgtcgtcgggctctaagatccgaagcgatgagcagtgttgcggcaaaagttcgggcagcccgagcatttggcgagtacctttcccagtcccaccccgagaatcgcaatggggctgatcacctcttagccgacgcttattctgggcacgacggctcccccgaaatgcagcccgcacctcagaacaagcggagactgagcctcgtttccaacggttgttacgaagggagcttaagtgaggagcctagcatcagaaaaccggcaggggagggtcctcagccaagggtgtacaccatctctggggagcctgccctgctccccagtcccgaagctgaagccatagaactcgcagtggtgaaggggaggcggcagagacaccctcatcatcactctcaaccactgcgcgctagtccgggtggctctagggaggacgtatctcggccatgtcagtcctgggcagggagccgccagggatctaaggaatgtccaggctgtgcccagctggctccagggcctacaccccgtgcattcggactggaccaaccgcctcttcctgaaacttccggaaggcgcaagaagctggaaagaatgtactccgttgaccgcgtatctgatgacatcccgattcgcacctggttcccgaaggagaatttgttcagctttcagacagcaaccacaacaatgcaagcagtattccggggatacgcggaacggaagcggagaaaacgcgagaatgatagcgcgagcgtcattcaaaggaactttagaaagcacctacgtatggtgggctcacggagagtgaaggcccagaccttcgccgaaagacgcgagagaagtttctctagaagttggtctgaccctacgcctatgaaggctgatacaagccacgacagtagagactcgtctgatctgcaatccagccactgtactctcgatgaggcctttgaggatttggactgggatacagagaaaggcctggaggcagtggcttgcgacactgaaggcttcgttcccccaaaggtcatgctgatctccagtaaagtccctaaggctgagtatatccccactataatccgtagggacgaccctagtatcattcctatactgtatgatcatgaacacgctacattcgaagatatccttgaggagatcgagcgcaagctgaatgtttaccataagggtgcgaaaatttggaaaatgttgatattttgccaaggcggacccggacatctgtacctcctgaagaataaggtggccactttcgccaaggtggagaaggaagaagacatgatccacttttggaaaagactgtctaggctgatgtccaaggtgaacccagagcctaatgtcatacacatcatgggctgctacattttgggtaacccaaacggggagaaactctttcagaatcttaggaccctcatgactccatatcgcgttacatttgagtcacccctcgagctgtctgctcaggggaagcagatgatcgagacgtacttcgactttcggctctaccgtctatggaagagccggcagcactctaagttgcttgattttgacgacgtcctttag

SEQ ID NO: 232028 - DNA, 1503 bp, Artificial Sequence
  Description of Artificial Sequence: Synthetic coding sequence
atgggcgctgcagcaagtaggcgcagagccttgagatccgaagccatgtcttccgtagccgctaaggtacgcgctgcacgggctttcggggaatacctcagccaatcacatccagagaatcgaaatggagcagaccatctgctggcagacgcctacagtggacatgacggatctccagagatgcaaccggcacctcagaacaagcgtagactctccctggtttctaacgggtgttacgagggtagtttatccgaagagcctagcatccgcaagccggctggtgaggggccacagcctcgagtgtataccatcagcggtgagcctgccctattgccatcccctgaggcagaagctatcgaactggctgtggttaaaggccgtcgtcaacgtcacccgcatcatcatagccagcccctgcgggctagccccggtggaagcagagaagacgtctcacgtccctgtcaatcttgggctgggtcccgtcagggatcaaaagagtgtccaggatgtgctcagctggccccagggcctaccccgagagcttttggcctcgaccagccaccactccccgagactagtggcagaagaaagaaactggaaaggatgtatagcgtcgacagagtctctgatgacatacccattcgaacatggtttcccaaggagaatttgttctccttccagactgcaacaacgacgatgcaggccatttctgtatttagggggtacgcagagcgtaaaaggcgaaagagagagaacgatagtgcttctgtaatacaacggaatttccggaaacacctgaggatggtgggcagtcgcagggtgaaggctcaaagctctgacctgcagtcctcgcattgtacccttgatgaggcattcgaggatctggactgggacacagagaaggggctcgaggccgtcgcatgcgacaccgagggctttgtgccgcctaaggtgatgctcatctcttcaaaggtaccaaaggcagagtacatccctaccattatcaggagagatgatccctccattatcccgatactctatgatcacgagcacgcaaccttcgaggacattctcgaggaaattgaaagaaagttaaacgtgtaccacaagggagccaagatttggaaaatgttgatattctgtcagggaggacccggacatctctatctgttgaagaataaagtggccacctttgctaaggtagagaaagaggaggacatgatacatttctggaagaggttatctcgccttatgtccaaggttaaccctgaacccaacgtgattcatatcatgggctgttacattttgggaaatcccaacggagagaaattgttccagaatctgcgtacgctgatgactccctatcgcgtgaccttcgaatcccccctcgagctcagcgcacagggaaagcagatgattgagacgtactttgacttcagactgtaccggctgtggaaatcccgccaacactccaaactgctcgatttcgatgatgtgctctag

SEQ ID NO: 232029 - DNA, 1518 bp, Artificial Sequence
  Description of Artificial Sequence: Synthetic coding sequence
atgggagccgctgcaagtagaagacgggctctcaggtcagaagcgatgtcaagtgtggcagccaaggtgagggctgctagagcttttggggaatacctctcccagagccaccctgagaataggaatggcgctgaccatctgctggcggatgcttactctggccacgacgggagccccgagatgcagcccgcaccgcaaaataagcgcagactgagtttggtcagtaatggatgctacgaaggaagcctctctgaagaacccagtattcgcaagccagccggtgaaggcccacaacccagggtctataccattagtggcgaacctgccctcctcccgagcccagaggccgaagcgatagagctcgcagtggtgaaaggcagacgacaacgacaccctcatcatcattcacagccactgagggccagtcctgggggatcacgggaagacgtgagccgcccatgccagagctgggctggctccaggcagggcagcaaggagtgtcccggttgtgcccagctcgcacctggaccaactccccgtgctttcggactggatcaacctcccttaccagagaccagcggacgtagaaagaagctggagcgtatgtacagcgtggatcgcgtgtctgacgacatccctatacgaacatggttcccaaaggagaaccttttctcgtttcaaacagcaacgactaccatgcaggccaattttcggaaacacttgcgtatggtcgggtctaggcgggtgaaagcccagacctttgctgaacgacgggaacggagtttcagccgctcctggagcgacccaacccccatgaaagcggacaccagccacgatagccgtgatagcagtgacctgcagagctcccactgcactctggatgaagccttcgaagatctggactgggatacagagaaaggattagaggcagtggcttgcgacacggaaggattcgtaccgcctaaagtcatgctgatctcctctaaggtcccgaaggccgagtacattccaacaattatcaggagggatgatccctccatcattccaattctgtacgaccatgaacacgctactttcgaggacatcctggaggaaattgaacgtaaacttaacgtgtaccacaagggggctaaaatatggaagatgctcatcttctgtcagggtggacccggtcacctgtacctcctgaaaaataaggtagcaacctttgccaaggtggaaaaggaggaggacatgattcacttctggaagcggctctcccgtctaatgtctaaggtgaacccggagccaaacgtaatacatatcatgggctgctacattctagggaatccaaatggcgaaaaacttttccagaacttaagaactttgatgacaccctatcgtgtgaccttcgagagtccactggagctgtcagcgcagggtaagcagatgattgaaacatatttcgacttccgcctgtacagactgtggaagtctaggcagcactcgaagctcctggactttgacgacgttctgtag

SEQ ID NO: 232030 - DNA, 1593 bp, Artificial Sequence
  Description of Artificial Sequence: Synthetic coding sequence
atgggcgctgccgcttcacgcagacgtgcactccgcagtgaggccatgagctctgtcgctgcaaaagtacgggctgcccgtgcatttggggagtatttgtcacagagccacccggagaataggaacggggctgatcacctacttgccgacgcttattcggggcatgacggctcccccgagatgcagcccgctccacagaacaagcgtcgcctgtcccttgtgtctaacggctgctatgagggcagtctctctgaagaacctagtatcaggaaacccgcaggggagggcccacagcccagagtatacacgatttcgggggagccagccttactcccatctccggaggcagaggctattgagctggcggtcgtaaagggcagaaggcaacgccacccacatcaccactcacagccattgcgggcaagtcctggtggctcacgtgaggacgttagccgtccctgccagtcttgggcagggagcagacagggaagcaaggagtgtcccggatgcgcccagctggctccgggacccactcctagagcttttggcctggatcaaccccctctgcctgaaacttccggacggaggaagaaattggaacggatgtactctgttgaccgcgtgtcggatgatatccctatccgtacctggttcccgaaagaaaacttgttctcattccagaccgcgacaacaacaatgcaagctattagcgttttccgtggttatgccgaacgaaagcgccgtaagcgcgagaacgactccgccagtgtcatccagcgcaatttccggaagcatctcagaatggtgggatctaggagagtgaaggcccagacgtttgcagagagaagagaaaggtccttttcccgatcatggtctgatccgactccgatgaaagcggatacttcacacgactcacgtgactcatctgatttgcagtcgtcgcattgcacgctagatgaggcctttgaggacctggactgggacacagaaaaaggcctggaagctgtggcatgcgacactgagggatttgtccctccaaaggttatgctgatctcttcgaaggtgcccaaggcggagtacattccaactattatccggcgagacgacccctctattatcccgattctctatgatcacgagcacgctacattcgaggacatcctcgaggagatcgagcgcaagcttaacgtgtatcacaaaggagccaagatatggaagatgcttatattttgtcagggcggaccaggccatctctacctgctcaaaaacaaagtcgctacctttgctaaagtcgaaaaggaggaagacatgatacatttctggaaacgactctcccgcttaatgagcaaggtgaacccagagcctaatgtgatccacattatgggctgctatatcctagggaatcccaatggggaaaagctatttcaaaacctgaggactcttatgactccatatagagtgacttttgaaagtccgctggagttgagtgcccagggtaaacagatgatcgaaacctatttcgatttccgtctgtatagactctggaagagccgacagcacagcaagctacttgatttcgacgatgtgctgtag

SEQ ID NO: 232031 - DNA, 585 bp, Artificial Sequence
  Description of Artificial Sequence: Synthetic coding sequence
atgggactcggtcccctgagtagctcgttgtcaccccagctaatcagttccaaggtgcccaaagcagaatacattccaacgataatcagaagggatgatccctcaatcattcccatactgtacgaccacgaacacgcaaccttcgaggacatcctggaggagatcgagcgaaaactgaatgtgtaccataaaggtgctaagatatggaagatgctgattttttgtcagggcggaccaggccatctgtatttactgaagaacaaggtggccacgtttgctaaagtggaaaaagaagaagatatgatacatttctggaagcgcctgtcacgcttgatgagtaaggtcaatcctgagcctaatgtgatccatataatggggtgttatatcctgggaaaccccaatggggaaaaactttttcagaatttaagaacactgatgaccccttatagggtcacattcgaaagtcctctcgaactttcggcacagggcaagcagatgatcgagacctactttgatttcagactttataggctgtggaagtcacgccagcattcgaagttgctggactttgacgatgtgctgtag

SEQ ID NO: 232032 - DNA, 1524 bp, Artificial Sequence
  Description of Artificial Sequence: Synthetic coding sequence
atgggagcagcagccagccggcgtcgagcactgagaagtgaggctatgagctctgtcgccgcaaaggtgagggctgcacgtgcattcggtgagtacctgtcccaaagccatcctgaaaatagaaacggtgccgatcacttgctggctgacgcctatagtgggcatgatggctcccctgagatgcagcctgcaccccagaacaagcgcagactgtcactggtgtctaatgggtgctacgaaggctccctctctgaggagccttccattcggaaaccagcaggcgaaggaccacagccgagagtgtataccatttcaggggaacccgctttgttgccaagcccggaggccgaagccattgaactggctgtcgtcaagggaaggcgccaacggcatccacaccatcattcccagccacttcgcgcaagcccagggggtagccgggaagatgtatcacggccatgtcagagctgggcgggatcaagacaagggtctaaagaatgtcccggatgcgctcagctggctcctggacccacccctcgggctttcgggctcgaccagcctccattaccagagacttccggcaggagaaaaaaactggaacgcatgtactccgtcgatcgcgtgagtgacgacatccccattcgaacatggtttccgaaggaaaatttgttttccttccagacagccactaccaccatgcaggccgtggggaattttagaaaacatctcagaatggttggcagtaggcgggtcaaggctcaaaccttcgccgagcgccgtgagcggtcattctcgcgaagctggagcgatccaacccccatgaaggcagatacaagccacgattctcgagattcttccgatctgcagtcctcccactgcacactggatgaggcctttgaagatctggattgggatactgagaaaggtctggaagccgtggcatgtgacaccgaaggctttgtgccaccaaaggttatgcttattagttcaaaagtgcccaaagccgagtacatacccacaattatccggagagacgatcctagcatcattccaattctttacgaccacgagcacgccacattcgaggatatacttgaggaaatagaacggaaactcaatgtttaccacaagggagccaaaatctggaagatgttaatcttttgccagggtggtcccggacatctgtatctgttgaaaaacaaggtagcgacattcgcgaaagtcgaaaaagaagaggacatgatccatttctggaagcggctgtcaagactgatgagcaaggttaacccagagcccaacgttatccacatcatggggtgttacatcctaggcaaccccaacggcgaaaagctctttcaaaacttgcgcacactgatgaccccttatcgcgttacattcgagtctccgttggagctcagcgcacaaggtaaacagatgatcgagacttattttgacttccggctgtacagactctggaagtctaggcagcattctaagctgctcgacttcgacgacgtgctgtag

SEQ ID NO: 232033 - DNA, 1524 bp, Artificial Sequence
  Description of Artificial Sequence: Synthetic coding sequence
atgggcgcagccgctagccgaagaagagccctgcgcagtgaagccatgagctcagtggccgctaaggtccgggcagccagagccttcggggagtatttgagtcagtcccaccctgaaaaccgcaatggtgcagaccatctcctggccgacgcctactctggtcatgacgggtccccagaaatgcagccagccccacagaataagcgacgcctgagtctggtttcaaatggatgctatgagggcagcctgagtgaggagccatccattcgcaagcccgctggtgaggggcctcaaccaagagtgtacactatctccggcgaacctgctttacttccatcccctgaggcggaggcaatcgagctggccgtggtgaaagggcgaaggcagcgtcacccccaccaccacagtcagcccctccgggcatctcctggcggaagccgggaagacgtttcccggccatgtcagagctgggctgggtcacgccagggcagtaaggaatgtccaggctgcgcgcagctggcccctggacccacccctagagcctttggacttgatcagccgcctctgccagagacatccgggaggagaaaaaagctggagaggatgtactctgtggacagagtttctgacgatattccaatccgcacgtggtttccgaaagaaaatctgtttagtttccagacagctacaaccaccatgcaggcgattagcaacttcaggaaacatctgcgtatggttggctcccggagggttaaggctcagacttttgctgaaaggagggagcgcagcttttctcgatcttggtcagaccctaccccgatgaaggcggacaccagccacgactcacgcgatagctctgaccttcagagttcacattgtaccttggacgaggcatttgaggacctggactgggatacagagaaaggtcttgaggctgtggcctgcgatacagaaggcttcgtacctcccaaagttatgctcattagctctaaggtccccaaagctgaatacataccaacaatcattcggagggacgatcctagtataatcccgattttgtacgaccatgagcatgccacctttgaggacatactggaggagatcgagcgcaaactcaacgtgtaccacaagggagcaaaaatctggaagatgttgatcttttgccaaggtggtccagggcacctttacctgttaaagaacaaggtggctacatttgctaaggtcgaaaaggaggaggatatgatacacttctggaaacgcctgagcaggctgatgagtaaagtaaatccggaaccaaatgtgattcacattatgggttgttatatcttagggaatcctaatggcgaaaagctgttccagaacctgaggaccttaatgacgccataccgagtcactttcgagtcccccctggagctcagtgcccaagggaaacaaatgatcgaaacgtatttcgattttaggttgtacagactttggaagagccgtcagcatagcaagctgcttgacttcgacgacgttctgtag

SEQ ID NO: 232034 - DNA, 984 bp, Artificial Sequence
  Description of Artificial Sequence: Synthetic coding sequence
atgcagttgggacggaggcttgacccagagcgccaggcactccacttgtgtagcggcgtagaaggcgaaccatggaaggcagttgccggacgggctttgggcggtatctgtctgtgggtcgggggaggagcacggtctcagggggaacactggcttcccacacctaagggtaatttccggaaacatttgaggatggtgggtagcagacgcgtcaaggcgcagaccttcgctgagagaagagaaagaagtttcagtcgatcttggagcgatcctacaccaatgaaggcagacacgtcacacgactcacgcgactccagtgacctgcagagctcgcattgtaccctggacgaagcctttgaggatttggattgggacacagaaaagggcctggaagccgtcgcctgcgacacggagggcttcgtcccaccaaaggttatgcttatcagtagcaaggtgcctaaggccgagtacattcctacaattatccgcagagatgacccctccatcatacccatcctgtacgatcacgagcacgctacctttgaggacattttggaagaaatagaacgaaaactgaatgtttaccataagggtgctaagatttggaagatgctgattttctgccagggaggcccagggcacctctatctgctcaaaaacaaagttgctacctttgctaaagtggaaaaggaagaggatatgatccacttttggaagcggctatctcggctcatgtcaaaggtgaaccctgaacccaacgtcatccatatcatgggatgctatatcctggggaacccaaacggagaaaagcttttccagaatctgaggacgctgatgacaccttatcgggtgacatttgagagtcccctcgagttgtccgcccaggggaagcagatgatcgaaacgtatttcgatttccgcctgtacagactgtggaagtctcgacaacactccaagctgttggacttcgatgacgtgttgtag

SEQ ID NO: 232035 - DNA, 648 bp, Artificial Sequence
  Description of Artificial Sequence: Synthetic coding sequence
atgccaggggaggccactgagactgtgcctgctaccgaacaggaactcccccagcctcaggctgagaccggctctggcacggagagcgatagcgatgagtcagtgcctgaattggaagagcaggacagcactcaggctactacacaacaagcccagctggctgccgcagctgagatcgacgaggagccggtttccaaagccaaacagtcccgatcagaaaagaaggcaagaaaggccatgtctaaattgggactgagacaagtgactggcgtgacacgcgtgactattaggaaaagtaagaatattctgttcgttatcacaaagcctgatgtatataaaagccccgcaagcgacacctacatcgtgtttggagaggcaaaaatcgaggatctgtctcagcaagcgcagctcgccgctgcggagaagtttaaggttcaaggagaagcggtgtcgaatattcaggagaacacccagactcccactgtacaagaagagtctgaagaagaggaggtggacgagactggagtagaggttaaggatatagagctggtaatgtcgcaagccaatgtctctagagctaaggccgtgcgtgcgctcaagaacaatagcaatgatatcgtgaatgcaatcatggaactgaccatgtag

SEQ ID NO: 232036 - DNA, 648 bp, Artificial Sequence
  Description of Artificial Sequence: Synthetic coding sequence
atgcctggcgaagccacagagactgtgcccgctaccgagcaggaacttcctcaaccgcaggccgaaaccgggtcagggacagaaagcgacagcgatgagagcgtgccagaactagaggaacaagatagcacgcaagccacaacgcaacaggcacagctggctgccgctgctgagatcgacgaagaacctgtgtcaaaggctaaacaaagtcgctctgagaaaaaagcacgcaaggctatgagcaagcttggactgaggcaggtgactggggttactcgcgtgacgattcggaaaagcaagaatattctattcgtgataaccaagcctgatgtctataagagtcctgccagtgatacttatatagtattcggggaggccaaaatcgaagaccttagtcagcaggcccagctggccgctgctgagaagtttaaggtccaaggtgaggccgtgtctaacatccaagaaaacacccagaccccgactgtccaggaggagtcagaagaagaggaggtcgatgaaacgggtgtggaagtcaaggacatcgaactggtgatgtctcaggctaatgtgtcaagggctaaagccgtcagagctctgaagaataattccaacgacattgtgaatgcgattatggagctaactatgtag

SEQ ID NO: 232037 - DNA, 6236 bp, Artificial Sequence
  Description of Artificial Sequence: Synthetic coding sequence
atgccaggcgaggccactgaaacggtgcctgccacagaacaggagctcccccaaccccaggcggagacagctgtgcttccgatgagctccgctctctctgttactgccgcattgggacaacctgggcctaccctgcccccaccatgcagccccgctccccagcagtgtcccctcagtgcggcaaatcaagcgagcccattcccttcccctagtaccatcgcctccacgcccctagaggtaccgttcccccagtcttcctctggaaccgcattacccctcggcactgcaccagaggcaccaaccttcttgccaaacctgattggcccacccatcagccccgcagccctcgctttagcaagcccgatgatcgcacccacacttaagggaacccctagttcatcagccccactggctttggtcgcattagcgcctcatagcgtccagaagagcagtgcctttccacctaaccttttaacctcccccccttccgtcgcagtcgccgagagtggctctgttattacactctccgcccctattgcaccctccgagcctaaaacaaatctgaataaggtgccctctgaggtggtccctaacccgaagggcactccttcccctccctgcattgtcagtacggtcccctatcactgtgttacgcctatggcaagtattcagagcggcgtcgcatcactcccgcagacaacgccaactactaccttagctatcgcctcccctcaggtgaaggatacaaccatctcctccgtactaattagcccgcagaatccaggttcgctttcgttgaaaggaccggtgagcccgccagcggctctgagcctcagcacacaatctctccctgttgttactagctctcaaaaaacggccggaccaaatacaccacccgatttcccaatctcccttggcagccatttggctcctcttcaccagagtagtttcggctcagtgcagctgcttggccagaccggtccatccgctctaagcgaccccactgtcaagaccatctcagtggaccactcatctacaggggctagctacccatcccaaagatcagttatccccccactgccctcccgcaatgaggtggtgcccgctaccgttgccgcttttccagtggtcgccccttcagtggataagggtccttctacaatcagctcaatcacctgcagcccttcaggaagtttaaatgtcgccacatccttcagcctcagccctacaacatcacttatcttgaagtctagtcccaatgccacctatcattatccactggtggcccagatgcccgtatcatcagtcggaactacgcctctcgtggtcactaacccctgtactatagccgctgccccaaccacaacgttcgaagtggccacctgcgtcagtcctcctatgagctctggccctatctctaatattgagccaacaagtccggcagctttggtaatggctccagtggcaccaaaggagccgagtactcaggtagccactactctgcgcattcctgtctcgcccccactaccagacccggaagacctgaagaacctgccatcgtccgtcttagtgaaattccccacacaaaaggacctgcagactgtacccgcttctctggagggcgctccattcagcccagcccaggccggtttaacaactaagaaggacccaaccgtgctgcctctggtacaggccgcacctaagaattctccctcgttccagagcacaagctcatcacctgagatccccctgagcccagaagccacactggcaaagaagagtttgggagagcccctgccaattggcaaacccgcatctagcatgaccagtcctctgggcgttaactcttcagcatctgtcatcaagactgacagctacgccggtcccgacagtgcaggaccactcctgaagtcttctctgatcactccgactgtggctgcttttccgctcgaaagtgcggaccctgctggggtcgcccctactacagctaaaggcactagcacatatacaacaaccgctagtccctttctggaagggactgtgagcctggccccaaagaaccaccccgtcaaagagggaacattgaccacactcccactggtccccaccgcctcggaaaattgtccagttgctccttcacctcagaatacatgtgctcccctagccacattggtgctggccccagagattcccaagtctgtcccttcaccttctttgccacccgctggtacccctcccggtaccaagaaagtggatggaatctctcacacaagtgccttagcgccagtggcgtcatcacctaaagaatgcccaacagaggatagtggagcttctgccacagccagtagcaagggcaccctcacgtacctagcagactctccgtctccgctgggggtgagcgtctcccctcagacaaaaaggccacccactaaaaaggggtccgcgggacctgacactcctattggaaatctgagctcccctgtctcccccgttgaggcttcgttccttcctgagaacagcttgtctttccagggatctaaggatagcccagcgacaacgcattcgcctacgcctccatcccccaaaggggcacctacaccctctgcagtaactcccttgtcgccaaagggtgtgacactcccccctaaagaaactccgaccccatccgttgtgaacctcccctttcctaaagaaggcccagccacccctgccccaaagcaggccccagctctcagtatgacaagttcatctccgaaaaaggccagagcaacacccgcacccaagggtatcccagcatctccatccccaaagggcgctcccacgccacccgctgctactcccccaagcccaaaagggggtccggctacaccctcccctaagtgggcacctactcccccagcagctacccctccatcccctaaaggcggtccagccacaccgagccccaaaggggctcctacaccccctgccgctaccccgccatctccaaagggaggcccagctacccctagtccgaagggggcaccaacccctcctgcagtgactcccccttctcccaagggcagccctgcggcaaccccattccccaagggcgctagtacgccccctgcagcaacacctcccagccctaaaggctccccagccgctacgccgttacctaagggcgcacctaccactcctgccgctaccctgccttcccctaaggggggacctgccacaccttcactgaaaggggctccgactcctccagccgctacaccaccatccccgaagggaggaccagcgacaccaagcccgaagggggctcccatgcctccagccgcaacccccccatccccaaaagggggattggctacccctcctcacaagggcgctccaactaccccagctgccaccccacccagcccgaagggaggactcgccaccccccctccaaaaggagccccaacgaccccagctgccacaccaccgtcacccaagggtggactggccacaccgccaccgaagggcgctcctacaacaccagctgccaccccccctagccctaaaggcggtctcgcaaccccctctccaaaaggagcacccacaacgccagcggcaactcctccttccccaaagggcggtttagccaccccaagccccaaaggtgcaccaactacaccggctgctacgcctccgagccccaagggagggctggcaactccttctcccaaaggtgcacctacgacccccgcagctacaccccctagcccaaagggcggacctgcaaccccacccccaaaaggcgctcctacgccacctgccgctacacccccttcactgaaggggggtctggcgaccccaccacataaaggagctcctaatccagctgtggtcacaccccctagccctaaaggagggcctgccacctcaccaccaaagggcgcacctactccccctgccgcaacaccccctagcccaaaggggtccccagggacacctccacccaaaggggctcctaccccacccgctgtgacaccgccatctccgaaaggcactcctacattgccagccacgacgccttcctccaaggggggtccaacgacaccgagctcaaaggagggccctaccccacccgcagcaactccttctcataagggagggccagctatgacaccaccctccccaaagcggggtccagccatcccatcccctaagggagacccgactagccccgcagtgatacctctctcccccaagaaagctccagccaccccagtcacccgtgagggggctgccacccccagcaagggtgacttgacacctcctgctgtcacgcccgtcagcttgaagaaagctcctgcaactagcgctcccaagggcggaccagccaccccctcctcaaagggggatcccacactacctgcggtgactccccctagccctaaggaaccacctgctccgaaacaggtggctacaagcagctcacccaagaaggctcctgccacccctgcaccaatgggagctccaacactgcctgccgttattcctagctctcctaaagaggtgcccgctaccccaagcagtcgtagggatcccattgcacctaccgccacactactgagcaagaaaacccccgctaccctggctcccaaagaagccctcatcccacccgctatgaccgtcccctctcccaagaagacccccgcaattcccactccaaaggaggccccagcgactccatcctcaaaagaagcctcaagcccaccagcagtgaccccaagcacatacaaaggcgctccttctccgaaggagttgttgatcccccctgctgtgaccagtccatctcccaaagaggcaccaacgccccctgcggtgacgcctccgtctcctgagaaaggcccagctacacccgcaccaaaaggtacgccaacatcacccccagtcacgccctcatctctgaaggatagtcccacaagccccgcatctgtcacgtgcaagatgggggcaactgtgccacaagcaagtaagggactgccagcaaagaagggcccaacagccctgaaggaagtactggtcgctcctgcaccggagagtactcctattatcactgcacccacccggaagggcccacaaaccaagaagtcgagcgctactagccccccaatatgtccggatccgtccgcaaaaaacggctctaagggaccacttagcacagtagctcctgcccctctcttgccagtacaaaaggactcaagcaagacagccaagggcaaggacgccagccattcgcccaaaggccctctggcgccaccagagagcaaagccagtacccccctcactgccgctgcttttgagaaggtgctccctaagcccgaatccgcttcagtaagcgcagcccctagcccacctgtgtccctccctcttgccccttcccctgttcctacccttcctccaaaacagcagtttctcccctcatctcccggattggtcctggaatcaccgtctaagccactggctccagcagatgaggatgagctactaccattaattccacctgagcctatctctgggggagtccccttccagtctgtgctggtcaatatgcccacccctaaatcagcgggtataccagtacccactccatccgctaagcagcctgtaactaagaataacaagggctcgggaacagaatctgatagcgacgaatcagtgcccgagcttgaggaacaggatagtactcaggcaactacccagcaggcccagttagccgcagctgctgagattgacgaagaacctgtatccaaggcaaaacaatccagatccgaaaagaaggcccgtaaagccatgtctaagctgggattgaggcaggtcacaggcgtgacaagagtaactatacgtaagagcaaaaacatcctcttcgttattacgaaacctgacgtctacaaatcccccgctagtgatacttatatcgtgttcggcgaggccaagatagaagaccttagtcaacaggcccagctcgcagcagcagagaagttcaaagtgcagggcgaggccgtttcgaatatccaagaaaacacccagactcccacagtccaggaggaatcagaagaagaggaagtggatgagaccggtgttgaagttaaggatattgagttggtgatgtcccaagctaacgtgtcaagagccaaggccgtgcgggctcttaagaacaactccaatgatatcgttaatgccatcatggaattaaccatgta

SEQ ID NO: 232038 - DNA, 648 bp, Artificial Sequence
  Description of Artificial Sequence: Synthetic coding sequence
atgccaggcgaagctactgagaccgttcctgctactgaacaagaactgccacaacctcaagctgagaccggctcaggtacagaatctgattctgacgaatcggtgcctgagctggaggaacaggattccactcaggccacgacccaacaggcccagctggcagcagccgctgaaatcgacgaagaacccgtaagcaaggcaaagcaatcccggtcagagaagaaggccaggaaagcgatgagtaaacttggcctgcggcaggtaaccggggttactagagtaaccatcaggaagtcgaaaaacattctgttcgtgatcaccaaacctgacgtgtataagagcccagcttcagacacgtacattgtcttcggggaagccaaaatcgaagatctgtcccagcaggcacagctggctgcggcagagaaattcaaggtgcagggagaggccgtcagtaacattcaagagaacactcaaaccccaaccgttcaggaggaatcagaggaggaagaggtggacgagaccggggttgaagtgaaagacatcgagctggtgatgtcacaagccaatgtgagtcgagccaaggctgtgcgggctctgaagaacaattccaacgacatcgtcaatgccataatggagttgactatgtag

SEQ ID NO: 232039 - DNA, 21 bp, Artificial Sequence
  Description of Artificial Sequence: Synthetic coding sequence
atgcctggggaagccacgtag

SEQ ID NO: 232040 - DNA, 597 bp, Artificial Sequence
  Description of Artificial Sequence: Synthetic coding sequence
atgcccggagaggcgactgagacagtgccagccacggaacaggaactgccgcagcctcaggccgaaacaggatccggaactgaaagcgattccgatgaaagtgtgcctgagttggaagagcaggacagcacacaggcgacgacccagcaggcccagttggccgctgccgctgagatagatgaggaacctgtgtctaaagctaagcaaagtcgttcggagaaaaaggctagaaaagctatgagtaagctgggtctcaggcaagttaccggggttactagggtcacgattagaaagagcaaaaacatactgttcgtgattaccaaaccggacgtgtacaaatctccggcatctgacacttacatcgtgttcggagaggcaaaaattgaagacctatcccaacaggcccagctcgcggctgctgaaaagttcaaggtgcagggagaagccgtgagtaacattcaggaaaacactcagacccccaccgtgcaagaggagagcgaggaagaagaggttgatgagacaggtgtcgaagtgaaagatattgagttagtgatgagtcaggccaacgtaagcagggcgaaggccgtccgagcctag

SEQ ID NO: 232041 - DNA, 381 bp, Artificial Sequence
  Description of Artificial Sequence: Synthetic coding sequence
atgcctggtgaagctacggaaaccgtgccagcaacagagcaggagttgccacagcctcaagccgaaaccggcagcggtacagagagcgattcggatgagtccgtccccgagctggaagagcaggattccacacaggcgacaacccagcaggcccagttagctgccgcagctgaaatcgacgaagagcctgtctccaaagctaaacagtctcgtagtgagaagaaggcccgtaaagcaatgagcaagttggggctgaggcaagtgacaggtgtgacacgggtcactatccgaaagagtaagaacatcttatttgtaattacaaagccagatgtgtataagtctccagcctctgatacatatatagtattcggggaagcctag

SEQ ID NO: 232042 - DNA, 648 bp, Artificial Sequence
  Description of Artificial Sequence: Synthetic coding sequence
atgcccggagaggccaccgaaaccgttcccgctaccgagcaggaactgccccaacctcaagcggagactgggagcgggacagaatctgattctgatgagagcgtgcctgagctcgaggaacaggatagcacacaggccacaactcagcaggctcaattagccgcagcagcagagattgatgaggagcctgtgtcaaaggccaaacaaagccgttcagagaagaaagcacgcaaggcaatgtctaaactgggcctcaggcaggtgaccggtgtcacccgggtgactatacgtaaaagtaaaaacattctgtttgtgataactaaacccgacgtgtataagtcccctgcatccgacacttatatagtgttcggcgaggctaaaattgaggatctgagtcagcaagcccagctcgcagctgccgaaaagttcaaggtacagggtgaggccgtatcgaacatccaggaaaacacccaaacccctacagtccaggaagagtctgaggaggaggaagtggacgaaaccggcgtggaagtgaaagatattgaacttgtgatgagtcaggcaaacgtgtcaagggcaaaggccgtccgagccttgaaaaataactctaatgacattgtcaatgctatcatggaactgacaatgtag

SEQ ID NO: 232043 - DNA, 2778 bp, Artificial Sequence
  Description of Artificial Sequence: Synthetic coding sequence
atgcccggagaggccactgagaccgtcccagcaactgagcaggaactgccgcaacctcaggccgagactgcagtgctccccatgagcagtgctcttagcgtcacagcagccctcggccagcctggaccaactctacctcctccatgttcacccgctccccaacagtgccctttgtccgcagccaaccaggcctcacctttcccgtcacctagcacaattgctagcaccccgctcgaggtgcccttcccacagagctcttccgggacagctttacctttggggacggcgcctgaagctcctacgttcctacctaatttgataggccctccgattagcccagcagccctcgccctcgcttcacccatgattgccccaaccctaaaaggaaccccctcctccagtgcgcctctggctctggtggccctggcacctcattccgtgcagaagtcctcagcttttcctcccaatcttctaacctccccccctagtgtggccgttgctgagtcagggagcgtcattacactcagtgcccctatcgcacctagcgaaccaaaaacgaatttaaataaggtgccctccgaggtcgtaccaaatccaaaaggtactccaagccctccgtgcatcgtgtccacagtgccctaccattgcgtgaccccaatggcttctattcagtccggggtcgctagcctgccccagacaacaccaacgacaacacttgcgattgccagtcctcaagtgaaggatacgaccatatcaagcgtcctgataagcccccagaatcccggtagcctgagtcttaaggggccagtctcaccccctgctgccctcagcctcagcactcagagccttcctgtggtgaccagcagccagaagaccgctgggcctaacacacccccagatttccctattagcctcggcagccatctagcccctcttcaccagagttcttttgggagcgtgcagctcctcggtcagaccggtccatccgctctctcagatcctacagtcaagacaatcagcgtcgaccattctagcacaggcgcttcctaccccagtcagcgcagcgtcatcccccctctgccttctcgaaatgaggttgtaccagccaccgtggcagccttcccagttgtggctcctagtgtcgataagggcccatctactatctcttctatcacctgtagtcctagcggatcgcttaacgtggcgacttctttctcattgagtcccaccacttcactcatcctgaagtcatcccccaacgctacttaccattaccccttggttgctcagatgccagtttcaagtgttggcacgaccccacttgtcgtcactaacccatgtaccatagccgcagctcctacaactacctttgaggtggctacgtgtgtgagcccgcctatgtcgtctggacctatcagcaatatcgagcctacctctccagcagcgctcgtcatggctcccgtcgccccaaaggaacccagtacccaagtcgccacaactctgaggatacccgtgagtcccccactccccgatccagaggacttgaagaatctgccttcttccgtcctggtcaaattcccaacccagaaggacctgcagactgtgcctgcgtccttagaaggcgcaccattttcgccagctcaggctggcctgacgactaagaaagacccaacagtgcttccgctcgtgcaggccgctcctaagaatagcccaagttttcagagtacaagctctagtccagagattccactaagcccagaagcaacgctcgccaaaaagtctctgggtgaacctctgccaatcgttgcagcttttccactagagagcgccgacccagcaggggtggcacctacaactgctaaggcagcggcatttgaaaaggtcctgccaaagcccgagagcgcctctgtatcggcggcaccatccccacccgtgagcctgcctctggccccatctcctgtacccacgttgcccccaaaacagcagtttctgcccagctctcccggacttgtactggagtcacccagcaaacccttggcccctgccgatgaggacgagctattgcccttgattcccccagagcctattagcggaggcgtcccttttcaatcagtgctcgtcaatatgcccacccctaagtcagccggaattccagtacccacacctagcgctaaacagcccgtcactaaaaataataaaggtagtgggaccgagagcgacagcgacgaatcagtgcctgagcttgaagagcaggactccacacaggccaccacacagcaggctcaactggctgcagcagcagaaattgacgaagagcctgtgtccaaggcgaagcagtccagatccgaaaagaaagccaggaaggccatgtccaagttgggcctgcggcaagtcacaggggttacccgggtgacaatccggaaaagtaagaatatcctcttcgtaatcaccaaacccgatgtttataaaagccccgcaagcgatacgtatattgtgtttggtgaggctaagatcgaggacttgagtcaacaggcacagcttgccgcagcagagaagtttaaggtgcagggggaggccgtctccaatattcaagagaacactcagactccaaccgtgcaggaggagtctgaagaggaagaggtcgacgagaccggggtcgaggtaaaggacatcgaattggtgatgtcccaagcgaacgtttctagggctaaagcagtgagggccctgaagaacaactcaaacgacattgtcaacgccataatggagctgactatgtag

SEQ ID NO: 232044 - DNA, 306 bp, Artificial Sequence
  Description of Artificial Sequence: Synthetic coding sequence
atgccactggaagacgaggttgtgccacctcaggtgctgtcagaacccaatgaggaagcgggagcagccttgagtcccctcccggaagtccccccatggacaggcgaagtctcccctgcccagcgggatgggggagctctcggcagaggcccttgggacagctccgatcgctccgctttgcttaaaagtaagctgcgcgctctactgaccgcacccaggtctctaagaaggtcttcatgttttggcggtcgcatggatcgcattggagcacaatcaggcctggggtgtaatagctttcggtattag

SEQ ID NO: 232045 - DNA, 456 bp, Artificial Sequence
  Description of Artificial Sequence: Synthetic coding sequence
atgtcatcgtttagcaccacaactgttagctttctgctgcttcttgcgtttcagctcttggggcaaactcgtgccaatcctatgtataacgcggtgtcaaacgccgatcttatggattttaagaatctgctcgaccacctggaggaaaaaatgcctctcgaagatgaggtggtgccccctcaagtgctgagcgagccgaatgaagaagcgggtgccgctttgtcgccactccctgaagtaccaccctggacgggggaggtgtcgccagcccagcgagacggaggggctctcggacgaggtccatgggactcttccgataggagcgctctgctaaagtccaagctgagggcgctactgaccgcaccccgaagccttcggagatcgtcctgttttggaggccgtatggacaggatcggcgcacaaagcgggctcggctgtaactccttccggtactag

SEQ ID NO: 232046 - DNA, 768 bp, Artificial Sequence
  Description of Artificial Sequence: Synthetic coding sequence
atggagcagtatgcaaataacctagaagagttagtcgaagagcggacacaggcataccttgaggagaagcgtaaggccgaagccttgctctaccaaatcctccctcactccgtggccgagcagcttaagcgaggggagaccgttcaggccgaagcattcgatagcgtaaccatctacttttcagatatcgtgggttttaccgccttgtcagctgagtcaacgccaatgcaagtcgttacattactgaacgacctgtatacttgctttgacgccgtgatcgacaatttcgatgtgtacaaggtggagacgatcggagacgcttatatggtggtaagtggcctgccagtacgcaatgggcgattacatgcatgcgaggtagccaggatggccttggctctgctggacgcagttagatccttcagaataaggcatcggcctcaagaacagctgcggctgcgcatcggtatccacacagggccagtatgcgccggagtggtggggctgaagatgcctcgatactgtctgttcggtgacaccgttaataccgcctctaggatggagtccaacggagaagccctgaaaattcatttaagttctgagaccaaggctgttcttgaggagttcggagggttcgaactcgaactgaggggagacgttgaaatgaaggtggagggcgaggcctctgccctacctactttttggggaccccgaggatcatacccgtcccaggcggcaaatgctacccctattccgaaagccctgatttag

SEQ ID NO: 232047 - DNA, 3186 bp, Artificial Sequence
  Description of Artificial Sequence: Synthetic coding sequence
atgccagggcctagaagaccagccggttctcgccttaggctgcttctgctgcttctgctgcctccactcctgttgctgttgagaggctctcacgctggtaatctgactgtggcagtcgtcctcccactcgccaacaccagctatccctggtcttgggcaagagtcggtccagcagtggagctggcgctcgctcaagtcaaagcgaggcctgacctgttgccaggttggaccgttcgaacagtgttaggttcctcagagaacgctctaggcgtgtgttcggacaccgcagctcccctggccgctgtcgatctgaaatgggagcacaatccagctgtgtttcttggccctggttgtgtgtacgccgctgctcccgttggccgattcacagctcattggagagtgcctctgctcacagctggtgccccagcccttggctttggggttaaagacgaatatgcactgacgaccagagccggtccctcgtatgcaaaacttggtgatttcgttgcagcattgcacaggaggttgggatgggaaaggcaggccctgatgctctacgcctaccgcccaggagatgaggagcactgtttcttcctagtggaaggtctgttcatgcgagtaagagaccggctgaatattacggtggaccacctcgagttcgcagaagatgacctgtctcactataccagattactccgcacaatgcctcgtaaaggtcgggtcatttacatttgttcatctcctgatgcatttagaacactaatgctcctggctctggaagcaggcctgtgcggggaggactacgtgttttttcacctggatatttttggacagtctctgcagggcggacaaggaccggctcctcggcgaccttgggagcgcggagacggccaggatgtgtccgcaaggcaagcttttcaagctgcgaagatcatcacatataaggatcctgataacccagagtatttagagtttctgaaacagctgaaacatttggcttacgaacagttcaattttaccatggaagatggcctagtgaatactatccccgcttcgttccatgacggcctgctcttatatatccaggcagtaaccgagactctggcccatggaggcactgttacagatggagaaaacattactcaacgcatgtggaaccgttctttccagggagtcacaggctatctcaagatcgactcaagtggagatcgcgaaacagacttctccctctgggatatggatcccgagaacggcgcatttagagttgtactgaattacaatggcactagtcaggagctcgttgcggtttcaggaagaaagttaaattggcctttgggataccctcctcctgacatcccaaagtgtggctttgacaacgaagaccctgcatgtaatcaggatcacctttccactctggaggtactggctctggtcggcagcctgagtttgttaggcatcctcattgtgtcctttttcatataccgcaagatgcagttagaaaaggagcttgcctcagagttatggcgcgtgagatgggaagatgtggagccctccagtctcgagcggcacctgagaagcgccggaagcaggttgacgctcagcgggaggggctcaaattacggtagtttgctgaccactgagggccaattccaagtctttgcaaaaactgcatactataaaggaaatctcgtggcagtcaagagagtgaaccgaaagcggatcgagctgaccaggaaagtgctgttcgaattaaagcacatgcgggacgttcaaaatgagcatttgactaggttcgtcggcgcatgcactgatcccccaaatatctgtatccttacagagtattgtcccagaggtagcctccaggacatcctggaaaacgagagcatcactttagattggatgtttcggtactctctgaccaacgacatcgtcaagggcatgctctttctgcacaatggagctatttgcagtcacggcaacctgaagagtagtaactgtgtcgtggacggaaggttcgtcctgaagattactgattacgggctcgaaagttttagagacttggaccctgagcaagggcatacagtttacgctaaaaagctgtggaccgccccagagctcctgcggatggcctccccaccggttcggggttcacaggccggagatgtgtacagtttcggcattatccttcaggagattgctctgcggagcggcgtgtttcatgtagaaggattggacctgagcccaaaagagattattgagagggtgacccgcggtgagcagccacctttccgacccagcctggcccttcaatcccatttggaggaattggggctcctcatgcagagatgttgggcagaggacccacaggagcggcctccctttcaacagattcggctcaccctgcgtaagttcaacagggaaaattctagcaacatcctggacaatctcctatcccgcatggaacagtacgccaacaacctagaagagttagtggaagagcggactcaggcctacctcgaagagaaacggaaggccgaggccctgctctaccagatcctgcctcattccgtggcagagcagctcaagcgaggggagacagtccaggccgaggcattcgactctgtgaccatttattttagcgatatcgtgggatttactgcgctctcagccgagtcaactcctatgcaggttgtcacacttcttaatgatctgtacacttgcttcgatgcagttattgataattttgatgtgtataaggttgaaacaattggcgatgcttacatggttgtgtcgggcctgcccgttagaaatggccgtctgcacgcttgcgaagttgctcgcatggcattagccctcctcgacgcagtgagatcttttcgaatcagacatcgtccccaagaacaactgcggctgcgtataggaatacacacaggcccagtgtgcgcaggagtggtaggcctcaaaatgccgcgttattgtctcttcggagatacagtgaataccgcttctaggatggagtccaacggagaagcgcttaagatacatttgagttcagagacaaaagcggtgctggaggagtttggcggattcgagcttgaactgcggggagacgtggaaatgaaagggaaagggaaggtcagaacctactggcttctcggcgagagaggttcctccaccaggggatag

SEQ ID NO: 232048 - DNA, 1623 bp, Artificial Sequence
  Description of Artificial Sequence: Synthetic coding sequence
aaaatgcagctggagaaggaactcgcctccgaattgtggagagttagatgggaggacgtagaaccttcaagtctggagcggcatctccgatctgcaggctcacggttgacactgtcgggacggggtagcaattacggctccttgctgactactgaggggcaatttcaggtttttgcaaagacagcctactacaagatgagagatgtccagaacgaacacctaacacgatttgtgggcgcttgcactgatccaccaaatatttgtatcctcaccgaatactgtccaagaggctctctgcaggacatcctggagaatgagagtatcactctggattggatgtttagatactctttaactaatgatattgtgaaggggatgctgttcttgcacaacggggcaatatgcagccacggaaacctcaaatcatccaattgcgtggttgatggccgtttcgtgttaaaaattactgattatggattggaatcctttcgggatttggacccagaacagggtcacacagtgtacgccaagaaactgtggacagcccctgaactgctacggatggccagcccaccagtgcgtggcagccaagctggagacgtgtactctttcggtatcattctgcaggagattgctctccggtcgggcgtcttccatgtggaagggctggacttgtcacccaaagagattatcgagagagtgactcgtggtgagcagccgccttttaggccatcacttgctctgcaatcgcacttagaagagctggggcttctaatgcagcggtgttgggcagaagaccctcaagagagacccccattccagcagattcggctgacgctcaggaagtttaaccgggaaaacagcagtaacattttggataaccttttatcaagaatggagcagtatgctaacaacttggaggagcttgttgaagagagaacacaggcatacctggaagaaaaaaggaaggccgaggcccttttatatcaaatcctgccgcacagcgttgcggagcagctcaagagaggcgaaacggttcaggcagaggcttttgacagtgtgacaatctacttcagcgacattgtgggcttcacagcactgtccgcagagagcacccctatgcaggtcgtgaccctgcttaatgacctttacacttgtttcgatgcagtgattgataatttcgatgtgtataaggtggaaactattggagatgcgtacatggtggtgtctgggctgcctgtccgaaatggacgtctacacgcgtgtgaagttgccagaatggcgctggcgcttctggatgctgtacggagcttcagaattaggcacagaccacaggagcagctacgtctccgaataggtatccacacaggacccgtatgtgccggagtggtcggcttgaaaatgccccgttattgcttgttcggcgataccgtcaacaccgcttcacgaatggagagcaacggcgaggctctgaagatacacctctcgagcgagactaaagcagttctcgaggagttcgggggattcgagctggaattgaggggggacgtggagatgaagggaaaggggaaggtgagaacatactggctgctgggggaaagggggtcatcgaccaggggttag

SEQ ID NO: 232049 - DNA, 3144 bp, Artificial Sequence
  Description of Artificial Sequence: Synthetic coding sequence
atggcactgccatcactcttgcttctggtggcagcccttgcgggaggggtcaggcctcccggtgcaaggaaccttactctggctgtggtgctaccagagcataatttatcatacgcatgggcttggcctcgggtgggaccagcagtggcattagctgtggaggccctggggcgtgctttaccggttgatctcagattcgtgtcgtccgagctcgagggagcctgcagcgagtatctggcacccctgtccgccgtggatctcaagttgtaccacgaccctgatcttctcctgggcccagggtgcgtgtatccagccgcatcagttgcccgatttgcatcgcattggcgcctgccactgctcaccgccggagctgtggccagcggtttctctgccaagaacgaccattaccgaactcttgtgaggactggcccaagcgcaccgaagttgggagaattcgtggttactttacatgggcatttcaactggacagcaagggctgcgctgttgtatctggacgcaagaactgacgacagaccgcactattttaccattgagggagtctttgaggctttgcaaggttccaatttaagtgtacaacatcaagtgtacgccagggagcctgggggaccagagcaggccacacacttcatccgcgctaatggaagaatcgtgtatatttgtggcccattagaaatgctgcatgaaatactgctgcaggcacagagagaaaacctgacaaacggagactatgtttttttctaccttgacgtgttcggtgaaagcctccgcgcaggccctactcgcgcaacaggaaggccatggcaggacaatagaaccagggaacaggcacaggcattgcgagaagcttttcagaccgtactggtgattacatatcgtgagcccccaaaccctgaatatcaagaatttcaaaacaggctcctcattagagctcgcgaggatttcggcgtggagttaggcccatctctgatgaatttaatagccggttgcttttacgatggcatcttgctctatgccgaggtcctgaatgaaactatacaggaaggtggtaccagggaagatggtcttagaatcgtcgaaaagatgcaaggcagacgctaccacggggtgactggtctcgtcgtgatggataagaacaatgaccgtgagaccgattttgtattgtgggcgatgggagacctcgatagtggagatttccaacctgccgctcattatagtggggctgagaaacaaatctggtggactgggagacccatcccctgggtcaaaggcgctccaccctcggataacccaccatgtgcatttgacctggatgatccatcttgcgataaaacccctctgagtaccctcgccattgttgctctcgggactggcattactttcattatgtttggggtcagttcttttctcatcttcagaaaactaatgctagagaaggaactggcctctatgttatggaggatacggtgggaggaactgcagttcggcaattcggagcggtaccacaaaggggcaggttccagactgaccctctcccttcgcggttcaagttacggtagtttaatgactgcgcatgggaaatatcagatttttgcgaacaccggccacttcaagggtaatgtggtcgctattaaacatgttaataagaaacgtatcgagcttacacgccaggttctgttcgaactcaagcatatgcgggacgtgcagtttaaccatctcactcgtttcataggagcttgtatcgatcctccaaatatctgcatcgtgacggagtactgcccgaggggctcccttcaagacattctggaaaacgactcaataaacctggattggatgttccgttactccctgattaatgatctggtgaaaggcatggcgtttctgcacaatagcatcatttcctctcatgggagcctgaaatcatctaactgtgtggtcgacagtaggtttgtccttaagattacggactatggactggccagctttcgaagcacagccgaacccgacgactctcacgctctgtacgccaagaagctatggaccgctcccgaactgctgagcgggaaccccctgccaaccacagggatgcagaaggctgatgtctacagtttcggaatcattctccaagagattgcgctgcggtccggccctttctaccttgaaggtctggacctgtcacccaaagagattgtgcaaaaagttaggaacggccagcgcccttacttcagacctagcatcgatcggacacagctaaacgaagagttggtgcttctgatggaacgctgctgggcccaggaccctgccgaacgacccgactttgggcagataaaagggttcattaggcgatttaacaaagaaggcggtacttcgattctcgacaatttactcctgaggatggagcagtacgccaacaatttggagaagcttgtggaagagcggacccaggcgtatctagaggagaagagaaaagcagaagctctgctgtaccagattctgcctcactcagtggccgagcagttgaagcggggtgagaccgtgcaggctgaagcgtttgattccgtaacgatctatttttcagatatcgttggctttaccgcactctccgcagaatctactcccatgcaggtggtcactttgttaaacgatctgtacacatgtttcgatgcaattattgacaatttcgatgtttataaagtcgagacaatcggcgatgcttatatggtagtaagcggactgcccggaagaaacgggcagaggcacgcccctgaaatcgccaggatggcattagcacttctcgacgccgtgtcatcctttcggatacgacataggcctcacgatcagcttcgccttagaatcggcgtgcataccgggcctgtgtgtgccggtgttgtcggactgaaaatgcctaggtattgcctctttggagatacagtcaacacagccagtcgaatggaatctaatggccaggctctgaagatccatgtgagctctacgactaaggacgcgttagatgaactgggatgcttccaactcgaactccgcggagatgtcgaaatgaaaggcaaggggaaaatgcggacctattggcttctaggggagcgtaagggccctcctggactgctctag

SEQ ID NO: 232050 - DNA, 1626 bp, Artificial Sequence
  Description of Artificial Sequence: Synthetic coding sequence
atgccttcccttttagtattgacctttagtccttgcgtcctgctcgggtgggccttactcgcagggggtacaggagggggaggagtgggcggtggaggcggtggggctgggattggtggaggcaggcaagagcgagaagcactcccaccgcaaaaaatcgaagttttggtgctcctgccccaggacgactcatacctgttcagtttaacccgtgtaagacccgcaattgaatatgctctgcgaagcgtggagggcaacgggacaggcagaagacttctcccgccaggcaccagatttcaggttgcatacgaggacagtgactgcggcaatagagcgctgtttagcctcgttgaccgagtggccgcagcacgaggcgctaaacccgacctgattttaggccctgtgtgtgagtatgccgctgcacccgtggcaaggctggctagtcactgggatctgcctatgttgtctgccggagctctcgccgcaggcttccagcacaaggactcagagtacagccacctgacccgagtggctcccgcatatgcgaagatgggtgagatgatgctggcacttttcagacatcaccattggtcaagggctgccctggtatatagcgacgataaactcgagagaaattgttactttaccctggagggggtgcacgaggttttccaggaagaaggcctccatacgtctatatactcgtttgatgagacaaaggacttggatttggaagatattgttcgaaacatccaagccagcgaaagagtcgtgatcatgtgcgcctcttctgacacaataagatccattatgctggtcgcacacaggcacgggatgacgtccggtgattatgccttctttaacatagaactgtttaatagttctagttatggcgacggctcatggaagcgcggtgataagcacgatttcgaggccaagcaagcatacagttcactgcaaacggtaacactgctgaggacagtcaaaccggaattcgaaaagttcagtatggaggtgaagtcctccgtggaaaaacaggggctgaacatggaggactacgtgaatatgttcgtagaggggtttcacgacgctattctgctctatgttctggcactgcacgaagtattgcgcgctggttattcaaaaaaggacggcggaaagattatccaacagacttggaaccgcacgttcgagggtatcgccggtcaggtgtctattgatgctaatggcgacagatacggcgattttagcgttattgccatgacagatgtcgaggcgggtactcaggaagtaattggcgattacttcggtaaagaggggagatttgaaatgcggcctaatgtcaaatatccttggggaccgctgaagttgaggatagacgaaaacagaatcgtagagcatacaaacagctccccgtgtaaaagctctggagggttggaagaatccgccgtgaccggaatagtggtgggagctctcctgggagccggactgttgatggcattttacttttttagaaaaaaatatcgaatcacaattgaaaggagaactcagcaggaagaaagtaacttgggcaaacaccgcgagttacgagaagacagcatacgctcacacttctctgtcgcttag

SEQ ID NO: 232051 - DNA, 1623 bp, Artificial Sequence
  Description of Artificial Sequence: Synthetic coding sequence
atgccaagtctgctggtcctgacattttccccgtgcgtgttattgggctgggcactcctggctggagggacaggaggtggcggagtggggggaggaggcggaggcgctggaatcgggggtggtcgccaggaacgagaggccctgcctccccaaaaaatcgaggtgttggttttactgccacaggatgatagttacctcttctctctcactagggtgcgtccagccattgagtatgctttaagaagtgttgagggcaatgggactggcaggagactactgcctcctggtacaagattccaggtagcatacgaggactctgactgtggcaatcgggctcttttctccctggtggacagagttgctgcagcacggggagccaagccagacctcatcctgggtcccgtgtgcgagtatgctgctgcacccgtcgcccgattagcctcgcattgggatctgcctatgctgagcgccggagccctcgccgctgggttccagcacaaggattctgagtactcccatctaacgcgcgtggcaccagcgtacgctaaaatgggagagatgatgctcgctctgttccggcaccatcactggtcaagggcagcactggtctactccgacgacaagcttgaacgaaattgttattttaccttggaaggagtgcatgaggtctttcaagaggagggccttcatacctccatctacagctttgacgagactaaggatcttgatctggaagacatcgtccgcaacatccaagcctccgagagagtggtgatcatgtgtgcctccagcgacacaattcgtagcattatgttggtcgcccatcgtcatggtatgacatctggagattatgcatttttcaacatcgaactgtttaactccagttcgtatggcgatgggagctggaagcggggtgacaaacacgacttcgaggcaaagcaggcctactcaagcctgcaaacggtgacccttctgaggaccgtcaaaccagagtttgaaaaatttagcatggaagtcaagtcttcagtggagaagcagggcctaaacatggaggactacgtgaacatgttcgtcgagggcttccatgacgctatccttctgtatgtactggcactccatgaagtgctccgtgctggatatagtaaaaaggacgggggaaaaatcatacaacaaacatggaaccgcacgtttgagggtattgccggacaggtgagtatcgatgctaacggagaccgttacggcgatttttcagtgatagcaatgaccgatgttgaagccggaactcaagaggtcatcggagactacttcggtaaggaggggcgattcgagatgcgcccaaacgtcaaatacccctggggacccctgaaactgcgtatagatgagaacaggattgtggagcacacaaactctagcccctgcaaaagttgtggcttagaggaaagcgcagtcacgggtattgtggtgggggctctgctaggagccggtcttctcatggctttttactttttccgcaaaaagtataggataaccatcgaacgcaggacacaacaggaggaaagcaacctgggcaagcatcgcgaattgagagaagacagtattaggtctcatttttcagtcgcctag

SEQ ID NO: 232052 - DNA, 975 bp, Artificial Sequence
  Description of Artificial Sequence: Synthetic coding sequence
atggaaccttctgcacttggtccgtggagcctgttcccagatctggctcctcgcgaccaagagggccaagtgttggcccctcgaagatgcttcagaagagaatgtgggcagaatgagaaagtagtgatcatgtgcgcatcttccgacactatcagatctataatgctggtagctcatcggcatggaatgaccagtggagactacgcattttttaatatcgagctgttcaattcctcatcatacggggacggttcatggaaaaggggggacaaacacgactttgaagcaaagcaggcttattcaagcctacagactgtcacattgctacgcaccgtaaaacctgagtttgaaaagttcagcatggaggtcaaatcaagcgtggaaaagcaaggcctgaacatggaggactacgtgaacatgtttgtagaagggttccatgatgccatcctgttgtatgtactggctctccatgaagtcctgagggctggttattccaagaaagacggcggaaaaataattcagcagacttggaaccgcactttcgagggcatcgccggacaagtttcaatcgacgctaacggtgacagatacggggatttctctgtcattgcaatgacagacgttgaagccggaacgcaggaggtcatcggggactacttcggaaaagaggggaggtttgagatgagacctaacgttaaatatccttggggacccctgaaactgaggattgatgagaatagaattgtcgagcacactaattcgtcaccatgcaaatcatgcgggctcgaggagtccgccgtcactggtattgtagtcggcgcattgctcggggctggtcttttgatggcattttactttttcaggaaaaagtaccggatcacaatcgaaagacggacccagcaagaagaatctaacctgggtaagcacagagaactccgagaggactccatcaggagccacttttcggtcgcctag

SEQ ID NO: 232053 - DNA, 915 bp, Artificial Sequence
  Description of Artificial Sequence: Synthetic coding sequence
atgtcctccacacttcccgcacttctgtgtgtgggactgtgtctgagccagaggatatccgcccaacagcagaccctccccaaaccattcatttgggcagagccccattttatggtacctaaggagaagcaggttactatttgctgtcaggggaattacggagcagtggaatatcagctccactttgagggttcactgttcgctgtagataggcctaaaccccctgagaggatcaataaagttaagttttacatcccggacatgaattcaaggatggccggacagtacagctgtatctacagagtaggtgaactctggagtgagccatccaatcttctcgacctggtggtcaccgaaatgtatgacacacctacgcttagcgttcatcctggaccagaggtgatatccggtgaaaaagtgaccttctactgtcgactcgataccgctactagtatgttcctgctgctgaaagagggcaggtctagtcacgtacagcggggatacggtaaggtgcaggctgagtttcccctgggccctgtgaccactgcccaccgcggtacgtaccgctgttttggcagttacaacaaccatgcatggtctttcccgtctgaaccggtcaagctcctggtgacgggcgatattgagaacacatctctcgctcctgaggatcctacatttccggcagacacatggggaacctacctgcttactacagagacaggcctacagaaggatcatgccctgtgggatcatactgctcagaacctcctccggatgggcctggcctttctggtgttggtggctctggtgtggtttctggtggaggactggttgtcaaggaagcggactcgagaacgcgctagccgcgcatccacctgggaaggtagaagaaggctgaatacacagacgctttag

SEQ ID NO: 232054 - DNA, 864 bp, Artificial Sequence
  Description of Artificial Sequence: Synthetic coding sequence
atgtctagtacactgccagccctcctttgcgtcgggctttgtctttcgcagagaatctccgcacaacagcagaccctgccgaaaccattcatttgggcagaacctcattttatggtccctaaggagaagcaggtgactatctgttgtcaggggaattacggagcggttgaatatcagctccattttgagggctctctgttcgcagtggacaggcccaaaccaccagaacgtatcaataaagttaagttctacatacccgacatgaatagccgaatggctggccaatactcttgcatctatcgtgtgggcgaactgtggtccgagccgtccaacctgctcgatctggtggtgacagaaatgtatgacaccccaacgttgagtgtacatccagggccagaggtgatttctggtgaaaaggtaaccttttactgtagactggatactgccacatccatgtttttattgctgaaagaaggccgtagcagccacgtgcaaagaggctacggaaaagtccaggcagagttccccttaggacccgtgaccacagcccaccgaggaacctacaggtgcttcggaagctacaataatcatgcttggtcattcccaagtgagccggttaaattgctggtcacaggggacatcgagaataccagcctggcccctgaggaccccaccttcccagaccacgcgctgtgggaccatacagcccagaacctacttagaatgggcctggcttttttagtgctagttgccctggtgtggtttttggtcgaagactggctgagcagaaagaggacccgtgagcgagcaagccgcgcttccacctgggagggacgaaggagattgaacacccagacgctgtag

SEQ ID NO: 232055 - DNA, 630 bp, Artificial Sequence
  Description of Artificial Sequence: Synthetic coding sequence
atgagttccacacttccagcccttttatgtgttgggctatgcttaagccagcgaatctcagcccagcaacagatgtatgacacacctaccctgtctgtacacccagggcctgaagtcatctctggcgagaaggtcaccttttactgcaggttggacacggctactagcatgtttttgctactgaaggaaggtagaagctcccacgtccagcgtggatatggcaaagtgcaagcggaattcccactggggcctgtcacaacagcgcatcggggtacctacaggtgctttgggagttacaataatcacgcctggagctttcccagcgagccagtgaagctgttggtcaccggcgacattgaaaatacttcactggctccagaggatcctacgtttcctgcggatacctggggaacttacctgctgaccacagagaccggcctgcagaaggatcatgcactgtgggatcacaccgctcaaaaccttctcaggatgggtcttgcattcctggtgctcgttgctctagtctggtttctcgttgaagattggttaagccggaagcggacgcgagaacgagctagtagggcttctacttgggaaggacgtagaagactgaacacacagaccctttag

SEQ ID NO: 232056 - DNA, 594 bp, Artificial Sequence
  Description of Artificial Sequence: Synthetic coding sequence
atgtcctcgacgctccccgctctgctctgtgttgaaatgtatgacacaccaacactgtcagtccaccccggtcctgaagtcatctctggcgagaaggtgaccttctactgtcggctggacactgccacatctatgtttcttctgctaaaagaagggagaagctctcacgttcagcgaggttatggaaaggtgcaggctgaatttcctctgggtccggtgactacagcgcatcggggaacataccgatgcttcggatcttataataaccacgcttggagctttcctagtgagcccgtgaaactgctcgtaaccggtgatattgaaaacacctctttggctccagaggatcccacctttccagctgacacctggggtacttaccttctgacaaccgaaaccgggctgcagaaagatcacgccctgtgggatcacacagcacagaacttgctccggatgggtttggccttccttgttctagtggccttagtatggttcctcgtcgaagactggctgagtcgaaaacggactagggagcgagccagccgggctagcacatgggagggtcggagacgtctgaatacacagacattgtag

SEQ ID NO: 232057 - DNA, 912 bp, Artificial Sequence
  Description of Artificial Sequence: Synthetic coding sequence
atgtcatcgaccctgcccgctttgctgtgtgtgggtttatgcttatcacaaagaattagcgcccagcagcagacactgccaaagccctttatttgggccgagccacacttcatggtgccaaaggagaagcaggtgactatatgttgtcagggcaattacggcgcagttgaataccagttgcacttcgaagggagcttgttcgccgtcgacagacctaaaccaccagagagaatcaataaggtaaagttttacatccctgacatgaactctaggatggctgggcaatacagctgcatctaccgcgtgggtgagctttggagcgagccatctaacctcctggacctggtggtaactgagatgtacgataccccaacactgtcagtgcatcctggcccagaagtgattagcggcgagaaggttaccttctactgccgtctagatactgcaaccagtatgtttctgctgcttaaagaagggcgatcctcccacgtccagcggggttatgggaaagttcaggccgaattcccactcggtccagtgactaccgcgcacagaggcacctatagatgttttggtagttataacaaccacgcttggagctttccttcagagccggtcaaactcctcgtgacaggggacattgaaaacacctccctcgccccagaagatccaacattcccagacacatggggtacatatctgcttacaacagaaaccggtctccagaaggaccacgccttgtgggatcatacagcccagaacctgctgagaatgggccttgctttcctggttcttgtggccttggtttggtttttagttgaagactggctttcaagaaagcgtacaagggaacgcgcaagccgcgcttcaacctgggagggcaggcgcaggctaaacacccagaccctttag

SEQ ID NO: 232058 - DNA, 777 bp, Artificial Sequence
  Description of Artificial Sequence: Synthetic coding sequence
atggcatggcgtgcattacatccacttctcttgctgctgctcctctttcctgggagtcaggcacaaagcaaagcccaagtgttgcagagcgtggccggtcagacacttacagtcagatgccagtacccccctacaggcagtctctatgagaaaaaaggatggtgcaaggaagcgtctgcattggtatgtatcaggcttgtcacaagttccaagccaagaaccatggcatggacatcccgcttcaccatatgggatgacccggacgccggtttcttcactgtgaccatgactgatcttcgagaggaagattctggtcactactggtgtcgaatctatagaccctcggacaacagcgtgtccaaatctgtccgcttctaccttgtggtaagtcccgcatctgcatccacacaaacctcctggacccctcgcgacttggtgagctctcaaacccagacacagtcttgcgtacctccaactgccggtgccagacaagccccagagtccccttcaacaatccctgtgccttcccagcctcagaactcaaccctcagacccggtccagccgctcccatcgccctggttcccgtgttctgcggcctgctggtcgccaaatctctggtgctgtcggctctcctcgtatggtgggtgctgcgcaatcggcacatgcagcaccagggccgatctctgctgcacccagcccagccaagaccccaggcccacaggcattttccactttcgcatagggcccctgggggaacttatggtggcaagccctag

SEQ ID NO: 232059 - DNA, 813 bp, Artificial Sequence
  Description of Artificial Sequence: Synthetic coding sequence
atggcatggcgggctctccacccactacttctgctgcttctcctgtttcccggatcccaggcacagagtaaggcccaggtgctccagtccgttgccggtcaaaccctaactgtgagatgccagtaccctccaaccggcagtttatacgagaaaaaaggctggtgcaaagaagcctctgcgctggtgtgcatcaggctagtgacctctagtaaacctagaaccatggcttggaccagccgcttcacgatttgggacgaccctgatgcaggcttctttaccgttaccatgacagacttgagggaggaggatagtggacactattggtgtaggatttaccggccttcagacaacagcgttagcaaaagtgtccgcttttatctcgttgtctctccagctagcgcgtccacccaaacaagttggactcccagagacctggtcagctcccagacccagacccagtcgtgcgtcccacccacagcaggggcaaggcaggctcctgagtcaccaagtaccattcctgtgccctcccatcccagctcgcccctgcctgtgcccctgccatcgaggcctcagaattcaactctccgcccagggcctgccgcacctatcgcgttggtgcccgtgttctgcggtctgttagtggctaaatccctcgtactatccgctctcctggtttggtgggtcttgcgtaatagacacatgcagcaccaaggccgatcattattgcacccagctcagccccgacctcaggctcaccgacacttccccctctcccacagagcgcctggcggaacttacggagggaagccttag

SEQ ID NO: 232060 - DNA, 831 bp, Artificial Sequence
  Description of Artificial Sequence: Synthetic coding sequence
atggcctggcgggctctccatcccttattgttattgctgctcctgtttccaggctcacaggcacagagcaaagcacaggtactgcagtctgtcgccggacagaccctgacagtaaggtgtcaatacccaccgaccggaagcctgtacgaaaagaagggctggtgcaaggaagcatccgccctagtgtgcatcaggctggtgacatcctcaaagccacgtactatggcctggacgtccaggttcactatctgggacgatcctgatgcaggcttttttactgtgaccatgaccgatcttcgagaagaagattctgggcactactggtgccggatctacaggccctctgataactctgtttcaaaatcggtccggttctacctggtcgtgagtccagctagcgcgtctacacaaacatcatggacgcctcgcgatttggtctcgtcccagacccagacccagagctgcgtgccgccaacagctggagccaggcaggcaccggagtcccctagcacaatccccgttcccagccaaccccagaacagcacgctgaggcctggcccagccgcacctatcgcgctcgttcccgtgttttgcggactgttggtggccaaatcgctggttctgagcgcgctcctggtgtggtggggagacatttggtggaagaccatgatggaactgagatctctagacacccagaaggctacctgccaccttcagcaagtgaccgaccttccatggacctcggttagctcaccggtcgagcgggaaatcttgtaccatacggtcgcccgtactaagatctccgatgacgatgacgagcacacactgtag

SEQ ID NO: 232061 - DNA, 606 bp, Artificial Sequence
  Description of Artificial Sequence: Synthetic coding sequence
atggcttggatgttgttactgattttaatcatggtgcatcccggatcctgcgccctctgggtaagtcagccccctgaaatcaggactctagagggctcatcggccttcctcccttgttctttcaacgcctcccagggacgactcgctattggttccgtcacctggttcagggatgaggtggtgcctggcaaggaagttcggaatggcactcctgaatttcgagggagactcgcacccctcgcgagctctaggttcctgcatgaccatcaggctgagcttcacattagagacgtccggggtcacgacgcgtcgatttacgtgtgcagggtggaggtgttagggctgggagttggaacgggcaacgggacacggctggtggtggaaaaggagcatccacaattgggagccggtaccgttctgcttctccgtgccggattctacgccgtgtcttttctgtcagtggcagttggcagcacagtgtattatcaggggaagtgccttacgtggaagggcccacgaagacagctgcctgcggtcgtcccagccccactgccacctccatgtggcagctctgcgcacctgttgccccctgtacccggaggttag

SEQ ID NO: 232062 - DNA, 498 bp, Artificial Sequence
  Description of Artificial Sequence: Synthetic coding sequence
atggcctggatgctgctcctgatcctcatcatggttcacccgggtagctgcgccctgtgggtctctcagcctcctgagatcagaaccctagaaggctcttctgcttttctaccttgtagcttcaacgccagccaaggacgtctagccataggctcagtcacctggttccgcgatgaagtggtccccggaaaggaggccgaactccatatcagggacgtgcgcggacatgacgcttccatctacgtgtgtagagtggaggtgctgggcctgggcgtggggaccggaaacggcacacgactggtggtagaaaaggaacatccgcagctgggcgctggaaccgtgctgctgctgcgggcaggcttctacgccgtgagcttcctcagtgtggccgtaggaagcaccgtgtactatcagggaaagtgccactgccacatggggacccactgtcatagcagtgacggccctaggggggtgatccccgaacccagatgtccctag

SEQ ID NO: 232063 - DNA, 573 bp, Artificial Sequence
  Description of Artificial Sequence: Synthetic coding sequence
atggcatggatgctcctcctgatattgattatggtgcatccgggaagctgcgctctatgggtttcccaaccacctgagattcggactctagaggggtcttcagccttcttgccgtgttcttttaacgcatctcaagggagattggctatcggctctgtgacctggttccgagacgaggtggtgcctgggaaggaggtgcgaaacgggactcctgaatttcggggacgactcgcaccactcgcaagctccagatttcttcatgaccaccaggcagagctccacatacgcgatgttcgcggacatgatgccagcatctacgtgtgcagggttgaagtactggggcttggtgttgggacgggcaatgggacgagactcgtcgtagaaaaggagcacccgcagctaggggcaggcaccgtccttctcctgcgtgcgggattttatgccgtctcatttctgtctgtggccgtgggctcaactgtatactatcaggggaaatgtcactgtcacatggggacccattgccactctagcgacggtcctcgcggagtcatcccagagccgaggtgtccatag

SEQ ID NO: 232064 - DNA, 534 bp, Artificial Sequence
  Description of Artificial Sequence: Synthetic coding sequence
atggcctggatgctgctgctgatcctaatcatggtacatcccggttcctgtgccttatgggtatcgcaacctcctgagataagaacacttgagggatcctctgccttcctaccttgtagctttaatgcatctcagggtaggctcgccattgggtctgtcacttggtttcgtgacgaagtggtgccagggaaagaggtgcgtaatggaactcccgaattccggggtcgactggctcctctggcatcaagcagatttctgcatgaccatcaggcagagctgcacattagagatgtgcgagggcacgacgcaagcatctacgtttgtcgcgtggaggtcctcgggctgggcgtgggcacaggcaatggcaccaggctggtggtggagaaagagcatccacagctaggggcaggcaccgtattactgctccgtgcgggtttctatgccgtgtcctttcttagcgtcgctgtaggctctaccgtttattaccagggcaagtacgctaagtcaactcttagcggctttccacagctgtag

SEQ ID NO: 232065 - DNA, 573 bp, Artificial Sequence
  Description of Artificial Sequence: Synthetic coding sequence
atggcttggatgctcttgttaattttgattatggtccacccagggagctgcgcactgtgggtctctcagcctccagagatcagaacactggagggtagctcagcattcctcccgtgtagcttcaacgccagccaaggccgactggcaatcggtagtgttacctggttccgggatgaggtggtccctggtaaggaagtgagaaacggtacccccgaattccgcggtcggctggccccacttgccagctccaggtttctgcacgatcaccaggccgagctgcacatccgggatgtgcgcggacatgacgcctctatttatgtgtgccgtgtcgaagtactgggactgggcgtcggcacaggcaacggtacacggctggtggttgagaaggaacaccctcagcttggcgctggaacggttctgctgctgcgcgcaggcttttacgctgtgtcctttctgtctgtggcagtggggtcaactgtctactaccagggtaaatgtcattgtcacatgggcacgcactgtcacagctccgatggcccaagaggggtgatccccgagccaaggtgcccctag

SEQ ID NO: 232066 - DNA, 606 bp, Artificial Sequence
  Description of Artificial Sequence: Synthetic coding sequence
atggcttggatgctgctgttaatactgatcatggtacaccccggaagctgcgcgttgtgggttagtcagccaccggagattcgaacactggagggatctagtgctttcctgccctgttcatttaatgcgtcacagggtcgattagctattggatccgtcacgtggttcagagatgaggtggttccagggaaggaggtgcgcaatggcacccctgagttcaggggccgtctggcgcctctggcgtcctcccgattcctgcatgatcaccaggcggaattgcacattcgcgacgttagaggacatgatgcttctatctatgtgtgtcgggtggaggtgttaggcctaggcgtggggacaggcaacggtacacgcctagtcgtggagaaggagcacccacagctgggcgctggcactgtactgctgctgagagccggtttttatgctgtgagctttctaagcgttgccgttggtagcacagtgtactaccagggcaagtgtctgacgtggaaagggcctaggaggcagctgcctgctgtggtgccagctcccttgcctccgccttgtgggtcaagtgcccacctgctgcctccggtgccaggtggatag

SEQ ID NO: 232067 - DNA, 534 bp, Artificial Sequence
  Description of Artificial Sequence: Synthetic coding sequence
atggcctggatgttgttgttgatacttattatggtccaccccggaagttgcgccctctgggtcagtcaaccacctgaaattcggacactggagggtagttcagcctttctaccatgctctttcaatgcatcacagggcagactcgctattggatccgtgacctggttcagagatgaagtggtcccaggaaaagaggtaaggaatggtactccggagtttagaggacggttggcaccactggctagctcacgctttttacacgaccaccaggcagaactccacattagggacgttcggggacacgatgcaagcatttacgtttgcagagtagaggtactaggtctgggcgttggcaccggaaacggcacgaggctagtggtggaaaaagagcatcctcagctgggggctggcactgtactgcttctgcgcgctgggttctatgccgtgtcctttctgtccgtcgcggtcggcagcaccgtgtattatcaaggcaaatacgctaaaagcaccctgtctgggtttccacaattatag

SEQ ID NO: 232068 - DNA, 498 bp, Artificial Sequence
  Description of Artificial Sequence: Synthetic coding sequence
atggcctggatgctgctgctgattctgattatggtgcatccgggatcttgtgcgctatgggtgtctcagcctccagagattcgcaccctagaaggcagttcagcattcctcccatgctctttcaatgcctcacagggccgactcgcaatcggctctgtgacttggtttagggatgaggtcgttcctggcaaggaagccgaactccacatcagggacgtgcggggtcacgacgcttcaatttatgtttgtagggtggaagtcctaggattaggcgttggcacagggaacggcacgcgacttgttgtcgaaaaggagcatccccagctcggagccggaacggtcctcctcctgagggccggtttctatgccgtcagctttctgagcgttgctgtcggcagcacagtctactaccagggaaagtgtcactgtcacatgggaacccattgtcatagctcagatggcccacggggtgtgatcccagagccaagatgtccctag

SEQ ID NO: 232069 - DNA, 573 bp, Artificial Sequence
  Description of Artificial Sequence: Synthetic coding sequence
atggcctggatgctcctgcttatcctgattatggtacatcccggaagctgcgctttatgggtgtctcagcctcccgagattaggaccctggaaggaagctctgctttcctgccctgttcgtttaacgcttcccagggccgtttagctataggctcggtcacctggtttcgcgacgaagtggtgcccggaaaagaagttcggaacgggacccccgagttccgtggcagactcgctcctttggcctcttctcgcttcctgcatgatcatcaggccgagctccatattcgtgacgtccgcggtcatgacgcctctatctacgtttgtcgcgtagaggtgttgggccttggcgtcggcacaggcaatggcactcggctggtagtggaaaaggaacacccccagttgggagccggaaccgtgttgctgttaagggctggattctatgcagtttcattcttgtctgtggccgtcgggagcaccgtttactaccagggcaaatgccactgccatatggggacacactgtcacagctccgacggaccacgcggagtgataccagagccaaggtgcccttag

SEQ ID NO: 232070 - DNA, 606 bp, Artificial Sequence
  Description of Artificial Sequence: Synthetic coding sequence
atggcttggatgctgctgctgattctgatcatggtgcaccccggaagttgcgcactgtgggtgagccagccccctgagatcagaaccttagaaggcagctcagccttcctgccttgtagcttcaacgcttcgcagggtcgtcttgctattggatcagtgacctggttccgcgacgaggtagtgcccggaaaagaggtgcgaaatggcacccccgagttccgcggtcggctcgcccctttggccagttcccgctttcttcatgaccaccaggcggagctacacatccgagatgtgcgtggtcatgacgcctcaatttatgtttgtagagtagaagtcctcgggcttggtgtcggcacaggcaacgggacccgactggtggtcgagaaagaacatccacagctgggggcaggcacagtgctgctattaagagccggattctatgctgtgtcctttctgagcgtcgccgtgggatcaaccgtctattaccagggaaagtgtctcacttggaagggccctcggcgtcagctgcctgcagtcgtcccagcacctttgcctcctccgtgcggaagctcggcacacctcttacccccagtccccggaggctag

SEQ ID NO: 232071 - DNA, 573 bp, Artificial Sequence
  Description of Artificial Sequence: Synthetic coding sequence
atggcttggatgctgcttttgatactgataatggtgcatccgggttcctgcgccctgtgggtgtcccagccacctgagattaggactcttgaaggctccagcgccttcctgccttgtagctttaacgcgtcacagggaaggttggccatcggatccgtgacttggtttagagatgaggtggtgcccggtaaagaggtaaggaacgggactcctgaatttcgaggacgtttggccccactggcctcctcgcgctttttgcatgatcaccaggcagaactccatatccgggacgtgagggggcacgatgcctctatctacgtttgccgggtggaagtgctggggctaggggttggtaccggaaatggtacccggttagtagtggaaaaggagcacccacagctgggcgcaggcactgtcttactactgcgggcagggttctatgccgtgtctttcctgtccgtcgcagtgggatctactgtgtactaccaaggaaagtgccattgccatatgggaacccactgccattcctcagacgggccaaggggagtgattcccgaaccgagatgcccatag

SEQ ID NO: 232072 - DNA, 498 bp, Artificial Sequence
  Description of Artificial Sequence: Synthetic coding sequence
atggcgtggatgttattgctcattttgatcatggtacaccctggcagctgcgccctgtgggtgagccagccccctgagattaggaccctcgagggttctagtgcctttctcccctgttctttcaacgcttcccaaggaagactcgccattggatccgtgacctggttcagggacgaggtggtgccagggaaggaagccgagctgcacataagagatgttcgcggacacgatgcgagtatttatgtctgcagggtggaggtgctggggctcggcgtgggcactggcaatggcacccgcctggttgtagagaaggagcacccccaactaggagcagggactgtgctgctgctgagagcaggattctacgccgtgagttttctgtctgttgcagtgggctccacagtgtactaccaagggaaatgccattgccacatgggaacccattgccactccagcgatggccctcggggagttatacctgaaccacggtgcccatag

SEQ ID NO: 232073 - DNA, 498 bp, Artificial Sequence
  Description of Artificial Sequence: Synthetic coding sequence
atggcctggatgctgctcctaattctcattatggtgcatcccggatcatgtgctctgtgggtgtcccaacctccagagattaggacccttgagggaagctcggcattcttgccatgttcttttaacgccagtcagggtcgactggccattggcagtgttacctggtttagagatgaggtagtgccgggaaaggaagcagagcttcacattcgggacgtccggggtcacgatgccagcatttatgtatgccgggtggaggtgctgggcctgggagtgggcaccggtaatgggacaagactagtggttgagaaagaacatccccagttgggagccggtacagtattgctcctgcgggcagggttctacgcggtctcctttctcagtgttgcggtgggatcgaccgtgtactatcagggcaagtgccactgccacatggggactcattgtcactcgagcgatggcccaagaggcgtgatccccgagcccagatgtccatag

SEQ ID NO: 232074 - DNA, 498 bp, Artificial Sequence
  Description of Artificial Sequence: Synthetic coding sequence
atggcctggatgctgttgttgattctgataatggtgcatcctggttcttgcgcgctgtgggtgtcccaacctccggaaatccgaacactcgaggggtctagtgcatttctgccctgttccttcaacgcttcgcaaggaagacttgccattggatccgtgacatggttccgcgacgaagtggtgccaggcaaggaagccgagcttcatatcagggatgtgcgagggcacgatgcttcaatttacgtgtgccgggtggaggtgctgggattgggcgttggcactgggaatggtacaagactggttgttgagaaagagcatcctcagctgggggctggcacagtgttgctgctgcgcgctgggttctacgcggtctcttttctctcagtggcagtcggaagcaccgtatattaccagggaaagtgccactgccacatgggcacacattgtcattcctctgacggacctcgcggagttatccccgagccgcgatgtccctag

SEQ ID NO: 232075 - DNA, 606 bp, Artificial Sequence
  Description of Artificial Sequence: Synthetic coding sequence
atggcttggatgcttctcctcatcctgatcatggtgcacccaggtagttgtgccctatgggtctcccagccacccgaaattagaaccctggagggttcatcggcatttctgccgtgctccttcaatgcatctcagggaaggctcgcaatcgggagcgtaacatggtttagagacgaggttgttcccggaaaggaagtgaggaacgggacaccagagtttcgagggagattagccccactggccagtagccgatttctgcatgaccaccaagccgaattacacattagggacgtgcggggacacgacgcgtccatctacgtttgcagggtcgaggttctgggcctgggtgtgggtaccggaaacggcacccgcttagtcgtagaaaaggaacacccacaattaggagcagggactgtgctactcctgagagcaggtttctacgcagttagttttctgtccgtggctgtggggtccaccgtgtactaccagggaaaatgcctaacctggaaggggccacggaggcagcttccggctgtggtcccagcaccgctgccacccccatgcgggtctagcgctcacttgttgcccccagtgccaggcggatag

SEQ ID NO: 232076 - DNA, 606 bp, Artificial Sequence
  Description of Artificial Sequence: Synthetic coding sequence
atggcatggatgcttctcttaatcctgatcatggtgcacccagggagttgtgctctgtgggtgagtcagccccctgagattcgcacactagagggatcttccgccttccttccctgtagtttcaacgcctcacagggaaggctggctattgggagcgtaacttggttcagagatgaagtcgtcccaggaaaggaagtgagaaacggaactcccgagttccgcggacgccttgccccactagccagctccagattcctccacgaccaccaggcggaactccacatcagagatgttcgcggtcacgacgctagcatttacgtgtgccgggtggaagttctggggctgggtgtaggcaccggaaacggcaccagattggtcgtggagaaggagcatcctcagttaggcgcaggtacggtgttattgttgcgtgccggattttacgcggtgtcttttttgtctgttgcggtgggctcaaccgtctattatcagggcaagtgccttacttggaaaggtcctaggagacagctacccgcagtggtgcccgctccattgccgccaccctgcggctcaagtgcccatctgctgcctcctgtccccggtggttag

SEQ ID NO: 232077 - DNA, 534 bp, Artificial Sequence
  Description of Artificial Sequence: Synthetic coding sequence
atggcgtggatgttgttgctgattttgatcatggttcacccagggtcttgtgccctgtgggtcagccaacccccagaaatccgcacactcgaaggttcatccgctttccttccctgttcatttaatgcctcacaggggagactcgctatcgggagtgtgacctggttccgggacgaagtcgtgcccggtaaagaggtgaggaatggcaccccagagtttagagggagactggctcccctcgcgtcaagtcggttcctgcatgaccaccaggccgagctgcatatccgggatgtgcgcggtcacgacgcctctatctacgtttgcagggtcgaagtactcggtctaggcgtaggaacagggaacggcaccagactggtggtagaaaaggaacatccacaattaggagccggtacagtgcttctgctccgggctggcttttacgcagtgtcctttctgtccgtcgctgtcggctccaccgtctactaccagggcaaatacgccaagagcacactgtccggattcccccagctctag

SEQ ID NO: 232078 - DNA, 534 bp, Artificial Sequence
  Description of Artificial Sequence: Synthetic coding sequence
atggcatggatgcttctgctgattctgattatggtgcatcccggttcatgcgccctgtgggtgagtcagcccccagagattcggactctagaagggtcttcagctttcctgccatgctcttttaacgcgagtcagggcaggttagccataggttcagtgacttggttccgggacgaggtggttccgggaaaagaagtgaggaatggaacaccggagtttcggggtcggctggcacctcttgccagcagccgcttcttgcacgaccaccaggcggagctgcatatcagggacgttcgaggccatgatgcgtcaatatatgtatgtcgggtggaggtcctggggctgggcgtaggaaccggtaacgggacacgcctagtggtagagaaggagcaccctcagctcggggctggcacagtgcttctcctaagggcgggtttttacgccgtgtcatttctttcagtggcggtaggtagtacagtgtattaccagggtaaatatgcaaaatccactctgagcggttttccacaattgtag

SEQ ID NO: 232079 - DNA, 606 bp, Artificial Sequence
  Description of Artificial Sequence: Synthetic coding sequence
atggcatggatgctgctgttaatccttattatggtgcacccaggctcatgcgcactgtgggtaagccaaccaccggagatacgcaccctggaggggagttccgccttcctgccatgcagttttaatgcatctcagggcaggctggctatcggtagcgtgacttggtttcgggacgaagttgttcctgggaaagaagtgcgtaacggcactccggaatttagggggaggctggctccgctggcgtcttccagattcctgcatgaccatcaggcagaattgcacattcgtgatgttcgaggtcacgatgcctccatttacgtgtgtcgcgtggaggttttaggactgggcgtgggcaccggcaatgggacgcgccttgtggtcgagaaggaacatcctcaactaggggctgggaccgttcttttactgcgggcaggattctacgccgtcagcttcctgagcgtggcggtcggatccactgtctactaccagggtaaatgtctgacatggaaaggtccacgcagacaactcccagcagtggttcccgcacctctgcccccaccctgcggttcttccgctcacctgctcccccctgttcccggagggtag

SEQ ID NO: 232080 - DNA, 534 bp, Artificial Sequence
  Description of Artificial Sequence: Synthetic coding sequence
atggcatggatgctgcttctgattctgatcatggttcaccccggtagctgtgctctgtgggtgtctcaaccacccgaaatacgaaccctggaaggttcctctgcatttctcccatgcagcttcaacgctagccagggtaggctcgccattggatctgtgacatggttccgggacgaggttgtgcccggtaaggaagtccggaacggaacccctgagtttcgcggacggttggcccctctggcttcatccagatttctacatgaccatcaggcagaattgcatatccgagacgttagggggcacgacgccagcatctatgtatgcagggtggaagtgctgggactgggggttgggaccggaaacggaacccggctcgtcgttgaaaaggagcacccccagttgggagcgggaaccgtgctgctcctgagagccggtttctacgccgtatcatttctgtctgtcgcagtcgggtctaccgtatactaccagggcaaatatgcaaagtcgacactgtctggcttcccgcagttgtag

SEQ ID NO: 232081 - DNA, 573 bp, Artificial Sequence
  Description of Artificial Sequence: Synthetic coding sequence
atggcctggatgctgctgctgatactgattatggttcaccctggcagttgtgccctatgggtgagccagccgccagagattcgcacactggagggctccagtgcatttctgccgtgttctttcaatgccagccagggcagactggcaatagggtctgtgacgtggtttcgagatgaggtggttccaggcaaagaagttcgaaacggcactccagagttccggggtcggctggccccattagcctcgtcccggttcttacacgaccatcaagccgagctacacatccgggatgtccggggacacgacgcatcaatttatgtgtgcagagtggaggtcttgggactgggggtgggaaccggaaatggcacgcgcctggtcgtagagaaagagcacccccagttgggagcgggtaccgttctgctcctgagggccggattttacgccgtttcgttcttgagcgttgcagtcggctcaacagtgtattaccaagggaaatgccattgccatatggggacccactgccactcaagcgacggccctcggggagtgataccggagccaaggtgtccttag

SEQ ID NO: 232082 - DNA, 606 bp, Artificial Sequence
  Description of Artificial Sequence: Synthetic coding sequence
atggcctggatgttattgctgatcctgatcatggttcatcctggtagttgcgctctctgggtgtctcagcccccagagatccgaaccctggaagggtccagcgcgttcctgccttgctcctttaatgccagccaggggagacttgccattggttccgtgacatggtttcgggatgaagtggttccgggtaaagaagtgaggaacggaacacctgagttccgaggcagacttgcgccactcgcatcttcccgattcctgcatgatcaccaggcggaactgcatattcgcgacgtgcgcggacatgacgcgtccatctatgtgtgtcgcgtggaggttctgggactcggggtggggactgggaacggtacgcgtctcgttgtggagaaagagcatcctcagttgggcgctggcactgttctgctgctccgcgcaggcttttacgccgtcagctttctaagtgtggcagtgggctctaccgtatactatcagggtaagtgcttaacttggaaaggaccacggcgacagctgcccgcagtggtccccgctcccctaccaccgccatgtggatcatcagcccatctactgcctcctgtacctgggggatag

SEQ ID NO: 232083 - DNA, 498 bp, Artificial Sequence
  Description of Artificial Sequence: Synthetic coding sequence
atggcctggatgttgctgctgattctcataatggtgcatcccggaagctgcgctttatgggttagccagccgcctgagatacgaactttggaaggcagctctgctttcctgccgtgttctttcaacgccagccaggggcgactcgctattggcagtgtgacttggttccgcgacgaagtcgtccctgggaaggaggctgaactccacattagagacgtgcgcggacacgatgccagtatttatgtgtgccgcgtggaggtgttgggcctaggtgtgggcacaggcaatggaacaagattggtcgtggaaaaagagcacccacagcttggtgccggaaccgttctcctgctgcgggctggtttttacgccgtgtcgttcctgagtgtggccgtcggctctacagtgtactaccaggggaagtgtcactgccatatgggaacacattgtcattcttcggatggaccacggggagttattccggagcctaggtgcccctag

SEQ ID NO: 232084 - DNA, 534 bp, Artificial Sequence
  Description of Artificial Sequence: Synthetic coding sequence
atggcctggatgctgttattaatcttgatcatggtccatcccggatcttgtgctctttgggtgtcccagccaccggagataaggactctcgaaggcagtagcgccttcttgccttgctcctttaacgcctcccagggcagactggccataggctccgtgacttggttccgcgatgaggtggtgcccggtaaggaagtgcgaaacgggacacccgaatttagagggaggttagctccattggcatcaagtaggttcctgcacgaccatcaggccgaactgcacattagggacgtccggggtcatgacgcttctatttacgtatgcagggttgaagtgctcggcctaggtgtggggactgggaatgggactcgcctcgtggtcgagaaggagcacccgcaactgggtgccggaacagtcctcctgctccgcgctggtttttatgcagtctccttcctcagtgtggcagtgggatccacagtttattatcagggaaaatacgctaagtccaccctgagcggatttccccagctttag

SEQ ID NO: 232085 - DNA, 573 bp, Artificial Sequence
  Description of Artificial Sequence: Synthetic coding sequence
atggcctggatgctcctgttgatcctgattatggtccaccccggatcatgcgctttgtgggtctcacaacctcccgagattagaacgctggagggcagttccgcctttctgccttgctcatttaatgcctcacaaggcaggctggcaataggaagcgtgacctggttcagggatgaggtcgtaccaggcaaagaggtgagaaatggcaccccagaattccgcggacgcctcgctccacttgccagtagtagattcctgcacgaccatcaagccgaactgcatatcagagacgtcaggggccacgacgccagtatttacgtttgccgagtggaagtactaggcctgggtgtgggaacgggtaacggaacaaggctggtggtggaaaaagaacatcctcagttgggcgctggcacggtgttacttttgcgagcagggttttacgctgtgagttttctcagcgtggcagtgggctccactgtctattatcagggcaaatgccattgtcatatggggacacactgccacagcagcgatggccctaggggcgtgatccccgagcctcgctgcccctag

SEQ ID NO: 232086 - DNA, 534 bp, Artificial Sequence
  Description of Artificial Sequence: Synthetic coding sequence
atggcttggatgctgctgcttatcctgattatggtgcatcccggatcatgtgctctctgggtgagccagccaccggagattcggacgttagaaggcagttcagcctttctgccctgctctttcaacgcttcccagggcaggctcgcaataggcagtgttacttggttccgagacgaagtggtgcctggcaaggaggtgcggaatgggacccctgaattccggggaagattggcacctctcgcctcaagccgattcctccacgatcaccaggctgaactgcacatcagagacgtgcgcggtcacgatgcatcaatatacgtgtgcagagtcgaagtgttgggcctgggagtggggactggtaacggaacccggctagtcgtggagaaggagcaccctcagctgggcgcagggacagtgcttttattaagggcgggtttctatgcagtttcttttctctctgtggccgtgggatctacagtctattatcaggggaagtatgctaaatctaccttaagcggatttccacagctctag

SEQ ID NO: 232087 - DNA, 606 bp, Artificial Sequence
  Description of Artificial Sequence: Synthetic coding sequence
atggcatggatgcttctgttaattcttatcatggttcaccctggaagctgcgcgctatgggtttcacaacctcccgagattcgtactctagagggaagttctgccttcttaccttgcagctttaatgctagccaggggaggctggcaatcggatccgtcacatggttccgggatgaagtcgtgccaggcaaggaagtgcgaaacggaacccccgagttccgaggtagactggccccattggcaagctcaagattcctgcatgaccaccaggccgagctgcatatccgcgacgtaaggggtcatgacgcctctatctatgtgtgtcgcgttgaagtgctggggcttggtgtcggcaccggcaatggcacacggcttgtggttgagaaggagcatcctcagctgggtgctggaaccgtacttcttttaagagccggattctatgcagtgtcttttctcagtgtggccgttggatctactgtgtattaccagggcaagtgtctcacgtggaaaggaccaagaaggcagctcccggctgtggtccccgcaccccttcctccaccatgcggctcctctgcacatctgctccccccagtgccaggcggatag

SEQ ID NO: 232088 - DNA, 573 bp, Artificial Sequence
  Description of Artificial Sequence: Synthetic coding sequence
atggcctggatgctgctgttgattctgataatggtgcacccaggttcgtgtgctttgtgggtctctcagcctcctgagatcaggactctagagggtagctcagcctttcttccttgttcatttaacgccagccaggggaggctggccatcggtagcgtgacttggttccgggacgaagtggtgcccggaaaagaggtccgcaatgggacaccagaatttcgcggacgcttggcccctctcgccagttcacgcttcctgcacgaccatcaagcagagcttcacatacgcgatgtcaggggacacgacgcaagcatctatgtatgcagggtggaggtcctcggcctgggtgtcggaactgggaacggtacccgactggtggttgagaaagagcaccctcagctcggagcaggcacagttttgttgttgcgggctggattttacgccgtcagtttcttaagcgtggccgtaggcagcactgtctattaccaaggtaaatgtcactgccatatgggaactcactgccactcatctgatggccctagaggggtgattccagagcctcgctgtccgtag

SEQ ID NO: 232089 - DNA, 498 bp, Artificial Sequence
  Description of Artificial Sequence: Synthetic coding sequence
atggcatggatgctgctgctcattctgatcatggtgcaccctggctcatgtgccctctgggtgtcacagccgcctgaaatcagaactcttgaggggtcctccgccttccttccctgcagcttcaacgccagccagggtagactggcaatcgggagcgttacttggtttcgcgacgaagtcgttcctggaaaagaggcagaactgcacattagagacgtacggggacacgatgcctccatctatgtctgccgcgtggaagtactgggccttggagtaggaacagggaatggaactcggctcgtcgtcgagaaggagcaccctcagttgggagccggaaccgtgcttcttctgcgcgcagggttctacgccgtatcctttctgtccgtcgccgtcggtagcacagtgtattatcaggggaaatgccattgccacatggggactcactgccacagtagtgacgggcctcggggagtcatccccgagccgaggtgtccttag

SEQ ID NO: 232090 - DNA, 498 bp, Artificial Sequence
  Description of Artificial Sequence: Synthetic coding sequence
atggcctggatgctgcttctgattttgattatggtgcacccaggttcatgcgccctctgggttagccagcctccagaaatacgtacgctggagggctcttcggccttcctgccttgctcctttaatgcgagccaggggagactggctatcgggagcgtaacttggttccgcgacgaggtggtccccggtaaagaagcggaactgcatattcgcgatgtccgtggtcatgacgcctctatctatgtatgccgcgtcgaagtgcttggtttgggggtcgggaccgggaacggcacgaggttggtggtcgagaaggaacatccccagcttggggctgggaccgtgctcttgctccgcgctggtttttatgccgtgtcttttctgtcagtagcagtaggatcaaccgtctattatcagggaaagtgccactgccatatggggactcattgccacagttctgacggccctagaggagtgattcctgaacctcggtgcccctag

SEQ ID NO: 232091 - DNA, 534 bp, Artificial Sequence
  Description of Artificial Sequence: Synthetic coding sequence
atggcctggatgctcttactgattcttatcatggtgcatccgggtagctgtgctctttgggtatctcagccacctgaaatccggacactggagggatcatctgccttccttccatgtagtttcaacgcatcccaaggccgactggctatcggctcggtcacctggttccgcgatgaagtggtgcccggaaaggaagtcaggaatggaacccccgagttccgcggtagactggcacccctcgctagctcgcgcttcctccatgatcaccaggctgaactccacattagagatgttcggggacacgacgcttccatatacgtctgcagggtggaagtcctcggacttggggttggcactggtaatgggacgcgcctagtggtggaaaaggagcacccacagttgggcgcaggcacggtactattactgcgagctgggttttatgcggttagcttcctatctgtggctgtgggaagcactgtatattatcagggcaaatacgctaaaagtacccttagcgggttccctcagctgtag

SEQ ID NO: 232092 - DNA, 573 bp, Artificial Sequence
  Description of Artificial Sequence: Synthetic coding sequence
atggcctggatgctgttgctgattctgataatggtgcatcccggatcctgtgctctgtgggtgtcccagccacccgagatcagaaccttggaaggaagttcagctttcttaccctgctccttcaatgcttcgcaggggagattagccatcggatccgttacgtggttccgggacgaggtcgttccaggaaaggaagtaaggaatgggactcccgaatttcggggtagattagcgccactggcaagctctagattcttgcatgatcatcaggccgaacttcatattcgcgatgtccgaggacatgatgcaagcatatatgtatgccgggtggaggtactgggattaggcgtgggcacaggtaacgggactaggttggtcgtcgagaaagagcatcctcagctcggagcaggcaccgtgttgttgctgcgcgcaggattctacgctgtatcattcctctcagtggccgtcgggagcactgtttactatcagggtaagtgtcattgtcacatggggacacattgccattcttctgatggcccaagaggcgtcatccctgagcccaggtgtccatag

SEQ ID NO: 232093 - DNA, 486 bp, Artificial Sequence
  Description of Artificial Sequence: Synthetic coding sequence
atggacgacatatataaggccgctgttgaacaactgaccgaggagcaaaagaacgaattcaaggctgcattcgacattttcgttctcggagccgaggatggatgtatttcgacaaaagaactaggtaaagtcatgcggatgctggggcagaatcccacccctgaggagctacaggagatgattgacgaggtggacgaggatgggagtgggacagtggacttcgatgaattcctggtcatgatggtccggtgcatgaaagatgattccaagggtaagtcagaggaggaactgagcgatctgtttcgtatgttcgataagaacgctgatggatacatcgatttagatgagttgaaaatcatgttgcaggctactggcgaaaccattaccgaagacgatattgaggaactgatgaaggatggagacaaaaacaacgacggacgaattgactacgacgaattcttagagttcatgaagggcgtggagtag

SEQ ID NO: 232094 - DNA, 315 bp, Artificial Sequence
  Description of Artificial Sequence: Synthetic coding sequence
atgggagcccaagatcgacctcagtgtcacttcgacatagaaattaacagggaacctgttggaagaatcatgtttcagctgttttcagatatttgtcccaaaacatgcaagaactttctgtgcctgtgttctggagagaagggcctaggcaagacgacaggaaagaagctgtgctataagggttctaccttccacagggttgtcaaaaattttatgatacagggtggagacttcagcgagggcaatgggaaaggtggcgagtcaatatatggcggttactttaaagagaacgtggtgttctgtaagatgaaatag

SEQ ID NO: 232095 - DNA, 2805 bp, Artificial Sequence
  Description of Artificial Sequence: Synthetic coding sequence
atggcagtgcagcctaaagagacgctccaactggagagtgctgccgaggtgggtttcgttaggttctttcagggaatgcctgaaaaacctactacaaccgtgaggctttttgaccgaggcgacttctacactgcccacggagaggacgccctactggcagcgcgtgaagtattcaagacacagggcgtgataaaatatatggggccagccggagcgaaaaatctgcagtccgtggtgctgtcaaagatgaactttgaatcatttgtgaaggatctgctcttggtgcgtcagtaccgagtggaagtttacaagaacagagctgggaacaaggcctctaaagaaaatgattggtaccttgcttacaaagcctcccctggaaatctgtcccaattcgaagatattcttttcggcaataatgacatgtctgcatccattggagtggtcggcgttaaaatgtccgctgtagatggtcagaggcaggtgggggtggggtatgttgatagtatacagcggaagttaggcctgtgcgaatttcctgataatgaccaattttctaacttggaggccctgctgatccaaataggacctaaggagtgcgttctcccaggaggcgaaacagctggggacatgggcaaattgcggcagataatccaaaggggaggaattcttattactgaaaggaagaaggccgacttttctaccaaagatatataccaggacctcaacagactgttgaagggtaagaagggggaacagatgaattcagcagttctccccgagatggagaaccaggtcgcagtgagtagtctctctgccgtaattaagtttctcgagctgctcagcgacgattccaattttggacaattcgagttaacgacttttgatttctcccagtatatgaaactcgatatcgccgcagtccgggcactgaatctattccagggatccgtcgaagacacgacaggttcccaaagcctggccgcactgcttaataaatgtaagactccgcagggccaacgtctcgtcaaccagtggattaaacagccgctgatggacaaaaaccgcattgaggagcggcttaatctggtagaagctttcgtcgaagacgccgaactgaggcagaccctccaggaggatctacttcggcgatttcctgacctaaaccggctggcgaagaaattccagcgtcaggcggctaatctccaggattgctatcgactgtatcagggcattaatcagttgcccaacgtgatccaggcactggaaaagcacgagggaaaacatcagaagctgctcctggctgtattcgtgacacccctgacagacctgagatctgactttagcaagttccaggagatgatagaaacgacattggatatggaccaagtagagaatcacgagttccttgttaaacccagcttcgaccctaacctgagtgagcttcgagaaatcatgaacgatcttgaaaagaagatgcagagcaccctgatcagtgccgctagggacctgggactggaccccggtaagcagattaaactggactcaagcgcccaattcggctactatttcagagttacttgcaaagaagaaaaagtgctgaggaacaacaaaaacttctccactgttgacatccaaaagaacggcgtgaaatttacaaactcaaagcttaccagcttgaatgaagaatacacaaagaataagactgagtatgaggaggctcaggatgccattgtgaaagaaatcgtgaacattagttcaggatacgtggaacccatgcagactcttaacgacgtactagcacagcttgatgcggtggtctcatttgctcatgtctcgaacggcgctccagtcccttacgttcgccctgctatattagagaagggacaggggagaattattctgaaagcctctaggcacgcatgtgttgaagtccaggacgagatcgcatttataccgaatgatgtttatttcgagaaagacaagcagatgtttcacattattactggacctaacatgggcggtaaaagtacctatatcagacagaccggcgttatcgttctgatggcgcagattggatgcttcgtgccttgtgaaagcgccgaagtaagcatcgtggattgtatactggctcgcgtgggcgctggtgactcccagctcaaaggtgtgtccacctttatggcagaaatgctagaaacggcttctatcctgaggtccgcaaccaaagatagtttgatcattattgacgagctcggcaggggcactagtacatacgatggcttcgggctggcttgggctatcagtgagtatatcgctactaaaattggcgctttttgtatgttcgccacgcactttcatgaactcaccgcactggctaaccaaattcccactgtgaacaacctccatgtgaccgccctgacaaccgaggaaaccctcaccatgctgtaccaggtaaaaaaaggtgtgtgtgaccagagttttgggattcatgtggccgagttggccaacttcccaaaacatgtaatcgagtgcgccaagcagaaggcactggaactggaagagttccagtatattggagagagtcagggctatgacattatggaacctgccgcaaagaaatgctatttagagcgggagcaaggggaaaagataatccaagagtttctatccaaagtgaagcagatgcccttcacagagatgagtgaggagaacattactatcaagcttaaacagctcaaggcagaggtaattgcaaagaataattcctttgtaaacgagattatcagccgcataaaggtgaccacgtag

SEQ ID NO: 232096 - DNA, 435 bp, Artificial Sequence
  Description of Artificial Sequence: Synthetic coding sequence
atgaccgaagaggttattgtgattgctaaatgggactacactgcccagcaagaccaagaattggacattaagaagaatgagaggctgtggttgctggacgattccaagacctggtggcgggtgagaaacgccgcaaaccggaccggttacgtccccagcaactatgtggaaagaaagaactccctcaagaagggcagtttggtgaaaaacttgaaagatacattaggactgggcaagacacggaggaaaacctccgccagagatgctagccctacgccatcaacagatgccgagtaccctgctaacggtagcggcgcagatcggatctacgatctgaatatacctgcttttgttaaattcgcgtatgtcgccgaacgggaggacgagctgtccctggtgaagggatcacgggtaaccgtcatggaaaaatgctag

SEQ ID NO: 232097 - DNA, 1143 bp, Artificial Sequence
  Description of Artificial Sequence: Synthetic coding sequence
atgacggaggaggtgattgtcatcgctaaatgggactatactgcacagcaggaccaagaactcgacataaagaagaacgaacgattgtggctactcgacgattccaagacctggtggagagtgcggaacgctgctaacaggacggggtacgtcccaagcaattatgtcgaacgaaagaattcactgaaaaagggatctctggttaaaaatctgaaagacaccctcgggctaggcaaaacccgcaggaagacttctgccagggacgccagtcccacccctagtactgacgccgaatatcctgctaatgggagcggcgcagatcgtatatacgacctgaacatccctgcctttgtgaaatttgcatacgtggctgaacgtgaggacgagcttagcctcgtgaaaggttctagggtgacggtgatggagaaatgttctgacggatggtggcgcggatcctataacggtcagattggctggttcccatccaattacgtcctggaggaggtcgacgaggccgctgctgagtctccctctttccttagcctgaggaagggggctagcctctccaatgggcagggtagcagggtgctgcatgtcgtgcagacactctatcccttttccagcgtgacagaagaagaattgaacttcgaaaaaggagagactatggaggtcatcgagaaacccgagaatgatccagagtggtggaaatgtaaaaacgcaagggggcaggttgggctggtgcccaagaactatgttgtagtactgtccgatggtccagctctgcacccagcccacgcgccacagattagctacaccggaccgagcagctccgggagattcgccggaagagaatggtattatggcaacgtgaccaggcatcaagcagaatgcgcactgaacgaaagaggcgtggaaggcgatttcttaatcagagatagtgaatctagcccgtccgatttttccgtgagccttaaggcctcaggcaagaacaaacattttaaggtgcaactggtcgacaatgtgtactgcattggacagcgcaggtttcatacgatggatgagttagtggagcactacaaaaaggcaccaatattcacatccgaacacggggagaagctttatttggtgagggctctacaatag

SEQ ID NO: 232098 - DNA, 333 bp, Artificial Sequence
  Description of Artificial Sequence: Synthetic coding sequence
atgactgaggaggtcatcgtgatagctaagtgggattacactgcacagcaagatcaggaactggacatcaagaaaaacgagagactatggctgttagatgattctaagacgtggtggcgtgtgagaaatgcagctaaccggaccgggtatgtgccttccaactatgtggagcgaaaaaactcacttaaaaagggctctctcgtaaaaaatcttaaggatactctgggtctcggaaagacacgcagaaaaaccagtgccagagacgcttcgccaactccctccactgatgccgagtacccagcaaacggaagtggggcagacaggatctattag

SEQ ID NO: 232099 - DNA, 252 bp, Artificial Sequence
  Description of Artificial Sequence: Synthetic coding sequence
atgacagaggaagtcattgttattgctaagtgggattatacagcgcagcaggaccaagagctcgatattaagaagaatgaaagactctggctgttggacgattctaagacttggtggcgggtccggaacgccgcaaaccgcaccggctatgtgccgagtaattacgtagagaggaaaaatagtctcaaaaaagggtccctggtgaagaatctgaaggatactcttgcccagaggctcctgcgggtgccatag

SEQ ID NO: 232100 - DNA, 252 bp, Artificial Sequence
  Description of Artificial Sequence: Synthetic coding sequence
atgaccgaggaagtgattgtgattgccaaatgggactacaccgctcaacaagaccaggagctcgacatcaaaaagaatgagcgactttggctactggacgatagcaaaacttggtggagagtgcggaacgccgctaaccgaacggggtacgtccccagtaactacgtggaaagaaaaaattctttgaaaaaaggttctctggtgaaaaacctgaaggataccttggctcaaagattgctaagagtgccttag

SEQ ID NO: 232101 - DNA, 2169 bp, Artificial Sequence
  Description of Artificial Sequence: Synthetic coding sequence
atgtacagggctttgtatgcattcaggtccgcagagcccaacgccctggcattcgcagccggtgaaacgttcctggtattggaaaggtcatcagcacattggtggctggcggcaagggctaggtcaggggagaccgggtatgtacctcccgcttacctaagaagactgcagggcctcgaacaggatgtactgcaggcaatcgacagagcgatcgaggccgtacacaatacagctatgcgggatgggggaaagtactcgctggaacaacgcggagtcctccagaaactaatccaccaccgcaaggaaaccctatcacgacgtgggccttccgcctcttccgttgcagtgatgacatcaagtacttcagaccatcatctcgacgccgcagccgcaagacagccaaacggtgtgtgccgcgcaggcttcgagcgccagcactcccttccatctagtgagcacctcggggcagatggagggttatatcagatcccactgccgagttcccaaatcccaccacagcccagaagagcagctccgaccaccccccctcctccagtgaaaagacgcgatcgcgaggcacttatggcttccggcagtggagggcacaatacgatgccgtccggaggtaactctgtgagtagtggaagctctgttagtagcacgagtctggacaccctttataccagctctagccccagcgaaccaggatcaagctgcagcccaacacccccaccagtccctcgccgagggacgcacacgaccgtcagtcaggttcagccacctcctagcaaagcatctgcgcctgagccaccagctgaggaggaggtagcaactggcactacatcagcatccgatgacctcgaggccctcggcacactgagccttggcactacagaagagaaagctgctgctgaggctgcagtccccagaaccataggggcagaattgatggaattggttagacgcaataccggtcttagccacgaactttgcagggtggcaataggaattatagtcggccatattcaagccagcgtaccagccagcagtcctgtcatggagcaggtgctgctgagtcttgtagaaggtaaagatctgagcatggcactcccgtcagggcaggtctgtcatgaccagcagcgactagaagtcatcttcgccgacctggcaagacggaaggacgatgcgcagcagagatcgtgggccctgtacgaagatgagggcgtgataagatgctacctcgaagagctgctgcacatcctgactgatgcagatcctgaagtctgcaaaaagatgtgtaagcgtaacgagtttgaatcagtcctcgctctggtggcatactaccaaatggagcaccgcgctagcctgcgactgcttttgttaaaatgcttcggagccatgtgctctctggatgccgctataatctcaacattagtctccagcgtattgccagtcgaactggctcgggacatgcagacggacacccaggatcatcagaagttgtgttacagtgcactgatcctggcgatggtgtttagtatgggcgaagctgtcccttacgcacactatgagcatctggggacgcctttcgcacagttcctcttgaatatagtggaggatggactgcccctggatacgacagagcaattaccagacctgtgtgttaatttgttgttggcgctcaatttacatcttccggcagcagatcagaatgtcatcatggcggcactctctaaacacgctaacgtcaaaattttcagcgagaaattattgctcttgctgaaccggggtgacgaccctgtccgaatcttcaagcatgaaccccaacctcctcattccgttctgaagtttctccaggatgtgttcggttcccccgctacagctgctatcttttatcataccgatatgatggccctaattgatatcactgtacgccacatagcggatctttcaccgggtgacaaactgcgaatggaatatctttcattgatgcatgccattgtgcgaacaaccccatatctccagcacaggcaccgcctgcctgacctgcaagcgatactccgacgcatattgaatgaagaagagactagtccacagtgccagatggaccggatgatcgtgcgagaaatgtgcaaggaattcctcgtactgggcgaggccccatcctag

SEQ ID NO: 232102 - DNA, 2169 bp, Artificial Sequence
  Description of Artificial Sequence: Synthetic coding sequence
atgtaccgtgccctatacgcattccgttctgctgagcccaatgctctcgctttcgctgcgggagagacatttctggtcctggaacggagctctgcacattggtggcttgccgcacgggctcgatcaggtgagacgggatacgtgccacctgcataccttagacggttacagggcctagagcaagatgtgttgcaggcgatcgacagagccattgaagccgtgcacaatacagcgatgcgcgacggcggaaaatattcccttgaacagcgaggtgtgctgcagaagctaatacaccaccgcaaagaaacactaagcagacgcggacccagcgcatcttccgtggctgttatgaccagtagtaccagtgatcatcatctggatgctgcggctgctcgacagcctaacggcgtttgcagggccggatttgagcgacagcacagtctgcccagcagtgagcatctaggcgctgacggcggtctgtaccaaatccccctgccctcttcacagatcccccctcaaccacgtagagccgctccaactacgccccctcccccagtcaaaagacgggaccgggaagcgttgatggcctccgggtccggaggtcataatactatgccaagtgggggaaactcagtgtcgagcggtagttctgtcagttccacatcccttgatacgttatatacgtcgagctctccctcagagcctggatcaagttgctctcccacacctcccccagtgccacgcaggggaacacatactactgtctcgcaggtgcagcctccccctagtaaggctagtgcacccgaacccccagctgaggaggaagtggcaacgggtactacatcagcctcagacgacctggaggccctgggcaccctgtctttgggtacaaccgaggagaaggctgccgctgaagccgctgtgccacgaacaattggcgctgagttaatggagttagtcaggcgtaatactgggctgagtcacgaactgtgtcgggtggcaatcggaatcatcgtgggacacatccaggcaagcgtgcccgcatcaagccctgttatggagcaggtgttactcagtttggttgaaggaaaggacctgtccatggccctgcctagcggacaggtctgccacgatcagcagcgcctggaagtcatcttcgccgatctcgccagacgcaaggacgacgcccagcaacggtcctgggccctgtacgaggacgaaggggtcatccggtgttaccttgaagaacttctgcacattctcactgacgcagaccccgaagtctgcaagaagatgtgtaaacgtaacgaatttgagtcagtcctagctctagtcgcctactaccagatggagcatcgagcctccctgcgcctgctgctgctcaagtgcttcggagctatgtgttccctggacgccgctatcattagtactctcgtgagctcggtgcttcccgtggaactggccagagacatgcaaactgatactcaggaccaccagaagctgtgttacagcgcgttaatccttgccatggtgttttcaatgggagaggcggtaccgtatgcacattacgaacatctgggaacgccgtttgcgcagttcctgttgaacatcgtggaagacgggctgcccttagacacaaccgagcaactccctgatctatgtgtcaatctgctgctggccttaaacctccacctgccagccgctgaccagaatgtcatcatggccgcacttagcaaacacgctaacgtaaaaatcttctcagaaaaattgctgcttctgttgaaccgtggtgatgaccccgtccgcatttttaagcacgagccacagccccctcattctgtgctgaagtttctccaagacgtctttggctcacctgccactgccgctattttttatcacacggacatgatggctcttatagacataaccgtccgacacatcgctgacctgtctcctggtgataagggtccgttcggtgccggacagcggccttggcccggtgtgcctcgtctgctagagccagggagcactccaagcagagagccccatcctgtggaacgaagcggcgtgcctgcacttacctctagttgggcttccggatgtccacgtccacttcatccggcattacaattggtgattgacagtgccttcggaggcagaagcgtctag

SEQ ID NO: 232103 - DNA, 2148 bp, Artificial Sequence
  Description of Artificial Sequence: Synthetic coding sequence
atgtaccgtgccctgtacgcgttcaggtccgctgagccgaatgccttagcctttgcagccggtgagacctttctggtgctggaaagatcatccgcccactggtggctagctgccagagctcgctccggcgagactgggtacgttccacctgcatatttgcgtcgtttgcaagggttggagcaggatgtgctacaggcgatcgaccgggcaatcgaagccgtgcacaacaccgccatgagagatgggggaaagtacagcctggaacaacgcggtgtcctgcagaagttaattcatcataggaaagagaccctgagtcgtcggggtccatccgcctccagcgttgccgttatgacttcatctacctcggatcaccatctcgatgctgccgcagccaggcaaccgaatggcgtatgtagagccggttttgaaaggcaacacagcctgccaagctccgaacacttgggagccgacggcggattgtaccagatcccccctcagccccgtcgtgctgcccctacgacacccccacctccggtcaagcgacgagatcgtgaggcacttatggcctctgggagcggcggacataacaccatgccgtccgggggtaatagcgttagctccggtagcagtgtttcctcaacctctcttgacaccttatacacaagttcgtcccctagtgaacccggttccagttgcagccccactcctcctcctgtaccgagaagaggaacccacactaccgtgagccaggtacagccacctccttctaaggcatccgcacccgagcctcctgccgaagaagaggtagccaccggaactacatccgcatccgacgatctcgaggctctcggcacgctctcgctggggactacggaagagaaagccgctgccgaagctgccgtgccgagaaccatcggcgctgagctaatggagttggtcagacgaaataccggactttcccacgaactgtgtcgcgtggccataggtataatcgtgggccatatacaggccagcgtgcctgcctcctctcctgtgatggagcaggttcttctttctctggtggaggggaaagatctgtctatggccctcccctccggacaggtctgccatgatcagcaaagacttgaagttatattcgctgaccttgctcgccgaaaagacgacgcacagcagaggagttgggcactgtatgaggacgagggagtcatcagatgctacttagaggaactgctacacatcctcacagatgccgacccagaggtttgtaagaagatgtgcaaaaggaatgagtttgaatccgtactggccctagtagcctactaccaaatggagcaccgagcgagcctgcgactcctgctgctcaagtgctttggagctatgtgttcgctggacgcggctattatatcaactctggtgtctagcgttctgcctgtggagctggcgagagatatgcaaaccgacactcaagaccatcagaaactttgctactccgccctcatcttagcaatggtctttagcatgggcgaggccgtgccctacgctcattatgagcatcttggcaccccattcgcacaattcctgctcaatatcgtcgaggacggcctcccattggacactacagaacagctgcctgatctttgtgtgaaccttctgctcgctctaaatttacatctccctgcagctgatcagaacgtgataatggccgctcttagcaaacatgctaacgtcaagattttctccgagaagctgctcttactgctgaaccgaggggacgatcctgtgcgtattttcaaacatgaacctcaaccaccccactctgtgttaaagtttctacaggacgtttttggaagcccagctacagcggcaattttttaccacaccgacatgatggcattgatcgatatcaccgtgagacacattgcagacttaagccccggagataaactgaggatggagtatctttctctcatgcacgccatcgtgcgaacaaccccttatttgcagcatcgacaccgccttccagatctccaggcaattctgagaagaattctgaacgaagaggagacctccccccagtgtcagatggatcgaatgatagtgcgggagatgtgcaaagaattcctggtattaggcgaggccccttcctag

SEQ ID NO: 232104 - DNA, 3405 bp, Artificial Sequence
  Description of Artificial Sequence: Synthetic coding sequence
atgagcagaagtgttctgcagccgtctcaacagaagcttgccgaaaaattaactatattgaacgaccgtggagttggcatgctgacgcgactgtacaatattaagaagcaggggcaggtttggaaagcgtgcggcgaccccaaagcgaaacctagttacctgatagataagaatctggagtctgccgtcaaattcatcgtccgcaaatttcccgctgtggagacacgcaacaataatcaacagttggctcagctccaaaaagagaaatccgagatcctgaagaacttggccctttactattttaccttcgttgatgttatggagttcaaagaccatgtgtgcgaactgctcaacacgatcgacgtctgccaggtgttctttgatattacagttaattttgatcttacaaagaactatctcgacttaattatcacgtacactacactcatgattctactgtcccggattgaggagaggaaagccatcatcggcttatataactacgctcacgagatgactcatggggcaagcgatcgcgagtatcctcggttggggcagatgatagtggactatgaaaacccacttaaaaaaatgatggaggagttcgtgccacactctaaatccctgtccgatgccctaatctcactgcagatggtgtaccccagacggaatctgagcgctgaccagtggcggaacgcccagctccttagcctcatctcggccccaagcacgatgctgaatcccgctcagtctgacactatgccttgcgagtacctctcattggacgcgatggagaagtggataatttttggtttcattctctgccacggcattctaaacaccgatgctaccgcactgaacctttggaagctggcactacagtcatcatcctgtctgtccctatttcgtgacgaagtgttccacattcacaaggctgcagaggatctctttgtcaatattcggggatacaataagagaataaatgacatcagggagtgtaaagaagccgcagtgagccatgctggttccatgcaccgtgaacgccgaaaatttctcaggtcagcactgaaggagctagccacagtgctgagtgaccagccaggcctgttgggtcctaaggccttatttgtgtttatggccctgtccttcgctcgggatgagatcatttggctcttgaggcacgccgacaacatgcctaaaaagagcgccgatgactttatcgataaacatatagcggagctgattttttacatggaagagttacgagcccatgtccgaaagtatgggcctgtcatgcagagatattatgtccagtatctgtctgggtttgatgccgttgtcctgaacgaacttgtgcaaaacctgtccgtgtgtcccgaggatgagtcaatcattatgagtagctttgtgaataccatgacatccctgtcagtaaagcaggttgaggatggggaggtgttcgattttagaggaatgagactcgactggttcaggctgcaggcgtatacttccgtgtcaaaggcaagcctggggctggcagaccaccgcgagctcggtaagatgatgaacactattattttccacaccaaaatggttgacagcctggtagaaatgctggtggaaacctctgatctgtcaatcttctgcttctactcccgagcctttgaaaaaatgttccaacaatgcctggagctcccatcacagtcaagatactcaattgcctttccactgctctgcacccactttatgagctgcactcacgaactgtgtccagaggaacgacaccatattggcgaccgctctctcagtctttgcaacatgtttctggatgagatggccaagcaggcccgaaacctcattactgatatttgcaccgaacagtgtactctctctgaccagttactgccaaagcattgcgcaaagactatcagccaggcagtgaataaaaaatcaaaaaagcagacgggcaaaaagggggagcctgaaagagagaagcccggagtggagagtatgcggaaaaatcgcctggttgtgacaaacctggacaagcttcacaccgccctctccgaactgtgctttagtatcaactacgttcccaatatggttgtgtgggaacacacatttactccgcgtgagtacctaacaagccacctcgaaatccggttcactaaatcaatcgttggaatgaccatgtataatcaggctacgcaggagatcgcgaaaccatctgaactgttgaccagtgtgcgggcttacatgaccgtgttgcaaagcatcgaaaattacgtgcagatcgatataacccgtgtctttaacaatgtgctgctgcagcagacacagcacctcgattcccacggggaacccacaataacatctctctacacaaactggtacctagaaaccttgcttagacaggtttcaaacggacacatcgcctatttccctgcaatgaaagctttcgtgaacctgccaacagagaacgagctgacatttaacgcggaggaatattccgacatctcagaaatgaggtcactgtcagaattgctgggtccatatggcatgaagttcttgtcggagagtcttatgtggcatatttcctctcaggtggccgagctgaagaagctagtggttgagaatgttgacgtcttgactcaaatgaggacaagcttcgataaacctgatcaaatggcggctctgtttaagcggctctcctcagtggactcagtattgaagcggatgacaataatcggtgtaatcctctcctttcggtcacttgcccaggaagccctccgagacgtgctcagttatcatattccgtttctggtgtcttcaattgaggacttcaaagatcacattcctcgggagactgacatgaaggtggccatgaacgtgtacgagctctcaagtgcagcgggtctcccatgcgagattgacccagccctggttgttgcgctctcctctcaaaagtccgagaatatcagtcccgaggaagagtacaagatcgcgtgcctgctgatggtgtttgtagccgtgtcgctgcctacactcgcttctaacgtgatgagccagtactcgcctgccatcgaagggcattgtaataacatccactgcctcgcgaaagccatcaaccaaatcgccgcagcattatttactattcataaggggagtatcgaagacagactaaaagagttcttggcacttgcctcatctagtcttctgaaaattggacaagagacggacaaaaccactacgcggaacagagagtccgtgtatctcctgctcgacatgatcgtgcaggaatcaccatttttgaccatggacctcctagaaagttgtttcccctatgtgctcctgaggaacgcgtaccacgctgtgtataaacagagcgtgacttctagtgcatag

SEQ ID NO: 232105 - DNA, 3387 bp, Artificial Sequence
  Description of Artificial Sequence: Synthetic coding sequence
atgtcgcgcagcgtgttgcagccatctcaacagaagctggcagaaaagctcaccattttaaacgacagaggtgtgggcatgcttactcgcctgtacaacatcaaaaaggcatgtggggatcccaaggccaagccatcttatttaattgataaaaatctggagagcgccgtgaagttcatcgttcggaaatttccagccgtggaaacacgcaataacaatcaacagctggctcagctccaaaaagaaaagtccgagattctcaaaaatctagctttgtactatttcaccttcgtggatgtgatggagttcaaagatcacgtttgcgagcttctgaatactattgacgtgtgtcaggtgtttttcgatataactgtgaacttcgacctcacaaagaattatttggacttgatcatcacctataccacgctcatgatccttctgagccgtatcgaggaaagaaaagctatcatcgggctgtacaactatgcgcacgagatgacccatggtgcgtccgatagggagtatccccgactgggccaaatgatcgttgactatgagaaccccctgaagaagatgatggaggaattcgtcccgcattcgaaatccttgtccgatgcgcttatcagcctgcagatggtgtacccgaggaggaacctgagcgccgaccagtggaggaacgcccagcttctgtccttgatttcagcgccatctaccatgctgaacccagcccagtccgacaccatgccctgcgaatatctatccctcgacgctatggagaaatggataatattcggattcattctttgtcatggtatcctcaacaccgatgccaccgcccttaacctctggaagctcgcgttacagtctagcagctgcttatctctgtttagagatgaggtgtttcacattcacaaggcagcggaagatctgtttgtcaacattcggggatacaacaagaggatcaatgacatcagggaatgtaaagaagccgcagtcagccatgcgggatcgatgcatagggagcggcgaaagttcttacggtctgcactcaaagagctggccacagttctcagcgaccagcctggacttctggggcctaaggctctgttcgtttttatggcgctcagttttgccagggatgaaattatctggctcttacggcatgcagataatatgccgaaaaagtccgccgatgattttattgacaagcacatcgctgaactgatcttctacatggaggaactgagggcccatgtaaggaaatacggcccagttatgcagcggtactatgtccagtacctgagcggattcgacgctgtcgtgctcaacgagttagtgcagaacctctccgtctgtcctgaggatgagagcattattatgtcttctttcgtaaacaccatgactagcctgagtgtgaagcaggttgaggacggcgaggtcttcgacttccggggtatgcggctggactggttcagactccaggcatacaccagcgtcagcaaggccagtctcggactcgccgaccacagagagctgggaaagatgatgaatacaatcatcttccatactaagatggtggacagtctggtcgaaatgcttgtggagacaagtgatctgtccatcttctgtttttatagcagggcctttgagaaaatgttccaacagtgcctggaacttcctagccagagcagatactccatcgccttccctctgctctgcacgcattttatgtcgtgcacacatgaattgtgtccggaggagcgacatcacatcggagatagaagtctttccctatgcaatatgttccttgatgagatggcgaaacaggctaggaatctgatcaccgatatctgtaccgaacagtgcacactttcagatcagcttcttcctaaacattgcgcaaagaccatctctcaggccgtgaataagaagagcaagaagcagacagggaaaaaaggagagcctgagcgcgagaaacccggtgtcgaaagcatgcggaaaaaccgcttagttgtgacaaacctggacaagctgcacacagccctgtctgaactctgtttctccatcaactacgtgcccaacatggtggtgtgggagcacacctttacaccgagagagtacctgacctcccatctcgaaatccggtttaccaagagcattgttgggatgaccatgtacaatcaagcaacccaggaaatcgccaagccttcagagctcttgacttctgtccgcgcttacatgactgtgctgcagagcatcgagaactatgtccagatcgatatcacaagagtgttcaataacgtgcttctccagcagacacagcaccttgattcccacggcgagcccactattacctccctgtatactaattggtatctggagaccctactgcgacaggtgtctaatggtcatatcgcctattttccggcaatgaaggcttttgtgaacttacccaccgagaatgagcttaccttcaacgccgaggagtattcggatatcagcgagatgcggtccctgtccgagctgcttggcccttatggcatgaagttcctgtccgagagtcttatgtggcatattagctcccaagtagccgagctgaagaagctggtggtcgagaacgtagacgtacttactcaaatgcggacctccttcgacaaacccgaccagatggccgctctgtttaaaagactgtcctcagtggatagtgtactcaagaggatgactatcatcggagtgattctgtcctttcggagcctggcacaggaggccttgagggatgtgctctcctaccacattcccttcctagttagcagcatcgaagactttaaggaccatatccctcgcgagaccgatatgaaggtggccatgaatgtgtatgaactgtcctccgccgctggtctcccatgtgagattgacccagctctcgtggtggccctgagtagccagaagtctgaaaatatcagccccgaggaggagtataagattgcttgtttacttatggttttcgtggcggtgtcactccccaccctcgctagcaacgtcatgtcccagtactccccagctatcgagggccattgcaataatattcattgcctcgcgaaggccataaaccaaatagcagccgctctttttaccatccataaaggatctattgaggatcgtctaaaggaattcctcgccctggcttcaagttctctgctcaagatcggccaagaaacagacaagactacaaccaggaaccgggaaagcgtttacctcctcctggacatgatcgtgcaggagtcccctttcctgacaatggacctgctggagtcctgctttccctatgtgctgttgcgtaatgcctatcacgccgtgtataaacaaagcgtgacttcctctgcctag

SEQ ID NO: 232106 - DNA, 2649 bp, Artificial Sequence
  Description of Artificial Sequence: Synthetic coding sequence
atgccagctctcgcttgcctcaggaggctttgccggcacgtttccccccaggctgtcttattcctgctgttcatcttctgcttattcagtgtgtttatttcagcttactacctgtatggatggaaaaggggattggagccaagcgccgacgcccctgagcctgactgcggcgatcctccacccgtagcccctagccgcctgttgcccctgaaacctgtgcaagccgctacgccatccaggaccgacccactggttttggtctttgttgagtccctgtacagccagttgggccaggaagtagtggcaattctggaatccagccgcttcaagtaccgcactgaaattgcacctggcaagggagatatgcccacactgaccgacaagggccgaggaagatttgcattgattatatacgaaaatattctgaagtacgtgaatctcgacgcctggaaccgggaactcctggacaaatactgtgtggcttacggcgtgggaattattggtttctttaaggcaaatgagaacagcctgcttagcgcccagttaaaagggtttccattgtttctccacagcaacctcggcttaaaggattgttccattaaccccaagtcacccttactctatgtgactcgaccatccgaggtcgagaagggcgtattgccaggagaggattggacagtctttcagagtaatcacagcacatatgaaccagtcctccttgctaagacaagatcaagcgagtctatcccacacctgggagcggatgcagggctacatgcagcgttacacgcaaccgttgtgcaggacctgggcctccacgacggtatacagagagttctctttggaaacaacctcaatttctggcttcacaagttggtgttcgttgacgcagttgctttcctgacaggcaaaagactgtccctgcccctggatcggtacattctggtagacattgatgatatatttgtaggtaaggaaggaacaagaatgaaggttgaggatgtgaaagccctgttcgatactcagaacgaattgagagcgcacattcccaactttacatttaatttaggttattccggcaagtttttccacactgggactaatgccgaagacgctggggatgatctgctgttgagttacgttaaagaattctggtggttcccacacatgtggtcccacatgcagccacatctttttcacaatcagagtgtactagctgagcaaatggctctcaacaagaagttcgcggtcgagcatggaatcccaacggatatggggtatgctgtagcccctcatcattcaggagtctatcctgttcatgtgcagctgtatgaggcctggaagcaggtgtggagtattagagtgacttctacggaggagtaccctcatttgaaacctgcccgataccgcagggggtttatccacaacgggataatggtgttgccaagacaaacttgcggtctttttacacacactattttctacaatgagtacccagggggtagctctgagctagataagattatcaatggaggggaactctttctgacagtgctactgaacccgatctctatctttatgactcatctgagcaactatggcaatgatcgactgggactgtacacatttaaacacctggttagattcttacacagttggacaaacttgagactgcagaccctgccgcctgtccaactggcacagaagtatttccagatcttctccgaggaaaaggaccccctctggcaggacccctgcgaggataaaaggcacaaggatatttggagcaaggagaaaacctgtgacagattcccaaagctgctaattattggtccccagaagaccggaacaacagctctgtatctgtttctggggatgcaccccgacctgtcatccaactacccttcctcagaaaccttcgaagagatccagttctttaatggccacaactaccacaagggaattgattggtacatggagttttttccgattccttcaaacaccacatctgatttctacttcgagaagtcggcgaactatttcgactccgaggtcgccccacgacgagctgccgcacttctgccaaaagccaaggtcttgacaatcctaatcaacccagccgatagggcatactcctggtatcagcaccaaagggcccacgatgatcccgtggccttaaagtacacctttcacgaggttatcactgcgggatctgatgctagcagcaagctgcgggcacttcaaaataggtgcctggtccctggctggtacgctacacatatcgagcgatggctttccgcctatcatgcgaaccagatcctggtgttagatggaaagctgctgcgcacggagcccgctaaggtcatggatatggttcaaaaattcctcggtgttactaataccatcgattaccataagacactggcctttgacccaaaaaagggcttttggtgccagctgctagagggaggtaaaaccaagtgtctcggtaaatccaagggaagaaagtatcccgagatggacttagatagccgggcattcctcaaagattactatcgtgatcacaacatcgagttaagcaagctcctatacaaaatgggtcagaccctgcccacctggctgcgggaagatctgcagaatacgaggtag

SEQ ID NO: 232107 - DNA, 72 bp, Artificial Sequence
  Description of Artificial Sequence: Synthetic coding sequence
atgcctgctcttgcctgccttcgcaggttgtgtcggcacgtatctccgcaagcagtgctgtttctcctctag

SEQ ID NO: 232108 - DNA, 480 bp, Artificial Sequence
  Description of Artificial Sequence: Synthetic coding sequence
atgcctgctctggcttgtctgcgtcgactttgtagacatgtgtcgccccaggcagttctgtttctgctcttcattttttgcttattctccgtctttattagcgcttactacctctacggttggaagcgaggcctggagccttccgctgatgctcccgaacctgactgcggggatcctccaccagtcgctccgagccgactgctgcctctcaagcctgtgcaagcagccaccccatctaggacagatcctctggttctcgtgtttgtcgagtccctgtatagccagctcggccaggaagtggtcgccatccttgaatcctctagattcaagtacaggaccgaaatagccccaggcaaaggcgacatgccgacgctgaccgacaagggtcgcggtaggtttgcgttgatcatctatgagaatatactgaaatatgtcaatctggatgcttggaacagagagctcctggacaagtactgttag

SEQ ID NO: 232109 - DNA, 207 bp, Artificial Sequence
  Description of Artificial Sequence: Synthetic coding sequence
atgccggctcttgcctgtttaaggaggctctgtaggcacgtgagtccacaagccgtcctgttcctgctgttcatcttttgcttgttctctgtgttcatcagcgcctactacctttacggttggaaacgcggactggagccaagtgcggacgccccagaacccgactgtggcgatccccctcctgtcgcaccgtcgaggctgctttag

SEQ ID NO: 232110 - DNA, 2283 bp, Artificial Sequence
  Description of Artificial Sequence: Synthetic coding sequence
atgcctactctgacagataatacacacgggcgttatgtgctggtaatctatgagaatctgcttaagtatgtgaacctcgacgcatggagccgggagttgctggacaggtattgcgtcgagtacggggtggggataatcggcttttttcgggctcatgaacatagcttgctctctgcacagctgaaaggctttccactttttttacactccaacctaggactgagagattatcaggtgaaccctagcgctccattactacatctgacccgccctagccgtctggaacctggaccactccctggcgacgactggactatattccaaagtaaccactctacatatgaaccagtcttgctcgccagccttagaccagccgagcctgcagttccgggaccagttctgcggagggctcggttacccacagtggtccaggaccttggtctgcacgatggcattcagagggtgctttttggccacgggttatccttctggctgcataagcttatctttgtcgacgccgtggcttacttgacagggaagcggctgtgcctggatttggatagatatatccttgtggacatcgacgacatcttcgtgggtaaggagggtacccggatgaaagtcgccgacgtcgaagcgctgctgacaacacagaacaagctgagaacactggtcccaaactttacctttaatctggggttctcagggaaattctaccacactggcaccgaagaagaagatgctggcgatgacatgctcttgaagcacagaaaagagttctggtggtttccacacatgtggtctcatatgcagcctcacctgttccataaccgctctgtgctcgctgaccaaatgcgtctgaataaacaatttgcactggagcacgggattccaactgacctcggatacgccgtagcaccacatcacagtggcgtctatcctatccacacccaactttacgaagcatggaagtctgtctggggcattcaagtaaccagcacagaggagtatcctcatctgcggcctgccaggtatcgtcgaggattcatacataacgggataatggtactgccacgccagacctgtggcctgttcacgcacaccatcttttacaacgaatatcccggtggcagccgtgaattagacaggagcatccgaggcggagagctgttcctgaccgtacttttgaacccaatttccatttttatgacccatctgtccaattacggtaacgacaggctcggcctctacacctttgagtccctggtgcggttcttgcaatgctggaccagattgaggctgcagacccttccccctgttcctctagcgcagaagtattttgagctgttcccgcaggaaaggtcgcctctgtggcaaaacccctgcgatgataagagacacaaggacatctggtccaaggagaaaacctgtgataggctccctaagtttctcattgtgggcccacagaagaccggaaccacggccattcatttctttctatccctgcacccagcagtgacatctagtttccctagtcccagtacatttgaggagatacaatttttcaacagcccgaattatcataagggaatcgattggtacatggatttttttcccgtgccaagtaatgcttccaccgacttcctgtttgaaaagtcagccacctacttcgactccgaggtcgtccctaggaggggcgctgcgcttctgcctcgcgctaagattatcaccgtgctcacgaatccagccgatagagcctatagctggtaccaacatcaaagagcccatggagacccagttgcattgaactatactttctaccaggttatcagtgctagctcacagacaccactggccctgcgcagcctgcagaatcgatgtctagtcccagggtactactctacacaccttcagcggtggcttacctattatccatccggccaattattgatcgtggacgggcaggagctgagaacaaacccggcagctagtatggagtccattcaaaaattcctgggaatcacaccatttctgaactacactaggaccttacggttcgacgatgataagggcttctggtgccagggcttggaaggtggtaaaacccgctgtttgggtaggtcaaaagggcgaagataccccgatatggacaccgaatctcgcctgttcctcactgacttcttcagaaaccacaacctggaactttctaagctgctgagtcgactgggtcagcccgtgccttcttggctgcgggaggagctgcagcactctagcctggggtag

SEQ ID NO: 232111 - DNA, 2652 bp, Artificial Sequence
  Description of Artificial Sequence: Synthetic coding sequence
atgctacagctctggaaagttgtgcggcctgctcggcagctggagctgcacaggctgatcctactcctcatcgcattcagcctcggctcaatgggctttctggcttactacgttagtacaagcccaaaggctaaggaacctcttccactgcctctcggggactgtagtagcgggggtgcagctgggccaggacccgcacgtcccccagtgccacctcggcctccaagacctcctgagactgctagaacagagcccgtggtgctggtgttcgtggaaagcgcctattctcagctaggccaggaaattgtcgccatattagaatccagtcggttccgttattccactgagctggcgcctggaagaggggacatgcccactctgacagacaatacccacggcaggtatgttctagttatctacgagaatttactcaagtacgtcaaccttgacgcatggtccagagagctcttggacagatactgtgttgaatacggcgtaggcattatcggatttttcagagcgcacgaacattcactcctgagcgctcagttgaagggattcccactgtttctgcacagtaacctcgggctgcgcgactaccaggttaatcctagtgccccactactccacctcactcggccatctaggctagaacccggaccgcttcctggcgatgattggactatcttccagtccaatcacagtacatacgaaccagtgctgcttgcctctctgcgcccagccgaaccagccgtaccagggcctgtactgcgtagagcccgtttgccgacagtggttcaagatctgggactacatgacgggatccagcgagtcttgttcggacatggactttccttctggctgcacaaacttatttttgttgatgccgtggcatatttaacaggtaaaagactttgcctcgacctggacagatatattcttgtggacatcgacgacattttcgttgggaaggaggggacaagaatgaaggtcgccgatgttgaagctctgctcaccacccagaataaactgaggactctggtgcctaacttcacttttaatttggggttctccggcaaattttaccacactggcactgaggaagaggacgccggagacgacatgttgctaaagcaccgcaaggagttttggtggttccctcatatgtggtctcatatgcagccccatttatttcacaaccgctccgttctcgcagatcagatgagactgaacaagcagttcgctctggagcatgggattcccactgacttaggatatgcagtggcccctcaccatagcggggtgtacccaattcacacacagctgtatgaagcatggaaaagcgtctggggcatccaggtgacatctaccgaagagtacccacatctacgacctgcacgctaccggagaggcttcattcataacgggattatggtactgccccgacagacttgtggactcttcactcataccatcttctacaacgaataccccggtggtagcagagagctcgatagaagtattcgcggaggcgagctttttctgacagtgctgttgaatcctatcagcatctttatgacacacctgagcaactacggcaacgacaggcttggcctatatactttcgagtcgctggtgcgttttctgcagtgttggaccagactgagactccagacgctgccccctgtccccctggcccaaaagtatttcgagctcttcccacaggagagatcccctctgtggcagaatccatgcgacgataaaaggcataaggacatctggtctaaggagaagacctgtgatcgacttcccaagttcttaatagtgggaccacagaaaacaggcacaaccgcgatccacttttttctcagtctgcacccagcggtgacatcctcattccctagcccatctacatttgaagagattcaattctttaatagccccaattaccacaaaggaattgattggtatatggatttctttccagttccctctaatgcttctactgattttttgtttgaaaaatctgcgacctacttcgattcagaggtggtgcctaggagaggcgctgccctgctgccccgtgccaagatcatcactgtgcttacgaaccctgctgatcgtgcatattcttggtatcaacaccagagagctcatggtgatcccgtcgccttgaattataccttttaccaagtcatttcagcctcgtctcagacccctctagctctccgaagtctccagaacagatgtttagtccctggatactattccactcacctgcagaggtggctaacatactacccatctgggcagctactgattgtagacggtcaggaactaagaacaaaccccgcagcttccatggagtccattcagaagttcttgggtatcacgccgttcctaaactacacaagaactctcagattcgatgacgacaaagggttctggtgccagggcctggaagggggaaaaacgcggtgcctggggagatccaagggcagacgataccccgacatggacacagaaagccggctcttcctgactgatttcttcaggaaccacaacctggagttaagcaaattgcttagccggctgggccagccagtcccatcctggctcagggaagagttgcaacacagcagtctggggtag

SEQ ID NO: 232112 - DNA, 450 bp, Artificial Sequence
  Description of Artificial Sequence: Synthetic coding sequence
ggcgatcccgtggccctgaactataccttttaccaggtgatcagcgccagttcccagactccattggccctgcgatccctccagaatcgatgcctagtccccggttattactctacgcacttacagcgatggcttacgtactatcccagcgggcagctcttgatcgtcgatggacaggagctgaggaccaatcctgccgctagcatggagagcatccagaagtttcttggaattaccccattcctgaattacacgaggacactccgctttgatgacgataaggggttctggtgtcaaggcctggagggcggaaagacacgatgcctaggcaggtcgaagggcagaaggtatccagacatggacacggaagtgtccaaggcgagaggtaggggcatccctcttcactttcaggatttaatattgtgtccaaccagttatcatttctgctag

SEQ ID NO: 232113 - DNA, 696 bp, Artificial Sequence
  Description of Artificial Sequence: Synthetic coding sequence
atgcgggtgccagtgttcgaagatatcaaggacgaaacagaagaagaaaaaattggagaggaggaaaatgaggaggatcaggtcttctacaagcccgtgatcgaagatcttagtatggaactggccagaaaatgcaccgagctgatcagtgacataagatacaaagaggaattcaagaagtcaaaggacaaatgtacttttgtgacagactccccaatgctgaatcatgtgaagaacattggagcctttattagcgaggccaaatataagggcaccataaaggcggatcttagtaactccctgtacaagcggatgccggctacaatcgattccgtctttgccggagaagttactcagctgcagtctgaggtcgcttataaacagaagcacgatgcagcaaaggggttttcagactacgcccacatgaaagaaccaccagaagtcaaacacgccatggaagtgaataagcatcagtccaatatttcgtaccgaaaagatgtccaggacacacacacgtattcagcagagctggataggccagacatcaagatggctacacaaatttcgaagattatttctaacgcagagtataaaaaaggccagggcatcatgaataaagaacccgcagtgatcgggcgacctgattttgagcacgccgtggaggcaagtaaactttcctcccaggttcgcctgtag

SEQ ID NO: 232114 - DNA, 3045 bp, Artificial Sequence
  Description of Artificial Sequence: Synthetic coding sequence
atgcgagttcccgtcttcgaggacataaaggatgagactgaggaggaaaagatcggagaagaggagaatgaggaggatcaggtgttttacaaacccgtgatcgaagatctctctatggaactcgccaggaagtgcacagagctgatcagcgacatacggtacaaggaagagttcaaaaagtctaaagataagtgtacctttgtcacggattcccccatgcttaaccacgttaaaaatattggtgcctttatttcggaggctaaatacaaaggcaccatcaaggcggatcttagtaattccttgtacaaaagaatgcccgctactatcgattctgtctttgccggagaagttactcagctccagtccgaggtcgcctacaaacagaagcacgatgcggcaaaaggattttctgattatgctcacatgaaggaacctccggaagtgaagcacgccatggaggttaataaacaccaatccaatatatcctaccgaaaggatgtgcaggacacacacacatattccgctgagcttgaccgaccggacatcaagatggcgacccagatttctaaaattatcagtaacgccgaatataagaaaggccagggaattatgaataaggaacccgctgtcataggtagacctgattttgagcacgccgtggaggcaagcaaactgtcaagccagatcaaatataaagagaaatttgacaacgagatgaaagacaagaagcatcattacaatccactggagagtgcttctttcaggcagaaccagctcgcagcaacactggcttccaacgtgaaatataagaaggacatccagaacatgcatgaccccgtttcagacctgccaaacctgctgtttttagatcatgtgcttaaggcctcaaagatgctgagcggccgtgagtataaaaaattgttcgaggagaacaagggcatgtatcacttcgacgcagatgccgtcgagcatcttcaccataaaggcaacgccgtgctgcagagccaagtgaaatacaaggaggagtatgaaaagaacaagggcaaaccaatgctggaatttgtcgagacaccctcatatcaggcgtctaaggaggcgcagaaaatgcagagtgagaaggtctataaggaggatttcgaaaaggaaatcaaaggtcgatcctcccttgaccttgataagactcccgagtttctgcacgtcaagtacattacaaacctgctgagagagaaagagtacaagaaggatctagagaatgagattaagggcaaagggatggaactgaattcagaagttctggacatccaacgggctaaacgtgcatccgagatggcgagcgaaaaggaatacaagaaggatctggaatctattattaaggggaagggaatgcaggccggaacagatacattggagatgcagcatgctaaaaaagcagcagaaatagcatctgagaaggactacaagcgggatcttgaaacggagatcaagggcaaggggatgcaagtcagcaccgatacgctcgacgtacagagggccaaaaaggccagtgaaatggcctcacagaaacaatacaagaaggacctggaaaatgaaattaaagggaaggggatgcaggtctctatggatatccccgacatcctgcgggctaaacgcacaagtgagatctacagtcagaggaaatacaaagacgaggctgagaagatgctctcaaactattctaccattgcagacaccccagaaatccagagaatcaagacaacccagcagaacatttcagccgttttttataagaaagaggtgggtgcgggaaccgctgtgaaagatagtcctgaaatcgagcgagtcaagaagaatcagcaaaacataagttctgtaaagtataaggaggagattaaacacgcaacagccatctctgatccccctgagttgaagcgggtgaaagaaaaccagaagaatattagtaacctccaatataaggagcagaactacaaagccacaccggttagtatgacacccgagatcgaaagagtcaggcgtaatcaggaacaactgagtgctgtgaagtacaagggggagctccaaagagggactgctatctccgatccgcctgaactcaagcgcgcaaaggagaatcagaagaatattagtaacgtctattaccgcggacagctcggacgagccactacactttcagtgactccagagatggaaagagtcaaaaagaaccaggagaatatcagcagcgtcaagtacacgcaggaccataaacaaatgaaagggagacccagcctgattctcgatacaccagccatgcgacatgttaaagaggctcagaaccacatttcgatggttaagtaccacgaagactttgaaaagactaaggggagaggctttacccctgtggtggatgatcctgttaccgaacgggttaggaaaaacacccaggtcgtaagcgatgctgcgtacaagggggtacatccgcacattgtagagatggacagaaggccaggtatcattgtcgacctcaaggtatggaggacagatccgggatccattttcgatctcgatccactggaggataatattcaatcccgcagtctgcatatgctatctgaaaaggcaagccactatagacgacactggtcaagatcccatagctccagcacttttggcacaggactcggagatgaccggtctgagatttccgaaatttatccgagctttagttgctgctcggaggtgacacgccctagcgatgaaggagctcctgtgctgcccggagcctatcagcaatcccattctcagggctacggttacatgcaccagacatctgtgtccagcatgcgctcaatgcagcattctcccaacctcagaacctatagagccatgtatgattacagtgcgcaagatgaagacgaggtgtcattccgggacggggactacatagttaacgtgcaacccattgacgatggctggatgtatgggacagtgcagcgtacaggaagaactgggatgctgcccgcaaattatatcgagttcgtgaactag

SEQ ID NO: 232115 - DNA, 711 bp, Artificial Sequence
  Description of Artificial Sequence: Synthetic coding sequence
atgctgcacttctactacgaatggctccacagcggcagtcgtggggcagtgcccaaacccctccactaccctaaacagagtttcacaacagtagcggatacaccagaaaacttacggctgaaacagcaatccgaactacagagccaagttaagtataagagagatttcgaagagtcaaagggtcggggattttccattgttaccgacacaccagagttgcaacggttgaagcggacacaggagcaaatatccaatgtgaaatatcatgaggactttgagaagaccaaggggcgaggtttcacacccgtggtcgacgatcccgtcaccgagcgcgtgcgaaagaatactcaggtggtctcagatgctgcctacaagggtgtgcaccctcacattgtggaaatggacaggaggcccggtataatcgtcgctcccgtgctgcccggtgcctatcaacagtctcattcacaagggtacggctacatgcaccaaacttcagtctcttctatgcgatccatgcaacacagcccaaacctccgtacataccgtgccatgtacgactatagtgcgcaggatgaggacgaggtttccttccgcgatggagactatatcgtaaatgtccaaccaattgatgacggatggatgtacggaactgttcagcggactggtcgaactggcatgctgccagctaactatatagagttcgtaaactag

SEQ ID NO: 232116 - DNA, 813 bp, Artificial Sequence
  Description of Artificial Sequence: Synthetic coding sequence
atgaaccctcagtgtgcacgctgtggtaaggtcgtctatccgacggagaaagtcaattgcctggataagtattggcacaagggatgcttccattgtgaggtgtgcaaaatggctctgaatatgaacaattacaaaggatacgaaaagaagccctattgtaacgctcactaccccaagcagtcctttactaccgtggccgacacacccgagaacttaagattaaagcagcaatccgagttacagagccaggttaagtataagcgcgactttgaggaatccaaagggcgaggattcagcatcgtgacagacacccctgaactccagcggctgaagcgcacccaggagcagatatccaatgtcaagtaccacgaggattttgaaaagacaaagggcagggggttcacaccagtcgttgatgacccggttacagagagggttcggaagaatacccaggtggtatcagacgcggcatacaagggcgtccaccctcacattgtggagatggaccggaggccgggaattatagttgccccagtattaccaggcgcttatcagcagtctcattcacaaggatacggctatatgcaccaaactagcgtaagttcaatgcgatctatgcagcactcccccaatctaagaacatatagggccatgtatgattatagcgcacaggacgaggatgaagtgtccttccgcgacggggattatatcgtcaatgtccagcccattgacgacggctggatgtacggcacagttcagaggactgggcgtacaggtatgcttcctgccaattatattgaattcgtgaattag

SEQ ID NO: 232117 - DNA, 354 bp, Artificial Sequence
  Description of Artificial Sequence: Synthetic coding sequence
atgcggaacaactgtactgctagcttgatgaaagtgttctacaaaccagtgatcgaggacttgtcgatggagctggcccgtaaatgtacggagctcatcagtgacatcaggtacaaggaagaattcaaaaaatccaaagacaaatgtacttttgtgacggattctccgatgctgaaccatgtgaaaaatataggggctttcatatcagaagctaagtacaaaggtaccattaaggctgacttgtccaacagtttatacaagcgaatgcctgccacaatagatagcgtgtttgccggtgaagtaacgcagctgcagtccgaagtggcatacaaacaaaagcacgatgcagcatag

SEQ ID NO: 232118 - DNA, 20009 bp, Artificial Sequence
  Description of Artificial Sequence: Synthetic coding sequence
atggccgatgacgaggactatgaggaagtggttgaatattataccgaggaagttgtctacgaggaagtccccggagaaacgatcaccaaaatatacgagacaacgacgacgcgaactagcgactatgagcagtctgaaacatcgaaacccgctctcgcccaacccgcactggcgcagccggcaagtgctaaacctgttgagaggcgcaaggttatccgcaaaaaggtggacccttcaaagtttatgactccatatattgcccactcgcagaaaatgcaggacttattttcaccaaacaagtataaggagaagttcgagaaaaccaagggtcaaccctatgcttccaccacggacacccccgagctacgcagaattaaaaaggttcaagaccagctgtcagaagtcaagtaccgcatggatggagacgtcgctaaaacaatttgccatgtcgatgagaaagccaaagacatcgagcacgccaagaaagtgagccagcaggtgtccaaagtgttgtacaagcagaactgggaggacactaaagataagtatctgcttcctccagatgcacccgaactggtgcaggccgtgaaaaatacagcaatgttctccaagaaattgtatactgaggattgggaggccgataagagtcttttttacccctataatgactctcccgagcttaggagagtggcacaggcccagaaagctctttccgacgtggcttataagaaaggcctcgccgaacaacaagcacagttcacaccgttggcggatcctcccgatatcgaatttgcaaagaaagttactaaccaggtcagcaaacagaaatacaaggaagactatgaaaataagattaagggaaaatggagcgagacaccatgtttcgaagtggcaaatgccagaatgaatgcggataacataagtacacgcaagtatcaagaagactttgagaacatgaaggatcaaatctatttcatgcagactgaaacccctgagtacaagatgaacaagaaggcaggtgtagctgcttctaaagtcaagtacaaggaggattacgagaaaaataagggcaaagctgactataacgtgctcccagcttctgagaacccgcagctgcgacaactgaaggccgctggcgatgcactgtctgataaactttacaaggagaactacgagaaaaccaaagccaaatccatcaactactgtgagaccccaaagttcaagttggacacagtgctccagaatttttcatctgacaagaagtacaaagactcctatctcaaggacattctgggccattacgtcggaagttttgaggacccttatcactctcactgcatgaaggtcacagcacaaaatagtgataaaaactacaaagctgagtatgaagaggaccggggtaaaggtttcttcccacagactatcacccaagaatacgaagccatcaagaagcttgatcagtgtaaagatcacacctacaaggtgcacccagacaaaaccaagttcactcaggtcacggattcccctgtgctgctacaggcccaagtgaatagtaagcagctttcagatcttaactataaggccaagcacgagtcagaaaaatttaagtgtcatattcctccagacacacccgcattcatccagcacaaagtcaatgcctacaacctttcagacaacctgtataaacaagactgggaaaagagcaaggccaagaagtttgatatcaaagtggacgccataccactgctggcagccaaggccaacacaaagaacacctcagacgtcatgtataagaaggattacgaaaaaaataagggaaaaatgatcggagtcctgagtattaatgacgatccaaaaatgttgcactctctgaaggtggctaagaaccagtctgaccgcctgtacaaagagaactatgagaagacgaaagcaaagtctatgaattattgcgagacacccaagtaccaactagacacccagttaaagaacttctctgaggccagatacaaagatttgtatgtgaaggacgttctcgggcattacgtaggctctatggaagatccttaccatacacactgcatgaaagtagctgcacaaaatagtgacaagtcctataaagcagagtatgaggaggataaagggaaatgttatttcccccagacaattacccaggaatacgaagccatcaagaagctggaccagtgtaaggatcatacatataaagtgcatcctgataagactaagttcaccgctgtcacggacagcccagttctgctgcaagcgcaactgaacacaaaacaactttcagacctcaactataaggctaagcacgaaggggagaaattcaagtgccatattcctgccgacgctcctcagttcattcagcaccgggtgaatgcgtacaacctttcggataacgtgtataagcaggactgggagaaatctaaagccaagaaatttgatattaaggtcgacgctatccccttacttgcggctaaagctaacaccaaaaacacctcagacgtaatgtacaagaaagactacgaaaagtccaaaggcaagatgataggagctttgagtattaatgatgaccctaagatgcttcactcactcaagacagcaaagaaccagagcgacagggagtaccgcaaagactatgagaaatctaagaccatctataccgctcccctcgacatgctccaggtgacccaggctaaaaagtctcaggcgattgcctccgacgtcgattataagcacatcctgcacagttattcctatcccccagattctatcaatgtcgatcttgccaaaaaagcttatgccctgcagtccgatgtggagtacaaagcagattacaatagctggatgaagggttgtggttgggtgcctttcggatctttggaaatggagaaggccaaaagggccagtgatatcctcaacgaaaaaaaatatcgtcagcatcccgatactctaaagttcacctcgattgaggatgcccctatcacggttcagagcaagatcaaccaagcacagaggagcgatatcgcatacaaagctaagggggaggaaataattcacaaatacaatctgcctccagacctcccccagttcatccaggccaaggttaatgcatacaacataagtgaaaatatgtacaaggcagacttgaaggacctgagtaagaaggggtatgatcttcggacagatgccattcctatccgagctgccaaagccgctcgtcaggccgcatctgacgtccagtacaaaaaagactatgaaaaagctaagggcaagatggtcgggtttcagtcattgcaggatgatcccaaattggtgcattatatgaatgtggcaaagatccagagcgatagagagtataaaaaggattatgaaaaaacgaagagcaagtacaacacaccccatgatatgttcaacgtcgtggctgctaaaaaagcgcaggatgtcgtgagcaacgtgaattataaacattctctccatcactatacttatctcccagatgcaatggatctcgagctatccaaaaatatgatgcagatccaatcagataacgtatacaaagaagactacaataactggatgaaaggaattggatggatacccatcggttccctcgatgtagaaaaagttaaaaaggccggagatgctctgaatgagaagaagtacaggcagcaccctgatacgctcaagttcacatcaattgtagacagcccagtgatggtccaggccaagcagaacaccaagcaggttagcgacatcctgtacaaggcaaagggggaagacgttaagcacaaatacacaatgagccctgacctgcctcagtttttacaggccaagtgcaacgcatacaacatttcggacgtatgctataaacgggattggtatgacctaatcgccaaggggaacaacgttcttggtgatgcgatccccattacggctgctaaggctagccgcaacatagcctccgactataagtacaaagaggcttatgaaaaatccaaggggaagcacgtgggatttcgctcactccaggacgatcccaaactggtccactacatgaatgtggcaaaacttcagagcgatcgggagtacaagaaaaattacgaaaacaccaagaccagctaccacacaccaggagacatggtcagtattaccgcggctaagatggcacaggatgttgcaactaatgtaaactataagcagccgctgcaccactatacttacttacccgatgccatgtctctcgagcacactagaaacgtgaaccagatccagagcgataatgtgtacaaggatgagtataattcctttctcaaaggaattggatggatacctatcggatccctcgaggtggaaaaagttaagaaggctggggatgccctgaacgagcgaaaatacagacagcaccccgacacagtcaagtttaccagtgtgcctgactccatgggcatggtcctcgcccagcacaatacaaagcagttgtctgatctaaattataaggtggagggtgaaaagctaaagcataaatacactatcgaccccgagcttcctcagtttattcaagctaaggtgaatgccctgaatatgtccgacgctcactataaagccgattggaagaagacaatcgccaagggatatgaccttaggcccgacgccatcccaattgtggccgcaaaatctagcaggaacatcgctagcgattgcaaatataaagaggcctacgaaaaagcgaaaggtaaacaagtggggttcctgtcattgcaggatgatccgaagctcgtgcactacatgaacgtcgccaaaattcagtccgacagggagtacaagaagggatacgaggccagtaaaacaaagtaccacactcctctagatatggtttctgtcaccgcagccaagaagtcacaggaagtagcaacaaacgcaaattacagacaaagttaccatcattacaccctgcttcctgatgcactcaatgtggagcactcgcgcaatgctatgcagatacagagtgacaacctgtacaaatcggattttacgaactggatgaaagggatagggtgggtccccatcgagtcactcgaggtggaaaaagccaaaaaggctggagagattctgagcgagaagaagtataggcagcacccagagaaactcaagttcacctatgccatggacaccatggaacaagccttaaacaagagcaacaagcttaatatggataagcggttatataccgagaaatggaacaaggacaaaactactatccacgtgatgccagacacgccggatattctgctgagccgagtgaaccagattaccatgtctgacaagctgtataaggcgggttgggaggaggagaagaaaaagggatatgacttaaggccagacgcgatcgctattaaagccgcacgcgcaagcagggacatcgcttccgactacaaatacaagaaggcttatgagcaggccaagggtaaacacattggatttcgttctttggaagacgaccctaaactcgtccacttcatgcaagttgctaagatgcagagcgatcgtgagtataagaagggctatgagaagagtaagacctccttccatacccccgtggacatgctaagcgtggttgcggcaaaaaagtctcaggaggtcgcaaccaacgccaattaccgtaacgtcattcacacttacaacatgctgcctgatgctatgtccttcgagctggccaagaacatgatgcaaattcagagcgacaatcagtataaggcggactatgccgactttatgaagggtataggttggctgcctttgggctctctcgaagctgaaaagaataagaaggccatggagatcatatccgagaaaaaatacaggcagcatccagacaccctgaagtatagcacactgatggactctatgaacatggtgctcgcccagaacaatgccaagattatgaacgagcatctttataaacaggcttgggaggccgataaaacgaaagtacacattatgcctgacatccctcagattattctggccaaggctaacgcgattaatatgtctgataaactctacaagttgtctttagaagagagcaaaaaaaaggggtacgacctccgtcctgacgcgatccctatcaaggctgcgaaggcgtcacgtgatattgcgtcagattacaagtacaaatacaactacgaaaaaggcaaaggcaaaatggtgggatttcgatcactggaggacgaccccaaactcgttcactctatgcaggtagccaaaatgcagagcgatcgggagtataaaaaaaattacgagaatactaaaacttcgtaccacaccccagctgacatgttgtctgttactgctgcaaaggatgcccaagctaacatcaccaacaccaattacaaacacctaatccacaagtacatccttctgccggacgcaatgaatatcgaactaactcggaacatgaaccggatccagagtgataatgagtacaagcaggattacaatgagtggtataaaggattggggtggtcaccagccggttctctggaggtcgagaaggcgaaaaaggcgacggaatacgcttcagatcagaaatataggcagcatccttcaaattttcagtttaagaagctgacagattcgatggatatggtgctggcaaaacagaacgcgcacacgatgaacaaacatctttatactatcgattggaacaaagataagaccaagattcatgttatgcccgacacaccagatattctgcaggccaagcagaaccagacactatattcccagaagctttacaaactaggatgggaggaagccctgaagaaaggttacgatctgccagtcgatgctatctctgtgcaactggctaaagcatccagggacatcgccagcgactacaagtataaacagggctaccggaaacagctaggccaccacgttggtttcaggtcactccaggatgaccccaagctggtcctgtccatgaatgtggccaagatgcagagtgagagggagtacaagaaagactttgaaaagtggaagacgaagttttcttcccccgtcgatatgctgggcgtggtgcttgccaagaagtgccaggagctcgtttctgacgttgactacaagaattatctgcatcagtggacatgcctgccggatcagaacgacgtggtgcaggctaagaaagtatacgaactgcaatctgaaaatctttataaatctgatctcgaatggctgaggggcataggctggtccccactgggaagtctggaagcggagaaaaacaaaagagccagcgagatcatctccgagaaaaagtacagacaaccccctgacagaaataagttcacaagcatcccagacgctatggatatagtgcttgctaaaactaacgccaagaatagaagtgatcgcctgtaccgcgaggcttgggataaggataagactcagattcatattatgcccgacaccccggatattgtcctggctaaggccaatctaatcaatacgagcgataagttgtacagaatgggatacgaggagctgaagagaaaaggctatgaccttcccgtcgacgccatacctatcaaagcggcaaaggccagcagagagattgcttcagagtacaaatacaaggaaggcttccggaaacagctgggtcatcatataggggcacggaatatcgaagatgatcctaagatgatgtggtcaatgcacgtggccaagatacagtcagatcgggagtacaaaaaggactttgagaaatggaaaaccaaatttagttcacccgttgacatgttgggcgtggttcttgcgaaaaagtgccagactctggtgtctgatgtagactataaaaattacttacaccagtggacatgcttacccgatcagtccgacgtcatccatgccagacaggcgtatgacttgcagtccgataacttgtataaatcagatctgcagtggcttaaagggattgggtggatgacaagcggcagtctggaggatgaaaagaacaaaagagctacacagattttaagcgaccacgtctatcgtcagcatcccgaccagtttaaattctctagcctcatggacagcatacccatggtcctcgccaaaaacaatgcaatcaccatgaaccacagactatatacagaagcgtgggacaaagacaaaacaactgtacacatcatgcccgacacacctgaggtgcttctggccaagcagaataaggtcaactacagtgagaaactttacaagctgggattggaggaggctaaacgaaagggctacgacatgagagtggacgctatcccaatcaaggcggcaaaggcatctagagatatagcctctgagttcaagtataaggagggatacagaaaacagctgggacatcacatcggcgctagggcaattcgtgatgatccaaaaatgatgtggtcaatgcacgtggctaagattcagtctgatagagagtacaagaaggactttgagaaatggaaaaccaaatttagctccccagtggacatgctcggggtggtgctcgccaagaaatgccagactcttgtttcggatgtggactataaaaattatcttcaccaatggacctgtttgcccgatcagtctgacgttattcacgccaggcaagcttatgacttgcagtcagacaacatgtacaaaagtgacctccagtggatgagaggcattggctgggtcagtataggctccctcgacgtagagaaatgcaaaagggcaacagaaatcctttccgacaagatctatagacagccaccggacagattcaagtttactagcgtcacagattccctcgaacaggtactggctaagaataacgcaatcacaatgaacaaacgcctgtacacggaagcctgggataaagacaaaacccagatccacatcatgccagatacccccgaaattatgcttgcccgacagaataagattaattacagcgagaccctctacaagctagccaacgaagaagcgaagaaaaaaggctacgacctgagaagcgacgccattcctattgtggcagcaaaggcgtcaagggacgtcatcagtgattacaagtacaaggatggataccgcaagcagctgggacaccacatcggcgcacggaacatcgaggacgaccccaagatgatgtggtccatgcacgtggcaaaaattcaatctgatagagaatacaaaaaagacttcgagaagtggaagactaagtttagtagcccggtggacatgctgggggtcgtactagcaaaaaaatgtcagacactagtgtccgacgtcgattataaaaactacctccacgaatggacttgtctgccagaccagaacgacgtgattcatgcgcgacaggcatacgacctgcagtctgacaacatttacaaaagcgatctccagtggctccgaggcatcgggtgggtccccattgggagcatggatgtggtcaaatgtaaacgagcagcggaaatattgtccgataatatctacagacagccccctgacaagcttaagtttacaagtgtgacagatagccttgagcaagtattggctaagaataacgcactgaacatgaacaaaaggctctacactgaagcctgggataaggataagactcaggtgcatatcatgcccgatactcctgaaatcatgctcgccagacagaataaaatcaattattcagaaagcctgtatcgccaggccatggaggaagccaagaaagagggctatgatcttcggagcgacgcgatcccgatcgttgcagccaaagcaagccgggatattgcttctgactacaaatacaaagaggcttatcgcaagcagctgggccaccatattggtgccagggctgttcacgatgatcccaagatcatgtggtctctgcacattgcaaaagtgcaatctgacagagaatataaaaaagacttcgaaaagtataagacgagatacagctcaccagtggatatgctcggcatcgtgttggctaagaaatgccagaccttggtttcagatgtggattacaagcatcccttacatgagtggatctgccttcccgatcagaatgatattatccacgctcgcaaggcctacgacctccagtctgataacctgtataaaagcgatctcgaatggatgaaaggcattggatgggtgccgattgacagcctggaggtcgtgcgagccaagagagccggagaactgctaagtgatacaatttaccgacagaggccagaaacactgaagtttacgtctattacagacacccctgagcaggtgctcgccaagaacaatgccttgaatatgaataaaaggttgtataccgaggcctgggacaatgacaagaagacgattcacgttatgccggacactcctgaaatcatgctcgccaagttgaacaggatcaactactcagacaaattgtacaagttagccctggaagagtccaaaaaagagggttacgatttacgccttgacgcaatcccgatccaggctgccaaggcttcgagggacattgcaagcgactacaagtataaggagggttacaggaaacagctgggccaccacattggcgctcggaatattaaagatgaccctaagatgatgtggagcattcacgtggccaaaatacagtccgaccgagagtacaagaaagagttcgaaaaatggaaaaccaaattctccagtcctgttgatatgctcggtgtcgtgctcgccaaaaagtgccagatcctagtttcagacatagattacaagcatcctctgcacgagtggacgtgcctgcctgaccagaatgacgtaatccaggctcgtaaggcctacgatctacagagtgatgctatctataagtctgacctggagtggttgcggggaatcggctgggttcccatcggttccgtggaggtagaaaaagtcaaacgcgcaggtgaaatcctgtctgatagaaagtaccgacagccagccgatcagctgaagttcacttgtatcacggacacaccagaaatcgtgcttgccaaaaataatgctcttacaatgagcaagcacttgtatacagaggcatgggatgccgacaaaaccagcatccacgttatgcctgatacccccgatattctgttggctaaaagtaactccgccaatatcagtcagaagctttataccaagggctgggacgagtccaaaatgaaggattatgacctccgagcagatgctatttccatcaagagtgccaaggcctcccgagatatagcttcagactataagtacaaagaagcttatgagaagcagaagggacatcatatcggagcccagagcatcgaggatgaccccaaaataatgtgtgcaatccacgccggtaagattcagtctgaaagggagtataagaaggagttccaaaaatggaaaactaagttttcctcccctgtcgacatgctaagtattctgctggcgaaaaagtgtcagacgcttgtcacagatatagattacaggaactacctgcacgagtggacatgcatgccggaccagaatgatatcatacaagccaagaaagcctacgaccttcaatccgatgcactatacaaggccgacttagagtggttgaggggcatagggtggatgccacagggatcacccgaagtacttagagtgaaaaatgcacagaacatattttgtgacagcgtttatcggacacccgtggtgaacctgaaatacaccagcatcgtggacacccccgaagtcgtccttgcaaagagtaatgccgagaatataagcatccccaaatacagagaggtgtgggataaagataagacatccatacatataatgcctgacacccctgaaatcaacctggcgagggcaaacgccttgaatgtgagcaataagttgtaccgggagggctgggacgagatgaaagctggatgtgacgtgcgactcgatgccattcctatccaggcagcaaaggcatcccgagaaattgcatctgactataaatataaattagatcacgagaaacagaagggtcactacgtaggcactctgacagccagagacgataacaaaataagatgggcacttatagccgacaagttgcaaaatgaacgcgagtaccggctcgattgggcgaagtggaaggccaaaatccagagtcctgttgatatgctgagcattctgcatagcaaaaattcccaggctcttgtgtctgacatggactacagaaattatctgcatcagtggacttgcatgcccgaccaaaacgatgtgatacaggcaaagaaggcctacgaactgcagtctgataatgtctacaaggccgacctggagtggcttaggggaattggctggatgcccaatgactccgttagcgtgaaccacgcgaagcacgcagccgacatcttcagtgaaaaaaagtaccgcactaaaatcgagaccttaaattttacccctgtggatgaccgggtcgactatgttacagccaagcaatcaggcgagattcttgatgacatcaaataccgtaaggactggaacgctacgaaaagcaaatacacattgactgaaacgcctctactccataccgcccaggaggcagccaggatccttgaccagtacctctacaaggagggctgggagcgccagaaggcaactggttacattctccctcccgatgctgtacctttcgtgcacgcccaccactgtaatgacgttcagagcgaacttaagtacaaagccgagcatgtgaaacagaaaggacattacgtgggtgttccaacaatgcgtgacgatcccaaactggtctggtttgagcatgcaggccaaattcagaacgagagactctataaggaggactaccacaaaactaaggctaaaatcaatatcccagctgatatggtgagcgtgctggctgctaaacagggtcagaccctggtcagcgatatcgattataggaattacctccatcagtggatgtgtcaccccgaccaaaacgatgttattcaggcgcgaaaggcctacgacctgcagtctgacaatgtgtatcgtgcagaccttgagtggcttagaggtatcggatggattcctctggacagcgttgatcatgtcagggtaaccaagaaccaggagatgatgtcccagattaaatataagaagaatgctttagagaattaccccaactttagatccgtggtagaccccccagaaatcgttttagctaaaataaactccgtgaaccagtccgacgtcaaatacaaggagacttttaacaaggcaaagggaaagtatactttctctcctgacactccccacatcagccacagtaaagacatgggcaagctgtacagcactatactgtataaaggtgcctgggagggcacaaaggcctatggctataccctggatgaaaggtacattcccatcgtcggggctaaacatgctgatctcgtgaatagcgagttaaagtataaggaaacttatgagaagcagaaggggcactatttggctggcaaagttataggtgaatttcctggtgtcgtccattgcttggacttccagaaaatgaggtcagcactgaactatcgaaaacattatgaggacacgaaggccaatgtgcatatcccaaatgatatgatgaaccacgtccttgccaagagatgccagtacatactcagcgatctggaataccgccactacttccatcagtggacatcacttcttgaggaacctaacgtcatacgggttaggaacgctcaggagatcctcagtgataatgtgtacaaagatgaccttaactggctcaaaggaattggctgttacgtgtgggatacccctcagattctccacgcaaagaagtcctacgacctgcagagccagctacagtacacggccgctggtaaagagaatcttcagaattacaatctggtcactgacaccccattatacgtgactgctgtgcaatccggaatcaacgcctccgaggtgaagtacaaggaaaactatcaccaaatcaaagataagtatacaacagtgctggaaactgttgattacgacagaacccggaatctgaagaatctctattctagtaatctatacaaggaggcctgggatcgggtaaaggcaacctcatacattctgccctcttcaaccctgtcactgactcacgccaaaaatcagaaacacctcgcgtcccacatcaaataccgggaggaatacgaaaagttcaaagctctctacacactccctaggtctgtcgatgatgaccccaacaccgcgaggtgtctgcgggttggtaagttgaatattgatcggctctatcgatccgtctatgaaaaaaacaaaatgaaaatccacattgttccagacatggtggagatggtgacagcaaaagacagccagaaaaaggtgtcggagatcgactacaggcttcggctgcatgaatggatctgtcatcccgatctgcaggtgaacgatcatgttcggaaggtaactgaccagatcagtgacattgtatacaaggacgatctcaattggcttaaagggatcggatgttatgtttgggacactcccgagattcttcacgccaagcatgcgtacgatcttcgggacgacatcaagtacaaggcccacatgttgaagactcggaatgattacaagctggtcacagatacgcccgtgtatgtgcaggcagtgaaatccggcaagcagctaagcgacgccgtgtaccactacgactacgtgcactccgtgaggggcaaagttgccccaaccacaaagacggtagacctggacagggccctgcatgcctataagttgcagagctctaatctctacaagacctctctacgaactttgcccactggctacaggcttccaggcgatacaccacactttaagcacataaaggatacaagatatatgtcctcgtatttcaagtataaggaagcttacgagcatacaaaagcatacggctacacactaggacctaaggacgtccccttcgttcacgtacgccgagtcaacaacgtgacgagtgaaaggctctaccgcgagctgtatcacaaacttaaagataaaatccataccaccccagacacacccgagattagacaggtgaaaaaaactcaggaagccgtgagcgagcttatatataagagcgatttctttaaaatgcagggccatatgataagccttccctacacccctcaagtgatccattgtaggtacgtgggggatattacttccgacataaaatacaaagaggacttacaggtgctcaaaggcttcggttgctttttgtacgacacccccgacatggtgcgcagcaggcacctgcggaaactatggagcaattacttgtacacagacaaggctaggaagatgagagataagtataaggtggtgctcgacacgccggaatatcgcaaggtgcaggagcttaaaacgcatctgtcagagctagtgtacagggccgctgggaagaaacagaaaagtattttcacttccgtcccggatacacccgacctgctacgcgcaaagcgtgggcagaaactgcagtcacaatacctctatgtggagttggcgaccaaagaacgtccccaccaccacgcagggaatcagaccactgcactgaagcacgctaaggacgtgaaagacatggtttcagagaagaagtataaaattcagtacgagaagatgaaagacaaatacactccggtgccagatactcccatcctgatacgcgcaaaaagggcctattggaatgcgtcggacctgcgctacaaagaaacttttcagaagaccaaaggcaaatatcatacagtgaaagatgcactcgatatcgtgtaccaccggaaagtcactgatgacatttctaaaattaaatacaaggaaaactatatgtcccagctaggcatttggcgctccattcccgaccgacctgagcactttcatcatagagcggtcactgatacggtcagtgacgttaagtataaggaggacctcacatggctgaaggggattggatgctatgcttacgatacacccgacttcaccttagctgaaaaaaataaaaccctgtatagcaagtacaaatataaagaagttttcgagcgcacaaagtctgatttcaaatacgttgcagacagccctatcaacagacactttaagtatgccacgcaactgatgaatgagaagaaatatcgtgcggattacgaacagagaaaagataagtatcacctggtggtcgacgaaccacgccatctgctggcaaagaccgctggcgaccagatctctcaaatcaagtatcggaagaattacgaaaagagtaaggacaagttcaccagcatcgttgacacacccgaacacctaagaacaaccaaagtaaacaagcagatcagcgacatactctataagttggagtacaacaaagcgaagccacgcggatatactaccattcacgacacccccatgcttttacatgtacgaaaagtcaaggacgaagtgtccgacctaaaatacaaggaggtgtaccaacggaacaaaagtaattgcaccattgagcccgacgctgtgcacataaaggcagccaaggacgcttacaaggttaatactaatttggactacaagaagcagtatgaagctaacaaagcccactggaagtggacacccgacaggcccgacttcctgcaggccgctaagtcttcactgcagcagtcggattttgaatacaaactggaccgcgagttccttaagggctgcaagctgagcgtgaccgacgataagaatactgtgctggccctgcggaataccttgatcgagtctgatctgaagtataaggagaagcatgtgaaggaacgagggacatgccacgctgttccggacacacctcaaattttgctagccaagaccgtaagcaatctggtgtcagaaaacaaatataaagaccacgtgaagaaacacctcgcacaaggaagttacaccacgcttccggagacgagggacaccgttcatgtgaaggaggtcacaaagcacgtcagcgacaccaactataagaagaaatttgttaaagaaaaagggaagagcaattattccataatgctggagccccctgaagtgaagcacgcaatggaggtcgctaagaagcagtccgatgttgcttaccggaaggacgccaaggaaaacctgcactacacaaccgtggctgatcggccagacatcaaaaaagccacgcaagctgccaagcaggcatccgaggtcgagtaccgagccaagcataggaaagagggttcacacggtctgagcatgctggggcgtcctgatatcgaaatggccaagaaggcggctaagttgagctcccaagtgaaatatagggaaaattttgataaggaaaaaggaaaaacacccaaatataaccccaaggactcccagttgtacaaagtcatgaaggacgcgaataacttggcaagcgaggtcaagtataaagcggacttaaaaaagctccacaagcctgtgaccgatatgaaagaatccctgatcatgaaccatgtactgaatacgtctcagctggccagttcataccagtacaagaaaaaatatgagaagagcaagggccattaccataccatcccagacaaccttgaacagctgcaccttaaagaggctaccgagctgcaatcgattgtgaaatacaaggagaaatacgaaaaggagcgtggaaagccaatgctggatttcgagacacctacctatattaccgcgaaagagagtcaacagatgcagtcgggaaaggagtatagaaaagattacgaagagagtattaagggacgaaatctgaccggcctggaggtgactccggctctgttacacgtgaaatatgccacgaaaattgcatccgaaaaggagtaccgcaaggatttggaggaatctatccgtggaaagggcctcactgagatggaagacaccccagacatgttgagagctaagaacgcgacacagatactcaacgagaaggagtacaaaagagatttagaactggaggtgaagggtagaggcctgaacgctatggcgaatgagaccccagatttcatgcgggctcgcaatgcgaccgacattgcgtctcaaataaagtataaacaaagtgccgagatggagaaggcaaacttcacatcagtagtcgacacaccggaaataattcatgcacagcaagtgaaaaacctaagtagtcagaagaagtacaaggaggacgctgaaaagtccatgagctattatgaaactgtcctcgacaccccagaaattcaacgcgtgcgcgagaatcaaaaaaattttagcctgttacagtatcaatgtgacctgaagaacagcaaggggaagatcaccgtggtccaggacacaccagagattctgcgggtgaaggaaaatcagaaaaacttctccagcgtcctgtacaaagaggacgtatctcccggaactgcaataggaaagactccagagatgatgcgtgtgaaacaaacccaggatcatatttcctctgttaagtacaaggaggctatcggacaaggcacccccatcccggatctcccagaagtgaagcgtgtgaaagaaactcagaaacacatctcttcagttatgtataaggagaacctcggcacaggcatccccaccacggtgactcccgagatcgaacgcgtgaagagaaatcaggagaacttttcctcagtgttatataaggagaatctcggcaagggcattcccactcccatcacacctgagatggaacgagtgaagcgcaaccaggagaacttttcctcagttctgtataaagagaatatgggaaaggggactccactggctgtcacccccgagatggaaagagttaaacacaatcaggagaacatcagctcagtgctctataaagagaacgttggaaaagcaactgccactcctgtcacccccgagatgcaacgggttaagcgcaaccaggaaaatatatcaagcgtgctttacaaggaaaaccttggaaaagctactcctaccccttttacacctgagatggagcgcgtgaaacggaatcaggagaacttttcaagtgtcctgtacaaagagaatatgaggaaggccacccccacccccgtgactccagagatggagcgtgcaaaacggaaccaggagaacattagcagtgtgctctacagcgatagcttccgcaaacagattcagggtaaggcagcctacgttctggacacgccggagatgcggagggtccgtgaaactcagaggcatatatccaccgtgaagtatcacgaggacttcgagaaacacaaaggatgctttacaccagtagtgaccgatcccattacagaacgtgtcaagaaaaatatgcaggacttttcagacattaattacagagggattcaaaggaaggttgtggagatggaacagaagcggaatgaccaagatcaggaaacaattacaggacttcgcgtgtggcggaccaatcccggatcagtattcgactacgatccggctgaggacaatatccagagccgatctctccatatgattaacgtgcaggcacagagacgctcaagagaacagagccggtccgcctctgcactgagcatttctgggggtgaagaaaagtccgaacatagtgaagcacctgatcaccacctgagtacatactctgacggtggagtgttcgcagtctccaccgcctacaagcacgctaagaccactgagcttccccagcaacgctcatccagtgtggcaacacagcagacaaccgtctcttcgatccctagccacccttctacagcaggcaagatatttcgggctatgtacgattacatggctgccgatgctgatgaggtcagtttcaaagatggcgatgcaataataaatgttcaggcaatcgacgaaggctggatgtacgggaccgttcagagaactggccgtacggggatgctgccagccaactatgtggaagcaattta

SEQ ID NO: 232119 - DNA, 1503 bp, Artificial Sequence
  Description of Artificial Sequence: Synthetic coding sequence
atggagcgagttaaacgaaatcaggaaaatttttcatcggtcctctataaagaaaatttaggcacggggatccccatccccatcactccagagatgcagagggtgaaacataaccaggagaatctcagttccgttctatataaggagaacatgggaaagggaacccccctacccgtaacacccgagatggagagagtcaaacataatcaagaaaatatatcatccgttctctacaaagaaaacatgggcaaaggcaccccgttacccgttacacccgaaatggaaagagtcaagcacaatcaggagaacatttcaagcgtactgtacaaagaaaacatgggcaaggggaccccactcgctgtgacccctgagatggaaagagtaaagcacaaccaagagaacattagtagtgttctttataaagagaacgtgggaaaggccaccgccacaccagttactcccgagatgcaaagggttaagcggaaccaggaaaacatctccagcgtcctgtataaagaaaacctgggtaaggctacgcctactccctttaccccagaaatggaacgcgtgaagcggaaccaggagaacttctcctctgtcttgtataaagaaaatatgcgaaaagctaccccgacccccgtgacacctgagatggaaagggctaaaaggaaccaggagaacatcagcagcgttttgtattcggactctttcagaaagcaaatccagggcaaggctgcctacgtgcttgacaccccggaaatgcgccgagtccgagaaacccagcgacatatctccactgtcaagtaccacgaggactttgaaaagcataaggggtgttttacccccgtcgtcaccgatcccatcacagaacgagttaagaagaatatgcaggatttttcagacattaactatagagggatccagaggaaagtggtggagatggagcagaagcgcaatgatcaggatcaggaaactataaccggcctgagggtctggcggacaaacccgggatctgtgtttgactacgatcctgccgaagacaatatccagtctcgcagtcttcatatgatcaatgttcaggctcaaagacgttcccgtgaacagagcaggagtgcatccgcgctgtcaatctctggaggtgaggaaaagtccgagcactcagaagctccggatcatcatctaagcacgtattctgacggtggggtctttgccgtgtctaccgcttataaacatgcaaagaccaccgaactgccccagcaacgctcctctagcgtcgcaacccagcaaaccaccgtctcttcgattccttctcatccaagtacagccggaaagattttccgggctatgtacgactacatggcagcagacgccgatgaagtgagtttcaaagatggggacgcaatcatcaatgtgcaggctatcgatgaggggtggatgtacgggactgtacaacgcactggacgaactggtatgctgcccgctaattatgtcgaggccatttag

SEQ ID NO: 232120 - DNA, 7878 bp, Artificial Sequence
  Description of Artificial Sequence: Synthetic coding sequence
atgcccgatacacctgagataaacttggcacgtgctaatgcactcaatgtgtcgaacaagttgtaccgggaaggttgggatgagatgaaggccggatgtgacgttcgcttagacgccatcccaatccaagcagccaaagctagcagagagatcgcgtccgactataagtataaattggatcacgaaaaacaaaaaggccattatgttggaacattgacagctcgagatgataataagatcagatgggcattgattgccgacaagctccagaacgagcgtgagtacaggctagactgggcaaagtggaaagccaagatccagagcccggtggatatgctgtccatcctccacagcaaaaattctcaggcactggtgtccgacatggactaccgaaactatctccaccaatggacctgcatgcccgaccagaacgacgtgattcaagccaaaaaggcatacgagcttcagtccgataacgtctacaaggctgaccttgagtggcttcgcggtattggctggatgccgaatgattcggtgagcgtcaatcatgcgaaacacgcagccgatattttcagcgaaaagaaataccggaccaagattgagaccctaaattttaccccggtggatgatcgcgtcgactacgtgactgccaaacagtctggagagattctggatgacattaaatataggaaggattggaatgcaaccaaaagcaaatacaccctgactgagactcccctgctgcacaccgcccaggaggctgcccgaatccttgaccaatacctgtacaaggagggctgggagcgacagaaggccacaggttatattctaccacccgacgccgtaccatttgtgcatgctcaccactgcaatgacgttcaaagcgagctcaagtataaggcagagcacgtgaaacagaaaggccattatgtaggcgtcccgactatgagggatgaccccaagttggtctggttcgagcacgccggtcagattcagaacgagcgcctgtacaaagaagactaccataaaactaaggctaaaattaacatcccagctgacatggtgtccgttctggcagccaagcagggtcagacattggttagcgacattgattacagaaattatcttcatcagtggatgtgccaccccgaccagaatgacgtgattcaggccaggaaagcctatgatctgcaatccgataacgtgtacagggccgacctggagtggctcagaggtattggttggatccctttggattcagtggaccacgtaagagtgaccaagaatcaggagatgatgtctcagattaagtataagaagaatgctcttgaaaactatccaaacttccgatcagtcgtggatccccctgaaatcgtgctcgccaagattaatagcgtgaaccagagtgatgtgaaatataaggagaccttcaataaggctaagggaaagtacaccttttcaccggacacacctcatatttcccactccaaggacatgggcaaactgtattccaccattctgtacaaaggggcttgggaggggacaaaggcatatggttacaccttggatgagcgctatattccaattgttggggcaaaacacgctgacctagttaatagtgaattaaaatataaggaaacctacgaaaagcagaagggacattacttagcaggcaaagtaattggcgaatttcccggagtagtgcattgcctagatttccaaaagatgagatcagctcttaattaccggaagcattatgaggataccaaagccaacgtgcacatacctaacgacatgatgaaccatgtgttagccaaacggtgccagtacattcttagtgacctcgaatatcggcattacttccaccagtggacgtctctcctggaagaacctaatgtgatccgggtgaggaatgcccaggagatattgagtgataatgtgtataaggacgatctgaattggctcaaggggatcggctgctacgtttgggacacgcctcaaattttgcatgccaagaagtcctatgacctgcagagtcaacttcaatacacggctgcaggaaaggagaacctccagaattataacctggtgacagacacccccttatacgtaactgctgtacagtccggaattaacgcctcagaggtgaagtataaggaaaattaccatcagatcaaggacaaatatacaactgtgctggagaccgttgattatgaccgcactagaaacctgaaaaatctgtacagtagcaatttgtataaagaggcttgggatcgagttaaagctacatcctatatcctcccatcgagcactttatctctgacacatgctaaaaatcagaagcacctcgcctcgcatattaagtatagagaagagtatgaaaagttcaaagctctatatactctgcccaggtccgtcgatgacgaccctaacacagctcggtgtctgagagtgggaaaactgaatatagaccgcctctatcggagtgtgtacgaaaagaacaagatgaagatccacatcgtgcctgatatggtggagatggtaaccgccaaggacagccagaagaaagtctcagagattgactaccggctgaggctccacgaatggatctgccatccggaccttcaagttaatgaccacgtcagaaaagtaaccgaccagatctctgacattgtgtacaaggatgacttgaactggctgaagggaattggctgttacgtgtgggatacacctgagatcctgcacgcaaaacatgcctatgacctccgtgacgatatcaagtataaggctcacatgttgaagacaaggaacgactacaagctggtaaccgacacacctgtgtacgtgcaggccgtcaaatctggcaagcagttgagcgatgctgtgtaccattatgactatgtgcactcggtgaggggtaaggtggcgccaacaactaaaactgtggatctcgatcgggcactgcacgcatacaaattgcaatcttccaatctgtacaagaccagcctgagaacactgccgaccggttatcggctgcctggagacactcctcactttaagcatatcaaggacacccgatacatgtcttcctattttaagtacaaagaagcatacgaacacaccaaggcttacgggtatacattggggccaaaggacgtccccttcgtgcacgtgagaagggttaacaacgtcacttccgagcggctttacagggaactctatcacaaactgaaagacaagattcatacaacacctgacactccagaaattcgacaagtgaagaagacccaggaagccgtgtccgagcttatctataagagtgacttcttcaagatgcaaggccacatgatttcactgccctatactcctcaggtgattcattgcaggtatgttggcgatatcacgtccgacatcaaatacaaagaagacctccaggtgttgaagggttttgggtgctttctgtacgatacccctgacatggtcaggtctcgccacctgagaaaattatggtccaattacctttacactgacaaagctcggaagatgcgagacaagtataaggtcgtgctggacacacccgaataccgcaaggttcaggagctgaaaacccacctcagcgaactggtgtatcgagccgctggaaagaagcaaaaatcaatttttacttctgtgcccgataccccagacctgttaagggccaaaagaggacaaaagctgcagtcccagtacctgtatgtcgaactcgccactaaggagagaccccatcaccatgctggtaatcagacaaccgctctgaagcatgccaaggacgtaaaagacatggtgtccgagaagaaatacaaaatccagtatgaaaagatgaaagacaagtatacgcctgtgcccgacacccccattctgataagagccaaacgggcttattggaacgcatcagatcttagatataaggagacatttcaaaaaacaaaaggtaaataccacaccgtgaaggatgctctcgatattgtgtaccaccgtaaagtgacggacgatatcagcaaaatcaagtacaaagaaaactatatgtctcagctgggaatctggcgcagcatccctgacaggccggagcactttcaccaccgtgccgttaccgatactgtgagcgatgtaaaatacaaggaagatttaacctggctcaaaggcatcggctgttatgcctatgacacacctgacttcactctggccgaaaagaacaagaccctgtattccaaatacaaatataaagaagtgtttgaacgcacaaagagtgactttaaatacgtggctgattcgcctatcaaccgccacttcaagtatgccacacaactgatgaatgagaaaaagtatagggccgattacgagcagcgcaaggataagtaccacttggtagttgatgagcccagacacctactggcaaagacagccggagaccagatttcacagatcaagtatcgcaagaattatgaaaagagtaaggataagttcacaagtatcgtggacactccagagcacctgaggactacgaaagtaaataaacagatctcggatatcttatacaaactggagtacaataaggctaagccgcgtggctacacaactattcatgatacacctatgctcctgcatgtgaggaaggtgaaggatgaggtttctgacctaaagtataaggaggtgtatcaaaggaataaatcaaactgcaccatcgaacccgatgctgtgcacatcaaggcagcaaaggatgcctataaggttaataccaacctggactataagaaacagtatgaggcaaataaggcgcattggaagtggacaccagataggcccgatttcctgcaggccgctaagagctccttgcagcagtccgattttgaatataaactggatcgtgaattcctgaaaggatgcaagctgagcgttaccgatgataaaaacaccgttctcgccctgagaaatactcttattgagagcgatcttaagtacaaggaaaagcacgtgaaggagcggggaacctgtcacgctgtccctgacaccccccagatactgttggccaagaccgtctctaacctggtatccgagaacaaatacaaggatcatgtcaaaaaacacctagcccagggctcctacaccacactacctgaaactcgggacacagttcatgttaaggaggtgaccaagcacgtttccgataccaactataagaagaaattcgtgaaggagaagggcaagtctaactactctataatgctcgagccacccgaggttaagcacgcaatggaagtggctaaaaagcagtccgacgttgcctatcgcaaggatgccaaggagaatctgcattatactacagtggccgacagaccggatattaaaaaggctacccaggctgctaagcaggccagtgaggttgaatacagagctaagcaccgaaaggaaggctcccacgggctgtccatgctgggtagaccagacatcgagatggccaaaaaagctgctaagctctcatctcaggtcaagtacagagaaaactttgacaaggagaaagggaagacacccaagtataaccccaaagattcccaactctataaggtcatgaaggacgccaataacctcgcctctgaagtgaagtacaaagctgatctgaaaaagctgcataagcctgtgacagacatgaaagaaagccttattatgaatcatgtcctcaacacctctcagctggcctcttcttatcagtataagaaaaaatacgaaaaaagcaagggacactatcacaccattcctgacaacctggagcagctgcacttgaaggaagctactgaactgcagtccattgtgaaatacaaggagaaatatgagaaagaacgtggtaaacctatgttggattttgagactcctacttatatcacagctaaggaatcccaacagatgcaatccgggaaagaataccgcaaggattatgaagagtccataaaggggagaaacctaacaggccttgaggttacccccgcattgctacacgtgaagtatgccaccaagatcgcctcagagaaggagtatagaaaagacttggaagaatccattcgtgggaaagggttgaccgaaatggaggacacacccgacatgctgcgcgctaagaacgctacccagatcttgaatgagaaagagtacaagagggatctagagctggaagtgaagggacgtggcctcaatgccatggcaaatgaaacacctgactttatgcgggcacgaaacgccactgacattgcttctcagatcaagtataaacagagcgctgaaatggagaaggccaactttacttcggtggtcgacactccagagattatccatgctcagcaggtcaagaatctctcctcccaaaaaaaatataaggaagacgcagaaaaatctatgtcttactatgagacagtgcttgacacccccgagatccaaagagtacgggaaaatcagaagaatttcagcttgcttcagtaccagtgcgacttgaagaacagcaagggcaagattacagtggtgcaggacacacccgaaatcctgcgggtgaaagagaaccaaaagaatttctcaagcgttttatataaagaggatgtcagtcctgggaccgccatcggaaaaactccagaaatgatgcgagtcaaacagacacaggaccatatctcttccgtgaaatacaaggaagcaattggccaggggacaccaattcccgatctgcccgaagtaaagcgagtcaaggagacacagaagcacattagttcggtgatgtataaagagaatctgggaaccgggattccaacaacagttacacccgagattgagagggtgaagcgcaaccaggaaaatttttccagcgtgttatacaaggagaatatgggcaagggtaccccactgcctgtgactcctgagatggaaagggtgaaacacaaccaggagaacatttctagtgtcctgtataaggagaatgttggaaaagctaccgccacccccgtgacacccgagatgcagcgcgtcaaaaggaatcaggaaaacatctctagtgtcctctactctgacagcttccgcaaacagattcaagggaaagctgcctacgtgttggacaccccagagatgaggcgcgtccgtgaaactcagagacacataagcacagtgaaataccatgaggatttcgaaaagcataagggctgcttcacgcctgtggttactgacccaatcaccgaacgcgtgaagaaaaacatgcaggattttagcgatataaattaccggggtattcaaaggaaggtggtggaaatggagcagaagcgtaatgaccaggatcaggagactattacgggcctgcgcgtctggcgcaccaacccagggagcgtgttcgactatgatccagccgaggacaatatccaatcccggtctcttcacatgattaatgtgcaagcccagagaagaagtcgagagcagagtcgctcagcttctgctctgagcatctcgggcggagaggagaaatcagagcactcggaagcccctgatcatcacctgtcaacctattctgacggaggagtgtttgctgtgtcaacagcctataagcacgcaaagacaacggaactcccccagcaacggagttcatcagtagccacccagcagacaactgtgtcctcaattccatcccatccctctaccgccggtaaaatatttagggcaatgtatgattacatggcagccgacgccgacgaggtgtcttttaaggatggggatgctattatcaatgtgcaggccatcgacgaggggtggatgtacgggacagtccagagaaccggaagaacaggcatgctgcccgcaaactatgtggaggctatttac

SEQ ID NO: 232121 - DNA, 25578 bp, Artificial Sequence
  Description of Artificial Sequence: Synthetic coding sequence
atggctgacgatgaggattatgaggaagtggttgagtactatactgaagaagtcgtgtacgaggaagtgccaggcgaaacaatcacaaagatctatgaaaccaccactacgcgtacttcagattatgaacagagcgaaaccagtaaacccgctctcgcccaacccgcactggctcaacctgcatccgccaagcctgtggagcgaaggaaagtgattcggaagaaggtcgacccctccaaattcatgactccgtacatcgcccatagtcagaaaatgcaggacctgttctctccaaataagtataaagagaaatttgaaaaaaccaaaggccagccatatgcttcaaccaccgacacacccgaactcagacgcatcaaaaaagttcaggatcagctgagcgaggtcaaatacaggatggacggtgatgtggcaaaaaccatctgccacgtggacgagaaagcgaaggacatcgagcatgcaaaaaaagttagccagcaggtatccaaggttctgtacaagcaaaactgggaggacactaaggataaatacttgctccccccagatgcaccagagctggttcaggccgttaagaacaccgccatgttttctaagaaactttatactgaagattgggaagccgacaagagcttgttttatccttacaatgatagccccgaactgaggcgggtcgcacaggcccaaaaggctctgagcgacgtggcctacaagaagggcctggcagagcaacaggcccagtttactccacttgccgacccgccagatattgagttcgccaagaaagtgaccaaccaggtgagcaagcagaagtataaggaggattacgagaacaagatcaaaggtaagtggtccgagacaccttgcttcgaagtggcaaatgccaggatgaatgccgataacatcagcaccaggaagtatcaagaggatttcgagaacatgaaagaccagatttactttatgcagaccgaaactccagaatacaaaatgaataaaaaggccggagtcgctgccagcaaggtgaaatacaaagaggattacgaaaagaacaaggggaaggcagactataacgtacttccagcatcggagaatccacagttgaggcagctcaaggcggctggcgacgcgctgagcgacaagttatataaggagaattatgagaaaacgaaggccaagtctatcaactattgtgaaacacccaaatttaaactggatacggtgctacagaacttctcatccgataaaaagtacaaagacagttatctgaaagacattttgggccactatgttggaagcttcgaggacccgtatcacagccattgcatgaaagttacagcacaaaacagtgataaaaattataaggcggagtacgaggaggatagggggaaaggttttttcccccaaactattacgcaggaatatgaagccattaagaagctggatcagtgtaaggatcatacctataaagttcatccagataagaccaaattcacacaggtcactgatagtccagttcttctgcaggctcaggtcaattcaaaacagttgagtgaccttaattacaaagcgaagcacgaatctgagaagttcaagtgccacattccacccgacaccccagccttcattcagcacaaggtaaatgcctacaatctctcagataacctatacaaacaggactgggagaagtccaaggcaaagaaatttgatattaaagtcgatgcaatccccctccttgccgcaaaagctaacaccaagaacacaagtgacgtgatgtataagaaggactatgaaaagaataaaggcaagatgattggagttttgagcattaatgacgatccaaaaatgctccattcattgaaagtagcaaagaatcaatcagaccgtctgtacaaggagaattacgagaaaaccaaggcaaagagcatgaactactgcgagacccccaaataccagctcgacacacagctgaaaaacttctccgaggcgaggtacaaagatctttatgtgaaggatgtcctgggacattatgtcgggtcaatggaggacccttatcatacccattgtatgaaggtggcggctcaaaatagcgataagtcttataaggctgaatatgaagaagacaagggaaaatgttatttccctcaaacaattacgcaggagtacgaggctatcaagaaattagaccagtgcaaggaccacacctacaaggtacacccagataagactaaattcacagcggtgactgatagccccgttctgttacaggcccaattgaacaccaaacagctttcagaccttaactacaaagcaaagcacgagggtgagaagtttaagtgtcacatcccagctgatgcccctcagtttatccaacatcgcgttaacgcctataacctgtctgataatgtgtataaacaggattgggaaaaatcaaaggcaaaaaagttcgatataaaagtggacgccatccctctcttggccgcaaaagccaacaccaagaacacttcagacgtcatgtataaaaaagactatgagaaatcaaagggcaaaatgattggcgctttatcgattaatgatgaccctaaaatgctccattccttgaaaaccgccaagaaccaaagcgaccgcgaataccgtaaagactatgaaaaaagtaagactatttacacggcccctctcgacatgctgcaggtgactcaggccaagaagtcccaagcaattgccagtgacgtggattataaacatatcctgcattcatattcctaccctccggactccatcaatgtggacctcgcaaaaaaagcctacgcattgcagtctgatgtcgagtacaaagctgactataatagttggatgaaaggctgtggatgggtgcctttcggttctctcgaaatggagaaggccaagcgggcttctgacattctgaatgaaaagaagtatcgacagcaccctgacacgttgaaattcacctctatcgaagacgcccctatcactgtccaaagcaagattaaccaggcccagcgcagtgacattgcatataaggcgaagggtgaggaaattattcacaagtataatctcccacccgacctgcctcagtttatacaggccaaagtgaacgcctataacatcagtgaaaatatgtacaaggctgacttgaaggatttgtctaaaaagggctacgatctgaggactgacgcaattcctatccgtgccgctaaagccgctaggcaggctgcttcggatgtccaatacaaaaaggactacgagaaagctaagggaaagatggtcggttttcaaagtttgcaggacgaccctaagctcgttcattatatgaatgtagctaagatacagtcggatcgggagtacaaaaaagactacgaaaagaccaaaagtaaatacaatacacctcatgatatgttcaatgtcgtagcggctaaaaaagcacaggacgttgtgtcgaacgtcaattacaagcactcgctgcaccactatacctacctccctgatgccatggacctggagctgtctaaaaacatgatgcagatccaaagcgataatgtctacaaggaggattacaataattggatgaagggcataggctggataccaatcggtagcctggacgtcgaaaaagtcaagaaggcaggtgacgcccttaatgaaaaaaagtatcggcagcatcctgataccctaaaatttacttccatcgtcgacagcccagtcatggtccaggccaaacagaatacaaaacaggtcagcgatatcctgtataaagccaagggtgaagacgtcaaacacaaatacacaatgagtcctgacctcccccagtttctacaggctaaatgcaatgcgtacaacatctctgatgtttgttataaacgcgattggtatgacctcattgcaaaaggcaacaatgtgctcggagacgctataccaatcacagcagctaaggcctctcgtaatatcgcatctgattacaagtataaggaagcatacgaaaaatctaaggggaagcatgtgggatttagaagcctccaggatgaccccaaactggtccactacatgaacgtggccaaactgcagagcgatcgcgagtacaagaaaaattacgaaaacacgaaaactagctaccacactccaggagatatggtttctatcaccgccgcaaagatggctcaggacgtagcaactaacgtgaattacaaacaacctctccatcactacacctacctgccagacgcaatgtcactggaacataccaggaacgtgaaccaaatccagtccgacaacgtgtataaagacgaatacaattcatttttgaaaggaatcggatggattccgatcggtagcctggaagtggaaaaagtgaaaaaagcaggcgacgccctcaatgaacgcaaataccgccagcatccggatacggtcaagtttacatcggtgcccgattctatgggcatggttttagcccagcataacaccaaacagctgtctgatctgaattataaggtggagggcgagaagctaaagcataagtatacaattgaccccgaattgccacagtttattcaggcaaaggtcaacgctcttaatatgagtgacgcgcactataaggcggattggaagaaaactatagctaaaggttacgacttgagacccgacgccatccctatcgtagccgctaagtcaagcagaaacatagcctccgattgcaaatacaaggaagcgtatgaaaaagcgaaagggaagcaggtggggtttttgtcgcttcaggatgatcctaagctcgtgcattatatgaacgtcgccaagattcagtccgatagggagtataagaagggttatgaagctagcaagacgaagtaccatacaccccttgacatggttagtgtgacagctgctaagaaatctcaggaggtagccaccaatgcaaattacagacagagctatcatcactatactctgttacctgacgcacttaatgtggagcactctcgcaatgccatgcagatacaaagtgataatctctacaagagcgatttcactaactggatgaaagggatcggatgggtgcctatcgagtcattggaggtggagaaagcaaagaaggctggggaaatcctgagtgaaaaaaagtaccgccagcaccccgaaaagctcaagtttacttatgcaatggacacgatggagcaagctctgaacaagagtaataaactcaacatggataagcgcctgtacaccgaaaagtggaacaaggataagaccaccattcatgtgatgcctgatactcctgatattctgctgtctagagtgaatcagattaccatgtccgacaaactttataaagccggttgggaggaggagaagaaaaaggggtatgacctcaggcccgacgcaatcgcaattaaagcagccagggctagcagagacattgctagcgattacaagtataagaaagcctatgaacaggctaaagggaagcacatcggtttcagatctcttgaagatgaccccaagctcgttcattttatgcaggtcgcaaagatgcagagcgacagggaatataagaaaggttatgagaaaagcaagacttcctttcacacacccgtggatatgctttccgttgtagctgctaaaaagtctcaggaggttgccaccaacgcgaactaccggaacgtgattcacacctacaatatgcttccagatgccatgtcctttgaactcgctaagaacatgatgcaaatccaaagtgacaaccagtataaagcggattatgccgacttcatgaagggaatcggctggcttccattgggctcacttgaagcagagaaaaataagaaagctatggagatcataagtgaaaaaaagtatagacagcatcccgatacactgaagtactcaaccctgatggacagtatgaatatggtgctcgcccagaataatgctaaaattatgaatgaacacctgtacaaacaggcgtgggaggctgacaagaccaaagtgcacatcatgcctgacattcctcagattatcctggctaaggccaacgccattaacatgtctgataagctgtataagctgtccctggaggagagcaagaagaagggctacgacctgcgacctgatgcgattccaattaaggcggctaaggcaagtcgggacatcgcctccgattacaaatataaatataactatgagaagggaaagggtaagatggttggattcagaagtcttgaagacgacccaaagttggtgcactccatgcaggtggctaagatgcaaagcgaccgggagtacaagaaaaactatgagaatacgaaaacatcctaccacactcctgcggatatgctgtcagtgaccgcagcaaaagatgctcaagcgaacataacaaacacaaactacaagcatttaatccacaagtatattctcctgccagacgcgatgaacatcgagctgacgcggaatatgaaccgtatccaaagcgacaatgagtacaaacaggattacaatgaatggtacaaaggtctgggatggagtccggcaggctccctggaagtcgaaaaggctaaaaaggccacagagtacgcatcagatcaaaagtataggcaacacccatctaattttcaattcaaaaaactgaccgacagcatggacatggtgctggcgaaacagaacgcccacacaatgaacaagcatctgtatactatagattggaataaggacaagacgaaaattcacgtgatgcctgatacgcccgacattctccaggccaagcagaatcaaaccctgtactcccaaaaactgtacaagctgggctgggaagaagctcttaagaaagggtacgacctgcctgtggatgctatttccgtgcaactcgcaaaggcctctcgggacatagcaagcgattacaaatacaaacagggctatcggaaacagctagggcaccacgttggctttcgcagcttgcaggatgacccaaaactagttctcagcatgaacgtggccaagatgcagtctgagcgagagtacaagaaagactttgaaaaatggaagactaaattcagctctcccgtagacatgctgggagttgtccttgcgaagaagtgccaggagcttgtgagcgacgtggattacaagaactatctgcatcaatggacttgtctgccagatcagaatgacgtcgtccaggctaagaaggtctacgaactgcagtccgagaacctctataaatccgacctcgaatggctacgcggaatcggatggagccctcttggctcccttgaggctgagaagaacaagcgcgcaagtgaaattatcagcgaaaagaagtaccgacaacctcccgatagaaataaattcacgagcatccccgatgctatggatatcgttctggcaaaaacaaacgctaagaatcgcagtgataggctctaccgggaggcatgggacaaagacaagactcaaatccatattatgcccgacactcccgacatagttctggcaaaggccaatctaattaatacatccgacaagctgtatcgtatgggctacgaggaactaaagcggaagggatacgatctcccagtggacgcaattcccattaaggccgcaaaggcatctcgggagattgccagcgagtacaagtacaaggaggggttccgcaagcagttagggcaccatatcggggctcgtaacatcgaggacgatccaaagatgatgtggagcatgcatgttgcgaaaattcaaagtgacagagagtataagaaagactttgaaaaatggaaaactaagtttagcagtccagtagatatgctgggagtggttctggcgaaaaaatgccagaccttggtctccgatgtcgattacaagaattatctgcaccaatggacatgcttgccagaccagtctgacgtcatccacgcccgacaggcgtatgacctgcagtctgataatctttataaatctgaccttcaatggctgaaagggattggctggatgacctctggatccctagaggacgaaaaaaacaagagggctacacagattttgtcggatcatgtgtataggcaacatccagatcagttcaagttcagctctctgatggattcaattccgatggtgttggccaagaataatgccatcactatgaatcatcgcttatacactgaggcctgggacaaagataagactacggttcatataatgcctgatacacctgaagtcctgttggccaagcagaataaggtcaactattctgagaagctttacaaattgggactggaagaggccaaacgcaagggctatgatatgcgagtggatgcaataccaatcaaggccgctaaagcatcgagagacattgcatccgagttcaaatataaagagggttaccggaaacaactcggccatcatatcggagctcgcgctattcgcgacgatccgaagatgatgtggtccatgcatgtggcaaagatccaaagcgatcgggaatacaagaaagactttgagaagtggaaaactaagttctcctctcctgtggatatgctcggtgtggtcctcgcgaagaagtgccagactctcgtgtctgatgttgattataagaattatttacaccaatggacctgtctgcctgaccagagcgacgttatccacgcccgtcaggcctacgacctccagtctgataatatgtacaagagcgatctccaatggatgcggggtataggatgggtatctatcggcagccttgatgttgagaagtgcaagcgtgcaacagagattctcagcgataaaatctacaggcagcctccggataggtttaaattcacatcagtgacagactctctcgaacaagtgctcgctaagaataacgctatcacgatgaataagcgcctgtacacggaagcttgggataaagacaagactcaaatccacattatgccagataccccagagattatgctggcaagaatgaataaaatcaattactctgaatccctgtacaagcttgcaaacgaggaagccaagaaaaagggctacgacctccgcagtgatgccatccccatagtagctgccaaggcaagccgcgacatcataagtgactataagtacaaggacggttactgtaaacagctgggccaccatataggtgccaggaatatagaagatgacccgaaaatgatgtggtctatgcatgtcgcgaagattcagagtgatagggagtataagaaggactttgaaaaatggaaaactaagttcagttcaccggtggacatgctgggggttgtcctggctaagaaatgtcaaacactggtttctgatgtcgactataagaattaccttcatgaatggacctgtttacccgatcagagcgacgtgattcatgcccgtcaggcctatgacctgcaaagcgacaatatctacaaaagtgatctccagtggcttcgcggaattggttgggtgcccatcgggtctatggacgtggttaaatgcaagcgtgcgactgaaatactgtcagataatatctaccgtcagccacctgacaaactcaaattcacaagcgtgaccgattccctggagcaagtactagcaaaaaacaacgccctaaacatgaataagcggttgtatactgaagcatgggacaaggacaaaacccaaatccatatcatgccggatactcccgaaattatgctggccagacaaaataagattaactattccgaaacactttacaagctggccaatgaagaagcgaagaagaaaggctacgatcttagatcagatgccataccaatcgtcgcagccaaagcgtcaagagatgtcatatctgactataaatacaaagacggttatcggaaacagctaggacatcacattggtgccagaaatattgaagacgatcccaagatgatgtggtctatgcatgtggccaaaatccagtccgatagggaatacaaaaaggactttgagaaatggaagacgaaatttagttcccctgttgacatgcttggcgtggtcttagccaaaaagtgtcaaaccctggtatctgatgtggactacaagaattacttgcacgaatggacttgcctgccagaccaaaatgacgtgatacatgctcgtcaggcctatgatttgcagtcggacaatatctataagagcgatctccaatggctgcgcggaatcggatgggtgccaatcgggtctatggatgtagtgaaatgtaaacgcgcagcagagatcctctccgacaacatataccgccagcctcccgacaaactgaagtttacctctgtaaccgattctctggaacaagtgctggcaaaaaataatgcattgaatatgaacaagagattgtatacagaggcctgggacaaagacaaaacccaggtccacataatgccggatacccctgagatcatgctggctagacagaacaagataaactatagtgagagtttataccgccaagcaatggaggaagccaagaaggaaggttacgatcttcgctctgatgcgatcccaatcgtggccgctaaggcctccagggacatcgcatctgattataagtataaggaggcttacagaaagcaacttgggcaccacatcggggctcgagctgtccacgacgatcccaagatcatgtggtcactccacatcgcaaaagtgcagtcagacagagaatacaagaaagacttcgagaagtataaaaccaggtatagctctccggtcgacatgcttggcattgttttagccaagaaatgccaaacgttggttagtgacgtggactataaacaccctctgcacgagtggatctgcttgccggaccaaaacgatatcatccacgctcgtaaggcgtacgacctgcagtcagacaacctttacaaatcggatctggagtggatgaagggcattggctgggtacccatagattccttggaagtcgtccgggctaaaagagcaggcgaactcctgtccgacaccatctaccgtcagcgaccggagacactgaagttcacttccattactgacaccccggaacaggttctagccaagaacaacgcactgaacatgaacaagcgactgtatacagaagcttgggataacgataaaaagaccatacatgtgatgccagatacccccgagattatgctggcgaagctgaaccggatcaattactctgataaactgtacaaactggccctggaggagtctaaaaaggagggctacgatctgagactggacgcgatccctatacaggccgctaaggcgagcagagatatcgcctcagattacaagtataaggaaggctaccgcaagcaactaggccaccatattggcgcacggaacatcaaggatgacccaaagatgatgtggagcatccatgttgccaagatacaaagcgatagagagtataagaaggaatttgaaaagtggaagactaaattttcctcgccggtggacatgcttggagttgttttagctaagaagtgtcagattctggtgtcagacatcgactacaaacaccccttgcacgagtggacatgccttcctgaccagaacgacgtgattcaagctaggaaggcatacgatcttcagagcgacgctatctacaagagcgaccttgagtggcttcgtgggatcggctgggtgccaattgggtccgtggaggtggaaaaggtgaaacgggcaggcgagatcttgtcagatcggaagtacagacaacctgcagaccagcttaaatttacatgcatcactgacacgccagagattgtcctcgcaaaaaacaacgctctgacaatgagcaagcatctgtacacagaagcctgggacgccgataaaacctcaatccacgtgatgccagacacgcctgatatccttctggccaaatctaatagcgccaatatctctcagaagctgtatacaaagggatgggatgagtctaagatgaaggactatgatctgagagcagacgccattagcatcaagagtgccaaggccagccgagatattgcaagtgactacaaatataaagaggcctacgagaaacagaaaggacatcatatcggagctcagtccatcgaggatgaccctaaaatcatgtgtgcaatccacgcaggtaaaattcagagtgagcgagaatataaaaaggagtttcagaagtggaaaacaaaattttcttctcctgtcgatatgttgtctatcttgttggccaaaaaatgccagaccctggtgaccgatattgactatcggaattatttacatgaatggacttgtatgcccgatcagaacgacatcatccaggccaagaaggcctatgacctgcaatccgactcagtctataaagcagatctggagtggttgcgtgggatcggttggatgcccgagggctcggttgaaatgaatcgagtcaaagtggctcaagatttggtgaatgaacggctatacagaacaaggcccgaggctctctcattcacctcaatagtggacacccctgaagttgtactcgccaaggcgaattccctgcaaatttccgaaaaactttatcaggaggcatggaataaggacaaatcaaatatcactatcccctccgacactcccgaaatgctgcaggcgcacatcaatgccctgcagatctcaaacaagctctaccagaaagattggaacgatgctaagcagaaagggtatgacatcagagcagacgctattgaaatcaaacacgctaaggccagcagggagatagcaagtgagtataaatacaaggagggttacagaaagcaactcggccatcatatgggctttagaaccctccaagatgatcccaaaagcgtgtgggcaattcacgctgccaagatacagtccgatcgggagtacaagaaggcctacgagaagtccaaagggatccacaatacacccctagatatgatgtctatcgtccaggccaaaaagtgtcaagtgcttgtctctgacatagactaccggaactaccttcaccaatggacttgcctgcccgatcaaaacgacgtaatccaggctaaaaaggcatacgacctgcagagtgataacttatataaaagtgacctggagtggctaaaagggattggttggctgccagaggggtccgttgaggttatgagagtgaagaacgcacagaacctccttaatgaacgcctttacagaattaagcctgaggccttaaaatttacatccatcgttgatacacccgaggtcattcaggctaaaatcaatgctgtgcagatctctgaaccattataccgggatgcttgggagaaggaaaaagctaatgtcaatgtccccgctgatacgccactaatgcttcaatccaaaattaatgcactgcagatcagcaacaaaaggtatcagcaggcatgggaagatgttaagatgacaggatacgatcttcgggctgatgcaatcggcattcagcatgcaaaagcctctagagatatagcatctgattacctatacaaaaccgcctacgagaaacagaagggtcactacataggttgccgctctgcaaaagaggacccaaaactagtgtgggcagctaacgtcctaaagatgcagaacgaccgcttatacaagaaggcctacaatgatcacaaggccaagatctctattcctgttgacatggttagcatttctgctgccaaagagggacaagcgctcgccagcgacgtagactaccgacactacctccaccattggtcttgtttcccagaccagaacgacgtgattcaggccaggaaagcgtacgacttgcaaagcgattcggtgtacaaagctgatctggagtggttgaggggaataggttggatgccagagggcagcgtggaaatgaacagagtaaaagtggcccaggacctagtcaacgaaaggctgtatagaacacgaccggaagccctgtcattcactagtatcgtggacacccccgaagtggttctggctaaagccaatagcctccagatctccgagaagctctaccaggaggcctggaataaggacaaaagtaacatcacgatcccttcagacacgcctgagatgctgcaggcgcatattaacgcgctgcagattagcaacaagctctaccaaaaagactggaacgataccaagcagaagggctacgacattcgggcagacgcgattgaaatcaagcacgccaaggcttctcgggagatcgcaagtgagtacaagtacaaggagggttataggaagcagcttggccaccacatgggtttccgcacactccaggacgaccccaagagcgtgtgggccatccacgccgcaaagattcaatctgatagggaatacaagaaggcctacgaaaagagcaagggaatccacaataccccattagacatgatgagtattgtccaggcaaaaaagtgtcaggtactggtgtcagatatcgattaccgcaactacctccatcagtggacatgtctgcctgatcagaacgacgtcatccaagccaaaaaagcatatgatttacagtccgataacctgtacaaatccgacttggaatggcttaagggcattggttggctgccagaggggtccgtggaagtgatgcgagtcaagaacgctcagaatctgctcaatgagcgcttgtatcgcatcaaacctgaggcactaaaattcactagcattgtggacacacctgaggtcattcaggccaaaattaacgctgtgcagatctctgaacctctttaccgcaatgcatgggaaaaagagaaagcgaacgtcaatgttcccgcagacactccactgatgcttcagtctaagataaacgcccttcagatcagcaacaaacgctatcagcaagcttgggaggatgtgaaaatgaccggatacgacctgagggccgatgctataggcatacagcatgcaaaagcgtctagggatatcgcaagcgattatctatacaaaacggcatacgagaaacagaagggtcattacattgggtgcagaagcgcaaaagaagatcctaaactcgtctgggcagctaatgtgctgaagatgcaaaatgatcggctctacaaaaaggcctacaatgatcacaaagccaaaatatctatcccagtggacatggtgagtatcagcgcagccaaagaggggcaagccttagcctccgacgtggactaccgacattatttgcaccattggtcttgctttcctgatcaaaacgacgtgattcaggcacgcaaggcttatgatcttcagtcagatagcgtgtataaagccgacttagaatggctgaggggaattggatggatgcctgagggctcggtcgagatgaatcgggtaaaagtcgcccaagatctggtaaatgagcgcctctacaggaccagacccgaggctctgagtttcacatccatcgtggatacacctgaagtcgtgttggcgaaggcgaatagcttacagatcagcgagaagctgtaccaggaagcgtggaacaaggacaagtccaatataaccatccctagcgatactccagagatgttgcaggcacacatcaacgctctgcaaatctccaataaactttatcaaaaggactggaatgacacaaaacagaaggggtacgacatccgagccgacgctatagagattaaacatgctaaggcatccagagagatagcctcagagtataagtataaggaaggctatcgcaagcagctgggccaccacatggggtttcgtaccctccaggatgaccccaaatccgtctgggctatccacgcagccaagattcagagcgatcgggagtacaagaaggcctacgaaaagagcaagggaattcacaacacccccctggacatgatgtctattgtacaggcgaagaagtgtcaggtgctggtgagcgatatcgattaccggaattatcttcaccagtggacatgcttgcctgatcagaacgacgttatccaggcaaaaaaggcgtacgacctgcagtctgacaacttatataaatccgatttggagtggttgaaagggatcggctggttacccgagggatcagttgaggttatgagggtgaaaaatgctcagaacttactaaatgagcgcctgtacaggattaagcctgaggccctgaaattcacgtctattgtggatacaccagaggtgatacaggcaaagattaacgctgttcagataagtgagcccctgtaccgcgacgcctgggagaaggagaaagcaaacgtgaacgtacccgctgacacccccctcatgcttcagtccaagattaatgcattgcaaattagcaacaagaggtaccagcaggcctgggaggatgtaaaaatgaccggatacgatctccgggctgatgcgattggcatccaacacgccaaggcctcacgtgacatcgcgtcagattacttgtacaagaccgcgtatgagaagcagaaaggacactatatagggtgtcgctcagcgaaggaagatccaaaattagtgtgggccgctaatgtgttgaagatgcagaacgaccggctctataaaaaggcatacaacgatcataaagctaagatatcaatcccagttgacatggtgtctatcagcgcagccaaagaagggcaggctctcgccagcgacgtggactacaggcactacctgcatcggtggtcctgcttccctgaccagaacgatgtcatccaggccaggaaagcctatgacttacaatctgacgcactttacaaagctgatctggagtggctcagaggcataggatggatgcctcagggctcgcctgaggtgctcagagttaaaaacgctcaaaatatcttctgcgatagcgtctacagaactccggtggtcaacctcaagtacacttccattgtggatacaccagaggtggtgctagcgaaatcaaacgccgaaaacatctcaatcccaaaataccgcgaagtctgggataaggataaaacttctatccacatcatgccagatacacccgagataaacttggcccgtgccaacgccctgaatgtgtctaacaagctctaccgtgaaggatgggatgagatgaaggcaggttgcgacgtacggttagatgcaatcccaatccaggctgccaaagccagtcgggagattgcttctgactacaagtacaaactggaccacgagaaacagaaaggacactatgtcgggacattgaccgcaagggatgataataagatcagatgggccctcatagccgataagctgcaaaacgaacgcgagtaccgactggattgggcaaaatggaaggccaaaattcagtccccagtcgacatgctgtccatcctgcattccaaaaacagccaagcactggtctccgatatggattaccgaaactacctgcaccagtggacttgcatgccagaccagaatgacgtcatccaggccaaaaaagcttatgagctgcagagcgacaacgtgtataaggcggacctggagtggttacggggaatcggctggatgcccaatgacagcgtctccgtgaaccacgcaaaacacgcagccgacatttttagcgagaaaaaataccgtacgaagatcgagactctgaatttcacccctgtggacgacagggtggactacgtgactgcaaaacagtctggcgaaatactggacgatatcaaatatcggaaagattggaacgcaactaagagcaagtacacacttactgagacacctctactccatacagcccaagaggcagcgagaattttggatcagtatctgtacaaggaaggctgggaacgacagaaggccacaggctacattcttcccccagacgccgtgccatttgtccacgcccatcactgtaatgatgtgcagtctgaactgaagtacaaggcagaacacgtgaagcagaagggtcattacgtaggagtgccgacaatgagagatgatcccaaacttgtctggttcgagcacgccggacagatccaaaacgaaaggctctacaaagaggattatcacaaaactaaagccaaaataaatatacctgccgatatggtgagtgtgctcgcagctaaacaaggccaaactctcgtgagcgacattgattatcggaactatttacaccagtggatgtgccaccctgaccagaatgatgttatccaagccaggaaagcttacgacctgcaaagtgacaatgtgtatagggccgatcttgagtggcttcgcggtattgggtggattcccctggatagtgtggatcatgtgcgtgtgactaaaaaccaagagatgatgtcacagattaaatataagaagaacgccctcgagaactacccaaatttccgcagcgtggtcgaccctccagaaatagtattagccaaaatcaattcagtcaaccagtctgatgtaaagtacaaagaaacattcaacaaggccaagggaaagtacaccttttcgccagacactcctcacattagtcattctaaggatatgggtaagctgtatagtaccatcttgtacaaaggggcatgggaaggaacgaaagcctacggttacacccttgacgaacggtacattcccatcgtcggtgccaaacatgcggatctggtcaactccgagcttaagtataaggagacctatgaaaagcaaaaggggcattatctggctggcaaagtgatcggcgagtttcctggagtcgttcattgcctggactttcaaaaaatgcgaagtgccctcaactaccgcaagcattacgaggacaccaaggctaacgtccacatacctaatgacatgatgaaccacgtcctggcgaagaggtgccagtatattttgagcgaccttgaatacaggcactatttccatcagtggaccagccttcttgaggagcccaacgtgatccgagtacgcaatgcacaggaaatcctctccgataatgtgtataaggacgacctgaattggctaaaaggcatcggttgttacgtgtgggacacgccccaaatcctgcatgctaaaaagagctatgacttgcagtcccagttgcaatataccgccgctggcaaggaaaatcttcagaactacaacctggtgaccgacacacctctttatgtcaccgccgtgcagtccggaatcaacgcctccgaggtaaagtacaaggagaactaccaccagataaaagacaaatacactactgtgctggagacagtggactatgaccgtacacgcaatctcaaaaatctatatagttccaacctgtataaagaggcttgggatcgggtgaaggccactagctatattctcccttcctccacactgtcactcactcacgccaaaaatcaaaagcacctggcttcccacattaagtatcgggaggagtatgagaaattcaaagccctttacaccctgcctaggagtgtggacgacgaccctaacacagcccgttgcttgcgagtcggaaaactcaacatcgacagattgtaccgcagtgtctacgagaaaaacaagatgaagatacacatcgtccccgacatggttgagatggtaactgccaaagatagtcagaaaaaggtctcagaaattgattatcgtttgaggcttcatgaatggatttgtcaccccgacctccaagtaaacgaccatgtccgcaaagtgacagatcaaataagtgatatcgtctataaagacgatctgaactggctgaagggtatcggctgttatgtgtgggatacacctgaaatattgcacgccaaacacgcctacgacctcagagacgatattaagtacaaggcacatatgttgaagacacgcaatgattacaagctagtcactgacactcctgtatatgtgcaggcagtcaagtcaggtaagcaacttagcgacgctgtataccactacgactacgtgcatagcgtgagagggaaggtggcccctacaacaaagaccgtcgaccttgacagggctttgcacgcatacaagctgcagtcctctaacttgtacaagacctcgttgcgaactttgcccacaggataccggttgcctggggacactcctcacttcaagcacattaaagacactcgctatatgagttcatatttcaaatataaagaggcttacgaacacaccaaagcctatggctatacgttggggcctaaggacgtgccttttgttcatgttcgaagggttaacaacgtgacatccgagcgtctgtacagagagctgtaccataaattgaaggacaagatccatacaactccagataccccggagatccgtcaagttaaaaaaactcaggaagcagtctccgagctgatctacaagagtgactttttcaagatgcaagggcatatgataagcctgccctacacaccacaagtaatccactgtaggtatgtcggggatatcacgtctgatatcaagtataaggaggacctgcaggtcttgaaggggttcgggtgtttcctctacgatacccccgatatggtccggtctagacacctccggaagctgtggtctaactatctgtatacagacaaagcgcgtaaaatgcgcgacaagtataaggttgtgcttgatacaccagaatatcgaaaggtgcaggagctgaaaacacaccttagcgagctagtctaccgtgcggcaggcaagaaacagaagtctatctttacatcagtgccggacacccccgatctgctgcgcgctaagagaggacaaaagctgcagagccagtatttatacgtcgagctggctacaaaagagcgtccccaccaccacgccggaaaccaaaccactgcactgaaacatgctaaagacgtgaaagatatggttagtgagaagaagtataagatacagtatgagaaaatgaaagataagtatacacctgtacccgacacccctatactgatccgcgctaaacgcgcttattggaatgccagtgaccttaggtataaggaaacctttcaaaagactaagggaaagtaccacactgtgaaggatgccctggacattgtctatcaccgaaaagtgactgacgacataagcaaaattaagtataaagagaactacatgtctcagctgggaatctggcgaagcatccctgatagaccagagcatttccaccatagggccgttactgacacagtctccgatgttaaatacaaggaggaccttacttggctgaagggcattgggtgctatgcctacgacacccctgatttcacactcgctgaaaaaaacaagactctctattcaaaatacaaatacaaagaggtgttcgaaaggaccaagagtgatttcaaatatgtcgctgactcacccatcaatagacattttaagtatgcgactcagctaatgaacgagcggaagtacaagtcttcagctaaaatgtttctgcagcacggttgtaacgaaatactgagacctgacatgctgaccgccctatataacagccacatgtggagccagatcaagtaccgtaaaaattatgagaagtcaaaggacaagttcacctctattgttgacaccccagagcacttgcgcacaacgaaagtcaacaagcagataagtgacattctatacaagttagagtataacaaggccaaaccacgaggctatacgaccatacacgatacaccaatgctcctccacgttaggaaggtcaaggacgaagtatcagatttgaaatacaaggaagtgtaccagcggaacaaaagcaactgcacgatagagccagatgctgtgcacattaaggccgcaaaggacgcatacaaggtaaatactaatctggactacaagaaacaatacgaagctaacaaagctcattggaagtggacgcctgacagaccagactttctccaagctgcgaagtcttccctgcagcagtccgattttgagtacaaactcgaccgcgagtttctgaagggctgtaaacttagtgtgacagacgacaaaaacacggtgctggcactcagaaatacacttatagaaagcgatctcaaatacaaggagaagcacgtcaaggaacgagggacctgccacgccgtgcctgatactccccaaattctgctcgcaaaaaccgtgtcaaacctcgtatccgagaataagtataaggaccatgttaagaagcaccttgcccagggctcatacaccaccctgccggaaacccgggacaccgtgcacgtaaaggaagtcaccaaacacgtgtcagatacaaattataaaaaaaagttcgtgaaggagaagggaaagagtaattatagcattatgttggaacctcctgaggtgaaacacgctatggaagtcgcaaagaagcaatccgacgtggcgtacaggaaggatgctaaggaaaatttgcactacaccacagtcgcagataggccggatatcaagaaggccacccaggctgcgaaacaggccagtgaggtggaatatagggccaaacacaggaaagagggctctcacgggctctctatgttgggaaggcccgacattgagatggccaaaaaagccgctaagctgagctcccaggtgaagtaccgggaaaacttcgacaaagagaaggggaagacccctaagtataatccaaaggacagccaactgtataaagtcatgaaagatgctaataacctggctagtgaagttaagtacaaggcagacttaaagaagctgcacaagcccgtgacagacatgaaggagtccctcattatgaaccacgtcctgaacaccagccagttggcctcctcttaccagtataagaagaaatacgagaagtccaagggtcactaccataccatcccggataacttggaacagctgcatctcaaagaggccaccgagctccagtccatcgttaaatacaaggagaagtacgaaaaagaacgagggaagccaatgctggattttgaaactcctacctacatcaccgcaaaggaatcacagcagatgcaaagtggaaaagagtatcggaaagattacgaggagtccatcaaaggaaggaacttaaccggacttgaagtgaccccagccctgctccatgtaaaatacgccacaaaaatcgcaagcgagaaagagtaccgcaaagatcttgaagagagtattaggggtaaaggcctgacggaaatggaggacacgccagacatgctgagagctaaaaatgcaacacagatcctgaacgaaaaagagtataagcgcgacttggagctggaagtcaaaggcagaggcctaaacgctatggcgaatgagactccagacttcatgagggccagaaatgcgacggacatcgcatctcagattaaatacaagcagtccgcggagatggagaaagctaacttcacatctgttgttgacactcccgaaataatccacgcacagcaggtaaagaatttgagcagccagaagaaatataaagaggacgctgagaagtcaatgagttattacgagacagtacttgacactccagagattcaacgggtaagagaaaaccagaagaacttctcactgctccagtaccaatgcgacctcaagaatagcaagggcaagattactgttgtgcaagacacaccagagattctgagagtgaaggagaatcaaaaaaatttttcgtccgttctttacaaagaagatgtcagtccgggtacagccatcggcaagactcctgaaatgatgcgtgtgaagcagactcaggaccacattagtagcgtgaagtacaaagaagccattggacagggaactcctatcccggatttgcctgaagtcaagcgcgtaaaagagacacagaaacacattagtagcgtgatgtataaagagaatctgggaactgggattccaacaacagtaacacctgaaatagaacgggtaaaaaggaatcaggaaaatttttcctctgtgctgtataaggagaaccttggcaaaggcattccaacccctatcacccctgagatggagagagttaagaggaaccaggagaacttttctagtattttatacaaggaaaacctatccaaaggaacgcccttacctgtgacgcccgagatggaacgcgttaagctgaatcaggagaacttcagttcagtgttgtacaaagagaatgtgggaaagggaatcccaatccctattacacccgaaatggagcgagttaagcacaatcaggaaaattttagtagcgttctgtacaaagagaatcttggtaccggcatacctattcccataactcccgaaatgcagagagtgaagcacaatcaggaaaacctgagcagcgtgctctataaagaaaatatggggaaaggtacacctctgccagttacgcctgagatggaacgtgtgaagcataaccaagaaaatatctcttcagtgctttacaaggaaaacatggggaaaggtaccccactgccagtgacgcctgaaatggaacgggttaagcataaccaggagaacatttccagcgtgctctacaaagaaaatatggggaagggcacgcccttggccgtgacccccgagatggagcgcgtgaaacataaccaggaaaatatctcctctgtcttgtacaaagaaaatgtggggaaggccaccgccacacctgtgaccccggaaatgcaacgagtcaagcgaaaccaagaaaacatctcttccgtgctttacaaggagaacctgggtaaagcaaccccaacacctttcacccccgaaatggagcgagtgaagcgaaatcaggaaaatttcagttcagttctatacaaggagaacatgaggaaagccacaccaaccccggtcacccccgaaatggagagggccaaacgcaaccaggagaacatcagcagtgtgctttatagtgattcctttcggaagcaaatccaggggaaggcggcttacgtgcttgacacccctgagatgaggcgcgtgagggaaacacagcggcatatctcgacggtgaagtatcatgaagattttgaaaaacacaaagggtgcttcacaccggttgtgactgacccaatcaccgagagagtgaaaaaaaacatgcaggatttcagtgacatcaactatcggggaatccagaggaaagtggtggagatggaacaaaagcggaacgaccaggaccaggaaactattactgggctgcgcgtctggagaactaaccctggtagcgtgtttgactacgaccccgctgaggataacatacagtcacgatcgcttcatatgatcaacgtacaggctcagcgccgaagcagagagcagtctcgctccgcaagcgcattgtccatctctggcggagaggagaaatcagagcatagtgaggctcccgaccaccatctgagcacctattcagacggtggggtgttcgcggtgtctacagcctacaaacacgctaagaccactgagttgccccaacagaggagctcaagtgtggccacacaacagacaacagtctcatcaattcctagtcacccctctaccgctggaaagattttccgagccatgtacgattatatggcagccgacgcagacgaggtgagtttcaaggacggcgatgccatcattaacgtccaagcgatcgatgagggatggatgtatggaacggtccagaggaccgggaggacagggatgctgcccgctaactacgttgaggccatttag

SEQ ID NO: 232122 - DNA, 20010 bp, Artificial Sequence
  Description of Artificial Sequence: Synthetic coding sequence
atggcagatgacgaggactatgaggaggtggtggagtactacaccgaggaagtcgtgtatgaggaagtacccggtgaaactatcaccaaaatctatgagacgaccacgacaagaaccagcgactacgaacagtcagaaacgtccaagcccgcactggctcaacccgctttggcccaacctgccagtgctaaacccgtggagcgacgcaaggtgattagaaagaaagtcgatccctctaagtttatgacaccctacatcgctcactcacagaagatgcaggacctgttctccccgaataagtataaggaaaagttcgaaaaaactaaagggcagccctacgccagcaccactgacactccggagctgcgacgcataaaaaaggtacaggatcagttaagtgaagtcaaatatagaatggatggtgatgttgctaaaacgatttgtcacgtggatgagaaggcgaaggatatcgagcatgccaagaaagtctcacaacaggtttccaaggtgctctataagcagaattgggaagatacaaaggacaaatacctgcttccccctgacgcccctgagctggttcaggcagttaagaacacggcaatgttttcaaagaaactgtacacagaagactgggaagctgacaaatctctgttctatccatacaatgactcccccgagctgcgaagggtcgcacaggcgcagaaggctcttagcgacgtcgcctacaaaaagggccttgccgagcagcaagcccagttcacccctctggccgatccccctgatattgagttcgctaagaaggtgacgaaccaggtttccaagcagaaatacaaggaggattacgagaataagatcaagggaaagtggtccgaaacaccatgctttgaagtggccaacgctcgtatgaacgctgataatatcagcactcggaagtaccaggaagattttgaaaacatgaaagatcagatttactttatgcagactgagaccccagaatacaaaatgaacaaaaaggccggtgtagccgcttcaaaggtgaaatacaaagaggactacgagaagaataaggggaaagcagattataatgtgctgcctgccagtgaaaaccctcagcttcggcaactcaaggctgcaggcgatgccctgtccgacaagctttataaagaaaactatgaaaagactaaggccaaaagtatcaattattgtgaaacgcccaaattcaaactggacaccgtgttgcagaacttctcttcagataagaaatacaaggacagctatctgaaagacatcttggggcactatgttggttcctttgaagacccttatcacagccattgcatgaaagttaccgctcagaacagcgacaagaattacaaagctgaatatgaggaggatcgtggcaaaggcttcttcccacagaccatcacacaggaatatgaagcaatcaagaagctcgaccaatgtaaggatcacacctacaaggtgcaccccgataagaccaaattcacacaggtgacggactctccagtcctgctgcaggcccaggtgaattccaagcagctttcagacctgaattataaggccaaacatgaaagtgaaaagttcaagtgccacattccacccgacacacccgctttcattcaacataaggtgaatgcttataatttgagcgacaacctgtacaagcaggactgggaaaagtccaaagcaaagaagtttgatataaaagtcgacgccattcctctgctggccgcaaaggccaacacaaaaaacacttcggatgtgatgtacaagaaagactatgaaaaaaataaggggaaaatgatcggagtgctgagcattaacgacgacccaaaaatgctgcattccctgaaggtggcgaagaatcagtcagaccgtctttacaaagagaactacgagaagacaaaagcgaagtctatgaattactgtgagacacctaaataccagctggacacgcaactcaagaattttagtgaggcgcgttataaggatctgtatgtgaaagacgttctaggacactatgtggggtcaatggaagatccttaccacacacactgtatgaaagtggccgctcagaactccgataaaagctataaggccgaatacgaggaagacaagggaaaatgttatttcccccaaaccattactcaggaatatgaggccatcaagaaacttgaccagtgtaaagaccacacttacaaggtacaccctgataagacaaagttcacggctgtgaccgattctcccgtactgctccaggcccagctgaataccaaacagctgtctgatctcaattacaaagcgaaacacgagggagaaaaatttaaatgtcacattccagccgacgcccctcaatttatacagcatcgcgttaacgcatataacttgagtgacaatgtctacaagcaggactgggagaagtctaaggcaaagaagttcgacatcaaggtggacgccatcccccttctggccgctaaggcaaatacaaaaaacacctcagacgtgatgtacaagaaggattatgaaaaaagtaaaggcaaaatgattggagctctgtccattaatgacgaccccaagatgctccacagcctaaaaactgctaagaatcagtccgaccgggagtaccggaaggattatgaaaaatctaagacgatctacacggctccactggatatgctgcaagttacgcaggctaaaaagtcccaggcaatagcctctgatgtcgattacaagcatatattacacagctattcatatccccctgacagcatcaacgtggatctggcaaagaaggcatacgctctgcaatcagatgtcgagtacaaggccgactacaatagctggatgaagggctgcggctgggtgccctttggctccctcgagatggagaaagctaagcgggctagcgacatcctaaatgagaaaaagtataggcagcatcctgatacactgaaatttacttctatcgaagacgcgcctattactgtgcaaagcaagataaaccaggcacaacggagcgacattgcctataaagccaaaggcgaggagatcatacacaagtacaacctgccacccgaccttccacagttcatacaggccaaggttaatgcctataacatttccgaaaacatgtataaggccgatctgaaagacctttcaaaaaaggggtatgatctccgtactgatgcaatcccgatccgggcagcgaaggccgctagacaggctgcttctgatgtgcaatacaagaaggattacgagaaggccaagggaaagatggtgggatttcaatctctgcaagacgatcccaagctggttcactatatgaacgttgccaagattcaaagcgaccgggagtacaaaaaagactacgagaaaactaagtctaaatataacacaccacacgacatgtttaacgtggtcgcggcaaaaaaggcacaagatgtggtcagcaacgtcaattataagcactccctgcaccattatacctacttgcctgacgcgatggatctcgagttgagcaagaatatgatgcagatccagtctgacaacgtgtacaaggaggactacaacaactggatgaagggaatcgggtggatcccgatcggttccctggacgtcgaaaaggtgaagaaagccggagatgccctcaacgaaaaaaagtatcgccagcatcccgatacactgaagttcactagcatcgtggatagccccgtcatggtccaggctaagcaaaacacaaagcaggtaagcgatattctgtacaaagctaaaggcgaggacgtgaagcacaagtatactatgtctcccgacttgccacagtttcttcaggcaaagtgtaatgcctacaacatatccgatgtctgttacaaacgtgactggtacgacctgatcgccaaaggaaacaatgtgttgggggacgccatccctataactgccgctaaggcctcccggaatattgcatccgattacaaatacaaagaggcatacgagaaatctaaagggaaacacgtcggatttcgcagccttcaggatgaccccaagttggttcactacatgaatgttgctaaactccagtctgacagggagtacaaaaagaactacgagaatacaaaaacctcttaccacacaccaggcgatatggtgtccattactgccgcaaagatggcacaggacgtggcaacaaacgttaactacaagcagcccttacatcactatacatatctccctgatgcaatgagcctggagcataccagaaatgtcaaccagatccagtcggacaatgtctataaggacgaatataattctttcctcaaggggattgggtggatccctataggatcgctggaggtcgagaaggtcaagaaggcgggagatgccctgaacgaacgaaagtatcggcagcatccggacacggtgaagtttactagcgtgcctgacagtatgggcatggtgctggcacagcacaataccaagcagctgtcagatctcaattataaggtggagggcgaaaagctgaaacataagtacacaattgatcccgaactcccccaatttattcaggctaaggtgaatgccctgaacatgtcggatgctcactataaggcggactggaagaaaactatcgccaagggatacgacctgcgcccagacgccattccaatcgttgcggcaaagagcagtaggaatatagccagtgactgtaaatacaaggaagcatacgaaaaggcgaaggggaagcaggtaggttttctttcacttcaggacgatcctaagctggtccactacatgaacgtggctaagattcagtcggaccgtgagtacaagaagggctatgaagcaagtaagactaagtaccatacacccctggacatggtctccgttaccgctgctaagaaatctcaggaagtggctacaaacgcgaattatcgacagtcctaccaccattatacccttctgccagacgctcttaacgttgaacattcgaggaatgccatgcaaattcagagcgataacctttacaaaagcgactttacaaattggatgaagggaattgggtgggtcccaattgaatcactcgaggtagagaaagcaaagaaagccggtgaaatcctgagtgagaagaagtacagacagcacccggagaagctgaagttcacttatgccatggacacgatggagcaggccctgaacaagtctaacaaactgaatatggataagcgcctgtacacagagaaatggaataaagataaaacaacaattcatgtcatgcccgacacacctgacatactgctatcacgagtaaaccaaatcactatgtctgacaagctgtacaaagccggttgggaggaggaaaaaaagaaaggctacgacctaagacccgacgcaattgctattaaggctgccagagcaagccgtgatattgcctctgattataaatacaagaaggcatacgaacaggccaaaggcaagcatatcggctttagaagccttgaggacgaccccaagctcgtacacttcatgcaggtagccaagatgcagtccgacagagagtataaaaagggttacgaaaaaagcaagacttccttccacacacccgtcgatatgttaagtgttgtggccgcaaagaagtcccaggaagtggctacaaacgctaactaccgtaatgtcatccatacctataacatgttgccggacgctatgtccttcgaactcgctaaaaatatgatgcagattcagagcgacaaccaatataaagcagattatgccgattttatgaaaggcataggttggctgcctctcggatcactggaggctgagaagaataagaaagcaatggagataatctcagagaaaaaataccgtcagcatccagacactctgaaatattctactcttatggatagcatgaacatggtgctggctcagaataatgccaaaattatgaatgaacatctatacaagcaggcttgggaagctgacaagaccaaggtgcacattatgcctgacatccctcagattatcctggccaaagctaatgccattaacatgagcgataaactgtataaactgagcttggaggaaagcaaaaagaaagggtatgaccttaggccagacgccatcccaatcaaagctgccaaggccagtcgagacattgcctccgattataaatataaatataattacgagaagggcaagggcaaaatggtcggttttcggtcactagaagacgaccccaagcttgtgcactctatgcaagtcgccaagatgcagtccgacagggaatataagaagaactatgaaaataccaagacatcctaccatactcccgcagacatgctgagcgtaaccgccgcaaaggatgcacaggccaacattaccaacaccaattacaaacatctcattcataagtacatcctactgcctgatgccatgaacattgaattaactaggaacatgaacagaatccagtccgataacgagtataagcaggattataatgaatggtataaagggttgggttggtcccctgctgggtcccttgaggtcgagaaagcaaaaaaggcgacagagtacgctagtgaccagaaatacaggcagcacccaagtaacttccagttcaaaaagctgactgacagcatggacatggtgctggcgaagcagaatgctcataccatgaacaagcatctttacacgatcgactggaataaggacaagactaagattcatgtaatgccagacacacctgatattctccaagcaaagcagaaccagactttgtactcacagaagctgtacaagctggggtgggaagaagctctgaaaaaggggtacgatctgccagtcgatgcaatatctgtccagctcgctaaggccagtagagatattgcaagtgattataaatataagcagggctatcggaagcagcttggtcatcatgtagggttccgctcgctgcaggatgacccaaagctcgtgctgtccatgaacgtggccaagatgcagagtgagcgggagtataaaaaagactttgaaaagtggaaaactaagttttcctcccctgttgacatgttaggcgtcgtgctggcaaagaagtgccaggagttagtttcagatgtggattataaaaactaccttcatcagtggacttgtctcccagaccagaatgatgttgtccaggccaaaaaggtgtatgaactacaatctgaaaatctgtacaagtctgacttagaatggcttagggggatcggctggtcccctttggggagcctggaggcagagaaaaacaagcgcgcttctgagattattagcgaaaaaaagtaccgccagcctcctgacaggaataaattcacctctatccccgatgcaatggatatagtgttagccaagactaacgccaaaaaccgatctgacagactctaccgagaggcatgggataaggacaaaactcaaatccacatcatgcctgacacccctgacatagtgctggccaaagctaacctgatcaataccagcgacaaactttaccgaatggggtatgaggagctgaagcgtaagggctatgacctgcccgtcgatgcaatcccaatcaaggcagccaaggcctctcgagagatcgcatctgagtataagtacaaggaaggattccggaaacagctagggcatcatataggcgcacggaatatcgaggatgatcctaaaatgatgtggagtatgcacgtcgcgaaaatccaatctgaccgggaatacaaaaaagactttgagaagtggaaaacaaaattctcaagcccagtggacatgttaggggtggtgcttgccaagaagtgtcagactctcgtgagtgacgtggactataagaactatctacaccagtggacctgtttgcccgaccagtcagacgtgatccatgctagacaggcctatgacttgcagtcagacaatctctacaaatcagatcttcaatggctgaagggaattggttggatgacatcagggtcactggaagatgaaaagaataaacgcgcaactcagatcctgtctgaccacgtgtataggcagcatcccgaccagttcaagtttagctcgttaatggattccatacctatggtactggccaagaacaacgccatcaccatgaaccacagattgtacactgaggcatgggacaaagataaaactaccgtgcatattatgccggataccccggaagttcttttggccaagcagaacaaggtgaattacagcgagaagctttacaagctcggattggaggaagccaagaggaagggctacgatatgcgggttgacgctattcctatcaaagccgctaaagcgtcacgggacatcgcaagcgaatttaaatacaaggaggggtaccggaagcaactgggccaccatattggcgcacgcgcaatcagggacgatcccaagatgatgtggtctatgcatgtggccaaaattcagtccgatagggagtataagaaagattttgagaaatggaagactaaattcagtagtcccgtggacatgttgggcgttgtgttggctaagaaatgccagacccttgtaagcgatgtcgattacaaaaactacctacatcagtggacttgcttgcctgatcagtctgacgttattcacgctcgtcaggcctacgacttgcagagtgacaatatgtacaagtctgatcttcagtggatgcgtggaattggatgggtatccatcggttcactggatgtggagaaatgcaagcgggcaaccgaaatcctaagcgataagatttaccggcaacccccagataggttcaaatttacctccgtgactgattcccttgagcaggtgttagccaaaaacaacgcactgaatatgaacaagcggttgtataccgaggcctgggacaaggacaaaacacagattcatatcatgcccgacactccagaaattatgctggccagacagaacaagatcaactacagcgagaccctatacaaactcgcaaatgaagaagcaaaaaaaaaaggatacgaccttcgctccgatgccatccctattgtcgctgccaaggccagcagagatgttatctctgattacaagtacaaggacggctaccggaagcagctggggcatcacattggtgctagaaacatcgaggatgatccaaaaatgatgtggtctatgcacgttgccaagatccagtcagatagggagtacaagaaggatttcgagaagtggaagactaagttttcatcaccagtagacatgttaggcgttgtattggctaaaaaatgccagactctagtttctgatgttgattataagaattacctgcatgagtggacctgtttaccagatcagaacgatgtgatccacgcgaggcaagcatatgacctccagtccgacaacatatacaaatctgacctgcagtggctcagaggaattggttgggttcctatcgggagtatggatgtggtgaaatgtaagagggcagctgagattctcagcgataatatctacagacagcctcctgataaactgaaattcacctcagtgaccgactctctcgagcaagtgttagccaaaaataacgccttgaatatgaataaaaggctctatacagaggcctgggacaaagataagacccaggtacacattatgcccgatacacccgagattatgctcgcaagacagaataaaataaattactctgagagcctctaccgccaggccatggaagaagctaagaaggaaggatacgacctgcgcagcgacgccatacccatcgttgccgcaaaagcaagcagggacatcgcttccgactataaatataaagaagcatacaggaagcaactagggcaccacattggtgcgagagcagttcacgacgatcccaaaattatgtggtcgctgcatattgcaaaagttcaatctgaccgcgaatacaagaaagattttgaaaaatacaagactcgctactcaagtcccgtagatatgctgggtatagtgctggccaaaaagtgccagacactggtatctgacgtggactataagcacccactgcatgagtggatctgcctgccagaccagaatgatattattcacgcccgaaaggcttacgatctccagagtgacaatctttacaaatccgatctggagtggatgaagggtatcggctgggttccaatagattcactggaagtagtgagggctaagcgcgctggagagctgctgagcgacaccatctacagacagcgtccagagacactaaagttcaccagcattacggacacccccgagcaggttctggctaagaataacgctctcaatatgaataaacgcttatacacggaggcatgggacaatgacaaaaaaacaatccacgtgatgcctgacacacctgagattatgctggccaagctcaacagaattaattacagcgacaaattatacaaactggccctggaggagtccaagaaggagggctatgatctcagactggatgccatcccaatacaggccgctaaagcctcccgtgatatcgccagcgattataaatacaaggaggggtatcgcaagcagctgggccaccatattggcgcacgcaatatcaaagatgatccgaagatgatgtggtccatccacgttgcaaaaatccaaagtgacagagagtacaaaaaggagtttgaaaaatggaagacgaagttctcttcgcctgtggatatgctgggagtggtcttggctaagaaatgccagatcctggtctctgatattgactataaacaccccctgcacgaatggacttgtttgcccgatcagaatgacgttattcaggccaggaaagcttatgacctacaatctgatgcaatatacaagagtgacttagagtggcttcgtggaattgggtgggtgcctatcggttccgttgaggtcgagaaggtaaaacgagccggagaaattctcagtgatcggaagtacagacagcccgcagaccagctgaagtttacttgtatcactgacactcctgagatcgtgctggccaagaataatgcgctgaccatgtcaaagcacctgtatacagaggcatgggacgcagacaaaacatccattcatgtcatgcccgatacccccgatatactgcttgctaagagtaactcggcaaatatttctcagaaactctataccaagggctgggacgagtctaagatgaaagactacgaccttcgcgcagatgccatctccatcaaaagtgcaaaggcctcccgagatatcgcctccgactacaagtacaaggaggcttatgagaagcagaaaggtcaccacatcggcgctcagagtatcgaggacgaccccaagattatgtgcgccatacacgccggtaaaatacagagcgaacgcgaatataagaaggaatttcagaagtggaagactaagttttcctcgcctgttgacatgctctcgattttgctggccaaaaagtgccagaccctggtcaccgatattgactatcgcaactatctgcacgaatggacatgtatgcctgatcagaatgatatcatccaagcaaaaaaagcatacgatctgcagagtgatgctctttacaaggccgacctagaatggcttcgtggcatcggctggatgccccagggctctccagaagtgctcagggtcaagaatgcgcagaacattttttgcgacagtgtctaccgtactcctgtggtcaaccttaagtatacaagcattgtcgacacccctgaggtagttttggcgaagtcaaacgccgagaatattagtattccaaaatacagagaggtttgggacaaggacaagacctctattcatataatgcctgatactcctgaaatcaatctcgcacgggcaaatgcgcttaacgtgagcaataagctctacagagaaggatgggacgagatgaaggccggatgcgatgtcagactggacgcgattcccatccaggccgcaaaggcttcccgcgaaattgcaagcgattataaatacaaactcgaccatgagaagcagaaaggacactatgttgggaccctgaccgccagagacgataataagatccggtgggccctgatcgctgacaaacttcaaaatgagcgagagtaccggcttgactgggcgaaatggaaagcaaagatccagtctccagtcgacatgctgagcattttgcactccaaaaacagccaggccctcgtcagtgacatggactacagaaactatcttcatcagtggacatgcatgccagaccagaatgacgttattcaggcaaaaaaggcctatgaattgcagtccgacaatgtgtacaaagcggacctcgagtggttgagaggcatcggctggatgcccaacgattctgtttccgttaatcacgcaaaacatgccgctgacatttttagcgagaagaagtaccggaccaagattgagacgctgaacttcacccccgtggacgacagggttgattatgtcacggctaagcaaagtggcgagatcctggacgacataaaataccgaaaggactggaacgccaccaagtccaaatacaccctcaccgagactccccttctgcacacggctcaagaggcggcaaggatcctcgatcagtatctgtacaaagagggatgggagcgacagaaggcaaccggatacattcttcccccagacgccgtcccattcgtgcacgcccaccactgtaacgatgtgcaaagcgagttaaagtataaagccgaacatgttaaacagaaaggacattacgttggcgtgcccactatgagggacgatcccaaactcgtgtggtttgagcacgccggtcagatccagaatgaaaggttgtataaggaggattaccataaaaccaaagcaaaaatcaacatccctgcagacatggtgtctgtcctggccgctaagcagggccagaccctggtttccgacatagattatcggaactacctccatcagtggatgtgccatcccgatcagaacgatgtgatccaggccaggaaggcctatgatcttcaaagcgacaacgtctacagggctgatctggagtggctgagaggtattggttggattcccctcgactcagttgatcatgtgcgagtgactaaaaatcaagagatgatgagccagattaagtacaagaagaatgcactcgagaattaccctaattttcgtagcgtagtggaccccccagaaatcgtgctggctaaaatcaactccgtcaaccagagtgatgtaaagtataaagaaacattcaacaaggcaaaaggcaagtacaccttttctccagatacaccacacatctctcattcaaaagatatgggaaaattatactccacgatcctatataagggggcttgggagggcacaaaggcatatggttatactctggatgaacgctacatccccattgtgggcgctaagcacgctgatctggtgaactccgagctgaagtacaaggaaacctatgagaagcagaaaggccactatctggccggaaaggttattggcgagttccccggagtcgttcactgcctagactttcaaaagatgaggtcagctctgaactatagaaagcactacgaggatacaaaggccaacgttcacataccaaacgatatgatgaaccacgtcctggctaagcgctgtcagtacatcctctcagacctagagtacaggcactacttccaccagtggacttctctgctggaagagcccaatgtcattcgggtccggaacgcacaggaaatcctgtctgataacgtctataaggacgatttgaactggctgaaggggattggttgttatgtctgggataccccccagattcttcatgctaagaagtcatacgatctccagtctcagctgcaatatacggcagctggaaaggaaaacttgcaaaactataatttggttaccgacacccctctctatgtcactgcggttcaatccggtatcaatgctagcgaggtaaaatacaaggagaattatcatcagattaaggataagtatacaacagtcctggagaccgtggactatgataggaccaggaatctgaaaaatctctatagtagtaacctctacaaagaggcctgggatcgggttaaggcaaccagttacatcctcccgtcctccacattgtcgctaacccatgccaagaaccagaaacatctggctagtcacatcaagtatcgagaggaatatgaaaaattcaaagccttgtatacactgccccgatcagtggacgatgatccaaataccgccagatgtttgcgagtcggcaagctcaacatagacagactgtacaggtcggtttacgaaaagaataagatgaaaatacacatcgtgccggacatggtggaaatggtcaccgcgaaggacagccagaagaaagtttccgagatcgattataggctaaggctccacgagtggatttgtcatcccgacctgcaagtcaacgaccatgtgaggaaagtcaccgatcagatcagcgacatcgtctataaagacgaccttaattggctcaaggggattgggtgctacgtgtgggacaccccggagatcctgcatgccaaacacgcatacgacctcagagacgatattaagtacaaagcccatatgctgaaaacacgcaacgattacaagctcgtgacagatacacctgtctatgttcaggctgtcaaatctggaaagcaactgagcgacgccgtttatcactatgactacgtccactctgtgagaggcaaggtcgcccctactacaaaaaccgtggacttagaccgtgccctccacgcatataaacttcagtcatcgaatctgtataaaactagtcttaggactctgcctacgggataccggcttcccggagataccccccattttaagcatatcaaagatactaggtatatgtctagctattttaagtataaggaggcttacgagcacacaaaagcctacggctacactttgggccctaaggacgtgcccttcgttcacgtgcgccgagtcaataatgtgacgagcgaacgcctgtatcgcgagttatatcataaattaaaggataaaatccataccacacctgacacacctgaaatcaggcaagtgaaaaaaacgcaagaagcagtgtctgagttgatttataagagcgacttctttaaaatgcaggggcacatgatctctttaccttacacaccacaggtgatacattgccgctatgtgggagatattacatcagacatcaaatacaaagaagacctgcaggtgttgaaaggcttcggctgtttcctgtacgatacgcctgatatggttaggagcagacacctccgaaagttgtggtccaactatctgtacactgacaaggccagaaaaatgagggataaatataaagtggttttagacacgcccgagtacaggaaggtgcaggagctgaagacacacctttcagagctggtttatagggctgccggtaaaaaacagaagtcaatttttacaagtgtgccagatacacctgatttgttacgcgcaaaaagaggccagaagctgcagagccagtatctttatgtcgagctggccacaaaggagcgtccccaccatcacgcgggtaaccagaccacagccttgaagcatgccaaggatgtgaaggacatggtgagcgagaaaaagtacaagattcagtacgagaagatgaaggacaagtacacgccagtgccagatacccctatcttgataagggccaaaagagcctattggaatgccagtgatctacgttataaagagacgttccagaagactaaggggaagtaccacacggtcaaggacgcactagacatcgtatatcaccgaaaagtgacggacgacatctctaagatcaagtacaaagaaaattatatgtcccagctcgggatttggaggtccattccagataggcccgaacactttcaccaccgtgctgttaccgatacagtaagcgatgtgaagtataaggaagatctcacttggctcaagggcattggatgctatgcctacgatactcccgatttcaccctggcggagaaaaacaaaacgttgtattctaaatataaatataaggaagtgtttgagcggaccaagagtgacttcaagtatgtagcagactcgcccattaatagacactttaaatatgcgacacaactgatgaacgaaaaaaagtaccgtgccgattatgagcaaagaaaggacaaatatcacctggtggtcgacgaaccaaggcatctgctggccaaaacggctggggaccagatcagccagattaaataccgcaaaaattacgaaaagtccaaggacaagttcacaagcatcgtcgatacaccggaacacctcaggactaccaaagtaaataagcagatttctgatatactgtacaaactggaatacaacaaggccaagcctcggggttacaccactattcatgacacacccatgctacttcatgtgcgcaaagtcaaagacgaagtcagcgatctgaagtacaaggaagtctaccagcgaaacaaatccaactgcaccatcgagcctgatgccgtacacatcaaagctgcgaaggatgcctataaggtgaatacaaatctagactacaagaagcaatatgaagcaaataaggcacactggaagtggacacctgaccggccagactttctacaagctgctaagtcgtctctgcagcagtctgactttgaatacaagctggatcgcgaatttctgaagggctgtaagctttccgtgaccgatgataaaaacacagtgttggctctccggaataccctcatcgagtcggatctcaaatacaaagagaaacacgtgaaggaaaggggaacttgccacgctgttccagataccccccagattctgctcgctaaaactgtctcaaatctggtgagtgagaacaaatacaaggaccacgtcaaaaagcaccttgctcagggcagctacaccacccttcctgagacccgggacaccgttcacgtgaaggaagtgactaaacacgttagtgacaccaactataaaaagaaattcgtgaaggaaaagggaaaaagcaactatagcattatgttggaaccccctgaagtcaaacatgcgatggaggttgccaagaaacagtctgatgtggcctacaggaaagacgcaaaggagaacttgcattacactactgtagcagatagacccgatattaaaaaggccacgcaggccgctaaacaagcttctgaggtcgagtaccgggcaaaacacaggaaggaaggatctcatggcctgtccatgctgggaagacccgacatcgaaatggccaagaaggccgcaaaactctctagtcaggttaaataccgcgagaactttgacaaagaaaagggcaagacaccaaagtacaatccgaaggatagccagctatacaaggtgatgaaagacgctaataatcttgcgagcgaggtcaagtataaagcggaccttaaaaaactccacaaacctgtgactgatatgaaagaatctctgattatgaatcacgtgctaaataccagccagctggcctcaagttatcagtataagaagaagtatgaaaagagtaagggccactatcatacaattccagacaatctcgaacagttacatctgaaagaagctaccgaactgcagagcattgttaagtacaaggagaagtatgaaaaagagcggggtaagccaatgctggatttcgaaactcctacctatataaccgctaaggaaagccagcagatgcagtccgggaaggagtaccgtaaagattatgaggaaagcattaagggcagaaacctcaccggcctggaggttactcctgcccttctccatgtaaaatacgcgacgaaaattgccagcgagaaagaatataggaaggatctcgaggagagcataagaggaaagggtcttactgagatggaggacactccggatatgctgcgggcaaagaatgccacacagatcctgaacgaaaaagaatataagcgggacctcgagttggaagtgaaagggagagggttaaacgccatggccaatgaaacccctgatttcatgcgggcaagaaacgccaccgatatcgcatcccagatcaagtacaaacagtcagccgagatggaaaaggccaacttcacttccgtggtcgatacacccgaaatcatccacgcacaacaggtgaagaatttgtcttctcagaagaaatacaaggaggacgcagaaaagtctatgagttactacgagactgtgcttgacacacccgaaattcagagggtccgggaaaatcagaagaacttctccctgctccaataccagtgtgatcttaaaaattcaaaaggcaaaatcacggtggtgcaggatacgcccgagattcttcgtgtcaaggagaaccagaaaaacttctcctctgtgctttacaaagaagacgtgtcacctgggaccgccatcggtaagacgccggagatgatgcgagtgaagcagacccaggatcacataagctcagtgaaatataaggaggctatagggcagggcaccccaatccctgaccttccagaggtgaagcgcgttaaagaaacccaaaagcatatctccagcgtgatgtataaagagaatctggggactggtatccccacaacagtgacgcctgaaatagagagggtgaaaagaaaccaggaaaatttcagcagcgttttgtacaaagagaatcttggcaagggtatccccacaccaatcacacccgagatggaaagagtgaaaaggaaccaagagaattttagtagcgtcctctataaggaaaacatggggaagggcactcccctagctgtgaccccagaaatggaacgcgtcaaacacaaccaggagaacatctcctccgtcctctataaagaaaacgttggtaaggccacggccacccccgtcacccctgagatgcagcgtgtgaaacggaaccaagaaaatatctcgagtgtgctatacaaagagaacctgggcaaggctactcctacaccttttacaccggaaatggagcgagtgaagcgaaaccaggagaacttctcttcagtgctctacaaagagaatatgcgcaaggccactcccactcctgttacacccgagatggagcgggctaagcgcaatcaggagaacatctccagcgttctttattcagattctttcaggaagcagatccagggcaaggcggcttatgttctggataccccagagatgcgccgtgtgagagaaacccagcggcatatctcgaccgtgaaatatcacgaggacttcgaaaaacacaagggatgctttactcccgtggtgacagatcccattaccgagagggtcaagaagaacatgcaggatttcagcgatataaattatcgaggtatccagcgaaaggtggtggagatggagcagaagagaaatgaccaggaccaggagacaatcacaggcctgcgtgtgtggagaactaatcccggttcggtgtttgactatgatccagccgaggacaacattcagagccggtccctccacatgataaatgtgcaagcgcagcgcaggagcagagaacagtctagaagcgcctctgctctcagcataagcgggggagaggagaagagcgagcacagtgaggccccagaccatcatctgtcaacttattccgatggaggcgtattcgccgtcagcaccgcctataaacacgctaaaactacagaactcccccaacagcgctctagcagtgtggcgacacaacagacaaccgtgagcagcattccatcccatcctagcacggcaggcaaaattttccgtgctatgtatgactacatggccgcagatgctgatgaggtaagctttaaagatggagatgccattataaacgtgcaagccattgatgagggatggatgtacggaacggtacagagaacggggcgaacgggcatgttgcctgctaattacgtggaggcaatttaa

SEQ ID NO: 232123 - DNA, 25577 bp, Artificial Sequence
  Description of Artificial Sequence: Synthetic coding sequence
atggcagatgacgaggattacgaggaagttgtcgaatattataccgaggaggtggtgtacgaagaagttcctggggaaacaatcacaaaaatctatgagaccaccaccactcgtaccagtgactacgaacagagtgagaccagcaagccggctctggctcaacccgctttggctcagcccgcaagcgccaagcctgttgagagaaggaaggtaatccgaaaaaaggtcgaccctagcaaatttatgaccccctatatcgcacactcccaaaagatgcaggatttgttctcccccaacaaatacaaggagaagtttgaaaagaccaagggccagccgtacgcgtccacgaccgatacccccgaactgcgcaggatcaagaaagttcaggaccagctctcagaagtgaaataccgcatggatggcgacgtcgccaagaccatttgtcatgtggacgagaaggccaaggatatcgagcacgccaagaaagtgtcacagcaagtgagtaaagtgttgtataaacaaaactgggaggatacgaaggacaagtacctgctgcccccagacgctccagaactggtgcaggccgtgaaaaacaccgctatgttctccaaaaagttgtacactgaggattgggaggctgacaaatccctattttacccttacaatgactcacccgagttgagaagggttgcccaggcccaaaaggcactctccgatgtggcgtataagaaaggattggcagaacagcaggcacagtttacacccctcgccgatccacccgatatcgaatttgccaaaaaagtgaccaatcaggtcagtaaacaaaagtataaggaggattacgagaacaaaattaaggggaagtggagtgaaaccccttgtttcgaagtcgctaacgccagaatgaacgcggataacatcagcacccggaaatatcaggaagactttgaaaatatgaaggatcagatttatttcatgcagactgaaacccccgaatataagatgaacaagaaggcgggagtcgctgctagcaaggtgaagtacaaggaggattacgagaaaaacaaagggaaggccgactacaacgtgctgcccgcaagtgagaatccgcaactgagacaactcaaggctgctggcgatgctctgtctgataaattatataaggaaaactacgaaaagacaaaggcaaaaagtattaactattgcgaaactcccaagttcaagcttgatacagtcctccagaacttttcatcagataaaaaatacaaagacagctatctgaaggatatccttggccattatgtcggctcattcgaggacccataccactcccattgcatgaaagtgacagcccagaattccgacaaaaactataaagcggagtatgaggaagaccggggtaagggcttctttccacaaacaatcacgcaagagtatgaggctattaaaaagctcgaccagtgcaaagatcacacgtacaaagtgcatcccgacaaaacgaaattcacgcaggtcacggactcaccagtgttactccaagctcaagtgaattcgaagcagctaagcgacctgaactacaaagccaagcacgagagcgagaagttcaagtgtcacataccacctgatactccggctttcatccagcataaggtgaatgcatacaacttgagcgataatttgtataaacaggattgggaaaaaagtaaagccaaaaaatttgacattaaggtggatgcaatccccctgctcgctgccaaagctaacactaagaacacatctgacgtgatgtacaaaaaagactatgagaagaacaaagggaagatgattggagttttgtcaatcaatgatgacccaaaaatgctccacagcttaaaggttgccaagaatcaatcagataggttatacaaggagaattacgagaagaccaaagccaagtctatgaattactgcgagacacccaaataccagctcgatacacagcttaaaaacttctctgaagccaggtacaaagatttatatgtgaaggacgtcctcggtcactatgtcggctccatggaagatccttatcacacacattgtatgaaagtggccgcacagaattctgataagtcttataaggccgaatatgaggaggataaggggaaatgttatttcccccaaaccataacgcaggagtatgaagcgattaaaaagctcgatcaatgtaaagatcatacttacaaggtccaccctgacaagaccaagttcacggcagtgacagattcaccggtcctgctgcaggcccagctcaacactaagcaattatccgatctgaactataaggccaaacacgagggtgaaaagtttaagtgccacatccccgcagatgctccccagtttattcagcaccgagtcaacgcctataacctgtctgacaacgtgtataagcaagattgggaaaaatctaaggcaaaaaaatttgacatcaaggtggatgcaatcccactcctcgccgctaaggccaacacgaagaacacgtcagacgtgatgtataaaaaggactatgaaaagagtaaggggaagatgatcggagcgctgtcaataaacgatgacccaaagatgctccactccctgaaaacggctaagaatcaatctgatagagagtaccgcaaggactacgagaagtctaaaacaatctataccgccccattggacatgctgcaggtcacacaagccaagaagtcacaggctattgcatctgatgtagattacaagcatatcctacatagctatagctaccctccggattcaatcaatgtggaccttgccaaaaaagcgtatgctttacagagcgatgttgagtacaaagctgattataattcttggatgaaggggtgtggttgggtgcccttcgggagtttggagatggagaaggccaaaagagcatccgacattctgaatgagaagaagtaccgtcaacaccctgacacccttaaatttacctcaattgaggacgccccaattacagtgcaaagcaaaatcaaccaagctcagcgtagtgatatcgcatacaaagccaagggggaggaaatcatacataagtacaacttaccgccagacctcccccagtttattcaggccaaagttaatgcgtataacatatctgaaaacatgtacaaggcagatctgaaggacttgagcaagaagggctacgatctgaggacagatgctattccgatccgggctgctaaagccgcacgtcaagcagcttcagatgtgcaatacaaaaaagactacgaaaaggccaaggggaagatggttggatttcagtcgttgcaggacgacccgaagctcgtgcactacatgaatgtggctaaaattcagtcggatagggagtataaaaaggactatgagaagaccaagtctaagtacaatacaccacacgatatgtttaatgtcgtggctgccaaaaaagcccaggacgtggtatccaacgtgaactataagcattccctgcatcactatacatacctgcctgatgctatggatttggagctgagcaagaatatgatgcagattcagtcggacaatgtttataaggaggactacaataattggatgaaggggatcggatggataccaattggatcactcgacgttgagaaggttaaaaaggccggtgacgctctgaatgagaaaaagtaccggcagcaccctgatacacttaaattcacctcaattgtcgactctccggttatggtgcaggcaaagcaaaatacaaagcaggtgtctgatatcctgtataaagctaagggagaagacgtcaagcacaagtataccatgtctcccgacctacctcagttcctacaagcgaagtgtaacgcctacaacatctccgatgtctgctataagagagattggtatgacctcatagccaaagggaataacgtcctcggagatgccatacctataacagccgctaaggcttcaagaaatatcgcttccgactacaagtacaaggaagcgtatgagaaaagtaaggggaaacacgtagggttccgaagcctgcaagatgacccaaagctggttcattacatgaacgtggccaagttgcaatcggacagagagtataagaaaaactatgaaaataccaagaccagctaccacacacctggggatatggtttccataacagccgctaaaatggcccaggatgtggctacaaatgtgaactacaagcaaccgctccaccactatacatacttgccagatgccatgagtttggaacacaccaggaacgttaaccaaattcagtccgataatgtgtacaaggacgagtataacagctttctcaagggcatagggtggatccctatcggatcattggaagtcgaaaaagtgaaaaaggcaggcgacgcgctgaacgaacgaaagtacagacagcatcctgacaccgtgaagttcacgagcgtgcccgacagcatgggaatggtgttagcacaacataacaccaagcagctctccgacctgaattacaaggtggagggggagaaactgaagcataagtataccattgacccggaactcccccaattcatccaagccaaagtgaatgctttgaatatgagcgacgcccattacaaagctgactggaagaaaactatcgccaaaggttatgacctgcggcctgatgccattcctatcgttgcggcaaaatcctctagaaatatagccagcgattgtaaatataaggaggcatatgagaaagccaaaggcaagcaggtgggctttctttccctgcaggacgatcctaaacttgttcactacatgaatgtcgcgaagattcagtccgatcgagaatacaagaaaggatatgaggcaagcaaaaccaagtaccatactcctctcgacatggtgagtgttaccgctgcaaagaagtcccaggaggtggctacaaacgcaaactacaggcagagctatcatcactacaccctgctgccagatgctcttaacgtggaacactctaggaacgcaatgcaaattcagagcgataacctttacaaatctgattttactaattggatgaaaggaattggctgggtgcctattgagtcattagaggtcgagaaggctaagaaggccggagaaatcctcagtgagaaaaagtacaggcaacacccagaaaagctgaaattcacgtacgcaatggacactatggaacaagctctgaataaatccaataagttgaacatggataagcgcctgtacaccgaaaagtggaacaaagataaaacaactatccatgttatgccggatacaccagatattctactgtctagggttaaccagatcacaatgagcgacaaactgtataaggccggatgggaagaggaaaagaagaagggctatgacctgagacccgatgccatagcaatcaaagcggcacgggcaagccgggacatcgcttccgattataagtataagaaggcctacgagcaagctaagggaaaacatatcggctttagatcactcgaggacgatcccaaattagtccatttcatgcaggtcgctaaaatgcagagcgatagagaatataaaaaggggtacgaaaaatcaaaaacttccttccacaccccagttgacatgctgtccgttgtggccgcaaagaagagccaggaggtggccacaaacgctaactaccgcaacgttattcatacttacaacatgctcccagatgctatgtccttcgaactggccaaaaatatgatgcagatccagagcgataaccagtacaaggcagattatgcagactttatgaagggcataggctggctgcctctcggcagcctcgaggcagagaagaataagaaggctatggagatcatcagcgagaagaagtatcgccagcatccagacacactaaaatacagcacccttatggacagcatgaacatggtcctggcccaaaataacgcgaaaatcatgaatgaacatctctataagcaggcatgggaggcagataagacaaaagtccatatcatgccggacatcccacaaataatcttggcgaaagcaaacgcaattaacatgtccgacaaattatataaactgtctttagaggaaagcaaaaaaaaaggctatgatcttcgccctgatgctatcccgattaaggcggcaaaggcatccagggacattgctagcgattacaaatacaaatataattatgagaaagggaaaggtaaaatggtcggcttccgatccctcgaggacgaccccaagctcgtgcactccatgcaggttgccaagatgcaaagtgatcgtgagtataagaagaattatgagaatactaagacttcttatcatacacctgccgatatgctgtccgtgaccgccgcaaaggatgcacaagccaacattactaacactaactacaaacacctgattcacaagtatatactgctgcccgacgccatgaacatcgaactcacaagaaacatgaatcgaatccagagtgacaatgagtacaagcaggattacaatgaatggtataagggtcttggatggtcccccgcaggaagcctggaggtcgagaaagccaagaaggctactgagtatgcctctgaccagaagtaccgccagcatcccagtaatttccagtttaagaaattgacagacagcatggacatggtgctcgccaagcagaatgcgcacacaatgaataaacacctgtatactattgactggaataaggacaagaccaaaattcacgtcatgcccgatacgccagacattctgcaagcgaagcaaaatcaaaccttgtatagccaaaagctgtacaagctgggctgggaagaggccctgaagaaaggatatgacttgcctgtagatgcaattagcgtgcagctggctaaagcaagccgagatatcgcgagcgactacaagtacaagcaggggtataggaaacaactcggtcaccatgtggggttccggtctcttcaggacgaccctaaactggtcttgagcatgaacgtggcaaagatgcagtcggagagggagtacaaaaaagacttcgagaagtggaagaccaagttcagctctcctgtagacatgttgggcgttgtgctggcaaagaaatgtcaggagctggtgtcagatgtggactacaaaaactatttgcaccagtggacatgcctgcctgatcagaacgacgttgtccaggctaaaaaggtctatgaactccaatcagagaatttgtacaaaagcgatttggagtggctgcggggtataggctggtctccattgggcagcctggaggcggaaaaaaacaagcgggcatctgaaatcatatctgagaaaaagtaccgacagccccctgatcgtaataaattcacctccatacccgacgcaatggacatcgtgcttgctaagacgaatgccaaaaacagatcggatcggctgtatcgcgaagcatgggataaagataaaacccagattcacattatgcctgacacaccggatattgtgctagccaaagctaatctgataaacacgagcgataagctgtatcgtatgggctacgaggagctgaaacgaaagggatacgatctgcctgtggatgccataccaataaaagccgctaaggccagcagagagattgcttctgagtacaaatataaggagggcttcaggaagcagctgggccaccacatcggcgctaggaatattgaggacgaccccaagatgatgtggagcatgcacgttgccaaaatccagtctgatagggagtataaaaaagactttgaaaaatggaagactaaattctccagtcctgtagatatgctgggggttgttctggcaaagaagtgccagacactggtctccgacgtagactacaagaattatttgcaccagtggacatgcctgcctgatcagagtgacgtgatccatgcaagacaggcttacgaccttcagagcgataatctgtataaatccgatttgcagtggttaaaggggattggctggatgacttcaggttcattagaggacgaaaagaataagcgcgctacacagattctcagcgatcatgtttaccgtcagcacccagaccagttcaaattttcgagtctcatggatagcattccaatggtgctggcaaaaaacaatgcaattactatgaatcatcgtctgtataccgaggcctgggataaagataaaaccaccgtgcatatcatgccagacaccccggaggtgctactggccaagcagaacaaggtcaattatagtgagaagctctataaattaggcctggaggaggcaaaacgaaaagggtatgatatgagggtggacgcaattcccataaaagccgcaaaggcctcaagagatatagcgtcagaatttaagtataaagagggataccggaaacagctagggcatcacatcggagccagggctattagggacgatcccaagatgatgtggtcaatgcacgtggcgaaaatccagagcgacagggaatataagaaggactttgagaagtggaaaacaaagttctctagtccagtggatatgctcggggtcgtgctcgctaaaaagtgccagacactggtgagcgacgtcgactataaaaactacttgcaccagtggacctgccttcctgaccagtccgatgtgatacacgctcggcaggcctacgacctgcaaagcgacaacatgtataaatctgatctgcagtggatgcggggaatcggctgggtgtcaatcggaagtctggacgtcgaaaagtgcaagagagctaccgagatactgtccgacaagatttaccgacagccacctgatcgctttaagtttacatctgtcacagactctctggaacaggtcctggcgaaaaacaatgctattacgatgaacaaaagactctacaccgaggcgtgggataaagataaaacacagatccacatcatgccagacaccccagagatcatgctagctagaatgaataagattaactactccgagtccctctacaagctggcgaatgaagaagcaaaaaaaaagggttatgacctccggtctgacgccatccctatcgtcgccgctaaggcgagtcgcgatatcatcagcgattacaagtacaaggacggctattgtaagcagctgggacaccacattggggcacgaaatatcgaggatgatccaaaaatgatgtggagcatgcacgtcgctaagatccagtccgacagggaatacaagaaagatttcgaaaaatggaagacaaagttttctagtccagtcgacatgctgggcgtggtgttagccaagaagtgtcaaaccctagtgtcggacgttgattacaagaattatttacacgagtggacatgcctccctgatcaatccgacgtcatccatgcccgacaggcatacgatctgcagagcgacaatatttacaagtctgacctccagtggctgcggggaatcggatgggtaccaatcggctccatggacgtcgtgaaatgtaagcgagccactgagattctgagcgataatatttaccgacagccacctgacaaacttaaatttacctcagtcaccgattctctggagcaggttctcgccaagaacaacgccctcaacatgaacaagcggttgtacaccgaggcatgggacaaggacaagacacagatacatataatgccagacacccctgaaattatgctggctcgccagaataaaatcaactacagtgaaacgctgtacaagctggctaatgaggaagccaagaagaaaggctatgacctgcgctctgatgctattccaatcgtggccgcaaaagcctctcgcgacgtcataagcgactacaaatataaagatggataccgaaaacagctcggtcatcatattggggctcgaaatattgaggacgaccctaagatgatgtggtccatgcatgtagccaagatacagagtgacagggaatacaagaaagatttcgaaaaatggaagaccaagttctcatcacctgtggatatgctcggcgttgttctggccaagaagtgtcagacattggtgagtgacgtggactataagaactatctgcacgagtggacatgtctccccgatcagaacgatgttattcatgccagacaagcctatgacctccagtctgacaacatctacaagtctgacttgcaatggctgcgtgggatcggctgggtcccgattggatccatggacgtggtgaagtgtaagcgtgctgccgagatcctgtccgataacatttaccgtcaacctccagataagctcaaattcacctcggtcactgactccttagagcaggtcctagccaaaaataatgcccttaatatgaataagaggctttacacagaagcctgggataaagacaagactcaggtgcacatcatgcctgacacgcctgagataatgctcgccaggcagaacaaaattaattacagcgagtcattgtatcgccaggccatggaggaggccaaaaaggagggatatgatctccgcagtgacgccattccaatcgtggctgcaaaagcatcacgcgatattgcgtccgattataagtacaaggaagcatacagaaaacagctgggtcaccacatcggggctagggccgttcatgatgatccaaagatcatgtggagcctacacattgcaaaggtgcagagcgaccgggaatataaaaaggacttcgaaaagtataaaacacgctacagctcacctgttgatatgttagggattgtgctggctaagaagtgtcagactctggtgtccgacgtcgactacaaacatccactgcacgagtggatttgtctgcccgaccagaatgatatcatccatgccagaaaggcatatgatcttcagtctgataacttgtacaaatctgacctagagtggatgaagggcattggctgggtcccaatagatagcctggaggtggtcagagccaaacgggcaggcgagctactgagcgacaccatctatagacaaaggccagaaacattaaagttcacaagcatcaccgacacgccagaacaggtattggctaagaacaacgcgctcaacatgaataagaggctgtacacagaagcatgggacaacgacaagaagactatccacgtcatgccagatacacctgagattatgctggccaaactgaatcgtataaattattcggacaagctctataaactggcgttggaggagtccaaaaaggaaggttacgatttgagactcgacgcaattccgattcaggctgccaaggcaagcagggatattgcctccgattacaagtataaagagggatatagaaaacaacttgggcaccatatcggggcaagaaacatcaaagatgacccgaaaatgatgtggagcatccacgtggccaagatacaaagtgacagggaatacaagaaagagttcgagaaatggaaaacgaaattcagtagccctgtcgatatgcttggcgtggtgctcgccaagaagtgccagattctcgtgtctgatattgactataaacatccactgcacgaatggacgtgtcttcctgatcagaacgacgtcatacaggctcgcaaggcctatgatctgcaaagcgacgccatctacaagtctgatctggagtggctgcgcggtattggctgggtcccaatcggctcagtagaagtggagaaagtcaaacgggctggggagattctgtccgaccggaagtaccggcagccagccgatcagcttaaattcacgtgtattactgatactcccgagattgtcttagctaagaataacgcgcttacaatgtctaaacacctgtacacagaggcctgggacgccgacaagacatccatacatgtgatgccagacacaccggacatccttctcgcaaagtctaacagcgcaaacatttcacagaagttatataccaaaggctgggatgaaagcaagatgaaggattatgacttgcgcgctgacgccatctcaatcaagtccgccaaagcaagtagggatatcgcttccgattacaagtacaaagaggcctacgagaagcaaaaaggtcaccacatcggagcacagtctatcgaagatgatccgaaaatcatgtgcgctattcatgcgggaaagatccagagtgagcgtgaatataagaaggagtttcagaaatggaagactaagttcagctcccccgtcgatatgcttagtattttgctagccaaaaaatgtcagacccttgtgaccgacatcgattaccgcaattatctgcatgagtggacctgtatgccagaccagaatgatattattcaggccaaaaaagcttatgacttgcaatccgatagtgtatacaaagccgatctggaatggctgcgtggaatcggctggatgccggaggggtctgtagagatgaaccgagtgaaagtagcccaggacctcgtgaacgaacggctgtaccgcactagaccagaagcccttagtttcacgagcatagtcgacacccccgaggtggtccttgctaaggcaaacagtctgcagatcagcgagaagttgtatcaagaggcctggaataaagacaagtctaacatcacaatcccaagcgatacgcccgagatgttgcaggcccatattaacgcactgcaaattagcaataaactgtaccagaaagattggaacgatgcaaaacaaaaaggttatgatattcgagcagatgccattgagattaagcatgctaaggcctcacgggagatcgccagtgaatataagtataaagagggataccgtaaacagctgggacatcatatggggtttagaaccctacaagatgaccccaagagcgtgtgggccatccatgcagcaaagatccaatccgatagagagtacaagaaagcctacgagaagtctaaggggatccacaatactccgctggacatgatgtcgatcgtccaggccaaaaagtgccaggttctggtttctgacatagattacagaaattaccttcatcagtggacatgcctccccgatcaaaatgacgtgatccaggcaaaaaaagcttatgacctgcagagtgacaacctatacaagtctgacctcgagtggttgaagggcattggttggctcccagagggatcggtggaggtgatgagagtgaagaacgcccagaacctgttgaacgagcggttgtaccgcattaagccagaagccctgaagttcactagcattgttgatacacctgaagtcattcaggctaagattaatgccgtgcagattagtgagccactttatcgggacgcgtgggagaaagaaaaagctaatgtgaatgtgccagccgatactccgctgatgctacaatccaaaatcaacgccttgcaaattagcaataagagataccaacaggcatgggaggacgtgaaaatgaccggttatgatttgagggccgatgctatcgggatccagcacgccaaagcatctagagatattgcatcggactatctgtataagacagcctatgagaagcagaagggtcattacattggttgccggtccgccaaggaggatccgaagctggtctgggcggctaacgtattaaagatgcagaatgatagactctataaaaaggcttacaatgaccacaaagccaaaatttccattccagtcgacatggtgtccatcagcgcagccaaagaaggtcaagcgctggcctccgacgtggactatagacactatctgcaccattggtcttgctttccagatcagaacgacgtgatccaggccagaaaagcctatgacctgcagtctgattctgtgtacaaagcagacttggaatggctccgaggcatcggctggatgcccgaaggctctgttgagatgaatagagttaaggtcgcgcaggatctcgtgaacgaacgtttgtatagaacgagacctgaagccttgagcttcacatcaatcgtggacacgcctgaggttgtgctggctaaggccaactccttgcagatctccgagaagctttaccaggaggcgtggaataaggacaaaagtaacataacaataccatccgacacaccagaaatgcttcaagcccatattaacgcactccagataagtaacaagctataccaaaaagactggaatgatacaaagcagaaaggctacgatattagagctgatgcaatcgagatcaagcatgcaaaggcgtcaagagagatcgcttcggagtacaaatacaaggaggggtacagaaaacaactaggccatcatatgggctttcggactctccaggatgatcccaagagcgtgtgggcaattcacgctgctaaaatccagtcggacagagagtacaaaaaagcatatgaaaaaagtaagggaatccataatacgccactcgacatgatgtccatcgtccaggccaagaagtgtcaggttctggtttcggatatcgactataggaattacctgcaccagtggacatgcttaccagatcaaaatgacgttattcaggcaaaaaaagcatatgatttgcagtccgataacctgtacaagtcggacctggagtggctcaaaggaataggttggctcccagaaggcagtgtggaggtgatgcgcgtgaagaacgcccaaaatctacttaatgagaggctctaccgaattaagccagaagccttgaagttcacctcaatcgtagataccccggaagtaatccaggccaaaatcaatgctgtgcagatctctgagccactatacagaaacgcgtgggaaaaggaaaaggctaacgtgaatgtcccagcggatacacctctcatgctacagagtaagattaacgccctccagatttctaacaagcgataccagcaggcctgggaggatgtcaaaatgaccgggtacgacctgagagccgatgcgattggaatacagcatgcaaaggcatccagagacatcgcctctgattatctctacaaaacagcctacgaaaagcagaaggggcactatattgggtgccggtccgcaaaggaagacccaaaactggtctgggcagccaacgtcttgaaaatgcagaatgatagattgtataagaaggcctacaatgatcacaaggccaagatctcaatccccgtggacatggtctccatttcagcagcaaaggaagggcaggcgctcgccagcgacgtcgactatcgccattacctgcaccactggagctgttttccagaccagaacgacgttatccaggccaggaaagcttatgatctgcagagcgatagtgtgtataaggctgatctggaatggttgagagggatcggatggatgccagagggcagcgttgagatgaatcgggtcaaggtggcccaggatctcgtgaatgagcgtctgtaccggacacgccctgaggccctctcctttacatcgatcgtggataccccggaggttgtgctggcaaaagctaattccctgcaaatctctgagaagttgtaccaggaagcttggaataaggacaagtcgaacatcacgatcccttccgatactcctgaaatgctgcaagcccatattaatgcccttcagatctccaataagctttaccagaaggattggaacgatactaagcagaaaggatatgacatccgcgcagacgccatcgaaattaaacacgccaaggcctctagagaaattgcctcagaatataagtataaggagggctataggaaacagttgggacatcacatggggttcaggactttacaagacgacccgaaaagcgtttgggctatccacgccgcaaagatccagtctgatagggaatataaaaaggcgtatgagaaaagtaagggtatccacaacactcctctggacatgatgtctatcgttcaggcgaagaaatgtcaggtgctggttagcgatatcgactacaggaactatctgcaccagtggacttgcctgcccgaccaaaatgatgtgatccaggccaaaaaggcttacgacctacagtcagataatctatataagagcgatctggagtggttgaagggcatagggtggttgccggagggtagcgtggaagtcatgagggttaagaatgcacagaatctgctgaatgagagactgtatcgtattaaacccgaggcccttaagttcacatcaatagtggatactcccgaggtgatacaggccaagattaacgcagttcagattagtgagccactttaccgcgacgcatgggagaaggagaaggcgaacgtaaatgtgcccgcagatacccccctgatgttacagtcaaagatcaacgctcttcagatttccaacaagagatatcagcaggcatgggaagacgtcaaaatgacaggctacgatttgagagcagacgcaatcggtatccagcatgccaaagctagccgtgatatcgcatcagactatctctataagaccgcgtacgaaaagcaaaaaggacattatattggttgcagatccgcaaaggaggacccaaagctcgtgtgggcagcaaatgtactgaaaatgcagaatgataggctgtataagaaagcatacaacgatcacaaggctaagatcagcatccctgtggacatggtctctatctctgccgcaaaggagggccaagcacttgcttcggacgtagactaccgtcactacttacaccggtggtcgtgtttcccagatcaaaatgacgtgatccaagctcgcaaagcatatgaccttcaatcggatgcattatataaagccgatcttgagtggctcagggggatcggatggatgcctcagggctcgcctgaagtgctccgagtcaagaacgcacaaaacatattctgtgactctgtgtacaggaccccagtagtaaacctcaagtacactagcatagtggacactcccgaggtagttctagccaaaagtaacgccgagaatattagcatcccaaagtatcgcgaagtttgggataaagataaaacctcaattcacatcatgccggacactccagaaatcaacttggcacgggcaaatgcattgaatgtctctaacaagctttacagggagggatgggacgaaatgaaggccggttgcgatgtgcggttagacgccatccctatacaggctgccaaggccagtagagagatcgcctcggactataaatacaaactggatcatgagaaacagaaggggcactacgtcggcacactcaccgcgcgtgacgataataagattcggtgggcattgatagccgacaagctgcagaatgagagggaataccgtctggattgggctaaatggaaggctaaaattcagtctcccgttgacatgctgagcatcttacacagtaagaatagccaagcattggtgtcagacatggactaccgcaactatctgcatcagtggacctgtatgcccgaccagaacgacgtgatccaggctaaaaaagcctacgagttacagtccgacaacgtttataaagctgatttagagtggttacgagggatcggctggatgcctaacgattctgtttccgtaaatcacgccaagcacgcagccgacatttttagcgaaaaaaaataccgaacaaaaatcgaaactctcaactttacccccgtagacgacagagtcgactatgtgactgccaagcagtccggtgaaatactcgacgatataaaatatcggaaggattggaacgcaacaaagtctaaatacacacttactgagacacccctgctgcacacagcacaggaggcagccagaatactggatcagtatctgtacaaggagggatgggagcggcagaaagccaccgggtacatcctgccaccagatgcagttccctttgttcacgctcaccactgcaacgatgtccagtctgagcttaagtacaaagccgaacacgttaagcagaagggacactacgtaggagtccctacgatgcgcgatgatccaaaactcgtgtggttcgaacacgcaggccagattcagaatgagagactctacaaggaggactatcacaagactaaggccaaaataaacatccctgcagatatggtcagcgttctcgccgcaaaacagggccagacattagtctcggacattgattacaggaactatttgcaccagtggatgtgccatcccgatcagaacgacgtaattcaggcacggaaggcttatgatctgcagtctgacaacgtgtaccgcgctgatttagagtggctgagaggaatcgggtggattcccctagattctgttgatcacgtgagagtcaccaaaaatcaagagatgatgtcccagattaaatacaaaaagaatgcccttgagaattatccaaatttcaggagcgtcgtcgatcctcccgagattgtgctggctaaaataaactccgtaaatcagtcagacgtgaagtataaggagaccttcaacaaagcaaaaggcaaatataccttcagccctgacactccccatatttcccacagcaaagatatgggaaagctttacagtacgatcctgtacaaaggggcatgggagggcactaaggcctacggttacacactggacgaaaggtacatccctatcgtaggcgctaaacatgcagatctggtcaactccgagcttaagtacaaagagacatatgagaagcaaaaagggcactatctggcagggaaggtgatcggcgagttcccaggggttgtgcattgccttgacttccaaaagatgcggagtgccctgaactatagaaagcactatgaggacaccaaggctaatgtacatatcccaaacgacatgatgaatcacgtactggctaaacgttgtcagtatatcctcagtgatttggagtaccgtcactacttccaccagtggactagcctgctggaagagcctaacgtaatccgcgttcgaaacgcgcaggagattttaagcgacaacgtctacaaggatgacctgaactggttgaaagggattggatgctacgtctgggatacgcctcagatactgcacgctaaaaagagctatgatctgcagagccagttacagtatacagccgcagggaaagaaaatcttcaaaactataatttggtcacagataccccattatatgtgacagctgttcagtctgggatcaatgcctccgaggttaagtataaggagaactatcaccagataaaagacaagtatacaactgtgctggagacagtggattatgaccgcacaaggaatttgaaaaacctatattcctcaaatctctataaggaggcctgggatagggtcaaagccacgtcatacattctgccttcttccactcttagcctcactcatgcaaagaaccagaagcacctggcgtcccacattaagtatcgcgaggagtatgagaagtttaaggcactgtataccctgcccaggagcgtggacgatgatcctaatactgcacgctgcctgcgagtcgggaagctgaatattgaccggctgtaccgctctgtgtatgagaagaacaagatgaagatacacatcgtgccggacatggtggagatggtcacggccaaggattctcaaaagaaggtcagtgaaattgactacaggctgagactgcatgaatggatctgccaccctgatttgcaggtgaacgatcacgtgagaaaggtgaccgatcagatctcggacatcgtatacaaagacgacctgaattggctcaagggcataggatgttacgtttgggacacacctgagattctgcatgcgaagcatgcttatgacctgcgagatgatatcaagtataaggcccatatgctgaaaacccggaatgattataagctggttacagacacgcccgtttatgtccaggctgtaaagtcgggtaagcagctgagcgacgccgtataccactacgattacgtccactctgtgcgcggaaaagtcgcaccgacaacaaaaaccgtggacttggatcgggctttgcatgcttataaactacagagtagtaacctttataaaacctcactgcggacactccctactggatatagactgcccggtgatacacctcactttaagcatattaaagacacacgctatatgtcatcttacttcaagtataaagaggcttatgagcatactaaagcttacggctataccctagggcctaaagacgtaccctttgtgcacgtgagacgagttaacaacgtgacaagcgagaggttgtacagggagttataccacaagctgaaggataagatccacacaacccccgatactcccgagataagacaggtaaagaaaacacaggaagccgtcagcgaactgatttataaatccgactttttcaagatgcagggccacatgatcagcctgccatacacccctcaagtgattcactgccgatacgtgggcgacatcactagcgacatcaaatacaaggaggacttgcaggtgctgaaaggtttcggttgtttcttgtacgacaccccagacatggtgcggtcccgacatttgaggaaattatggagcaactatctgtacaccgataaagcaagaaaaatgcgcgacaagtataaagtagtcctagacacacccgagtaccgaaaagtgcaggaattgaagactcatctcagcgagctggtgtacagggccgcaggcaaaaagcaaaagagtatttttacttcagtcccagataccccagacttgctcagggccaaacgcggacagaaactccagtctcaatacctgtatgtggaactagctactaaggagaggcctcaccatcacgcgggaaatcagactacggctttaaagcacgcaaaagacgttaaggatatggtctcagaaaagaagtataagatccagtacgaaaagatgaaagacaaatacacccccgtaccagacacacctatcctgattcgagccaaacgcgcttactggaatgcaagcgacctgcggtacaaggagacattccagaagaccaagggtaagtaccacacggtaaaggatgctctggacattgtctatcacaggaaagtcaccgatgatatctccaaaattaaatataaagaaaattatatgagccaactgggcatatggcgaagtatccctgaccgaccagagcacttccatcacagggccgtgaccgataccgtgagcgacgtcaagtacaaggaggacctgacttggcttaagggcattggttgctatgcttacgataccccagatttcacactggccgagaaaaataagactctttattcgaaatacaagtataaagaggtatttgagagaacgaagtccgatttcaagtatgttgctgacagtccaattaacaggcattttaagtacgcaactcagctgatgaacgaaaagaagtatagagccgactacgaacagcggaaggacaagtatcacctggtggtagacgagcctaggcatctgctggccaagacagcaggcgatcaaatttcacagattaagtataggaagaactacgagaagtcgaaagacaagtttacaagcatcgttgacacgccggagcacctccgaacaactaaagtaaataaacaaatcagtgatattctctacaaactggaatataacaaggcgaaacctcgcggatacaccactatccatgatactccgatgctgctacacgtcagaaaggttaaggacgaggtgtcggaccttaagtacaaagaggtttatcagcggaacaaaagtaactgtaccatcgagcctgatgctgttcatattaaggctgccaaagacgcctacaaggtaaacactaatctggattacaagaagcagtacgaggcaaacaaagcacactggaaatggaccccagacagacctgactttttgcaggcagctaagagcagtctccaacagtccgacttcgaatacaagctggatcgggagtttttgaaaggctgtaagttaagcgttactgacgacaaaaatacagttctcgcactgagaaacacgctgattgagtccgacctgaaatataaagagaaacatgtgaaagagagggggacctgtcacgccgtcccagacacaccacagattctgctggccaagaccgtgtcaaatctggttagcgagaacaagtacaaggatcatgtgaagaagcatttagcacaagggagctacactacattgccagagactagggacacagtgcacgtcaaggaagtgactaagcatgtttctgatactaactacaagaagaaatttgtgaaagagaaggggaaatccaattattctatcatgctcgaaccacccgaagtgaagcatgccatggaggtggcaaagaagcaaagcgacgtggcctatcgcaaggatgcgaaagaaaatcttcactacactactgtcgctgaccgcccagacatcaagaaggctacccaggccgctaaacaggcgagcgaggtcgagtaccgggctaagcatcggaaggaggggagtcacgggttaagcatgctaggcaggcccgacatcgaaatggcaaaaaaagccgctaaactgtccagtcaggtcaaatacagggaaaattttgataaggaaaagggtaaaacgccaaaatataatcctaaggacagccagctatacaaagttatgaaagacgcgaacaatctcgcgtcggaagtaaagtataaagccgacctgaaaaaactgcacaagcccgttaccgatatgaaggaatccttgatcatgaatcacgtcttaaatacctctcagctggcaagttcctaccagtataaaaaaaaatatgagaaatccaaggggcactaccatactatacctgacaatctggaacagctccacctaaaagaggccaccgaactgcagtctattgtaaagtacaaggagaagtacgagaaagagcggggtaagccaatgcttgatttcgaaacccccacgtacatcacagcaaaggagagtcagcagatgcagagtgggaaggagtacagaaaagattatgaagaatcaataaaaggacgaaatctgacgggactggaggtcacccctgccctgttacacgttaagtatgccaccaagatcgccagtgaaaaagagtatcgcaaggatctggaggaaagtatcagaggaaagggtctaaccgaaatggaggatacacccgatatgttacgggctaaaaatgccacacagatcttgaatgagaaggaatataaaagagatctggagcttgaggtgaaaggcaggggactcaacgcaatggctaacgaaaccccagacttcatgagagccagaaatgccacagatattgcatcgcaaatcaagtataagcagtctgcagagatggagaaagctaatttcacaagcgtggtggatacacctgaaatcattcatgctcaacaggtcaagaacctgtccagccagaagaaatacaaggaggatgcagaaaaatccatgtcgtactatgagacggtcttagacacgccggaaatccaaagggtgcgagaaaatcagaaaaacttctcactgctccaataccaatgtgaccttaaaaacagcaagggaaagattacggtggtccaggatacacctgaaatactgcgagtaaaggaaaatcaaaaaaatttcagtagtgtgttgtacaaggaggatgtctcaccgggaactgctattggcaagacgcctgagatgatgagagttaagcagacgcaggaccacatcagttctgtgaaatataaagaggccatcggacaggggacgccaattcctgacctcccagaggtcaaaagggtaaaggagacccagaagcatattagctccgtcatgtataaagagaacctggggaccgggattcccacaactgtgacccctgagattgagcgagtgaagcgcaatcaggaaaatttctcatcggtcctttataaggagaacctggggaaaggcattccaacacctatcactcccgagatggagagagtcaaacggaaccaggagaacttctcgagtatcctttacaaggaaaatctctcaaaaggaactcccttaccagtgacacccgaaatggaaagggtcaaactgaatcaagagaacttctccagtgtgctttacaaggagaatgtaggtaagggcatcccaatcccaattacacctgaaatggagcgagtaaagcataatcaggaaaatttttcatcagtgctgtacaaggagaatctggggaccggaatacccattccaatcacaccagaaatgcagcgtgttaaacacaatcaggaaaatctctcttcagtcctgtataaagaaaatatgggtaagggcacaccgcttccagtgacgcctgagatggaacgagttaagcacaaccaggagaacatctcgagcgtcctatataaggaaaacatggggaagggcacaccactgcccgtgaccccagaaatggagcgggtcaaacataatcaagagaatatctcctcggtactctacaaagaaaacatggggaaggggacgccacttgccgttaccccagagatggagagagtgaagcacaatcaggagaatatcagctccgttctttataaggaaaatgtgggaaaagcgactgccactcctgtcacacccgaaatgcagcgggtgaaacggaaccaggagaatatttcatcagtgctgtataaagagaatctaggtaaggcaacgcccactccctttactcctgaaatggagagggtaaagcgcaaccaggaaaacttcagctctgtgctgtataaagagaacatgagaaaggccacacccaccccagtgacccctgagatggagcgcgcaaagcgaaaccaggaaaatatatctagtgtactctacagcgattctttccgaaaacagattcaggggaaggctgcatacgtactggacacccctgagatgcgccgagtcagagagacccagaggcacatctccacggttaaataccacgaggactttgagaaacacaagggttgttttaccccggtcgtgacagaccccataactgaacgtgtcaagaaaaacatgcaggatttcagcgacattaattaccgcggtatacagcgcaaagttgtggaaatggagcaaaagcggaacgatcaagatcaggaaacaatcacgggcctcagggtctggagaactaatccgggttccgtgtttgactatgatccagccgaggataacatccagtcgcggtccctgcatatgatcaacgtacaagcccaaagacgtagccgagaacagtcccggtcagctagtgcccttagtatctctggtggggaggagaagtctgagcattcagaagcgcctgatcatcatctcagtacttattccgacgggggtgttttcgctgtatctaccgcatacaagcacgccaagaccactgagctgccccagcagagatcaagctctgttgctacacagcaaaccacagtgtcttctataccatcccacccttctacagctggcaagatcttccgagccatgtatgactatatggcagccgacgcagacgaggtctcatttaaagatggcgacgctattattaacgtccaggcaatcgacgagggctggatgtatggaaccgtccagagaacagggagaaccggaatgctgcctgccaattacgttgaggcaattta

SEQ ID NO: 232124 - DNA, 864 bp, Artificial Sequence
  Description of Artificial Sequence: Synthetic coding sequence
atggctgatgacgaagactacgaggaggtggttgaatattatactgaggaggtagtttatgaggaagtgcctggcgaaaccattacaaaaatttatgaaacaaccacaaccaggacaagtgattacgagcagtccgaaacttctaaaccagccctcgcacagcccgctcttgcccaacctgcatccgccaaaccggtggagagacgtaaggtaataaggaaaaaagtggacccttcaaaattcatgactccctacattgcacactcccagaagatgcaggaccttttttcccctaataagtacaaggagaagttcgaaaagaccaaagggcagccttatgcctcaactacagatacgccagagctgcggcgtatcaagaaggtgcaggaccaactcagcgaggtaaaatatcggatggacggggacgttgccaagaccatttgccatgtcgacgaaaaggcaaaggacatcgagcatgccaaaaaggtcagccagcaagtgagcaaggtcctgtacaaacagaattgggaggacaccaaagataaatatctcctccctcctgacgccccagagctcgttcaagcagtgaaaaacactgccatgttctccaaaaagttgtatactgaagactgggaagccgacaaaagtctcttctatccttacaatgattccccggaactaaggagagttgcacaggcccagaaggcgctgtccgacgttgcctacaagaagggtctcgctgagcaacaggcccagttcacacccctggctgatcctcccgacattgagttcgctaaaaaggttacaaatcaggtctcaaaacagaaagaaaaaaaaaggaaaaagaaacgaaagaaagtgtag

SEQ ID NO: 232125 - DNA, 1317 bp, Artificial Sequence
  Description of Artificial Sequence: Synthetic coding sequence
atgatgagggtcaagcaaacacaggatcatattagctccgtcaagtacaaagaggctattgggcaggggactcccattccggatcttccggaagttaagcgtgtgaaggagactcagaaacacatctcctccgtgatgtataaggagaacctgggcactgggatcccaacgacagtgacccctgagatcgagagagtgaaacgcaatcaggaaaatttctccagcgtgctgtacaaggagaatatgggcaagggaacgccactggctgtgacacctgagatggagcgggtgaagcataaccaggagaatatttcctcagttctgtacaaggagaacgtggggaaagcaactgctaccccagtgacacctgagatgcagcgcgtgaaaagaaatcaggagaacataagcagcgtgctgtacaaggaaaacatgcgaaaggccacacctacccccgtgacacccgagatggaaagagccaagcggaaccaggagaacatcagctccgtcctctacagcgactcgttcaggaagcagattcaggggaaagccgcttacgttctggatacaccagaaatgcggagggttcgggaaacgcaacggcacatctcaacagttaaatatcacgaggatttcgaaaaacataaagggtgcttcacaccagtagttacggatcctataaccgagcgagtgaaaaagaatatgcaggacttctcagatatcaactacagaggcatccagaggaaagttgtggagatggaacaaaaaaggaatgatcaggatcaggaaacgataacagggctgcgcgtgtggcgcaccaatcccggtagcgtcttcgactatgatcccgctgaagacaatatccaatcgaggtcactgcatatgataaacgtgcaagctcagcgacgcagccgcgagcagtcaagaagtgcatccgcgctctccatatccgggggagaagaaaagtctgaacactctgaggctcctgaccaccatctttctacctactctgacggcggtgtcttcgccgtaagcaccgcctataaacatgctaaaacaacagaactgcctcaacagcggagtagctccgtggctacccagcaaacaaccgtgtctagcattccatcccatccctccaccgcaggtaaaatcttccgcgctatgtacgattacatggcagcagatgccgacgaagtgagctttaaggatggagatgccataatcaacgtccaggcaatcgatgagggctggatgtacggaaccgtccagcgaacagggaggacagggatgctgccagcaaattacgtggaggctatttag

SEQ ID NO: 232126 - DNA, 1014 bp, Artificial Sequence
  Description of Artificial Sequence: Synthetic coding sequence
cagaagtacaaggaggattatgagaataaaattaaaggcaaatggtccgaaacgccctgttttgaagtggctaacgccagaatgaacgccgataacatttccactcggaagtaccaggaggacttcgaaaacatgaaagaccagatctacttcatgcaaacagagacacccgaatacaaaatgaataagaaggccggtgtcgcagcctctaaagttaagtacaaggaagattacgaaaagaataaaggcaaagcggattataacgtcctgccggcttcggaaaacccacaactccgacagctcaaggcggctggtgacgccctcagcgataaactgtacaaagaaaattatgaaaaaactaaggccaaatccatcaattattgtgaaactcctaagttcaagcttgatactgtgctgcagaacttttcatccgataagaagtataaagattcttatcttaaggatattctgggccattacgtgggctcattcgaggatccttatcactcccattgcatgaaagttacggctcaaaatagtgacaagaactacaaagccgaatacgaggaagatcggggtaaaggtttctttcctcaaaccataactcaggagtatgaggccattaagaaattggaccagtgtaaagatcacacctataaagtccaccccgataagaccaagttcacccaagtcaccgattcacccgttctcctacaggcacaagtgaacagcaaacagttgagcgatctgaactacaaagcaaagcacgagtccgaaaagtttaagtgccatattcctccagataccccagctttcatacagcacaaggtgaatgcttacaatctgtcagataacctatataagcaggactgggaaaaatcaaaagcaaagaagtttgacattaaggtggacgccataccgcttcttgccgcaaaagcaaacacaaaaaacacatcagatgtcatgtacaaaaaggactatgagaaaaataaggtaaaggtgcagcagagatag

SEQ ID NO: 232127 - DNA, 5192 bp, Artificial Sequence
  Description of Artificial Sequence: Synthetic coding sequence
atgaacgtgcagccatgttcgaggtgcgggtacggcgtgtatccagcagaaaagatcagttgcattgatcagatttggcataaggcatgtttccactgtgaggtgtgcaaaatgatgttatccgtaaacaacttcgtctctcaccagaagaagccctattgccatgcacataatccaaagaataatacttttacttccgtgtatcatacccccttaaatttgaacgttcgcacattccctgaagcgattagcggtattcatgaccaggaagacggagagcagtgcaagagtgtgttccattgggacatgaagagcaaagataaagagggtgcacctaatcggcagccgcttgccaatgaaagagcatactggaccggatacggcgaggggaacgcgtggtgtcccggagcgctgccagaccctgagattgtgagaatggtggaggctagaaagagtctgggggaggaatataccgaagactacgaacagccgagagggaaaggcagtttccccgctatgatcacacccgcttaccagagagctaaaaaggccaaccagttggcgagccaggtggagtacaagcggggtcacgatgagaggattagtcgtttcagtaccgtggtcgacacaccggaactgctgcgtagcaaagccggagcccaactccagtcagacgtccgctacacagaggactacgaacaacagagaggtaagggaagcttccctgcgatgatcacccccgcttatcagatcgctaagcgcgctaacgagctcgcttcggatgtgcgataccaccagcaatatcagaaggagatgaggggtatggcgggacctgccataggggctgagggcattctcactcgggagtgcgccgaccagtacggtcaaggctaccccgaagaatatgaagagcatcgcggaaaggggagctttcctgcgatgatcactccggcatatcagaatgcgaagaaagcgcatgagcttgcgagtgacatcaagtacaggcaggattttaataaaatgaagggcgcagcgcattaccactctctgcccgcacaggataatctggtgctgaagcaggctcaatccgtcaacaagctggtgtcggaggttgaatacaagaaggatctcgagtccagcagaggccactctatcaattactgtgaaacccctcaatttcgcaatgtatcaaagatcagcaaattcacctcggataacaaatacaaagaaaactaccagaaccatatgcgtgggagatatgagggagtgggaatggacagaagaaccctgcatgcaatgaaagttggaagcttggcctcaaacgtggcctataaagctgactataagcacgatattgtggattacaactaccccgctacgctaaccccatcataccagaccgcgatgaagctagtgcctctcaaggacgcaaactaccggcaaagcatcgacaaattgaagtattctagcgttacagacacgccccaaattgtgcaagccaaaatcaatgcgcagcagctatctcacgtgaattaccgcgcagattatgagaaaaataaactcaactacactctgccccaggatgtgccacaattggtgaaagccaagaccaatgcaaagctgttcagcgaggtcaagtacaaggaaggatgggaaaagactaaaggaaaggggtttgagatgaagctggatgccatgtcgctgctagcggcaaaagccagcggggaattggcgtctaacatcaagtataaggaggagtatgagaagacaaagggcaaagccatggggactgctgactcgagacttttacacagtctgcagattgccaagatgtcatcagaggtggaatacaagaagggtttcgaagagagcaaaacacggtttcaccttcctatggatatggtcaacatccggcatgccaaaaaagcacagacccttgcctcagatctggactatcggaaaaagttgcacgaatataccgtgctccctgaggatatgaagacccagtgggctaagaaggcctacgggctgcaatcggaactacagtataaggccgatctggcttggatgaagggagtgggctggttaacagaggggtcccttaatctggagcaggctaagaaggctggacagctggtatccgagaagaactatcggcagcgcgtggacgaactgaagtttactagcgtgacagacagctctcagatggagcatgcgaaaaaaagccaagagctccagtctggcgtggcctacaaggctggtaatgagcagagcgtccaccagtacaccataagcaaagacgagcctctctttttgcaagcgcgtgctaatgcggctaatctgagtgagaagctgtacaagtcgtcctgggaaaatcagaaggcaaagggatttgagctacgcctggatagtctcactttcttggcagctaaagctaaaagagatctggcatccgaggtaaagtacaaagaagattatgagcggtcccggggaaagttgattggagccaaagatgttcagggagatagccagatgagtcacagtctgcagatgtccaagcttcagtccgagctagagtataagaaaggttttgaggacacaaagagtcagtgccatgtcagtctcgacatggtccatctagtgcatgcaaggaaggcacaacacctggctacagatgtgggatataagaccgccgagcaccactttactgccctgcccacagacatgaaggtggaatgggctaaaaaagcctacggcttacagagtgataaccagtacagggcagatgtgaagtggatgaaaggaatggggtgggtggccaccgggagtctgaacgtggaacaagcgaaaaaggccggagaactgataagtgagaagaagtacaggcaacaccccgatgcgctcaagttcactagcattaaggacacccctgaaatggtgcaggctagaatttcctatacccaggccgtcgatcgattgtatagggaacagggagagaatataaaacatcactacactccaactgcggaccttcccgaggtgctgctggccaagcttaatgctatgaatattagcgaaacacgttacaaggagtcatggagtaagcttagggatggcggatacaaacttaggctcgatgcactcccctttcaggctgctaaggctagtggagagatcatttctgactataagtacaaggaggcatttgaaaagatgaagggccagatgctgggctctcgatcactggaagatgacataagcctagcccatagtgtgtacgccacctccctccaaagtgacgtcaattacaaaaaaggtttcgagcactcgaaggctcaatttcatttgcccctggatatggccgctctggtgcacgccaagaaggcacagacgctcgccagtaatcaggactacaaacacccgctgccgcagtacacgagcttggctgaggatctgcggcttagttgcgcaaagaaagcccacaagctgcaatctgaaaacttatataggtccgacctgaatttcatgcggggagtggcctgcgtgattcctggcacccttgagatcgaaggaaggaagaaggccagcgagttgataagtgagtcgaaatatcgacagcacccgcattcatttaagtacaccgccgtgaccgatacaccgaatctgcttcacgccaaattcagtaatcagattactaatgagaggctgtataaggctgccggagaagacgctagacacgagtacactatgacacttgggctgcctgagttcattcgggcaaaaaccaacgctgctaatctgtctgacgcacgctataaagagtcgtggaggaacctccgtgctcaggggtataagctgaccattgaggcactcccctttcaggccgctcgtgcatccggcgatattgccagcgactttctttataggcacgactttgtgaaagagagaggcaagctgattggaccacagtcagtacgagacgaccccagaatccagcattgtaggcgaatggggcagcttcagagcgagttgcagtaccggaggggtgccacgtcatctcaggcacagtttcacctcccgatggacatggtgcatctcgtccacgcgaagaacgcacaggccctcgcttcggaccatgactacagaacccagtaccataaatttacggccctgcctgaagatctgaagatggcctgggctaaaaaagctcatgctctccagtctgagctgagatacaaaagcgacctcataggcatgaaggggattgggtggttggctcttaggagtccccagatggaaagcgccaaaaaggcaggggagctcatttccgagaccaaataccggaagaagcccgacagcatcaagtttaccacagtcgtcgattcaccggacctggtccacgctaaaaacagttatatgcactgtaacgaacgcatgtaccgatctggagacgcagagagcctgcataggtacaccctgatacccgaccatcccgacttcactcgggcacggcttaatgctctacacttgtcagataaggtgtacaggaatagctgggagcagacccgggctggcagttacgattttaggctcgacgcaatccccttccaaacagccagagcatccagagagatcgcatcggacttccggtataaggaggccttccttagggatcgcggattgcagattggctacagaagcgtggacgacgacccccgtatgaagcattttcttaacgttgggaggctccagagcgataacgagtataagaaggacttcgctaagagcaggtcccaatttcacagctccaccgaccaacctggacttctgcaggctaaacgcagccagcagttggcgtctgatgtgcattataggcagccattgccacagcccacatgcgaccctgaacagctgggcctccgccatgcgcagaaggcgcaccagttacagagcgacgtaaagtacaaaagcgatttaaaccttacgagaggggtggggtggacgccacccggatcctacaaagtggagatggcacggagagccgcagaactggcaaatgctagaggcctcggccttcagggtgcatatcgtggagctgaggcggtcgaggccggagaccatcagtccggcgaagttaacccggacgcgacagagatcttgcatgtgaagaaaaagaaagcgctgcttctgta

SEQ ID NO: 232128 - DNA, 5088 bp, Artificial Sequence
  Description of Artificial Sequence: Synthetic coding sequence
atgaatgtgcagccttgttcacgatgcggatacggggtgtaccctgctgaaaagatctcctgtatcgaccagatttggcataaggcttgtttccactgcgaagtgtgcaagatgatgttgagcgtgaacaactttgtgtcccaccagaaaaagccctattgtcacgcccacaaccccaagaacaatactttcacctctgtttatcatactcctctcaaccttaacgtgcgaaccttccctgaagcgatctctggcattcatgaccaagaggacggcgaacagtgcaagtctgtgttccactgggatatgaaatccaaggacaaggagggcgcacccaaccgccaacctttagccaacgaacgcgcttactggaccggctacggcgagggaaatgcctggtgtcccggtgccctgccagaccccgagattgtccgtatggtggaggcccgtaaatcccttggtgaagaatatacagaagactacgaacagccccgtggaaagggcagtttcccagcaatgattacccccgcatatcagagagcaaaaaaggcaaatcaactggcaagtcaggttgagtataaacgcggtcacgatgaaagaatctccaggtttagtactgtggtggatactcccgaattgcttagatccaaagccggtgcccagctacagagcgacgtgcgctacacagaggactacgagcaacaaaggggcaaaggcagttttccagcaatgattacacccgcttaccagattgctaagcgcgctaacgagctcgcgtcggacgtgcgataccaccagcagtatcaaaaggagatgagaggaatggcaggacctgctatcggcgctgagggcattctaacgcgcgaatgtgccgatcagtacggccagggctacccagaagaatatgaggaacacaggggcaaaggatcattccccgctatgatcactcccgcttaccagaatgccaagaaggcccatgagctagccagcgatatcaaataccggcaggactttaataaaatgaagggcgcagcccactaccattccctgcctgctcaggacaacttagtgctgaaacaggcacagagcgtcaacaagcttgtgagtgaaaacaaatacaaagagaattaccagaaccacatgagaggcaggtacgagggcgtcgggatggataggagaacacttcacgccatgaaggtgggctccctagccagtaatgttgcctataaggcagattacaaacatgatattgtagactataattatcctgcaacattgacaccaagctaccagaccgctatgaaactggtgcctctgaaagatgccaattaccggcaatccattgacaagttgaagtattcatcagttaccgacacaccccagattgttcaggccaagatcaatgctcagcagctgagccacgtgaattatagggccgactacgaaaagaataaattgaactacacactaccacaagacgtgcctcaattggtcaaggcgaaaacgaacgccaaactgttttccgaagttaagtacaaggaagggtgggagaaaactaagggaaaaggttttgagatgaaactggatgctatgtctctattggccgctaaagcctcaggcgagttggccagcaacattaaatataaggaagagtatgagaaaaccaaaggaaaagccatgggaaccgccgattctagactcctccacagcctgcaaattgccaaaatgtcaagtgaagtggaatataagaaaggattcgaggagtcaaagacgagatttcatttaccaatggacatggtgaacattcgtcacgccaaaaaggcccaaactctggcaagcgacctcgactaccggaagaagttacacgaatacaccgtgttgcctgaagacatgaaaacacagtgggccaagaaggcatacggacttcagtctgagctgcagtacaaagccgaccttgcctggatgaagggggtgggatggttgacggagggttccctgaacttggagcaggccaagaaagctggccagctggtgtctgagaagaactacaggcagagagtggacgaattgaagtttacatccgtgaccgactcttcccagatggagcatgccaagaagtcacaggagttacagagtggtgtcgcctataaagccggtaatgagcagtccgtgcaccagtatacaatctccaaggatgaaccactgttcctgcaagcaagagccaacgctgctaatctgagcgaaaagctgtacaaaagcagctgggagaatcagaaagctaaggggtttgagctgcgactagactcccttacattcctcgcagcaaaggccaaacgggacctggcttccgaggtcaagtacaaagaggactacgagcgttcccggggtaaactcattggagcgaaagatgtgcagggtgatagccagatgtcccatagccttcagatgtccaagctgcagtccgaactagaatataaaaaaggatttgaagataccaaaagtcagtgccatgtctccttagatatggtgcatttagtacatgctcggaaagcccagcacttggccaccgatgtgggctacaagactgccgagcaccatttcacggccttaccaacagacatgaaagtggagtgggccaaaaaggcctacggcctccaatccgataatcaataccgtgctgacgttaagtggatgaaggggatggggtgggtagcaactgggagcctgaatgtggagcaggctaagaaagcaggcgaactgatttctgagaagaaatacagacaacatcccgatgccctaaaattcactagtattaaggatacacccgagatggtgcaggcacgtattagctacacgcaggctgttgatagattgtacagagagcagggggagaatataaagcaccactatacccccaccgctgacctgcccgaggttctcttagccaagttgaatgctatgaatattagcgaaacacgctacaaagagtcctggagcaagctgcgcgatggaggatataagctgcgcctggatgccctgcccttccaggctgcaaaagctagcggagagattatttccgactataagtacaaggaagctttcgagaaaatgaaaggtcagatgctgggctcacgatctttagaggacgacatatcactagcccactctgtctatgctacatctctccagtctgatgtgaattataaaaaaggttttgaacattcaaaggcgcaattccacctacctctggacatggcggcactggtgcacgccaagaaagcacaaaccctggcctctaatcaggactataaacatcctttgcctcagtacacgtccctcgccgaagatctcagactttcgtgcgccaaaaaggcacataagttgcagagcgagaacctctacaggtccgacctgaactttatgagaggtgtcgcctgcgtaatccccggaactctggagatcgaaggcaggaaaaaggccagcgagttgattagcgaaagcaagtatcggcagcatccacactcttttaaatatactgcggtcaccgacacgcccaacctcctgcatgccaagttttctaaccaaattactaacgagcgactctacaaagccgcaggcgaagatgccaggcatgaatatacaatgaccctgggcctacccgaatttatccgggcaaaaactaacgccgcaaatttgagcgatgcccgatacaaggagagctggcgtaatctgcgcgcacagggctacaaactcactattgaggccctgccattccaggctgccagagcctccggggacattgcgagcgattttctctaccggcatgattttgttaaagaacgcggaaaattgatcggaccacagtcagtaagggacgatcccagaattcagcactgtcggagaatgggccagctgcagagtgagctgcagtacaggagaggcgctacgagctcccaggctcagtttcatctgccaatggacatggtacacctagtgcacgccaagaatgcccaggccttggcaagcgaccatgattaccgcactcaataccacaaattcacggctctgccggaagatctcaagatggcttgggcaaagaaagcgcatgctctacagagcgaattgcggtacaaatcagatctgattggtatgaagggtatcggctggcttgcgctgcgcagcccacagatggagtccgctaagaaagccggagaactgatttccgaaacgaagtaccgaaagaaaccagacagcataaagttcaccaccgtggtggattctccagatctcgttcatgcgaagaactcctatatgcattgcaatgagcgcatgtacagatccggggatgctgagagtctccaccgatacactttaattcctgatcaccccgacttcacacgggctagactgaacgctctgcatctgtcagacaaggtgtaccggaacagctgggagcaaacccgggcaggctcgtacgacttcagacttgatgctatcccttttcagactgctcgggcttcccgagaaatcgcatcagattttcgatataaagaagcattcttaagggatagagggttgcaaatcggctatcgatccgtggatgacgaccccaggatgaagcactttctgaatgtgggccgtctacaatccgacaacgagtacaagaaggacttcgccaaatcccgctctcagtttcattcttccactgaccagcccggtctgctgcaagccaaacgcagtcaacagctggctagcgatgtgcactatcggcagccgctcccgcaacccacttgcgatcccgaacagttagggctcagacacgcccagaaagctcatcagttacaaagcgacgtgaagtataagtccgacctgaatctgacacgtggcgtgggctggaccccccctggatcttacaaagtcgaaatggctcggcgagccgcagagctggcaaatgccaggggtctgggcctgcagggcgcttaccgaggcgctgaagccgtggaagcgggtgatcaccagtcgggagaagtgaaccccgatgccacagagatcctccacgttaaaaaaaagaaggcacttctcctatag

SEQ ID NO: 232129 - DNA, 2559 bp, Artificial Sequence
  Description of Artificial Sequence: Synthetic coding sequence
atgagagggatggccggtccggcaatcggagcggaaggcatccttaccagagagtgtgccgatcagtatggacagggataccccgaagagtacgaggagcatagggggaagggcagtttccccgctatgatcacacctgcctaccagaacgccaaaaaagcccacgaattggctagtgacataaagtatcgccaggacttcaataaaatgaaaggtgccgctcactatcacagtttgccagctcaagataatctagttctcaaacaggcccaaagtgttaataaacttgtgagtgaagtagagtataaaaaagacctggagtcctcccgcggacacagcatcaattactgcgaaaccccacagtttagaaatgtctctaagatcagtaagtttactagtgacaataaatataaggagaactatcagaatcacatgagagggaggtacgagggcgtcggaatggacagacgcaccctccacgctatgaaggtggggagtcttgctagcaacgtcgcctacaaggcagactataaacacgacattgtggactacaactatcctgccacactgactccaagttaccagactgcaatgaaactggtcccacttaaggacgccaactataggcagtccattgataagctgaagtattcaagcgtgaccgacaccccacagatcgtccaggccaaaataaatgcccagcagttgtcccacgtgaactaccgcgcagattacgaaaaaaataagttaaattacactttgccacaggacgtaccccagcttgttaaagccaagaccaacgcaaagctgtttagtgaggttaagtacaaggagggctgggagaaaacaaagggtaaaggctttgaaatgaaactcgacgctatgtctcttctagcagccaaggcctcaggcgaactggcttccaacgtacatctgctcctgtctctgaagatcaagtataaggaggagtacgaaaagactaaggggaaggctatgggcacggccgactctagacttctacactctctccaaatcgccaagatgagttcagaagtggaatataaaaagggctttgaggaatccaagaccagattccacttacccatggatatgggtgtggggtggctgacggagggctctctcaacctagaacaggcgaagaaggctggccagcttgtgagtgagaaaaactacagacagagagttgatgagcttaagttcaccagtgtgaccgacagcagccagatggagcacgcgaagaaatcccaggagcttcaatccggtgtagcctacaaggccggaaacgaacagagcgtacatcaatatacaatttccaaggacgaacccttattcctgcaggctagagctaacgcagcgaatctgtcagagttcctgtatcgccacgattttgtgaaggaacgagggaagctcatcgggcctcagtccgtgagggatgacccacggattcagcactgtcgtagaatgggacaactgcaatccgagttgcagtatcgacggggagccacatcttcacaggcccagttccatcttcctatggatatggtgcacctggtacatgcaaagaatgcccaggcactcgcaagtgaccacgactataggacccagtatcataaatttacggcgttacccgaggacctcaagatggcatgggctaaaaaagcacatgcgctgcagtctgagctgagatataagtccgacctcatcggcatgaagggaatcggctggctcgctcttaggagcccacagatggagagtgccaagaaagcgggagaactgatctctgagactaagtatcgcaagaagcctgactctattaagtttactaccgtggtggactctcccgatctcgtgcacgccaagaatagttacatgcattgtaacgagaggatgtacagatccggcgacgcagaaagcctgcatagatatactctcattcctgatcatccagatttcactcgggcacggctgaacgctctccatctgtctgacttcaggtataaagaggccttcctgagagacagaggactgcagattggctacagatccgttgacgatgatcctagaatgaagcactttctcaatgtcggccgtttacaatctgacaatgagtacaaaaaggacttcgctaagagtcgctcccaatttcactcctccactgatcaacctggtttgctgcaggctaaaaggagtcagcaattagcctccgacgtccattacagacaaccactgccacagcctacgtgcgaccctgagcagctgggccttcggcacgctcagaaagctcaccagctacaatcagacgtgaaatataagagtgacctcaaccttacccgtggggtggggtggaccccgccaggatcttataaggtcgaaatggcaagacgagccgcagagttggcgaacgccaggggtttaggtcttcagggcgcttacagaggtgctgaggcagtagaggctggggaccatcagtctggagaggtcaatccagacgctacggagatactacacgtcaagaagaaaaaggccctactcctgtag

SEQ ID NO: 232130 - DNA, 5217 bp, Artificial Sequence
  Description of Artificial Sequence: Synthetic coding sequence
atgaacgttcagccttgctctcggtgtggctacggagtctaccctgccgagaaaatttcttgcatcgaccagatttggcataaggcatgttttcactgtgaagtgtgcaagatgatgctgtcagttaataactttgtgagccaccaaaagaagccttactgtcatgctcataaccccaaaaacaacactttcacctcagtctatcacacacctctgaacctgaatgtgagaacgttcccggaggcgataagcggcattcacgatcaggaggacggagagcagtgtaagtctgtgtttcattgggatatgaaatctaaagataaggaaggcgctccgaatcgacaaccactcgctaacgagagagcctactggaccggttacggggaggggaacgcatggtgccccggagctctgcctgacccggaaattgtccgtatggttgaagctcgcaagtcactgggggaagaatacactgaggattatgaacagccacgcggtaagggctcatttcctgccatgatcacgcctgcataccagcgagcaaaaaaagccaatcagctcgcttctcaggtggaatataaacgaggccacgacgagcggatctctagatttagtaccgtcgtcgataccccagagctgctgaggagcaaagctggcgcacagctgcagtccgatgtgagatacactgaggattatgaacagcagagaggtaagggctccttccctgccatgataacacctgcgtaccagatcgccaaacgcgcaaatgagctggctagtgacgtgagatatcaccagcagtatcagaaggaaatgcgcggaatggccggtcctgccattggtgctgagggaatcctcacacgcgagtgtgccgatcagtatggccaaggttatcccgaggaatacgaagagcacagaggaaaaggatctttccctgcaatgattacccccgcttatcagaacgctaagaaggctcatgagttagcctcagatatcaagtatcgccaagattttaataagatgaaaggtgccgcacattaccacagccttccagcacaggacaatcttgttcttaagcaagcacagtcagtcaataaactggtgagtgaggtggaatataagaaagacctcgagagctctcgtggtcatagtatcaactactgcgagaccccacagttcaggaatgtatccaagattagcaaatttacctccgacaataagtacaaggagaactaccagaatcacatgagagggagatatgagggcgttggcatggaccgtagaacattacacgccatgaaggtgggctcactagcctcaaatgtggcatacaaggctgactacaaacatgatatcgttgattataactacccagcaacccttaccccaagttatcagactgccatgaagttggtccccctgaaagacgcaaactatagacagtctatcgataagctcaaatacagtagtgtgaccgacaccccacaaatcgtccaggctaagataaacgcacagcagctgagtcatgtaaattatagagcagattatgagaagaacaaactgaactacacactgcctcaagatgtcccccagttggtgaaggctaagaccaacgccaaactgttctccgaggtgaaatacaaggagggttgggaaaaaaccaagggtaaaggcttcgagatgaagttagatgctatgtcactgctggctgcaaaagcatcaggagagttagcttcgaacgtgcatctgttattgtccctcaagattaaatataaagaagagtacgaaaaaacaaaaggcaaggcaatgggtaccgccgactctcggcttctgcacagcttgcaaatcgccaaaatgtcctccgaggtcgaatacaagaaggggtttgaagaatctaagacccgctttcacctccctatggatatggtcaacatcagacatgctaagaaagctcagacactggcctctgaccttgattacaggaagaaactccacgaatacacagtgctcccagaagatatgaagactcagtgggctaagaaggcatacggactgcagtctgaactccagtataaggccgatctcgcgtggatgaagggcgtaggatggcttacagagggatcacttaatctcgaacaggccaaaaaagcgggacagctcgtttctgaaaagaactataggcagcgggtggacgaactgaagtttacaagcgttaccgacagtagccaaatggagcacgccaagaaaagccaagagctccagagcggggttgcatataaggccggaaacgaacagtctgtgcaccagtacactatttccaaagacgaaccactttttcttcaagctcgtgccaacgctgccaatctctctgaaaagttgtataagagtagttgggaaaatcagaaagctaagggcttcgagctgagactggattcgctcactttcttggctgcgaaagccaaacgcgaccttgccagtgaggtcaaatataaagaggactacgagcggtctcgcggaaaactcatcggggcaaaagacgtacaaggggattctcagatgtctcacagcctgcagatgagtaagctgcaatcagagctcgaatacaaaaagggtttcgaagacacaaaatcacagtgtcacgtgagcctggacatggtccacctcgtgcatgctcggaaggctcagcatctcgctactgatgtaggctataaaactgcggagcaccactttacagccctgcctacagacatgaaggtggagtgggccaaaaaggcatacggactgcagagtgataatcagtatcgggcagacgtgaaatggatgaaaggcatgggctgggtggctactgggtccctgaacgtggagcaggccaagaaagccggagaactgatatctgaaaagaagtacaggcagcatcctgatgctctgaaattcacgtccattaaggatacaccagagatggtgcaggctcgaatatcatatactcaggcagtggacagattatatagggagcagggagagaacatcaagcaccactacactccaaccgctgatctcccagaagttctgctggccaagctgaatgctatgaacatatcagaaacccgttacaaggagtcctggagcaagcttcgggacggcggttacaagctaagactggatgcgctacccttccaggccgcaaaagcgagcggagagattatcagtgactacaaatacaaagaagcttttgaaaagatgaaggggcagatgctgggtagcaggtccctcgaggatgatattagtcttgcccattctgtctacgcaacctcactgcagtcagacgtgaattataaaaaaggcttcgaacattctaaagcacagttccacctacccctggacatggctgctttggttcatgccaaaaaggcccagaccctggcttctaaccaggactataagcaccctctacctcagtacacatccttggctgaggatctgagattaagctgcgcaaagaaggcccataaacttcaaagcgaaaacctttatcgctcagacctgaactttatgcggggagtcgcgtgtgtaatccccggtacgctcgaaattgagggaagaaaaaaggcatccgaactgattagtgaatccaagtacagacagcatcctcattccttcaaatacacagccgtgacagacactcctaacctgctccacgctaagttctcgaaccaaataacgaatgagcggttgtacaaagcagctggtgaagacgcaaggcatgagtacaccatgaccctcggcctgcccgaattcataagggcgaaaactaacgccgctaatttaagcgatgctcgctataaagagtcatggaggaacctccgggctcagggctataaattgacaattgaggccctaccttttcaggccgctagagcatctggggacatagcgtctgacttcctgtacagacacgacttcgtcaaggaaagaggtaaactaatcggtcctcagagtgtcagggacgacccgagaatacagcattgcagaagaatgggccagctgcaatctgagttacagtacaggcggggagctacatctagccaagctcaatttcacttgccaatggatatggtgcatttagtgcatgccaaaaacgcccaagcgttggcatcagatcacgattatagaacccagtatcacaaatttaccgctctcccagaagacttgaagatggcctgggcaaagaaagcccacgctttgcagtctgagctccgctacaagtccgacttgatcggcatgaagggcatcggctggctcgcacttcgaagtccgcaaatggaatcagcgaaaaaagccggagaacttatcagcgagacaaagtacagaaagaaacctgatagtataaaattcactacagttgtagactcgccagatctcgtacacgctaaaaacagctacatgcactgtaatgaacggatgtaccggtcaggggatgcagagtcattacacagatatacactcataccagatcatccagatttcaccagggctcggcttaatgcgctgcatctgtcagataaggtttaccgaaactcatgggagcaaacccgcgctggtagctacgatttcaggctggacgctatccccttccagaccgcacgagcgtctagagaaatcgcttctgacttccgatataaagaggcgtttctgagagacaggggactgcagattggctaccgctccgtggacgacgatcctcgaatgaaacacttcctcaatgtggggagactacaaagtgataatgaatataaaaaggatttcgctaagtccaggagccagtttcacagtagcacagaccagccagggcttcttcaggctaagcggagccaacagttggccagcgacgtgcactaccggcagccgctgccacagccaacttgcgatccagagcagctaggtttacggcatgctcagaaggcccatcagctgcaatctgatgtcaagtataaatccgacctgaatctcacacggggtgtaggttggacccctccagggtcctacaaagttgagatggcccgtagggctgccgagcttgctaatgcgcgtggcctgggactgcagggcgcttatcggggtgccgaagcagtcgaggccggagaccaccagtcaggggaggtgaacccggacgccacagagatactgcatgtgaagaaaaaaaaggcacttctgctgtag

SEQ ID NO: 232131 - DNA, 5111 bp, Artificial Sequence
  Description of Artificial Sequence: Synthetic coding sequence
atgaatgtgcagccttgctccaggtgcgggtatggggtgtatccagccgagaaaataagctgtattgatcagatctggcacaaagcctgctttcattgcgaggtctgtaaaatgatgctgtcggtgaataactttgtgagtcatcaaaagaaaccctattgccacgcccacaatcccaagaacaacacctttacttccgtctaccacacccccctgaacctaaatgttcgaacattccctgaggcaattagcggcatacatgaccaagaagatggagagcagtgcaaatctgttttccactgggacatgaaatctaaagacaaggaaggcgctcctaaccgacagcccctggctaacgaaagagcttactggaccgggtatggtgaggggaacgcttggtgccctggggcacttcctgatcctgagattgttcgtatggtggaggctaggaaatcattaggggaagagtacaccgaggattatgagcagccacgcggaaagggcagcttccctgctatgattactcccgcatatcaaagagccaagaaagctaatcagctggcctctcaggtcgaatacaaacggggtcacgacgagcgcatcagccggttttccaccgtcgtggataccccagagctgctacggagcaaggctggcgcacagctccagagcgatgtgcgctacaccgaagactatgagcagcaacggggaaaagggagcttccctgcgatgattacccccgcttaccagattgccaaacgcgctaacgagctggcctccgacgtaagatatcaccaacagtaccaaaaggagatgcgcggtatggcaggaccagccattggtgctgagggaattctcaccagggaatgtgcggaccaatacggacagggatatcctgaagagtacgaggaacaccggggtaagggtagcttcccagccatgataacgcccgcttatcagaatgcgaagaaagcacacgaactggcctcagatatcaaataccgccaggattttaataagatgaagggcgctgcccattaccatagcctcccggctcaggataaccttgtccttaagcaggcccaatcggttaataagctggtgtcagagaacaagtacaaggagaactatcagaatcacatgcgcggacgttacgagggcgtgggaatggatcgcaggactctccatgccatgaaggtcggaagcctcgcatcaaacgtggcatataaagcagactacaagcatgatattgtcgattataactaccctgccacacttacccctagttaccagacagctatgaaattagtgcccttaaaggacgccaactaccgacagagcattgacaaactcaagtacagttcagtcacagacacacctcaaatcgtccaagccaagattaatgcccagcagctctctcatgtgaactaccgtgcagattacgagaaaaacaaactgaactacaccttgccacaggatgttcctcagctggtgaaggcgaaaaccaatgctaagctgttttccgaggttaagtataaagaggggtgggagaaaacaaaaggaaagggctttgagatgaaattggatgcaatgtctctactggccgctaaggctagtggagagctggcttctaacgtacacctccttttaagcttgaagataaagtacaaagaggaatacgaaaagactaaaggcaaagcaatgggcactgctgacagccgtttgctgcactctctccaaatagctaagatgtcttctgaagtggaatacaagaagggcttcgaggagtctaagaccaggttccatctgcctatggatatggtgaacatccgccacgccaaaaaagcacagacactggcatccgacttggattacaggaaaaaactgcatgagtacacagtgctgcctgaggacatgaagactcagtgggcaaagaaggcatacgggctgcagtctgagctgcagtacaaagccgacctggcttggatgaagggagtcggttggctgacggagggctccctcaacctggagcaagccaagaaagccggtcaactggtaagtgaaaaaaattacaggcaacgggtcgatgagttaaaattcaccagcgttacggacagctcacagatggagcacgctaaaaagagtcaggagctacagtccggagtcgcatataaggctggtaatgagcagtccgtgcatcagtatacaatctcaaaggacgaacccctgtttttgcaggcacgcgctaatgccgctaacttgtccgagaaactttacaaatcatcttgggaaaaccagaaagccaagggctttgaacttcggcttgattccctaaccttcctggccgctaaggccaaacgggatctggcttcagaggtaaaatataaagaggactatgaacgttccaggggcaagttgatcggagcgaaggatgtgcagggagacagtcagatgagccactccctgcagatgagcaagttgcagtcagaactggaatacaagaaggggtttgaggatacaaagagccagtgtcacgtgtcactcgacatggtgcatttggttcatgcccgaaaagcccagcacctggccaccgacgtaggctacaagacagccgagcatcactttactgctctgcctacagatatgaaagttgagtgggctaaaaaagcgtacgggctacagtctgacaatcagtaccgcgctgatgttaaatggatgaagggtatgggatgggtggccacaggctccctgaacgtggaacaagccaaaaaagcaggggagctcatttccgagaaaaaataccggcaacatccagatgcacttaagttcacatcaatcaaagacacccctgaaatggtgcaagcccgtatctcatacactcaggctgtcgatcgattatatcgcgagcagggagagaacataaaacatcactatactcccacagcggacctgccagaagtgctgctagctaagcttaatgccatgaatatttctgagactcgctacaaggagtcttggtccaaactgagggatggcggttataaactgaggctggacgctctcccctttcaagcagctaaggcctccggcgaaatcatctctgattataagtacaaggaagcttttgagaaaatgaaaggtcagatgcttggctctcgatccttagaggatgatatttcactggcacacagcgtctacgccacatccttgcagagcgatgtgaattataagaaagggttcgagcattctaaagcacaattccacctcccactagatatggcagctcttgtgcacgccaagaaggcccaaaccctcgcgtccaaccaggactacaaacaccccctgccccagtatacctccctggcagaggacttacgcctgagctgcgctaaaaaggcacacaaactccaatccgagaacctgtatagatccgatctgaattttatgcgcggtgtggcttgtgtgatccccggaacactcgagattgaaggaagaaagaaagcctccgagctgatttccgagagcaagtatcggcagcatcctcattctttcaaatatactgccgtaacggatacccccaatctgttgcacgcaaagttttctaaccagatcacaaatgagcgactgtacaaggctgcgggagaggacgcaagacatgagtacactatgactctggggcttcctgaatttatcagagcgaagacaaacgccgctaacctgtccgatgcccgttacaaggaaagttggaggaacttgcgcgctcaggggtacaagcttacaattgaggccctgccattccaggccgcaagagccagtggggacatcgcctctgactttctgtataggcacgacttcgtgaaggaaaggggcaagctgattggtccccaatcagtcagggatgaccctagaatccaacattgcagacgtatgggccaactgcagtccgaactgcagtaccggcgaggggctacttcttctcaggcacaattccacctccccatggacatggtgcatctggtgcatgctaagaatgctcaggccctggccagcgatcacgattatcgcacacagtatcacaagttcacggcgctgcctgaggacttgaagatggcctgggccaagaaggcccacgcactgcagtccgagctgcgatacaaatcggatctaattggaatgaaaggaatcggctggcttgccctccgtagtcctcagatggaatccgccaaaaaagccggtgaactaatatcagaaaccaagtaccggaaaaagccagactccatcaagtttacaacagtggtggacagcccagacctcgttcacgccaaaaactcgtatatgcattgcaatgagaggatgtacaggagcggtgatgcagagagccttcatcgatacacactgattcctgatcaccctgacttcacacgcgctcgcttgaatgcactgcacctgtccgacaaggtgtacagaaactcttgggagcagacgagagctgggtcttatgactttagacttgatgcaatcccctttcagacagcccgagcatccagagagatcgctagcgattttcggtacaaggaggcattccttagagatagaggattgcagatcggttatcggagtgttgatgatgacccccgtatgaagcatttcttgaatgtcggccgtctgcagtccgacaatgaatataagaaagactttgccaaatccagatctcagtttcatagctctaccgatcagccagggctgctgcaggctaagagatcccagcagctggcatctgatgtccactacaggcagcccttgccgcagcccacctgtgatccagaacaactgggattgcgccatgcccagaaggcccatcagctgcaatcagacgtgaaatacaaatcagatctgaatctcactcgaggcgtgggctggaccccccctgggagttacaaggtggagatggctagacgggcagctgaactggctaatgcacgcggtcttgggctccagggcgcataccgaggagcagaggcagtcgaggctggcgatcatcagtccggcgaagtgaatccggatgcgacagaaatcttgcacgtcaaaaaaaagaaagctctgctactcta

SEQ ID NO: 232132 - DNA, 828 bp, Artificial Sequence
  Description of Artificial Sequence: Synthetic coding sequence
atggctactgaactcgagtacgaatcagttttgtgcgtcaaaccagacgtgagtgtgtacagaattccaccaagggcaagcaatcggggttacagagccagtgactggaaactggatcagccagactggacagggaggcttcggataacctctaagggtaaaacagcctatatcaagttggaggacaaagtctcaggcgagttgtttgcccaggctcctgttgagcagtaccccggaatagccgtagaaacagtcactgatagtagtcggtacttcgtaattaggatccaggacggcactgggagatctgcattcattgggatcgggtttaccgaccggggtgatgcctttgattttaacgtgtctctgcaggatcatttcaagtgggttaaacaggaatctgaaatctccaaagagtctcaagagatggacgctaggcctaagctcgacctcggatttaaggaggggcagactataaagctgtgtatagggaatatcacaaacaaaaaaggcggtgccagcaagccgagaactgcgagaggcggtggacttagtctactccctcctccacccggaggaaaggttactatcccgccaccctcttccagtgtggcaataagtaatcacgtaacaccgcctcccatcccaaagtccaatcacggaggaagcgacgccgacatcttgctcgatctagatagtcctgccccagtgaccacacccgctccaacacctgtgtccgtcagtaatgacttgtggggcgacttttctactgcctcgtcatctgtgcccaaccaggccccacagccatctaattgggtacagttctag

SEQ ID NO: 232133 - DNA, 402 bp, Artificial Sequence
  Description of Artificial Sequence: Synthetic coding sequence
atggacgcacggccaaagctggatctgggtttcaaagagggacagactattaagctctgcatcgggaatataaccaataagaaaggaggcgctagcaagccccgtactgcgagaggcggaggactatccctcctgccccctccacccggaggaaaagtcaccatccctccacccagctcttccgtggccatttctaaccatgtgaccccgcctcccatccccaagtcaaaccacgggggatccgacgctgatatcctgctggacttagacagccccgctccagtgactactccggcaccaacaccggtttccgtctctaatgacctgtggggcgatttctcaactgcatcctcaagtgttccgaaccaggcgccacagcccagcaattgggttcagttctag

SEQ ID NO: 232134 - DNA, 828 bp, Artificial Sequence
  Description of Artificial Sequence: Synthetic coding sequence
atggcaaccgagctggagtacgagagtgtcctttgtgtcaaaccggacgttagcgtatacaggatccctcccagagcatctaaccgaggctacagagcatcagattggaagcttgatcaacctgactggacaggccgtctacgcattactagcaaagggaagaccgcgtacatcaagctggaagataaagtgagcggcgaactcttcgcccaggcccctgtggagcagtatcctggtattgccgtggagaccgttactgatagctctcgctatttcgtcattcggattcaggatggcacaggcaggtctgcatttataggaatcggcttcactgacaggggagatgcgttcgactttaatgtatccttacaggaccactttaaatgggtcaagcaggaaagtgagattagtaaagagtcccaagagatggacgccagacctaagctggacttgggattcaaagaagggcagacaataaagctgtgtattggaaacatcacgaacaagaaagggggagcctctaagccgagaaccgcacgtgggggtggtctttcccttctcccacccccacccggtgggaaagtgaccattcctccccctagctcctcagtggcgatcagtaaccatgtcacaccacctcctatcccgaagtcaaatcatggcggaagtgatgccgatatcctccttgatttagattcgccagcgcctgttacgacaccagcccctacacccgtctctgtgagcaacgacctttggggcgacttcagcactgcctcatcctcagttcctaatcaggcacctcagccctccaattgggtacagttctag

SEQ ID NO: 232135 - DNA, 558 bp, Artificial Sequence
  Description of Artificial Sequence: Synthetic coding sequence
atggaagaatctggctacgagtctgtcctctgtgtgaaacccgatgtgcatgtttacagaataccaccgcgagctaccaatcgcggttacagagcagccgaatggcaactggatcaaccttcttggtctggtagattaaggatcacagcgaagggacagatggcctacattaaactggaggatcggacaagtggcgaactgtttgctcaagctcctgttgatcagtttcccggtacagcagtagagagcgtgaccgatagcagtcgatacttcgtcatacggatagaggatgggaatggtcgacgcgcattcatcggtatcgggttcggggaccgtggtgatgcatttgatttcaacgtcgccttacaggaccactttaagtgggtgaagcagcagtgcgaatttgcaaaacaagcccagaaccctgaccagggacctaagctggatctcggattcaaggaaggacagacgattaaattgaacatcgctgtaggtctgggcaacatcaaccggagatgttcctgcaccctggcaacagcacagtcctgccattgttag

SEQ ID NO: 232136 - DNA, 792 bp, Artificial Sequence
  Description of Artificial Sequence: Synthetic coding sequence
atggaagagtcaggctacgaatccgtcctgtgcgttaagccagatgtccacgtatatagaatccctcccagagcaactaatcgcggataccgggctgcggagtggcagctagaccagccttcttggagtgggaggctgcggattactgccaaaggacagatggcgtatataaagcttgaagatcggacctctggcgagctctttgcccaggctcccgtcgaccagtttccgggaaccgcagtggagtccgttacggacagctcacggtatttcgtcataagaatagaagacggaaatgggaggcgagcatttatcggcattgggttcggagaccggggagacgcgttcgacttcaatgtagcactgcaggaccactttaaatgggttaagcagcagtgcgagtttgcaaagcaagcgcagaatcctgaccaggggcctaaactggacttagggttcaaagagggtcagaccatcaaacttaatatcgctaacatgaagaaaaaagagggggctgccggaaaccctagagtccgccctgcctccacaggaggcttaagtctgctgcccccaccaccgggagggaaaacaagcacgctcattcccccacctggcgagcaactagcggtgggaggaagcttggtgcagcccgctgttgccccttcgtctgggggtgctccagtgccctggccccagcccaatcccgcaacagcggacatttggggagacttcactaagtccaccggcagcactagcagccaaactcaaccagggaccggatgggtacagttttag

SEQ ID NO: 232137 - DNA, 792 bp, Artificial Sequence
  Description of Artificial Sequence: Synthetic coding sequence
atggaggagtcggggtacgagagcgtcctgtgtgtgaagccggacgtgcatgtctatcgcatccctcctagggccaccaatcggggttaccgggctgccgagtggcagctcgaccaacctagctggagcggcagattgagaatcaccgccaaaggccagatggcctatattaaattagaagatcgaacatccggagagctatttgctcaggcaccagtggaccagtttcctggcacggccgtagagagcgtcaccgatagctcccggtacttcgtgatccgaatagaggatggaaatggaagaagagcattcatcggcataggcttcggggaccgaggcgatgctttcgactttaatgtagccctgcaggatcacttcaaatgggtcaagcaacagtgcgagtttgctaagcaggcccagaaccctgatcagggtcctaaactggacctcggcttcaaagagggccagaccataaagttaaatatcgccaacatgaaaaaaaaagaaggagctgccggaaaccctcgggtgcgccctgcttctacaggcggtctgtcactgcttccccctcctcccggtggcaagacctcgacgctgatccctcctcccggagaacagcttgcagtgggaggtagcctcgtgcagcctgccgtggcccctagttcaggaggcgctccagttccttggccccagcctaacccagccaccgctgatatatggggagacttcacaaagagcacggggtctacgagttctcaaacccagcccggaacaggctgggtccaattttag

SEQ ID NO: 232138 - DNA, 822 bp, Artificial Sequence
  Description of Artificial Sequence: Synthetic coding sequence
atggaggaatccggctacgaatcagttctgtgcgtgaagcctgacgtgcacgtctaccgtattcccccaagagctaccaatcgcggataccgtgctgccgaatggcaactggatcaaccatcatggtcaggccgactccgcataacagccaaggggcaaatggcctatatcaagcttgaggacaggaccagcggcgaattgttcgcccaggctccagtcgatcagttccctggtaccgcagtggagtcagtgacagactcatcgcgttacttcgtgattagaatcgaggatggcaatgggcgtcgtgccttcatcgggattggattcggcgatagaggagacgctttcgatttcaacgtggctctgcaggaccatttcaagtgggtgaaacagcagtgcgagtttgccaaacaggctcagaaccccgatcagggacccaagttggacctgggatttaaagagggtcagactattaaattgaacattgccaatatgaaaaagaaagagggggctgctgggaatccccgtgtgcggccagctagtaccggcggtctcagcctcctgccgcctcctccaggcggaaagacctcaactcttattccccctcccggagagcagcttgcagtgggcggatccctggttcagcctgctgtggcaccttctagtgaccaactcccggcacggccaagccaggcacaggccggatcgagttccgacttaagcactgttttccctcatgtaacctctggaaaggccctgccccacttggggcagcgaaaggaggatgaggccctgctatcctggcccgtctttggggcatag

SEQ ID NO: 232139 - DNA, 714 bp, Artificial Sequence
  Description of Artificial Sequence: Synthetic coding sequence
atggaggagtctggtgccgctgaatggcaactggatcagccgtcatggtctgggaggcttaggatcaccgccaagggccagatggcatacataaagctggaggatcgaacctccggtgaactattcgcccaagctccggtcgaccaattccctggaacggccgtggagtctgtgaccgactctagcagatattttgtgattagaatcgaggatggcaatggcaggcgggcttttatcgggattggctttggcgatagaggggacgccttcgatttcaatgtggcactccaggaccacttcaaatgggtaaaacaacagtgtgagttcgccaaacaagctcaaaatcccgaccaggggccaaagctggatctcgggttcaaagagggccagacaatcaagcttaacatcgcgaatatgaaaaaaaaggagggagccgctgggaacccgcgtgtgagacctgcttcaaccgggggattgtcccttctgccaccgccacccggaggaaagacctctaccttaattccgcctcctggagaacagttagccgtaggcggatccttggtgcagccagccgtggccccttccagcgggggagctcccgttccttggccccaaccaaatccagctaccgctgatatatggggggacttcacgaaatccactggctcaacgagtagccagacccagccaggcacagggtgggtccagttctag

SEQ ID NO: 232140 - DNA, 792 bp, Artificial Sequence
  Description of Artificial Sequence: Synthetic coding sequence
atggaggagtctggctatgaatcagtgctgtgtgtgaaaccagatgtccacgtgtatcgaataccccctcgggcaacaaaccgaggctaccgggctgcggagtggcagctcgatcagccaagctggtccggcaggcttcgtatcacggctaagggccaaatggcatacattaagctagaggacaggacatccggcgagctgttcgcccaggcaccagtggaccagttccccggaaccgccgtagagagtgtgaccgattcctctcgctactttgtcatcagaatcgaagacgggaacggcaggagggcttttatcgggattggcttcggagacagaggagacgctttcgactttaacgtggccctacaggaccactttaaatgggttaagcagcagtgtgaattcgctaaacaagctcagaatcccgatcaggggccaaagttggatctgggttttaaagaaggccagacaatcaagttgaacattgctaacatgaaaaagaaagagggggctgccggtaatcccagggtcagaccagcgtcaacaggcggtcttagcctgctgccccctccacccggtggcaagactagcacactgataccacctcccggtgagcagctggcagtgggcggtagtcttgtccagcctgctgtggcacccagtagcggtggagcgccagtgccatggccacaacccaatcccgctaccgctgatatctggggcgactttacaaaatcaaccggctcgacctcctctcagacccagccgggaacggggtgggtccagttttag

SEQ ID NO: 232141 - DNA, 966 bp, Artificial Sequence
  Description of Artificial Sequence: Synthetic coding sequence
atgtccgaacaatcaaaagatctgtccgaccctaatttcgccgctgaagcaccaaattcagaagtccactctagccccggagtgagtgaaggggtccccccaagcgccacattggccgagccgcaatcgccccctctgggcccaacggcagcaccacaggccgcacccccaccccaggcgcctaacgatgagggtgaccctaaagcactacagcaggctgctgaggaaggcagagcccatcaagccccttctgcagcccagccaggtccggcaccacccgcaccagcccaattggttcaaaaggcacacgaactaatgtggtacgtgcttgtgaaagatcagaagaagatgataatttggttccctgatatggtgaaggatgtcatcggctcgtacaaaaaatggtgcagatccatcttaaggcgcaccagtctgatcctagctagggtgttcgggctgcatctccggctgacctcgttgcataccatggaattcgctctggtgaaggcccttgagccagaggaactggaccgggtggctctgtctaatcggatgccaatgacagggcttctcctcatgatccttagccttatctacgtgaaaggacggggagcaagggagtccgctgtgtggaacgtactgagaattttaggactccgaccttggaaaaaacacagcacgttcggagacgtaagaaaactgatcaccgaggaatttgtccagatgaattacctcaagtaccaacgcgtcccctatgtggagccacccgaatacgaattcttttggggctccagagccagccgcgagatcacaaaaatgcagataatggagttcctggccagagtgttcaagaaagacccccaagcttggccctctcgctatcgagaggctctggaggaggcacgggcactgagggaggcgaaccctaccgcccattatcccagaagctcggtgagcgaagattag

SEQ ID NO: 232142 - DNA, 915 bp, Artificial Sequence
  Description of Artificial Sequence: Synthetic coding sequence
atgctgcagaaaccacgaaatcggggaaggagcggaggtcaggccgagagagatcgggattggagccacagcggaaacccaggggcatccagagccggagaggatgcccgagtcttacgagatggctttgccgaggaagccccttctacttcgcgtggaccagggggaagccaaggcagccagggtccatcaccccagggcgcaaggcgggcacaagccgcaccagctgtgggaccaagatcccaaaagcagctggagctgaaggtgtctgaacttgtgcagtttctgctgattaaagatcagaagaagattcctatcaagagagccgatatcctgaaacacgttatcggcgattataaagacatcttcccagatttgttcaagcgcgctgcggaacggctccaatacgtgttcggctataagttggtagaactagagccaaaatcgaatacctacatcctcataaatacgctggaacctgttgaggaagatgcagaaatgagaggcgatcagggcacacctaccacagggctgctgatgattgtgctcggccttatttttatgaaggggaacactataaaggagactgaagcgtgggactttttacggagactgggtgtctatcccactaaaaagcacctaatctttggcgatcctaaaaaactgataacggaggactttgtcagacagcgttatttagagtacaggcggatacctcatactgatccggttgattacgaatttcagtgggggcctaggacaaaccttgagacttccaagatgaaagtgttgaagttcgtggccaaggtccacaatcaagatcccaaagattggccagctcagtactgcgaggctctggccgacgaagaaaatcgggcacgcccacagccatcaggacccgctccatcctcctag

SEQ ID NO: 232143 - DNA, 666 bp, Artificial Sequence
  Description of Artificial Sequence: Synthetic coding sequence
atggctttggccctagccgctctggcagctgtggagcctgcctgcggatcaagatatcaacagcttcaaaatgaggaagagtctggcgagccagaacaggctgccggtgatgctccgcctccgtactcgagtatcagtgccgagagtgctgcatattttgattataaggacgagagcggatttccaaagcctcccagttacaacgtggccacaactctgccctcatatgatgaagccgagcggactaaggccgaggccacgatccctctggtccctggacgggacgaagatttcgtaggcagagacgactttgacgacgcggaccagttacgtatcggaaacgacggtatctttatgctgaccttttttatggcttttctgtttaactggattggattcttcctgtctttttgcttgacaacttccgctgccggaagatacggcgctattagcggctttggcctttcattgatcaagtggattttaattgtgaggttctcgacctacttcccaggatactttgacggccagtactggctatggtgggtcttcctggtcctgggttttctgctctttctcaggggtttcatcaattacgcgaaggtgaggaagatgcccgagacattttcaaacctgccacggacccgagtactgtttatatactag

SEQ ID NO: 232144 - DNA, 462 bp, Artificial Sequence
  Description of Artificial Sequence: Synthetic coding sequence
atggccctggcccttgccgctctcgccgctgttgagccggcatgtggatccaggtatcagcagctgcagaacgaagaggaaagtggtgagcctgaacaagctgccggagacgcaccccctccctactcgagcatttccgccgagtcagcggcttactttgactacaaggacgagtcaggttttccaaagccaccaagttataacgtcgcaacaactctgccatcatgcttttacgacatatcacatctgatctttttcatcttctacctgagaaatatgaaaaaaaagtacaccaagatggtgaagctcctgcataagagcgcccctgcgcaatctgatagctgcaagtgtccatttatttgctgcgtctgtatcagccgcatatccatagggtcgagatccggctaccagtatatcatgcacaggagcgtggggtgcctgaaggccaagcaagaaaactag

SEQ ID NO: 232145 - DNA, 3138 bp, Artificial Sequence
  Description of Artificial Sequence: Synthetic coding sequence
atgcatcagaaaacgcctgaaatttattcagttgagctttctggcacaaaggacatcgtgaaaacggataagggagacgggaaagagaaatacagagggttgaagaacaattgtctggaactgaagaaaaaaaaccacaaagaagaatttcagaaggaactgcacttagatgaccacaagctgagtaatcgcgagctagaagaaaagtacggtactgatataattatgggactcagcagcacccgcgctgctgagctgctggcacgggacggcccaaattcactcactccccctaaacagacccctgaaatcgtaaagtttttaaagcagatggtggggggtttctcgatcctactttgggtcggggcttttctatgttggatagcctacgggatacaatactctagtgacaaatcggccagtctgaataatgtttacctcggctgcgtgttagggctcgtcgtcatcctaacaggcatatttgcttactatcaagaagcaaaatccaccaacattatgtcatctttcaacaagatgataccacagcaagccctcgtaatcagggatagcgagaagaagacaattcccagcgagcagttagtagtgggggatattgtggaagttaaggggggagaccagatcccagctgatatccgcgtcctctcatcacagggctgtagagtggataacagcagcctcactggagaatctgagccccaacctaggtcttcagaattcacacacgaaaatcctctggaaacaaaaaacatctgcttctacagtaccacttgcctggaagctagtacttctcctgttggaactgtaaccgggatggtgattaatacaggggacagaactataatcggacatatcgcttcgcttgcaagtggtgtggggaatgagaagacccccattgcaatcgaaattgagcacttcgtccatatcgtagccggtgtggctgtgtccatcggcattctcttcttcatcatagccgtgagtctgaagtatcaagtgctagattcaatcatcttccttataggaattattgtggccaatgtgcccgaaggtctgctggccacagtgactgtgaccctcagcctcactgcaaaacggatggccaagaagaactgcctcgtgaaaaacctggaggcagtggaaaccctcgggagcaccagcattatctgcagcgacaaaacaggcacattgacgcagaaccgaatgaccgtggcgcacctctggttcgacaaccagatcttcgtggctgacacgagcgaagaccattccaaccaggtgttcgatcagagttctcgcacatgggcgagtctctctaaaatcattacactctgtaatagggccgagtttaaacccggacaggagaacgtgccaatcatgaagaaagccgttattggcgatgcctccgagacagctttgctaaaattcagtgaagtaattctcggcgatgtgatggaaattcggaagagaaaccgcaaggtggctgagattcccttcaattccacaaacaagttccagctttccattcacgaaatggatgatcctcatggcaagagatttctcatggtcatgaaaggggcacctgaaagaattttagaaaaatgctcaactatcatgatcaacggggaggaacatcccctagataagagcaccgccaagacattccatacagcttatatggaactgggcggattgggtgaacgcgtattggggttttgtcacctgtacctgcccgcagatgaatttcccgagacgtacagcttcgatattgatgccatgaatttccctacatccaatctttgctttgtgggactgctctctatgatcgatccccctcgtagcactgtgcccgatgctgtgactaagtgccggtccgcaggcataaaggtgattatggtaactggcgaccaccctataaccgccaaagctatagctaagtccgtggggattatcagcgccaacagcgagaccgtggaagatatcgcccatcggctgaatatagcagttgaacaggtcaacaagcgggacgccaaggccgcagtggtgaccggcatggagttgaaggatatgtcaagtgagcagctcgacgagatcctggctaattatcaggagatcgtctttgcgaggacttctccccaacagaaattgatcatcgtggaggggtgtcagcgccaagatgcggtggtggctgttaccggagacggggtaaacgactcacctgctttgaaaaaagccgacatagggatagccatgggtatcgctgggtcagatgctgcaaaaaacgctgccgatatggtactcttggacgataatttcgcgtccattgttactggagtagaagaagggcgactcatcttcgacaacttgaagaagaccatcgcttactcactgactaaaaatattgcggagctgtgcccctttctgatctacattatagtgggcctccctcttcctataggaacaatcactatcctttttatcgatttgggtactgatataattccttccatcgccctggcctatgaaaaagcggagtcagatattatgaatcgaaaaccaaggcataagaataaagatcggcttgttaatcagcccctggctgtctactcttacttacacataggcctcatgcaggccctaggcgcattcctagtttattttactgtatatgcgcaggagggttttctccctagaacattgatcaacctgcgtgtggagtgggagaaggattacgtgaatgatctgaaggatagttatggacaagaatggaccagataccaacgcgaataccttgagtggacagggtacaccgcattcttcgtaggtatcttggtccagcaaatcgcagacttgatcataaggaagacaagaaggaacagcatattccagcagggtctctttcggaataaggtcatctgggtgggcatcacgagccagattatcattggcctcatcctgtcttacggcttaggctctgtgacagccctctcctttacaatgctgagagcacagtactggtttgtggccgtcccacacgctatcttaatttgggtctacgacgaggttcgcaagttatttattcggctctatccgggatcttggtgggacaagaacatgtactattag

SEQ ID NO: 232146 - DNA, 1605 bp, Artificial Sequence
  Description of Artificial Sequence: Synthetic coding sequence
atggcacagcttgggaagctcctcaaagagcagaagtatgatagacagcttcgcctctggggtgaccatggacaggaagctctggagtctgcccatgtctgccttatcaacgccacagccacaggaaccgaaatcctcaagaacctggtcctccctggcatcggcagtttcactataattgatggaaaccaggtcagcggagaggatgctggcaataacttcttccttcaacggagctccatagggaaaaaccgggcagaagccgcaatggagttcttacaggaactcaatagcgacgtctctgggagctttgtggaggaaagtccagagaatctgttggacaatgatcctagctttttttgccggttcactgtggtggtcgctacacagctgcccgagtcgactagcctgcggctcgccgatgtgctgtggaactctcagatcccactgctgatatgccgcacctacggactggtgggatacatgaggatcatcatcaaggagcacccagtcattgaaagtcacccggataatgccctcgaagatctccgccttgacaagcctttcccagaattgagagagcactttcagtcctatgatctagaccacatggaaaagaaagaccactcccatactccatggatcgtgatcatcgccaagtatctggctcaatggtattcagagactaatggacgtatccctaaaacctacaaagaaaaagaagacttccgggatttaatcagacaaggcatcctgaagaacgagaatggtgcacccgaagacgaggaaaactttgaagaagcaattaaaaacgtcaataccgcacttaatactacccagatcccttcatccatcgaggatatcttcaacgatgaccgctgcattaacattactaagcagaccccatctttttggatcctggccagggcacttaaggaatttgtggccaaggagggccaggggaatctgcctgttcgcggaacaatccccgacatgatcgccgacagtggcaagtacattaagctgcagaacgtgtatagagaaaaagcaaagaaggatgcggcagcagtcggaaaccatgtggctaaactgctccagtccatcggccaggccccagaaagcatctccgaaaaagagttgaagcttctatgcagtaacagcgctttcctcagggtggtgagatgcaggagcttggctgaggagtatggcttggacacgatcaacaaggatgagattatatcttctatggataatcccgataacgaaatagtgctgtatctcatgctgcgggctgtcgatagatttcacaagcagcagggtaggtacccaggagtatcaaactaccaggtggaagaagacatcgggaagctgaagagttgcctgactggctttttacaagaatacgggttatctgtcatggtgaaggatgattatgtgcatgagttctgtagatacggcgcagcagagccccacactatagctgcgtttctgggcggagccgctgctcaagaagtgattaaaatcattacaaagcagttcgttatctttaacaacacttatatttacagtggcatgtcgcaaacatccgccactttccaactgtag

SEQ ID NO: 232147 - DNA, 1587 bp, Artificial Sequence
  Description of Artificial Sequence: Synthetic coding sequence
atggatgctcagcagactaagactaatgaggctaggctgtggggtgatcacggtcaggaggcattagaaagcgcccatgtgtgtctgattaatgcaactgccacgggaacggagatactgaaaaacctggttttgccagggatcggatcattcacaattatcgatggcaaccaggtatctggggaagatgccggaaacaatttctttctgcagaggagctccattggaaagaacagagcagaggccgctatggagtttctccaggaactgaattccgacgtttccggcagttttgtagaggaaagccccgagaacctgcttgataatgaccccagctttttctgccgattcacggtcgtggtggctacgcaacttcctgagagtacatctctaagattagcagacgtcctttggaactcccagataccactcctcatctgccgcacctacggactcgttggatacatgcggatcatcatcaaggagcaccccgtaattgaaagccatcctgacaacgcccttgaggatctgcggctagataagccatttccggagctcagggaacacttccaaagctatgacttagaccatatggagaaaaaggaccactcccataccccatggatagtgattatcgccaagtacctggctcaatggtatagcgagaccaatggacgcattccaaagacatataaagaaaaggaagatttccgcgacctgatccgccagggcatattgaagaacgagaacggggctccagaggacgaagagaatttcgaggaggccatcaaaaacgtgaatactgcattgaatactacccaaatcccttcctccattgaggacatcttcaatgacgaccgttgtattaacatcactaagcagactcccagcttctggatcctcgctcgggcattgaaggaattcgtggcgaaagaagggcagggaaacctgccagtgaggggaactataccagatatgattgccgactccggcaaatacatcaagctgcaaaatgtgtaccgcgagaaagccaagaaggatgcggctgccgtcggcaaccacgtcgccaaactgctgcaatctattggccaagcccctgaaagcattagcgaaaaggaactgaaacttctctgctccaacagcgctttcctcagagtcgtgagatgccggtcacttgcagaggagtacggattagatacaatcaataaggatgagataatcagtagtatggacaaccccgacaacgagattgtgttatatcttatgttgcgggctgtagatcgcttccacaaacagcagggtaggtaccctggcgtaagcaactatcaggtggaagaggacatcggcaagttaaagtcttgtctgactggatttcttcaggagtacggactttctgttatggtcaaagatgattatgtccacgagttctgcaggtacggagccgcagagcctcatacgattgcggctttcttgggcggagctgcagcccaggaagtgatcaaaattattaccaagcaatttgtgatttttaataatacctacatttattcaggcatgtctcagacaagcgccacattccagctttag

SEQ ID NO: 232148 - DNA, 1338 bp, Artificial Sequence
  Description of Artificial Sequence: Synthetic coding sequence
atggagttcctccaagagctcaattcagacgtgagcgggtcttttgtcgaggaatctccagaaaatctcctcgacaatgatcctagcttcttctgtcgcttcacagttgtggtggccacgcagctgcccgagtccacttctctacgcttggctgacgtgctctggaattcccaaatcccacttctgatttgccggacatacggactggtgggatatatgcggattatcatcaaggaacaccctgtgatcgagtcacatccagataatgcattggaggacctgcggctggacaagccattcccagaactgagagaacatttccagagctatgatcttgatcacatggagaaaaaagaccacagtcataccccatggatcgtcatcatagccaagtatttagcccaatggtactccgagaccaacgggaggatccctaaaacttataaagaaaaagaggattttagagatctgatccgccaggggattctcaagaatgagaatggagccccagaggacgaggagaactttgaagaggctattaagaatgttaatacagccctgaataccacacagatacccagtagcatcgaagatatatttaatgatgaccgatgcattaatattacaaagcagactccgagtttctggatcctcgcgagggccctgaaggagttcgtcgccaaggaaggacaagggaacctacctgtgcggggaactatccccgacatgatcgccgacagcgggaagtacattaagttacagaatgtctaccgcgaaaaagccaaaaaggacgcggcagcagtcggcaaccacgtggctaagctgctacagtccatcggccaggcacctgagtcaataagcgagaaggagttgaagctgctgtgcagtaacagcgcgttcctcagagtggtcaggtgtaggagcttggccgaggaatacggactggatacgataaacaaggatgagattatttcatccatggacaatccagataacgaaatagtgctatacctgatgctccgggctgtcgacagattccacaagcaacagggacgatatcccggagtttctaattaccaggtcgaagaggatatagggaagctcaagagctgtctgacgggattcctccaggagtatggtctctctgtgatggtgaaggacgactatgtccatgaattttgtcggtacggagccgcagagcctcatacaatagctgcatttttaggcggagctgccgcacaggaggtaataaagatcatcaccaagcaattcgtgatcttcaacaatacctatatctacagcggcatgtctcagacgtctgccaccttccaattatag

SEQ ID NO: 232149 - DNA, 2901 bp, Artificial Sequence
  Description of Artificial Sequence: Synthetic coding sequence
atggaaccgcaggttaccctcaacgtgacttttaaaaatgaaatccaaagtttcttggttagtgacccagagaatacaacttgggctgatatcgaggccatggtgaaagtctcctttgatctcaataccatccagattaaatacctcgatgaggagaatgaagaggtcagtattaattcccagggcgagtacgaagaagccctcaaaatggctgtgaagcaaggaaatcagctgcaaatgcaggtgcacgaaggccatcacgtggttgatgaagcgccaccaccagtggtgggggcaaagagactggcggctcgtgcgggaaagaagccactagctcactattcctcactggtgcgcgtgctgggctcagatatgaagactcccgaagaccccgctgttcagtccttcccacttgtgccttgtgatacagatcaaccacaagataagcctcctgactggtttacttcatacctggaaactttccgggaacaggtcgtaaacgagactgtggaaaaactcgaacagaaactgcacgagaagctggtgctgcaaaatccctccctgggtagctgtccttcggaggtctcgatgccaacctcggaggagaccttgtttttgccagagaatcaattctcttggcacatcgcatgtaataattgccagagacggattgtgggcgtccgctaccagtgcagtttgtgcccttcttacaacatctgcgaagattgcgaggcagggccttacggtcatgatactaatcacgtgcttctgaagcttcgcagacccgtcgtaggtagctcagagcccttttgccacagcaaatactcgactccacgcctccctgcagccttggagcaggttcgcctgcagaaacaggtggacaagaatttcctgaaagcagagaaacagagactgcgcgcagaaaagaagcagaggaaggccgaagtaaaggaactgaaaaagcagctcaagctgcaccggaaaatccacctctggaattcaatacacggtctgcagagccccaaaagcccactcggcaggccagaatccctgctgcagtccaataccttaatgctgccccttcagccctgtacaagcgttatgccaatgttgagcgccgcttttgtggacgagaacttacccgacggaacgcatctgcagccaggcaccaagttcatcaagcactggcggatgaagaatacaggcaatgtgaaatggtccgcggacacaaaactaaaattcatgtggggcaatttgacactggccagtacggagaagaaagacgtgctggtcccgtgcctgaaagccggtcatgttggggtcgtctctgtcgaattcatcgctcctgctttggaaggcacttacacatcccactggagattgtcccacaaaggccagcagttcggaccaagggtgtggtgtagcataatcgtcgacccatttccatctgaagagagccccgacaacatcgaaaagggaatgatatccagtagcaaaactgatgatctgacttgtcagcaggaagagacatttctacttgccaaagaagaacggcagcttggcgaagtcaccgaacaaactgagggcacagctgcctgtattcctcagaaggctaagaatgtggctagcgaacgcgaattatacataccatctgttgatttgctaaccgcgcaggacctgctgtcgttcgagcttctcgatatcaacatcgtacaggaactggagcgggtgcctcacaacacacccgttgatgtgacaccttgcatgtcaccactaccgcatgattcacccctcattgagaagccaggattgggccaaatcgaggaggaaaacgagggggctggattcaaggctctgccagacagcatggtgagcgttaagcggaaggctgagaacattgcttccgtcgaggaggcggaggaggatctctccggcacccagttcgtatgtgaaactgtgatccggtcgctgaccttggacgccgctcctgaccataatccgccttgtcgacagaagagtctgcagatgacctttgcgttacctgaagggcctctgggcaatgagaaggaagagattatacacattgcagaggaggaggctgtcatggaggaagaagaagacgaggaagacgaggaggaagaggatgagcttaaagatgaagtgcagtcccagagctctgcctcatccgaagactacataatcattctccccgagtgtttcgacacaagtcggccactgggggattccatgtatagttctgccctgtcccagcctgggcttgagaggggggctgaaggaaaaccaggagtggaggccggtcaagagcccgctgaggcaggggaacgcctcccaggcggtgagaatcaaccgcaagagcacagtatttcagatatcctgaccactagccaaacactcgagacggttccgcttattcccgaagtcgtcgaactaccacccagtctcccaagatctagcccctgcgtccaccaccacggaagtcccggagtcgacctcccagtcaccatccccgaagtgtccagcgtaccagatcagattcgcggagagccgagaggatcctcaggactggtcaatagtagacagaagagctatgatcattcacgtcatcatcacggctcatctatagcaggaggtctcgttaaaggggcacttagtgtagcggcaagcgcttacaaggccttgttcgctggcccacccgtgactgcgcagcccattatttcggaggatcagacagccgctctgatggcacacttatttgaaatgggcttctgcgatcgccagctgaacttgcggcttttgaaaaaacataactacaatatcctgcaggtagtgacagaactgcttcaacttaataacaatgattggtatagtcaacggtattag

SEQ ID NO: 232150 - DNA, 2814 bp, Artificial Sequence
  Description of Artificial Sequence: Synthetic coding sequence
atggaaccccaagtcaccctgaatgtcacttttaaaaatgagattcaatcatttcttgtatcagatccggagaacacgacatgggccgacatcgaagcaatggtgaaagtctcctttgatttgaacaccatccaaataaaatacctggatgaggaaaacgaagaagtaaagatagtactgctgggagaatatgaggaggcactcaagatggccgtgaagcagggcaaccagctccagatgcaggtgcacgagggtcaccacgtggtggatgaggcaccaccacctgtggtgggcgcaaaaaggttagcagcccgagccggtaagaagccattagcccattatagtagtctggtccgggttttgggatctgatatgaaaacaccggaggaccccgcagtccagagtttccctctggtaccttgcgacacagaccagccacaagataagcccccagactggtttacatcctaccttgagactttcagggaacaggtggtcaatgagacggttgaaaaactggagcagaagctgcacgagaagctcgtcttacagaacccaagcctcggcagttgtccgtccgaagtgagtatgccgacttccgaggaaactctgttcctgcccgagaatcagttctcttggcacattgcatgcaacaactgccagcggagaattgttggcgttcgctatcagtgcagtctctgtccgtcatacaatatttgcgaggattgtgaggcagggccatacggacacgacactaatcatgtcctgctgaagctgcgtagaccggtcgtcggctcctcggagcctttctgccacagcaagtatagcacacctcgtctacctgcagctctggaacaagtcaggcttcagaaacaggtggacaaaaatttcctaaaggcagagaagcagcgcctgagagcagaaaagaaacaaaggaaggcagaggtcaaagagctaaagaagcaactgaaactgcaccgcaaaatccacctctggaattcaatccatggattacagtctccaaagagtccactgggacgaccggagtctctattgcaatccaataccctgatgttgccattgcagccgtgtacatccgtaatgcccatgctaagcgctgccttcgtcgacgagaacctgcctgatggaacccacctccagcctgggacaaaatttatcaaacattggcgtatgaagaacacaggaaatgtgaagtggtccgctgacaccaagctgaagtttatgtggggcaatcttactcttgccagcaccgagaagaaagatgtactggtcccatgcttgaaagcaggccacgtgggcgtcgtcagcgttgaatttattgctcctgccttagaaggcacttataccagtcattggcggctttctcacaaaggacagcaattcggcccacgagtgtggtgctctatcattgttgacccttttccaagtgaagaatctccagataatattgaaaaggggatgataagctccagcaaaactgatgatctcacttgccagcaggaagagactttcctcttggctaaagaggagcgacagctgggcgaggtgacagaacaaaccgaaggcactgctgcctgcattccacaaaaagcaaagaacgtagctagcgagagggagctatatattccaagtgtggacctcctgacggctcaggacttattgtcgtttgaactgttggatatcaatattgtgcaggaactcgagcgagtccctcataatacgcctgtcgacgtcaccccttgcatgtccccccttcctcacgactcacccctgatcgagaagccgggattgggccaaatagaggaagaaaacgagggagccggttttaaggccctgccggattcaatggtgtccgtaaagaggaaagctgaaaatatagcttctgtcgaggaagctgaggaagatctatccgggactcagttcgtatgtgaaaccgttattaggagtctgaccctggatgccgcaccagatcacaacccaccctgtcgccaaaagtcactgcaaatgacgttcgcattgcccgagggccctctggggaacgagaaggaagagattattcatatcgctgaagaagaagccgttatggaggaggaggaagatgaggaagatgaggaggaggaggacgagcttaaggatgaggttcaaagccagtcctccgcatccagcgaagactacatcattatcctgccagagtgttttgatacatcgcgaccactgggcgattctatgtacagcagcgcactgtcacagcccggactggagaggggggctgaaggcaagcctggcgtggaagctggacaggagccagcggaagccggagagcgtctgcccggaggggagaatcagccccaagaacacagcattagcgatatactgactacatctcaaacgctggaaacagtgcctcttattcctgaagtggttgaactgcccccttccctcccacgatcttccccgtgtgtccatcaccatgggtcaccaggtgttgacctcccagtgactatccccgaggttagttccgttccggatcagattcgcggagaacctcgcggatctagtggattagtcaattctcgacaaaaatcgtatgatcactctcgtcaccatcatggcagcagtattgctggcggactggttaagggggctttatccgtagcagcctcggcatataaagctttgtttgcgggtcctcctgtgaccgcccagggactttggggtctgttgtcattcctccacctagccaagaagtgcttctttttaaaggccccaagcgaagcttttagttggttctag

SEQ ID NO: 232151 - DNA, 2901 bp, Artificial Sequence
  Description of Artificial Sequence: Synthetic coding sequence
atggaaccccaagttacattaaatgtaacttttaagaatgaaatccagagcttcctcgtgtctgaccctgagaacacaacttgggcagatattgaggcaatggtcaaggtgtcgtttgaccttaatacaatccagatcaaatatttggatgaagagaacgaggaggttaagattgtgttgcttggagaatatgaggaggcccttaaaatggccgttaagcagggaaatcagctccagatgcaggttcacgaaggccatcatgtcgtagatgaggcgcctccaccggttgtgggcgctaagcggctggccgcaagagcgggaaagaaacccctggctcattatagcagcctcgtcagagtgttgggaagcgacatgaaaacaccagaagaccccgctgtacagagcttccccctagttccgtgcgataccgatcagccccaggataaaccacccgattggttcacttcctatcttgaaaccttccgggagcaggtggtgaatgaaactgtggagaagttggagcagaagttgcatgaaaagctcgtccttcagaacccctctttaggatcttgtccttctgaagtctccatgcccacgagtgaagagaccctgttcctccccgaaaaccagtttagctggcacatcgcatgtaacaattgccagcgcaggatcgtgggagtgcgctatcaatgctccttatgtcccagctacaacatttgcgaagactgcgaggcagggccatacggacacgatacaaatcacgttctgctgaagcttcgaaggccggtagtcggatcctctgaacctttttgtcatagcaaatacagtactcctcgcctcccagcagcccttgaacaggtccgcttgcagaaacaagtagacaaaaatttcctcaaggctgagaagcaacgactgcgggctgagaagaagcagagaaaggccgaggttaaggaactcaagaagcagctaaaattgcaccgcaagattcacctgtggaacagcattcacggtctgcagtctccaaagtctccactggggcgtccagagtcactgctccaaagcaacacactgatgctcccgttacagccttgcacatccgttatgcctatgttgtcggccgcttttgtggatgagaatttgcctgacgggacccatcttcagccaggcacaaaattcatcaaacattggagaatgaaaaatacaggtaacgtgaagtggagcgccgatacaaaactaaaatttatgtggggaaatctgactcttgcctccacggagaaaaaggacgtactggtgccatgccttaaagcaggacacgtcggagtggtaagcgtcgagttcattgccccagccctggaaggaacttacaccagccactggcgtctaagccacaaaggacagcagtttggacctagagtctggtgttcaattatcgttgacccttttcccagtgaggaatcacccgataacatcgagaagggaatgatctcatcatctaaaaccgacgacctgacctgccagcaggaggaaacttttctgctagctaaagaagagcggcagctgggcgaggtaacagagcagactgagggtaccgccgcatgtattcctcaaaaggcaaaaaatgtggctagcgagcgcgagctgtacatacccagtgtcgacttactaacagcacaggacttgctgtccttcgaacttctggacattaatatagtacaagaacttgagagggtgcctcacaatacccctgttgatgtgacgccctgtatgtctccactgccccacgatagcccattgatcgagaaaccaggactggggcagattgaggaagagaacgaaggcgctggattcaaggctttgcctgattccatggtgtctgtgaagcggaaggccgagaatatcgcctctgtggaggaggccgaggaggacctctcggggacacagtttgtctgcgagacagttatccgctccctaactctggacgctgcccctgatcacaaccccccatgtagacagaagtccctgcaaatgactttcgcgctgccagaggggccactggggaatgagaaggaggagatcatccacatcgctgaagaggaggccgtcatggaagaagaggaggacgaggaggacgaagaagaagaagatgagctcaaggacgaggtacagtcgcaatcctccgcatcttcagaggattacatcatcatactgcctgaatgcttcgacacttctagaccgctgggtgattctatgtatagttccgccctgagtcagcctgggttagaacgaggcgcagaggggaagccaggcgtggaggctggacaggagccagcggaagcaggggagcggctgcccggtggcgaaaatcagcctcaggagcatagcatcagcgacatcttgactacatcccagaccctagagactgtcccgctgatcccagaagtggtggagctccctccgagcctccctcgctcttccccctgtgtacatcatcacgggtctccaggggttgacctccccgtgacgatcccagaagtgagctcagtccccgatcaaattaggggcgaacctagaggcagctctggcctggtcaactcgagacagaagtcctacgaccattctcggcatcaccacggctcaagtatcgccggtggcctggtcaaaggtgccctgtctgtcgccgcaagcgcatataaagccctgttcgcaggcccacccgtcactgctcagcccatcatctccgaggaccaaactgccgctctaatggctcaccttttcgagatggggttctgcgatcgccagctgaacttacggctgctaaaaaagcataactataacattctgcaggtggtgacggaactcctccaactgaataataatgattggtatagccaacgctactag

SEQ ID NO: 232152 - DNA, 2901 bp, Artificial Sequence
  Description of Artificial Sequence: Synthetic coding sequence
atggaacctcaggttactctcaacgttactttcaaaaatgaaattcaaagctttctggtctctgatcctgagaacacgacttgggctgacatcgaagctatggtaaaagtttctttcgatcttaacacaatccagattaaatatctggacgaagaaaatgaagaagttagcattaattctcagggcgagtacgaagaggccctaaaaatggccgtaaaacaaggtaaccaactgcagatgcaggtccacgaagggcatcacgttgtcgatgaggcaccgcctcctgtcgtaggcgcaaagaggctggccgctcgagccggaaagaagcccctcgcacactactcaagtctggtcagagtcttaggatctgatatgaaaacccccgaggacccagccgtgcagagcttccccctggtcccatgcgatacagaccaaccacaggacaagccacctgattggttcacctcttatttagaaacattcagagaacaagttgtgaatgaaacagtcgagaaactcgaacagaagttgcacgagaagttggtgctgcagaatccctcattaggtagctgtccttccgaagtttccatgcctacatcagaagagacgctcttcctgccagagaaccagttcagctggcatattgcctgcaataattgtcagcggaggattgtaggggtcagataccagtgttcactgtgcccctcatacaatatttgcgaggactgtgaggcgggaccctatggacacgatactaatcacgtgttgctaaagctgcggaggcccgtggtcgggtcttcagaacctttttgtcattcaaaatacagcacacctagattgccagccgctctcgagcaagtccgcttacaaaaacaagttgacaagaactttcttaaagccgagaaacagaggctgagggccgagaagaagcaacgaaaagccgaagtcaaagaattgaaaaagcagttgaagcttcatcgaaagatacatctgtggaactctatccacggtctgcagtctcccaaaagcccgttggggaggcctgaaagcctgttgcaatcaaatacattgatgctgcctttacagccatgcacctctgttatgcccatgttaagtgcagcctttgttgacgagaacctacctgatggaacacacctgcagcctggcaccaaatttatcaagcactggcggatgaaaaataccggcaacgtgaaatggagcgcagatacgaagctcaagtttatgtggggcaacctcacactggcgtcgacagaaaaaaaggacgtgctggtcccctgtcttaaagcgggtcacgtgggggtggtgagtgtggagtttatcgcgccagctctggaaggcacttacacaagccattggagactctctcacaagggccaacagtttggcccacgggtgtggtgtagtataatcgtcgatcctttcccctccgaggaatcaccagataacatcgagaagggcatgatcagctctagcaagacggatgatcttacctgccagcaagaagagacttttctgctggccaaagaagagaggcagctcggtgaagttaccgaacaaaccgagggaaccgctgcatgcatcccccagaaggcaaaaaatgtggccagtgagagagaactttatatccccagtgtggacttactgactgctcaggacttactgagtttcgagctactggacatcaacatcgtccaagagcttgagcgggtgccacacaacacccctgttgatgtgacaccctgcatgtccccactcccccacgattctccgcttatagagaagcctgggctgggacagattgaggaggaaaatgaaggcgctggctttaaggccctccccgattctatggtgtccgttaaaaggaaggccgaaaacatcgccagtgtcgaggaggccgaggaggatttaagcggtactcagttcgtgtgtgaaacggtcattagatcacttactcttgatgctgcaccagatcacaacccaccatgtcgacagaagagcctccagatgaccttcgccctacctgaaggtccccttggaaacgagaaagaggagatcatacatatcgcagaggaggaggccgtgatggaggaggaggaggatgaggaggatgaggaggaggaggatgagctgaaagatgaagttcagagtcagtcttctgcctcgtccgaagactatatcataatactaccagagtgcttcgacacctcacgacccctcggggattcgatgtacagcagtgccctgagccagcccggtctggagcggggagctgaaggaaagcctggtgtcgaagccggtcaggaaccagccgaagcaggggaacgtctgcctggtggtgaaaatcagccccaggagcactctatcagcgatatactcacaacttcccagacattagaaaccgttcccctaatcccagaagtggttgagttacccccaagtctcccaaggagtagcccctgcgtgcaccatcacggaagtcccggtgtagatctgcctgtgacgatccccgaggtatcttcagtgcctgatcagattagaggggaaccaagggggagcagtggtctggtgaacagtcgccaaaagtcctatgaccatagccgccaccaccacggaagcagcatcgccggtggtctagtgaagggggctctttctgtggccgcatctgcttataaggccctgttcgctggccctcccgtgactgcacaaccgattatttctgaagaccagacggctgccttgatggctcacttgttcgaaatgggtttctgcgaccgccagctgaatctgagactgttaaagaagcacaattacaacatcctgcaggtcgtcactgaattattgcagctcaacaataatgactggtattcacaaagatactag

SEQ ID NO: 232153 - DNA, 654 bp, Artificial Sequence
  Description of Artificial Sequence: Synthetic coding sequence
atgtatagttcagcactatcccagcctgggctggagcgcggtgcggaaggaaagcctggtgtcgaagctggacaggaaccagccgaggctggcgaacgtctccctggcggagagaatcagcctcaggagcattcaatttctgacattctcactacctcacagaccctagaaaccgttcccctcatcccagaggtcgtggagttgccgccatccctgcctcgcagcagtccttgtgttcaccaccatggctctcctggggtggacctcccagtaaccatcccggaggtgtcttctgtgccggaccagataagaggagaaccacgtggctctagtggccttgtcaactcaaggcagaagagctatgaccactctagacatcaccatggatcaagcatcgccggaggcctggtcaagggtgcgctgtctgtggccgctagtgcgtacaaagcattgttcgccggaccgcctgtcacagcacagccaataatcagcgaggaccagacagcagccctgatggctcacctgttcgaaatgggattttgtgataggcagcttaacttgagattgctcaaaaagcacaactacaatattcttcaagttgttaccgaactgctgcagctgaacaataacgactggtatagtcagagatactag

SEQ ID NO: 232154 - DNA, 2514 bp, Artificial Sequence
  Description of Artificial Sequence: Synthetic coding sequence
atggagccccaggtgaccttgaacgtcacctttaagaatgaaatccagtcgttcctggtgtctgacccagaaaacacgacctgggcggacatagaagctatggtgtccataaattcccaaggcgaatacgaagaggctcttaagatggcggtcaaacagggaaaccagctgcagatgcaagtgcacgaagggcatcatgtggttgatgaagctcctccccctgtggtgggggctaaaagactagcagccagggctggtaagaagcccctggcccactacagcagtctcgtaagggtcctgggcagtgatatgaaaacccctgaggatccagctgtgcaaagtttccctcttgttccctgtgacactgatcagccccaggacaaaccccctgactggtttacttcgtacttagagacatttcgggagcaggtggtgaacgagaccgtggagaaactggaacagaagttgcacgaaaaactcgtgttgcagaatccctctcttggttcatgcccgtcagaggtcagcatgcccacgtctgaagagaccctctttttgcctgagaaccagttctcatggcacattgcatgcaacaactgccagaggaggattgtcggagttcgctaccaatgctccctgtgcccgtcttataatatctgcgaagactgtgaagccggaccgtacggccatgacaccaatcatgttcttcttaagcttcgaagacccgtggttggctcctctgaacctttctgccacagcaaatactcgactcctcgactgccggcagctcttgaacaggtgagactgcagaagcaggtggacaaaaattttctgaaagctgaaaaacagagacttagggcggaaaaaaaacaacgcaaggctgaagtcaaagaactgaagaaacagctgaagttacatagaaaaatccacctgtggaactctatacatggactacagtcgccaaaatcacctctcggaagacctgaatccctgctgcagtccaacactctgatgctgccactgcagccctgtacttctgttatgccaatgctctcagctgccttcgtggatgagaacctgcctgacggcacccatctgcagccaggtaccaagttcattaagcattggcggatgaagaacacaggcaatgtgaaatggagtgccgataccaaactgaagtttatgtggggcaacttgacactggcgtcaacagaaaaaaaagatgttcttgtgccctgtctgaaggctggccatgttggcgtcgtaagtgtagagttcatcgctcctgcacttgaaggaacgtacacatcacactggcggctgagccacaaggggcagcagtttgggcctcgtgtctggtgttccatcatcgttgacccctttccctcagaagaatctcctgacaacattgaaaaggggatgatctcttcatccaagaccgacgacttaacttgccagcaggaggaaacattcttactggccaaagaggagcggcagttgggcgaagtaactgagcagactgaggggaccgcagcctgcattcctcagaaggctaaaaacgtcgcgtcagagcgcgagctttacatcccctccgttgatctccttacggcccaagatctgctcagcttcgaactcctcgatatcaatatagttcaggaactggagagggtaccacacaacaccccggttgacgtaacaccctgtatgtccccattaccccacgacagtcccctgattgaaaagcccggtctcgggcagattgaagaggaaaacgagggcgctggcttcaaggcactccctgactctatggtctctgtcaagagaaaagcagagaacatcgcgagtgtggaggaagccgaggaggacttgagcgggacacaattcgtctgtgaaaccgtgattcggtccctgacattagacgctgcccctgaccacaatcctccctgcaggcagaagtctctgcaaatgaccttcgccctgcccgagggtcccctcggcaacgaaaaggaagagattatccacatcgctgaggaagaggccgtaatggaagaagaggaggatgaagaagatgaagaagaagaagatgagttgaaggatgaagtccagtcccagagctccgcaagttctgaggattacataataatcttgcctgagtgtttcgacacctctagacccctgggcgatagcatgtacagtagtgcgctctcacagcccggactcgaacgtggagccgagggcaaaccaggagtagaggcaggtcaggagccagcagaggccggagaacgccttccgggtggagagaatcaaccccaggagcactccattagtgacatcctcacaacatcccagacactcgaaaccgtccctctgatacccgaagtcgttgaactccctcctagcctgccaaggtcttccccttgcgttcaccatcacgggtctccaggcgttgatctgccggtgactataccagaggtcagctctgtccctgaccagatccggggagcgaataatttctag

SEQ ID NO: 232155 - DNA, 2262 bp, Artificial Sequence
  Description of Artificial Sequence: Synthetic coding sequence
atgcccatggacctcattttggtggtttggttttgcgtctgcacagccagaactgtcgtgggatttggtatggaccccgatctccagatggatatcgtgaccgaactggatttagtcaacacaactttaggcgtcgcacaggtaagtggaatgcacaatgccagtaaggcgtttctgttccaggacatagagcgtgaaatccacgccgcacctcatgtctctgagaaactaattcagctgttcagaaataagtccgaattcacaatactcgccaccgtacaacagaagccgtctacttccggggtgatcttgtctatcagagagctggagcacaggatctacgaacgcgtgatagatccaccagatacaaacctgccacccggaatcaatttgtggctgggacaacgcaaccaaaaacacggtctgttcaagggtatcatccaagacggaaagatcatcttcatgccgaatggatacattacacaatgtcccaacctaaaccatacatgtcccacttgttctgatttcctgagtttggtgcagggcataatggacctgcaggaattactggccaaaatgactgccaaacttaactatgcggaaacccggctgtcccagctcgagaactgccactgtgagaagacatgccaggtctcggggctactttaccgtgatcaggatagctgggtcgatggcgatcattgccgtaattgcacctgcaaatccggtgccgtggagtgtcgcaggatgagttgtccccctctcaattgcagtccagatagtctccccgtgcacatcgccggtcagtgttgcaaggtgtgcaggccgaagtgtatatatggcggaaaagtgctggcagaaggacagcggatcctgactaaaagctgccgtgagtgtcgtgggggagtgctggttaaaattaccgagatgtgccctccgcttaactgtagcgagaaggaccatattttacctgagaatcagtgctgcagagtgtgcaggggccataacttctgcgccgaaggacccaagtgtggcgaaaattctgagtgcaagaattggaatacgaaagcaacttgcgagtgcaagtcaggatatatctccgtgcaaggggactctgcgtactgcgaagacatagacgagtgcgctgcaaagatgcattactgtcacgccaatacagtgtgcgttaacctgcccggtttgtacagatgtgactgcgtacctggctatatccgcgtggatgacttttcctgcactgaacacgatgagtgtgggagcgggcagcataactgcgatgagaacgcaatttgtacaaacacggtgcaaggacatagttgtacatgtaagccgggatatgtgggaaacggtacaatttgccgagctttctgcgaagagggctgccgctatggaggaacttgcgtagcgcctaacaaatgtgtgtgtccatccgggtttaccggtagccattgcgagaaagacatagacgaatgttcggaagggattatcgagtgtcataaccattcaagatgtgtcaatcttccaggctggtaccattgcgagtgccggtccggatttcacgatgacgggacttacagtctgtccggtgaatcgtgtatagatatagatgagtgcgcactcaggacccacacatgctggaatgactctgcatgtatcaatctcgcaggcggattcgattgcctgtgcccttctggccctagctgcagcggggattgtcctcatgagggaggtcttaaacacaatggacaggtgtggaccctcaaagaagatcggtgttcggtctgcagctgcaaagatggtaagattttttgccggaggacggcctgtgattgtcagaatcccagtgccgacttgttctgctgtccagaatgcgacaccagagttacatcacaatgtttggaccagaacggtcataagctgtatcgaagtggtgataactggactcattcctgtcagcagtgcaggtgcctggagggagaggtcgattgttggcccctgacttgtccaaatttatcttgtgagtacacagccatcttggagggggagtgttgtcctagatgcgtgtcagacccctgcctggccgataacatcacctacgacatcaggaagacatgcctcgattcttacggggtctctcgcctgtccggatctgtgtggacaatggccggatccccctgcaccacctgcaaatgcaaaaatggcagagtgtgctgttcagtggacttcgaatgccttcagaacaactag

SEQ ID NO: 232156 - DNA, 2433 bp, Artificial Sequence
  Description of Artificial Sequence: Synthetic coding sequence
atgcccatggaccttatactcgttgtctggttctgtgtttgtacagccaggacagtggtcggcttcggcatggatccggatcttcagatggatattgtgaccgagttagatctcgtaaacacaaccctgggagtggcccaggtatcaggcatgcacaatgcttctaaggcctttctctttcaggacattgagcgagagatccatgccgcaccacatgtttccgaaaagttgatacagttgtttcgtaacaagtccgaatttacaatcctggccacagtccaacaaaaacccagcacctcaggagtcatcctgagcatacgcgagctggagcattcatatttcgagctagagagctccgggctgcgcgacgaaatcagatatcattacatccacaacggcaagcccagaaccgaggccctgccttacagaatggccgatggacagtggcataaggtcgctttgtcagtatccgcctcgcatcttctgctgcacgtggactgtaataggatctacgaaagagtgatcgatccgcctgatacaaacctcccccctggcatcaacctgtggctggggcagcgaaaccagaaacatggattattcaagggcattattcaggacgggaagattatctttatgcctaacggttacattactcagtgccctaacctcaatcacacgtgtcctacttgtagtgactttctgtccctcgtgcagggtatcatggacctacaagaattactggcgaagatgaccgctaaactgaactacgccgagacgagactctcccagctcgaaaattgtcactgtgagaaaacctgccaagtgtccggacttctgtaccgcgatcaagattcctgggtggacggtgatcactgtcgcaattgcacctgtaagtccggagctgtagaatgtagacggatgtcctgtccaccccttaattgtagcccggacagcttgcctgttcacatcgccggacagtgttgcaaagtgtgtcgaccgaaatgcatctacggcggtaaggtactcgccgagggtcagcgcattctgacgaagagttgtagggagtgtagaggcggtgtgctggtaaaaatcactgaaatgtgcccacccctgaactgctccgaaaaggaccacatacttcctgaaaatcagtgttgtcgcgtgtgtaggggacataatttctgcgctgagggaccgaagtgtggcgaaaactcggaatgcaagaactggaacaccaaagctacttgcgaatgtaagtcaggttatatctccgtacaaggtgactcggcgtactgcgaggacatcgatgagtgtgcggctaagatgcactactgccacgctaacacagtgtgtgttaatctgccagggctttacagatgtgattgcgtcccaggttatataagagtggatgatttttcttgtacagaacatgacgagtgcggctctggtcagcacaactgtgacgaaaacgctatttgcaccaatactgtgcaagggcactcttgcacatgtaaacctggctatgtcggtaacgggacaatttgccgggcattttgcgaagagggttgtcgctacggaggaacgtgcgtagcccctaacaaatgcgtatgcccaagtggatttactggttcccactgtgagaaggacatcgacgaatgtagtgagggcataatagaatgtcataatcactctagatgcgtgaatctcccagggtggtatcattgtgaatgcagatccggatttcatgacgacgggacgtattcgcttagtggcgagtcttgtatcgacattgatgagtgtgcattgcgcacacacacctgctggaacgactctgcatgtatcaaccttgctggcggttttgattgcctatgtcctagcggcccttcatgttcaggcgactgcccccatgaagggggactgaagcataacggccaagtgtggacactgaaggaggacagatgtagcgtgtgttcctgcaaggatggcaaaatcttctgtaggcgcacagcctgtgattgccagaacccatcagcggatctgttttgctgccccgaatgtgacacacgggtgactagccagtgtctcgatcaaaacggtcacaaactgtaccgttctggtgacaactggacacattcatgccagcaatgccgttgtttggaaggggaggtggactgctggcccctgacatgccccaacctgagctgcgaatacactgctatcctcgagggggagtgctgtccacgctgcgtttcggatccatgtcttgctgataatattacatatgacattcgtaagacttgtctggacagctatggggtgtctcggctgagtggctctgtatggaccatggccggatctccctgcaccacatgtaaatgcaagaacggaagggtttgctgcagcgtcgacttcgaatgcctgcaaaataactag

SEQ ID NO: 232157 - DNA, 2292 bp, Artificial Sequence
  Description of Artificial Sequence: Synthetic coding sequence
atgccgatggacttgatcctggtcgtgtggttctgcgtttgtacggcccgtaccgtagtcggcttcgggatggacccagaccttcagatggacatcgtgacggaacttgatctggtgaacacaaccctgggagtagctcaagtgagcggaatgcacaatgcatcgaaagcctttctgtttcaggatatcgaacgcgaaatccacgcagcccctcatgtatccgaaaagttaatccagctgttccggaataagtctgagttcacaatcctcgctaccgtgcagcagaagccctccacctccggagtgatcctgagcatacgcgaactagaacactcttactttgaattggaaagcagtggactgcgcgacgaaatccggtatcactatattcacaatggtaaaccacgtactgaggccctaccgtaccggatggccgacggccagtggcacaaagttgcccttagtgtctcggccagccaccttctcctgcacgtggattgcaataggatctacgaacgagtaatagatcccccagacaccaacttaccccctgggatcaacttgtggctggggcagcggaaccaaaaacatggcctgtttaaggggataattcaggacggtaaaataattttcatgccgaatggctatatcacccagtgtccaaatctgaatcatacgtgcccaacttgctctgacttccttagccttgttcagggcattatggacctgcaggagctgctggccaagatgaccgcaaaactgaactatgccgagactaggctttcccagctcgaaaactgccattgtgagaaaacatgtcaggtgagcggccttctttaccgggatcaggattcatgggtggacggagatcactgcaggaattgtacgtgtaaaagcggcgctgttgaatgtaggcggatgtcctgcccaccactgaattgttcccctgattccttgcccgtgcacattgctgggcaatgctgtaaggtttgtagacccaagtgcatctacggaggcaaagtactggctgaaggtcagagaattctcaccaagagttgcagggaatgccgtgggggtgtgttggtgaagattacagagatgtgtccccctctcaattgctcagagaaggatcatattctcccagagaatcagtgttgccgggtctgcagggggcataatttctgtgctgaaggccctaaatgcggtgaaaattctgagtgtaaaaactggaataccaaggccacctgcgaatgcaagagcgggtatatttccgtgcaaggagattcagcttactgcgaggacatcgacgaatgcgccgctaagatgcactattgccacgccaacacagtttgtgtgaatctcccgggactttaccgttgtgactgcgttcctggctacatccgcgttgacgattttagctgcacagaacacgatgaatgtgggtctggacaacacaattgtgacgagaacgctatctgcacaaatactgtccagggacattcgtgtacctgcaagcctggctatgtgggaaacgggaccatctgccgcgctttttgtgaggaagggtgccggtatgggggaacttgcgtggctccaaataaatgtgtctgccccagtggatttaccgggtctcattgcgaaaaagatatcgatgaatgtgccctgcggacccatacgtgctggaatgacagcgcgtgcattaacctcgccggaggttttgactgtctgtgtcccagtggcccttcttgctcaggcgattgcccacatgaagggggacttaaacataacggacaggtatggacgctgaaagaagataggtgctctgtgtgttcctgcaaggatgggaagatcttctgtaggagaacagcctgtgactgccagaaccccagcgccgacctgttttgttgccccgaatgcgacacacgtgtgaccagtcagtgcctggaccagaacgggcataagctgtatagatctggtgataactggactcattcctgccagcaatgccgctgtcttgagggggaagtagattgttggccgctcacatgtcctaatttgtcttgcgaatatacagcaatcttggagggagaatgctgcccacggtgcgtgtctgacccttgcctcgccgacaacattacatacgacatccggaagacgtgtcttgattcttacggcgtgtcacggctgagcggctcagtgtggacaatggcaggtagcccctgcacaacgtgtaagtgtaagaacggccgagtgtgctgttccgtggacttcgagtgcttgcagaataactag

SEQ ID NO: 232158 - DNA, 2520 bp, Artificial Sequence
  Description of Artificial Sequence: Synthetic coding sequence
atgtcaattagaaggctattaatcctgatcttgaaaatcgggcgacgatggaccgagttaattcgtaccatggaaagccgcgtgcttctgcgaactttctgcctgatctttggtctgggggcagtctgggggttaggggtggatccatccctacaaatcgacgtgctcactgaattagaactcggggagtcaaccacaggtgtgcgacaggtgccgggtctgcacaacgggaccaaagccttcctgttccaggacacacccagatcgatcaaggccagtaccgccacagccgagcaatttttccaaaagctcaggaataaacatgagttcacaatcttggtaacactgaagcaaactcatctcaactcaggggtaattctctcgattcaccatctcgatcaccgctacctagaattggagtctagcggacataggaatgaggtcaggctccactatcggagcggtagccatcgcccacacacagaggtatttccatacattttagctgacgacaaatggcacaagctaagcttagccataagcgcaagccacttaatcctgcacatcgattgtaacaaaatttatgagcgggtggtggaaaagccaagtacagatctacctctgggcacaacattctggttgggtcaaagaaacaacgcccacggatatttcaagggaatcatgcaggatgtccagctgctggtgatgccacaagggttcatcgctcagtgtcccgatctgaataggacctgccccacctgcaacgatttccatgggttagttcagaagatcatggaactgcaggatattttggcgaagactagtgccaagttgagccgggcagagcagcgcatgaatcggcttgaccagtgctattgcgaaaggacatgcacaatgaagggcacaacttatagagagtttgaatcttggatcgatggctgtaaaaattgtacatgcctaaacgggaccattcagtgcgagacactaatttgtccaaaccccgactgtccactgaaatctgctctcgcctatgtggacgggaagtgctgcaaagagtgcaaatctatctgtcagttccaggggagaacatattttgaaggagaacgtaatactgtctatagctcatcaggtgtctgcgttctgtacgaatgtaaggaccagacgatgaaattggtggagtcatccggctgtcccgcacttgactgtccagaatcacaccaaataacccttagccactcctgttgtaaagtttgcaagggctacgacttctgttccgaaaggcacaattgtatggaaaattcgatctgtcggaatctgaacgacagagccgtctgctcttgcagggatgggttccgggctttaagagaagataatgcctactgcgaggacatcgacgagtgcgcagagggaaggcactattgccgtgaaaataccatgtgcgttaataccccgggatcctttatgtgcatctgcaagactggctacattcgaatcgatgattactcctgcacggagcacgatgagtgtattactaatcaacacaactgtgacgaaaatgcgctttgttttaatactgtggggggtcataactgcgtatgcaagccgggatatacaggcaatggcaccacctgtaaggctttttgtaaggacggctgtcgtaacggtggcgcatgtatcgcagcaaacgtctgcgcctgtcctcaaggatttacaggcccaagttgcgaaactgatattgatgaatgttcagatgggttcgtgcagtgcgatagtagagctaactgtattaatctccctggatggtatcattgtgagtgcagagatggctatcacgataacggcatgttctccccaagcggcgagagttgtgaagatatagatgagtgcggaaccggccgacacagttgcgccaatgatactatctgtttcaacctggatggcggatatgactgcagatgcccccatggtaaaaattgcaccggggactgcatccatgatggcaaggtgaaacacaatggtcagatttgggttctggaaaatgacaggtgcagtgtgtgctcctgccaaaacgggttcgtgatgtgcaggaggatggtttgcgattgtgagaatccaaccgtagacttgttttgttgtcccgagtgcgacccgaggctgagctcacagtgtttgcatcagaatggtgagacgctatacaattcaggcgacacctgggtacagaattgccagcagtgtagatgtctgcagggagaggttgactgctggcccctcccctgccctgacgttgaatgcgaattcagtatattacccgaaaatgagtgctgtccgaggtgcgtgactgacccttgccaggcagataccattcgaaatgatattaccaagacttgtttggacgaaatgaatgtcgtgcgcttcacagggagtagctggattaagcacggcaccgaatgcacactctgtcagtgtaagaatggccacatctgctgctctgtggatcctcagtgcttgcaggagttatag

SEQ ID NO: 232159 - DNA, 2448 bp, Artificial Sequence
  Description of Artificial Sequence: Synthetic coding sequence
atggaaaccggcctgggggcaccattattcaaggcgtggctgcttattagcgtctggggcctcggggtcgatccatccctacagatcgacgtcttaaccgagctggagctgggcgaatctaccacaggagtaaggcaggtgccagggctccataatggtactaaggcttttttattccaggatacccccaggagtattaaggcaagcacagctacggctgaacagttttttcagaagctcagaaacaaacacgagttcactatcctggttacattgaagcaaacccatcttaactcaggagtcattttgtctatccaccacttagaccaccgatacctggagctagagtcaagtgggcatcgcaatgaagtacgtctgcactatcgcagtggctctcaccgacctcatactgaagtgttcccttacatcctcgcagatgataagtggcataaactgtccctggcgatcagcgcgtcccacctgatcctgcacatcgattgcaacaagatatacgaaagggtcgtagagaagccatctacagatttgcccttagggactaccttctggctcggccagcgaaataatgcccacggctacttcaagggcattatgcaagatgtacagttgttggtcatgccacagggttttatcgctcaatgtccagatctgaacagaacctgtcctacctgtaatgatttccatgggttggtgcaaaaaatcatggaactccaggacatcctagccaaaacatcggccaagttgtcccgtgccgagcaacggatgaaccgcctggatcagtgttactgtgagcggacctgcaccatgaaaggtacaacttaccgggagtttgagagctggattgatggatgtaagaactgtacttgcctaaacgggaccatccagtgtgagactctgatttgtcctaatccggactgtccactgaagtccgcgctcgcttacgttgatggaaagtgctgcaaggaatgcaaaagcatttgtcagttccaaggcaggacatacttcgagggagaaaggaacactgtctactcgtcatccggagtgtgtgtgttatatgagtgcaaggaccagactatgaagctggtggaatcctcaggatgcccagctctcgattgcccagagtcacaccaaataaccttgagtcatagctgctgtaaagtatgcaagggttacgacttctgtagtgaacgccacaactgtatggaaaactctatttgtcggaacttgaatgatcgagccgtctgctcttgccgggatgggttccgcgcactgcgggaagacaatgcatactgtgaggacatcgatgaatgtgctgaggggaggcattattgtcgtgagaataccatgtgcgtgaacacaccgggatctttcatgtgcatttgcaagaccggctacattaggatcgacgattactcctgtactgagcacgatgaatgcattaccaatcagcacaattgcgacgagaacgctctgtgtttcaacactgtgggcggtcacaactgcgtgtgcaaacccggatataccggtaatggaactacctgtaaggcattttgcaaggatgggtgccgaaacggaggcgcttgcatcgctgctaacgtctgcgcctgcccacaggggtttaccggcccaagctgcgagactgacattgacgagtgcagcgatgggtttgtgcagtgtgattcaagagcaaattgcattaacctgcccggttggtatcactgcgaatgtcgggatggctatcatgacaacggaatgttctcccccagcggggagtcttgtgaagatatcgacgagtgcgggacagggcgacatagctgcgctaatgacacgatctgtttcaacctcgatggcggatacgattgtcgctgcccacacggcaagaattgcacgggggactgtatccacgacggtaaggtgaaacacaacgggcagatatgggtgcttgagaacgaccgctgctcggtctgctcttgtcagaacggctttgttatgtgcagacgtatggtgtgcgactgtgagaatcctaccgttgacttattctgctgtcccgaatgcgatccgaggctgtcgtcccagtgtcttcatcagaacggggagaccttgtacaactcgggcgacacctgggtccagaattgccagcaatgccggtgcttacagggtgaggtcgactgctggccactgccctgcccggacgttgaatgcgaatttagcatcctgccggagaacgaatgctgtccaagatgcgtaaccgatccgtgtcaggctgacacgataaggaacgacattaccaagacatgcctggatgaaatgaatgtcgtgcggttcactggctcatcatggatcaagcatggtactgaatgcacactatgccaatgcaaaaacggtcatatctgttgttccgtagacccccagtgtctgcaggagctttag

SEQ ID NO: 232160 - DNA, 2451 bp, Artificial Sequence
  Description of Artificial Sequence: Synthetic coding sequence
atggagtcgcgcgtgcttttaagaacgttttgcctcatattcggtctgggcgctgtgtggggactcggagtagatccaagtctgcagatcgacgttctcacggaacttgagctgggcgagagcactactggcgtgcgccaagtacccggacttcacaacgggaccaaggctttcctctttcaggacactccacggagcatcaaggcctccaccgccaccgctgagcagttctttcaaaagctccggaataagcatgagtttacaatcctggttactttgaagcaaactcacctgaatagtggggtgatcctgtcaatccatcacctcgaccaccgttatctggagcttgagtcgagtggccaccgcaacgaggtgcgactgcactacagatcagggagccatagaccccacaccgaagtttttccatatatcctggcagatgataagtggcacaagctgagtcttgccatttcagcctcacacttgatccttcatatcgactgcaataagatctacgaaagggtggtggagaagccgtccaccgacctgcccctgggcaccacattctggctggggcagcgaaacaatgcacacgggtacttcaagggaattatgcaggacgtgcagttgctcgtgatgcctcaaggattcatcgcccagtgcccagatctgaatcggacatgcccaacctgtaacgactttcacgggctggttcagaagattatggaacttcaggacattctcgctaaaacctcagccaagctctcacgggcagagcagcgaatgaacaggctagatcagtgttattgtgagcgcacttgtacaatgaagggtactacatacagagaatttgagtcatggatcgacggctgcaaaaactgcacctgcctaaacggcacaatccagtgcgaaactctcatttgtccaaacccagattgccctctgaaatctgccctcgcttatgtggacggaaagtgttgcaaggagtgcaaaagcatttgtcagttccaggggcgaacatacttcgaaggcgagaggaatactgtgtactcaagcagcggcgtttgcgtgctgtacgagtgcaaggaccagaccatgaaactagtggagtcttctgggtgccctgcactcgactgtccagagtcacatcaaattacgctttcccacagttgctgtaaggtctgtaaggggtacgatttctgcagcgaacggcataattgtatggagaattcaatttgcaggaatctcaatgatcgtgccgtctgttcttgtcgggatggcttcagggcgctcagagaggacaatgcatactgcgaggatatagacgagtgtgctgagggtaggcactactgtcgcgagaatacaatgtgcgtgaatactcctggctctttcatgtgtatttgcaagactggatatattcggatcgacgactattcatgcaccgaacacgatgaatgcatcactaatcagcacaattgtgacgagaacgccttgtgttttaacactgttgggggtcataactgcgtgtgcaagcccggttacacaggcaacggaaccacatgtaaagctttttgcaaagacggctgtagaaacggaggtgcgtgcatcgctgctaacgtgtgtgcttgcccccagggattcacgggccctagttgcgagactgatattgacgaatgtagcgacggttttgttcaatgcgattctagagctaattgtatcaacctgcctggttggtatcactgcgagtgccgcgatggttaccatgacaatggaatgttcagcccttctggggagtcttgtgaggatattgacgaatgtggaaccgggagacactcctgtgccaacgacactatatgttttaatttggatgggggttacgattgcagatgcccccatgggaagaactgcacgggcgattgcattcacgatggaaaggtaaaacataacggacagatatgggtgcttgaaaacgacagatgctcggtgtgctcctgccagaatggattcgtaatgtgtcgcagaatggtgtgcgactgcgaaaatcctactgtcgacctgttttgttgtccagaatgtgatccacgccttagcagtcagtgtcttcatcaaaatggcgagaccctctacaactctggcgacacctgggtccagaattgtcagcagtgccgctgcctgcagggtgaagttgattgttggccactcccttgtccggacgttgaatgtgagttttcaatcctgcccgagaacgaatgctgcccacgctgcgtgacagacccgtgccaggccgacaccatccgcaatgacataaccaaaacctgtctggatgagatgaatgtagtgagattcaccggtagtagctggattaagcacgggaccgaatgtacactctgccagtgtaaaaacgggcatatttgctgctccgttgacccacagtgtctgcaggaactgtag

SEQ ID NO: 232161 - DNA, 2601 bp, Artificial Sequence
  Description of Artificial Sequence: Synthetic coding sequence
atggggtttcccccactactgaaggggcaggcctctgctactcggagcagcctggcctcatgcagctgggtagtcttttttctgagctgtctcagtagacatgccccagagattgagggaggccgtcggtggaccgagctgatccggactatggaatcccgcgtgctccttcggacattctgcctgatttttggtctgggtgcagtatggggtcttggagtcgatccgtccctgcaaattgacgtgcttacagagctggagttgggcgagagcaccacaggggtaaggcaagtgccagggttacacaatggaactaaggcattcttgtttcaggatactcccagatccataaaagcgtctaccgcaacagccgaacagtttttccaaaagcttcggaacaagcacgagttcacaattctggttacacttaagcagacgcatctgaattctggcgttattttatcaattcaccacctggaccaccgctatctcgagctcgaatcaagtggccatagaaatgaggttaggctgcattacaggtccggatctcaccggcctcacacagaggtgttcccttacattctggctgacgataaatggcacaagttgagcttggctatcagcgcatctcatttgattttgcacatcgattgcaataagatctacgagcgcgttgttgagaaaccatctaccgatctgccactagggacgactttttggctcggacagcggaataacgctcacgggtacttcaagggcattatgcaggacgtgcaattgttggtaatgccccaaggttttatcgcccagtgcccggacctcaacaggacttgcccaacctgtaacgatttccatgggctcgtccagaagatcatggagctgcaggatattttggccaaaactagcgctaaactgagccgcgctgaacagaggatgaaccgactagatcagtgctactgtgaaaggacatgtaccatgaaaggtacgacataccgggaatttgaatcttggatcgacggctgcaagaattgtacgtgcttgaacggcaccatccagtgtgagaccctgatttgtcctaaccccgactgtcccctgaaatccgctctggcttacgtggatggtaagtgttgcaaggagtgtaaaagtatctgccagttccaggggcgaacatactttgagggagagcggaacactgtctacagctcttccggagtttgcgtcctctatgagtgcaaagaccagacgatgaagcttgttgagtcttccggctgcccggctctcgactgtcctgaaagccatcaaatcaccctgtctcactcctgctgtaaggtctgtaagggttacgacttttgctctgagcggcacaactgtatggaaaatagtatctgtcgcaatctaaacgacagggccgtatgctcttgccgcgatggcttccgcgcacttagagaagacaacgcatactgcgaggacatcgacgaatgtgctgagggtcggcactattgtagagaaaacacgatgtgcgtgaacaccccaggctcttttatgtgcatctgtaagacaggctatattaggattgatgactatagctgcactgaacacgacgagtgtatcaccaatcagcacaattgcgacgaaaatgctctctgcttcaatacggtgggtgggcacaattgtgtttgcaaaccaggttacactggcaacggcactacttgtaaggccttttgtaaggacggctgtcgcaatggtggcgcttgtatagcagccaacgtctgtgcctgtccccagggctttaccggaccttcttgcgaaaccgatatcgatgaatgcagcgatgggttcgtacagtgcgactccagagccaattgtattaatctgcctgggtggtaccattgcgaatgccgcgacggataccacgataatggcatgttctctccgtctggagaaagctgcgaagacatagatgagtgcggcaccggcagacatagctgtgctaatgacacgatctgcttcaacctggacggcggatacgattgccgatgcccacacggaaagaattgcaccggggactgcatacatgatgggaaagtgaaacacaacggccagatctgggtattggaaaatgaccgctgtagtgtgtgctcttgtcagaatggcttcgtgatgtgtcgacgaatggtctgtgactgcgagaacccaactgtggacttattctgttgccccgagtgtgacccaagacttagttcgcagtgcttacatcaaaatggtgaaacgctgtacaacagcggagacacgtgggtgcaaaactgccagcaatgtaggtgtctccagggtgaagtcgattgctggccactcccctgtcccgacgtggaatgcgaattttcgatcctgcccgagaacgaatgctgtccccgatgcgtcaccgacccatgtcaagcagacactatcagaaatgacatcaccaaaacctgtctcgacgaaatgaacgtggtacggtttacggggtcttcttggatcaagcatggaaccgagtgcacgctctgtcagtgcaaaaatggccatatttgctgttccgttgaccctcaatgcctacaggaactctag

SEQ ID NO: 232162 - DNA, 2451 bp, Artificial Sequence
  Description of Artificial Sequence: Synthetic coding sequence
atggaatccagggtcttgttgaggactttttgcctcatctttggactgggggctgtgtgggggcttggcgtggatcctagcctacaaatcgatgtactgactgaactcgaactgggtgagagcacaaccggtgtgagacaggtgccaggacttcacaatggtacgaaggcctttctcttccaagatacaccacgatctattaaggcctccaccgccactgccgaacagtttttccagaagttacgcaataagcacgagtttactatccttgtgactctgaagcagacccatctgaactcaggtgtcatcttgagtatacaccatctggatcataggtacctcgagctggaaagttcaggacatcggaacgaggtaaggctgcactacaggtcaggctcacatcgccctcacacagaagtgtttccctacatcttagctgacgataagtggcacaagctgtctcttgctatatccgcttctcatctgatacttcacatcgattgtaataaaatttatgaaagggttgtggaaaaaccttcaacagatttacccctagggacaaccttttggctggggcagagaaataacgcacacggctattttaaggggattatgcaagacgtgcaattgctcgttatgccacaggggttcattgctcagtgccccgatttgaatcgcacatgccccacttgcaacgacttccacggccttgtccagaagattatggaactgcaggatattcttgccaagacatctgcaaaactcagtagagccgagcagcgcatgaaccgcttggatcagtgttattgtgaacgcacatgcacgatgaagggtaccacttaccgcgagtttgagagctggattgatggctgtaagaattgtacctgcctaaacggaacaatccagtgtgaaacgctgatctgtcctaatccagactgccctctgaagtccgccctggcctacgtggacggcaaatgttgcaaggagtgcaagtccatatgccagttccagggccgtacgtatttcgaaggagagcgcaatacagtctactcatccagcggcgtgtgcgttctgtatgaatgtaaagaccagaccatgaaactggttgagagttcaggttgtcccgctcttgattgtcctgagtctcaccaaattacgctgtcgcattcatgctgcaaggtctgtaaaggatacgacttttgttctgagcgtcacaattgtatggagaattccatctgccgcaatctcaatgatagggcggtttgttcgtgccgagatggatttcgtgcgttaagagaggacaatgcctactgtgaggatattgacgagtgcgcagagggacggcattattgccgggagaacacaatgtgtgtcaatactcccggatccttcatgtgtatatgcaagacgggatatattcgcattgacgactattcttgtactgaacatgatgaatgcatcacaaaccagcataactgtgatgagaatgccctatgtttcaacacagtcgggggacacaattgcgtgtgtaaacctgggtatactggcaacggtactacatgcaaggcgttctgcaaggacggatgtagaaatgggggagcatgcattgctgccaatgtgtgtgcttgcccccaagggttcactggccctagctgtgagacggacattgacgaatgttcggatggcttcgtgcaatgcgacagtagagccaactgtatcaacctgccaggctggtatcattgcgagtgtcgggacgggtaccatgacaacgggatgtttagcccctccggagaatcctgcgaagatattgatgagtgcggcaccggacggcactcttgtgcaaatgatacaatctgcttcaatcttgatggtgggtacgattgccgctgtccgcatgggaaaaattgcaccggcgactgtattcatgacggaaaagtgaaacataatggtcagatttgggtgctcgaaaatgatcggtgttccgtgtgttcctgtcagaatggctttgttatgtgtaggcggatggtgtgtgactgcgagaaccccacggttgacctgttctgttgccctgaatgcgatccaagattaagtagccagtgcctgcaccagaatggtgagaccttatataactcaggcgacacatgggtgcagaactgtcagcagtgtcggtgcctacagggagaagtcgattgctggcctctgccgtgccctgacgtggagtgtgaattctctatcttgcctgaaaatgagtgttgtccacgatgcgtcacagatccctgccaggccgacactatccgcaacgacattactaaaacctgcctggacgagatgaacgttgtcaggttcaccggaagcagctggattaaacacggcacggagtgcaccctttgccagtgcaaaaacgggcacatatgttgttcagtcgatccgcaatgcctccaggaattgtag

SEQ ID NO: 232163 - DNA, 1734 bp, Artificial Sequence
  Description of Artificial Sequence: Synthetic coding sequence
atggaaactggactcggggctccgttgttcaaagcctggctgcttattagtgtgtggggtctgggggtcgacccctctctgcaaatcgatgtcttgaccgaactggaactcggagagtctacaacaggagttaggcaggtccctggactccataatggcacaaaggcattcttatttcaggacacacctcggtccatcaaagcttcaacggccacagcagaacaattcttccagaagttgagaaacaagcacgaattcaccatattggtgaccctcaaacagactcacttgaatagtggggttatcctgtccattcatcacctagaccaccggtacctggaactcgaatcaagcgggcaccggaacgaggtacgcctgcattaccgaagtggatcacaccgaccacacactgaggtttttccgtacatcctggcagatgacaagtggcacaaattgtctctggcgatttcagctagtcatctcatacttcacatagactgcaataagatctacgaaagagtagtggagaaaccctcaacggatctgccactggggaccaccttctggctggggcagcgcaataacgcccacggttacttcaaaggaattatgcaggacgtgcagctactggtgatgccacaggggttcatagcccaatgtcccgacctaaacaggacctgccctacctgtaatgattttcatggattggtgcagaaaatcatggaactgcaagacattctcgctaaaacttccgccaaactcagtcgcgcagaacagcggatgaataggctggatcagtgttattgtgaacggacatgcaccatgaaggggaccacttatcgggaattcgaatcctggatcgatggatgcaagaactgcacatgcctgaacggaactatacagtgcgagacactaatttgtcctaatccagactgcccactgaagagtgctctggcatacgtggatggcaagtgctgcaaagagtgcaaatcgatatgccaatttcaggggagaacatattttgaaggggaacgcaataccgtctactcaagttccggcgtctgcgtcctctacgaatgcaaggaccaaactatgaagctggtggagagttccggctgtcccgcactcgactgtccggagtctcaccagataacactctctcactcctgctgcaaggtctgcaagggctatgatttttgcagcgaacggcacaattgtatggaaaatagtatttgccgaaatctgaatgatcgtgctgtatgctcatgccgcgatggcttccgcgctctgcgggaagacaacgcctattgcgaggatatagacgagtgcgccgaaggaaggcactattgcagggaaaataccatgtgtgtaaacaccccaggcagcttcatgtgcatatgtaagacaggctacattcgcatcgacgactatagctgtaccgagcacgacgagtgtattacgaaccagcacaattgcgatgaaaatgccctctgttttaacacggtcggcggtcataattgcgtgtgcaaacctggctataccggaaacggaaccacgtgtaaagctttctgtaaagacggctgcagaaacggcggagcttgtattgccgctaatgtgtgtgcctgcccacagggattcaccggcccttcatgtgagaccgatatagacgaatgctccgatggctttgtgcagtgtgattccagggcgaactgcatttgcttggtccccttatag

SEQ ID NO: 232164 - DNA, 333 bp, Artificial Sequence
  Description of Artificial Sequence: Synthetic coding sequence
atggagacaggcttgggcgcaccactgtttaaagcctggctgcttatcagcgtctgggggctgggtgtggacccttctctgcagatcgacgttctaacagaattggaattgggggaaagcactaccggagtgcggcaggtccctggcctgcataatggaactaaggcttttttgttccaggatacaccccgatctatcaaggccagtaccgcaaccgctgaacagttctttcaaaagctccgcaacaaacacgagtttactatcctggtgactttgaaacaaacccacctgaactccggggtcatcttgtctatccaccacctggaccactag

SEQ ID NO: 232165 - DNA, 2448 bp, Artificial Sequence
  Description of Artificial Sequence: Synthetic coding sequence
atggagacggggctcggtgctcctctcttcaaagcttggttattaatctcagtttgggggttgggcgtggaccccagcctgcaaattgacgtgctgaccgagttggagcttggcgaatcaaccactggcgtgaggcaggtgcctgggcttcataatggcaccaaagctttcctgttccaggataccccaagaagtataaaggcaagcactgcaacagccgaacagttctttcagaagttgagaaataagcacgagttcaccattctcgtaacattgaagcagacccacctgaattccggtgtgattcttagtatccaccacctcgatcacagatacctggagctcgaatcatccggccatagaaatgaggtgcgattgcattaccgtagcggcagccatcgcccacacactgaggtcttcccttacattctcgctgatgataagtggcacaaactgtcactggcaatctccgccagccatttgatcttacacatcgattgcaataaaatttatgaacgggttgtggagaaaccttccactgacttgccgttgggaacaactttctggctcggacagcggaataacgcacacggctactttaaaggcataatgcaagacgtgcaattactggtaatgcctcagggctttattgcccagtgccctgacctgaacaggacctgcccaacttgcaacgactttcacggcttggtgcagaaaatcatggaactccaggacatcctggctaaaacgtcagccaagcttagcagggcagagcagagaatgaacaggcttgatcagtgttattgcgaaagaacatgtaccatgaaaggaactacttaccgagaattcgaatcttggatcgatgggtgcaagaattgcacctgcttaaatggcacgatacagtgcgaaacattaatctgcccaaacccagactgcccactgaagtcagccctggcgtatgttgatggaaagtgctgcaaggaatgtaaatctatatgtcaatttcagggtagaacttattttgaaggcgaacgtaatactgtgtatagctcaagcggcgtgtgcgtcctgtacgaatgtaaggatcagactatgaaactggtggaatcctctgggtgccctgcgctcgactgtcccgaaagccatcaaattacccttagccactcttgctgcaaagtgtgcaaggggtacgacttctgctcagaaaggcacaactgcatggagaattccatatgtagaaaccttaatgatcgcgcagtatgtagctgcagggacggttttcgtgcactacgtgaggacaacgcctactgcgaagatatcgatgagtgtgccgagggcaggcattactgccgggaaaacacaatgtgtgtgaacacacctggctcctttatgtgcatctgtaagacaggctatattcgtatcgatgactacagctgtactgaacacgatgagtgtattaccaaccaacacaactgcgacgaaaatgctttatgttttaacaccgtaggtgggcacaactgtgtgtgtaagcccggatatactggaaatgggacgacctgtaaagccttctgcaaagacgggtgcaggaatgggggagcctgcatcgcagcaaatgtgtgtgcttgccctcaaggtttcacgggaccctcatgcgagacagacatcgacgaatgctctgacggctttgtgcagtgcgactcgagagccaattgcatcaatctgcctggatggtaccactgcgagtgccgggacggctaccacgacaatggtatgttcagcccaagcggtgagtcgtgcgaagatatcgatgaatgcggcacaggcaggcacagttgcgccaacgataccatctgttttaacctggatgggggatatgattgccggtgccctcacgggaaaaactgtaccggggattgtatccatgacggcaaagtaaagcacaacggccagatctgggttctagagaacgaccgctgttcagtgtgtagttgccaaaatggcttcgtcatgtgcagaagaatggtctgcgactgcgagaaccccacagtagatcttttttgctgtcccgagtgtgaccctcgtctcagttctcaatgtctccaccagaatggcgaaacattgtacaacagtggggatacttgggtgcagaactgccagcaatgtaggtgcttgcagggagaagtggactgctggccactgccctgccctgatgtggaatgtgaattctccatcctacctgaaaacgagtgctgtcccaggtgtgtgaccgatccttgccaagccgataccatcagaaacgacatcaccaagacatgtctggacgaaatgaacgtagtgcgattcactgggtcaagttggatcaagcacggcactgagtgtaccctatgccagtgcaagaatggtcatatctgctgctcagtagaccctcagtgccttcaggaactctag

SEQ ID NO: 232166 - DNA, 69 bp, Artificial Sequence
  Description of Artificial Sequence: Synthetic coding sequence
atggaatctcgcgtactgctgcgcacgttctgcctgatcttcgggctcggagccgtgtggggtctctag

SEQ ID NO: 232167 - DNA, 966 bp, Artificial Sequence
  Description of Artificial Sequence: Synthetic coding sequence
atggaatcacgagttcttttacggacattttgtcttattttcgggcttggagcagtttggggactgggagtggatcccagcctgcagattgatgtgctaacagaactggaactcggcgaaagtactacaggtgtgcggcaggtgcccggactacataacggaaccaaggcctttctgtttcaagatactcctagatcgattaaagcctccacggccacggccgagcagttctttcagaaactaagaaataagcatgagttcacaatcttggttacactcaagcaaactcacctcaattctggcgtgattctctccatccatcacttagaccaccgctacctcgaacttgagagctctggacatcgcaacgaagtcaggctgcactaccgatccggatcccatagaccgcataccgaggtgttcccttatattttagctgacgacaaatggcacaagttatctttagctatttcagcatcccatttgatcctgcacatcgactgtaataagatctatgaacgagttgtcgaaaaaccgtctacagatttgcctctgggaacaactttctggctcggccagaggaataacgctcacgggtacttcaagggaatcatgcaggacgtgcagctgctagtgatgccccaaggttttattgcacagtgtccggacttgaatcgtacttgccccacatgcaacgacttccatggtctagtccagaagatcatggaactgcaggatatcttagccaaaacttcagctaagctgtcccgggcagagcagaggatgaataggcttgaccagtgctattgcgagcgcacatgtaccatgaaaggtacaacctatcgcgaatttgagtcctggatcgatggctgtaagaattgtacctgcctaaacggcacaatacagtgcgagactttaatctgccccaaccctgattgccccctcaaatccgccctcgcttactag

SEQ ID NO: 232168 - DNA, 4386 bp, Artificial Sequence
  Description of Artificial Sequence: Synthetic coding sequence
atggctgctgagaggggcgctcgaagactgctgagcaccccgtccttctggctctattgcctcttgctgctaggtaggcgggcaccaggagccgctgctgcccgttctggaagtgcaccgcagtcgcccggagccagtatcagaacatttacccctttttacttcttggtggaacccgtcgataccttgtcagtccggggatcttcagtcatccttaattgtagcgcatattcagagccttcgcccaagatcgaatggaaaaaggatgggacctttctcaacctggtctctgatgataggcgccagctgctgcctgatggctctttgttcattagtaacgttgtgcactccaaacataacaagcctgacgagggatactatcaatgcgtcgccacggtggagtccctcggaacaatcatctcgaggaccgccaagcttatcgtggctggtctcccccgtttcacaagtcaaccagaaccatctagcgtatatgccggtaacaatgccattctgaactgcgaagttaatgcagacctggtccccttcgtccgatgggaacagaaccggcagccattgttgttagatgatcgcgtaatcaagctgccctccggtatgttagtaatctccaacgctaccgaaggagacggtggtctttaccgctgcgtggtcgagtccggcggtcccccaaaatatagtgacgaggtggagctcaaagtgctgcctgaccctgaagtgatttccgatctcgttttcctcaaacaaccttcccccctggtacgcgtcattgggcaggatgtggttctgccatgcgtggcctccgggctgcctaccccgacaatcaagtggatgaagaacgaagaggctcttgacaccgaaagttctgagcggctggtccttctagctgggggaagcttggagatctcggacgtcacagaggatgatgctggcacatatttctgcatagcagataacggcaatgagactattgaagcgcaggcagagctcacagttcaggctcagcccgagttccttaaacagccgaccaacatttacgctcatgaatccatggatattgtgttcgagtgcgaagtgactggcaagcctacccccacagtgaagtgggtcaagaatggcgacatggtgatcccttccgattattttaagattgtgaaggaacataacctgcaagtactgggtttggtgaagtctgatgagggcttctatcagtgtatcgctgaaaacgacgtcggaaatgcacaagctggggcacaattgatcatcctggagcacgctcctgcaacaacagggccactgccttctgcgcctagagacgtggtggcttccctagtctccacccgctttattaagctcacctggcgcacaccagcgagtgatccgcacggggacaacctgacatacagcgtcttttatacgaaagagggtatagctcgagaacgagtggagaacacatctcatcctggcgagatgcaggttaccatccaaaacctgatgccagcaaccgtctacatcttcagggtaatggcgcaaaataagcatggtagtggcgagtcatcagccccattgcgagtggagactcagcctgaagtccagctgcccggacctgccccaaatttgcgggcttatgcagcctctcccaccagtatcaccgttacatgggagactccggttagcgggaatggtgaaatacagaactataagctgtactatatggaaaaaggaaccgataaagaacaagatgtggacgtttcgagccattcatatacaattaatgggcttaagaagtacaccgagtattcattcagagtggttgcctacaataaacacggacccggagtgagtactcctgacgtggccgtgcggacactgtcagatgtgccatcagccgctccccaaaaccttagtctcgaagtgcgtaatagcaagtccataatgatacactggcagccgccagccccagctacccagaatggacagatcacagggtacaagatcagataccgaaaggcctcacgcaaatccgacgtcacagagacacttgtgagtggcacacaactgtcacaattaattgaagggctggaccgaggaacagaatacaatttcagggtggccgctctcactataaacggaaccgggccagccacagactggttgagcgctgaaactttcgagtcggatctggacgagactagagtgcccgaagtccccagctctttgcatgttagacctttagtcacctctattgtagtgtcgtggacaccccctgagaatcagaatattgttgttagggggtacgccattggttatggtattggaagccctcacgcgcaaaccattaaggtggactataagcagaggtactacactattgagaatctggatccttccagtcactatgtcatcaccctgaaggcttttaacaatgttggcgaggggatccctctttacgaatcggcagtcactaggccacataccgacacatcagaggtggatctgttcgtcatcaacgccccttatactcccgtgcccgatccaacaccaatgatgcctcctgtgggggtccaggcttctatcctatcacatgacacaatcagaataacatgggctgacaatagcctgccaaaacaccagaagataacagactcccgctactatacggtacgctggaagacgaatatacccgctaatacaaaatacaagaacgccaacgccaccactttgtcttatctggtaactgggctaaaaccaaacaccctatacgaattttccgtcatggtgaccaagggacgtagatcgtcaacctggagcatgactgctcacggcaccacatttgaactcgttccaaccagcccccctaaggacgtgaccgtagttagcaaggaggggaaaccgaagacaatcatcgttaattggcaaccaccttccgaggccaacgggaagattaccggatacataatttactatagtacagacgtcaatgcagagatacatgattgggtgatcgaaccggtggtcggaaaccgcttaacacatcagattcaggaactaaccctcgataccccctactatttcaaaatacaggccagaaactcaaagggaatgggtccaatgtctgaggctgtgcagttcagaacccccaaagccgattcttccgataagatgcccaacgaccaggcgagtgggtcaggtggcaaaggatctaggttaccggatctgggtagcgattataagcctccaatgagtggttctaactcccctcacggcagccctactagtcccctggacagcaacatgctgctcgtgatcatcgttagtgtgggcgtaattaccattgttgttgtcgtcattattgccgtgttttgcacaagacgcactacttctcaccagaagaaaaaacgcgcagcatgcaagtctgtaaacggctcacacaagtacaaagggaattcgaaagacgtcaaacccccagacctgtggattcaccacgagcggttggagctgaaacccatcgataaatctcctgacccaaaccctattatgacagacacacctattcccaggaattcacaggacatcactcccgtggacaatagcatggattctaacattcaccagaggcgaaacagctaccgagggcatgagtctgaagattccatgtccaccctggccggaagacgaggcatgcgacctaagatgatgatgccatttgactcccagccacctcagccagtgataagtgcccatccaattcatagcctagacaaccctcatcaccatttccactccagctccctagccagccctgcccgaagccatctttatcaccccggatctccttggccaataggtacttctatgtccctgtcagacagagctaatagcaccgagagcgtccggaacacaccttctacagacactatgcctgcaagtagcagccagacttgttgtacggaccaccaggacccggaaggcgctacaagtagttcttatctggccagctcccaggaagaggactcaggacagagtctcccaactgctcatgtacgccctagccaccccttgaaaagtttcgctgtgcctgcaattcccccacctggcccaccaacttacgaccccgcactaccttctacccctctcctgtctcagcaagctttgaaccatcatatccactcagtcaagactgcttcaatcgggacattagggagaagcaggcccccaatgccagttgtggtgccgtccgcgccagaagtgcaagagacaaccaggatgctcgaggactcagaatcttcttacgaacccgacgagcttaccaaggaaatggctcacttagaagggctgatgaaagatctcaatgctattactactgcctag

SEQ ID NO: 232169 - DNA, 4386 bp, Artificial Sequence
  Description of Artificial Sequence: Synthetic coding sequence
atggctgcggagaggggagccagaaggcttttgtctaccccttccttctggctctattgtctactccttctggggagacgcgcaccaggggcagccgctgcacgaagtggcagcgcgcctcaatcacccggagcgtctatacgcacatttacacccttctatttcctcgtagagccagtcgacacgctatcagtccgaggctcctctgtaatattgaattgtagtgcctattcagagccttcgccaaagattgagtggaaaaaggacggtacgttcttgaacctcgtctcagatgatagacgccagctgttgcccgacggatccctgttcatcagcaatgtggtgcattctaagcacaataagcctgatgagggctactatcagtgcgtcgccacagttgagtccctggggactataatttctcggaccgccaagctgattgtggccggtctcccgaggtttacgtcccagccagagccatcttcagtgtacgccggtaataatgcaattctgaattgcgaagtgaacgcagacctggtaccgttcgtacggtgggagcagaacagacagcccctgcttctggacgaccgcgtgattaaacttccctctggcatgctcgtgatttctaatgccacagagggcgatgggggactgtaccggtgcgtcgtggagtccgggggtcctccaaagtactccgacgaggtggagctaaaggtcttaccggatccagaagttatctccgaccttgtgtttctgaagcaaccctcgcccctagtgagagtgatcggacaagacgttgttctcccatgtgtcgccagcggcctgcccaccccaaccattaaatggatgaaaaatgaggaggcccttgatactgagtcaagtgagcggctggtactgctcgctggaggtagcctggaaattagcgatgttacagaggacgacgccggaacatacttttgcatcgccgacaacgggaacgaaacaatagaagcccaggcagagctcaccgttcaggcgcagcctgaattccttaagcagccaactaacatatacgcccacgagtcaatggacattgtgttcgaatgcgaagtcaccgggaagcccacgccaacagtcaaatgggtgaagaacggagacatggtgattccatctgattatttcaagatcgttaaggagcacaacctccaggtcctcgggctagttaagtcagacgaaggcttttatcagtgcatcgcagaaaatgatgttggcaacgcccaagcaggtgcccagctcatcattctagaacatgcccctgctacaactggtccactcccttccgcaccccgtgatgtcgtcgcctctctggttagtactcgattcatcaagctcacgtggcgcacaccggcttcagatccgcatggtgataacctgacctattccgtattttacaccaaagaaggcatcgcaagagaacgggtcgagaatacctcccatccaggcgagatgcaggtcactatacagaatctaatgccggctacagtttacatcttcagagttatggcccagaataagcacggtagtggcgaatcgtcagccccattgcgggtggaaacccagcccgaggtccagctacctggtccagccccaaacttacgggcttatgctgccagccctacatctatcaccgtgacatgggaaactcctgtgagcggaaacggtgagatccaaaattataagttgtactatatggagaagggaaccgacaaggaacaggatgtcgatgtgagttcacatagttacaccatcaacgggctaaaaaagtacacggagtacagctttcgcgttgttgcgtacaataagcatgggccaggcgtctctactcctgatgtcgctgtgaggacattatctgatgtgccatcggcggctccgcagaacttatcacttgaagtgagaaactctaagtctatcatgatacactggcagcctcctgcccctgccacacagaacggccagatcactggatacaaaatcaggtacaggaaagcttcgcggaagtccgacgtcactgaaacacttgtgagcggtactcagctctcacagctgatcgaagggctggaccggggtacagaatataacttccgggtcgccgctttaacaatcaatgggacaggacctgccacagattggctctccgccgaaacctttgagtcagacttggacgaaacacgggtcccagaagtcccctccagcctgcatgtgcggccactggtcacgagcatagtcgttagttggactcctccggagaaccagaatattgtggtgagaggatatgccattgggtacggaatcggatcccctcacgcccaaactattaaggtcgattacaagcagagatattacactattgaaaacctcgacccctcctcccactatgtgattaccctcaaggcttttaacaacgtcggggaggggattcctctctacgaaagcgcggttactcgcccacataccgacacctcggaggtcgacctgtttgtgattaatgcaccgtacacccctgtgcccgaccctacacctatgatgccccctgttggggtccaggcttccatactgagtcacgataccattagaataacttgggccgataactcacttcctaagcaccaaaaaatcacagacagccggtactataccgtgcgctggaagaccaatattccggcaaacaccaaatacaaaaatgccaacgctaccacgttatcttatttagtgactggactgaagcctaacacactttacgaatttagcgttatggttaccaaggggaggcggtcatccacctggtcaatgaccgcccatggcacaaccttcgaactcgtgcctacctctcctccaaaggacgttaccgtcgtgtcgaaagaaggaaagcccaaaactataatcgtcaattggcagcctccatctgaggccaacggtaaaattaccgggtacattatttactattcaaccgacgttaacgcggagatccatgactgggtgatcgagccagtggtggggaacaggctgactcatcaaattcaagaactcacactcgataccccctattactttaaaatccaggccaggaactctaaggggatgggacccatgtctgaagctgtacagttcaggactcccaaggccgattcctctgataagatgcctaatgatcaggcatctggcagtggaggaaagggctcaaggttgcccgaccttgggagcgattataaacccccaatgtccggctccaattctccacatggctcacctacgtcccccctggattccaatatgctcctggtgattatcgttagcgtgggggttataaccatcgtcgttgtagttattatcgccgtgttctgcacaagaagaacaacctcccatcagaagaagaaacgggcagcatgcaaatccgtgaatggatcccataagtacaaaggcaattccaaggacgttaaaccccctgacctctggatccatcatgagagactggagctaaagcctatcgacaaaagccctgaccctaacccaatcatgaccgatacacctatcccacgcaatagtcaggacataacccctgtggacaacagtatggacagcaacatccatcagcggagaaattcctatagaggacacgagagcgaggactctatgtcaacactggccggtaggcggggaatgagaccaaagatgatgatgcccttcgactctcagccaccccagccggtcatcagcgcacatcctattcatagcttggacaatccccaccaccactttcactccagttcgttggccagcccggcacgctcacatctctaccatccaggttccccgtggccaattggcacttccatgagtctgagtgatcgagctaatagcaccgaatcagtgcgtaatacgccatctacggacacaatgcccgcttcctcctctcaaacatgctgtacagatcaccaggaccccgagggagccaccagctcgagctatctggcaagctcccaggaggaagacagcgggcagtccctcccaacagcgcatgttaggccgagccacccacttaagtccttcgccgtcccagccatccctccccctgggcctcccacatatgacccggcactcccttcaacgcccctcctgtcacagcaagctctgaatcatcacatccatagtgtcaaaacggcaagtatcggaacgctgggtaggagccgacccccaatgcctgttgtggtgccatccgcgccagaagtccaggaaactaccaggatgctggaggatagcgagagctcctatgaaccagatgagctgacaaaagaaatggcgcacctggaaggactgatgaaagaccttaatgccatcaccactgcctag

SEQ ID NO: 232170 - DNA, 3519 bp, Artificial Sequence
  Description of Artificial Sequence: Synthetic coding sequence
atgaagaatgaggaggccctcgatacagaatcttcggaacgactggtcctcctcgcgggtgggagcttagagatctctgacgtcacagaagacgatgcgggtacgtatttttgtatcgcagataatggcaatgagacaatcgaggcgcaggcggagctgactgtccaggctcaaccagagtttctgaaacaacccactaacatctacgcacacgaaagtatggacatagtctttgagtgcgaagtcaccggaaagcccactcctacagtaaagtgggtgaagaacggggatatggtgattccatccgactacttcaagattgtgaaagagcataatctacaggtccttgggctcgtaaagagtgatgagggattctaccagtgtatcgctgaaaacgacgtaggaaacgctcaggcaggggcacaactcattatactggagcatgacgtggccatccctactctgcccccaacttctctgacatctgctaccacagaccacctcgctccagctacaacgggtcccttacccagcgcaccccgagatgtcgtcgccagtcttgtcagcacccgctttataaagctaacctggaggacaccagcttctgatccccacggagataacctgacgtactctgttttctataccaaggagggcatcgccagggagagggtagagaatactagccacccgggagaaatgcaagttaccattcagaacttaatgccagccacagtttatatttttcgggtgatggcccagaataagcacgggagcggtgagagcagcgctcccctgcgtgtcgagacacagccagaagtgcagctccctggtccagctcccaatctgagggcttatgctgcctcccctacctccatcacagtgacctgggaaacacctgtgtcgggaaatggggaaattcagaactacaaattgtactacatggagaagggcaccgataaggagcaagacgtggatgtttcttcccactcatatacgataaatggcctgaaaaagtacactgaatatagctttcgagttgtcgcgtataacaagcacgggcctggggtcagcaccccagacgtcgccgtcagaactctttccgacgtgcctagcgccgctccacagaatctgtcactagaagtgcgcaactccaagagcattatgatccattggcagcctccggcaccagctactcaaaatggtcagattactggctataagattagataccggaaggcaagccggaagagtgatgtgaccgaaactcttgtgtctggtacgcagctctcgcagttaattgagggactcgatagggggactgagtacaactttagggttgctgcactcacaataaacggaacagggccagccaccgactggctcagcgccgaaaccttcgagtccgatctcgatgagacccgggtccccgaggtcccttcatccctgcacgtgagaccgttggtaactagtatcgtagtgtcctggaccccccctgaaaaccagaatatcgttgttcgcggatatgcaataggctacggaatcggctcaccacatgctcagacaattaaagtggattataagcagcggtactatactatcgaaaacctagacccgagcagtcactatgttattacattgaaagcctttaacaatgtgggagaggggatcccactatatgagagcgcagtgaccaggcctcacaccgtgcccgatcctactcccatgatgcccccagtgggggtccaagcttctatcctgtcacacgataccatccgaatcacttgggccgataacagcctgcctaagcaccagaagattactgacagtcggtattacactgtgcggtggaagaccaacattccagcaaatacaaaatataagaacgctaatgctactacactgtcttacctcgtaacaggcctaaagccgaacactctctatgagttttctgtgatggtaactaaaggtagaaggtcatccacatggtccatgacagcccacggaacgacctttgaattggtcccgactagcccaccgaaggatgtgactgtggtatcgaaagagggaaaacctaagactattattgtcaactggcagcctccttccgaggccaatgggaaaattaccggctacattatatattactctaccgatgtaaacgcagaaatccacgactgggtgatagagcctgtggttggcaatcgacttacgcatcagatccaggagcttacccttgacaccccctattactttaaaatccaggcgcgtaacagcaaaggcatgggtcctatgtcagaggctgtgcagtttaggacgcccaaagcaagcgggtctggtggaaaggggagccggcttcctgatctcggttctgattataaaccacctatgagcgggtcaaatagtccccatggatcaccgacgagccccctggattccaacatgttgctggtcatcatcgtgtccgtaggagtgatcaccatagtggtagtggtgattattgctgttttctgtactagacgcaccacatctcaccagaaaaagaaaagagctgcgtgtaagagcgtaaatggctcccataagtacaagggcaattctaaagacgtaaagcctcctgatctgtggattcaccacgaacgactggagcttaagcctattgacaagtcgcctgaccccaatccgataatgaccgacactccaatccctagaaactctcaggacattacaccagttgataacagtatggacagcaacatccatcagcggcgtaattcgtatagaggccatgagtcggaggacagtatgtccaccctggctggccgtaggggtatgcgcccaaagatgatgatgccctttgatagccagccccctcagccggtgatctcagctcacccgatccattcattggataacccccatcatcactttcattcttcttctttagccagtcctgcaaggagccacctttaccacccaggctctccatggcccattgggacttcaatgtccctctccgatcgagctaacagcacggaatccgttcgtaatacgcctagcaccgacactatgcctgcaagctccagtcaaacatgctgtacggatcatcaggacccggaaggggcaacatcttcatcttatcttgcttcctcccaggaggaggattcagggcagtctctgcccactgcccacgtccgaccttcacatccgctaaaaagctttgccgtgcccgcaattccaccccctggtccacctacgtatgacccagctttaccttctacccccttgctgtctcagcaagccctgaatcaccatatccactctgttaagacggctagcattggcacgctgggcagaagtcgcccacccatgcccgtcgtggtgccaagcgcgcctgaggtgcaggaaaccacccgcatgcttgaggattcggagtctagctacgagccggatgagctgacgaaagagatggcgcacttagaaggcctgatgaaggatctgaatgctatcacaacggcttag

SEQ ID NO: 232171 - DNA, 4353 bp, Artificial Sequence
  Description of Artificial Sequence: Synthetic coding sequence
atggctgccgaaagaggagcgcgacggttactgtctacaccatctttctggctgtactgcctgctgctactcggtaggcgggcaccgggagctgccgctgcgagaagcggctcagctccccagagccctggtgcgtccatcaggacttttacgccattctatttcctagttgagccagtggacacgttatcagtgaggggttctagcgtcatcttgaattgttccgcctacagcgaaccttcccccaagatcgagtggaagaaagatggcactttcctcaacctggttagtgacgatcgacgtcagcttttgccagacggaagcctctttatcagtaacgttgtccactcaaaacacaacaagccagacgaaggctattatcagtgtgtagcgaccgtggaatctctgggaacgattatatcaagaaccgctaaactgattgtggccggtctaccacggttcacatcgcagcctgaaccaagctccgtctacgccggaaataatgccattctgaactgcgaagtgaacgcggacttggtccctttcgtgcgatgggaacagaaccgtcagcccctcctgctcgacgatcgtgtcatcaagctgccctcagggatgttagtcatcagcaatgcaactgagggggacgggggactgtatcggtgtgtggttgaatccggaggacctcctaaatactcagacgaggtggagctgaaggttctgccagacccagaggtgatctctgacctcgtgtttctgaaacagccaagccctctcgtgcgagtgatcgggcaagatgtagtgttgccgtgcgtcgctagcggattaccgacacctaccattaagtggatgaaaaatgaggaggccctggataccgaatcctccgagagacttgtgctgctcgcagggggtagcttggagattagtgacgttaccgaagacgacgctggcacctatttctgtatcgccgataacgggaatgagaccattgaggcacaggcggagttgacagtccaggcccagccagaattcctcaaacaacctaccaatatttatgcccatgagagcatggatatcgtgttcgagtgcgaggtgacggggaaacccacccctactgtcaagtgggtcaagaacggtgacatggtgatcccgtcggactattttaagattgttaaggagcataacctgcaggttttgggcctagtgaagtctgacgaaggattttaccagtgtatcgcagagaacgacgttggaaacgctcaggcaggcgctcaattaatcatactggaacatgctccggcaactacgggacccctgccctccgcccctcgagatgtggtggcctcattggtgtccacaaggttcataaagctcacctggcggaccccggcaagtgacccccacggggataacttaacttactccgttttctacaccaaggaaggcatcgccagagaacgggtggaaaacacgagccatcctggggagatgcaggtcacaattcagaacctaatgcctgctaccgtatacatttttagagtaatggcacagaacaagcatggctctggagaaagcagcgcacccctccgggtcgaaacccagcctgaggttcagctccctggcccagctccgaaccttcgggcatacgctgcatccccaacatccatcactgtaacgtgggagacacccgtctccggtaatggagaaatacagaactacaagctgtactatatggagaagggcaccgacaaggagcaggacgtcgatgtgtcttcacacagctacaccattaacggtctgaaaaaatacactgagtattccttccgggttgtggcttataacaagcatggacccggagtcagtaccccggatgtggctgtgaggaccctgtctgacgtgcccagtgcggctcctcagaacctgtcactggaagtcaggaacagcaagtcaattatgatccactggcaacctcccgctccagcgactcagaacgggcagatcacagggtacaaaatcagataccgcaaggccagcaggaagtcagatgttacagagactttggtgtcaggtactcagttgtcacagctgattgagggattagatcggggtaccgaatacaattttcgcgtggctgccctgaccattaacgggaccggtcccgcaaccgactggttgtccgcagagaccttcgagtcagatttggatgagaccagggtgccagaggtgcctagctcgctccacgtgcgcccactggtgacaagcatagtcgtctcctggaccccccctgaaaatcagaacatagtcgttaggggctatgccatcggctatggcatcggctccccccacgctcagacgattaaggtggattacaaacaacggtactatactatagaaaacctggatccatcatctcactacgtgatcacactgaaggcatttaacaacgttggagagggcatccctctatatgaaagtgcagtgacccggccacataccgacacatctgaggtggatctgttcgtcattaacgctccatacacccccgttccagaccctacacctatgatgccgccagttggagtacaggcatccatactgagtcacgacacgattaggatcacttgggccgataactctttgcctaaacatcagaagatcaccgattctaggtactacacagtgcgatggaagaccaatattcccgctaatactaaatataagaatgccaatgccactaccttaagctatctcgtgacgggcctgaagccaaacaccttgtatgagttctccgtaatggttacaaagggaagaagatcttcaacatggtctatgactgcgcacgggacgacattcgaattggtgccaacaagtccccctaaagacgtcacggtggtcagcaaggaaggaaaacccaagacaataattgtcaattggcaaccaccaagcgaggcgaacggaaagattacagggtacatcatttattatagtaccgatgtgaacgcagaaatccatgattgggtaattgaacccgtagtgggaaataggttgacgcatcagatccaggaactgaccttagatactccctattattttaagattcaggccagaaactctaaggggatgggcccaatgtctgaagcggtccaattcagaactcccaaagcctccggttctggtggcaaaggctctcggctacccgatctcggcagtgattacaagccgcctatgtccggttccaacagcccacacggtagccctacatcccctttagatagtaacatgctcctcgtgatcattgtgagtgtcggtgtgataacaatcgttgtggtggtcattatcgctgtattctgcacacgacggacgacgagccatcaaaagaagaaacgcgcagcttgcaagtccgtgaatggatctcacaagtacaagggaaacagtaaagatgtcaagcctccggacctctggattcatcacgagagactggaactgaagcctatcgataaatctcctgatcctaatcccatcatgaccgatacacccataccgcgaaattcacaggacatcaccccggttgacaatagtatggattccaacatccatcaacgtcgtaactcttaccggggtcacgaatctgaggatagcatgtctaccctggcagggagacggggtatgaggccaaagatgatgatgcccttcgactcccagccaccccagcctgtgatttccgcccaccctatccattctttggataatccccatcaccactttcattctagttctttggcctcaccagccaggtcacacctttaccacccaggaagtccctggccaatcggtacttcaatgtcgctttccgatagggcaaattcaaccgagtcagtgcggaataccccctctaccgacaccatgcctgcctctagttcccagacttgctgcactgaccatcaggaccctgagggcgcaacaagcagtagttatttagcctctagccaggaggaagattccggtcaatcactgcccaccgctcatgtgcggccaagccaccccttgaagtctttcgccgtacccgcaattcctcctccaggaccccctacctacgaccctgctcttcctagtacccccctgctctctcaacaagcccttaaccaccatatccattccgtcaagacggctagtatcggtactttgggcaggtcacgccctccaatgcctgtcgtcgtgccctccgccccagaggtgcaggagactactagaatgctcgaagattctgagtcctcttacgaaccagacgagcttaccaaggagatggcacatctggaaggccttatgaaggacctgaacgctattaccacagcctag

SEQ ID NO: 232172 - DNA, 4227 bp, Artificial Sequence
  Description of Artificial Sequence: Synthetic coding sequence
atggcagccgaacggggtgctcgcaggttactctctaccccatctttttggctctattgtcttctgctgctcggcaggcgggcaccaggcgctgctgcagctcgaagcggcagtgcgcctcagtcaccaggcgcatccataaggaccttcacgcccttctacttcttagttgaacctgttgatactctctcggtgcgtgggagctccgtcattctgaattgctccgcctacagcgaaccctctccaaagatcgaatggaaaaaagatggcacttttctgaatcttgtcagtgacgaccgcagacagctgttgcctgacggatcactgttcatctcaaatgttgtgcactcaaagcacaataagcccgacgaaggatattaccagtgtgtggctactgtggagtccctggggaccatcatatccaggaccgcaaagctgattgtggctgggctccctaggtttaccagtcagccagagccatctagcgtgtatgcagggaataacgccatcttgaattgcgaggttaacgccgatctagtcccctttgtaagatgggagcaaaaccgccagcctctcctgctggacgatcgcgtgatcaagttaccttcgggcatgctggtaatttccaacgcaaccgagggagacggaggcctgtacagatgtgttgtggagtccggcggacctccaaaatattcggatgaagtcgagctgaaggtacttcccgaccccgaggtgattagtgaccttgtgttcctgaaacagccctcacctctggtgcgcgtgatagggcaggacgtcgtcttaccatgtgtagcatccggcctgcctacacccactatcaagtggatgaaaaacgaagaagccttagatactgaatcctcagaacgcttggtactgctggctggcggttccttggaaataagtgatgtgactgaagatgacgccggtacatacttttgtatcgccgataatggcaacgaaaccatcgaggcgcaggctgagcttactgtccaagcccagcccgagttcctgaagcaacccacgaatatatatgctcacgaaagcatggacattgtgttcgagtgcgaggttactggcaagccaacaccaaccgtgaaatgggtgaagaacggggatatggtgattccctctgactattttaagattgttaaggagcacaatttgcaagtgcttggcctcgtgaagagcgatgaggggttctaccagtgtatcgccgaaaatgatgtcggtaacgcccaagccggtgctcagctgatcatcctcgaacatgcgccagcaactacgggcccactgccttccgcaccaagggacgtggtagctagtctggtcagcacccggtttattaaactcacctggcgcacacccgcatctgaccctcacggggataatctaacttactctgtgttctataccaaggaaggcattgccagggagcgcgttgaaaacacaagtcatcctggcgagatgcaggtgactattcagaacttgatgccagcgactgtgtacatcttccgcgtcatggctcagaacaagcacggtagcggagaatcttctgcacctctccgtgtagaaacccagccagaggtgcaactgcccggtcccgcaccaaatttaagggcctacgcggcttcacctactagtataacggttacttgggaaacacccgtctccggtaacggggaaatccagaattacaagttgtattatatggaaaaaggtaccgacaaggagcaggacgtcgacgtttctagccattcctacactatcaatggtttaaagaagtatacagagtacagcttccgggtagtggcctacaacaaacacggcccaggtgtgtccacgcctgacgtggccgtgcgaaccctctctgacgtacccagcgccgctccccagaacctcagcctcgaggtccggaatagtaagtccattatgattcactggcagccacctgcgccagccacccagaatgggcagataaccggctacaaaataaggtacaggaaggcgagcagaaagtcagacgtcactgagacacttgtttcaggtacccagctgtcccagttgattgaaggtctagatcgcggtactgagtataacttccgcgtggctgccctaaccataaacgggacagggccagccacggactggctgtccgccgaaaccttcgagtccgatctcgatgagaccagggtaccagaggttccctcgagtctgcacgtgcggccactggtgacgtccatagttgtttcttggacaccaccagaaaatcagaatatcgttgtgaggggctacgccatcgggtacgggatcgggtccccccacgcccaaactattaaggtggactataagcaaaggtattacaccattgaaaatcttgatccctcttcgcactatgtgatcacattgaaagccttcaataacgtcggcgagggaatcccgctgtacgaatctgctgtcactagaccacacacagatactagtgaggtcgatctcttcgtgattaacgcaccctacactcctgtgcccgatcccacacctatgatgcctcccgtgggtgtgcaggctagcattctttcccatgatacgatccgtattacatgggcggacaactcactcccgaagcaccagaaaataacggacagcaggtactataccgtaaggtggaagaccaatatcccagccaatacaaaatacaaaaacgctaacgctactacactcagctatctggtcaccggcctgaaaccgaatactctgtatgaattcagcgtaatggtcaccaagggcaggcgctcatctacctggagcatgaccgcccatgggactaccttcgaattagtgccaacttcccctcccaaagacgttacagtggtgtcgaaagaaggtaagcctaagacaattatagtgaactggcagccaccaagcgaggcgaatgggaagatcaccggctacattatctactactctacggacgtaaatgccgagatccacgattgggtcattgaaccagtggtcgggaacagactaacacatcagattcaggagctgacccttgacacaccctactatttcaaaattcaggccagaaattcaaaggggatgggcccaatgtccgaggcagtgcagttcaggactccgaaagcagattcctccgacaagatgccaaacgatcaggcaagtggtagtgggggaaaaggctctagactgccagaccttggaagcgactacaaaccacctatgagcggcagcaacagcccccatgggtccccaactagccccttggatagcaacatgttgctcgttataattgtgtccgttggtgtcataaccattgtcgtggtcgtgattatcgcagtcttctgtacccggcgaactacaagccatcaaaagaagaagcgggcagcttgcaaatcagtaaacgggagccacaaatataaaggcaacagcaaggatgtaaagccaccggacttatggattcatcatgagagactggagctcaagccaattgacaaatcccccgacccaaatccgattatgactgacacgcccatcccccgaaactctcaggatataacccccgtggacaacagcatggatagcaacatccatcagagacgcaactcataccgcggtcacgaatctgaggattcaatgagcaccctggccggtcgtcgtgggatgcgccctaagatgatgatgcccttcgactctcaaccgccacagcagagcgtacggaatacgcccagcaccgacaccatgccagcttcatcatcccagacgtgttgcacagaccatcaggatccagagggagctactagcagttcttatctcgcttcctctcaggaggaagatagtgggcagagcttgcccaccgcgcacgtgagacctagtcatccacttaaaagcttcgctgttcccgcaatccccccacccggaccacctacttacgatcctgcacttccatctacgccgctgctgtcccaacaggccctcaatcatcacatccatagtgtgaaaacagcctctattgggacactggggcgatcccgcccacctatgcccgtggttgttccttccgcccctgaggtacaagagactacccgtatgcttgaagatagcgaatccagttatgaacctgatgagctcacgaaagagatggcacatttggaaggactcatgaaggacctcaatgccatcaccacggcctag

SEQ ID NO: 232173 - DNA, 1074 bp, Artificial Sequence
  Description of Artificial Sequence: Synthetic coding sequence
atgcaatccgtccaatcaacttcattctgccttcggaagcagtgcctctgcctgacattcctgttgctgcatctgctcggacaggtggcggctacccagcgctgtcctccccaatgtcctggcagatgccccgcaacaccccctacttgtgctcctggagtgcgggctgtgctcgatggttgttcttgctgtctggtgtgcgctcggcagcgtggggagagttgtagcgacctggaaccttgtgacgagagtagcgggctttactgcgaccggagtgcagatccttcaaaccagaccggcatttgtaccgctgtggaaggagacaactgtgtgttcgatggagtgatttacagatctggagaaaaattccagccatcatgcaaatttcaatgcacttgccgggacggccagatcggctgtgtgcctaggtgccagctggacgtgctgctccccgagcctaattgcccggctccacgtaaggtcgaagttcccggagaatgctgtgagaagtggatctgtggccctgatgaggaagacagtctcggagggttgactctcgcggcttacagaccagaagccactctcggggttgaagtctcagattcatcagtgaactgtatcgagcaaacaacagagtggactgcttgcagtaagtcgtgtggcatgggctttagcacgcgagtcaccaaccgaaatcggcaatgcgaaatgctcaaacagacgaggctgtgcatggtccggccatgcgaacaagagcccgagcagcccacagacaagaaagggaaaaagtgtctgcggacgaagaagtctctcaaagctatccatcttcagtttaaaaactgcacgtccctgcatacttataaaccgagattctgcggggtctgctcagacgggagatgttgtactcctcataataccaaaaccatccaggctgaattccaatgttctccaggacagatcgtgaaaaaaccagtgatggtgattggcacctgtacatgccacaccaactgcccgaagaataacgaagctttcctacaggaactagaattaaagacaacaagaggtaaaatgtag

SEQ ID NO: 232174 - DNA, 2202 bp, Artificial Sequence
  Description of Artificial Sequence: Synthetic coding sequence
atgcttgccaggcgtcaaagggaccccttacaggcgctgcgcaggcgcaatcaggaactgaagcagcaggtcgactctctcctcagtgagtcacagttaaaagaggcacttgagcctaacaagagacagcacatatatcagagatgcatccagctcaaacaggctatcgacgaaaataaaaacgcactgcaaaagcttagcaaggcagatgagagtgcccctgtggctaactacaaccagaggaaggaagaggagcacacactgctcgataagctcacacaacagctccagggtcttgccgtgactatatcaagggagaatatcaccgaggtgggagcacccactgaggaggaggaagaatccgaatctgaggatagtgaggactcgggaggcgaagaagaggacgctgaggaggaggaagaggagaaggaggaaaatgagagccacaagtggtccactggggaggagtacatagcagttggcgattttaccgcccaacaggttggggatctgactttcaaaaagggagaaattctgctagtgattgagaagaagccggatgggtggtggattgccaaagacgcaaagggtaacgaaggactcgtgcctcggacttacttggagccttattccgaggaagaagagggtcaagaatcaagcgaggagggtagcgaggaggacgtcgaggccgtggacgaaaccgctgatggagccgaggttaaacagagaactgatccacattggagcgcggtgcagaaagcgatatccgaggctggaatcttttgcctggtgaatcatgtctctttctgttacctcatcgtcctgatgcgtaaccggatggagacggtcgaggatactaacggatctgagactggtttcagagcctggaacgtgcaaagtaggggaaggatttttctggtgtcgaaaccagtactgcagcagatcaacactgtggacgtcctcacgacaatgggggctatacctgctggttttcgaccttccacactgtcccagcttttagaggaaggtaaccagttcagggcaaattatttcctgcagcctgaactcatgcccagccagctggcctttcgagacttaatgtgggacgctaccgaagggacaataagatcccggccaagccgcatctctctgatattaactctttggtcttgtaaaatgatccctttgccgggaatgtctatacaagtgctctcacgacacgtcagactgtgtctgtttgatggcaacaaggtactgtctaacattcacaccgtcagggccacatggcagcctaagaaacccaaaacttggaccttttccccacaagtgactagaattctcccctgcctgttggacggggactgctttatcagatctaatagtgccagcccagatcttggaatcctatttgagctggggatcagttacattagaaacagcactggagagcggggtgaactgtcttgcgggtgggtttttctcaaactgttcgacgcctccggtgtcccaattccagccaaaacctacgagttatttttgaacggtggcactccttatgaaaaaggcatcgaagtcgatccgagcattagccgcagagcccatgggtctgtgttttatcagattatgactatgcgcagacagcctcaactccttgtgaagctgaggtcactcaataggagaagccgcaacgtcctgtccctgcttcccgagacacttatagggaacatgtgtagtattcacctgctcatcttctaccgccaaattttgggagatgttctgctcaaggaccgcatgtctctccaaagcacagacctgatctcccaccccatgctggccacgtttcctatgttactagaacagccagacgtgatggatgccctcagatcttcctgggcgggaaaagaaagcaccctgaagagatcggaaaagagagataaagaattcttgaagtcaactttcctgctcgtctatcacgactgcgtcctgccccttctccactccacacgcctgccacccttccgatgggcggaggaagagaccgagacagcgagatggaaggtcatcactgatttcctgaagcagaaccaagagaaccagggcgcactgcaggcccttttatctcccgatggcgtccatgaaccttttgatttaagcgaacagacgtacgactttctcggggagatgcgcaaaaacgctgtttag

SEQ ID NO: 232175 - DNA, 1845 bp, Artificial Sequence
  Description of Artificial Sequence: Synthetic coding sequence
atgctggcccgaaggcagagagatcctctgcaggccctgaggcgcaggaaccaagagctgaagcagcaggtcgattcactcctttccgaatcgcaacttaaagaagcgctggagcctaataaaaggcagcatatctaccagcgagtcggagctcctaccgaggaagaggaagagtccgaatcagaagactctgaggacagtggaggagaggaggaagatgccgaagaagaggaggaggagaaagaggagaacgaaagtcataagtggtcaaccggcgaggagtacatcgctgtgggcgatttcactgcacagcaggtcggcgaccttacattcaagaaaggcgagattttgctggtgattgagaagaagcctgatgggtggtggattgcaaaggacgctaagggaaacgagggcctcgttccacggacctacctggagccgtatagtgaggaggaggagggtcaagaatccagcgaggaaggatctgaggaagatgtagaggccgtcgatgagaccgctgatggggctgaagtgaaacagagaactgacccgcactggagcgcagttcagaaagccattagcgaaataaacactgtggatgtgcttactacaatgggcgctatccctgccggattcaggcccagcaccctcagccaactgctggaggaaggtaaccagttccgggctaactattttcttcagcctgagctgatgccgtcccagttggcatttagagatttgatgtgggacgctaccgaaggaaccatcaggtcccggccaagtagaattagcttgatcctcaccctgtggtcttgtaaaatgatccctcttccgggaatgtcgatacaggtgctttcacgccatgttcgtttatgcttattcgacggcaataaagtgctttcgaatatccatactgtgagggccacatggcaacctaaaaagcctaagacatggacgttttcgcctcaggtgacaaggatcctcccttgtttacttgacggggactgtttcattaggtctaatagcgcttcgcccgatttggggattctgtttgagctggggatttcctatatccgcaactctactggggaaaggggcgaactttcttgcggatgggtatttctcaaactgttcgacgctagcggcgtgccaataccggcaaaaacgtatgagcttttcctcaacggcggaaccccatacgaaaaggggatagaagtcgacccctccatctcccggagagcccacgggagtgtgttttaccagattatgaccatgcggaggcagcctcagttgctcgtgaaattgagaagcttaaaccgccgatctagaaatgtcctttcactcctgccagagacgttaattggaaatatgtgcagcattcacctgctcatcttttatagacagatcttgggcgatgtcttgctgaaggatcgtatgtccctgcaaagtactgacttgatctctcatcctatgctggctacgttcccgatgctgctggagcaacctgatgtgatggatgccctgagatcatcctgggccggtaaagaaagtacgctaaagcgttccgaaaagcgagataaggagttcctgaaatccacttttctcctggtgtatcatgactgcgtgctcccattgctccattccacccgactgcctccctttagatgggccgaagaggagaccgaaactgctaggtggaaagtaatcaccgatttccttaaacagaatcaggagaatcaaggggctttacaggcactcctgtctcccgatggggtgcacgaaccattcgacctgtcagaacagacctatgacttcctgggcgaaatgaggaagaacgccgtctag

SEQ ID NO: 232176 - DNA, 2199 bp, Artificial Sequence
  Description of Artificial Sequence: Synthetic coding sequence
atgctggccaggcggcagagggacccactgcaagcactccgcaggcggaatcaagagctcaaacagcaagttgactcactcctctctgagagtcagctgaaggaggccttggagcccaacaagagacagcacatctaccagcgatgcattcagctgaagcaggctatcgacgaaaacaaaaatgccctccaaaaactaagcaaggccgatgagagtgcgccagtggctaattataaccagagaaaggaagaggaacatacccttttggacaaacttacccagcagttgcagggcctggctgtgactatctcacgagagaatatcaccgaagttggggctccaaccgaggaagaggaggagagcgagtctgaggactccgaagattctggtggggaggaggaagacgctgaggaggaggaagaggagaaggaggagaatgaaagtcacaaatggagcactggcgaagagtacatagccgtgggagactttacagctcagcaggtgggtgacctgactttcaagaaaggggagatccttttggtaatcgagaaaaaacctgatggttggtggatagccaaggacgcgaagggcaacgagggcctggtacctcggacatatctcgaaccttactcggaagaagaagaaggccaggagagcagtgaggagggaagtgaggaagatgttgaggccgtggacgaaaccgcagatggcgcagaagtgaagcagcgcaccgatccccattggtcagctgtgcaaaaagcgatttctgaggctggcatcttctgcctcgtgaaccatgtttcattctgttacctcattgtgctgatgcgaaacaggatggagactgtcgaggataccaatggatctgaaacgggtttccgcgcttggaatgtgcaatccagaggccgaatcttcctcgtgtctaaacccgttctgcagatcaacacagttgatgtgctcaccaccatgggcgctatacccgcaggtttcaggccaagtacgctgtcccaacttctggaggaaggcaaccagttccgggcaaactactttctgcaaccggagctcatgccctcgcagctggcgttcagagacttgatgtgggatgcaactgaaggaacaattcgatcccggccttcacggatttcactgatcctaacactttggagctgtaagatgattcctctgcctggcatgtcaatccaggtgctgtcaagacacgtgaggttatgcctgtttgacgggaataaggttttgagtaacatccacacagtcagggcgacatggcagccaaaaaagcctaaaacatggacgtttagccctcaggtgacacgcattttgccctgcctcctggatggtgattgcttcatcaggagcaatagcgcaagccccgacctgggaattctgttcgaactggggatttcctatatccgcaactccacaggagaacgcggagagctctcctgcggctgggtgtttctgaaactgttcgacgctagcggggtaccaatccctgctaagacttacgagctgttcctgaacggcggtaccccctacgaaaaaggcatcgaagtggaccctagtatcagccgaagagcccacggcagcgtgttctaccaaataatgactatgcggaggcaacctcagctactcgtgaagcttcgcagcttaaatcggagatcaagaaacgtattgagcttactccctgagactctcattgggaatatgtgctccatacacctgctaatcttttacaggcaaatcctgggggatgtgcttctcaaagaccgtatgagcctccagagtactgatctgattagtcaccctatgctggcaacgtttcctatgcttttggaacagcccgacgtgatggacgctctcaggagctcttgggcgggaaaagagtccaccctgaaaaggagcgagaagcgcgataaagagttcctcaaatccactttcttactcgtctatcacgactgcgtgctgccgcttctccattctactcgactccccccattccggtgggctgaggaagaaactgagaccgcgaggtggaaagtgatcacagacttcttaaagcagaatcaggaaaatcagggagcattgcaggctctccttagcccagacggggtgcacgagcccttcgacctctccgagcagacctatgacttcctgggcgaaatgcggaagaacgcagtttag

SEQ ID NO: 232177 - DNA, 2034 bp, Artificial Sequence
  Description of Artificial Sequence: Synthetic coding sequence
atgttggccagacgccaaagagacccacttcaggcgctcaggcgtagaaaccaagaacttaagcaacaagtagactcgttactgagtgaatcacagctcaaagaggcattggaacccaataaacgccaacacatatatcaaagatgtatccagctgaagcaagcaatcgatgagaataaaaacgctttacagaagttaagcaaggcggatgagtctgccccagtggcaaactataatcagaggaaagaggaagaacacacgctgctcgataagctgacgcagcagctgcaagggctggccgtgacaatctcccgggagaacataaccgaggtgggcgcacctacagaagaggaagaagagagcgagagtgaggactcagaggacagcggaggcgaagaggaggacgcagaggaggaggaggaagaaaaagaggaaaatgaatctcacaaatggagcaccggcgaagaatacatcgcggtcggagacttcaccgcacaacaggtgggcgacctgactttcaagaagggagagattctgctggtgattgagaaaaaaccagacggatggtggatagccaaagacgcgaaggggaacgagggtctggtgccaagaacttacctcgaaccatattccgaggaagaggaggggcaggaaagcagtgaggaggggagtgaggaggatgtggaggcagtcgatgagacagctgacggagccgaagttaagcaaagaaccgacccacactggtccgctgtacagaaggcaatttcagaacaaattaacacagtagatgttctgacgacgatgggcgcaatcccagccggatttcggccaagtaccctatctcagctccttgaagaagggaatcagttcagggcaaactattttctgcaaccagaattgatgccgagccaactggccttccgcgaccttatgtgggatgctacagaagggacaattaggagccgacccagtcggatcagtctcattctgacactttggagctgtaaaatgattccactgcccggtatgtccatccaggttctcagccgccatgttcgactgtgcttattcgatggtaacaaagtcttgtccaacatccatactgtgagggcgacatggcagccaaagaaacccaaaacctggacattttcaccgcaggttacccggattctgccctgcttactcgatggcgattgcttcatcaggtcaaattctgcctccccagatctgggcatcctgtttgagctggggatctcctacataaggaactccaccggcgaacggggagaactatcgtgcggatgggtattcctgaagttgttcgatgcctccggtgtgccaatcccagccaagacgtacgagctattccttaatggcggtaccccttatgaaaagggaatagaagttgatccatccatatcaagaagggcccacggaagcgttttctaccaaatcatgaccatgaggcggcagcctcagctgctagtgaagttgcgctccctcaaccgacggagtaggaatgtgctgtccctcctacctgagaccctcatagggaatatgtgctccattcatctgctgatcttttacagacagatcttgggcgacgtcctcctaaaggacaggatgtccttacagagcaccgatttgatcagtcacccaatgctggctacatttccaatgctgttggaacagccagatgtcatggacgctctgagaagctcatgggccggtaaagagtctactctcaagagaagcgaaaagagagacaaagaatttctcaagagtacgttccttctggtctaccacgattgtgtacttccactgctgcacagtacccgactgcccccttttagatgggccgaagaagaaacagagaccgccagatggaaggtcatcacagatttcctcaagcagaatcaagaaaatcagggcgcacttcaagccctgctcagtcccgatggtgtccatgagccattcgacctgtcagagcaaacatacgattttctaggcgagatgagaaaaaatgccgtatag

SEQ ID NO: 232178 - DNA, 2115 bp, Artificial Sequence
  Description of Artificial Sequence: Synthetic coding sequence
atgggcacagcttcttcactggtttcaccagcgggtggggaggtcatcgaggatacttatggcgctggaggaggtgaagcttgtgagattcctgtcgaggtgaagcctaaagccagactccttcgcaattccttccgcagaggagccggtgccgctgccggagcgggtccagggagcttgcccaggggggtcggcgctggaggtctgctgggtgctagtttcaaatccaccggcagttccgtgcctgaactcgagtatgccgctgctgagtatgagagactgaggaaagagtacgagatctttagggtatcaaagaaccaggaactcctatctatgggtaggcgagaggccaagttggacacagagaacaagcggctgcgggcagaactccaagctctccagaagacgtatcagaagattttacgcgaaaaagagagtgccctggaagctaagtaccaggcaatggaaagggccgctaccttcgagcacgatagagacaaagtcaagcgtcaattcaaaatatttcgtgagacgaaggaaaatgagattcaggacctgcttcgagccaagagggaattggaaagtaaactgcagagactccaggcccaggggattcaggtcttcgatccaggtgagtctgactccgacgacaattgtaccgatgtgacggcagcgggaacccagtgcgagtactggaccggtggggctctggggtctgagccgtctatcggtagcatgatccagttgcagcaatcttttcgtggccctgagtttgcacattctagcatcgacgtggaggggccatttgccaatgttaatagggacgattgggatattgccgtggcctcacttctgcaggtgacgccacttttcagccacagtctgtggagtaacaccgtgaggtgttacctgatctacacagacgagacacagccggagatggacctgttccttaaggactattctccaaaattgaagagaatgtgcgaaaccatgggctacttttttcacgcggtttacttccccatagatgttgagaatcaatacttgacagtcagaaaatgggagatcgaaaagagttctcttgtcattctgtttattcatctgaccctcccctcactgctcctggaagattgcgaagaggccttcctcaaaaacccagagggtaagcccaggctgatctttcacaggctggaagacggtaaggtgagcagcgattctgtgcagcagctgatagatcaggttagtaacctaaataaaaccagtaaagcaaaaataatcgaccatagtggagacccggcagagggtgtttacaaaacctatatctgcgttgagaagattatcaaacaggacatcctgggcttcgagaacacagacctggagactaaagatctgggatccgaggactcaattccggaggaggacgacttcggagacgttctttgggatatccatgacgagcaggagcagatggaaactttccaacaggctagtaattctgcccatgagcttgggtttgagaagtattaccaacgcctgaatgatctggttgccgcacctgcccctattcctccactgctggtcagcggtgggcctggctccggcaagtccctcctgctgtccaagtggattcagttgcagcaaaagaatagcccaaacacgctaattctgtcacactttgtcggcaggcccatgtctacatcctctgaaagctcattgattatcaaaagactgacactgaagctgatgcaacactcctggtctgtgtcggccctcactctcgaccccgcaaaactcctggaggagttccctcgttggctggaaaagctttccgctcgccaccagggcagtatcatcatcgtgattgactctatcgatcaggtgcagcaggtcgaaaaacacatgaagtggttgattgaccctctccccgtaaatgtccgagtgatcgtgtccgtgaacgtggagacatgtcccccagcgtggcgtctgtggcccaccctgcatctggacccattatcgcccaaggatgctaaatctatcatcattgctgagtgtcacagtgtagatataaagctgagtaaggagcaatgctgggagtctcggcagttccgctag

SEQ ID NO: 232179 - DNA, 3993 bp, Artificial Sequence
  Description of Artificial Sequence: Synthetic coding sequence
atgggaaccgcaagcagcctcgtgagtccagcaggcggtgaggtgatagaagacacatatggagccggaggcggagaggcctgcgagatacccgtcgaggtaaagccaaaggccaggctgcttcggaactcctttaggcgaggggcaggagcagccgctggcgctggacccggatcgctgccaaggggcgtaggcgctggagggctgctgggagcttcattcaaatccaccgggtctagcgtcccagaactggagtatgccgcagcagagtacgaacgactcagaaaggagtacgagatctttagggttagcaagaatcaggaattactgagcatgggtcgccgagaagccaaattagataccgaaaataaaaggctcagagctgaactgcaagcgctccagaaaacttatcagaagatactgagggaaaaagagtcggctctagaggccaagtaccaggcaatggagcgcgctgcaactttcgagcacgatcgggataaggtgaaaaggcagttcaagatatttcgcgagaccaaggaaaatgagattcaggatttgctaagagctaagagggaacttgagtccaaactgcagaggctgcaggcacaggggatccaggtgttcgatccaggagaaagcgattctgacgacaactgcactgatgtcaccgccgctggaacgcagtgtgagtactggactggcggtgctctgggctcagaaccttccataggatccatgattcagcttcagcagtcatttaggggacccgagtttgctcatagttccattgatgtggagggcccttttgctaatgtgaaccgggatgattgggatattgcagtggcatctcttctgcaggttacacctctgttttctcattccctgtggtctaatactgtgcgatgttacctaatctacacagatgaaactcagccggagatggatctatttctcaaagattattccccaaagcttaagcgcatgtgcgagacgatggggtacttcttccacgcggtctatttccctattgatgtggagaatcagtacctgaccgtgcggaagtgggaaattgagaaaagctcactggtgatcctgttcatccatttaaccctgcctagcttgctcctcgaggactgtgaggaagcattcttgaagaaccccgaaggtaaacctcgattgattttccaccgactggaggacggtaaagtgagttccgacagtgtgcaacagctgattgatcaagtaagcaatctgaataagacatctaaggctaagatcattgaccactcaggtgacccggctgaaggggtttataaaacttacatctgcgttgaaaaaatcatcaaacaagatatccttggcttcgaaaataccgacctggaaaccaaggacctgggcagcgaagactccattccagaagaggatgatttcggtgatgttttatgggacatccatgatgagcaagaacagatggagactttccaacaggcaagcaactccgctcacgaattggggtttgaaaaatattaccagaggctgaacgatcttgtcgcggctcccgctcccatccctcccctcctggtgtcaggagggccagggtccggaaaatctctgctactttctaagtggatccaactgcaacagaaaaactcccctaacacactgattctcagccatttcgtgggaaggccaatgtccacaagtagcgaatccagccttattataaaaaggctgacactgaaactcatgcaacactcctggtctgtgtctgccttaacactggaccccgctaaactcctggaagagttcccacgttggctcgagaaactgtcagctcggcatcagggttccatcatcattgttattgattccattgaccaagttcaacaggtagagaaacatatgaagtggcttatcgacccgctgcccgtaaatgtcagagtaatcgtctctgtgaatgtcgagacgtgccctcctgcgtggaggctatggccaactctgcatttagaccccctctctcctaaagacgcaaaatcaattatcatcgcagagtgtcactccgtcgatataaagcttagcaaggagcaggaaaagaagcttgaacggcactgcaggagcgccacaacctgcaatgcattgtatgtaacacttttcggaaagatgatcgctagggccggacgagccggaaatttagataagatactgcatcagtgcttccagtgtcaagacacgctgtctctgtaccggctggtgcttcacagcattcgcgaatcaatggccaacgatgtggacaaggaactcatgaaacagatactttgtttggtcaacgtctcccataatggtgtctccgagtccgagctgatggagctctaccccgagatgtcttggacctttctgacttcacttatacacagcctctataagatgtgtctgctgacgtacggctgcgggctattacgattccagcatcttcaagcttgggaaactgtcagactagagtacctggaggggccaaccgtcacctcgtcatatcgccagaagctcattaactacttcacgctacaactgtcgcaggatagagtgacctggcggtcagctgatgaactcccctggctcttccagcagcagggctcaaagcagaaactccatgattgtttgttaaacctgttcgtgtcccagaatctatacaagcggggacacttcgctgaactgctatcctactggcaattcgtgggcaaggataagtccgcaatggctacagagtacttcgacagcctaaagcaatatgagaaaaactgcgaaggcgaggacaatatgtcctgtttggcagatttatacgaaaccttgggcagatttctgaaggacttaggactgctgagtcaagccattgtaccactgcaacgcagtctggaaattagggaaaccgccctcgatccagatcaccccagagttgcacagagcctccaccaactcgcttcagtttacgtgcagtggaagaagttcggcaacgccgaacagctttataaacaagcccttgagataagcgagaacgcatacggagcagaccacccctacaccgccagggagctggaagcactcgccaccctgtatcagaaacagaataaatacgagcaggctgagcatttccggaaaaaaagctttaagatccaccaaaaagccataaagaaaaaagggaatctgtacgggtttgcactgctgagacgcagagcgctgcagcttgaagaattgacgctcgggaaggacactccagacaatgcaaggactctgaatgaattgggagtgctatactatctgcagaacaacctggagactgccgatcagtttcttaaacgatcactcgagatgcgggagcgcgtcctggggccagatcacccggactgtgctcaatctctgaataacctggcggctctgtgcaatgaaaaaaaacagtacgacaaggctgaggagctttacgagagagcccttgacatcagacgacgggctctagcccctgaccacccgtcgctagcttacacagtcaagcacctggcaattctgtataaaaagatggggaagttagacaaagccgtgccgctgtatgagctggctgtggagatcagacagaagagtttcggacctaagcacccgtcggtggcaaccgccctcgtgaacctggccgttctctattcgcagatgaagaagcacgtagaagctctcccgctgtacgagcgcgctttgaagatttatgaggactctttgggacgaatgcacccaagagtgggcgagactctcaagaacctagcagtgttgagctatgagggaggagacttcgaaaaggccgcagagctgtacaaaagagcaatggagattaaggaggcggaaaccagtcttcttggcggtaaagcccctagtagacattcatcctctggcgataccttcagtttgaaaacagcacatagccctaacgtttttttgcagcagggccagagatag

SEQ ID NO: 232180 - DNA, 720 bp, Artificial Sequence
  Description of Artificial Sequence: Synthetic coding sequence
atggggaccgcaagttcgttggtttcaccagctggaggagaagtgattgaagacacctatggcgcaggcggaggtgaggcatgtgagattcccgtggaagtgaagccaaaagcgagactgctgcggaactctttccgtcgtggggcaggcgcagctgcaggcgcaggcccaggcagcctgccacggggtgtgggagcgggtgggctgctgggcgcatcgttcaagtcaaccggatctagcgtgcccgagctagaatacgctgccgctgaatatgagcgactacggaaagaatacgaaatctttcgtgtttccaagaaccaggagctgctgagtatgggtcgccgagaggctaaactggacaccgagaataaacggcttcgcgcagaattacaggccctgcagaaaacttatcagaagatcctgagggaaaaagaaagcgccctggaagcaaaataccaagccatggagagagccgcaacatttgagcacgatagagataaagtaaagagacagtttaagatcttcagagagactaaagagaatgagatccaggatcttctccgggctaagcgggagttggaatccaagctgcagagacttcaggcccagggcatccaagtgttcgaccctggagagtccgacagtgatgacaattgcaccgatgttaccgtgagtctagagagcgaccaacatcccggtatattcatagctaatttctag

SEQ ID NO: 232181 - DNA, 453 bp, Artificial Sequence
  Description of Artificial Sequence: Synthetic coding sequence
atgggcactgcttctagtttggtgtctcctgctgggggtgaggtgatagaggacacctatggagcaggcggaggagaggcttgcgaaatccctgtggaggtgaaacccaaggctaggcttctcaggaactccttcaggcgaggtgcaggtgccgcagcaggagccggtcctggttcccttcctcggggtgtcggagctggaggcctcctcggcgcttccttcaagagtaccggatctagcgtgccggagctggagtatgctgccgcagagtacgagcggctccggaaagagtacgaaatttttcgggtgtcaaagaatcaggaattactgtccatgggcagacgcgaggccaaactggacactgaaaacaagcggctgagggccgagttgcaggggctcgccgcagtagccagaagccgattaactgccacctggaactcctgggcccaatag

SEQ ID NO: 232182 - DNA, 1914 bp, Artificial Sequence
  Description of Artificial Sequence: Synthetic coding sequence
atcatcgcaaatgcgggtcgggcaggaaacttagataagatcttgcatcagtgtttccaatgtcaagatacactgagcctgtatcggctcgtcttgcacagtattcgcgagagcatggccaatgatgttgacaaggagttaatgaagcagatcctttgcctggtcaacgtgtctcataatggggtatcggagtctgagctgatggagttgtacccagaaatgagctggacattcctcacctcccttatccattcattgtataagatgtgtctgctgacctacgggtgcggcctgctgaggttccagcatttgcaggcttgggagaccgtccggttggaatatcttgaaggaccaacagtgacaagctcatacaggcagaagcttatcaactactttaccctgcaactgtcgcaggaccgggtcacatggagatcagccgatgagttgccgtggttatttcaacagcagggcagcaagcagaaactgcacgactgcctccttaacctctttgtatcccaaaatctgtacaaacggggacactttgcagaactgctgtcttattggcagttcgtgggcaaagataaaagtgcaatggcaaccgaatatttcgactccctgaaacagtatgaaaagaattgcgagggagaagataacatgagctgcttggcagatctgtacgaaactttgggccgattcctgaaagacctggggctcctttcacaagccatcgtgcctctgcaacggtcccttgaaataagagaaacggcccttgatcctgaccacccaagagtggctcagtccctgcaccagctcgcctctgtgtacgttcagtggaaaaagttcgggaacgccgagcagctatacaagcaggccctggagatctccgagaatgcttacggggcagaccacccttacacagctagggaactcgaagctctggctaccctgtatcagaagcagaacaagtacgagcaggccgaacacttcaggaaaaaaagctttaagatccaccagaaggcaattaaaaagaagggcaacctatatggcttcgcccttctccgacgccgagcactgcagctggaggagctgactctggggaaagatacccctgacaatgctagaacccttaacgaattgggcgtgttgtactatctgcaaaacaacctggagactgccgatcagtttctcaagaggtccctggaaatgcgcgaacgagtgttggggccagaccatccagactgtgctcagagcctgaataatctggcagcactgtgtaatgagaagaaacagtacgataaagctgaagaattgtacgagcgggctctggacataaggaggcgcgcactcgccccagaccatcccagccttgcatacacagtaaagcacctggccatcctctacaagaagatgggcaaacttgacaaagcagttccactgtacgaattggcggtggaaatccggcaaaagagctttggccctaagcatcccagcgttgccactgcactggtcaatctggcagtgctctactcccagatgaaaaagcacgtcgaggcactgccactttacgaaagagcccttaagatttatgaagactccctcggacgcatgcaccccagagtgggagagaccctgaagaatctggccgttctctcgtacgaaggcggtgatttcgagaaggcggctgagctgtataagcgagccatggagattaaagaggccgaaactagcctgctggggggaaaggctccgtcccggcatagcagctctggcgatacgtttagcctgaaaactgcacacagccctaacgtttttctgcaacaggggcaacgcaaggtccagtctaatctactctcacccgaaggcctgtctaatatctgcgcccaagaaaagacaacaaggtttaccagcagctag

SEQ ID NO: 232183 - DNA, 1236 bp, Artificial Sequence
  Description of Artificial Sequence: Synthetic coding sequence
atgagctgcctggccgacctgtatgaaactctcggcagattcctaaaggacctcggcctgctcagccaggccatcgtgcccctacagaggtcactcgagatacgggagaccgctctggaccccgaccatcctcgcgtggcccagagcttgcatcaactggcctcggtatacgtacaatggaagaaatttggaaatgccgagcagctttacaaacaggcgttagagatctctgagaacgcgtatggtgctgatcacccctacaccgctcgcgaattagaagctcttgctacgctgtaccagaagcagaataagtacgagcaggccgaacactttagaaagaaaagcttcaagattcatcaaaaggccattaaaaagaagggcaatctgtatggattcgctctgcttcggagaagagcactgcagttggaggaactgacgttgggaaaagacactccagataacgccagaactctgaatgaactcggcgtgctttattatcttcagaacaacttggaaacagccgatcagttcctgaagcgtagcctggaaatgagagaacgggttttaggtcccgaccatcctgactgcgcccagtcccttaacaatctggcagccctttgcaatgagaagaaacagtatgacaaggcagaagagttatacgaacgcgcattagacatccgcaggcgggctcttgcaccagaccatccttcgctggcttacacagtgaaacatttggcaatcctttataaaaaaatgggaaagcttgacaaggcagtgccactgtacgagctcgcagttgaaatccgccagaaatcttttggcccaaagcaccccagcgttgccacggctcttgtgaacctggccgtgttgtattcccagatgaagaagcacgtggaggctcttcctttgtatgaacgagccctaaaaatctacgaggatagcctaggacgaatgcatccccgtgtgggagaaaccctcaagaatttagccgtcttgtcctacgaggggggtgatttcgagaaggccgctgaattgtataagagggccatggagatcaaggaagccgagaccagtctgttaggtgggaaggctccttccaggcactcatcatctggcgacacgttctcacttaagaccgcccacagtccaaatgtgttcctacagcagggtcaaagagccggtaaatccaatccaacgttctacctgcagaagggcttccagacttacgtcctttag

SEQ ID NO: 232184 - DNA, 4281 bp, Artificial Sequence
  Description of Artificial Sequence: Synthetic coding sequence
atgaacgactggcacagaatttttacgcagaatgtgctggtgccccctcaccctcaaagggcacggcagccgtggaaggagagcacggctttccagtgcgtgctcaaatggctagacggcccagttatccggcagggggtgctggaggtgctgagcgaggttgagtgccacctgcgagtgagcttctttgatgtgacctatagacacttctttggacgcacatggaagacaaccgtcaaaccaactaagcgccctccatccagaatcgtgttcaatgagcccctgtacttccacacgagtctaaaccacccccatatcgtggctgtggtggaggtggttgccgagggtaagaagcgcgatgggtctctccagacactgagctgcggctttggcatcttgagaatttttagcaaccagcccgatagccccatttctgcatctcaggataagcgactgcggctgtaccatgggacacctcgcgcactgctgcatccactccttcaagatcccgctgaacagaaccggcatatgactctcatcgaaaattgcagccttcagtacacactaaagccacatcctgctttggaacccgcattccacttgctgccagaaaacctgctggttagtgggctgcagcaaattcccggtctgctccccgctcacggtgagagcggcgacgccctgaggaagcctagactgcagaaacctattacagggcacctggacgacctcttcttcactttataccccagcctcgagaaatttgaggaggaactgctcgagttgcacgtgcaggaccacttccaggaagggtgtggaccgctggatggtggcgctctggaaattctggagaggagactgagagtgggggtgcacaacggcctcgggttcgtccagcgcccacaggtggtggtactggtaccagaaatggatgtggccctgacacggtctgcctcgttctctaggaaagtcgtcagttcctcaaagacaagcagtggatcgcaggctctggtcctgaggtccaggctgcggttacccgagatggtgggacaccctgcattcgcggtaatcttccagctcgagtacgtcttttcaagccccgcaggggtcgatggaaatgccgcttctgtcaccagcctctctaacttagcctgcatgcacatggtccgatgggcagtgtggaacccactgctggaggcagattccggaagggtgaccttaccattgcaaggcggtattcagccaaatccctcacactgccttgtgtacaaggtgcccagcgccagcatgtccagtgaagaggtgaaacaggttgagagcggaaccctgcggttccaattctccttgggcagtgaagagcatctcgatgccccaactgagcctgtctccggccctaaagtagaacgcaggccctctcggaaacctccaactagcccaagctcgcctccggcacccgtgcctcgggtgctcgccgctccacaaaactccccagtcggccctggtctctcaatttcccagctggccgctagccctaggagccctacgcagcactgtctggcgaggcctacttctcagctcccccatgggtcccaggcctctcccgcacaggcacaagagttcccactcgaagctggaataagccacctggaggcggatttaagccagaccagcctagtgcttgagacttcaattgctgagcagctgcaggaactgccattcaccccgcttcatgctccaatcgtagtagggacacagacacgctccagtgccggtcagcctagccgcgcttctatggtactgctgcagagctctggcttccctgagatcctggacgccaacaagcaaccagccgaggctgtatcagcgacggaacccgttacgtttaatccccagaaggaagaaagcgactgtctccagagcaacgaaatggtgctgcagtttcttgcgttctctcgagtggcacaggactgtaggggaacgtcctggcccaaaacagtctattttacctttcaattctaccgcttccctccggctacaacacctcggctgcagttggtgcagctggacgaggctgggcagccttcatctggtgctctgactcacatcctggtgcctgtttcaagggatggtaccttcgacgccggtagtcccggtttccagcttcggtacatggtgggtcccggattcctcaagcccggtgagcgaaggtgtttcgccaggtatctcgctgtgcagaccctgcagatcgatgtctgggatggggacagcctgctgctcattggttccgccgctgtccagatgaaacaccttctgaggcaggggagacccgcagtacaggccagccacgaattggaggttgtcgccacagagtatgagcaggacaatatggtggtctcaggtgatatgctcggcttcgggagggtcaagcccatcggggtccattctgttgtaaagggacgcctgcatctcacgttagctaatgtgggtcacccttgtgaacagaaggtgcgcggatgcagcaccttgcccccatctcgatcaagagtcattagtaacgatggggcttccaggttttccggaggctccctgctgacgacggggagcagtaggcggaagcacgtcgtccaggcacagaagctcgccgacgtcgacagcgaactcgccgcaatgctcctcacacacgccagacaaggaaagggaccacaggatgtctccagggaatccgatgccaccagacgtaggaaactcgaacggatgaggtccgtccgtctccaagaggcaggtggtgatctgggcagacgaggaacatcagtgttagcacagcagtcagtccgcactcagcatctcagggatctccaagtcatcgccgcatatagggagcgtacaaaggcagaatctatcgcgagcttgctgtcactggccattactaccgagcacacactgcacgcgactctcggcgtggcggaatttttcgaattcgtgctgaagaacccccacaacacacagcatacagttacagtggaaattgacaatcccgaactgtctgtgatagttgactcacaagaatggcgcgacttcaagggagcagcaggtctgcatacccctgtggaagaggatatgtttcatttgcgcggttccctggccccacaattatacctgagaccacatgaaacagctcacgttcctttcaagtttcagagcttcagtgcaggtcaactggccatggtccaggcaagcccgggattgagcaacgagaagggtatggatgccgtgtccccctggaaaagttctgctgttcccactaagcacgccaaagtcctgtttcgggcaagcggaggaaaaccaatcgccgtcctctgcctgacagtggagctacagcctcacgtcgtggatcaggtgtttcgcttttaccatcccgagctcagctttctgaaaaaagccattagattgcccccatggcatacgttcccaggcgcacccgttggtatgcttggagaggatccccctgtccacgttcggtgtagcgaccccaatgtcatttgcgaaactcagaacgtgggcccaggggaacccagggacatcttcctgaaagtggccagcggaccctctccagaaatcaaagatttttttgtaatcatttattcggataggtggcttgctacgccaacgcagacctggcaggtttatctgcactccttgcagagagtcgatgtgtcctgcgtggccggacagttgacaaggctatccctcgtcctccgaggcacgcagacggtgcgaaaggtcagggctttcacgagtcatccccaggagctgaagacggatcctaaaggggtctttgttctcccaccaaggggggttcaggaccttcatgtgggggtaagaccccttagggccggaagccggttcgtgcatctgaatcttgtcgacgtggattgccaccagcttgtggccagttggcttgtgtgcctgtgttgccgacagcccctgatttccaaggcctttgaaattatgcttgcagcgggtgaaggtaagggagttaataagcgaatcacgtatactaacccttacccgtcacgtcgtaccttccacctgcattctgaccaccctgagttgttgcggttccgcgaggacagctttcaggttggcggaggcgagacctacacaattgggcttcagttcgccccaagtcaacgagtaggagaggaagaaattctgatttatatcaacgaccatgaagacaaaaatgaggaagccttctgtgtcaaagtgatctatcaatag

SEQ ID NO: 232185 - DNA, 546 bp, Artificial Sequence
  Description of Artificial Sequence: Synthetic coding sequence
atggtcctcttgcaaagcagcggattcccggaaatcttagacgctaataagcagccagccgaggccgttagtgcaaccgaacctgtgacatttaatcctcagaaggaagagtccgattgtttgcagtccaatgaaatggtcctgcaatttctggctttctccagagtcgcccaggactgtagaggcacctcttggcctaaaacagtgtacttcacatttcaattctaccgctttccacccgctacgaccccaaggttacagctcgtccagctggacgaggctggacaaccctcctctggggcactgacccatattctggtcccggtcagcagagacggtaccttcgacgctggttcccctgggtttcaactccgatatatggtgggtcctggcttcttaaaaccaggcgagcgccgttgtttcgccaggtacctggcagtacagacgctccagattgatgtgtgggatggcgacagccttctgctgatcggctcagccgcagtccagatgaaggaaacctcacatatcttttctgtttcccaatag

SEQ ID NO: 232186 - DNA, 3606 bp, Artificial Sequence
  Description of Artificial Sequence: Synthetic coding sequence
atggccctggggacaactctgagggcgtcccttctgttgcttggcctattgactgaggggctcgcccagttagctatccccgcttcagtcccgcgtggcttttgggcgctgcctgaaaacttgacagtcgtggagggtgcttcggtggaactcaggtgcggggtgagtacacccggaagtgctgtgcagtgggctaaggatggcctgctgcttggccctgacccgcgaatacctggcttcccacgataccgactagagggcgacccggctcgaggggaattccatctccacatcgaagcgtgtgatctttccgatgacgcagaatatgagtgccaggtagggaggtccgagatgggaccagaactcgtctcgcctagagttattctgagtatattggtgccacccaagctgctcttgttgacacccgaggctggcaccatggtcacatgggtggcaggccaggagtatgtggttaactgcgtttcaggtgatgctaagccagcgccagatatcacaattctcctgagtggacagaccatcagcgacattagtgctaacgtgaatgaggggtctcagcagaaactgtttactgttgaagcaaccgcgagagtgacccccaggtcctcagataaccggcaactcttggtgtgtgaggcctcctctccagcattggaggcccctattaaagcatcattcacggtcaacgtgctatttccccctgggccacctgtcatagagtggccgggtttggacgaaggccatgttcgagctggtcagtcccttgaactaccttgcgtggctcgtggtggcaatcccttagcgactctgcagtggttaaagaacggccagccagtgtccactgcatgggggaccgagcacacacaagcagtggccaggtccgtgctggtcatgaccgtgaggcccgaggatcacggagcccagctgagctgtgaggctcataactctgtgtccgcgggtacccaggaacacggtatcactttgcaggtcaccttccccccatcagcaatcatcattcttggatctgcctctcagacagaaaacaaaaatgtgaccttgagctgcgtatctaagtcttctaggcctcgggttttattgcggtggtggttgggatggcggcaacttctgccgatggaagagacagttatggacggactgcatggagggcatatttcaatgtccaaccttactttcctggccagacgcgaagacaacgggttgactcttacctgcgaagcatttagcgaagcattcaccaaggagactttcaaaaagagtttgattctgaacgtaaaataccctgcccagaaactgtggatcgaagggcctcctgagggacagaaactgcgagcaggaactcgggtgcggctggtatgtctggcaataggtggaaaccctgagccatctctgatgtggtacaaagacagtcgaaccgtcactgaaagcaggctgccccaggagtcccggagggtgcacctcggatcagtggagaaatcaggttctactttttccagagaactggttctcgtgaccgggccatctgataaccaggctaaattcacatgtaaagctggtcaattatctgccagcacccaactggcagtgcagtttcccccaaccaatgtcacaattctggccaacgcgtccgcccttaggcccggtgatgccttgaatttgacttgtgtgtccgtctcatcaaaccccccagttaacttgagctgggataaagaaggggaaaggttggagggcgtggccgctccccctcgtagggcgccttttaagggatcagctgccgctcgatccgtgttactgcaggtgagtagtagagatcacgggcaacgggtcacatgtagggcccattccgccgagctgcgcgaaaccgtgagctccttctaccggttgaacgtgctgtatcggccagagtttctgggggagcaggtcttagtcgtgacagccgtcgagcaaggggaagctttactccctgtatccgtctccgccaacccagctccggaggcctttaattggactttcaggggctacagactatccccagctggtggccctagacacagaatcctttcatctggggctctccacctgtggaatgttaccagggctgacgatgggctgtaccagcttcactgtcagaacagcgaaggcactgccgaggctcggctaagacttgacgttcattacgcccctacgataagagctcttcaagaccccaccgaggtgaatgtaggtgggtccgtggacattgtttgtaccgtggacgcaaatcccattctgcccggtatgtttaattgggagcgcctcggggaagacgaagaggatcagagcctggatgacatggaaaagatctctcgcggtccgacaggccgactcagaattcatcacgccaaactcgcgcaggctggagcatatcagtgcatcgtggataacggcgtggcacccccagcgaggaggttgttacgcctagtggtccgattcgctccgcaggtggaacatccaaccccattaacaaaagtggcagctgcaggggactcgacaagttcagccaccctgcactgccgggctcgcggagtccctaacatcgtcttcacgtggactaagaatggtgtacctttagacctgcaggacccccgttacaccgaacatacgtaccaccagggcggagttcactcctctctgcttacaattgcaaatgtcagcgccgctcaggattacgccctttttacttgcaccgcaacaaatgcactggggagtgatcagacaaacatacagctggtaagtatttctcggccagacccgccttctggacttaaggtcgtgtccctgaccccacatagcgttggactggaatggaaacctggatttgatggtggtctaccacaacgcttttgtatcagatatgaggctctgggcacccctgggtttcattacgtggacgttgtccctcctcaagctaccacatttaccctgacaggtctgcagcccagtactcggtaccgcgtgtggctgctggcaagcaacgcactgggggatagcggcctggctgataaagggactcagttaccgatcacgacaccaggactgcatcagccttcgggggagccagaagaccaactgccaacagaaccaccatccggcatcagcgagaagacagaggctggttctgaagaggacagggtgaggaacgaatacgaagaatcgcaatggactggggagagagacacgcaaagcagcaccgtcagcacaaccgaggccgaaccatattatcgttcactgagagatttctccccacagctgccgcctactcaggaggaagtctcttactctaggggtttcacgggggaagacgaagatatggctttccctgggcacctgtatgatgaagtagaaagaacgtatccacccagtggggcttggggacccctctacgacgaagttcagatggggccttgggacctgcattggccggaggatacctatcaggaccccagggggatttatgatcaggtggccggagatctggatactctggagcccgatagcctgcctttcgaactccggggacacctggtctag

SEQ ID NO: 232187 - DNA, 3726 bp, Artificial Sequence
  Description of Artificial Sequence: Synthetic coding sequence
atggctttgggaaccacacttcgggcaagtctgctgctgctggggctcctgaccgaaggtctcgctcagctagccattcccgctagcgttcctcggggtttttgggccttacccgaaaacttgaccgtagtggaaggcgcatccgtcgagttgagatgcggcgtgtcaactcccggatctgccgtacagtgggctaaggatggactgctcttggggccagacccccgtatccccggtttcccccgataccgcctggagggagaccccgcacgaggcgaattccacctgcacatcgaggcctgtgatctgtccgacgatgccgagtacgagtgtcaggtgggaagaagcgaaatgggaccagaacttgtaagccccagagtgatcctctccattctcgtgcctcccaaacttctgctccttacccccgaagcgggaacaatggttacctgggtggcaggccaggagtatgtcgtgaattgtgtctcgggcgatgccaagccagctccagatatcaccatcctactctccggtcagactatcagcgacatatctgccaacgtaaatgaggggagccagcagaaactatttaccgtagaagccaccgccagggtgactcccagatcctctgacaatagacagctccttgtgtgcgaagcctccagtccggctctagaggccccaatcaaagccagttttaccgtcaatgtactcttcccccctggcccacctgtgatcgagtggccgggactggacgagggccatgtgcgagctggccagtctctggaactgccatgtgtggccaggggcggaaatcccctggccacattacaatggctcaaaaatggccagccagtgagcaccgcttggggtaccgaacacactcaagccgtggcgagaagtgtgctcgtgatgactgtgcgccctgaagaccatggcgcacagctgtcgtgtgaggcccacaacagtgtctccgctggtactcaggaacacggcatcacactgcaggttaccttcccgccttcggcaatcattatacttggctcagccagtcagaccgagaataagaatgtgactctgtcttgtgtgtcaaaatcatcgagacctagagtgctgctgcgatggtggctcggttggcgacagcttctccccatggaggagaccgtgatggatggactgcatggcggacatattagcatgagtaacctgacgtttttggccagaagagaagacaacggtctgaccctgacatgcgaggccttttccgaggctttcacaaaagaaaccttcaagaaatccctgattctgaatgtgaagtacccagcccagaagctttggatcgaaggcccaccagagggccagaaactaagggctggcacccgagtcagactggtgtgcctggccattggcggaaatccagagccatcgttgatgtggtacaaagattcccgcactgtaaccgaatcacgcctgccccaggagtccagaagggtgcacttgggcagcgttgagaagtcaggctccacgttcagtcgggaactcgttctggtgacgggcccaagtgacaaccaagccaaatttacatgtaaagcgggacagctgtcggccagtactcagcttgccgtgcaattcccccctaccaacgtgacaatcctggcgaatgcgtccgctctgaggcccggagacgcgctgaacctgacatgcgtgtcggtgtcctcaaaccccccagtgaacctcagctgggacaaggaaggagaaaggctggagggggtggcagccccaccccgtcgagccccttttaaaggcagtgcggctgctagatcagtgctgcttcaggtaagttctagggatcatgggcagagggtaacgtgtcgcgcacattcagccgaattgagagaaactgtgtcttccttctaccgcctgaacgtcctgtaccgccctgaatttctcggagaacaggtcctggtcgtgaccgcggttgagcagggcgaggctttgctgcctgtgtctgtatccgccaacccggctcccgaagccttcaattggacttttcgcggatacagattatctccggctggaggacctcggcatcggatcctctcatccggtgccctgcacctgtggaacgtaacaagggctgatgacggcctgtaccagctgcattgccagaatagtgaagggactgcggaagccagacttcgcctcgacgttcattatgcaccaactattcgcgctctgcaggatcctactgaagtcaatgtgggtggctccgtcgatatcgtgtgcacggtggacgccaatccgatcctccctgggatgttcaattgggagcgcctgggagaggacgaagaggaccagtcattagatgacatggaaaagatctcccggggacccaccggtaggttacggatccaccatgctaaattagctcaggcgggagcctaccaatgtatcgttgataatggggtggcacctccggcacgcaggctcctgcgcctggtagtcaggttcgcaccacaagtggagcaccctactcctcttactaaggtggccgctgcaggtgatagcacctcctcagccacattacactgcagagcaaggggcgtccccaacatcgtatttacatggacaaaaaacggagttcccctcgatctccaggacccccgatacaccgagcacacttaccaccaggggggagtccatagttcgctacttacgatcgccaacgtgtccgctgcacaggattatgctctattcacttgtaccgcaactaacgccctggggtcagatcaaactaacatccagttggtcagtatctccaggccggaccctccaagtggcctcaaagtggtgtccctcaccccacactcagtgggtctggaatggaaacccggattcgacgggggtttgccacagaggttctgcatacgctatgaggctctaggaactccaggatttcactatgtcgacgtggtccctcctcaagcaaccacattcacactcacaggcctgcagccgtccacccggtatcgggtctggctcctcgcgtcaaacgcactgggtgattccggactggctgataagggcactcaattgcctatcaccaccccaggactgcaccagccaagcggcgagccggaagaccagttgcccactgagcctccttccggcccttcaggcttacctctgctgcctgtgctctttgctctgggtggtctgctcctgctttctaatgcaagctgtgtgggcggtgtgctgtggcagcgcagactgagacgcctagccgagggaatctctgagaagacagaagctggttccgaggaagacagggtaagaaatgagtatgaggaaagccagtggaccggcgagcgcgacacacagtcctccactgtgtcaacaactgaggctgaaccgtactaccgctccctgcgggactttagcccccagcttcccccaacgcaggaggaagtttcctatagtcgtggctttacaggcgaggatgaagacatggcatttcccggtcatctgtacgatgaggtcgagagaacatacccaccctccggagcatggggcccattgtatgatgaagttcagatgggcccttgggatctccactggcctgaggacacctaccaggaccccagaggaatctatgatcaagtggcaggggatctagatacccttgagccagattccctccctttcgaacttagggggcacctggtatag

SEQ ID NO: 232188 - DNA, 1152 bp, Artificial Sequence
  Description of Artificial Sequence: Synthetic coding sequence
atggaacgacgcgcacggtcatcctccagggagagccgcggtcggggaggaagaactccccataaggagaataaacgcgcaaaagccgaacggtcaggcggtggcagggggaggcaggaagctggccctgaacctagcggtagcggacgagcgggtacacccggtgagccgagggctcctgcggcaaccgtggtcgatgtcgacgaagtgagaggctctggagaagagggaaccgaggtggtggctctgctagaatccgagcgacctgaggaaggaactaagtctagtggactgggggcatgcgagtggttgctggtccttatctcactgctgttcatcatcatgacgtttcctttttccatctggttttgtgtgaaagtcgtgcaggaatatgagagagtgattatattcaggctcgggcaccttttgcctggtcgggctaagggcccaggtctgttttttttccttccatgtttggacacttaccacaaggtcgatcttcgcctccagacactcgaaattcctttccatgaaattgtcaccaaggatatgtttataatggaaattgacgctatctgctactaccggatggagaacgctagtctcttactatcgtcactcgcacatgtgagtaaggcagtgcagtttctggtacaaaccaccatgaagagactccttgcccaccgcagcctaacagagattctcctggaaagaaaaagcatcgctcaggacgctaaagttgctctagacagtgtcacttgcatttgggggattaaggtggaacggatcgaaattaaggacgtccgcctgcctgccggactgcagcattccttggccgtggaggctgaggcccagcggcaagccaaagtacgtatgattgcggctgaggcggagaaagctgcgagcgaatccttacgtatggccgctgaaatcttgtcaggcacacccgcagccgtgcagctgcggtacctgcataccctccagagcctcagcacagagaagccttcgaccgtagtattgccattacccttcgacctgctgaattgtctcagcagccctagcaacaggactcaaggatctctcccattcccgtctcctagcaagcctgtggagcccctgaatcccaaaaagaaggactcaccaatgctgtag

SEQ ID NO: 232189 - DNA, 948 bp, Artificial Sequence
  Description of Artificial Sequence: Synthetic coding sequence
atggagcgacgagcaaggagcagctccagagagagtcggggtcgcggagggaggacgccacacaaggaaaataagagagcgaaagctgagagatctggtgggggtagaggcagacaggaagccggaccagagccgagcgggtcaggccgagccggaactcccggtgagcctcgggctcctgcggctaccgttgtcgatgtggacgaggtccggggaagtggtgaagagggcaccgaggtcgttgccctgttagagtctgagagacccgaggagggcactaaaagctctggattgggcgcatgcgagtggctgctcgttcttatctcgttgctgtttatcataatgacatttccattttctatctggttttgtgtgaaagtggtccaggaatacgagcgagttatcattttccgcctcggccacctactgccagggcgagccaaagggccaggcctgttcttctttctaccttgcttggacacctatcacaaagtcgatctacgacttcagaccctggaaattcccttccacgaggtggcccttgacagcgtcacttgcatttggggcatcaaagttgagagaatcgaaatcaaagacgtgcggctacccgcaggtctccaacatagcctcgcagttgaggctgaggcgcagagacaagccaaagttcgcatgatcgccgctgaagccgaaaaagccgcttccgaaagcctacgtatggccgcagaaattctttctgggacccctgccgctgtccagctcaggtatcttcatactttacagtcgctctccaccgagaagccgtccacagtcgtcttgcccctgccgtttgatctcctcaattgcctgagctctcctagcaatcggacccaaggatccctgccattccctagtccctctaagcccgtggagcccctgaaccccaaaaagaaggactcacctatgttgtag

SEQ ID NO: 232190 - DNA, 1284 bp, Artificial Sequence
  Description of Artificial Sequence: Synthetic coding sequence
atgggcgctggagctacagggagggcgatggacggacctaggctactgctgttgctcctgctcggcgtgtccttgggaggggcaaaggaggcatgccccactggcctctacacccattccggggagtgctgcaaggcctgcaacttaggtgagggcgtggcccagccctgcggtgctaaccagacagtctgtgagccttgcctggatagcgtaactttcagtgatgtggtaagtgccacagagccatgtaaaccctgcaccgagtgtgtggggctccagagcatgagtgctccctgcgtggaagctgacgatgccgtctgcaggtgcgcctacggctattatcaggacgaaacaactggaaggtgtgaggcttgtcgcgtatgtgaagctgggtccggattagtattttcctgccaggacaagcagaacacagtatgtgaagagtgtccggacggaacatactcagatgaggctaaccacgttgatccatgcctgccatgtaccgtctgtgaagacaccgaaagacaactgcgcgaatgcaccagatgggcagacgctgagtgcgaagagattcccggacgttggataacccgttcaactccccctgaagggagcgattcgacagccccttcaactcaggagccagaggcgccaccagagcaagatcttattgcgagcaccgtggccggtgtggtcacgaccgtgatgggaagcagtcaacccgtcgtgactagaggtactacagacaacctaatcccagtgtactgctccatcctcgcagcggtcgtggtgggactcgtggcttatatcgccttcaaaaggtggaattcatgcaaacaaaacaaacaaggggctaacagtaggccagttaatcagacacctcccccagaaggcgaaaaactgcacagtgattcagggattagtgtggactcacaaagcctgcacgaccagcagccgcatacacagaccgcatctggccaagccttgaaaggtgacggtggcctttatagctcactgcccccagccaaacgggaagaggtggagaagttgttaaacggttccgcgggagatacatggcgtcacctcgcaggagaactgggttaccaaccagaacacatagatagcttcacacatgaagcatgtccagtgagggctctgcttgcgtcttgggcaacccaggacagtgcaactcttgatgccctcttggctgcactaaggaggatccagcgagccgatctcgtggagtctttatgctccgaatcaacagcgacctcccccgtttag

SEQ ID NO: 232191 - DNA, 1002 bp, Artificial Sequence
  Description of Artificial Sequence: Synthetic coding sequence
atgtcagctccctgcgtagaggctgacgatgccgtgtgccgatgcgcttacggatattatcaggatgaaacaactggtcggtgtgaagcctgtcgggtgtgtgaggcgggatcaggactggtcttttcttgtcaggataagcaaaacaccgtgtgcgaggaatgtcccgatgggacgtattcagatgaggctaatcatgtagacccctgcttaccatgcaccgtgtgcgaggacaccgagagacagcttcgggagtgtaccagatgggctgacgccgagtgtgaggaaattcctgggaggtggattaccagatctacacccccagagggatcagactcaaccgctccttcgacccaggagccagaggccccacccgaacaagatctcattgcatcaacagtggccggagtggtcactactgtgatgggcagctcccaacctgtcgttacacgaggcaccactgataacctcattccagtgtattgctccattctggcagctgtagtagttgggttggtggcttatatcgcatttaagagatggaactcatgtaaacaaaacaagcaaggggctaatagcagaccagtaaaccagacccctccgccagagggcgaaaagttacattctgacagtggtatttctgttgatagtcagagcttacatgaccaacagcctcatactcagacagcctcaggccaagctctgaaaggcgacggcggactctatagcagcctgcctccagctaagcgcgaagaggtggagaagctgctgaatggctccgccggtgacacctggaggcacctcgccggagagctggggtatcagcccgagcacattgatagtttcacccatgaagcttgccccgtgagagcactgttggccagttgggccacacaagattcagccacccttgatgcactgctggctgcactgaggaggatccagcgggcagatctggtggagtccttgtgtagtgagagcactgcaacgtcccctgtctag

SEQ ID NO: 232192 - DNA, 336 bp, Artificial Sequence
  Description of Artificial Sequence: Synthetic coding sequence
atggcgaacatccaccaggagaacgaagagatggagcagccaatgcagaatggggaggaggaccgtcccctgggcggaggcgagggccatcagcccgctgggaaccgtagaggacaggcgcgtaggctggcccctaacttccgctgggctatccccaatcggcagattaacgacggaatgggcggagacggcgacgatatggagatctttatggaagagatgagggagatcaggcgtaagttgagagagctgcagctaagaaattgtctgcgcattctgatgggggagttgtctaatcatcacgaccatcacgacgaattctgcctcatgccatag

SEQ ID NO: 232193 - DNA, 306 bp, Artificial Sequence
  Description of Artificial Sequence: Synthetic coding sequence
atggaacagcctatgcagaacggcgaagaagaccgcccattggggggtggagagggccatcagcctgccggtaatcggcgtggtcaggcacgcagactcgcaccaaatttccgatgggccatccccaacaggcagattaacgacggaatgggtggcgacggtgacgacatggagattttcatggaggaaatgagggaaatcaggcggaaactacgggagcttcagcttcggaattgtctgcggatcctgatgggggagctgtcaaaccatcatgaccaccacgacgagttttgtctgatgccttag

SEQ ID NO: 232194 - DNA, 306 bp, Artificial Sequence
  Description of Artificial Sequence: Synthetic coding sequence
atggaacagccgatgcaaaatggagaggaggatcgaccacttggagggggtgagggccaccagcccgcaggcaatcgtaggggtcaggctcggcgactggcccctaattttagatgggccattccaaatcgacaaattaatgatggcatggggggagacggagacgacatggagatttttatggaagaaatgcgagaaatcaggcgaaagctccgagagttacagctgaggaattgcctccgaatcctcatgggagagttgtcaaatcaccatgatcaccatgatgagttctgcctgatgccttag

SEQ ID NO: 232195 - DNA, 336 bp, Artificial Sequence
  Description of Artificial Sequence: Synthetic coding sequence
atggccaatattcaccaagagaacgaagagatggagcagcctatgcagaatggcgaggaggacaggcctctcgggggaggcgaaggccatcaacccgcaggcaatcggagaggtcaagcccgtaggctggcccctaattttcgctgggcgatcccaaatcgacagataaacgatggaatgggtggcgacggagacgatatggaaatcttcatggaggagatgcgcgagattagacggaaactgcgggaactacagctgaggaactgtctgcggattttaatgggggaactctccaatcatcacgaccatcatgacgagttttgcctgatgccctag

SEQ ID NO: 232196 - DNA, 336 bp, Artificial Sequence
  Description of Artificial Sequence: Synthetic coding sequence
atggccaatattcatcaggaaaacgaagagatggaacagcccatgcagaacggagaagaagataggcccctcggcggtggcgagggtcaccagccagctggcaaccggagagggcaagcgaggaggctggcccctaacttcaggtgggccatacccaaccgccagatcaacgacggcatgggtggagatggagatgatatggagatctttatggaggaaatgagagagattcgaagaaagctgagggaactgcagttgagaaattgcctgcgaattctgatgggggaattgtctaatcaccacgaccaccatgatgagttttgtctcatgccctag

SEQ ID NO: 232197 - DNA, 402 bp, Artificial Sequence
  Description of Artificial Sequence: Synthetic coding sequence
atgatgctgaatagtgacaccatggagttagacctaccgcctactcacagcgaaacagaaagcggattctccgattgtggtggaggcgctgggcctgacggggcaggaccgggaggaccgggtggcggtcaagcaagaggtccagaaccaggcgaacccggtcgaaaggacctccagcacctatcacgggaggaacggaggcggagacgcagagccactgctaaatatcgcacggcacacgctactagggagagaatccgcgtggaggcatttaacttagcttttgccgaactgaggaagctgctgcccacactccctcctgataagaagctttcaaagattgagattctaaggctcgctatctgttacatatcatacctgaaccacgtgcttgatgtttag

SEQ ID NO: 232198 - DNA, 408 bp, Artificial Sequence
  Description of Artificial Sequence: Synthetic coding sequence
atgatgctttctccagaccaagccgcagactccgatcatcccagtagcgcccattcggatccagaatctcttggaggcacagatactaaggttctcgggagtgtgagtgacctggaaccagttgaggaggccgaaggagatggcaagggtggcagtcgggctgccttgtacccccacccgcaacagctgagtcgagaggaaaagagaagacgcagacgagcaacagccaaatataggagtgcgcatgccacgagagagaggatcagggtggaggccttcaatttggcattcgccgagttgaggaagttgctgcctaccctgcccccagataagaaactgtcaaagatcgagattctccgtttggctatctgttatatatcatacctcaaccacgtcctggatgtttag

SEQ ID NO: 232199 - DNA, 408 bp, Artificial Sequence
  Description of Artificial Sequence: Synthetic coding sequence
atgatgctttcacccgaccaagcggcagactcagatcatccttcctccgcacatagcgatccggaatctctgggtggcacagatacaaaagtcctgggttcggtatctgatctggaacctgtcgaagaggccgagggggacggcaaggggggttccagagcagccctgtaccctcatccgcagcagctgagccgtgaggagaagcgcaggcgacgaagagccactgccaagtatcgctcggcacacgccacacgggagcgaatccgggtggaagctttcaacttagccttcgccgaattacgtaaactgctcccaaccctcccccctgacaagaaactatccaaaatcgagatcctccgactagccatttgctatatttcttatttaaaccatgtattggacgtctag

SEQ ID NO: 232200 - DNA, 324 bp, Artificial Sequence
  Description of Artificial Sequence: Synthetic coding sequence
atgatgctcagcccagaccaggcagccgattctgatcatccttcatccgcccattcagatccagagagccttggcggaactgatactaaggttctcggcagcgtatctgacctggaacccgtggaggaggcggagggggatggcaagggagggtcacgcgcagctttgtacccccaccctcagcagctgtctcgtgaggagaaaaggcgcaggcggagggctaccgcgaagtacaggagcgcccatgccactcgcgagcgaatcagagtagaagcatttaacctggcattcgcggaattgagaaagcttctacccaccttgtag

SEQ ID NO: 232201 - DNA, 1125 bp, Artificial Sequence
  Description of Artificial Sequence: Synthetic coding sequence
atgggactgccgagggggagcttcttctggctgctgttattactgaccgcggcttgtagcgggctcctgttcgccctgtatttcagcgcagttcagcgttaccctggccctgccgctggtgcacgggacacgacctccttcgaggcctttttccagtccaaggcaagtaacagttggaccggaaaagggcaggcctgccgccaccttctacacctggcgatccaaagacatcctcacttccgtggcctattcaatctgtcaatccccgtactgctctggggggacctgtttactcccgctttatgggatcgcctgtcccagcacaaagctccttacgggtggaggggactgtcccaccaggtcattgcaagtaccctgtcactgcttaacggcagcgagtctgccaagctgtttgcccctccacgagacaccccccctaagtgtattagatgtgccgtcgtgggcaacggcggaatactgaacggctcacggcaggggccaaacatagatgcccacgactacgtcttccgactgaacggcgcagtgattaaaggctttgaaagggatgtgggaaccaagacgtcgttctacggcttcaccgttaatactatgaaaaatagcctggttagttattggaaccttggcttcacgtccgtccctcaggggcaagacttgcaatatatctttatcccaagtgacatccgcgactacgtcatgctccgatcggccatcctaggtgttccagtgcctgaaggcctggacaagggagatcggcctcatgcctactttggccctgaagcctctgcttctaaatttaagcttcttcatcctgacttcatttcttatctcactgagagatttctcaagtctaaacttattaatacccatttcggggatctgtatatgccctccacgggagccctgatgctgctgacagcactgcacacctgtgatcaagtgagcgcctacgggtttattacaagcaactattggaaattttcagatcattattttgagagaaagatgaaacccttgattttctacgcaaaccatgacctttcactggaggccgcactatggagggatctgcataaggcaggcattctgcaactgtaccaaaggtag

SEQ ID NO: 232202 - DNA, 2235 bp, Artificial Sequence
  Description of Artificial Sequence: Synthetic coding sequence
atggcgggtcgcagcatgcaggccgcaaggtgccccaccgacgagctgagcctcaccaattgcgcagtggttaacgagaaagatttccagagcggccagcacgtcattgtccggacaagcccaaatcaccgttacacttttaccctcaaaacccatcccagcgtcgtccccggttccatcgccttttcgctgccccagcgcaagtgggccggactttctataggtcaggagatagaagtgtcactgtataccttcgataaggctaaacagtgcattggtactatgactatcgagatcgacttcctacaaaagaagtccatagactccaatccctacgatactgataagatggcggctgaattcattcaacagtttaataaccaggcatttagcgtgggacagcagctggtattttctttcaatgagaagttgttcggactgttggtcaaggacattgaggccatggatccatccattttgaaaggggaacctgcgaccggaaagagacagaagattgaggtgggactcgtcgtaggcaattctcaggtcgcgttcgaaaaagccgagaacagtagtctgaacttgattgggaaggctaaaaccaaggagaaccgccagagcattatcaatcctgactggaactttgagaaaatggggatcgggggtctggacaaggaattctccgacattttcagaagagcttttgcatcccgcgttttccccccagagatagtcgaacagatgggttgtaaacacgtgaaagggatcctgctgtatggaccaccgggatgcggtaagaccctcctggcccgtcagataggaaagatgctgaacgcgcgagaacccaaggtcgtcaatggcccagaaatcctgaacaaatacgtaggtgagtcagaagccaatatccgcaagttgttcgccgatgcagaggaagagcagagaaggttgggtgcaaattctggacttcacattattatctttgacgagatcgatgctatctgtaaacagaggggaagcatggctggcagcacaggtgtgcacgacacggtggttaatcaactgctgtccaagattgatggcgtggaacagctgaacaatattctcgtcatcggcatgaccaaccgaccagacctgattgacgaggcattactcaggcccggtaggctggaagtgaaaatggagattggcctccctgacgagaagggtcgcctgcagattctgcacattcacacagcacgcatgcgcggacatcaactcctatccgccgacgtggacatcaaggaactggctgtagagacgaaaaacttttcgggcgcagaattagaagggctcgttcgtgccgctcagtcaaccgcaatgaaccgccatataaaagcctctaccaaagtggaggtcgacatggaaaaggccgagtctctgcaagtgacccggggagactttctggcctcgcttgaaaacgacataaagcccgcatttggcactaatcaggaggactacgcctcgtatatcatgaatgggatcattaaatggggagatccggtgactagagtcttagatgacggtgagctgctggtgcagcagactaagaatagtgaccgaactcctctcgtgagtgtcttgctggagggacctcctcactcggggaagacagccttagcagccaaaatcgccgaggagagtaattttcccttcatcaaaatatgttccccagacaagatgatcggcttctcggagaccgcgaagtgccaggcaatgaagaagatcttcgatgatgcctataagagccagctgagctgtgtggtcgttgatgatatcgagcggcttcttgattacgtccctattggcccacgtttcagcaacttggttctgcaggccttgcttgtgctgctgaaaaaagcacctccacagggtaggaaacttctgattattggcaccaccagccgcaaagacgtgctccaggagatggagatgctgaacgctttttcaaccaccattcatgtgccaaacatcgcaaccggcgaacagttactggaagcactcgagctcctggggaacttcaaggacaaagagagaacaaccatagcacaacaggtgaaaggaaagaaagtttggattgggattaagaaactcctgatgctgatcgagatgagccttcaaatggaccctgaatacagagtccgcaaattcctggcactcttgagagaggagggcgctagtcccctggactttgactag

SEQ ID NO: 232203 - DNA, 888 bp, Artificial Sequence
  Description of Artificial Sequence: Synthetic coding sequence
atggacaacagcgggaaagaggccgaagctatggcccttctggctgaagctgagcggaaggtgaaaaactcccagtcatttttctcgggactgtttggaggctcctcgaaaattgaggaggcttgcgaaatctacgccagagcagcgaacatgtttaaaatggcaaagaactggtctgccgctggcaatgcattttgtcaggccgctcagctccacctgcaactgcagagcaagcacgacgccgctacttgcttcgtggacgctggaaatgcatttaaaaaagccgatccacaggaggctattaattgtctgatgcgagcgatcgagatctataccgacatgggcaggttcactattgctgcgaaacaccacatttcaatcgccgagatttatgagaccgagctggtcgatatcgagaaggcaattgcacattacgaacagtcagcggactattacaagggtgaggaaagcaactcgtccgccaacaagtgtctcctgaaggtcgccggttatgctgcgctcctggagcagtatcagaaggccatcgacatctacgaacaggttggaactaatgccatggacagcccactgttgaaatactcggctaaagattacttttttaaggccgcactctgtcacttttgcattgatatgctcaatgccaagctggcagtgcagaaatatgaggaactttttccagccttctctgacagccgcgaatgtaagctgatgaagaaattgttggaagcacacgaggagcagaatgtcgactcatacaccgagtctgttaaggagtatgattccatctctcgcctcgatcagtggttgactacaatgcttctcaggataaaaaaaacaatccagggtgatgaggaggacttgcgctag

SEQ ID NO: 232204 - DNA, 897 bp, Artificial Sequence
  Description of Artificial Sequence: Synthetic coding sequence
atggacaatgcaggcaaagagcgagaagccgtgcagctcatggccgaagcagaaaagagggtaaaggcttctcacagctttcttagaggcctgtttggcggaaatacacgcatcgaggaagcttgtgaaatgtacactcgcgcagctaatatgtttaaaatggccaagaattggtccgcagcaggcaatgccttttgccaggcagccaaactgcatatgcagcttcagagcaaacacgacagcgcaacctctttcgttgatgccggtaatgcgtataagaaagccgatcctcaagaggccataaactgtctcaacgccgcaatcgacatctatacagacatgggcagattcacgatcgcggcaaaacaccacattacaatcgcagagatctatgagaccgagctggtggatattgaaaaagctattgcccattacgagcaaagcgcagactattacaagggagaagaatctaattcctctgctaataaatgcttactcaaagttgccgcatatgccgcacagttggaacaataccagaaagctatagaaatatatgagcaagtgggggctaacacaatggacaacccattactcaaatactcggctaaggactacttttttaaggcagctctatgccacttcatcgtcgacgagttgaacgctaagcttgcccttgaaaagtatgaggagatgttccccgctttcacggatagtcgggaatgcaaactgcttaagaagctgctggaggcccacgaggagcagaactccgaagcttatacggaggctgtaaaggaatttgacagtatctctcgactggatcaatggcttacgaccatgctgcttcgaattaagaagagcatccagggtgacggtgagggtgacggggacctgaaatag

SEQ ID NO: 232205 - DNA, 615 bp, Artificial Sequence
  Description of Artificial Sequence: Synthetic coding sequence
atgacactgctgccggctttatggatgctggaaatgctcacaaagcgccagattcccaaaggcagattcacaatcgcagctaaacaccatatcacaattgcagaaatctacgagaccgagctggtcgacatcgagaaggccatcgcccattatgaacaatcggctgattattataaaggcgaggagtcaaattcctcagccaacaaatgcttactgaaagttgccgcttatgcagcccagctcgagcagtatcagaaggcgatcgaaatttatgaacaggtgggtgccaataccatggacaatccactcctcaagtattcagccaaggactattttttcaaagcagcgttgtgccacttcatcgttgacgagctgaacgccaagctggctttagagaagtatgaggagatgtttcctgcctttaccgatagcagggagtgtaaactgttgaagaagctccttgaggcccacgaagagcagaatagtgaagcctatactgaagcagtcaaggagtttgattctattagtcgacttgatcagtggctaactactatgctactacgcatcaagaagtcaatccagggcgacggagaaggggatggtgacttgaaatag

SEQ ID NO: 232206 - DNA, 768 bp, Artificial Sequence
  Description of Artificial Sequence: Synthetic coding sequence
atgtacacacgggcagccaacatgttcaaaatggccaagaactggtctgcggctggtaacgcgttctgtcaggccgcaaagttgcacatgcagctgcagagtaagcacgactccgcaactagcttcgtcgacgccggtaacgcttataaaaaggcagaccctcaggaagcgatcaactgtctgaatgccgcaatcgatatctacaccgacatgggccgtttcaccatagcagcaaagcaccacatcacaattgccgagatttatgagactgaattagttgatattgagaaggccatcgcccactatgagcaaagtgctgattattacaaaggggaagagtcgaattccagcgccaacaagtgcttactgaaagtggcggcttacgccgcacagttagagcagtaccaaaaagctatcgaaatctatgaacaagtgggagccaatactatggacaaccctctgctgaaatattccgcaaaagattacttctttaaggcggcactctgtcacttcattgttgacgagctcaacgctaaactcgcgctcgaaaaatatgaagaaatgttcccagctttcactgattcgagggaatgcaagctgctgaagaaactcctggaggcccatgaggagcagaatagtgaggcctataccgaggcagtgaaggagttcgacagtatcagtcgcctggatcagtggctcacaaccatgctcctgcggattaagaaatctatccaaggcgacggcgaaggagacggagatttgaagtag

SEQ ID NO: 232207 - DNA, 780 bp, Artificial Sequence
  Description of Artificial Sequence: Synthetic coding sequence
atggataatgccggaaaggagagagaggctgtgcaactgatggccgaggcggagaaacgtgtcaaggcctcccactcattcctccgcggacttttcgggggaaacacacgaatagaggaggcctgcgaaatgtacaccagagctgccaatatgtttaagatggccaaaaattggagcgaggctatcaattgtctcaacgcagcaatagacatctacacggatatgggcagatttaccattgctgccaagcaccacataacaattgctgagatttatgagacagagctggtcgacattgaaaaggccattgcccactatgagcaatcagctgactactacaagggtgaggagtcaaacagtagtgcaaacaaatgtttgctgaaggtagccgcttatgcggctcagctggagcaatatcagaaagcaatcgagatttacgaacaggtcggggctaatacaatggacaatcctctcctcaaatattccgcgaaggactacttcttcaaggccgctttatgtcacttcatagtcgatgagctgaatgccaagctcgccctagagaagtacgaagagatgtttcctgctttcacggattccagggaatgcaaactcctgaaaaaactccttgaggcccacgaagagcagaactctgaagcttatacagaagctgtgaaagagttcgactcgattagtcgtcttgatcagtggctgacaacaatgctcctgagaattaagaaatccatccagggggatggagaaggcgatggggacctgaaatag

SEQ ID NO: 232208 - DNA, 1887 bp, Artificial Sequence
  Description of Artificial Sequence: Synthetic coding sequence
atggggtcatgcgctcggctcctcttgctctggggttgcacagttgtcgccgctggcctttccggggtggcgggagtgtcatctcggtgtgaaaaggcctgtaaccccagaatgggcaacctcgcgttgggccgtaagctgtgggccgacactacctgtggccagaacgcaaccgagctgtattgtttctattctgaaaacaccgacctgacctgtcgccaacctaagtgcgacaagtgcaacgccgcttatccacatttggcacacttgccgtctgcaatggctgactctagttttcgcttcccgaggacctggtggcagtctgcggaagatgtgcatagggagaagatccaactggatctggaagcggagttttacttcactcacctcattgtcatgttcaagtccccacgacctgctgctatggttctggacagaagccaggattttggaaaaacttggaaaccctataaatatttcgctaccaactgttcagccaccttcggcttggaggatgatgtggttaagaagggtgccatctgcactagtaagtattctagcccgttcccttgcacaggtggcgaggtgatcttcaaagccctgtctcctccctatgacaccgagaatccgtactccgcaaaggtgcaggagcaactcaagataaccaatcttagggtacagttgcttaagcgccaaagctgcccatgtcagagaaatgacttgaacgaggagccacaacatttcacacattatgccatctatgacttcatcgtgaaaggttcctgtttctgtaacggacacgccgatcaatgtatacccgtgcatggctttagacctgtgaaagccccaggtactttccatatggtgcacggaaagtgtatgtgcaaacacaataccgctgggagtcattgccagcattgtgcacctctctataacgaccggccttgggaagccgctgacggtaagacgggcgctcctaacgaatgccgcacatgcaaatgcaacgggcacgctgacacttgccactttgatgtgaatgtctgggaagcttctggcaaccgcagcggtggcgtctgcgacgactgtcagcacaacacggaagggcagtactgtcagcgatgtaagccgggattctatcgggacctgcgacgaccattcagtgcaccggacgcgtgcaagccttgctcttgtcatccggtcgggtccgctgtcctcccggctaattctgttaccttctgcgatccttccaacggcgattgcccctgcaaacccggtgtggccggaagacgctgcgaccgttgcatggtgggttactggggttttggagattacggctgccgtccatgtgactgtgccggaagttgcgatcccattacaggcgactgtatttcaagccataccgatatcgactggtaccacgaggtccccgatttccggccagtgcacaataaatccgagccagcctgggaatgggaggatgcacagggattctcggccttgttgcactcaggaaagtgcgaatgcaaagagcaaactttgggaaacgcaaaagcattctgcggtatgaagtacagctacgtcctgaaaattaagattctctccgcccacgacaaaggaacccacgttgaagtgaatgtgaaaatcaagaaagtgctgaagagtacgaagctcaagatctttaggggaaaacggacgctataccccgaatcttggacagatcgcggatgcacttgtccaatcttgaatcctggcctggagtacctggtcgcaggccatgaggacataagaacaggaaaactgatcgtgaacatgaagagcttcgtgcaacactggaaacctagcttgggaagaaaagtcatggatatacttaaaagggagtgcaaatag

SEQ ID NO: 232209 - DNA, 1776 bp, Artificial Sequence
  Description of Artificial Sequence: Synthetic coding sequence
atgggcaatcttgctctggggaggaagctctgggccgacacaacttgtgggcagaacgctacggaactatactgtttctactctgagaatactgatcttacttgtaggcaacccaagtgtgataagtgcaacgccgcttatccccacctggcccacctaccatcggcaatggctgactcttccttccgatttcctcgcacctggtggcagtctgccgaggacgtgcatcgagagaagattcagttagatttagaggccgagttttacttcacccacttgatcgtgatgtttaagagccctagaccagccgctatggtgctggaccgaagtcaggactttggcaaaacctggaagccgtataagtactttgctaccaactgctcagcaaccttcggcttggaggatgatgttgtgaagaaaggagccatttgtacgtccaagtattcaagtcccttcccttgtacgggaggcgaagtaatcttcaaagcactcagccccccatacgataccgaaaatccgtatagtgccaaagtacaggagcaactgaagatcaccaacctccgtgtgcagcttctgaaaagacagagttgtccgtgccagcggaatgacctgaatgaggagccacagcacttcactcattacgctatctatgatttcatcgtcaagggctcctgcttttgcaatggacacgccgatcagtgtatccccgtgcacggctttagacccgtgaaagctcctgggacatttcacatggtccatggaaagtgcatgtgcaaacataacactgccggaagccattgtcaacactgtgcccctttgtacaacgaccggccatgggaggcagccgacggaaagaccggagcgcctaatgagtgcagaacctgtaagtgcaacggccatgccgacacatgccactttgatgtgaacgtgtgggaggcttcaggtaataggagtgggggtgtctgtgatgattgccaacacaacacggaaggccagtactgccagcgatgcaagcccggtttttaccgggacctgcgcagaccattttctgctcctgatgcatgtaaaccatgctcatgccaccccgtgggatctgcggtgctgcctgctaattctgtgacattctgcgatccttccaatggcgactgtccttgcaaacccggtgtggccggacgtcgttgtgaccggtgcatggttggatactggggcttcggagactatggctgcaggccttgcgattgtgctggtagctgtgatcccatcactggggattgtatttcttctcacacagacatcgattggtatcacgaggtaccggatttcaggccggtgcacaacaagtctgaacccgcatgggaatgggaggacgctcagggcttttctgcactgctacacagcggaaagtgcgagtgcaaggagcagactctaggcaatgcgaaagctttctgcggcatgaaatactcatacgtattgaaaatcaagatcctgagtgcacatgataaaggcactcacgtggaggtgaacgtaaagataaaaaaggtgctcaaatctacgaaactgaagatttttcgcggtaaacgaacactctatcctgaaagctggacagacagaggttgcacttgcccaattttgaaccccggattggagtatttagtggcagggcatgaggacattcggaccggaaaacttattgtgaatatgaagtccttcgtccagcattggaaaccaagcttgggccgtaaggtaatggacatcctgaagagggagtgcaagtag

SEQ ID NO: 232210 - DNA, 1818 bp, Artificial Sequence
  Description of Artificial Sequence: Synthetic coding sequence
atgggcagctgcgcccgtctgctgttactgtggggctgtactgtagttgctgctggattgtctggcgtcgcgggagtgagcagcagatgcgaaaaagcgtgtaatccccgaatgggcaatctggctttaggcagaaaattgtgggccgatacaacttgcggccagaacgcaactgaactttattgtttctacagtgaaaataccgatctcacgtgcaggcagccgaaatgcgataagtgcaacgctgcctatccgcacttggcacatctgccctctgccatggctgattcttccttcaggttcccaagaacttggtggcagagcgcggaagacgtccaccgagaaaaaattcagcttgacctggaagcagagttctactttacccacctgatcgtcatgttcaaatcacctcgtcctgccgcaatggttctggacagatcacaggactttggaaagacttggaagccttataagtactttgccactaattgttctgccaccttcggattagaagatgacgtggtgaaaaagggcgcaatatgtacaagcaagtatagctcacccttcccatgtaccgggggagaagtcatcttcaaagccctgtctcccccttacgatactgagaacccatattctgcgaaagtgcaagagcagttaaaaatcaccaatctgagagttcaactcttaaagagacaatcttgcccttgccagagaaatgaccttaacgaggaaccacaacattttacacactacgctatatacgactttatcgtcaagggttcgtgtttctgcaacgggcacgccgaccagtgtattccagttcatggattccggccagttaaggctcctggcactttccacatggtgcacggcaagtgcatgtgcaagcacaacacagcaggcagtcattgccagcattgtgccccattgtacaacgatcgaccctgggaggccgctgatgggaagacgggtgccccaaacgaatgtcggacctgtaagtgtaatggacacgctgatacgtgccacttcgatgtgaacgtgtgggaggcaagcggcaatcggtctggtggagtgtgcgacgactgtcagcacaatacggagggacagtattgtcagcggtgcaagcctggattctatagagatctgaggcgaccatttagcgcgccagacgcctgtaagccctgtagttgtcatcccgtcgggtcggcagtgctgcccgctaacagcgttaccttttgcgaccctagtaatggcgattgcccttgtaagccaggcgtggcaggtaggcgttgcgaccggtgcatggtgggctattggggctttggtgactatggatgtcgcccttgcgactgcgcaggatcctgtgaccccattacgggtgattgcatctcctctcacacagacatcgattggtatcacgaagttcccgactttcgacccgtgcacaacaagagtgagcccgcttgggaatgggaggatgctcagggcttcagcgccctcttgcattcagttctgaaaatcaaaatattgagtgcgcacgacaagggaactcacgtggaagtgaacgtgaaaatcaaaaaggtcctgaagagtaccaagctgaaaatttttcggggaaaacggacgctttatccagagtcctggactgaccgaggctgcacttgtccaatactgaatcccggattggaataccttgtggctggccacgaagacatccggaccgggaaactcatcgtaaacatgaagtctttcgtccagcactggaagccctcccttggacgaaaggtaatggacatcttaaaacgggagtgcaagtag

SEQ ID NO: 232211 - DNA, 1095 bp, Artificial Sequence
  Description of Artificial Sequence: Synthetic coding sequence
atgtatttgtcaaggtttctgagtattcatgccttgtgggtcactgtgtcctccgtgatgcagccatacccactggtgtgggggcactatgatctttgcaaaacccagatttacacagaggaagggaaggtatgggattacatggcctgccagccagaaagtaccgacatgacaaagtatctgaaggtcaaactggacccccctgatatcacatgcggcgacccccctgagaccttctgtgcaatgggcaacccctatatgtgtaacaacgagtgtgatgcctcaacacccgagctggcccacccacctgagcttatgttcgattttgagggacgccatcccagcaccttttggcagtctgcgacctggaaagagtatccaaagcctctgcaagtcaacattacgctttcctggtctaagactatcgaactcaccgacaatattgtgatcacatttgagtccggcaggcccgaccagatgatcttagagaaatccctcgattacggtaggacatggcagccttatcagtactacgcaacagactgtctggatgcctttcacatggatccaaaaagtgtgaaagatctctcgcagcatactgtgcttgaaatcatctgcacagaagaatatagcactggttacacgacaaattccaagatcattcactttgaaatcaaagatcgctttgctttctttgccggaccacggctccgcaatatggcttctctgtacggccagttagatactacaaaaaaactgagggatttcttcactgtgaccgatttgcggattcgcttgttacggcctgctgtgggtgagatctttgttgacgaactgcaccttgctagatatttctatgccatttcggacatcaaggtccgtggtagatgcaaatgcaacctacatgccacagtttgtgtgtacgataatagtaagctgacctgcgagtgcgagcacaataccaccgggccagattgtggcaagtgcaaaaagaactaccaaggcaggccgtggagtcccggaagctaccttccaattccaaagggaactgccaacacttgcattccgtcaatcagcagcatcggctcaaagtag

SEQ ID NO: 232212 - DNA, 1518 bp, Artificial Sequence
  Description of Artificial Sequence: Synthetic coding sequence
atgtacctctctcgcttcttgagtattcacgccctatgggtcaccgtttctagcgtcatgcaaccctatcccttggtctggggtcattatgacctatgcaaaacacagatctacacagaagaaggaaaggtttgggattacatggcttgtcaacccgagagcactgatatgactaagtatctgaaagtgaaacttgacccaccggacatcacatgtggtgacccgcctgagactttctgcgccatgggaaacccatatatgtgcaacaatgaatgtgatgctagtaccccagaactagctcaccccccagaactgatgtttgattttgagggtcgccatcccagtaccttctggcagtccgcaacatggaaggaatacccaaaacccttgcaagtcaatattacactatcctggagcaagactattgagttaactgacaacatcgtcataactttcgagtcgggacggcctgaccaaatgatcctagagaagtcattggattacgggagaacttggcaaccgtaccagtactacgcaacagattgtttagatgcattccacatggatccaaagtccgtgaaagatttaagtcagcatactgtactggaaattatatgtaccgaggaatatagtaccgggtacaccacaaactctaagattatccatttcgaaatcaaagatagatttgccttcttcgctggccctcgattacgcaatatggcctccctatacggtcaactggataccactaaaaagcttcgggacttcttcactgtaaccgacctgagaataagattgctgagacctgccgtgggggagatatttgtggacgagctacacttggcacgatacttttatgctatctcagacataaaggttcgcggacggtgcaaatgcaatctgcacgccacagtttgcgtgtatgacaactcaaagttgacctgtgagtgtgaacacaacacaaccggccctgactgtggcaaatgcaagaaaaattaccagggccgtccttggtctccaggttcctacttgccgatccccaagggaactgccaatacttgtattccctccatcagtagcattggaaaccctcctaagtttaaccgaatctggccaaacatttcctcactagaggtgagtaatccgaagcaggaatgctattgcaatcccctggggagcattcatgacaggtgtaacgggagtggattctgtgagtgcaagaccggaaccacagggcctaaatgtgatgagtgcttgcccggaaattcctggcactatggctgccagcccaacgtgtgcgacaatgaattgctgcactgtcagaacggcggaacctgccacaacaacgtaaggtgcctgtgccctgccgcttatactggaattttgtgcgagaagctgcggtgcgaggaggccggtagttgtggatccgattcgggacagggcgctccaccccacggatccccagcactgctcctgctaactaccttgttgggcaccgcttcccctctcgtgttctag

SEQ ID NO: 232213 - DNA, 861 bp, Artificial Sequence
  Description of Artificial Sequence: Synthetic coding sequence
atggcctcgttgtatgggcagctggacactaccaaaaagcttagggatttttttacggtgacagacctccgcattcggctccttcggcctgccgtgggtgaaattttcgtcgatgaattacatctcgcccgatacttttatgccattagcgacatcaaggtacgagggcgatgtaagtgcaacctgcacgcaacagtgtgcgtctacgataatagcaaactgacctgtgaatgcgaacataatactacggggcctgattgcgggaaatgcaagaaaaattaccagggcaggccatggtcaccagggagttacctgccgattccaaaggggaccgccaacacttgcataccatccatttcctctatcggcaatccgcctaagtttaacaggatatggcccaatatttcctctctggaggtttcaaaccctaaacaggttgcgccaaaactcgccctgtctacagtctccagcgttcaggttgcaaatcataagagggaatgctactgcaacccactggggtccattcatgaccgttgcaacggcagtggattctgtgaatgcaagactggtaccactggacccaagtgtgatgagtgcctccctggtaattcttggcactacggatgtcagcccaatgtctgtgacaacgagctgctccactgtcaaaacggtggaacgtgtcacaataacgtgcgttgcttgtgccccgctgcttatacaggcatcctgtgtgagaagcttagatgcgaggaggctgggagctgcggtagcgactcagggcaaggcgcaccgcctcacggatctccagctttgctactgctcacaaccttgctcggtacagctagccctctcgtgttttag

SEQ ID NO: 232214 - DNA, 1029 bp, Artificial Sequence
  Description of Artificial Sequence: Synthetic coding sequence
atggcctcgctgtacggtcagctagacaccaccaagaaactgcgggactttttcaccgtaacagaccttagaatccgccttctgagacctgctgtcggtgagatcttcgttgacgagctacacctcgcacgttatttctacgcgatatccgatatcaaggtacggggtcggtgtaaatgcaatttacacgccactgtgtgcgtttacgataattccaagttaacctgtgagtgcgagcataacacaacaggccctgactgcggcaagtgcaaaaaaaactaccagggacgtccttggtcaccagggtcctacttgccgattccaaaaggcaccgccaatacctgtatcccatcaatatcctccattggcaatccccctaaatttaatcggatctggcctaacatctccagcctggaggtgtccaatcctaagcaggtcgcacctaaactggccttatccacagtctccagcgtgcaggtggccaaccacaagcgggattgtgagtgttttggccattccaaccgctgctcctatatcgacttgcttaacacagtcatttgtgtatcttgcaagcataatactcgcggacagcactgcgagctgtgtcggctggggtactttcggaatgcgtctgcgcagttggacgatgagaatgtctgcatcgaatgctattgtaaccctctgggctcaatccatgatcgatgtaacggtagcggattctgcgaatgcaaaacagggactacgggcccaaagtgtgatgagtgtctccccggaaactcctggcactatggctgtcagccaaacgtgtgtgataatgagctgctacactgtcaaaatggaggcacctgccataataatgtgcgttgtctgtgtcctgccgcatacacaggaatcttatgtgagaaactccggtgcgaagaagccggatcgtgcgggtccgacagcgggcaaggggctcccccacacggatcacctgctctgctactgcttacaaccctcttagggacggcaagccctcttgtgttctag

SEQ ID NO: 232215 - DNA, 1485 bp, Artificial Sequence
  Description of Artificial Sequence: Synthetic coding sequence
atgtacctctcccgattcctcagtattcatgctttatgggtaaccgtcagctctgtgatgcagccataccctctggtgtggggccactacgacctgtgcaagactcagatatacacagaggaagggaaagtctgggattatatggcttgccagccagaaagtacggatatgacaaaataccttaaagtcaagctcgacccgccagacattacgtgtggcgaccctccagaaactttttgcgcaatgggcaatccttatatgtgtaacaacgagtgcgacgcgagcacacccgaactggctcatccacccgagctcatgtttgacttcgagggccgacacccatctacattctggcagtcggccacctggaaggagtaccctaagccactgcaggttaatatcaccttgagctggagcaaaactatagaactaacagataatatagtgataacattcgaatctggccgacccgatcagatgatcctggagaagagcctcgactatggcaggacctggcagccataccagtattacgccaccgactgcttggatgcttttcatatggatccaaagtctgtaaaggatctctcccaacacactgtgctggagatcatttgcacagaggaatactccacagggtatacaactaattctaagatcatccattttgagatcaaggaccggtttgcatttttcgctggtcctcgcctgcgaaacatggcatcactctacggccaacttgacactaccaaaaaactgagggacttctttacagtaacagaccttcgaattcgccttctccgtccggctgtgggggaaattttcgtcgatgagcttcatttagctagatacttctacgccatctccgacattaaggtccgcggaagatgcaaatgtaacctgcatgcaaccgtgtgcgtctacgacaactccaaactaacttgtgaatgtgaacataacacaaccggaccagactgcggtaagtgtaaaaaaaactatcaaggccgtccctggagccctggttcgtacctcccgatcccgaaaggcaccgccaacacttgcatccctagcatcagctctattgggaactgcgagtgctttggacactctaaccgatgctcctacatcgatttacttaacactgtgatatgcgtttcatgtaagcataacacacggggtcagcactgcgaactgtgcagattgggttattttagaaatgccagtgcccagctggatgatgagaacgtttgcatcgccaacgtgtgtgacaatgaactcctgcattgccagaacggcggtacatgccataacaacgtgcggtgcctctgcccagctgcttacacaggcatcttgtgcgaaaagttgcgttgtgaagaagctggctcctgtggatctgattctggacagggagccccaccgcatggaagccccgctcttttgctgctgaccacattactggggactgccagtccactggtcttctag

SEQ ID NO: 232216 - DNA, 1443 bp, Artificial Sequence
  Description of Artificial Sequence: Synthetic coding sequence
atgtacctaagtcgtttcttgagcatacacgccctttgggtgaccgtctcgagcgttatgcagccctatcccctggtctggggccattatgatctgtgtaagacacagatctacactgaagagggaaaggtgtgggactatatggcttgtcaacctgagtccaccgatatgaccaagtatctcaaggtgaagctcgacccacccgatattacttgcggagaccccccagagaccttctgtgccatgggaaatccatacatgtgtaataatgaatgcgatgctagtacacccgagcttgcacatccccctgaactcatgtttgactttgagggaagacaccccagcaccttctggcaatctgcaacttggaaggagtatcccaagccgctgcaagtcaacatcacattgagttggtccaaaacaattgagctgacagataatatcgtgatcacgttcgaatctggtcggcctgaccagatgatcctggagaagtctctcgactacggacggacatggcagccatatcagtattatgctaccgactgcctcgacgcttttcacatggaccctaagtctgtcaaggaccttagccagcacactgtgctggagattatctgtaccgaggagtatagtacgggatacacaaccaattcgaagattatccacttcgaaataaaggatcggtttgctttcttcgcaggaccacgcctgagaaacatggcgtccctctatgggcagcttgataccaccaaaaaactcagggatttttttaccgtgaccgacctgagaattagacttttgagacctgctgtcggcgagatctttgttgatgaattgcatctggcgcgttatttttatgctatctctgacataaaggtccgtggaagatgtaagtgcaatctgcacgctactgtctgtgtgtatgacaactctaagctgacctgtgagtgcgagcacaacaccaccggcccagattgcggtaagtgtaaaaagaattatcaagggcgaccctggagcccgggatcctatctgcctattccaaaaggtactgccaacacatgcatacccagcatttcctctattgggaacccgcctaagttcaaccgaatctggcctaacatttctagcctcgaagtgtcaaacccaaagcaagtagctcccaagctggccctgtccacggtgtccagtgtccaggtcgccaatcacaaacgcgcaaacgtctgcgataatgaactattacactgtcaaaatggaggaacctgtcacaataatgtccggtgcctttgccctgcagcgtacacaggaatcctgtgcgagaagctgcgctgtgaggaggccggaagctgcggaagtgattcaggccagggtgctcctccgcacggctcccccgcacttctacttctaactactctgctcggaactgctagtccattagtgttctag

SEQ ID NO: 232217 - DNA, 1383 bp, Artificial Sequence
  Description of Artificial Sequence: Synthetic coding sequence
atgtacttgtcacgcttcctgtctatccatgcgctttgggtgacggtaagctcagtaatgcagccgtacccgctggtatggggtcactatgatctatgcaagacccagatctacacagaggagggtaaggtctgggattatatggcatgtcagcctgagagtactgacatgactaaatacctgaaagttaaactggaccctccggacatcacttgtggagatccacctgagaccttctgcgccatggggaacccgtatatgtgcaataacgaatgcgacgcatctacacctgaactggcccatccccctgaattgatgttcgacttcgaaggacggcatcctagcactttctggcagagcgccacctggaaagagtaccctaaacccctccaggtcaatatcaccttatcctggagcaagacaatcgagctcacagataacatagtgataacgttcgagtccggccgtcccgatcagatgatcttagaaaaatctttggactatggccgtacttggcaaccctaccagtactacgctactgactgtctcgatgctttccacatggatccgaagtctgtgaaggacctgtctcagcatactgtgctggaaattatatgcacagaagagtacagcacagggtataccacgaatagtaagatcatccacttcgaaatcaaggaccgctttgcattctttgccggacccaggctaagaaatatggccagcctgtacggccagctcgacaccacaaagaaacttagggacttcttcacagtgactgacttgagaatccggttacttaggccggctgtgggggagatctttgtggacgaactgcatctggccagatacttctacgctatcagtgacattaaggtgagaggacgctgtaaatgcaatctccacgcgacggtttgcgtgtacgataatagcaaactgacatgcgaatgtgagcacaatacaacaggtcccgactgcggcaagtgtaagaagaactatcaaggtaggccctggagccccggaagctatttgccaatcccgaagggtaccgccaatacctgcatccccagcataagctcgattggcaacccaccaaagttcaatcgtatttggccgaatatttcttcactagaggtgtccaatcccaagcaggcaaatgtctgtgataacgaactgcttcactgtcagaacggcggaacatgccataacaatgtgcgctgcctgtgtccggcagcttatacgggcatcctctgcgagaagcttcgctgcgaggaggcaggatcttgtggaagcgactccggacagggcgctccccctcatggttcaccagctctgctgctcctgaccactctactcggcacggcaagccccttggtcttctag

SEQ ID NO: 232218 - DNA, 1620 bp, Artificial Sequence
  Description of Artificial Sequence: Synthetic coding sequence
atgtatctgagtcgcttcctttctatccatgccctttgggttacggtgtcctctgtgatgcagccttacccactagtgtggggacattatgatctgtgcaaaacccagatctacaccgaggaaggtaaggtctgggactatatggcgtgccagccagagtctaccgacatgaccaagtacctcaaagtgaagttggaccctcccgacatcacatgcggagacccacccgagactttttgtgctatgggcaatccatacatgtgtaataatgaatgcgacgcttcaacaccagagctggcacatcctcccgaactaatgtttgacttcgagggacgacatcctagcactttctggcagagcgccacatggaaggagtatcccaagccattacaggtgaacataactctgagctggagtaagacaatcgagctcaccgacaatatagtaataacatttgaaagtggaagacctgaccagatgatacttgagaagtctctcgattacggaaggacatggcagccataccagtattacgccactgactgcctggacgccttccacatggaccccaagtctgttaaagatctctctcagcatacagtcctcgagatcatctgcaccgaggagtatagcaccgggtacaccactaattcgaaaattatccactttgaaattaaagacaggtttgccttttttgctggacccaggctgcggaatatggccagcctatacggacaattagacacaacaaaaaaactgcgcgactttttcaccgtgaccgacctgagaattcggcttttgcgccctgccgtaggtgagatctttgtagacgaactgcatctcgccaggtacttttatgcgatctccgacataaaggtgagagggaggtgcaagtgcaatctgcacgctacggtttgcgtttacgacaatagtaaactgacatgcgaatgtgaacacaacactaccggaccggattgtgggaagtgcaaaaaaaattaccaaggacgtccttggtcgcctggttcttacctgcccattcccaaggggactgccaatacctgcattcccagcattagctcgattggcaattgtgagtgctttgggcatagcaaccgatgtagctacatagacctgctgaatactgtcatctgtgttagctgcaaacataatactcgcggacagcactgcgaactgtgtcgcctgggatacttccgcaacgcttcagctcagttggatgacgagaatgtatgcatcgaatgctattgcaacccccttggatccatccacgaccggtgcaacggatccgggttctgtgagtgtaagacaggtacgaccggccctaagtgtgatgaatgcttgcccggtaactcctggcattatggctgtcagccaaacgtctgtgacaacgagctgttacactgccagaacgggggtacctgccataacaatgtgaggtgtctgtgtcctgccgcttatactgggattctgtgtgagaaacttcggtgtgaggaagccggatcgtgtggaagtgattccggccagggcgctccacctcacggctcccctgctttgctcctgttgacaacattactggggaccgccagccccctggttttctag

SEQ ID NO: 232219 - DNA, 1383 bp, Artificial Sequence
  Description of Artificial Sequence: Synthetic coding sequence
atgtacttgagtcggtttctcagcattcatgccctctgggtcactgtttcaagtgtgatgcagccatatcccctggtgtggggacactatgacctgtgcaagacccagatctatacagaggagggtaaggtctgggactacatggcgtgccaacccgagtcgaccgacatgaccaagtatctgaaggtgaagctcgacccaccagatatcacgtgcggcgatccaccagagactttctgcgccatgggcaacccatatatgtgcaataatgaatgcgacgcttccaccccggagctggctcacccgccagagttaatgtttgatttcgaggggcgacacccctccacgttttggcaatccgcaacctggaaagagtatcccaagccactccaggtgaacattactcttagttggtctaaaactatcgaactgacagacaacatcgtcattacttttgagtctgggagacccgaccagatgattctggaaaaatccctcgattacgggcgaacctggcagccttatcaatattacgctaccgattgccttgacgctttccatatggacccaaaatccgtcaaggatctctctcaacatacggtgctagaaataatctgtacagaggaatatagtactggctataccaccaactccaaaataattcacttcgagattaaagatagattcgcctttttcgcaggacctagattgcgtaatatggcttcactttacggccagttagacactactaagaaactgcgggatttctttactgtgaccgatctgaggatcagactgctgaggcctgctgtgggtgaaatattcgtcgatgaacttcacctggctcgatatttctatgccatctctgatatcaaagtccggggacggtgtaaatgtaatttacatgctacggtctgtgtgtatgacaactccaagctcacatgcgagtgcgagcacaatacaactgggcctgattgcgggaaatgcaagaaaaactatcagggccgaccctggagcccaggatcgtacctccctatccccaagggcacagctaacacctgcgatccctatctaacatcgtgtggtgatcctcccaagtttaataggatttggccaaatatctcaagccttgaggtttcaaaccccaagcaggccaacgtatgcgacaatgaattgcttcactgtcagaatggcggaacatgccacaataacgtcagatgtttgtgccccgctgcgtacaccggaatcctgtgtgagaagttacgatgtgaagaggccggttcgtgcggtagtgatagcggccagggtgcaccaccccacggttcccccgctctcctcctgctcacaactctgctgggcacagccagcccacttgtgttctag

SEQ ID NO: 232220 - DNA, 1443 bp, Artificial Sequence
  Description of Artificial Sequence: Synthetic coding sequence
atgtatctaagcaggtttctcagtatccacgcattgtgggtgacagtgtcctcagtcatgcagccttatcctcttgtctggggtcactacgatctatgcaaaacccagatctataccgaagagggcaaggtgtgggactatatggcttgtcagcccgagagtacggacatgactaagtatctcaaagttaagttagatcctccagacatcacctgcggagaccccccagagacattctgcgctatgggaaacccctacatgtgtaataacgaatgtgacgcctcgacaccggaactggcccatcccccagagctgatgtttgactttgagggtcgacatccttccacattctggcagtcagcgacctggaaggaatatcccaagccactgcaggtgaacatcacactgtcctggagcaagaccatcgagttaacagataatatcgtaataaccttcgagagcggcaggccagatcaaatgattctggaaaaaagcttagattacggcagaacctggcagccatatcagtactacgccaccgattgtctggatgcgtttcacatggatccaaagtcggtgaaggatctgtcacaacatacagtgctggagattatctgtaccgaagagtatagcaccggttacaccactaacagcaagatcattcacttcgaaataaaagatagattcgctttctttgccggacctcggctgaggaatatggctagcctctatggacagttagataccactaagaagctccgagacttcttcactgtgactgatctgaggatccgactgctgagaccggctgtgggagagatcttcgtggacgaactacatctcgcacggtacttctatgctattagtgacataaaggttagaggaaggtgcaaatgcaatctgcatgcaacagtttgcgtttacgataattctaaactcacttgcgaatgtgaacataatactaccgggcctgactgtggcaaatgcaagaagaattaccagggtaggccttggtctcccggatcttatctcccaatacccaagggaacagcaaatacttgtatcccttccatctcgtctatcggcaatcctccaaagtttaatcggatctggccaaacatcagtagcctggaggtatcaaatccaaaacaggtggcccctaaacttgcattgtccacagtatcctcggtacaagtggctaatcacaaacgggctaacgtctgtgacaacgagttgttgcattgtcagaacggcggaacctgtcacaataatgtgcgctgcctctgtccagctgcttacacaggtattctctgtgagaagttgcgttgtgaggaagctggatcatgtgggtccgattctgggcagggagcccctccccacgggtctcctgcacttcttctactgactaccctgctgggtacagcgtccccgttggttttttag

SEQ ID NO: 232221 - DNA, 1485 bp, Artificial Sequence
  Description of Artificial Sequence: Synthetic coding sequence
atgtacctgagtagatttttgtccatccacgctttgtgggtaactgtgtcctctgtgatgcaaccctaccctctggtttggggacactatgacctgtgcaagacacagatttataccgaagaaggcaaagtttgggactacatggcgtgccagcctgaatccaccgatatgactaagtacctgaaagtcaagctggacccgcctgatatcacgtgcggagatcccccagaaacattttgtgctatgggcaacccttacatgtgtaacaatgaatgcgacgctagtaccccggagctcgcccacccccctgagttgatgttcgattttgaaggcaggcacccctccaccttctggcagtccgcgacctggaaggagtacccgaaacctctgcaagtgaacattacattatcctggtcaaaaaccatcgagctaactgacaacatagtgatcactttcgagagtggccgaccagatcagatgattcttgaaaagtcgttggattacggaaggacctggcagccctaccagtactatgctaccgactgcttggacgcttttcacatggatcctaagtcagtcaaggacctcagccagcacaccgtgctcgagataatctgcactgaggaatatagtacgggctacaccacaaatagtaaaatcatacacttcgagataaaggaccggttcgctttctttgctggacccaggcttaggaacatggcatcgctgtacggccaactcgatactactaagaaactacgggacttctttacagtgacagacctcaggattcgcttgctgaggcccgctgtcggtgagatctttgttgacgaactacatctggcgagatacttttatgcaatctccgatattaaagtccggggaagatgcaaatgcaacctgcatgctacagtctgtgtatacgacaattcgaaacttacttgcgagtgcgagcacaatactaccggacccgactgcggcaaatgcaaaaagaattatcaagggcgaccttggagccctgggagttacctgccgatacctaaggggaccgctaacacctgcgatccatacctgactagctgcggagattgcgagtgtttcgggcacagcaatcgctgctcctacatcgacctcctgaatacggtgatctgtgtctcttgtaagcataacacccggggacagcattgtgagctgtgccggttgggttacttccgaaacgccagtgcgcagttggatgatgagaatgtatgcatagccaacgtatgtgataatgagctgctgcactgtcagaacggcggaacttgtcataacaacgtgcgctgcctgtgccctgcggcatataccggcattttatgcgagaaactccgctgcgaggaagctgggtcctgcggcagcgattccggacagggcgctcctccccatgggagccccgcactcttacttttgaccactcttttgggtactgcaagccccctcgtattctag

SEQ ID NO: 232222 - DNA, 1620 bp, Artificial Sequence
  Description of Artificial Sequence: Synthetic coding sequence
atgtaccttagtcgatttctgtcaatccatgcactgtgggtcaccgtttcaagcgtgatgcagccttaccccctcgtgtgggggcactatgacctgtgcaaaactcagatctacacggaggaagggaaggtctgggactatatggcctgtcagccggagagcaccgatatgacaaagtacctgaaagtgaagctcgaccccccagacatcacctgtggggacccacccgagactttctgcgcaatggggaatccctatatgtgtaacaacgaatgcgatgcttcaacaccagaactggcacacccaccagagctcatgttcgattttgaaggtcgacatccttcaacgttctggcagtctgcaacctggaaagagtaccccaagccgcttcaggtcaacatcacgttgagctggagcaagactatagagctgaccgacaatatcgtcatcacctttgagagcggaaggcccgaccagatgatcctcgagaaaagcctcgattacggtcggacctggcaaccttatcagtactacgcaactgattgcctcgatgcctttcacatggatcccaaatccgtgaaggatctatcacaacacacggtactcgaaatcatctgcacggaggagtatagtactgggtatacaactaacagtaagattattcacttcgagattaaagatcgattcgcctttttcgccggaccaaggctgcggaatatggcctcactgtacggccagctcgacactacaaagaagctgagggatttctttacggttaccgatctgcgaattaggctgttgaggcccgctgtcggtgagatctttgtggacgaactgcacttagccagatatttttacgcaatctctgacatcaaggttcgaggcagatgcaagtgcaacttgcatgctactgtatgcgtctatgacaattcaaagcttacttgtgaatgcgaacacaacaccactgggcctgactgcggtaaatgcaaaaaaaactatcagggcagaccatggtctccaggcagttatttacccataccaaaggggacagccaacacgtgcatccctagtatctctagtattggaaactgcgagtgcttcggacattccaacaggtgctcctacatcgacctgctgaacacagtcatctgcgtgagctgcaaacacaacacaagagggcagcattgcgaactgtgtaggctgggatactttagaaatgcaagcgctcagttggacgacgaaaatgtttgcatagaatgttactgcaatcctctgggctcaattcacgataggtgcaacggatccggcttttgtgaatgcaaaactggaaccaccggtcctaaatgcgacgagtgcctacctgggaactcctggcattatgggtgtcagccaaacgtatgtgacaatgagctactgcactgccaaaacggtggaacctgccacaataacgtacggtgcctctgtccagccgcttacacaggaatcctgtgcgaaaagctccgttgtgaggaggctgggagttgcggctctgactctggacaaggagccccaccacacgggagcccggctctcctcctgctgaccacattactggggacagcatcaccattggtgttctag

SEQ ID NO: 232223 - DNA, 1317 bp, Artificial Sequence
  Description of Artificial Sequence: Synthetic coding sequence
atgtacttgtcacgcttcctcagcatccacgccctgtgggttactgtttcttccgttatgcagccatacccccttgtgtgggggcattacgacctgtgcaaaactcagatttatacagaggaaggaaaagtgtgggattacatggcctgccagcccgagagcaccgatatgacaaagtacctcaaagtcaagctggatccaccagatattacatgcggcgaccctccggaaaccttctgtgcaatgggcaatccctacatgtgtaataatgaatgcgatgcttctactcctgaactcgctcatcccccagagctcatgtttgacttcgagggcagacacccctcaaccttttggcagtccgcaacatggaaagagtatcctaagcccctgcaagtcaatataacactcagttggtctaagacaattgagttgaccgacaatatcgttattacttttgagtccggcagaccagaccagatgatcctcgaaaagagcctagactatggcaggacttggcaaccttatcaatattacgcaacagattgtctagacgcctttcacatggatcccaaatccgtgaaggatctgtctcagcataccgttttggagatcatttgcacagaagaatactctactggctacacaaccaactcaaagattattcacttcgagataaaggaccgctttgcgttttttgcaggcccacgacttaggaatatggcatctttgtacggccagcttgacactactaaaaagcttagggacttttttactgtcactgacctgagaatccggttgttacggccagcagtgggcgagatcttcgttgatgagttgcatttggccagatacttctacgctatttccgacataaaggttaggggaaggtgcaagtgtaatctccacgcaaccgtgtgcgtgtacgacaacagtaagcttacatgtgagtgtgagcacaataccacgggtcctgactgcgggaagtgcaaaaagaattatcagggtaggccttggagtcctggaagctacctcccaattcccaaagggaccgccaacacatgcatcccatccatcagttctattgggacaaacgtttgcgacaacgaactcttgcactgccagaatggtggcacctgtcacaataacgtacgctgcctatgtcccgctgcatataccggaattctgtgcgaaaaacttaggtgcgaggaagcgggttcatgcgggtcagactctgggcagggggctccccctcatggatcacctgccctgctcctcctgacaacgctgctaggcaccgcaagccctttagtgttctag

SEQ ID NO: 232224 - DNA, 1095 bp, Artificial Sequence
  Description of Artificial Sequence: Synthetic coding sequence
atgtatctttctcggttcctatccatccacgcactgtgggtgaccgtgtctagcgtgatgcagccttatcctctggtttgggggcactatgacctctgtaaaacacagatctataccgaggaggggaaggtctgggattatatggcttgccagcctgagagtacagacatgacaaagtaccttaaggtcaagttggatcctcctgacatcacctgcggcgacccaccggagactttctgcgccatgggcaatccttacatgtgcaacaacgagtgtgacgcatctaccccagagcttgctcacccgcctgagctaatgtttgactttgaaggacggcatccatctaccttttggcagtccgcaacatggaaggaatatccgaaacccctacaggtgaatattaccctgagttggagtaagacaattgagttgactgacaacatcgtgatcacctttgaaagcgggaggccggaccagatgattctggagaaaagtctcgactatggtcggacctggcagccctaccagtattacgctaccgattgtcttgacgcgttccacatggatcctaagtctgtaaaagatctgtcccagcatacagttctcgaaattatatgcaccgaggagtattcgaccggctacaccactaatagcaagatcattcatttcgagataaaagaccgatttgcgttttttgctggtcccagactaagaaatatggcctccctgtacgggcaacttgatacaactaagaagctccgagacttttttaccgtgaccgatcttcggattcgattgctgcggccagccgtgggggaaatctttgtggacgaattacatctggcacgatatttttacgcaatctcggacatcaaggttagagggagatgcaagtgtaacctgcacgccactgtctgtgtatatgacaattccaagcttacatgtgaatgcgagcataacacaactggccctgactgcggtaaatgcaaaaagaactaccagggtagaccgtggtcacccggatcgtatctacccataccaaaaggcaccgcgaatacttgtataccgtccatttcctcgatcggctccaaatag

SEQ ID NO: 232225 - DNA, 1317 bp, Artificial Sequence
  Description of Artificial Sequence: Synthetic coding sequence
atgtacttgagccgcttcctgtctattcacgctctgtgggtcacagtgtcttccgtgatgcagccctatcccctggtctggggccattacgacctctgtaagacccagatctacaccgaagaggggaaggtctgggattacatggcctgccagcctgaatccaccgatatgaccaagtaccttaaggtgaagctcgaccctccggatattacatgtggggaccctcctgaaacattttgcgcgatggggaacccttatatgtgcaacaatgagtgcgacgcctctacacccgagctggctcacccccctgagctgatgtttgattttgaaggtagacacccaagtactttctggcagtccgctacttggaaggaatatcccaaacctcttcaggtaaatatcaccctctcctggtctaagactatagaactcaccgataacatcgtgattacattcgagagcgggcgaccggaccaaatgatactagagaagtcactggactacggacgcacttggcaaccgtatcaatattacgcaactgattgcttggacgccttccacatggatcccaaaagcgtgaaggacctgtctcagcacaccgtgctggagatcatctgcaccgaggaatactcaacaggctatacaactaactcaaagattatccacttcgaaataaaggatcggttcgcgttcttcgcgggaccacgcctcagaaatatggcgtccttgtatggccagctggacaccaccaaaaagttgcgagacttttttacagtcaccgatctgaggattcgcctactaaggcctgccgtaggggaaatcttcgtcgatgagttacatctggctaggtatttctatgctataagcgatattaaagtcagagggaggtgcaagtgcaatttgcatgccaccgtgtgcgtctacgacaacagtaagcttacatgcgagtgcgaacataacacgaccggtcccgattgtggcaagtgcaagaaaaattaccaaggcaggccttggagcccaggatcttacctgcccatcccaaaaggcactgcgaacacttacctaccaagcatgtattccgtagccgcaaatgtttgcgataatgaacttctccattgtcaaaacgggggaacgtgccacaacaacgtacggtgtctctgtcccgctgcttacacgggcattctctgcgagaaactgcgatgtgaggaggccggtagttgcggcagcgactcgggccaaggcgctccccctcatggaagcccagccctgcttctcttgactacgctgcttggaacagcctcccctctggtgttttag

SEQ ID NO: 232226 - DNA, 1620 bp, Artificial Sequence
  Description of Artificial Sequence: Synthetic coding sequence
atgtacttgtctcgttttcttagcattcacgccctatgggtgaccgtcagctctgttatgcagccctaccctctggtttggggtcactacgatctatgcaaaacacagatatacacggaagaggggaaagtgtgggactacatggcctgccagccagagagtaccgacatgacgaaatatttaaaagtgaagctggacccaccggatattacttgtggagatcctccagagacgttctgcgcaatgggcaacccctatatgtgtaacaatgagtgtgacgcatccactcctgaattggctcatccacctgaactaatgtttgactttgaaggccgtcacccttccactttctggcagagcgccacatggaaagagtaccccaaacctctccaggtcaacatcacactgtcttggtctaagaccattgaattaacagataacattgtgattacgttcgagtcaggcaggccagatcagatgatactggaaaagagcctggattatggccgaacttggcagccttaccaatactatgccaccgattgtcttgacgcctttcatatggacccaaagagtgtaaaggacctgtcccagcacaccgttttagagattatttgcacagaagaatactctacaggctataccaccaattcaaagataattcactttgagattaaggacagattcgcattttttgccggtcctcgcctccgcaatatggcctccctgtacggacagctggacaccacgaagaagttgagggacttcttcaccgtaacagacctgagaattcggctgcttagacctgctgtgggggagatatttgtagacgagctgcacctggcgagatatttttatgctatctctgacattaaggtgaggggcagatgtaagtgcaatctccacgctacggtctgcgtttatgataatagtaaacttacttgtgagtgtgaacacaacaccaccggtcctgactgcggcaagtgtaagaaaaattaccaggggagaccatggagccccggttcttatctccctatccctaagggaaccgccaacacgtgcgatccgtatcttaccagctgtggagattgtgagtgcttcggccattcaaataggtgttcctacattgatctactgaacacagtaatctgcgtttcttgcaagcacaatacacggggtcagcactgtgagctctgccgcctgggctattttcgaaatgcaagcgctcagctggatgatgaaaacgtgtgtattgaatgttattgtaaccctcttggctctatccatgatcggtgcaacggaagcggcttctgcgaatgcaaaactggcaccaccgggcctaagtgtgacgaatgtcttcccggaaacagctggcattatggatgccagcccaatgtgtgcgacaatgagctgcttcattgtcagaatggcggaacttgtcataataatgtgcgctgcctgtgtccggcagcctacacagggatcctgtgcgagaaactacgctgtgaggaggcaggaagctgtggtagcgatagcgggcagggggcaccaccacacggctcgccagccctgttactgctcacaactctactcggtacagctagtcccctggtgttttag

SEQ ID NO: 232227 - DNA, 519 bp, Artificial Sequence
  Description of Artificial Sequence: Synthetic coding sequence
atggtcggtcctgcccctcgcaggaggctgaggcccctcgccgcactagcacttgtacttgccctggcccctggcctccccactgcccgagcagggcagacccctagacccgcagaacgcggacctcccgttcgactctttactgaggaggaattggccaggtacggaggcgaggaggaagatcagccgatctacttggccgtgaagggggtagtgtttgacgtgacgtcaggaaaggaattctatggtagaggagcaccatacaacgccctcacagggaaagattcaacacgtggcgttgcaaaaatgagcttggacccagctgatctcacgcacgataccactgggctgacggcgaaggaacttgaggcgctggatgaagtcttcacaaaggtgtacaaagccaaatatcctatagtgggctatactgccagacgaatcctcaacgaagacggatcacctaacctggattttaagcctgaggaccagccacacttcgacatcaaagacgagttttag

SEQ ID NO: 232228 - DNA, 2088 bp, Artificial Sequence
  Description of Artificial Sequence: Synthetic coding sequence
atgtcactattgttatccttctacttgctcggtttgttagtatcgagtggccaggatcgctttgctatgttggccaataacaacctccagattctgaatataaataagtcagacgagggaatataccggtgtgagggaagagtggaggcaaggggagaaattgactttagagacataattgttattgtgaatgtgccaccagcaatctcaatgcctcagaagagttttaatgctactgctgaacggggtgaagagatgactttttcatgtcgcgcaagcgggtctccagaaccagcaatcagctggttccgcaacgggaagttgattgaagagaacgaaaagtatatactgaaggggagcaatacagagctaacagtgcgaaacattattaactctgatggcggaccctacgtttgtagggccacaaataaagccggtgaagatgagaagcaggcattcttgcaagtctttgtacagccgcacataattcagttgaaaaacgagaccacttacgagaacgggcaagtaaccctggtgtgcgacgctgagggcgaacctatccctgagattacatggaagcgtgccgtggatggattcactttcactgaaggagacaaatcactcgacggcaggatcgaggtgaaggggcagcacggctcctccagcctgcatatcaaggacgtcaagttgtcagacagcggtaggtatgattgtgaggcggcatctcgcatcgggggacaccaaaaaagtatgtatctggatatcgaatacgctccaaagtttatctcaaatcagacaatatattatagctgggaagggaatccaatcaacatttcctgtgacgtgaaaagcaatcctcccgctagtatccactggcgccgagataagctggtgttgcccgcaaaaaacaccaccaatcttaagacttatagcaccgggagaaagatgatccttgaaatcgccccaacaagcgataatgacttcggtaggtataactgtacagctacaaaccacataggaaccagattccaggaatacatccttgcccttgcagacgtccccagcagcccatatggagtcaagattatcgaactttcccagacaaccgcaaaagtgtcctttaacaaacccgactcccatggaggcgtcccaatccatcactatcaagtggacgttaaggaagtagcctcggagatctggaagattgtgcggtctcacggtgtacagaccatggttgtgctgaacaacctagagcccaacactacctacgaaattcgggtcgccgcagtgaatggcaaaggacagggtgactatagtaaaatagaaatctttcagaccctgcctgtgagggagccctccccgcctagtatccatgggcagcctagttccggcaagagcttcaagttgagcattaccaaacaggacgatgggggagcccctattctggaatatatcgtcaagtacaggagtaaggataaggaagaccaatggctcgagaagaaggtccagggaaataaggatcacattatcctcgagcatcttcagtggacaatgggatacgaggtccaaatcactgctgctaatcgcctcggctattcagagccaaccgtctatgaattctcaatgcctcctaagcctaatataattaaagacactctctttaatggcctggggcttggagcagtgataggtcttggtgtggctgctctcctgctgatcctggttgtaacagatgtgtcgtgtttcttcatccgtcaatgcgggctcctaatgtgcattacacgacgtatgtgtggcaaaaaatccggaagcagcgggaagagcaaggagctggaggagggcaaggcagcttatctgaaggatggctccaaagaacccattgttgagatgcggaccgaagacgagcgtgttaccaaccatgaagacggatcccccgtcaatgagcccaatgagactacacccctcacagagcctgagaagctgccactcaaggaagaggatggtaaagaagcccttaatccagagactattgagataaaagtcagcaacgatatcatccagagtaaggaggacgatagcaaagcttag

SEQ ID NO: 232229 - DNA, 2514 bp, Artificial Sequence
  Description of Artificial Sequence: Synthetic coding sequence
atgagcctgctactgagcttctatctcctaggacttctagtgagctctggccaggctctgttgcaggtgacgatctctctgagcaaggtagaactgagtgttggcgagagcaaatttttcacatgtaccgccattggcgaacccgagtcaatcgattggtacaatcctcagggcgagaagattatcagtacccagagggtggtggtgcagaaagaaggtgtccggagcaggttgacaatatacaacgccaacatcgaagatgccggtatttatcggtgtcaggccacagacgcaaaggggcagactcaggaggcaacagtcgtgctggaaatctatcagaagttaacttttagggaggtggtgtctccgcaggagttcaagcagggagaggacgccgaggtggtttgtagagtgtcatcttctcctgcccctgctgtgtcttggctgtaccataatgaagaagtgactacaatctcagacaatcgcttcgcaatgctcgcgaacaacaacctgcagatcctgaatatcaataaaagcgatgaaggtatttaccgttgcgaggggcgtgtggaggcccgtggcgaaatcgatttccgagatatcatcgtcatcgtcaatgtcccccctgccatcagtatgccccagaagtcctttaatgcaaccgctgaacgaggcgaggaaatgactttttcttgccgggcaagtggatcccccgaaccagctatctcatggtttcggaacggcaaactaatcgaggagaacgagaaatatattctcaaaggaagcaacaccgagctaacagtgagaaatattataaactccgacgggggaccatacgtttgtcgcgcaactaataaggcaggtgaggacgaaaagcaagcattcctacaggtttttgtgcaaccccatatcatccagctgaagaacgaaactacgtatgaaaacgggcaggtcaccctggtatgcgatgccgagggcgagccaatccctgaaataacttggaagcgggcagtggacgggtttacattcactgagggcgacaagtccctggatggacggattgaagtgaagggacagcatggctcaagctcactgcacatcaaggacgtaaagcttagcgactccgggcgttacgactgtgaggccgcaagtcggatcggtggacaccagaaaagcatgtatcttgatatagagtacgcccctaaattcatttccaatcagacgatctactacagctgggaaggaaatcctatcaatattagctgcgatgtaaaatcaaatccaccggcatctatccactggcggagagacaagctcgtgctcccggctaaaaacacaaccaacttgaaaacttattccacaggcaggaagatgatcttggagatagccccaacgtcagataatgattttggccgatataattgtaccgcgacgaatcacatcggcacccgcttccaggaatatattctggctctggccgacgtgccaagcagtccgtatggcgtgaagatcattgagttatcacagacaacagccaaagtttccttcaataaacctgactctcacggcggagttcctattcaccattatcaagtcgacgttaaagaagtggccagtgaaatttggaaaattgtgcggagccatggcgtgcaaacaatggtggtcctaaataatctagagcctaacacgacttacgagatccgagttgctgcggtcaacgggaagggccagggcgactatagcaagattgaaattttccagaccctgcctgtgagagagccgtctcccccatccatccatggccaacctagctctgggaaaagtttcaagctgtctatcacaaagcaggatgacggcggagcacctattctggagtatatcgtgaaataccggagcaaagacaaagaggatcaatggctcgaaaagaaagtccagggaaataaggatcacataattttggaacatctgcagtggacgatgggctacgaagtacagatcacagctgctaataggcttgggtatagcgagcccacggtatacgaattctccatgccacccaagcccaatatcatcaaggacacactgttcaatggccttggtctgggggcagtgatcggcctgggggtggccgctttgctgcttattctcgtggtcaccgatgtaagctgtttcttcattcgccagtgcgggctactcatgtgcatcactaggagaatgtgcgggaagaagtcagggtcttctggcaagagcaaagagctggaggaggggaaggcggcatacctcaaggatggaagcaaggaacccattgtggaaatgcggacagaagacgagagagttaccaaccatgaagatggaagcccagtaaacgagcccaacgagaccacccctctcacggagcccgaaaagttaccgctcaaggaagaggatggcaaagaggcactgaatccagagacgattgaaattaaggtcagtaatgacatcatccagtctaaggaagacgatagcaaagcctag

SEQ ID NO: 232230 - DNA, 1275 bp, Artificial Sequence
  Description of Artificial Sequence: Synthetic coding sequence
atggttcgctcagattctggcggacaagtctacttggattaccacaatagacagggtttgttcgtggattggaagtacaatgaggcactctacttggaagagggacagccggagacttattacaggaccgccctattgcaagtaacaattagcttgagtaaggtggaattaagtgtaggggagagcaagtttttcacctgtacagcaatcggtgaaccagaatccatcgactggtacaatccgcagggagagaaaattatctccactcaaagagtggttgttcaaaaggaaggagtgagaagcagactgacaatttataatgcaaacatcgaggacgcaggcatctatcggtgccaggctaccgatgcaaaaggacaaacccaggaggctacagtggtcttggagatttatcaaaaactaacatttcgggaagtggtgtctcctcaggaattcaaacagggagaagacgccgaagtggtctgccgagtcagttctagccccgcacccgctgtaagctggttgtaccataatgaagaggtcacaacgatctcggataaccggtttgcgatgctagcaaataacaatctccagatcctcaacattaataagagcgatgagggaatttatagatgtgaagggcgagtggaggccaggggcgagatagactttagggatatcatagttatcgtcaacgttccgcctgctattagtatgcctcagaaatccttcaatgcaactgctgagaggggcgaggaaatgaccttctcatgtcgcgcttccggatcacccgagccagccatctcctggtttcggaatggcaagctcatcgaggagaacgagaagtacattctgaaggggagcaacaccgagctgactgtacgtaatatcattaattctgacgggggtccttacgtgtgtcgagccactaacaaagctggtgaggacgaaaagcaagcattcctccaggtgttcgtgcagccccacattattcagctgaagaatgagaccacatacgaaaacggacaggtgaccctagtctgcgatgctgaaggagagccgatccccgaaatcacttggaaacgcgctgtcgatgggtttaccttcactgaaggtgataagagtctagatggccgtatagaggtgaaaggccagcatggctcttcctccctgcatatcaaagacgtgaaattgtctgacagtgggaggtacgactgtgaggcggcttcacgtataggcggacatcagaagtccatgtacctcgatatcgagtcctag

SEQ ID NO: 232231 - DNA, 1983 bp, Artificial Sequence
  Description of Artificial Sequence: Synthetic coding sequence
atgcaggaaaaccttcggtttgcgtcttctggcgatgacatcaagatatgggatgccagctccatgaccctggtggataagtttaaccctcacacgtctccgcacggaatttcctcaatttgctggagctccaacaacaattttctcgtcaccgcttcctcctccggtgacaagatcgtggtttcgagctgtaagtgtaaaccagttccgctattggagttagctgagggacagaagcaaacctgtgtcaatctgaactcgacgtctatgtatctagtgagtggcggtctgaataatacagtgaacatctgggatcttaaatctaagcgtgtgcaccgcagcctgaaggaccataaagaccaggtgacctgcgtgacttacaactggaatgattgctatatcgcatcgggctccttgagtggagagataattctgcattctgtcacgacaaacctgtcatctactccctttggccatggctctaatcagtccgtgcgccatctcaaatactcactatttaaaaagagcttgcttggatctgtgtcagataacggcatcgtgacattatgggacgtcaattctcaaagtccataccacaactttgattctgtgcacaaagccccagcctctggcatttgcttttctcccgtcaacgaactgcttttcgtgactattggtctggataaaagaataattctgtacgacacgagctctaaaaagctggttaaaacgctggtagccgacactcctctgacagctgttgatttcatgcccgatggcgcaacactcgccatcggtagctctcggggaaagatataccagtacgacctgagaatgctgaaatctccagtgaagactatttctgctcacaagactagcgtccagtgtatagcctttcagtactctaccgttctcacgaaatcctcactgaacaaaggctgctcgaataagcctacgactgtgaacaaacggagtgtcaatgtgaacgccgcaagtggtggtgtgcaaaactctggaatcgtgagagaggctccagccactagtattgcaaccgtgttaccgcagcccatgacttcggccatgggaaaggggaccgtagcagtccaagagaaggccggattaccaaggtctattaacaccgacacgctgagtaaggaaacagacagcggaaaaaaccaggattttagctcttttgacgatacagggaagtcaagtttgggcgatatgtttagcccaatccgggatgatgctgtggtgaataaaggctctgacgaaagcatcgggaagggcgatggctttgatttccttcctcagctgaacagcgtgttccctcccagaaaaaacccagtgacttcttctacgtcagttttacacagtagtcccctgaatgtcttcatgggcagtcccggtaaagaggagaacgagaatcgcgatttgaccgcagaaagcaaaaaaatctacatggggaagcaggagagcaaagattccttcaaacagctggccaaactagttacctcaggggctgagtctgggaacctgaatacaagtcctagttcgaatcagactcggaactccgaaaaattcgagaagcctgaaaacgagatcgaggcacagttgatctgtgaacctccaatcaatgggtcttctactccgaaccctaaaattgctagttccgtgacggccggagtcgcttccagtctgagcgagaaaattgcagattcaatcggcaataacaggcagaatgccccactcacatcgattcagatacggttcatccagaatatgatccaggaaactctagacgactttcgggaggcttgtcaccgagatattgttaacctgcaggttgaaatgatcaaacagttccatatgcaactgaacgaaatgcacagtctgctcgagagatactctgttaacgaggggctagtggctgaaattgaacgcctcagggaagagaataagcggttgcgcgcacacttctag

SEQ ID NO: 232232 - DNA, 1716 bp, Artificial Sequence
  Description of Artificial Sequence: Synthetic coding sequence
atgtacctggtgagcggcggtctcaataatactgttaatatttgggatctgaagtcaaaaagagtccaccgaagtctgaaagaccacaaggatcaagtgacatgcgttacttataattggaatgactgttatattgcttcaggatctctttccggcgagatcatcctgcactcagtaaccactaatctgagttccaccccgtttgggcacggcagtaaccagagtgtgagacacttgaaatactccctctttaaaaagtctctgctcggaagcgtgagcgacaatggcattgtgacattgtgggacgtcaattcccagtcaccatatcataattttgactcagtgcacaaggcccctgcctctgggatctgtttttccccggtgaacgagttgctgttcgtcactatcggtttagacaagcggataattctatatgacacgagctctaaaaaattggtgaagaccctcgttgcagataccccactgactgccgttgactttatgcctgacggagccactttggccattgggtctagccgagggaagatttaccagtacgatctgcgcatgctgaaatcacctgtgaagacaatcagcgcgcataaaacaagcgtgcagtgcatcgcatttcaatactccaccgtgctgacaaagagctccttaaataaagggtgttccaacaaaccaaccaccgtgaacaagagaagcgtgaatgttaacgcagcctcgggcggagtacagaatagtggcattgtacgggaggcaccagctacatccatcgctacagtgttaccacaacctatgaccagtgcgatgggcaagggcaccgtagctgtgcaggagaaagctgggctgccgaggagtattaatacagatacactgtctaaagaaacagactctggtaagaatcaggatttcagctccttcgatgacactggcaagtcaagtctcggggacatgttcagccccattcgggacgacgcagttgtcaacaaaggttcagatgagagcatcggaaagggtgacggttttgatttcctgcctcagcttaactccgtctttcctcccagaaaaaatcctgtcacctcctccacgtctgtcctccactcgtcacccctgaacgtgttcatgggctctcccggaaaagaggaaaacgagaaccgggatctcaccgccgaaagtaaaaagatctatatggggaaacaggagagcaaagactccttcaaacagctggccaaactcgtgacctccggggcagagtctgggaacctcaacacatctccaagcagtaatcagacaaggaacagcgagaagttcgaaaagccagagaatgagatcgaggcccagttgatttgcgagcccccaattaatgggtcttctactcctaatcctaaaattgcaagttcggttactgctggagtggcatccagcctttctgaaaaaatcgccgatagtatcggtaataaccggcaaaacgctccacttactagtattcagattagatttattcagaatatgatccaggagacactggacgactttcgagaggcgtgtcaccgtgatatcgtgaatctccaggttgaaatgattaagcagtttcatatgcagctgaatgaaatgcacagtctgcttgaacgctacagcgtgaacgagggtctggtggcagagattgagcgactcagggaagagaacaagcgccttcgagcccacttttag

SEQ ID NO: 232233 - DNA, 1983 bp, Artificial Sequence
  Description of Artificial Sequence: Synthetic coding sequence
atgcaggagaacttgcgctttgcgtcgtccggcgacgatatcaagatctgggacgcttcgagcatgactctggtagataaattcaacccccatactagcccccacggcatcagctcaatctgctggagttcgaacaataactttctggtaaccgcttcctcatctggcgacaaaattgtggtgtctagctgcaaatgcaaacccgtgccactgcttgagttagccgaaggacaaaaacaaacatgcgtgaaccttaactccacttcgatgtacctcgtgtctgggggtttgaacaataccgtgaacatctgggatctcaagtcaaaaagagtgcatcgctccctgaaggaccacaaagaccaggtcacatgcgttacatataattggaatgactgctatatcgcttctggatccctgtcgggcgagattatccttcactctgttaccactaacctgagcagcacaccctttggacatggctccaatcagtctgtgcggcatctaaaatactctctgttcaagaaatccttacttggatctgtatccgataatgggatcgtcacgctgtgggacgtgaattctcagagtccttaccataacttcgacagcgtccacaaagccccagcttcaggaatctgtttctctccagttaatgagctgctattcgtcacaattggcctggacaaacgcatcatcctgtatgacaccagctctaaaaagcttgtaaaaacactggtcgctgacaccccactgacggcagttgactttatgcctgatggagccacactagctatcggcagttcccggggaaagatatatcaatacgacctgagaatgttgaagtcaccagtgaaaaccatctctgcacacaagacttccgttcagtgtattgcctttcagtatagcaccgtgctgaccaaaagttctctgaataagggttgtagtaacaagcccactacagttaataagcgtagtgtgaatgtaaatgctgcaagcggaggtgtccagaatagtgggattgtcagggaagctccagctaccagtatagcaaccgtcttgccccagccaatgacaagtgccatggggaagggtaccgtagctgtgcaggagaaagctgggttaccacgctccataaacaccgatacactgagcaaagaaactgattccgggaagaatcaggatttttcgtcatttgatgatactggaaagtcatccctgggagatatgttctctcccatccgggacgatgccgtagtaaacaaagggtcagacgagtctatcggcaagggagacggttttgatttcttgccccaattaaactccgtgttcccaccacggaaaaatcccgtcaccagcagcacctcagtgttacactctagtcctctgaatgtgtttatgggcagccccggtaaagaagagaacgaaaatagagacctaactgccgagagcaagaagatctacatgggcaaacaagaatccaaggattcgtttaaacagctggctaagctcgtaactagtggagcagagtcaggtaacctgaacacatcaccttcctcgaaccagactaggaattcggaaaagtttgagaagcctgagaacgaaatcgaagctcaactgatatgcgagccgccaatcaacggctcatccaccccaaatccaaagattgcctcatctgttacagctggagttgccagctctctttccgaaaaaattgcggattccattgggaataaccgacagaacgctccgctgacgtcgattcaaattagattcattcaaaacatgattcaagagaccctagacgactttcgggaagcttgtcatagggacatcgtaaacttacaggtggagatgatcaagcagttccacatgcagctaaacgaaatgcattcactgcttgagcgatactctgtgaatgagggcctggttgccgagattgagaggctgcgcgaggagaataagagactgcgcgctcacttctag

SEQ ID NO: 232234 - DNA, 1716 bp, Artificial Sequence
  Description of Artificial Sequence: Synthetic coding sequence
atgtacctggttagtggaggtctcaataatacagtgaacatttgggacctcaagagcaaacgcgtgcatagaagtctcaaggatcataaagatcaggttacctgcgtgacttacaactggaatgactgttatattgcttctggtagtctgtcaggtgaaatcattctacattctgtgactaccaatttgtcctccactcccttcgggcacggctcaaaccagtccgtccgccacctgaaatactcactgtttaaaaaaagtctgctggggagcgtgtctgataacggcatcgtcaccctttgggatgtcaattcccaatctccataccacaattttgactctgtccacaaagccccagcaagcgggatttgtttctcccctgttaacgagctcctgttcgtgacaatcggcttggacaaaaggatcattctgtatgacacaagctcaaaaaaactggtcaaaactctcgtggccgatactcccctgaccgcggttgatttcatgcccgacggagccacacttgccatcggctcaagccgcggaaagatctatcaatatgatttgcgcatgctgaagtcacctgtgaaaaccatcagcgcccataaaacttcagtccagtgtatcgcgttccaatactccaccgtgctcaccaagtcttccctgaacaagggctgctctaacaaacctactactgtgaataagcggagcgtcaatgtgaacgctgctagtggcggagtgcaaaacagcggaattgttagagaggctcccgctacaagcatcgcaactgtgctgccgcaacccatgactagtgccatggggaagggcacagtcgcggtgcaggaaaaagctggactgcccagatccatcaacacagatacactgtccaaggagacagacagcggaaaaaaccaggactttagttcatttgacgacacaggcaagagtagcctgggtgacatgttcagtccaatcagggacgatgccgtggtaaataagggctctgatgagtctataggaaagggcgacggcttcgattttctcccacagctcaacagtgttttcccccctcgtaaaaatcccgtgacatcaagtaccagcgtcctgcattcatctcctttaaacgtcttcatgggatctccgggaaaggaggagaacgagaatagagatctcacggccgaaagcaagaagatctacatggggaaacaggagtccaaggactctttcaagcaactggccaagctggtaactagcggagctgagtctggaaacctaaatacctctccctcctcaaaccagactcgcaatagtgaaaaattcgagaaacccgagaacgagatcgaagctcaactaatttgtgagcctccaataaacggaagctctacccccaatcctaagatcgcttccagcgtgacagccggagtggctagtagcctcagcgagaaaatcgcagatagcatcggcaataaccggcagaacgccccactgacctcaatccagattcggttcatccagaatatgatccaagagacactggatgactttagggaagcctgccacagagatattgtaaatctgcaggttgaaatgattaaacaatttcatatgcagctgaacgaaatgcactctttgctagagcggtatagtgtgaatgaaggattagtcgcagagatcgagcggcttcgagaagaaaacaaacggctgagggctcatttttag

SEQ ID NO: 232235 - DNA, 483 bp, Artificial Sequence
  Description of Artificial Sequence: Synthetic coding sequence
atgtatctggtatccggagggttaaacaatacggtgaacatctgggacctcaaatcgaaacgggtgcaccggtcacttaaagatcataaagaccaggtaacctgcgtaacatataactggaatgactgctacatagcctcgggatccttatctggcgagatcattttacacagtgtgacaaccaacctgagctctaccccgtttggtcacggctctaaccaaagcgtgcggcacctcaaatattcattattcaaaaagtctcttctcgggagcgtgtctgacaatggaattgtgactctttgggacgtgaactctcagagcccatatcacaatttcgactcggtgcacaaagctcctgcttctggcatatgcttttcacccgttaatgaacttctttttgtcacaatcggcctggataagcggatcattctgtacgacacctccagcaagaaactggtcaagaccctggtggcggacacctag

SEQ ID NO: 232236 - DNA, 504 bp, Artificial Sequence
  Description of Artificial Sequence: Synthetic coding sequence
atgcatttcaccggcgcagtgatgcaggagaatttgaggttcgcgagttctggtgatgatataaaaatttgggatgcaagtagcatgaccctcgtggacaagtttaatccccataccagtcctcacggcatcagcagcatatgctggtcgtcaaacaataattttctcgtcacagcatctagctccggagacaaaatcgtagtctcatcgtgtaagtgcaagccagtccccctgttggagctggccgagggtcaaaagcagacctgcgtgaacctgaactcaacttccatgtatcttgtgtcaggagggctgaacaacacagtgaatatttgggatttgaagtctaaacgagttcaccggtctcttaaagatcataaagaccaggtgacttgtgtgacatataattggaatgactgttatattgccagtggctctctgtccggtgagattatcctgcacagcgtcacgacgaatctgtcctccacccccttcggccacggatag

SEQ ID NO: 232237 - DNA, 306 bp, Artificial Sequence
  Description of Artificial Sequence: Synthetic coding sequence
atgcaggagaatctgcggttcgcatctagtggagatgatatcaaaatctgggacgcctcatccatgaccctcgtggataagtttaatccgcacactagccctcatggcatcagttctatttgctggtcttctaataacaattttttagtgacagcatcatccagcggggacaaaatcgtggtttcttcctgcaaatgcaagccagtgccgctgctggagctggcagagggccagaagcagacctgtgttaacctgaattccaccagcatgtacctggtgtctgggggattaaacaacactgtctag

SEQ ID NO: 232238 - DNA, 498 bp, Artificial Sequence
  Description of Artificial Sequence: Synthetic coding sequence
atgcaggaaaatttgcgtttcgcctcaagcggcgatgatattaaaatatgggacgcttcttctatgaccctggtagataagtttaatcctcacacctctccccacggtatctcaagtatctgttggtccagcaataataattttttagtaacagcaagttccagcggtgataagatcgtcgtgtcgtcttgcaagtgcaagccagtcccgctgctggagctggcagagggccagaaacagacatgtgtgaacctgaacagcacctccatgtacctagtcagcggaggccttaataacaccgtgaacatctgggacctgaaaagcaagcgggtccacagaagtttgaaggaccataaagaccaggtaacgtgtgtgacctacaactggaatgattgctacatcgcgagcggttctttgtcaggcgagattattctgcactcggtcaccactaatctgagcagcactcccttcggacatgggtcgaatcagtctgtgtag

SEQ ID NO: 232239 - DNA, 2004 bp, Artificial Sequence
  Description of Artificial Sequence: Synthetic coding sequence
atgcatttcactggggctgtcatgcaggagaacctcaggttcgcgtccagcggggacgatatcaaaatctgggacgcatcttctatgacacttgttgataagttcaatccacatacatccccccacggcataagttctatttgttggtccagtaataataatttcttggttaccgcttcctcatccggggataagattgtggtttccagctgtaagtgcaagcccgtgccactcttagaactggctgagggccaaaagcagacttgcgttaatctcaatagcaccagtatgtatctagtgagcggaggtctgaataacactgtaaacatttgggacctgaaaagcaaaagagtacacagaagtctcaaggatcacaaagatcaagtcacatgtgtgacatataactggaatgattgttacattgctagcggtagcctgtccggagaaattatcttacattccgtaaccacgaatctctcgtcaactcctttcgggcatggtagcaaccagagtgtccggcatcttaagtacagtttgttcaaaaaatctctcttgggtagtgtgagcgataacggcatcgtgacactctgggatgttaactcacagtctccttaccacaattttgacagcgtccacaaggcccctgcctccggcatctgtttcagccctgttaacgaacttctctttgtgactatcggcctggataagcggattatcctctacgacaccagctccaagaaactcgtcaaaacccttgtcgccgatacgccgctcaccgcagtagattttatgcccgatggcgcaaccctcgctatcggttcatccaggggcaagatatatcaatatgatctgagaatgttgaaatcacctgtcaagaccatttcggcacacaaaacatccgtccagtgcatcgctttccagtacagtactgtattaacgaagtccagtctgaacaaaggctgcagcaataagcccacaacagtgaataaaagaagtgttaacgtgaatgccgcttcaggcggtgtccagaatagtggaattgtccgcgaagcccctgccacttctatagcgactgtactgcctcagcccatgacatctgccatgggcaagggcaccgtggccgttcaggaaaaggcgggacttccacgcagcatcaacaccgatacgctgtccaaggagaccgactcaggcaagaatcaggatttctcctcatttgacgatactgggaagagcagcctgggtgacatgttttccccaatacgggatgacgcagtggtcaataaggggtctgacgaatccattggaaaaggtgatggattcgattttctgccacagcttaattctgtgtttccccctcgaaagaacccagttacttctagcacctcagtcctgcattccagcccactgaatgtgtttatgggaagccccggtaaggaggagaacgagaaccgagacctgacggccgaatctaagaagatctatatgggaaagcaggagtccaaggacagcttcaaacagctggccaaactggtcacatcaggagccgaatcaggcaaccttaacacaagcccgtcgagtaatcagactcgcaacagcgagaaatttgagaagcctgaaaacgaaatcgaggcccagcttatctgtgagcctccaattaatggctctagtacaccgaaccctaagattgctagttctgtgacagcaggcgtagcttcttcgctctccgagaaaatcgccgactctattggaaacaatcggcagaacgcccctcttaccagcatccagattcggttcatccagaacatgatccaagagaccctagatgacttccgagaggcctgccatagagacattgtgaacctccaggttgagatgatcaagcagtttcacatgcaattgaacgagatgcactcccttcttgagcgttacagcgtgaatgaggggctggtagcagaaatagaacggctgagggaggaaaataaacgactcagagcccatttctag

SEQ ID NO: 232240 - DNA, 3744 bp, Artificial Sequence
  Description of Artificial Sequence: Synthetic coding sequence
atggcccagagcctgcggctgcacttcgccgctcggagaagcaacacctatccgctgtccgagacgtctggagatgatcttgattcacacgtacacatgtgtttcaagagacctactagaataagcacctcaaacgttgtacaaatgaaactcacccctcgccagaccgccttggctccacttatcaaggagaatgtgcagtcgcaagaaagatcaagcgtgcccagtagcgaaaacgtgaacaaaaaaagttcttgtctccaaatatcactccagcctactaggtacagtggataccttcagtccagtaatgtgctggcagactctgacgacgcatcgttcacgtgtatccttaaagatggaatttattcttcagctgttgtggacaacgaacttaatgctgttaatgacgggcatctcgtgtcatcacctgcgatatgcagtggcagcctcagcaacttctcaactagcgataatggcagttacagctctaacggctctgacttcggcagttgtgcctcaatcacatccggcggaagttacacgaacagcgttatttccgattcctccagttacaccttccctccctccgatgacacatttcttgggggaaacctcccttctgatagcacctcaaaccgatccgtccctaacaggaatactaccccgtgcgagattttttcgaggtcgacttcaacagacccttttgtccaggatgacctggagcatggactcgagataatgaaactccccgttagccggaatacaaagattcctctgaagcgatacagttctttggtgatctttccccgtagcccaagcaccacgcggccaacctcccctaccagcctgtgcaccttgctgtcaaaggggagctaccagacttctcaccagtttatcatctctccctctgaaattgcacataacgaggacggcacatcagctaaaggatttctctcaaccgcagtcaacgggcttcgactgtcaaaaaccatttgtacgcccggtgaggttagggatatccgacctttgcataggaaagggagcctgcaaaagaaaattgtgctgagcaataacactcccagacagacagtctgcgagaagagttcagaggggtatagctgtgtttccgtacactttacccagcgcaaggctgccaccctagactgtgagacgactaatggagattgcaagcccgaaatgtctgaaatcaaacttaactccgactctgaatacatcaagctgatgcatcgaacctctgcgtgcttgccgtcttcacaaaatgttgattgtcagattaacattaatggggagctagagaggccacactctcagatgaataagaaccacggtatattaaggagaagtatttctctgggcggtgcttatcctaatatttcatgtctttcctctctgaaacataattgtagcaaagggggaccttcgcagctgctcattaagtttgcaagtggcaatgaaggcaaagtagacaatctctctcgcgattccaaccgcgattgcactaacgaattgagcaacagttgcaaaccaggatgggttgtgctcgatcagcccgatgctgcctgccacctgcagcaacagcaggagccttccccgctgcctccgggatgggaggaacgacaagatattctcggccgtacttattacgtgaatcacgaatcccgcaggactcagtggaaacgacctaccccacaagataatctcacggacgctgagaacggaaacatccagcttcaggcacagcgcgcatttacaacccgtaggcagatcagcgaagagaccgagtccgtggacaatcgcgaaagcagtgaaaattgggaaattataagagaagacgaagcaacgatgtactcaaatcaggcgttcccgtcaccgccacccagcagtaacctggacgtccccactcatctggccgaggaacttaacgcacgtctcaccattttcgggaactccgcggtttctcaacccgcatctagttcaaatcattcgagccgtcgcggttcactgcaggcttacaccttcgaggagcagcctacccttcctgtgctcctgcccacctcctctggcctcccccctgggtgggaagagaaacaggacgaacggggtcggtcatattatgtggaccacaattccaggacgacaacatggaccaaacctaccgttcaagccaccgtagagacatcacagctgaccagcagtcaatcctcagcgggaccgcagagtcaggccagcacttctgactcagggcagcaggtgactcagccaagcgaaatcgagcagggtttcctacctaaagggtgggaggtgcgccacgctcccaacggcaggccattctttattgaccacaatactaagactacgacgtgggaggatccaaggctgaagattcccgcacacctcagggggaaaacttcgctcgatacgtcaaacgacttggggcctctgccgcctggatgggaggagcgaacccataccgacggaagaattttctatatcaaccacaatataaagcgcactcaatgggaagatcccagattggaaaacgtcgccataacaggccctgccgtaccgtattcccgggactataagcgcaagtacgaatttttcaggcgaaagcttaaaaagcaaaacgacatacccaacaaattcgagatgaagctgcgtagagcgactgtccttgaggatagctacagacgtataatgggcgtcaagcgcgcagacttcctaaaggcgagattatggatagagtttgacggggaaaaaggccttgactacggtggagtggctagggaatggttcttcctgatctccaaagaaatgttcaacccttattacggtctcttcgagtattcagctaccgataattacacactgcaaataaacccaaacagcggactctgcaatgaggaccacctgagctactttaagttcatcgggagagtcgctggcatggctgtgtaccacgggaagttgctcgatggcttcttcatcagacccttttataagatgatgctacacaaacccataaccctgcatgatatggagagtgtggactcagaatactacaattctttgagatggattctagagaacgatccaactgagctagacttacgattcatcattgacgaggaactcttcggccaaacccaccagcacgaactgaagaatggaggttcggaaatcgtggttacaaataagaacaaaaaagaatacatctacctcgtgatccagtggaggtttgtgaaccgaatccaaaaacagatggccgcttttaaggaaggttttttcgaacttataccacaagatttgatcaagatctttgatgagaatgagcttgagttgctaatgtgcggcctcggggatgttgatgtgaatgactggagagagcacaccaagtacaagaatggatacagcgcaaaccatcaggttatacagtggttttggaaggcagttctgatgatggattccgaaaagaggattcgattgctgcaattcgttaccgggacctctcgtgttccaatgaacgggtttgccgagttatacggaagtaatggaccacagagtttcacagtggagcagtggggtacccccgaaaagttgccgagggcccacacctgttttaaccggctcgatttgccaccttacgagagcttcgaggaactgtgggacaagctgcagatggcgatcgaaaacacacagggcttcgacggcgtggattag

SEQ ID NO: 232241 - DNA, 2703 bp, Artificial Sequence
  Description of Artificial Sequence: Synthetic coding sequence
atggccacctgtgcagtcgaagtcttcggtttgctcgaagatgaagaaaatagtagaattgtccgggttagggtcatcgctggcattggactcgcgaaaaaagatatcctcggcgcatctgacccatatgtgagggtaactctgtatgatccaatgaatggggtgctgacctccgtgcagacaaaaaccatcaagaaatccctgaaccccaaatggaatgaagagatcttgttccgggttcacccacaacaacatagactgctgttcgaggtcttcgatgaaaaccggttgactagagacgacttcctcggccaggtcgatgtacctttgtatccacttcctacagagaacccacgcctggagagaccatatacctttaaagattttgtcctccacccccgaagccacaagtcgcgcgtaaaagggtacttacgcctgaagatgacctatctgccaaaaaccagcggctcggaagatgacaatgccgagcaagcagaggaactcgaaccaggatgggtggttctggatcaacctgatgcagcctgccatctgcaacagcagcaagaaccttcccccctgccacctggctgggaagaaaggcaggacatcctcggacgaacatattatgtgaaccacgaaagccggaggactcagtggaaacgccctacaccacaggacaacttaacggacgctgaaaatggcaacatccagcttcaggcccagcgagccttcaccacaagacgacagatttccgaagagacagaaagcgttgataatagggaaagtagcgagaactgggagattatcagagaggacgaagcgactatgtacagtaatcaggcctttcctagccctccacccagctctaaccttgatgttccaacccatctcgcagaggaattaaatgccagactgacaatctttgggaattcggctgtttcacagcccgcatcatcctctaatcatagcagcagaaggggtagccttcaggcgtatacattcgaggaacagcctaccctccccgtgctacttcctacctcatcgggactgcctccgggttgggaggaaaaacaggacgagcgaggacgttcctactatgttgaccacaattcccgcacgaccacctggacaaagcccacagtgcaggccaccgtcgagacctctcaactcacatccagccagtcaagcgctgggccacagagtcaggcgtctacctccgattccgggcagcaggttacacagcccagtgaaattgagcaggggtttctcccaaaaggctgggaggtccgccatgcgcctaatgggaggcctttctttatagatcacaatactaagacgacgacttgggaagatccacggctgaaaattcccgctcacctgcgaggaaagacttctctggacacttctaacgatttaggccctctaccacccggttgggaggagagaacacacactgacggcagaattttctacattaaccataacatcaagcgaactcaatgggaagatccacgattagagaatgtggctatcacagggccagccgtgccatattcgcgagactataaacgcaagtacgagtttttccggcgaaagctgaagaagcagaatgacattcctaacaagttcgaaatgaaactgaggcgcgcaaccgtgcttgaggactcctaccggcgaattatgggggttaaacgggctgatttccttaaagctcgcctatggatcgagttcgatggcgaaaaagggctggactacggaggtgttgccagggaatggttcttcttgatcagcaaagagatgtttaatccctactacgggctgttcgagtattcagccacagacaactacactcttcagatcaaccccaactccggcctttgtaacgaggatcacctcagctattttaaatttattggcagagtggccggaatggctgtgtaccatggaaaactcctggacggattcttcatcaggccattctacaaaatgatgctgcataaacctattactcttcacgatatggagagcgtggattctgagtattacaattcccttaggtggattctcgaaaatgaccccactgaactggacctgcgctttattatcgatgaggagctgttcggtcaaacccaccaacacgaacttaagaacgggggtagcgagattgtcgtgacaaataaaaacaaaaaggagtatatttatttagttatccaatggcgctttgtgaatcgaatccagaagcaaatggccgcttttaaagaaggattctttgagctgattccacaagacttaattaaaatattcgacgagaatgaactggaactgctcatgtgtggattaggcgatgtagacgtcaatgattggcgcgaacacactaagtacaaaaacggctactccgccaaccaccaagtgatccagtggttttggaaggccgtgctgatgatggattctgagaaaagaatccgtctgcttcagttcgtgaccggtacaagtcgagtgcccatgaacggttttgccgagctctatggatctaacggccctcagtccttcacagttgagcagtgggggactccagaaaaattaccccgtgctcatacatgctttaacaggctggatctgccaccctacgagtcatttgaggaattatgggacaagctgcagatggccattgagaacacccaggggttcgatggtgttgactag

SEQ ID NO: 232242 - DNA, 3912 bp, Artificial Sequence
  Description of Artificial Sequence: Synthetic coding sequence
atggcccaaagcctccgcctgcacttcgcggctcgtcgtagcaacacataccccctgagcgaaacaagcggtgatgatcttgactcacatgtgcacatgtgtttcaagcgtcctacaagaatctcaaccagtaacgtggtgcaaatgaaactgacccctcgccagacagccctcgcccctctcatcaaggagaatgtccaatcccaggagcgaagctcagtgccttcttccgaaaacgtgaataaaaagtcctcatgcctacagatctctctgcaaccaacccgctacagtgggtatcttcagtcgagtaatgtgctcgctgattccgacgatgcgtctttcacttgcattctaaaggatgggatatactcctcggccgtggtcgataatgagttgaacgcagtgaacgacggacacctagtctcatcccctgccatttgcagcggcagcctgagtaacttctcgacctccgacaatgggagctattcaagtaatgggtccgacttcgggagttgtgccagtatcacttcgggtgggtcatatacaaattccgtgatcagcgacagttcatcttatacttttcccccttccgatgatacgtttctagggggaaatctgccttccgactctacatcgaaccgcagcgtacccaatcgtaatacaactccatgcgaaattttttcacgtagcaccagcacagatccatttgtccaagatgatctggaacacggcctcgagattatgaagctccccgtcagtcggaacaccaaaatccctctcaaacggtactcatccctggtgatctttcccagaagtccctccacgacacgcccaacatctcccacaagcctgtgtaccctgctctccaaaggttcttatcaaacatcacatcaattcatcatttcgccctctgaaatcgcccataatgaagacggcacctctgccaaggggttcctgagtaccgcagtgaacggccttagactgtctaagactatttgcacaccgggtgaagtgcgagatattcggccattgcatcggaagggctcactccagaaaaagattgtgctatcaaacaacacaccacgccagacagtgtgcgagaaatcctccgagggttattcttgcgtatccgtccacttcacccagaggaaagccgcaacactcgattgtgagactacaaatggcgactgtaagcccgaaatgtcggaaatcaagttgaatagcgactcggagtatattaaactgatgcaccggacttccgcttgcctgccttcaagccagaacgtcgactgccaaatcaacatcaatggggaacttgagagaccccattcccagatgaataaaaatcacggcatactccgcaggtctatatctctgggcggtgcgtaccccaacatctcttgccttagctccttgaaacacaattgtagcaaggggggtccttctcaactcctgattaagtttgctagcgggaacgaggggaaggttgataacctcagtagggactccaatcgcgattgtaccaacgagctaagtaactcctgcaaaactcgcgatgattttcttggccaggtggacgttccactctaccccctgccaacagaaaatcccagactcgagcgcccatacacttttaaagacttcgtgttacaccccagaagccataaaagcagggttaaaggatacctgcgcctgaagatgacatacctccctaagacgtctgggtcggaggatgacaatgctgagcaggccgaggagctcgagcagcaacaggagccttcacccctgcctcccggttgggaggagcgccaggacattttaggcaggacatattatgtgaatcatgaatcccggaggacgcagtggaaacgcccaactccacaggacaacctaactgacgcagagaacgggaatatacagttgcaggcgcagcgtgccttcaccactcgccgtcagatctcagaggaaactgagtccgttgacaaccgcgagagctcagagaattgggagatcatccgagaggatgaggcaactatgtactctaatcaggcattcccttcccccccaccatcctctaatctggacgtccctacgcacctggccgaggagctgaacgcacgccttacaatcttcggcaacagtgccgtctcccaacccgcttcatcatcgaatcacagtagtagaagaggctcactacaggcatatacattcgaggagcagccgacgctgccagtgctgcttcccacaagctctggcttgccaccaggatgggaggagaagcaggacgaacggggaagatcatattacgtggatcataactcccgtacaaccacttggacgaagcccacggtgcaggctactgtggagacaagccagttgacctcctctcagtcctcagcagggccacagagtcaggcaagcacctctgactctggacagcaggtgacgcaaccgtccgaaattgagcaggggttcttgcctaaaggttgggaggtaagacacgcaccgaacggccgtcctttctttattgatcacaacacgaaaaccactacctgggaggaccccaggcttaaaattccagctcaccttcgtgggaagacttccttggacacttcaaacgacctcggcccacttcctcctggctgggaggaaaggacacacaccgacggccgtattttttatataaaccataatatcaaaaggacacaatgggaggacccaagactggagaacgtcgccattacagggcctgcagtcccatactccagggattacaagagaaaatacgaatttttccggagaaagctgaaaaagcagaatgatatccctaataagtttgagatgaagctccggagggctactgtgttagaagattcatacaggcgtataatgggggtgaagcgcgcagacttcctgaaagccaggctgtggatagagtttgacggagaaaagggactggactatggcggagtcgctcgcgagtggttcttcctgatctccaaagaaatgttcaatccatactacggactgttcgagtactcagctactgataactacacattacaaattaaccccaattccggcctttgtaatgaagaccatctttcgtactttaagtttatcggccgtgttgcaggcatggccgtctaccacgggaagctactggacggattctttattcgcccattctataaaatgatgctccacaaacccatcactctacacgacatggaaagtgtggacagcgaatactataattcacttaggtggatattagagaatgacccaacggagctggatctcaggttcatcatcgatgaggaactttttggacagacgcatcagcacgagttaaagaatggagggtcagaaatagtggtgactaacaagaacaagaaggaatatatttatcttgtgatccagtggcgattcgtcaaccgtatccagaagcagatggccgcttttaaagagggcttctttgagctgatccctcaggacctgatcaagatttttgacgagaacgaactcgagttgctcatgtgcggattgggagatgtagatgtgaacgattggagggaacatacaaagtacaaaaacggctactctgccaaccaccaggtcatccagtggttttggaaggctgtgctcatgatggatagcgaaaagaggatcagactacttcaattcgttacaggtacttcacgcgttcccatgaacggatttgcagaactctacggctccaacggacctcagtcatttaccgtggagcagtggggtaccccagaaaagctcccgagagctcatacttgctttaacaggctagacttgccaccctacgaatcctttgaggagctatgggacaagctgcagatggccatagaaaatactcagggcttcgacggagtggattag

SEQ ID NO: 232243 - DNA, 3960 bp, Artificial Sequence
  Description of Artificial Sequence: Synthetic coding sequence
atggctcagagcctgaggttacattttgccgctcgtcgctcaaatacgtaccctctgagtgaaacctcaggtgatgacctcgacagtcacgtgcacatgtgtttcaagcggcctaccaggattagtacatcaaacgtggtgcagatgaaactcacacccagacagacggcactagcacctttgatcaaggagaacgtgcaatctcaggagcggtcaagcgtcccatccagtgagaacgtcaacaagaagtcctcatgtctccagataagcctccaacctacaaggtatagcggctacctgcagtccagcaacgtgctggcagacagtgacgacgcatcttttacttgtatactgaaggacggcatctactcgtctgcggtggtggacaacgaactgaacgctgtgaatgacggccacctcgtgtctagccccgctatctgtagcggatcactgagcaacttcagtacttcagacaacggatcctattcttcaaacgggtcagacttcggaagctgcgcaagcatcacatctgggggatcctacactaactccgtgatatccgattcatctagttatacatttccaccaagtgacgacacatttctcgggggtaatcttccaagcgactcaacctctaacaggagcgtgccaaataggaacacaaccccctgcgaaatcttctccaggagtacgagcaccgatcccttcgtacaggacgatctcgagcatgggctcgagatcatgaaactgccggtctctaggaacactaaaatccccctgaagagatacagctctctggtcattttccctcgctcccctagtacgacaaggccaaccagccctacttctctgtgcacccttctgtcaaagggatcctaccagacctcgcatcaattcataatatccccttccgagatcgcccacaatgaagacgggacatccgctaaggggttcctgagcaccgccgtcaacggattgcggctctctaagaccatctgcacccccggtgaggtccgggacatccgccctctgcatcgcaaagggtctttgcagaagaagatcgtgctgtctaacaatactccccgtcagactgtgtgcgagaagagtagcgagggatactcatgcgtttctgtccattttactcaaagaaaagctgcaacacttgactgcgaaaccaccaacggtgattgcaaaccagagatgtctgagataaaacttaactcagacagcgagtatatcaaactgatgcaccggactagcgcctgtctgccatcctcccagaatgtcgactgtcagattaacatcaatggcgaactggaacggcctcacagtcaaatgaataagaatcacggcatccttcgacgaagtattagcttgggtggtgcttatccaaatatttcctgcctgagctccttaaaacataactgtagtaaggggggacctagtcagttgttgatcaaattcgccagcgggaacgaggggaaggtggacaacctaagccgcgactcaaatagggactgcaccaatgagctgtctaatagctgcaagacccgggacgattttttggggcaggtcgacgtacccttataccccttacctactgagaatcccagactcgagcgcccatatacattcaaggacttcgtgctccatccacggagtcataagtcccgggtgaaaggctatctgcgactcaaaatgacttacttgcctaaaacttccggaagtgaggacgataacgccgaacaggcagaggagctggagcctgggtgggtcgtgctggatcagcctgacgccgcatgccacctccagcagcagcaggaaccatctccactgccacccggttgggaggagcgacaggacatcctcggccgtacctattatgtgaaccacgaaagtcgacggacacaatggaaaaggcctacccctcaggataatctcactgatgcagaaaacggcaacatccagttgcaggcgcagcgagcgtttactactcgcaggcaaataagtgaagagacggaatccgtcgacaaccgggagagttccgagaattgggaaattataagagaggatgaggccaccatgtatagcaatcaggccttcccctcgccccctccatcctccaatctagatgtgcccacccacctagctgaggaactcaacgccaggcttaccatatttggaaacagcgctgttagtcagccagcctcctctagcaatcattcatctcgtcgaggatcgctgcaggcttacacattcgaagaacagcccacgttgcccgtacttctgcctacttcttcgggcctcccgcctgggtgggaagagaaacaggacgaaagaggtagatcatattatgtggatcacaatagccgtacgactacatggaccaaaccaacagtccaagccaccgttgagacgagccaactgaccagcagccagtcttctgctggaccgcagagtcaagctagcacttccgacagtggccagcaggtaacacagccgtccgaaatcgagcagggcttcctgcccaagggatgggaggtgcggcatgctcctaacggaagacctttctttatcgaccataataccaagaccaccacctgggaggatcctcggctgaagattccagcacaccttcgaggaaagacttccttggacacttctaacgacttgggccctctgccgcctggctgggaggagaggacgcacaccgatggtaggatcttctacattaaccacaacattaagcggacacagtgggaagacccgagattggaaaatgttgctatcaccggcccagctgttccctactctagagattacaagcgcaagtatgaattcttccgtcgaaaactgaagaagcaaaatgatattcccaacaagtttgaaatgaagctgagaagagctactgtactagaagactcctaccgccgaatcatgggcgtaaagagggccgattttctgaaggctaggctgtggatagaatttgacggcgaaaaaggcctggactatggtggcgtagctagggaatggtttttcctgatttccaaggaaatgtttaacccttattacggtctatttgaatatagcgccacggataactatacgctgcagatcaaccctaactccggactttgcaacgaggatcatctgagctacttcaaattcattggcagagtcgccggaatggccgtttaccatgggaaactgctggatggctttttcatcagacccttttacaagatgatgctccataagcccataacattgcacgacatggagtcagtggattccgaatactataatagcctccgctggattctagagaatgatcctactgagctggacctgcgattcataatcgatgaggagttattcggacagacccaccaacacgagctaaagaacggcggttcggagattgttgtgaccaataagaataaaaaggaatacatctatcttgtcattcaatggagattcgtaaatagaattcagaagcagatggcagcatttaaggaagggttcttcgagctgataccccaggacctgatcaaaatctttgatgagaacgaattggaattgctaatgtgcggcctgggcgacgttgatgtgaatgactggagggagcataccaaatacaaaaacggatattcagcaaaccaccaggttatccagtggttctggaaggcggtgctcatgatggacagtgaaaagagaatccgtctgctccagtttgtgacgggaacttctcgggttcccatgaatggctttgccgagctgtatggttccaatgggccacagtcttttacggtcgaacagtggggcacacccgaaaaactgcccagggcccacacctgctttaaccggctcgacctgcctccttacgagagcttcgaggaactgtgggacaaactgcagatggccattgagaacactcagggattcgacggcgtcgactag

SEQ ID NO: 232244 - DNA, 2616 bp, Artificial Sequence
  Description of Artificial Sequence: Synthetic coding sequence
atggccactggcctgggcgagccagtttatggtctatcagaagacgagggagaaagcagaattctgcgagttaaagtagtgagcgggattgacttggccaagaaagatattttcggagccagcgatccttacgtcaaattgagtctctacgtcgctgacgaaaaccgcgagctggctctggtgcagactaagaccatcaaaaagaccctgaaccctaagtggaacgaggaattctactttcgcgtcaaccctagcaaccaccggctcttgtttgaagtgtttgacgagaacaggctcacaagagatgacttcctaggccaggtggacgttcctctcagccatctgccgaccgaagatcccacaatggagcgaccttacacattcaaagactttctcctgaggcctagaagtcataagtctcgcgttaagggttttctgaggctcaaaatggcttacatgccaaagaatgggggacaggacgaggagaactcagaccaacgcgacgatatggagcacggatgggaggtcgttgactccaatgatagtgcctcacagcaccaggaggagctgcccccacctcctctgccaccgggttgggaagaaaaagtggacaacttggggcgtacgtactacgtgaaccataataacagaacaacgcagtggcataggcctagcctcatggatgtaagttctgaaagcgataacaatatccgtcaaattaatcaggaggccgctcataggcgctttcgttcccgcagacatatcagcgaggatcttgagccagagcccagtgagggaggagatgtcccagagccctgggagacaataagcgaggaagtgaatattgcaggagattctctcggtctggcacttcctcctccccctgcttctccaggatcccgcacatctccccaggagcttagtgaggagctctcgaggcgcctccagataactcctgactctaacggtgagcaattctcttccctaattcaaagggaaccgagcagccgtctgaggagttgtagtgtgacagacgctgtagcggagcaggggcacctgccaccaggcgctaaggattctcccgttaggcgagccgtgaaggacacactttccaatcctcagtccccacagccttcaccttacaactcacctaagcctcagcataaagtgacacagtcctttctgcctcctggatgggagatgaggatagcacctaatggccgacctttctttatagatcacaacaccaaaacaactacgtgggaagacccacggctgaagtttcccgtgcacatgcgatccaagacgtccctgaaccctaacgacttgggcccattgccacctggttgggaagagaggattcatctggatggtcgaactttttatatcgatcataactcaaaaatcacacagtgggaagaccctcggctacagaacccagccatcaccgggccagctgttccatattctagggagttcaagcaaaaatacgactattttagaaaaaaactgaaaaagcccgctgacattcccaacaggttcgaaatgaagcttcataggaataacatctttgaagagagctaccggaggataatgtcggttaagagaccagacgtactcaaggccaggctctggatcgagttcgaaagcgaaaaaggcctggattacgggggagtcgctagagaatggttctttctgctgtccaaggagatgtttaacccctactatgggctgttcgagtacagcgcaactgataactacaccttgcaaataaacccaaacagcggcctgtgtaatgaagatcatctttcctattttacgttcatcggtcgagtggcaggtctggcagtcttccatggcaagctgcttgacgggttttttatcagacccttttataagatgatgctgggaaaacaaattaccttaaatgatatggaaagtgtagactcagagtactataattccctgaagtggatcttggaaaacgatcctaccgagcttgacttgatgttctgtatcgatgaagagaacttcggccagacatatcaggtggacttgaagcctaacgggtcggagataatggtcaccaatgagaacaagcgggagtatatagacctggtgatccagtggagattcgtcaaccgggttcagaagcagatgaatgcattcctggagggattcaccgagctgctgcctatcgacctgattaaaatattcgatgagaatgagctggaactgctgatgtgcggactcggggacgtggacgtcaacgactggcgtcaacatagcatatacaagaatggatactgcccaaatcatccggttatacagtggttttggaaggcagtgttgctgatggatgctgaaaagcgaattagattgctacaatttgtgacaggcacctctcgcgtgcccatgaacgggttcgctgagttgtatgggagcaacgggcctcaactgttcactattgagcagtggggatcgcctgaaaagctacctcgagcacacacatgtttcaacaggctagatttgcccccatacgagacgtttgaggatttacgcgaaaagcttctgatggcagtggagaatgctcagggttttgagggtgttgactag

SEQ ID NO: 232245 - DNA, 2508 bp, Artificial Sequence
  Description of Artificial Sequence: Synthetic coding sequence
atggagcggccatacacatttaaggacttcttgcttagacctcgttctcacaagagtagagtcaaagggtttctcaggctgaagatggcttatatgcctaagaacggcggacaggacgaagaaaattctgaccagcgcgatgacatggaacatggctgggaggtggtcgactctaacgattccgctagtcaacaccaagaggaactgcctcctccacctttgccaccgggatgggaagaaaaagttgataatctcggcaggacatactatgtgaatcacaataaccggaccacacagtggcacaggccaagtctgatggacgtatccagcgagagcgataacaatatccggcagataaaccaggaagccgcacatagaagattccgctcaaggcggcatataagcgaagatctggagccggagccctctgaaggaggagatgtgccagaaccctgggaaacaattagcgaagaagtcaatattgctggcgacagcctggggttagctctacccccaccaccggctagccccggttcccgcacttcaccgcaggaactcagtgaagaattgtcccgcagactgcagatcacacctgatagcaacggagagcagttctcatctctgatccagagagaaccttcctctcggcttcgcagctgttctgtgaccgacgccgtcgccgagcaaggccatcttccgcctcctagcgtagcctacgtccataccactcctggactcccttcaggctgggaagagcgaaaggacgccaaggggaggacctactatgtgaatcacaacaacaggacaacaacctggacacgacctattatgcagctggccgaggatggggctagtggaagtgcaacaaacagcaataatcatcttatcgagccccagatacggaggccccgaagtctcagttctcccacagttaccctttcagctccactggaaggagccaaagatagccccgttcgccgagccgtcaaggacacactgtccaacccccaaagtcctcagccctccccttacaactctcctaagccccaacataaagtcacccagtcattcctgcccccaggatgggagatgagaatcgcccctaatggcagacccttctttatcgatcacaataccaagacgacaacctgggaagaccctcgactcaagttccccgtccacatgcgctccaaaacctcactgaaccctaatgacttggggcctctaccgccagggtgggaggagagaatccatcttgatggtagaacgttttacatcgaccacaactctaaaatcacccagtgggaagaccctcgcctgcaaaaccctgccatcacaggcccaaaggcagtgccctactctcgggagttcaagcagaagtacgattacttccggaaaaagttgaaaaaaccagccgatatccccaatagatttgagatgaagctgcaccggaacaacatatttgaagagtcttatagacggatcatgagtgtgaaacgacccgacgttctgaaggccagactttggatcgaattcgaatccgaaaaaggattggattacgggggagttgccagagaatggttctttttactgtccaaggagatgttcaacccttactacggtctgtttgagtattcggctaccgacaactacacactgcagattaatccaaattccggactgtgcaacgaagaccatctctcgtattttacgttcatcggacgggttgccggactggcagttttccacggtaaattactcgacggctttttcattcgacctttctataaaatgatgctcggcaaacagataaccctcaacgatatggaatccgtagattccgagtattataactcgctaaaatggattctggaaaatgaccccacggaactggacttgatgttttgcattgatgaggagaatttcggtcagacttaccaggtggacctgaaacccaacggatcagagatcatggtgacgaacgagaacaagagagagtatatagacttagttatacagtggcgattcgttaatagagtgcagaagcagatgaacgccttcctagaaggattcaccgagctcttgcccatcgatctcatcaaaatctttgatgagaacgagttggaactgctcatgtgtggccttggcgacgtcgatgtgaacgattggaggcaacatagcatttataagaatgggtactgtcctaatcacccagtcatccagtggttttggaaagcagtgctccttatggacgccgaaaagcgaatccgcctgctgcaattcgtgaccggtacatcccgggtgcctatgaacgggttcgccgaactgtatggtagcaacggaccacagctcttcactatcgagcaatggggctcacctgaaaagttgccaagggcgcacacatgctttaaccgactggacctccccccttatgagacctttgaggacttaagagagaaactgctgatggcggtggaaaatgcccaaggcttcgagggcgtagactag

SEQ ID NO: 232246 - DNA, 2736 bp, Artificial Sequence
  Description of Artificial Sequence: Synthetic coding sequence
atggccactggcctcggtgaaccagtgtacggtttatcagaagacgaaggtgaatctagaatcctccgtgtgaaagtagtgtccgggatcgacctggccaagaaggacatcttcggcgcttccgacccctacgtcaagctgagcctctacgtcgcagacgagaaccgggaattagcgctcgtgcagaccaagacaattaagaaaactctaaatcccaagtggaatgaggagttctatttcagggtgaatccatccaaccacaggctactgttcgaggttttcgacgaaaatcgattgacaagggatgatttcttgggacaagttgatgtcccgctctcgcatctgcccaccgaagatcccacaatggagcgcccttacactttcaaagatttcctgctgcgcccaaggagtcataaatctcgtgttaaaggttttctccgactgaaaatggcctacatgcccaagaacggcggtcaggacgaagagaattcagaccagagagacgacatggagcacggctgggaagtcgtagattctaatgactctgccagtcaacaccaggaggaactgcctccccctcctctgccgcctggttgggaggaaaaggtcgataacctggggagaacatattatgtcaaccataacaaccgcaccacgcagtggcaccgtccatcccttatggatgtcagttccgagagtgataacaatatccgtcagattaaccaggaagctgcgcatcgtcggtttcgatcaagaagacatatcagtgaagatctggagccagagccctcggagggcggtgacgtacctgagccctgggaaactatcagcgaagaggtgaatattgctggtgatagcctaggcctggcactgccccctcctcccgcaagccccggatcccgcacgtctcctcaggagctgagcgaggaactctccagacgcctgcaaatcaccccagattccaacggcgagcaattctctagccttatacaaagggaacccagcagtagactgagaagttgttcggttaccgacgcagtggctgagcagggacatctgcccccacttgccgaggacggagcctcaggctctgcgaccaacagtaacaaccacctcatcgaaccccagatccgcagacctcggagtttgtcaagtcccacagtgaccttatcagcgccactagaaggggcaaaggattcaccagttcgccgtgccgtcaaggacacactctctaacccacagagtccacaaccgtcaccctacaattcccccaaaccacagcacaaggtcacccaatccttcctgccacccggatgggagatgaggattgcgcctaatggtcggccatttttcatcgatcacaataccaagactaccacctgggaggaccccagactaaagtttcctgtgcacatgcgctcgaagacgtcattaaatcctaacgaccttggaccactccctccgggatgggaggagcgcattcatctcgatggacgcacgttctacattgaccataattccaaaattacccagtgggaggacccacggctgcagaaccccgcaattaccggccctgcagtgccatactcccgggaattcaaacagaaatatgactacttcagaaagaaactcaagaaacccgcagacattccaaaccggtttgagatgaaactgcatcgaaataacatttttgaggaaagttaccggaggatcatgtccgttaaacgaccggatgtgctgaaggcccgattgtggatagaatttgaatccgaaaaaggactggactacggcggtgttgcacgtgagtggttctttcttctgtcaaaggagatgtttaatccctactacggactttttgagtactctgccactgacaattataccctgcagattaacccaaacagtgggctttgtaacgaggatcatctgagctacttcacgtttattggccgtgtggctggattggcagtgtttcacgggaagctgcttgacggcttctttatcaggccattctataagatgatgttgggcaagcagattaccctgaacgatatggagtcagtggactccgagtactacaactcacttaagtggatacttgagaacgatccaacagagctcgaccttatgttctgcattgatgaagagaacttcggacagacctaccaggttgatctaaagccgaatggaagtgagatcatggtgacgaatgaaaacaagagggagtatattgacttggtgatccagtggagattcgtgaaccgggttcagaaacagatgaacgccttccttgagggctttacagagctcttgccaatagatcttatcaaaatttttgatgagaacgaattggaacttcttatgtgcgggttgggagacgtggacgtgaatgactggagacagcacagtatctataagaacggttactgcccaaatcaccccgtgattcagtggttttggaaggctgtgctgctgatggatgcagagaagaggatccggctgcttcagttcgtgacaggaacctcgcgagtccctatgaacggctttgccgaactgtatggctccaatgggcctcagctgtttaccattgagcagtggggtagccccgagaagttgcccagagcccatacgtgttttaatcgtctggacctgccaccttatgagaccttcgaagatctgcgagagaaattgctgatggctgtggaaaatgcccagggtttcgagggcgtggattag

SEQ ID NO: 232247 - DNA, 2904 bp, Artificial Sequence
  Description of Artificial Sequence: Synthetic coding sequence
atgaggcgccttgccttcgagcaaggagagagtagaattctgcgcgtgaaggtggtttcgggaattgatcttgcaaagaaagatatctttggcgcaagcgacccctacgtgaagctcagtctgtacgtagccgatgagaatcgtgagctggccctggtgcagaccaagactattaaaaagacactcaaccccaagtggaacgaggagttttatttccgggttaaccccagcaaccataggctcctgtttgaggtctttgatgagaataggttgacacgcgatgacttccttggccaagtcgacgtgccactctcacacttacccaccgaagatcctacaatggagagaccatataccttcaaggattttctcttacggccacggtcccacaagtctcgcgtgaaagggtttctcaggctgaagatggcttacatgccaaagaacggcggacaggacgaagaaaactcagatcagcgcgatgacatggagcacggctgggaagtggtggactcaaacgattcagcgagtcagcatcaggaggaactccccccaccccctttgcctcctgggtgggaggagaaggtcgataacctcggcagaacctattacgtgaaccacaacaatagaacaacgcagtggcacagaccgtcattaatggatgtctcttctgaatcagataataacattcgccaaatcaaccaagaggccgctcatcgcagattcaggtcaagacgccacatctccgaggacctagaacccgagcccagcgaaggtggggatgtccctgaaccttgggagactatctccgaagaagtaaatatcgccggtgactctctaggcctggcactgccaccacctccggcatctcccggatcacgtacatcaccccaggaactaagcgaggagctaagccgacgcctacaaattaccccagactctaatggtgaacaattcagtagtttgattcagagggagcctagcagccgacttaggtcttgttcagtgaccgacgccgtagcagaacaggggcacctgccgcctcccagtgccccagcaggtagggcacgctccagcaccgtaacaggcggtgaagagcccaccccgtcagtggcctatgtacacaccacacccggactgccttctggctgggaggagagaaaggacgcaaaaggccgtacatattacgttaatcataacaacagaaccactacctggacacggccaataatgcaactcgccgaagatggagccagcggcagtgccaccaactctaataaccacctcatcgagcctcagatacgacgtccacggagtctgtcttcccctaccgtcacattgagtgccccactggaaggcgctaaagatagtcccgtccgcagagcagtcaaagacaccctgtccaacccacagtcaccccagccttctccatataattctcccaagcctcagcacaaagtaacacagtccttcctgcctccaggatgggaaatgcggatcgctcctaacgggcgacccttttttattgatcacaacacaaagaccactacctgggaagatcctcgcctgaaattccccgtccatatgcgctctaaaacgtctctgaacccaaatgatctagggcctttaccccctgggtgggaggagcgcatccatctggacggacgcacgttttatattgaccacaattcgaagattacgcagtgggaagaccccagactccagaatccagctattactggccctgccgtgccctactcccgggaattcaagcagaagtatgactacttcagaaagaagctaaagaaaccggctgacatacccaatcgcttcgaaatgaagctgcacagaaacaacatcttcgaggagtcataccgtagaattatgtccgtgaagaggccagatgtgttgaaagcccgactttggattgagttcgagtccgagaagggactggactatggtggtgttgcgcgagaatggttcttcctgctgtctaaggaaatgttcaacccctactatggcctgttcgaatacagtgcaaccgacaactataccctccagatcaatcccaacagtggtctgtgcaacgaggaccacctcagctattttacgtttattggaagggttgcgggtttggctgtgttccacgggaaactgctggacggcttctttatccggccattctacaaaatgatgctgggcaagcagatcaccttgaacgacatggagagtgtggacagcgagtattacaattctctgaagtggatcctggagaatgatccaacagaattggatctgatgttttgtatcgatgaagaaaattttgggcagacataccaggtggatctcaagcccaatggcagtgaaatcatggtgacgaatgagaacaagcgggagtatattgatcttgtgatccaatggcgctttgtgaaccgcgtccagaagcagatgaatgcttttctcgaaggattcactgagctccttccgatcgatctcatcaagatcttcgatgagaacgagctagagttgctcatgtgcggactgggcgatgtggatgtgaatgattggcgccagcacagtatatataagaatggatactgtcccaatcacccggtcatccagtggttctggaaagcagtgttgcttatggacgctgagaagagaatcaggctcttacaatttgtaactgggactagccgcgtgcctatgaacggcttcgcggagttatatggcagtaatggtccacagctcttcaccattgaacagtgggggagcccggagaagctccccagggcacatacttgttttaatagactggacctgccgccatatgaaacttttgaagacctccgcgagaagttgctcatggcggttgagaacgcacagggttttgagggcgttgactag

SEQ ID NO: 232248 - DNA, 2868 bp, Artificial Sequence
  Description of Artificial Sequence: Synthetic coding sequence
atggccacagggcttggtgagcctgtctacggactatctgaagacgaaggggaatctcgaatcctgcgcgttaaggtggtcagtggcatcgaccttgctaagaaggacatttttggcgcaagcgatccctacgtgaaactgtctttgtatgtcgccgatgagaacagagaattggctctcgtgcagacgaaaacgatcaagaaaacccttaatcccaaatggaacgaagaattctatttccgcgttaacccctctaaccatcgactgctgttcgaagtgtttgatgaaaaccggctcactagggatgatttccttggtcaagtggatgttccactgtcccaccttcccacagaggacccaactatggagaggccctatactttcaaagacttccttctccgcccacggagccacaagagtcgggtgaaaggctttctccggctcaaaatggcctacatgccgaagaacggcggtcaggatgaggaaaatagcgatcagcgcgacgacatggagcacggctgggaagtcgtcgatagtaacgactccgcttcacagcaccaggaagaactgccacccccaccgctgcccccaggctgggaggagaaggtggataacctggggcgtacctactacgtgaatcataataatcgcaccactcagtggcacaggcctagcctgatggacgtgagctccgagtccgataataacataagacagatcaatcaggaagcagcccaccgcagatttaggtctaggagacacatcagtgaggatttggagcccgagccgtctgaaggaggtgatgttcccgaaccttgggaaacgatttcagaggaagtgaacatcgccggagactccctcggcttagctttgcccccacctccggctagtcctggatccagaaccagtccgcaggaactaagcgaggagctgtcccggagattgcaaattactccagattctaacggtgaacagttctcttcacttattcagcgagaaccgtctagtcgactcagatcatgttccgtgactgacgccgttgcagagcagggccatctgccaccccctagtgttgcatatgtgcatacgactcccggattaccgtccgggtgggaggaacggaaagatgccaaaggccgtacctactatgttaatcataataaccggaccacaacatggacacgaccgatcatgcaactggcagaggatggggcttctggatccgctacaaattccaataaccatttaatcgaacctcagatccgcaggccacggtctctcagctcccccactgtgactctcagcgcccctctggaaggggcaaaggacagccctgtgagacgcgcagtgaaggatacactcagcaatccacagtcgccccagccttctccatacaatagccccaagcctcagcataaagtaacccagagtttcctccctccaggatgggagatgaggattgcaccaaacggacgccctttctttatcgaccataacacaaagacaacgacgtgggaggaccccagactgaagtttccagtgcatatgaggagtaagacaagcctcaatccaaatgatttggggccacttcctcctggttgggaagaaaggatacatttggatgggagaacattctacatagaccacaactcaaaaataacccagtgggaagacccgcgtctgcagaacccagccattaccggtcctgccgtcccctatagcagggagttcaaacaaaaatacgattactttagaaagaaactgaagaagcccgcagatatccctaatcgctttgaaatgaagctgcacagaaataatatctttgaggaatcatacagacgcattatgtccgttaaaaggcccgatgtgctcaaagcccgtctttggatcgaattcgagtccgagaaaggtctggattatggaggtgtcgccagagaatggttctttttattatcaaaagaaatgtttaacccttattacggcttgttcgaatacagcgcgaccgataactataccctccagataaatccaaacagtggcctttgcaatgaagaccacctctcttatttcacgtttatagggcgtgtggccggtcttgcagtgtttcatgggaaacttctcgacgggttttttatacgtccattctataagatgatgctggggaaacagattacacttaatgacatggagtcggttgactcagagtactataattccctcaagtggatcctggaaaacgaccctaccgagctggacctcatgttttgcatagacgaagaaaattttgggcagacatatcaggtcgacttaaaacccaatggatcagagattatggttacgaatgaaaataagcgggagtacatcgatctggtgattcagtggcgtttcgtgaatcgcgtacagaaacaaatgaacgcgttcttagaggggtttacagaactacttcctattgacctcatcaagatcttcgacgaaaacgagctagaactcctgatgtgtggactaggcgatgtagacgtgaatgactggcggcagcacagcatatacaaaaacgggtattgccctaaccatccggtcatccaatggttttggaaggccgtgctgctaatggacgcagaaaagagaatcaggctactccagttcgtgacaggtacaagtagagtacctatgaatggttttgctgaactgtatggcagcaatggaccacaactgttcacgatagaacagtggggaagccccgagaaacttcccagggcccacacttgttttaaccggctagatttgcctccgtacgaaacttttgaggatctccgggagaagctactcatggcggtggaaaatgcccagggatttgagggtgtagattag

SEQ ID NO: 232249 - DNA, 2928 bp, Artificial Sequence
  Description of Artificial Sequence: Synthetic coding sequence
atggcaacaggtctgggcgagcctgtgtatggcttgtcagaagacgagggtgagtcaaggatcctccgtgtgaaggttgtgtcgggcatcgacttggctaaaaaggatattttcggtgcctctgatccatatgttaaactgtctctgtatgttgcagatgagaacagggagttagccttggtgcagaccaagacgatcaaaaagaccttaaaccctaagtggaacgaggagttttatttcagagtaaatccttctaaccacaggctgctgtttgaagtgtttgatgagaataggctcaccagagacgacttcctgggccaagttgacgtgccgctaagccatctgcccacagaagacccaacgatggagcgcccttacaccttcaaagacttcttgctgcgtccgagaagccataaatctcgtgttaagggattcctacgcctaaaaatggcttacatgccgaagaatgggggacaggacgaagagaacagcgaccaacgggatgacatggagcatggctgggaagtcgtcgacagtaacgatagtgcctcacagcaccaagaggagctgcccccaccgccactccctcccggatgggaggaaaaggttgataatctgggcaggacatattacgtaaaccataataaccggacgactcagtggcatcggccaagtctcatggacgttagtagtgaatctgacaataatattagacagattaaccaagaagccgcacatagaagatttcgctcaagaaggcacatcagtgaggatctggagcccgaaccctctgagggcggagacgttccagagccttgggaaactatcagcgaagaggtgaatatcgcaggcgatagcctgggcctggctctgccccctccacccgctagccccggatcacgcacgtcccctcaggaattaagtgaggaattgtctaggcggttacagataactcccgattcaaacggcgaacagttttcgagtctaatccagcgggagccctcatctagattgcggtcatgttccgtcacggacgcagttgccgaacaagggcacctacccccaccttctgcccctgctggccgagcgcgttcaagcactgtgaccggtggggaggaacccactccctcagtggcctacgtgcacactacaccgggtctgccctcaggctgggaagaaagaaaagatgcaaagggaagaacctactacgttaaccacaataatcgcacaacgacttggacacgtcctattatgcagttggccgaggatggtgccagcggaagcgccactaattctaataaccacttgattgaaccccagatcaggagacccagatctttaagtagtccaactgtaaccctgagcgcgcctctcgaaggagctaaggattcgcccgtcaggagggccgtgaaggatactctgtccaacccccagagcccccaaccctccccctataattccccaaagccacaacataaagtcacccagtcattcttgccccctggatgggagatgcggatagcaccgaatggcagacccttcttcattgaccacaatactaagactaccacgtgggaagatccacggctgaaattcccagttcacatgagatccaagacttccttgaaccccaatgacctgggacccctcccccctggatgggaggagcgtatccacctggacggcaggacgttctacatagatcacaacagcaaaatcacgcagtgggaggaccctaggctgcagaatccagccatcacagggcctgcagtgccctattctagagaatttaagcagaagtatgactattttcggaagaaactgaagaagccggctgacatccccaatcggttcgaaatgaagttgcacaggaataatatcttcgaagagtcttatcggagaatcatgtccgtgaaaagaccagatgttcttaaagcccgtctgtggatcgaatttgagtccgaaaagggactcgactatggaggagtcgccagggagtggtttttcctccttagcaaggagatgtttaacccatactatggcctctttgagtactctgctacagataattacaccttgcaaattaatcctaatagcggcctgtgcaatgaagatcacctcagttacttcacctttattggcagagtggcagggctggcggtcttccacggaaagctgctggatggattttttattaggccattttacaaaatgatgcttggaaagcagatcacactcaacgatatggagtcggtggattccgagtactataattctctgaagtggatcctggagaacgaccccacagagctggacctgatgttttgtattgatgaagaaaattttggtcagacatatcaggtagatctgaaacccaacgggagcgagataatggtgacaaacgagaataagagggagtacatcgatctggtgatacagtggagatttgtcaatcgggtgcaaaagcaaatgaatgctttcttggaagggttcaccgaattgcttcctattgatcttattaaaattttcgacgaaaatgagcttgagctgctcatgtgcggccttggtgatgttgatgtgaacgattggaggcagcactccatttataagaacgggtattgtccaaatcaccctgtgatccagtggttttggaaagcagtccttcttatggacgctgagaaacgcattagattgttacagtttgtcactgggactagtagagtgcctatgaacgggtttgctgagctgtacggttccaacggaccccagttattcactatcgaacagtggggcagccccgagaagctcccaagagctcatacatgctttaaccgcttggatctgccaccttacgagacgtttgaggatctccgagagaaactactgatggctgtcgaaaacgcccagggcttcgaaggggtggattag

SEQ ID NO: 232250 - DNA, 2565 bp, Artificial Sequence
  Description of Artificial Sequence: Synthetic coding sequence
atggaacgaccttacacatttaaggatttcctgctgcggcctcgcagtcacaagtctcgagttaagggattcctccggttgaagatggcgtacatgccaaagaatggcggacaggacgaggaaaacagtgatcagcgagatgacatggagcatggctgggaagtcgtcgatagcaacgactcagcttcacagcatcaggaggaactgccacctcctcctctgccccctgggtgggaagagaaagttgataacctggggaggacctattacgtaaaccataataatcgcaccactcaatggcacagaccttccctgatggatgtgagcagcgaatcagataacaacattcgccagatcaaccaggaggccgctcaccggcgttttcgaagccggcgacacatttctgaagacctcgaacctgaaccctccgaagggggagatgtacccgagccctgggagactatctctgaggaggtgaacattgccggagattcattggggctggctctgcccccacccccagcctccccagggagtcgaaccagtcctcaggagctctctgaagagctgtctcgcaggcttcaaatcacgcctgacagcaatggagaacagttctccagtcttatccagagagagcccagcagccgactccggagttgtagtgtaactgacgctgtcgctgagcaaggacatctgccacctcccagcgctcccgctggccgagctaggagtagcacagttaccgggggagaggaaccaacgccatcggtcgcatatgttcacacgacgcccggtctgcctagcggttgggaggagaggaaagacgctaagggaaggacatattacgtaaaccacaataataggactacaacctggaccagacctatcatgcaacttgccgaagatggggcttctggctccgctaccaactctaataaccacctcattgagccccaaatcagaaggcctagaagtttatcttccccaaccgtgacgctgagtgcacccctcgagggggcaaaagattctccagtccgacgggctgtgaaggatacgctgagtaacccacagtccccccagccctctccttataactcacccaagccacaacacaaggttacccaatcgtttctgccacccggatgggaaatgcgtattgcccctaatggaagaccatttttcatcgatcataatactaagaccaccacatgggaagaccctagactgaagttccccgtgcatatgcgcagtaagacttcactgaaccccaacgacctgggacctcttccaccgggttgggaagagcggatccaccttgatggccgaaccttctatatagaccacaacagcaagataacccaatgggaggatcccagactccaaaaccctgctatcaccggcccagctgttccttacagtagggagttcaaacaaaaatacgactatttccggaaaaagctcaagaaaccagccgacatcccgaataggttcgaaatgaaattacacagaaacaatatctttgaggaatcatatagacggattatgtcggtgaagaggcccgacgtgctgaaggcccgtctctggatcgagtttgagtctgaaaagggccttgattacgggggagtggcacgggagtggtttttcctcttgtctaaggaaatgtttaatccttattacggtctatttgagtatagcgctacagataattacactctgcaaataaatccaaactcagggctttgcaatgaagatcatctgtcttacttcacattcatcgggagagttgctggcctagcagtcttccacggtaaactgcttgacggattcttcataagaccattctacaaaatgatgttgggtaaacaaataactctaaatgacatggaatccgtagactccgaatactacaattccctcaagtggatactcgagaacgatccaactgaactcgacctcatgttttgcatagacgaagagaactttggacagacgtatcaggtagacctcaagcctaacggttccgaaattatggtgacaaatgagaacaagagagagtatatcgacctggtgattcagtggcgcttcgtaaaccgcgttcagaagcagatgaacgccttccttgagggcttcaccgagttgctacccatagatttaattaaaatcttcgatgaaaacgaactggaactcctaatgtgtggtctgggcgacgtggatgtcaacgattggcgccagcactccatatacaagaatgggtactgtcccaatcaccctgtgatccagtggttctggaaagccgtcttgcttatggacgctgagaagcgcattcgtttgctgcaattcgtaactggtacctctagagtgcccatgaacgggtttgcagaactctatgggtccaatggccctcagctgtttacgatcgaacagtggggaagccccgaaaagctgccacgagcgcatacctgcttcaaccggctcgatttaccaccttacgagacatttgaggatctgcgagaaaaactcctgatggccgtggagaatgcacaaggattcgagggggttgattag

SEQ ID NO: 232251 - DNA, 2505 bp, Artificial Sequence
  Description of Artificial Sequence: Synthetic coding sequence
atggaacgaccctacacctttaaagacttcctacttcggccaagaagtcataagtcccgcgtaaaaggcttcctgcgtttaaagatggcctacatgcctaagaatgggggacaagacgaagaaaacagtgatcagagggacgacatggaacacggatgggaggtggtcgattcaaacgactccgcaagccagcatcaagaggagctgccacctcctcctctgcctcctggctgggaagagaaagttgataatctcgggagaacttattacgtgaaccacaacaacagaaccactcaatggcacaggcccagcctgatggacgtgtcttctgagtccgacaataacatacgtcagatcaaccaggaggcagctcaccgtcgtttcagaagccgcagacacatttctgaagatctagaacccgagccttcagagggtggggacgtccccgaaccctgggaaacaatcagcgaagaggtgaatatcgctggcgatagccttggcctggctctccctccaccacccgcatctcccggatcccgaacgagccctcaggaactgtctgaggaattatcccgccgtctgcagatcacacccgatagtaatggggaacaattcagtagcctgattcagcgtgagccatcaagccggcttagatcttgttcagtgactgatgctgtcgctgaacagggccacctaccacccccatcagtggcctatgtccatactacccctggactcccctccggctgggaagaaaggaaagatgcaaaggggagaacctactatgtcaaccacaataaccgcacaactacttggactagaccaatcatgcagctagccgaggacggggcttccgggagcgccacaaactcaaataatcaccttatcgagccacagatcagaagacctcgaagcctttctagcccaacagtcaccttgagtgctcctctggaaggtgccaaggattcccctgtaagacgagcagtcaaggacacactgtctaaccctcagtcaccgcagccctcaccctacaactcacccaagccacagcacaaggttacccagagtttcctccctccgggttgggaaatgcggattgcccctaacggacgacctttttttattgatcataataccaaaaccaccacttgggaagacccacggctgaaattcccagtgcacatgagatctaaaacgtcactgaacccaaacgatctcggccctctcccccctggttgggaggagcggatacatctagatggaagaacgttctacatcgatcacaatagcaagatcactcagtgggaggatcctcgactgcagaatcccgctataacaggacccgctgttccctactctcgagaattcaaacaaaagtacgattattttagaaagaaactcaagaaaccagccgacatacccaacaggttcgagatgaagctacaccgaaataatatttttgaggagtcttacagaaggataatgtcagtgaaaagaccagatgttctgaaggcccgtctctggattgaattcgaatccgagaagggccttgattatggaggcgttgcacgggagtggtttttcctgctctctaaagaaatgttcaatccttattacggattgttcgagtatagcgcaaccgataactataccttacagataaatcccaactcggggttgtgcaatgaagaccatcttagctacttcaccttcattggcagggttgctggtctggcagtgttccacggtaaacttctggacgggttttttatccgcccattctataaaatgatgctcggtaaacaaattacccttaatgatatggaaagtgtggactcagaatattataattccttaaaatggattcttgagaacgaccccactgagctcgatctaatgttctgcatcgacgaagagaattttggccagacttaccaggttgacctcaagccaaacgggtccgaaatcatggtcacaaatgagaacaaacgtgaatacattgatctggtgatccaatggcggtttgtaaacagggtacagaaacagatgaacgcgttcctagaaggttttactgagctgctgcctatcgacttgatcaaaatattcgatgaaaacgagctagaactgctcatgtgtggcctaggcgacgttgacgtgaatgactggagacagcattccatttacaagaacggttattgtccaaatcaccccgtgattcagtggttctggaaagcagtgctgctgatggacgctgagaaaagaatcagactgctgcagttcgtcaccggaacatcccgagtcccaatgaatggctttgcggaactatatggatccaacgggccacagctctttacaattgaacagtggggctcccccgagaagctgcccagggcccatacctgctttaacagactcgacctacctccgtacgaaacattcgaggacctgcgcgagaaactgctgatggctgtggagaacgcccagggtttcgaaggcgttgactag

SEQ ID NO: 232252 - DNA, 2505 bp, Artificial Sequence
  Description of Artificial Sequence: Synthetic coding sequence
atggaacgcccttatacttttaaggatttcttgttgcgccctcgttcccataagtcgcgcgtgaaggggttcctgcgcctcaagatggcttatatgcctaagaatgggggtcaggatgaggagaactctgaccagagagatgatatggagcatggatgggaagtcgtggattcaaacgactccgcatctcagcaccaggaggagctgccacctcccccacttcctcccggttgggaggagaaggtcgataatttaggcaggacatattacgtgaaccataataaccgaactactcagtggcaccgcccttccctgatggatgtgagttccgagagtgacaacaacattagacagattaaccaggaggccgcacacaggagattccgctctagaaggcacattagcgaagaccttgaaccagaaccaagcgaaggcggagatgtgcccgagccttgggagacaatctcagaggaggtgaacatagccggagattccctgggcctagcactcccacccccaccggcatcaccaggatcccgcacatctcctcaggaactgtcagaagaactttctagaagacttcagatcactccggactctaacggcgagcagttctcttccttgatacagcgggagcctagctcccgcttgcggtcatgttctgtcacagatgcagtggccgagcaggggcacctcccgcctccatctgtggcctatgtgcacaccaccccaggactcccatcaggctgggaggagagaaaagacgctaaggggcgtacatactacgtgaatcacaacaacagaacgaccacatggacgcggccaatcatgcagcttgccgaagatggcgcttccgggtctgcaacaaattccaacaaccatttaatcgaaccacaaattaggcggcctcgaagcctctcatcccccaccgtgaccctgagcgcacctttggaaggggcaaaggactctcccgttaggagagctgtgaaagatacactgtcaaatccgcagtctccacagccttcaccatataacagccccaaacctcagcacaaggtcactcagagcttcctgccccctgggtgggaaatgagaatcgcacccaatggcagaccgttctttattgaccacaacacaaagacaacaacatgggaagatcccaggctgaagttccccgtgcacatgcggagcaagacctctttgaaccctaacgatcttggccctctccctcctgggtgggaagagcgtatccatcttgacgggagaaccttctacattgaccacaattctaaaatcactcaatgggaagatccgagactacagaatccagcgatcaccggccctgccgtgccatacagccgcgaattcaaacagaagtacgactattttagaaaaaagctgaaaaagccggcagacatacctaaccggtttgagatgaagcttcacaggaataacatattcgaagaatcataccgcagaattatgtcagtgaaacgccctgacgtccttaaagcacggctgtggatcgagtttgaatcagagaagggtctggattacggaggcgtggccagggaatggttcttccttctgagcaaggaaatgttcaatccttattacggcttgttcgaatattccgctactgacaactacacattgcagatcaatcctaattctggcttatgcaacgaggaccacctctcctacttcactttcattggccgtgtagctggtctcgccgtttttcacggcaagttactggatgggttttttatccgccctttctacaaaatgatgcttggaaagcagataacacttaatgacatggaatctgtcgattcagaatactataattcactgaaatggattctggagaatgacccaacagaacttgatctgatgttctgtattgatgaagaaaactttggccagacctaccaggttgatcttaagcctaatggttctgagatcatggtcactaatgagaataagcgcgagtacattgatctcgtgattcagtggaggtttgtgaatagggttcagaagcagatgaacgctttcctcgaggggttcactgagctactgccaattgacctcattaaaatttttgacgaaaacgagctggagctcctaatgtgtggcctgggagatgtcgacgtgaacgattggcgccaacacagcatatacaagaacgggtactgcccaaaccacccggtgatccaatggttctggaaagcagtcctgttgatggacgctgagaagaggataagattgctgcagtttgttaccggaactagcagggtgccaatgaatggatttgctgaattatacggctctaacggaccccagctatttactattgaacagtggggaagtccagagaaactgcctcgagcccatacttgcttcaaccggctggatcttcctccgtacgaaactttcgaagatctgcgggaaaaactgctaatggcagtggaaaatgcacagggcttcgagggcgtagattag

SEQ ID NO: 232253 - DNA, 2565 bp, Artificial Sequence
  Description of Artificial Sequence: Synthetic coding sequence
atggaacggccatacacctttaaggactttctgttacggcctcggtcccacaaaagcagggtgaaagggttcctgcgtctcaaaatggcctacatgcccaagaacggtggacaagacgaagaaaactcagatcaacgggacgatatggagcatggctgggaggtggtcgactctaacgactcggctagtcagcaccaggaagagctgcccccaccacccttaccacccggttgggaggagaaggttgacaacctggggaggacctactatgtgaatcacaacaacaggacaacacagtggcacagaccgagcctgatggacgtgagctccgagagtgataataacattcgacaaatcaaccaagaggcggcacataggcggttcaggagcagaagacacattagcgaagatctggagccagaaccaagcgagggcggagatgtgcctgagccctgggagacgataagcgaggaagtaaatattgccggagacagccttggcctggctctcccacctccccctgcaagccccggaagccgcacatccccccaggaactttccgaagaactgtctagacggcttcagattactcctgacagcaatggtgagcagttcagttctcttattcagagagagcctagttccaggctgcgctcctgttcggtgaccgatgcagtggcggaacaggggcacctgccgcctccctcagcgccagcaggtcgtgcaaggtcctccaccgttactggtggggaggaaccgacaccatcagtggcgtacgttcacacgacaccaggcctgccctcaggctgggaggaaaggaaggatgctaagggtcgtacgtactacgtgaaccataacaaccggacgaccacctggactcgaccaatcatgcagttagccgaagatggagcatccggttccgctaccaacagcaataaccatctgatcgagcctcagataagacgcccaagatctctgtctagtccaactgtcacgctcagcgccccactggagggagccaaggattctccggtgcgccgagcggtgaaagacactctttctaacccacaatctccccagcctagtccctacaactcccctaagccccagcataaagttacacagagctttctgccgccagggtgggaaatgcgcattgccccaaatggcagaccattttttatcgaccataatacgaaaacaacaacttgggaagatcctaggttaaagtttcctgtacatatgagatcaaaaaccagcctcaatcccaatgacttaggcccacttccgcctgggtgggaagagcgtatacacctggacggtcgaactttttatatcgaccataacagcaaaataacccagtgggaggaccccagactccaaaaccctgccataacggggccagccgttccttattctagagagttcaaacaaaagtacgactacttcagaaaaaagctcaagaaaccagcagacattcccaatcgttttgagatgaagctgcaccgcaacaacattttcgaagagagttatcgtcgtatcatgagcgtaaagcggcctgatgtcctgaaggcacgactgtggatcgagttcgaatcggaaaagggattggactatggcggtgtcgcaagagaatggttcttcctgctcagcaaagagatgttcaatccatattatggcctgtttgagtactcagcaacggacaattacactctgcagatcaatccgaactcggggctttgcaacgaggaccacctttcctattttacgtttatcggtagggttgctggactcgcagtgttccacggtaaactcctggatggcttttttatcagacccttttataagatgatgctgggtaagcaaataacacttaatgatatggaaagcgtcgactctgaatattataattctctgaaatggatcctggaaaatgaccccaccgaattggacctgatgttttgtattgatgaggagaatttcggtcagacatatcaggtggatctcaaaccgaatgggtcggaaatcatggtgactaacgaaaacaaaagagaatatatcgacctggtgattcagtggcggttcgtcaaccgagtgcagaaacagatgaacgcctttttggaaggttttacagaactgctgccaattgacctgatcaaaatttttgatgagaatgagttggagctgctaatgtgcggactgggggacgtggacgtgaacgactggcgacaacatagtatctacaagaacggttattgccctaaccaccccgtcatacagtggttctggaaggccgtgctgctgatggacgccgaaaagcgcatccgcttgctccagttcgtcaccggtacctctagagtgcccatgaacggctttgcagaattgtatggaagcaatggaccacaactgttcaccattgagcaatggggcagcccagaaaaactgccgagggctcacacatgctttaacaggctcgatctcccgccttacgagacattcgaagacctgagggagaagctcctgatggccgtggaaaatgcccagggctttgagggggtggattag

SEQ ID NO: 232254 - DNA, 525 bp, Artificial Sequence
  Description of Artificial Sequence: Synthetic coding sequence
atgaagtataagaacttgatggccagggccctgtacgacaatgtgccagagtgcgctgaagaactagctttccggaagggtgatatcttaactgttatcgaacaaaacactggcggtctggaaggatggtggctgtgctctctgcacggcaggcaggggattgtcccaggaaaccgggttaaattattaatcggaccaatgcaagaaaccgcctcgagtcatgagcagcctgcttctgggttaatgcagcaaacgttcgggcagcagaagctctatcaggtgcccaatcctcaggcagcaccaagggatacaatataccaggttcctccctcttatcagaaccagggaatttaccaggtacctactggtcatggcacccaggagcaggaagtgtaccaggttccgccatcagttcagcgatctataggcggaacaagcgggccacatgtggggaagaaagttttccaacgcgatggacaggtcagttattttttggtgagagccagcaaacagacatccttgtag

SEQ ID NO: 232255 - DNA, 2505 bp, Artificial Sequence
  Description of Artificial Sequence: Synthetic coding sequence
atgaagtacaagaacctgatggccagggccctgtatgataacgtgcccgagtgtgccgaggaactggcattcaggaagggcgacattcttacggtcatcgagcagaatacaggaggcctggaaggctggtggctttgcagtctacacggccgacagggcatcgttcccggtaaccgggtgaaactattaatcggcccaatgcaagagaccgcatcgtcacacgagcagcccgctagcggattaatgcagcagactttcggccagcaaaaactgtaccaggtgcctaatccacaagccgcaccgagagacactatctatcaggttccaccttcttaccagaatcaggggatctatcaggttcccactggtcacggaactcaagaacaggaagtatatcaggtccctcccagcgtgcagcggtcaatagggggtaccagtggaccccacgtgggaaagaaggtgatcacacctgtgaggactggccatggctacgtgtacgaatacccttctagataccaaaaggacgtttacgatattcccccttctcacaccacccagggcgtctacgacattcccccttcaagcgcaaaaggtcctgtgttttccgtgcccgttggtgagattaagccgcaaggtgtttatgatattcctcccactaaaggggtttatgccatacctccttctgcatgtcgggatgaggctggtctgcgagagaaggactatgactttccaccccctatgcgacaggccggtaggcccgatctacggcctgagggagtgtatgacatcccacctacctgtaccaaaccagctgggaaggacctccacgtcaaatataactgcgacattcctggagcagctgagcccgtagcccgacggcatcagagtttatctcccaatcatcccccaccgcagcttgggcaaagtgtgggaagtcagaacgatgcatacgacgtgccgcgaggcgtgcagtttcttgaacctccagctgagacatctgagaaggccaacccacaggagagagatggtgtgtacgacgtccctctgcacaatcctcctgacgcaaagggctcccgcgacctggtggacggcatcaatagactgtcattctcttcgaccggatcgacccgcagtaatatgtctacctcttctacttccagcaaggaatcttccctgtccgctagcccagcccaagacaaacgcttatttctcgatcccgacacagccatagagcgtctccagcgactccaacaggcccttgagatgggcgtttcatccctgatggctttagtgactaccgactggaggtgttacggatatatggaaaggcatataaatgaaatccgtaccgcagttgacaaggtggagctgttccttaaagaatacttgcactttgtaaaaggggcagtcgcgaatgctgcttgccttccagaacttattctgcacaacaaaatgaaacgggaacttcagcgcgtggaagacagccaccagatactgtcccagacgtctcacgatctgaatgagtgctcctggtcccttaatatcctagcaattaataagccacagaataagtgtgacgacctggaccgatttgtcatggtggcaaaaacagtacctgacgatgcgaagcaactcaccactactattaacaccaatgccgaagctttgttcagaccaggccctggcagcctgcacttgaagaatggaccggaatcgatcatgaatagtaccgaatatcctcacggaggtagccaggggcagctcctccaccctggcgatcataaggctcaagcacataataaggccctacccccaggcctgtctaaggagcaggcccctgactgttcatctagcgacgggagcgaacgtagctggatggacgactatgattacgtccaccttcaggggaaggaggaattcgagagacagcagaaggagctgctcgagaaggagaatataatgaagcagaataaaatgcagctggagcaccatcagttaagtcagtttcaactacttgagcaagagatcaccaaacccgtagaaaacgatataagcaagtggaagccaagtcaatccttgccaacaaccaacagtggcgtgtccgcccaagatcggcagctgctgtgcttttactatgaccagtgcgagactcacttcataagcctgttgaatgctatcgacgcactattctcctgtgtcagctccgcccagcccccacgcatcttcgttgctcactctaagtttgttatactttcagcgcacaaactggtttttataggagacacgctaacacgtcaggtcacagcgcaagatatcaggaataaagtgatgaactcctcaaaccagctgtgcgagcaactcaaaactattgtaatggcaactaagatggccgcacttcattaccctagtacaacagccctgcaggagatggtacatcaggttaccgacttgagtcgcaacgcccagttgttcaagcgcagcctattagaaatggccactttttag

SEQ ID NO: 232256 - DNA, 99 bp, Artificial Sequence
  Description of Artificial Sequence: Synthetic coding sequence
atgtggaccagaaacttgatggcgagggcactctacgataatgtgccagaatgtgcagaggagctcgcctttaggaagggtgacattcttacagtctag

SEQ ID NO: 232257 - DNA, 2505 bp, Artificial Sequence
  Description of Artificial Sequence: Synthetic coding sequence
atgtggacccgcaatttgatggcacgagccttatatgacaatgttcccgagtgcgctgaagagcttgcttttcgcaagggtgacattctgaccgtgatagagcagaatactggcggtctggagggctggtggctctgctcactccacggcagacagggaatagtgcctggtaaccgtgtgaaactccttatcggaccaatgcaggaaaccgcttcttcccacgagcagccggcttcagggctgatgcagcagacgtttggacagcaaaagctctaccaggtgcctaacccccaggccgcaccccgtgatacaatttaccaggtgccacccagttatcaaaaccagggaatctatcaggtacctaccggacacggcacccaggagcaagaggtgtatcaggtgcccccatcagttcaaagatctataggaggaactagcgggcctcatgtgggtaagaaagtgattacccctgtgagaactggccatggctacgtctatgaatatcccagccgctatcaaaaagatgtgtacgatattcccccatcgcatactactcagggggtctatgatatacccccaagtagcgctaaagggcctgtgttcagcgtgccggtgggagaaatcaaaccgcagggggtgtacgatatccctccaaccaagggcgtgtatgcgattcccccttcagcctgtcgcgacgaagcgggtcttcgtgagaaagattatgattttcccccacccatgcggcaagcaggtcgccctgatctgaggcccgagggtgtttacgacataccaccgacttgcactaaaccagccggtaaggatctccacgtgaaatacaactgtgatattcctggagccgcagaacccgtcgcacggagacaccaatcactatcaccaaaccatccccctccacagctgggccagtcagtgggaagccagaatgatgcatacgacgtcccccgtggagtccagtttcttgagccccctgctgagacctcagagaaagcaaatccacaagagagggatggagtttacgatgtgccactgcataatcccccagatgccaaaggctccagagacctggtggatgggatcaatagattgagcttcagttccaccgggtcaactcgatcaaacatgagtacctcttccacatctagcaaagagtcctctctgagcgcaagcccagcccaggataagcggctgttcctggatccagatacagccattgagaggctgcagcggctacagcaggccctagaaatgggcgtgagctctctgatggcgctagtgaccacggattggcgctgctacggttatatggaacgtcacatcaacgagattcgtaccgctgtcgacaaggtggagttattcctgaaggagtacttacatttcgttaagggagccgttgctaatgccgcttgccttccagaactgatcctacacaataagatgaaaagggagctgcagcgggtggaagatagtcaccagatattaagtcagacttcccatgatctaaatgaatgcagctggtcattaaatatccttgcaataaacaagccgcagaacaagtgcgatgatttagacaggttcgtgatggtggccaaaactgtgccagatgatgcaaaacagctcaccaccacaatcaatacaaacgccgaagccttgtttaggcccggaccgggaagcctgcacctcaagaacggcccagaatcgatcatgaacagcacagagtatccccatggtggatctcagggccagttgcttcaccccggtgatcataaggcgcaggctcataataaagcactccccccaggcttgagcaaggagcaggcccctgattgtagctcctccgacggtagcgaacggtcatggatggacgattacgactacgtccatctccagggcaaggaagaatttgagagacagcagaaggaacttctggagaaggaaaacatcatgaaacagaacaagatgcagctagagcaccatcagctgagtcagtttcagttactagaacaggaaatcaccaagcccgtggagaatgatatctccaaatggaaaccatcacaaagtctgccaacgactaactccggtgtgagtgcacaggatcgccagctcctatgtttctactacgatcagtgcgagactcacttcattagcctcctgaacgctattgatgccctgtttagctgcgtaagtagtgcacagcctcctcgcattttcgtggcccatagcaagtttgtaatcctatctgcacacaaattagtattcatcggagacaccttgacacgccaggtgacagctcaggacatccgcaacaaggtgatgaacagcagtaatcagctatgtgagcagttaaagactattgtgatggcaactaagatggccgcactgcactacccctctactacagccctgcaggaaatggtacaccaggttacagatctctcgcggaacgctcaactctttaaacgtagtttgttagaaatggccacattctag

SEQ ID NO: 232258 - DNA, 1212 bp, Artificial Sequence
  Description of Artificial Sequence: Synthetic coding sequence
atgttaagacccgaggctggcttagtaggtcttcatggtcctgcgcaggagaattcagcacttccaggcagaagagattcagcatcagagctcagggccctttctggtctcgaggtcgacccgggtgaggggtggggcagggtggttctcatcagcccaaggacagtcagattcagagtgctctccccaggagtgagggaagagggacatgtccagaacaacggccagaaccaggccagaccggcaagaggcgttaccggagctggaggttggggaagtgcggcagtgtgcaggggacgcgctcttcgcggaagggaacctgccctaccaagtgccagtttccccgatgtggcagcctgtcctgggtcccttgactgcgcactgaagaggcgggctcgctgtccccctggagcccacgcctgtggtccatgtctgcagcctttccaggaggaccagcaaggcttatgcgtgcccagaatgagacgacctccaggaggcggacgccctcagccacgtctagaggacgagatcgattttctagcccaggagcttgctcgaaaagagagcggccacagtacaccccctctgcctaaagacaggcaacgcttacccgagccagctactttgggcttctcggccaggggccaaggattggaactcggcctgccatctacgcccggtacaccaacgccaacaccccacacaagccttgggtcccctgtgtcctctgaccccgttcacatgagccctctggagcccaggggagggcagggggatggattggcgttggtgctgattttagccttctgtgtggctggagcggctgctctgtccgtggcatctctgtgctggtgcagattgcaacgggagatccgtctgacccagaaggcagactacgcaactgctaaagctccgggtagccctgccgcacccaggataagccctggcgaccagcgtttggcccagtcagctgaaatgtaccattaccagcaccagaggcagcagatgctgtgtttggagagacataaagagcctccaaaggaattagatacggcatccagcgatgaagaaaatgaagacggagacttcaccgtctacgagtgccctgggctggcccctaccggggaaatggaagtgcgaaaccccctgttcgatcacgcagctctgtcagctcccttaccagctccgtcttctccacctgccctgccttag

SEQ ID NO: 232259 - DNA, 978 bp, Artificial Sequence
  Description of Artificial Sequence: Synthetic coding sequence
atggccactcccctccccccaccctcaccacgccatctgcgtcttctccgcttgctgcttagcggccttgtgctgggtgcagccctgagaggggcagctgccggacatcctgatgtggcagcctgccccggatctcttgactgtgccctaaagcgaagagcgagatgtcccccaggggcacacgcctgcggtccgtgtttacagccttttcaagaagaccagcaagggctgtgcgtaccacggatgaggcgccctcctggcggtggcaggccgcagccgaggctggaggacgagattgatttcctggcacaggagctggcccgtaaagaatctggccattcaaccccacctctcccgaaggacaggcagagattacccgaacctgccacgctgggcttctcggctaggggtcagggtctcgaactgggtctgcctagcactcctggaacacctacaccgactccgcacacctcccttggatcccccgtttcatccgatcccgtgcatatgtcaccactagaacccagaggcggacagggcgacggcctcgccttggtgctgatcctcgcgttttgcgtggccggagccgcagctctctccgtggccagcctctgttggtgcagactgcaacgtgaaatccgactgacccagaaagccgattatgccactgccaaggctcccggttccccagctgctcctagaattagccccggagaccaacgacttgcgcagtccgcagaaatgtaccattaccagcatcagcgtcagcagatgctgtgtttggagaggcacaaggagccccctaaagagcttgatacggcttcaagcgacgaagagaatgaagacggggatttcaccgtgtacgagtgtccaggactcgcccctactggtgaaatggaagttcggaatcctctctttgatcatgctgctctttccgcacccctgcctgcccctagttctcctccagcactgccttag

SEQ ID NO: 232260 - DNA, 297 bp, Artificial Sequence
  Description of Artificial Sequence: Synthetic coding sequence
atgtccgtccgcgagttaaaccgccaattgcgtggctgcggacgcgacgaagccctaaggctcaagcagcgaaggcgcactctgaaaaataggggatacgcacaggcttgccgctcaaaacgccttcagcagcgacgcggattagaagctgaaagggcgaggttagccgctcagctggatgctctgcgcgcagaggtcgctcgcctcgccagggagcgggatctgtataaggcccgttgcgacaggctgacgtcctctgggccaggctctggcgatcctagccacttgtttctatag

SEQ ID NO: 232261 - DNA, 714 bp, Artificial Sequence
  Description of Artificial Sequence: Synthetic coding sequence
atggccttgcccccatcacctctagctatggaatatgtgaatgatttcgacttgatgaagttcgaggtgaagagggagccgtccgagggaagacctggcccacccactgcctcacttggctccaccccctatagttcagttcctcctagccctacttttagcgaaccgggtatggtgggtgccacagaggggacgagacctgggcttgaggagctgtactggctggctactctccagcagcagctcggtgcgggagaggccctcggactgtctcccgaagaagcaatggagctgcttcagggtcagggccctgtccccgtcgatgggcctcacggctactacccgggaagtccggaagaaacaggcgcacaacacgtgcagctcgctgagaggttttcagatgccgcactcgtctctatgagtgtcagagaactaaataggcaactgagagggtgcgggagagacgaagcactgagacttaaacagagaaggagaaccttaaagaaccgtggatatgcccaggcctgccggtccaaacgactccagcagcgacgtggactcgaggcagaacgtgctcggctggcagcacagctagacgcgctccgagctgaagtggccaggctagcccgtgagcgggacctgtataaggctcgttgcgaccggctgacgagcagcggccctggctctggtgatccatcccacctgtttttgtag

SEQ ID NO: 232262 - DNA, 714 bp, Artificial Sequence
  Description of Artificial Sequence: Synthetic coding sequence
atggccctacctccttcacccctggccatggaatatgtgaacgacttcgatttgatgaaattcgaggtaaagcgagaaccttcagagggcaggcctggtcctccaaccgccagcctgggctcaaccccatattctagtgtaccgccttctcccacgttcagcgagcccggaatggttggagctaccgagggaacgcggccaggtttggaggaattgtactggttagcgacactgcaacagcagttgggagccggagaagctctcgggcttagtccggaagaggccatggaactcctgcagggccaaggcccagtgccagtggacggccctcacggatattaccccggaagcccggaggagaccggcgctcagcacgtccagctcgcggagcggttttcggatgctgccttggtaagcatgagcgtgcgtgagctcaaccggcagttaagagggtgtggtcgcgatgaggcactgaggctgaaacagcgacggagaacattaaagaaccgcggatacgcccaagcctgcaggagcaaacggctgcagcaacgcagggggctggaggctgagcgtgctcgcctggccgctcagctagatgcgctgagggcggaggtcgctagattagctcgcgagcgtgacctctacaaggccaggtgtgatagactcacaagcagtgggccaggctctggggaccctagtcatctgttcctctag

SEQ ID NO: 232263 - DNA, 198 bp, Artificial Sequence
  Description of Artificial Sequence: Synthetic coding sequence
atggctctgcccccttctccccttgctatggagtatgtgaatgacttcgatctgatgaagtttgaagttaaaagagagccatccgagggccgtccaggaccacctactgcctcactgggctctacaccctattcgagcgttcctccctctccaacatttagcgaacccggaatggtcggcgctaccgaaggaacttag

SEQ ID NO: 232264 - DNA, 297 bp, Artificial Sequence
  Description of Artificial Sequence: Synthetic coding sequence
atgtccgtcagagaattgaataggcagctgagaggatgtgggagagacgaggcattgcgcttgaagcagagaaggaggacgctaaaaaatcgcggttatgctcaagcttgtagaagcaaacgactgcagcagcggaggggactggaggccgagagggcaaggctcgcggctcagttagatgcccttcgcgcagaggtggctaggctcgccagagagagggatctgtataaggctaggtgtgacaggcttacgagcagtgggccaggctcaggcgaccctagccacctctttctgtag

SEQ ID NO: 232265 - DNA, 714 bp, Artificial Sequence
  Description of Artificial Sequence: Synthetic coding sequence
atggccctccctccatctccgttggctatggagtacgtaaatgactttgatctgatgaagtttgaagtgaagcgagaaccctctgagggaaggcccggaccccctactgcatcccttggaagtaccccttactcttccgtccccccttctccaaccttcagtgagcctgggatggtgggcgcaacagaggggacacggcctggccttgaagagttatactggctggctaccctgcaacaacagctaggtgctggggaagccctgggtctttctcctgaagaagccatggagctcctgcagggccagggtcccgtgcctgttgacggtccccacggctattatccgggttcccctgaagagaccggagcgcagcacgtgcagctggcggagcggttctccgatgcagctcttgtgagcatgtccgtccgtgagctgaataggcagttacgaggttgtggaagggacgaggccctgcggttgaaacagcgcaggcggacactgaagaacagaggctacgcccaagcctgcagatccaaacgtttgcaacagaggagaggactggaggctgaacgcgctcgcctggcagctcagcttgatgccctacgggcagaagtcgccagactagcgcgtgagcgagatctctataaagccaggtgtgaccggttaacaagttcaggacctggaagcggcgaccccagccacctctttctatag

SEQ ID NO: 232266 - DNA, 1674 bp, Artificial Sequence
  Description of Artificial Sequence: Synthetic coding sequence
atgggtggacagatcactcgcagcacccttcacgactccatcgggggaccatttccggtcacaagtcataggtgccatcataaacagaaacactgcccagccgtcctcccatcaggcggactgcccgctacaccgctcctcttccatccccataccaaggggagtcagattttaatggatctgtcacataaggctgttaaacgccaagcttctttctgtaatgccataaccttctctaataggccagtgttgatttacgaacaggtcaggttgaagatcaccaagaagcagtgctgctggtcaggcgcactgcgactagggtttacctcaaaggatccttctcgcatccacccagatagccttccaaagtatgcatgcccagaccttgtctcccaatcaggtttctgggccaaggccctccctgaggagtttgcaaacgaagggaatatcatcgccttctgggtcgacaaaaagggtcgggtctttcaccgcatcaatgattccgccgtaatgctgtttttcagcggtgtcagaacagccgatcccctgtgggcattagttgatgtttatggattgaccagaggtgtccaattgttagactctgagctggttctgcctgactgtctgcgtcctaggagctttaccgccctgcgcagaccgagcctgcgacgcgaggcagacgatgccaggctgagcgtgagtctctgcgatctcaatgtgccaggggcagatggtgacgaggcggcacctgccgcagggtgtccaattccacagaactcactaaatagtcagcattcacgagccctgccggcacagttggacggcgacctgaggtttcacgccctgagagccggagcacacgtgcgcatcctcgacgagcagaccgtagcaagggtcgagcacggtagagatgaaagagctcttgttttcacctccaggccagttagggtcgccgaaacaatttttgtcaaagtgacgagatcaggcggagccaggccaggggcactttcctttggtgtgaccacctgcgatccgggaacattacgcccagctgaccttccattcagtcccgaggcactggttgaccgaaaagaattctgggccgtctgccgggtgcccggacctctgcatagcggcgacatcctgggcttggtagttaacgctgacggggaattgcacctgtcacacaatggcgctgctgccggaatgcagctttgtgtggacgcgtcccagccactgtggatgctctttgggctgcacggaaccatcacacaaatccggattctggggagcactatcctggcggaaagaggaatcccatcccttccctgcagccctgcgagtacccccactagcccttccgctctgggatcaagattgagtgacccgctgctgtcaacttgttctagcggaccgctggggtcgtccgctggaggtactgccccaaactcccctgtttctttgccagagtcaccagttacccctggacttggccagtggagtgacgaatgcacaatttgctacgaacacgccgtggacaccgtgatctacacatgtgggcacatgtgcctctgttacgcctgcggactgcgccttaagaaagctctgcatgcatgctgtccaatctgtagaagacctatcaaagacattataaagacctacaggtcctcctag

SEQ ID NO: 232267 - DNA, 1725 bp, Artificial Sequence
  Description of Artificial Sequence: Synthetic coding sequence
atgggaaacaacttctcttcaattccctcattgcctaggggcaacccttctagggcgccacgcggacaccctcagaatctgaaagattctatcggcggtcccttccctgtgacgagccatcgatgccaccataaacagaaacattgtcctgccgtgctccccagcggtggcctgcccgcaaccccgctgcttttccatccccacactaagggttcccaaatcctcatggacttatcgcacaaagctgtgaagcgacaggctagcttttgcaacgctattacctttagtaatcggccagtactgatctacgaacaagtaaggcttaagatcactaaaaagcagtgctgctggtctggcgcactgagactggggttcaccagcaaggatccttcccgcattcatcctgactcgctcccgaaatacgcttgccccgatcttgttagccagtctggcttctgggctaaggctttaccggaagaattcgcaaatgaaggaaatatcatcgccttttgggtggacaagaagggccgagtgtttcataggatcaacgactctgctgtaatgctgttcttttcaggagttagaacagccgatcctctttgggctctcgtggacgtgtatgggctgacacgaggggtacagctgttggatagcgagttggtgctacccgactgtttaagaccgaggagtttcactgcactgaggcgaccatcccttcgtagggaagccgatgatgcccgtctcagcgtgtctctatgcgacttgaatgtaccgggagcggacggagatgaggctgctcccgcagctggatgcccgataccacaaaattccttgaattcccagcacagccgggctctccccgcacagttggacggagacctgcgatttcatgctcttagggccggagcgcacgtaaggatcctggatgaacagactgtcgccagggtagaacacggcagagacgaacgggctctcgtgtttacctccagaccagttcgtgtggcggagaccatcttcgtcaaggtgacgaggtccggcggtgcacgacccggagcattgagtttcggagtgactacatgtgaccccggtaccctgcgacccgctgacctgcctttctcgccagaggccctggtcgataggaaagaattctgggccgtgtgccgtgttcctgggccacttcatagcggcgacattctaggactcgtcgtcaatgcagatggagagctgcatctgtctcataatggagctgctgccggtatgcaattgtgcgtggacgccagtcagcccctgtggatgcttttcggattacacggaacgatcacgcagatcaggattttaggttctactattctggcagagagaggaataccgtctctgccttgctcccccgcaagcactcctacgagtccctcagccctgggcagtaggttgtctgaccccttgctcagcacatgctcgtcagggccactggggtcttctgctggaggaaccgcaccgaattctccagtgagcctgcctgaatcgcccgtgaccccaggcctggggcaatggtccgatgaatgtacaatttgctacgagcatgccgtagacacagtgatatatacatgcggacacatgtgtttatgctacgcctgtggtctgagactaaaaaaggcactgcatgcctgctgcccgatttgtcgacgcccaatcaaagatattataaagacctacaggagcagttag

SEQ ID NO: 232268 - DNA, 600 bp, Artificial Sequence
  Description of Artificial Sequence: Synthetic coding sequence
atggggggtcagatcacaagaagtactctgcatgatagcattggcggaccgttccctgtaacaagtcatcgctgccaccacaaacagaaacattgtcctgcagtcctgccctccggcggacttccagccacgccacttctctttcatcctcataccaagggatcacagatcctgatggacttatcccacaaggccgtgaaaaggcaggcctccttttgcaacgccatcaccttctcaaataggccagtcctgatctacgagcaggttaggttaaagattacaaagaaacagtgctgctggtctggagccttacggctgggattcacctcaaaagatcccagtaggatccatcccgatagcctacctaagtacgcgtgcccagacctagtgtctcagtctggcttttgggcgaaggcccttccagaggaattcgccaatgaggggaacattatcgcattctgggttgacaaaaaaggcagggtgtttcatcggattaacgacagcgccgttatgctgtttttttcaggcgtgagaactgcagatccgctctgggctcttgtcgacgtttatggacttactcgcggagtgcagctgctctag

SEQ ID NO: 232269 - DNA, 327 bp, Artificial Sequence
  Description of Artificial Sequence: Synthetic coding sequence
atggacttgtctcacaaagctgtaaagcgtcaggcatccttttgtaacgcaatcaccttcagcaatagacctgttctgatctatgagcaggttagactaaagataactaagaaacagtgctgctggagcggagctcttagacttgggtttacctccaaggacccatcacgcattcatcctgatagtctcccaaagtacgcctgtcccgacctggtgtcccagtctggtttctgggcaaaagctttacctgaggagttcgctaacgagggaaacatcattgcattctgggtggataagaagggaagggtctttcaccggatcaactag

SEQ ID NO: 232270 - DNA, 2553 bp, Artificial Sequence
  Description of Artificial Sequence: Synthetic coding sequence
atgcggcaggtgtgctgttctgccctccctccccctccattggagaagggcaggtgttcctcctactctgatagttcaagctccagcagtgaaaggagctcgtcttcgtcctccagctcaagtgagtcagggagtagctctaggagctcgagtaacaatagcagcatctctcgcccagcagcaccccctgagccccgtccacagcagcagcctcagccgagatctcctgcggctagaagagcggctgctcgaagtcgtgccgctgctgcaggcggaatgcggcgtgatcctgcaccaggattctcaatgctgctgttcggagtctccctggcctgttattcccccagccttaagagcgtgcaggaccaggcatataaggcccctgtcgtggtggagggcaaggtgcaaggcctcgtgccggcaggagggagcagctccaactccactagggagccccctgctagcggccgtgttgctctggtaaaggtgttagacaagtggcctttgaggtcaggcggattgcagcgagaacaggtcattagcgtgggtagctgcgtacccctggagaggaatcagaggtatatcttcttcctggagcccacagaacagcccctagtgtttaagaccgctttcgcgcctctggacactaacggcaagaacctgaaaaaagaggtgggcaagatcctctgcacagactgtgccacccggcctaaactgaaaaagatgaagtctcaaacgggacaggtcggagaaaagcaaagcttaaagtgtgaggccgctgcaggtaatcctcaaccttcctatcgttggtttaaggatggcaaggagctgaataggtcacgagatatcagaatcaaatacggcaatgggaggaagaatagtcgccttcaatttaataaggtgaaggtagaggatgccggagagtatgtctgcgaggccgaaaacatactgggcaaggacaccgtgagaggaagactatatgtaaacagcgtcagcactactttgagttcttggagcgggcacgcgagaaagtgcaatgagactgccaagagctattgtgtgaacgggggagtctgctactatatagaaggaattaatcagctgtcctgcaagtgccctaacgggtttttcggacagcggtgtttggagaaactgcctctccgtctgtatatgccagaccccaaacagaaggctgaggaactgtatcagaagcgggtcctgacgatcaccgggatttgtgtggccttgttggtcgtcggaatcgtgtgcgtagtggcttactgtaagaccaagaaacaaagaaaacagatgcacaatcatctcagacagaacatgtgtcccgcacaccagaatcgaagtctcgccaatggtccatcccatccacggttagatcctgaggaaattcagatggccgattatatatctaagaacgtgccagccacggatcacgtcataagacgcgaaaccgagacaacgttctccgggtcccattcgtgttccccaagccaccattgctcaaccgccactccaacatcgagtcaccgccatgaatcccatacgtggtcattggaacgtagtgagtctcttacttcggattctcaaagcggcatcatgctgtcatctgtcggaacctcgaagtgcaattcacccgcttgcgtggaagctagagctagaagagccgctgcttacaatcttgaggagaggagacgggcaacagcaccgccataccacgatagtgtagactccctgagggactccccacatagtgagcggtacgtcagcgcattaactaccccagcacggctgagtcccgttgacttccattactcattggccacccaagtacctacatttgagattacgtctccaaacagtgctcacgctgtttccctgccgcctgctgctcccataagctaccgcctcgccgagcagcaaccactgctgaggcatccagctcctcccggtcctggtcctggccctgggccaggccctgggccaggagccgacatgcaacgatcttacgacagttattactacccggcagccggtcccggtcctcgcagaggcacttgtgcactcggcggatctcttggctcgctgcccgcatccccatttagaatccccgaagacgacgaatatgaaactacccaagagtgtgcacccccaccccctccgaggccacgtgccagaggcgcttctcggcgaacttctgcagggcctcgcagatggaggcgatctagacttaacgggctagccgcacagcgagcacgagccgctagggactctctgtctttgtcgagcggatcgggaggcggatcagcatcagcctcagatgacgacgccgacgatgccgacggtgccctggccgcagaaagtacacccttcctgggccttcgcggagcacacgatgcgttacgatcggacagcccccctctctgtccagccgcagatagtcgcacctactattcattagacagccacagtaccagggcgtcttctcgccactctcgtggacctcctcccagggcgaaacaggacagtgcgccactgtag

SEQ ID NO: 232271 - DNA, 1281 bp, Artificial Sequence
  Description of Artificial Sequence: Synthetic coding sequence
atgagacaggtgtgttgctccgcactgccaccccctccactcgagaaaggtaggtgcagctcttactccgattcttcttcgtccagctccgaacgatcgagcagtagttcaagcagttcctccgagagtggctctagttcacgaagttcttccaacaactccagcatcagtcggccagctgcacctcccgagccccgtccccaacagcagcctcagcctcgcagcccggcagccaggagagccgcagccaggagcagggctgctgccgctggaggaatgcggagagatccagccccagggttttcaatgttgctcttcggggtgtctctggcgtgctacagccctagtctgaagtccgtccaggaccaagcttataaggccccagttgtcgtagaaggcaaggtgcaggggctggtccccgcaggcggtagttcgtccaactccacaagagaacctcccgctagcggacgagtcgctctagtcaaggtgcttgataagtggcctttgaggagtggcggattacagcgggagcaggtgatctctgtggggtcgtgcgtcccattagaacgtaaccagcgatacattttcttcttggagccaactgagcagcctttggtgttcaagacagccttcgcacccttggacactaatggaaagaatctcaaaaaggaggtgggcaaaatcctatgtacagattgtgccactagacctaagcttaaaaagatgaagtctcagacgggtcaagtgggtgagaagcaatccctgaagtgtgaggctgccgcaggaaatcctcagccctcatacaggtggttcaaggacggcaaagaactaaacagaagccgggacattcggatcaagtatggtaatggacggaaaaattcaaggctccagtttaataaagtgaaggtggaagatgccggtgaatacgtgtgtgaagctgagaatatcttgggcaaggataccgtgagaggcaggctctacgtaaatagtgtatcaaccactctgtcctcgtggtccggccatgccagaaagtgtaacgagacagctaagagctattgtgtgaacggaggggtctgttactatatcgaggggattaatcagctgagttgtaaatgcccaaacggtttctttgggcaacgatgcctggaaaaactgcctctacgattatacatgcccgacccaaagcagtcagttctttgggacaccccgggtaccggagtttcatcatcacaatggtcgacctcccccaaaccacgttcctgtaccagaagggggagttag

SEQ ID NO: 232272 - DNA, 2577 bp, Artificial Sequence
  Description of Artificial Sequence: Synthetic coding sequence
atgcgtcaggtgtgttgtagcgcgctgccccctccccctctagagaaaggaaggtgttcatcctactctgatagctcatcttcaagcagcgaacgttcgtcctcgtcgagctcctcatcgagcgaatccggctcctcctctcggagcagcagtaacaattcatctatttcccgccctgccgctcctccagagcctaggcctcagcagcagccccaacccaggtcgcctgctgccaggagggccgctgcaaggtcgcgagccgctgccgcaggaggtatgaggagggatcccgctcccggatttagcatgctgctatttggggtgagtcttgcctgctactccccaagcttgaaaagcgtgcaagatcaggcatataaagcccctgtcgtggtggaaggaaaggtgcagggtctggtgcccgcaggaggcagcagctccaactcaacacgcgaaccacctgcttctgggcgagtggctctcgttaaggttctcgacaaatggccactgcgcagcggcggacttcagagggagcaggtcatatcggttggctcttgcgtccccctcgagaggaaccagagatacattttcttcctggagcccaccgaacagcccctggttttcaagacagcctttgctccactcgacaccaacggcaaaaatttaaaaaaagaggtgggcaagatattgtgtactgattgtgccaccagaccgaaactgaagaaaatgaaatcccagactggccaggtcggcgagaaacagtccctgaagtgtgaggctgctgccggaaatcctcagccgagttaccggtggtttaaggatggtaaagagctgaaccgctctagagatatcaggatcaagtatggcaatggacgaaaaaactcaagactgcagtttaacaaggtgaaggtggaggacgctggcgagtatgtctgtgaggccgaaaacattctgggaaaagatactgtgcgtggccgtctgtatgtgaatagcgtctctacgactctcagctcatggtcagggcacgctcggaaatgcaacgagactgccaaaagttattgcgtgaacggcggtgtgtgctactatattgaaggaatcaaccagttgagctgcaagtgtcccaacgggttcttcggccagcgctgtctggagaagctgccgttgaggctgtatatgcctgaccctaaacagtccttcctgtccttcgaattgtcaaaagcagaagagttgtatcagaaacgagtgctaaccattaccggaatttgcgtagcgctactggtcgtgggcatcgtttgcgtcgttgcatattgcaaaaccaagaaacagcgtaagcaaatgcacaaccatctgagacagaacatgtgccctgctcaccagaaccggtccctggcgaatgggcctagccatcctcggttggaccctgaggaaatccagatggcagattacatctccaaaaacgtgcccgctactgatcacgtcatccggagagaaactgagaccaccttcagtggatctcacagctgttccccaagccatcattgcagtacggcaacccctacaagcagccaccgtcatgagtctcatacatggtcacttgaacgctccgagtctctaacatctgattcccagtccggaataatgctgagctccgttggcacctcgaagtgtaactcacccgcatgcgtggaggctagggctcggcgagctgctgcttataatctcgaggaacggagacgcgcaaccgccccaccctatcatgattccgttgactcactgcgagattcacctcatagtgagcgctacgtgagcgccttgacaaccccggctcgactcagtccggttgattttcattactccttggctactcaggtgccaacttttgagataacaagcccaaattcagctcatgcagtctctttgccgcctgcggcacccatctcgtaccgactcgcagaacagcagcctctgcttcggcacccggctccaccaggtcccggacctggacccggtccgggtccagggccaggagccgatatgcagaggtcctacgatagctactactaccccgctgccggaccgggacccaggcgtggaacttgcgcactaggcggatccctgggatcccttcctgcatcccctttcaggattcccgaagatgatgaatatgagactacccaggaatgtgctccccctccccctcccagacctcgtgccaggggtgccagtcgaagaacctctgcagggccaaggaggtggcgtaggagtcgtctcaacggcttggccgctcagagagcccgagccgcacgcgactctttgagtttgagtagcggcagcgggggaggctctgcttctgccagtgatgatgacgctgatgacgccgacggggctcttgccgcagaaagcacaccctttctgggcctgcggggtgcacatgatgcccttcgttctgacagcccgccactgtgtccagccgctgactccagaacatactactctttagattctcattctacacgcgcaagctcgagacactcccggggtccccctcctagagctaaacaggactcagcccctctatag

SEQ ID NO: 232273 - DNA, 2355 bp, Artificial Sequence
  Description of Artificial Sequence: Synthetic coding sequence
atgcgccaggtgtgctgttctgctctcccaccgccacccctggagaagggcaggtgttcgtcttacagcgatagctcctcaagcagcagtgagaggtctagctctagctcgtcatcctcttccgaatcaggatcgtctagccgcagctctagcaataattctagtatcagccgccctgccgcacctcctgagcccaggccacaacaacagccccagccacgttctcccgcagccagaagggccgcagctcgctctagggcagccgcagccggtggaatgcgtagagaccctgctcccggtttttcgatgctattatttggcgtgtctctggcctgctactctcccagtttgaagtcagttcaggatcaggcctacaaggcaccagtagtcgtggaaggtaaggtccagggcctggtgcccgctgggggaagctcctctaacagcacacgagaaccccctgcttctggtagagtcgcgttggtgaaagttttggacaagtggcccttgcggagtggcggtcttcagagagagcaggtgattagcgtcggcagctgcgtgccattagagaggaaccagagatacatattcttcctggaacccactgaacagcctctagtgtttaaaacagcctttgcgcctttggacacgaatgggaaaaacctgaaaaaagaagttggtaagatcctgtgcaccgattgcgctacccgtccaaaactcaagaagatgaaaagccagaccggccaggtgggtgagaaacagagcctcaagtgcgaagctgctgctggaaacccgcagccatcttaccgctggtttaaagacggaaaggagttgaatcggtcaagggacatcagaatcaagtacgggaacgggcgtaagaatagcaggctccagttcaacaaggtgaaggtggaagacgccggagaatacgtctgtgaagccgagaacatcctcggtaaggacactgtgcggggtagactctacgtgaactccgaagccgaagagctttaccagaaacgtgtgctaacaattaccggtatctgtgtggcgctgctcgtggtcggcatcgtgtgcgtcgttgcctactgcaaaactaagaaacagcgaaaacagatgcacaatcacctgcgacagaatatgtgtccagcccaccaaaaccggtctttagctaatgggccttctcatccaagattggatcctgaggagattcaaatggctgactatatcagcaagaatgttccggctacggaccatgtgatccgcagggaaacagaaactactttcagtgggtcgcacagttgctcaccgtcgcaccactgtagcactgctacaccaacgagttcccaccggcacgaaagtcacacatggtcacttgagaggtcagaaagtctaacctctgactcccaatctggcataatgctgtcgagcgtggggacaagcaagtgtaatagcccggcttgcgtggaggctagggctagacgcgctgccgcttacaacctcgaagaacggaggcgagcgaccgctcccccatatcatgacagcgtcgactcgctgcgggacagccctcatagtgagcgatatgtgtccgcactgacgactccagctagactgtcaccggtggatttccattacagcctggccacacaggtcccaaccttcgagatcactagccccaacagcgcccatgcagtgtccctccctccagctgcccctatctcctacaggctggcagaacaacagcccttactccggcatcctgctccacccggtcctggtcctggacccggacccggtcctgggccaggggctgacatgcaaaggtcgtatgattcttactactatcctgccgctggtccaggtcccagaaggggaacatgtgcactcggagggagcctgggcagcctccctgccagtccctttcgcatacctgaggatgacgagtacgagaccacacaggagtgtgccccacccccacccccaaggccccgagctcgcggtgcctctaggcggaccagcgctgggccaagaaggtggcgccgttcacggttgaacggccttgctgctcagcgggcacgggctgcaagagactctctctccttaagctctggcagcggcggtggctctgcctccgcatcagatgacgacgcagacgatgcagacggagcactggcagccgagtctacgcccttcctcggactgagaggcgctcacgacgctctcagaagcgactctccaccactgtgtccagcggctgattcgagaacctattactccctcgattcccatagtaccagagcctcttctcggcattcccggggtccaccacctcgcgcaaaacaagacagcgcacccctctag

SEQ ID NO: 232274 - DNA, 993 bp, Artificial Sequence
  Description of Artificial Sequence: Synthetic coding sequence
atgcgcagggatcccgcacccggtttctccatgctgctctttggggtatcacttgcctgctattcgccctccttgaaatcagtccaagaccaagcctacaaagcccctgtggtggtagaggggaaagtccagggactggttcccgcaggcggttcgagctccaactcaactagagagcctcctgcctccggtcgcgtggcactggtgaaggtacttgataagtggccattgcgaagtggagggctgcagcgtgagcaggttatctctgtggggagctgcgtcccactggaacggaatcagagatacatcttctttctggaaccaactgagcagcccctcgtgttcaagacagccttcgcacctctcgataccaatggcaagaatttgaagaaggaagtgggcaaaatcctctgtactgattgtgcaaccagacccaaactgaagaaaatgaaaagtcagaccggccaggtaggcgagaaacagtccttaaagtgtgaggccgcagcaggcaaccctcagccgagctacaggtggttcaaagacggcaaagagctaaaccgctcgagagacatccgaattaaatacggcaacgggaggaaaaattcacgcttacagttcaataaagtgaaggtcgaggacgccggtgagtacgtctgcgaggcagaaaacatactggggaaagataccgtcagggggcgtctctacgtcaatagcgtctccactacgctttccagctggtccggccacgctagaaaatgcaatgaaaccgccaagtcttattgcgtgaatggcggagtgtgttactatattgaaggaattaaccaactgtcgtgcaaatgccccaacgggttttttggtcaacgctgtctggaaaagctgcccttaaggctgtatatgcctgacccgaaacagagcgtattgtgggataccccgggtacaggagtatcctcctcccagtggtccacttctccttctaccctggatctgaactag

SEQ ID NO: 232275 - DNA, 2559 bp, Artificial Sequence
  Description of Artificial Sequence: Synthetic coding sequence
atgaggcaagtgtgttgcagtgctttgccccctccgccactggagaaaggtagatgcagcagttacagcgatagctcgtcttcctcttccgaaaggagctcaagttcgagctcctcctcttccgagagcggatcctcgagcaggagctcttccaataacagttccatctccaggcccgcagctccgccagaacctagacctcagcaacagccacagccacgttctcctgctgcacgcagagcagctgccagatccagggccgcagccgcaggtggaatgcgccgagacccagcaccaggattcagcatgctgctctttggcgttagtcttgcatgttactctccaagcctgaagagcgtgcaagaccaagcttacaaggccccagtggtcgtagaaggaaaggttcaaggcctcgttccagctggtggctcgtcttccaattcaacccgcgaacccccagcttccgggcgagtggcgcttgtaaaggtgctggacaagtggcctttgaggagtggtggtctccagcgcgaacaggtcatcagtgtcgggtcctgtgttcctttggaacgtaaccagcgatatatcttcttccttgagccaacggagcagccgcttgtttttaaaactgcttttgcccctctggacaccaacggcaagaacttaaaaaaggaggtgggcaagattctgtgcacggactgtgctacgcggccaaagctcaaaaaaatgaagtcccagacaggacaggtgggtgaaaagcaaagtctaaagtgtgaggctgctgcaggaaatccacagccaagctacaggtggttcaaggatggtaaggaactaaatagaagtcgagatattagaatcaaatatggaaacggtaggaaaaattctaggctgcaattcaataaagtgaaagttgaggacgcaggggagtacgtttgtgaggccgagaacatcctgggcaaagacaccgtgcgcggtcggctatatgtgaacagcgtatcgaccactctctcatcctggtcgggacatgccaggaagtgcaatgagacagccaaatcgtactgtgtgaacgggggagtgtgttattatattgaggggatcaaccaactgagctgtaagtgtcctgttggatatacaggagaccgttgccagcagttcgcaatggtgaatttttctacacggctagggggagatgtggaggaggccgaagaattgtatcagaagcgcgtgttgaccatcaccggcatttgtgtggcgttgcttgttgtcgggatcgtgtgcgttgtggcctactgcaagaccaagaagcagaggaagcaaatgcacaatcacctcaggcaaaatatgtgtcctgcacatcagaacagatccctcgcaaacggaccctcacacccacgcctagacccagaggagatacaaatggccgattacattagcaaaaatgtgcctgctactgaccatgtgattcgtcgtgaaaccgaaactacttttagcgggagtcattcctgcagcccaagtcaccactgttccacagctacacccaccagtagccatcgtcacgagtctcatacttggtccctggaaagatctgaaagcctcacatctgattcccagtcaggaatcatgttaagctctgttggcacctccaaatgtaacagtcctgcctgtgtcgaggccagagcacgtagggctgcggcttacaaccttgaggagagaagacgcgcaacagctcccccttatcacgattctgtcgattctctgcgcgattctccccactctgagcgctacgtctcagctttgacaactcccgctagactgagccccgttgatttccactattccttggccacccaagtgccgaccttcgagatcactagtcccaactcggcacacgccgtctccctgcctccagcagctccaatcagttatagactggcggaacagcagccactgctaagacacccagcacccccaggtcctgggccagggcctgggcctggaccagggccaggtgccgacatgcagcgatcctatgacagctactactaccctgctgcgggaccagggcctcgcagaggtacctgtgccctggggggttccctcggatcactgcctgcctcccccttccggataccagaggatgatgaatacgaaacaacacaggagtgcgcaccccctccccctccacgtccaagggctcgaggcgcatcaaggaggacctccgcaggacccagacggtggcggcgtagccggctgaacggtctggctgcgcagagggcgcgagctgctcgcgacagcctgtcattatcatccggaagcggaggcggtagtgcctctgcatctgacgacgacgccgacgatgccgatggtgcacttgctgccgaaagcactccattcttagggttgcggggtgctcatgatgcattgcgttcagattctcctcccctgtgtcccgctgccgattccaggacctactacagcctggattcccattccactcgtgcctccagccgacactctagaggaccccctcctcgtgccaaacaggacagcgccccattatag

SEQ ID NO: 232276 - DNA, 2535 bp, Artificial Sequence
  Description of Artificial Sequence: Synthetic coding sequence
atgcgacaggtttgttgctcagcactgccccctcccccactcgagaagggtcgttgctcatcttatagcgattctagtagttcgtcatccgaacgatccagcagttccagcagcagcagtagcgaatccggatcctcctccaggtctagctcgaataacagcagcataagtcggccagcggctccccctgagccgagaccacagcagcaaccacagcccagatcgccagcagcaagaagagcagccgcaaggtcccgggcagccgcagcgggaggcatgaggagggatcccgcaccaggcttcagcatgctcctgttcggagtttctctggcctgctacagtccctccttgaaatccgtccaagatcaagcctacaaagcccctgtggtggtcgaggggaaagttcagggactcgtgcccgctggcggttcttcctccaacagcacccgggagcctccagcctccggtcgcgtcgctctcgtgaaggtcctagataaatggccgctgaggtctggcggactgcaaagagagcaggtcataagcgttggaagctgtgtgccccttgagaggaaccagaggtacatcttcttcctcgagccaacagagcagcccctcgtgtttaagacggccttcgctccgcttgacaccaatgggaaaaacctaaagaaggaggttggaaagatcttatgtaccgattgtgcaaccaggcccaaattgaagaagatgaagagccagaccggacaggtgggtgagaaacagagtcttaaatgcgaggctgcagccggaaacccccagccttcctaccgatggtttaaggacggcaaagagctcaacagatcccgggacatccgtattaagtatggcaatggaagaaagaactcccgcctgcagtttaacaaagtaaaagtggaagacgcaggcgagtacgtctgtgaagccgaaaatattctgggaaaagacacagttcggggtcgcctttacgtgaattctgtgtccacaacactttctagctggagtgggcatgccaggaagtgtaatgaaactgcgaaatcatattgcgtgaacggcggagtctgctactatatcgaaggcattaaccagctgtcatgtaagtgccccgtgggttatacaggggataggtgccagcaatttgccatggtaaactttagtaaagcagaggagctctaccaaaaaagagttttaaccattactgggatctgtgttgcactacttgttgtgggcatcgtttgtgtcgttgcttactgcaagaccaagaaacaaaggaaacaaatgcataaccacctgcgccagaacatgtgccccgcacatcaaaatcgtagtctggctaacggtccgagtcacccaaggttagaccctgaggaaatccagatggctgactacattagtaagaatgtgccagcgacagaccatgttatccgtagagaaacagaaaccacgttttctggatcccattcctgcagtccaagccatcactgctctaccgccacacctaccagtagtcatcggcatgagtctcacacatggtcattagaacgatcagaaagtctcacctctgattcccagtcaggcattatgcttagttccgtaggtacatctaaatgcaattcccccgcatgtgtcgaagccagggcgaggagagccgcagcatacaatctggaggagcggagacgagccacagctccaccttaccatgatagcgttgacagccttcgcgactccccacattcggagaggtatgttagtgccctcactactcccgctagactgtccccagtcgactttcactactccctggcgacccaggtgccaacgttcgagattactagccccaacagtgcacacgcagtgagcttaccacctgctgccccaatttcatacaggttagcagaacaacagcctctgcttagacacccagctccccctggcccaggacccggaccgggtccagggccaggacccggagctgatatgcaacgcagctacgatagctactactatccagcagcagggcctgggccacgcagagggacatgtgccctgggtggaagtctggggtcactgcccgcatcacccttcaggattccggaagatgacgagtacgaaacaactcaggaatgcgcccctccgccacctcctcgaccacgggctagaggcgcttctcgtcgcaccagtgccggaccacggcgttggcgacgaagcagactaaatgggttggccgctcagcgcgcacgggctgctagggattctctgagtctgagcagcggcagcggagggggatccgcttccgcatcagatgatgacgccgatgacgctgatggagccctggctgccgagtccacaccgtttctcggactacgcggtgcacacgacgcactgaggtcagactctcccccactgtgtccagctgccgactcaaggacctactattcgctcgacagtcactcaacacgcgcatcatctagacactcaaggggccctccaccgagagcaaaacaagacagcgcacccttgtag

SEQ ID NO: 232277 - DNA, 2577 bp, Artificial Sequence
  Description of Artificial Sequence: Synthetic coding sequence
atgcgccaagtgtgttgcagcgctctgcccccaccccctctagaaaagggacgctgttccagctactcagatagttcaagcagcagcagtgaaaggtccagcagctcttctagttcaagttctgaatcaggaagtagttcaagatccagctctaacaactcaagcatctcccgtccagctgccccacccgaacccagaccacagcaacagccacagcccagatctcctgccgctcgcagagctgcggctcggagcagggccgcagccgcaggaggcatgcgccgagaccctgccccaggattcagtatgctgctttttggagtgtctctggcatgctactccccttcccttaagagcgttcaggatcaggcttacaaagcccctgttgtggttgagggaaaagtgcaagggctggtgcctgcaggtggttcatccagcaattctacaagagagcctccagccagcggccgagtggccctggttaaggtcttggataagtggccattgcgaagcggaggcctccagagggagcaggtgatctcagttggctcatgcgttcccctggaacggaatcaaaggtatattttcttccttgagccaactgagcaaccactagtgtttaagacggcattcgccccactggacactaatggtaagaatctcaagaaagaagttggaaagattttgtgtacagactgcgccaccagaccaaaactgaagaaaatgaagtcacagactggacaggtaggcgagaaacagagcctgaagtgcgaggccgcagctgggaatcctcagccttcgtaccgctggttcaaggacggaaaagagctgaataggtctcgcgacatccggattaagtatggaaacggaagaaaaaattctagattacagttcaacaaggtcaaggttgaggacgcaggcgagtacgtctgcgaggccgagaacatcttagggaaagatactgtgcgcggtcgtctgtatgtcaacagtgtatccaccacattgagttcatggtctggccatgcccgaaagtgcaacgagactgcaaagtcttactgcgtaaacggcggtgtctgctactacattgaagggataaaccaactgagctgcaaatgtcccaacggcttctttgggcagagatgtttagagaaactgcccctaaggctctacatgcccgaccccaaacagaaacacttggggttcgaattaaaagaggccgaggagctgtatcagaagcgcgtgttgacgattactggtatttgcgtcgcactgcttgtcgtaggtattgtgtgcgtggtggcctactgtaagaccaaaaagcagaggaagcagatgcacaatcacctaagacagaatatgtgccctgcccatcaaaaccggagcctcgctaatggcccttctcacccccgtttggacccagaagaaattcagatggccgactacatcagtaagaatgtgcctgctaccgatcacgtaatacgacgggaaacagaaacaaccttctctggctctcactcctgttcacctagccatcactgttccacggccacacctacgtcatcgcatcggcatgaaagccacacctggagtctcgaacgttctgagagccttacgtctgactcacaaagcgggatcatgctgtccagtgtcgggacaagcaagtgtaattcacccgcttgcgtcgaggcaagggcacgcagagctgctgcctacaacttagaggagcggaggcgggctacagcccctccttaccatgactccgtggacagcctaagggacagcccacactctgaacgatacgttagcgccctaactacaccagcccgtttgtccccagttgacttccactattctcttgccacacaagtaccaactttcgaaatcacttcccccaattccgcccacgctgtctccctgcctccagcagcgcctatcagttaccgtctcgccgagcagcaaccattgttacgacacccagcacccccaggcccagggccaggacctgggcctgggccagggccaggcgctgatatgcagcggtcttacgactcttactactaccccgcagccggtcccggaccacggaggggaacatgcgcactggggggatcccttggctccctgccagctagtccattcagaatccctgaagatgatgagtatgagaccactcaagaatgcgctccaccacctcctcctcggcctagagctcgaggcgcatctaggagaacttccgccggtccgagacggtggaggcgcagccgccttaacggcctcgcagcccaacgcgcaagagctgcacgagattctctgagtctgtcgtctggctccggagggggatctgcctccgcctcggacgacgatgccgacgacgcagacggggctctggccgctgagtccacaccctttctcgggttacggggtgctcatgatgccctgcggtcagactctccacctttgtgcccagccgcagattcgcgtacctactattctttagacagtcattctactcgggcatcatcccgtcattccagaggaccacctccacgggctaaacaggattccgcacctttatag

SEQ ID NO: 232278 - DNA, 2091 bp, Artificial Sequence
  Description of Artificial Sequence: Synthetic coding sequence
atgagcgaaggcgctgctgcagcctctccacccggagccgcaagcgcagccgcagcctctgccgaagagggcaccgctgctgctgcggctgctgcagctgccggaggagggccagacggcggaggtgaaggggcagctgaacctcctagggagttgagatgtagtgactgtatcgtctggaatcgtcagcagacttggctgtgcgttgtccctttgtttatcgggtttattggcctcgggctgtccctgatgcttctgaagtggattgtagtcgggtcggtgaaagagtatgttcctaccgacttagtcgattcaaaaggcatgggacaggatccatttttcctctccaagccatcctcattccctaaggccatggagactactacaacgacaactagtacgaccagccccgcaaccccctccgcaggaggcgctgccagttcccgaactccaaatcgcatcagcacccgactaaccacaattactcgggctccaacgaggtttcctggacacagggtccccatccgcgcttctcccagatctaccactgcacggaatactgctgctccagcgaccgtaccgagcacaactgcacctttctttagttcttctaccctgggcagccgcccaccagtgccgggaaccccatcaacccaagcaatgccttcatggcccaccgctgcctacgccacatcaagttacctccacgactctactccttcctggacactgtcaccattccaggacgctgccagttcatcatcaagcagcagctcatccgccacaactaccacacccgagacatcgacctcccctaagtttcataccaccacctacagtactgaacgctcagagcacttcaagccttgtcgcgataaagatttggcctactgtctgaacgatggggagtgcttcgtgatcgagactctcaccgggtctcacaagcactgtcggtgcaaggagggttatcagggagttagatgcgaccagtttctgcccaagactgatagtatcctgtctgacccaactgaccatcttgggattgaattcatggaatccgaagaagtgtaccaacgacaggtgctctccattagttgcattattttcgggattgtcatcgtcgggatgttttgcgccgcattttattttaaaagcaaaaagcaagcaaaacagatccaggaacagcttaaagtgcctcagaacggcaagtcgtattcattgaaagcgagtagcaccatggccaaaagcgagaatctcgtgaaaagccatgtccagctgcagaattattcaaaagtggaacggcatcccgtgacggcactggagaagatgatggagagtagctttgtgggcccacagagcttcccagaagtgccaagccccgacaggggatcgcagtctgtgaagcatcaccggagcctcagcagctgttgtagcccaggacagagatcaggaatgctccatagaaacgccttccgtcgcacacctccctcacccaggtcaagacttggtggcattgtagggccagcgtaccagcaactcgaggagagccgcatcccagatcaggacactatcccatgccaaggatattcttcatcaggattgaagacccagcgcaacacctcaatcaacatgcagctgcccagtcgcgaaaccaatccctatttcaactcgctggagcagaaggacctagttgggtatagttcgactcgcgctagtagcgtgcctatcatcccctcagttggacttgaagaaacctgcctccagatgccaggaatctctgaggtgaaatcaatcaaatggtgcaagaacagttattcagccgatgtggttaatgtgtcaattcccgtctccgattgtctgattgccgagcagcaggaggtgaaaatcctccttgaaacagttcaggaacaaattagaatcctcacagacgcgcgtaggagcgaggattacgagttggcctctgtggagacagaagactctgctagcgaaaatactgctttcctgccccttagtcctaccgccaaatcagagagagaggcacaatttgtgcttcggaatgaaatccagcgagacagcgcccttacaaagtag

SEQ ID NO: 232279 - DNA, 1500 bp, Artificial Sequence
  Description of Artificial Sequence: Synthetic coding sequence
atggagtgtggcattcctccgaccctggtatgcgtgggcaggggcggtgggttacatactatcaatatcatcatttggtattatttcccaagcgcgtggcgcacgtgtttcaatatctcatcctctgtgggacttttgctcactaactcctataagttctataccaccacatattctacagagcgcagcgaacatttcaaaccatgtagggacaaagatctggcctactgcctgaatgacggggagtgctttgtgatagaaaccttaactggatctcataagcattgtcggtgcaaagagggctatcagggcgtacgttgtgaccagttcctgcccaagacagattccattctctctgatcccacagaccacctgggcattgagtttatggagtctgaagaagtctatcaaagacaggtgctgtcaatctcttgcatcattttcggtatcgtgatcgttgggatgttttgcgcggctttttacttcaagtcaaagaagcaggccaagcaaatccaggagcaactgaaggtccctcagaatgggaagagctactccctgaaagcatccagtacgatggctaagtcagaaaatctggttaagagtcatgtccagcttcagaactatagcaaagtggagcgccacccagttacagccctggaaaaaatgatggagagttcctttgtgggccctcagtcctttcccgaggtccctagtccagaccggggatctcaatccgtcaagcaccacaggtctctcagctcgtgttgttcacccggacagcggagcggcatgctccatagaaatgcctttcgccgtacccccccttccccacgcagcaggttgggcggaatcgtgggacccgcatatcagcagctcgaagagagccggatacccgaccaggacacgatcccgtgtcagggcatcgaggtgcgaaagactatcagccatttgcccatacaattgtggtgcgtggagcgccctttggacctgaaatactcatcttccggcttaaagacccagcgcaatacaagcataaatatgcagctgccatctcgggagacaaacccttatttcaactctctggaacagaaagatttagtaggatacagcagtacaagagcctcaagtgtgcccattatcccatccgtcggtctggaggaaacctgccttcagatgccgggaatatccgaagtcaagagtattaaatggtgcaagaattcatacagcgcggatgtagtgaacgtctcaatcccagtgtcagactgcctaatagcagaacaacaggaagtgaaaatcctccttgagaccgtgcaggaacagattaggattctgacagacgcgaggcgctccgaagattacgagctggcctccgtggaaacagaagattctgccagcgagaacacagcatttcttcccctgtccccaacagcaaaatctgaacgcgaggcacagtttgtcctgcgtaatgagatccaacgcgactctgcactgaccaaatag

SEQ ID NO: 232280 - DNA, 2163 bp, Artificial Sequence
  Description of Artificial Sequence: Synthetic coding sequence
atgtctgagggcgcagcagcagctagcccacccggtgctgcgtctgccgcagcggcttccgccgaagaggggactgccgctgcggcagccgctgctgccgctggcggaggtcccgacggcggtggagaaggtgccgctgaaccccctagagaactacgctgcagcgactgcatcgtgtggaatcgccaacagacctggctctgcgtggtgcctctgttcattgggttcatcggactcgggctatcattgatgctcttaaaatggatcgttgtaggaagcgtgaaagagtacgtgccaactgatctcgttgactctaagggcatgggccaggatccctttttcctgtctaagcctagcagcttccctaaggcaatggagactaccacaactaccacgtctacaaccagcccagcaacaccatctgcaggaggtgctgcctcctcacgcacccccaatcggataagcacacgactgacaactatcacacgggcacccaccaggtttccagggcaccgcgttccaatccgcgcttcacctcgaagtacaactgctagaaacactgccgcaccagctactgttcccagcacaactgcaccgttcttttcttcatcgacacttgggtctcggccaccagttcctggtaccccttctacacaagcgatgccaagttggcctactgctgcctatgccactagcagctacctgcatgactctactccatcctggaccctttcaccctttcaagatgcagcctcatcatccagttcctcctcgtcatccgcaaccacaaccacccccgagacttctacgagtcctaaattccacacgaccacatattcaactgaaagatctgagcacttcaagccttgccgagacaaggatctggcctactgtctcaacgatggggagtgcttcgtcattgaaacgcttactggttcccataaacattgtagatgtaaggaagggtaccagggagttcgctgcgatcagtttttgcccaagactgacagtatactttccgacccgacagaccacctgggcatcgaattcatggagtccgaagaggtctatcagagacaagtcctgtccattagttgtatcatattcggcattgtgatagtcgggatgttctgcgctgctttctatttcaagagtaagaagcaggccaaacagattcaggagcaacttaaagtgccccagaatggaaaaagttatagtctcaaggctagctctacaatggccaagtctgagaacttggtgaagagtcacgtgcagctgcagaactacagcaaggtggaacgccacccagtgacagctctggagaaaatgatggagtcaagctttgtcggcccacagtcatttcctgaggtaccatctcctgatagggggtcccagtccgtgaaacaccacagaagcctgtcatcatgctgcagtccagggcagaggtccgggatgctccatcgcaatgcatttagacgaacaccgccttcacccaggtccagactggggggaatcgttggacctgcctaccagcagctcgaggagtcccgcataccagatcaagatacgatcccttgccagggtattgaggtcaggaagaccataagccatctgcccattcagttgtggtgtgtcgagcgccctctggatttgaaatatagtagctctggcctcaaaactcagcgaaataccagtatcaatatgcagctgccaagtcgggagaccaatccatactttaactccttagaacagaaggacctggtgggatattcatcaactcgggcttccagcgtcccaattatcccatcagtgggtcttgaggaaacctgcttgcagatgcctggcattagcgaggtgaaatccatcaaatggtgcaaaaactcttacagtgccgacgtggtcaacgtgagtattccagtctccgactgcttgatcgccgagcaacaggaggtaaaaatactgcttgagactgtccaggagcagatccgcatactgacggacgccagaaggtcagaggactacgagctcgccagtgtcgaaacagaagattctgcatccgaaaatactgcctttctcccactcagtcctaccgccaagagtgaacgcgaggcgcagttcgtgctgagaaatgaaatccagagagactcagcgctgaccaaatag

SEQ ID NO: 232281 - DNA, 2088 bp, Artificial Sequence
  Description of Artificial Sequence: Synthetic coding sequence
atgagcgagggggctgcagcagcctccccccctggggcagcatctgcagctgccgcatctgctgaagaggggacagcggctgccgcagcggctgctgcggcagggggtggacccgacggcggaggcgagggagcagccgagcctccccgagaattgcggtgctcggactgtatcgtctggaatcgccaacagacctggctatgcgttgtgccactcttcataggatttattgggcttggcctcagcctaatgctgctcaagtggatcgtcgtgggcagtgtcaaggaatatgtgcctacagacttggtggatagcaagggcatgggccaggaccccttttttctgagcaagcccagtagttttccaaaagccatggaaactactaccaccaccacgagcactactagtcctgcaactcctagtgcgggaggagctgcatctagccggacaccgaaccgaattagcactagactaacaacaatcacccgggctcccacacgatttcccggtcacagggtccctatacgcgcaagtccacggtcaaccacagctaggaataccgccgcacccgcaacagtcccttccaccacagcccctttcttttcaagctctacgctgggatccaggcccccagttccaggtacaccctccactcaggcgatgccatcctggcctacagctgcttacgccacatcttcctatctgcatgatagcacgccttcatggacactcagcccttttcaggacgcggcttctagctcatcttcatcatctagttctgctactactaccacacccgaaacctctaccagccctaagttccacacaactacctacagtaccgagaggtccgaacactttaagccctgtagagacaaggatttggcttattgtctcaatgatggtgagtgcttcgtgatagagactcttacaggatctcacaaacactgccggtgcaaggagggctaccagggtgtgagatgcgaccagttcttgcccaaaaccgacagcattttaagcgatccaacgcacatcggtattatattcaccgagagtgaagaggtctaccagcgtcaggtgctgtctatcagctgcatcatctttggaatcgtcatagtgggtatgttttgtgctgctttctattttaaatccaagaaacaggccaagcagatccaggagcagctaaaggtgccccagaatggcaagtcttattccctgaaggcctcaagtacgatggctaaatccgagaacttagtgaagagtcatgtgcaactgcaaaactacagcaaagtggagcgacatcccgttacagctcttgagaagatgatggagagctcttttgtcggcccacagtcttttcccgaagttccgtcgcccgacagagggagccagtcagtcaaacaccataggagcctcagctcatgttgttctcctggccagcggtcgggaatgctgcaccgcaatgccttccgcaggactcccccttctcccaggtcgcggctgggaggaattgtggggcctgcatatcagcaacttgaggaatctagaatccccgatcaggataccataccctgtcagggttactccagtagcggactgaagactcagcgaaatacttccatcaatatgcaactaccatccagggagacaaacccatattttaattctctggaacagaaagatttggtaggctactcaagtactagagcgtctagcgtgccgatcatcccctcggtgggactcgaggagacttgtctgcagatgcctggcatcagcgaggtgaaaagcattaagtggtgcaagaattcatactctgctgacgtggtgaatgtgtcaatccccgtctcagattgcttgattgctgagcagcaggaggtgaaaattctcctcgagaccgttcaggagcagataaggattctgacagatgcccgacggtccgaggactacgagctcgcttccgttgagacagaagactcagcctccgagaataccgccttcctgcccctctcaccaactgccaaatccgagcgagaagctcagttcgtgcttcgcaatgagatacagagagacagtgcactaaccaagtag

SEQ ID NO: 232282 - DNA, 1041 bp, Artificial Sequence
  Description of Artificial Sequence: Synthetic coding sequence
atggagtcagaagaggtgtatcagcgacaggtgttatcaatcagctgtattatcttcgggattgtgattgtgggcatgttttgcgctgcattctatttcaaatcgaaaaagcaggcgaagcagatccaggaacaattgaaggtgcctcagaacggcaagtcttatagtctcaaggcgagttctaccatggctaagtcagagaacttagtgaaaagccatgtacagcttcagaactatagcaaagttgagcgacatccggtgaccgccctcgagaaaatgatggagtctagtttcgtcggccctcagagtttccccgaggtgcccagcccagacaggggttctcagagtgtgaaacaccataggtcccttagcagttgctgcagccccggtcaacgatctggaatgttacataggaatgctttcaggcgcacgccgccatctcctaggagccggcttggcggtatagtgggccctgcttaccagcagctggaagagagcaggatccctgatcaggacaccatcccttgccaagggtacagcagttcagggttgaagactcaacgaaataccagcatcaacatgcagctcccatccagagaaactaacccgtatttcaatagcctggagcagaaagacctggttggctatagcagcacccgagcctctagcgttccaataatcccatccgtgggtctggaagaaacatgtctgcagatgccaggaataagcgaagttaagtctattaaatggtgtaaaaactcatattcagcagacgtcgtcaatgtgagcatacccgttagcgactgtctcatagccgaacagcaagaagttaagattctgctggagaccgtccaagaacaaattagaattctgactgatgcacggaggagcgaggactatgagttggccagtgtcgagactgaggattcagcttcagaaaatacagcatttctgccactgagccccaccgcaaagagcgaacgagaagcccaattcgttttgcgtaacgagattcagcgcgacagcgctctgaccaagtag

SEQ ID NO: 232283 - DNA, 1041 bp, Artificial Sequence
  Description of Artificial Sequence: Synthetic coding sequence
atggagtccgaggaggtgtaccaaagacaggtcctgtccataagctgtattatatttggcatcgttatcgttggaatgttctgcgcagccttctatttcaaatcaaaaaaacaggccaagcagatccaagagcaactgaaagtgcctcagaacggcaagagctacagtctgaaagcatcatctaccatggcaaaatcagagaatctggttaagtctcacgttcagctccagaactacagcaaggtcgagcgccatcccgtaactgctctggagaagatgatggagtcttctttcgtcgggccacagagttttccagaagtaccctctccagatcgcggaagccaaagtgtgaaacatcacagatccctgagcagctgctgttcccctgggcagagatctgggatgcttcaccgcaacgctttccgacggacgcctccttcacctaggtcacgacttgggggtatagtgggcccagcttaccagcagctggaagagtctagaattccagatcaggacacaatcccttgccaaggctattcctcatccggattaaagacacagagaaacacttcaatcaacatgcaactacctagcagggagacaaacccatattttaattctctggagcagaaagaccttgtgggctactctagcacacgcgcttcttcagtacctattattccgtcagtcgggctggaggagacttgcctacagatgccaggtatcagcgaggtgaaaagcatcaagtggtgcaagaactcctattctgcagacgtggttaacgtgtctatccccgtcagcgattgcctgatagccgagcagcaggaggtgaaaatccttttggagactgtccaggagcagataagaattctcacggacgccagaaggtccgaggactacgagctcgccagcgtggaaacagaggatagcgcttcggagaacaccgcttttctgcctttaagtccgaccgccaaatccgagcgggaagcccagtttgtgctgcgcaacgaaatccagcgagatagcgcattgacaaaatag

SEQ ID NO: 232284 - DNA, 171 bp, Artificial Sequence
  Description of Artificial Sequence: Synthetic coding sequence
atgcccacagatcatgaagagccatgcgggccatctcataaaagcttttgtctgaacggcggactttgctacgtcatcccaacaatcccaagccctttctgttcactacacgagaacgagaatgataacaacgaggatctttacgatgatcttctacctcttaacgagtag

SEQ ID NO: 232285 - DNA, 348 bp, Artificial Sequence
  Description of Artificial Sequence: Synthetic coding sequence
atgcctactgaccacgaagagccgtgcggaccctcccataagtcgttctgtctgaatgggggactatgttacgtgattccaaccattcccagcccattctgccgttgtgtggaaaattacacgggagcccgttgtgaggaagtgtttctaccaggaagcagcattcagaccaagtccaacttatttgaagctttcgtggcgctggctgttttggtcaccctgatcatcggcgcattctacttcctgtgccgaaaagggcactttcagcgggcttcttccgtccaatacgacattaatctggttgaaacaagttctaccagtgcgcaccactctcacgagcagcattag

SEQ ID NO: 232286 - DNA, 273 bp, Artificial Sequence
  Description of Artificial Sequence: Synthetic coding sequence
atgcccaccgatcatgaggaaccctgcggcccatctcacaaaagcttttgcctgaacggcggattgtgttacgtaatacctaccatcccctctcccttttgccggtgcgtcgagaactacactggcgctagatgcgaggaggttttcttgcctggctcctctatccagacgaagtctaacctgtttgaggctttcgtagctttagccgttctggtaacactgattatcggcgcattctatttcctatgtcgctgcgggaacacctgcatgtag

SEQ ID NO: 232287 - DNA, 615 bp, Artificial Sequence
  Description of Artificial Sequence: Synthetic coding sequence
atgatgcctagctgtaaccgctcttgctcctgctcacgaggaccgagtgtggaggacggaaagtggtacggcgtgcgttcatacttgcacctattttacgaagattgcgcaggcactgccctcagtgatgatccagagggtccccctgtgctttgtcccaggcggccttggccaagtttgtgttggaagatttcactttcgtctggcaccctgttgctgttgttgggtgttgccgcactcacgaccgggtacgccgtgccccctaaactggaggggataggtgaaggcgaatttctcgtgctggatcagcgcgcagcggattacaaccaagctctgggcacctgccggctcgccggaaccgccctgtgtgtggctgccggagtcctcctcgccatctgtctgttttgggccatgatcggctggttatcgcaagacaccaaggctgagcccctggacccggaagcagactctcatgtcgaggtctttggagacgaacccgaacagcagctgtcaccaatcttccgtaatgcatcagggcagtcatggttttcaccacctgcatctccgtttggacagtcaagcgtgcagaccatccagcctaaaagggattcctag

SEQ ID NO: 232288 - DNA, 615 bp, Artificial Sequence
  Description of Artificial Sequence: Synthetic coding sequence
atgatgccctcttgcaaccgcagctgctcgtgctcacgcggacctagcgtggaagacggaaaatggtatggcgttaggtcttacctgcatctcttctacgaggattgcgcagggaccgcattgtccgacgatcctgagggacccccagttctgtgccccaggagaccttggccctcgttatgctggaaaatttcactctcctcagggacgcttcttctgctcctgggcgtggcagccttgaccactgggtacgctgtgccgccaaaattggagggaattggagagggcgaatttctcgtcctcgatcagcgggcagcagactacaatcaggctctgggcacatgtaggttggccggaacagccctgtgcgtcgccgcaggagtgttactggctatatgcctattttgggctatgattggctggttatcgcaggacaccaaggccgaacctctggatcctgaggccgactcccatgtggaggtcttcggggacgagcccgagcagcaactcagccccatattccgcaacgcttccggacagtcctggttttctcccccagccagcccctttggtcagagtagcgtgcagaccattcagccaaagagggattcatag

SEQ ID NO: 232289 - DNA, 1329 bp, Artificial Sequence
  Description of Artificial Sequence: Synthetic coding sequence
atgtatcaaaggatgttacggtgcggggctgaactggggtctcccggaggcggtggcggtggaggtgggggtggcggagccggtggcaggctcgctttgctgtggatagtccctctaacgctatccggtctactgggcgtggcctggggagcctcctccttaggggcacaccacattcatcatttccacggttctagcaagcaccactctgtgcccatagctatttaccggtcacctgcgagcttacgaggaggacacgccggaaccacttacatctttagtaaaggaggtgggcagatcacgtacaaatggcccccaaatgacaggccttccacccgagcagatcgcctcgccattggcttttcaacagtccagaaggaagcagtgctcgtccgggtagattcaagttccggcttgggagattatctagagctccacatccatcaaggcaagatcggcgtgaagtttaacgtagggactgacgacatcgcgatcgaagagtccaacgctattattaacgatggaaaataccacgtggtgaggtttacccgatcagggggtaacgcaaccttacaggtggattcctggccagttattgagcggtatccagccggaaggcagcttaccattttcaattcccaggctacgattattattggaggaaaagaacaggggcagccgttccagggtcaactctccggcctttattataatggtcttaaggtgctgaacatggccgctgagaacgatgccaatatagccatagtaggcaatgtccggctcgtcggtgaagttccatccagcatgacaaccgagtctacagcgaccgcaatgcagagcgagatgagtacaagcatcatggagaccacaacgacactggcaacatctactgctcggaggggaaaaccgcctaccaaggagcccatttcacagacaacggacgatatcctggttgcatcagccgaatgcccttccgacgacgaggatatcgacccctgtgagccttctagcggcggactggccaaccccacgagagcaggaggcagagagccctatcctgggtccgccgaagtgattagagaaagcagctccacgacagggatggtggttggtattgtcgcggctgcagccctctgcatccttatcctattgtatgcaatgtataagtaccgcaatagggatgaaggaagctaccacgtggatgagagccgtaactatatcagcaattccgctcagagcaatggagctgtggtaaaagaaaagcagccctcttctgctaaatcctcaaataagaacaagaagaataaggacaaagagtactatgtgtag

SEQ ID NO: 232290 - DNA, 4524 bp, Artificial Sequence
  Description of Artificial Sequence: Synthetic coding sequence
atggggaccgctctcttgcaacgagggggttgttttctcctatgtctgagcctgttgctcctgggatgttgggctgaacttgggtccggcctcgaatttcctggggcagaggggcaatggacccggtttcctaaatggaacgcttgctgtgagtcggaaatgtcttttcagctgaagacccggtctgcccgtggattggtgctgtatttcgacgatgaaggattttgcgattttcttgaactaatattaacccggggagggcgtttgcagctatcctttagtatcttttgtgccgaacccgctacactcttagcagataccccagtgaatgatggggcttggcactctgttagaatcagaagacaatttagaaatacaacgctgttcatcgatcaggtggaggcaaaatgggtggaagtaaagtcaaagagaagagatatgacggtgttttccggcttattcgtaggtggactgcctcctgagctcagagcagccgcactcaaactaacactagcctccgtgcgggaaagagagccgttcaaagggtggatccgggacgttagagtgaacagttcccaggtcctgccagtggattccggcgaagtaaagctggatgacgagcctcccaattccggcggtggctctccctgcgaagctggcgaggaaggtgaagggggagtgtgtctgaatggaggagtgtgttctgttgtggacgaccaggctgtctgtgactgttctaggacgggattccgcggaaaagactgctcacaggaggataacaacgttgagggacttgcgcacttgatgatgggtgaccagggaaagagtaagggcaaagaagaatatatcgctacatttaagggatcggaatacttctgttatgacctgtcacagaatcctatccagagcagtagcgatgaaataactctcagctttaagacgctccagaggaatggactgatgctccacacaggaaagtccgccgactatgtcaatctggcccttaagaacggggctgtgtctctggtcattaatttggggagcggcgcatttgaggccctagttgagcccgtgaatgggaagttcaatgataacgcctggcatgacgtcaaggtgacacggaacctgagacagcatagcgggattggtcatgcaatggttacaattagtgtcgacggcatcctcactaccactggctatacacaggaagactacaccatgcttgggagcgacgatttcttttatgtgggaggaagtccgtctacggcagatctgccaggcagtcccgtctctaacaatttcatggggtgcctgaaggaggtggtctacaaaaataatgatgtcagactggagctatcccggcttgccaagcaaggcgatcccaaaatgaaaattcacggagtggtggcgtttaaatgcgaaaatgtggcgaccctggaccccatcacattcgagacgccggaatctttcatctctctgcctaaatggaacgccaagaaaaccggaagcattagcttcgatttcaggaccactgagcctaacggtctgatcctattttcccacggtaagccgaggcatcaaaaagatgctaaacatcctcagatgatcaaagtggacttcttcgcaatcgagatgctcgacggccacctgtacctcctcctcgacatgggctctggcaccattaagataaaggctttgttgaaaaaggttaacgacggggaatggtaccatgtagactttcagagagatggacgctccggaacgatatctgtgaacaccctccgcacgccatatacagcgcctggcgaaagcgaaatccttgacctggacgatgagctttatctgggcggattaccagagaacaaagctggattagtgtttccaaccgaggtgtggacagcgttgcttaattatggctacgttgggtgtattagagatctctttatagatggccaaagcaaagacattcgccaaatggccgaagtgcaatcaacagcaggagtgaagccatcttgtagcaaagagactgccaagccgtgtctgtcaaatccttgcaagaataatggaatgtgcagggacggttggaacaggtatgtctgtgactgttccggtaccggatacttggggaggtcttgcgagagagaagcaacagttctgagctatgatggcagcatgtttatgaagatacagttaccagttgtgatgcacacggaagccgaagatgtttctctcaggtttagatcgcaacgagcatatggtattctaatggcaacaacttccagggatagcgccgacactcttcggcttgagctcgatgccggaagggtgaaactaacagtcaacttggattgcatccgtatcaattgcaactcatccaagggtccagagacattgtttgccggatacaatctgaacgacaacgagtggcatacagtgcgggtagtgagacgaggaaaaagccttaagctgaccgtggacgatcagcaggccatgaccgggcagatggctggggaccatactcggttagagttccacaatattgagaccggtattattacagagcgacggtacctgagtagcgtcccctctaactttattggacatttgcaaagcctcacatttaacggtatggcttatatcgacctgtgcaagaatggggacattgactattgtgagctgaacgcgcgattcggattcaggaatatcatagccgatccagtgaccttcaaaaccaaaagtagctacgttgcactggcaactctgcaggcatacacaagtatgcacctcttctttcaatttaaaaccacttctctggacggcctcattctgtacaattcaggtgacggaaacgattttatagtggtcgagctggtcaagggttatcttcattacgtatttgatctcggcaatggtgccaatctcatcaagggcagctccaataagcccctcaacgacaaccaatggcataatgttatgatttctcgggatacgtctaacctccacaccgtcaagatagatactaaaatcactacccaaatcaccgccggtgcccgaaatcttgacctcaaaagcgacctttatatcgggggtgtggcaaaggagacttacaagtctcttccaaagctggtccatgccaaagagggcttccaggggtgtctagcctctgtcgaccttaatggcaggcttccagacttgattagcgacgcactgttttgcaatggccagatcgagcggggttgtgaaggaccatccactacttgccaggaggatagttgctcaaatcagggagtgtgccttcagcagtgggatggattctcctgcgactgttcgatgacatcgttctcagggccactgtgtaatgatcctggcaccacatatatcttttctaaagggggaggccagatcacgtataagtggcccccaaacgacagaccatcgactagggccgaccgtttagctatcggcttcagcaccgtgcagaaggaggcagtactagttagagtagatagctcatccgggctgggggactaccttgaactacatatccaccaggggaagattggggtgaagtttaatgtggggacagatgacatcgccatcgaggaaagcaatgccatcatcaatgacggaaagtaccacgttgttcggttcacaagatccggagggaacgctactcttcaggtcgatagctggcctgttattgagcgctatcctgctggaaacaatgacaacgaaagacttgccattgcgagacagcggattccctaccggctggggagggtggtcgacgagtggcttcttgacaagggtcgccagctcactattttcaattcccaggccactatcattattggcggaaaggagcagggccaacccttccagggccagctcagcgggctctactataatggactcaaggtgcttaatatggctgcagagaatgatgcaaatatcgcgatagttggtaacgttaggctggtgggcgaggttccatccagtatgacaacagaatccacggccactgcgatgcagagcgaaatgagtacttcaatcatggagacaactaccaccctggcgacctccacagctagacgcggaaagccaccaaccaaagaacccatctcccagaccacagacgacattctggtggcctccgcggaatgtccctctgatgacgaggacatagatccatgcgaaccaagttcggggggattggctaatccaaccagagccggaggtcgagagccgtaccccggtagtgccgaggtaatacgagagtcgtcctctacaacgggcatggtcgttggaattgtggcggctgccgctctgtgtatcttgatcctcttgtacgccatgtacaagtacagaaatcgcgacgaggggagttaccatgttgatgagtctaggaactatataagcaattccgcccagtccaatggagccgtggtgaaagagaagcagccctcgtctgccaagagttcaaataaaaacaaaaaaaacaaagacaaggaatactacgtttag

SEQ ID NO: 232291 - DNA, 1488 bp, Artificial Sequence
  Description of Artificial Sequence: Synthetic coding sequence
atgatatccagagatactagcaacctgcataccgttaaaatagacaccaagattacaacgcagatcacggccggagcaaggaatctggaccttaaatccgacctatatatcgggggtgttgccaaggagacttacaaaagcctgccgaagttagtccatgctaaggagggctttcagggctgtttagcatccgtcgaccttaatggcaggcttcccgatctgatttccgacgcactgttttgtaacggacagatagagcgcggttgtgaggtcgccttgatgaaagctgatcttcaggggccatcgaccacatgccaggaggacagttgcagtaaccagggggtttgcctccagcaatgggatggcttctcatgcgactgttcaatgacctcattctccgggccactctgtaacgaccccggaacaacgtacatcttcagcaagggcggaggacagatcacctacaaatggccccctaatgaccgaccatcaactcgagccgaccgcctggctatcggtttctctaccgttcaaaaagaggcggttttggtgagagtagattcaagctctggtctgggcgactacctggagctgcacattcaccaggggaaaatcggcgttaagttcaacgtgggcacagatgacatagcaatcgaggaatccaacgccattatcaacgacgggaagtaccacgtagtccgcttcacgcgctccgggggtaacgctaccttgcaggtggacagttggccagttatcgagagatatccggctggcaggcagcttactatctttaattctcaggccacaatcatcatcgggggtaaggagcaagggcagccctttcagggacagctctcaggcttatactacaacggcctcaaggtgttaaatatggcagcggaaaatgatgctaatatcgctattgtcggcaatgtccgcctagtcggtgaggtgccatcctcgatgactaccgaaagcactgccacagccatgcaatcggagatgagcacatctattatggaaacaactaccacattggctacctcaaccgcaagaagaggaaaaccacctaccaaggagccgatctcccaaacgactgacgatatcctggtcgcttctgctgagtgcccttctgacgatgaagatatcgacccttgcgagccatcctcaggagggctagcaaacccaacgcgtgccggtggtagagagccctaccccggttcagccgaagtgatccgcgagagctctagcacaacaggcatggtggtggggatcgtcgctgcggctgccctgtgtattctgattttgctctatgccatgtataagtatcgcaaccgtgatgagggctcctatcacgtggacgaaagcagaaattacatctccaattctgcccaaagcaacggagccgtcgtgaaggagaaacagcccagctccgccaaaagcagcaataaaaacaaaaagaataaagataaagaatactacgtttag

SEQ ID NO: 232292 - DNA, 4500 bp, Artificial Sequence
  Description of Artificial Sequence: Synthetic coding sequence
atgggtactgcattactgcagcgtggcggatgctttctgctgtgtctctcgctcctactgctgggttgttgggccgagctgggatccgggttggaattccctggggcagaaggtcagtggacgcgatttcctaagtggaacgcctgttgcgaatccgagatgagtttccagcttaagacaaggtcggctcgcggactcgtcttgtactttgatgatgaagggttctgcgattttctggaactgattttgacgaggggagggcgactccagctcagcttttctatcttctgtgcagaaccagctacactgcttgccgatactcccgtcaatgacggtgcctggcatagcgtgaggatcaggaggcagtttaggaacaccacactgtttatagatcaagtcgaagccaagtgggtcgaagtcaaaagcaagaggcgtgacatgaccgtgttttccggtcttttcgtggggggactgcctcccgaattgcgagccgcagcactgaagctgacattagcctctgtgcgcgaacgcgagccgtttaaaggttggattcgggatgtcagagtgaatagctctcaggtgcttccggtcgacagcggggaggtgaagctggatgacgagccaccgaactcggggggtggttcgccgtgcgaagccggtgaagagggcgaagggggagtatgtctcaacgggggagtttgcagtgttgttgatgatcaagctgtatgcgactgctctagaacaggatttaggggaaaggattgctcgcaggctgacaccaatctggaaggtctggcgcaccttatgatgggagatcaggccaagtctaagcggaaggaggagtacattgcaacttttaaggggtctgagtatttttgctacgatctctcgcagaacccaatacaaagctcaagtgatgaaattacgctgagctttaaaaccctacagcggaacgggctcatgctgcacaccgggaagagcgctgactatgtgaatttagcattgaagaacggcgctgtgtctctcgtgattaacctaggctcaggagctttcgaggcactggtagagcccgttaatgggaagttcaatgataatgcgtggcacgatgtcaaggtgactagaaacctgagacaggtcacaatcagcgttgacggcatcttgaccaccaccggctacacacaggaagattataccatgctggggtccgacgactttttctacgtagggggaagtccttccacagcggacctgcccggttccccagtgtcaaacaactttatgggttgcttgaaggaagtggtatacaagaacaatgacgttaggctggagttgagtcgtcttgccaaacagggggatcccaagatgaaaatccacggagtcgtagcctttaaatgtgagaatgtggccacactggaccccataaccttcgagactcccgaaagcttcatctctctgccaaagtggaacgccaagaagacagggtcgatatcatttgacttcaggactaccgaacctaatggcttgatactgttctctcatggtaagccccgacatcagaaggacgctaagcaccctcagatgatcaaggtcgatttctttgccatcgaaatgcttgacgggcacctgtaccttttacttgatatggggagcgggaccattaagatcaaagccctgctgaagaaggtcaatgatggcgagtggtaccacgtggacttccaacgagacggacgatctggcacaatcagcgtgaatacattgaggacgccatatactgccccaggtgagagcgagattctcgatctcgacgacgaactttatctcggtggattgcccgagaacaaggccggtcttgtcttccccactgaagtatggacagccttattaaattacggttatgttggatgtatccgcgacctttttatcgatggacagtcgaaggacatacgccagatggccgaagttcagtctacggccggagtcaagccctcttgctctaaagagaccgccaaaccctgcctgagcaacccctgtaagaataacggtatgtgtcgtgacggatggaaccgatatgtatgcgactgtagcggcactggctacctcggcagaagttgcgagagagaggctactgtgctctcatatgatgggagcatgttcatgaagattcagctgccggtggtcatgcacactgaagccgaggacgtgagcctgcgttttcggagtcagcgggcttacggcatcctgatggccacaacatcacgcgattcagccgacaccctgaggctcgagcttgacgccggacgcgtcaagctgacagtgaatctggactgcatacgcataaattgtaacagcagtaaaggcccagaaaccctgttcgcgggttacaatttaaatgataacgagtggcacacagtgcgagtcgtacggcgaggcaagagcctaaagcttacagttgacgatcagcaagcgatgaccggacagatggccggagatcacacgaggcttgagttccataacatcgagactggcataatcacagagcgccgatatcttagctctgtgccatccaacttcatcgggcatctccaatctcttacgttcaacgggatggcttacatcgatctctgtaagaacggggacatcgactactgtgagctaaacgctaggttcggattcaggaatatcatcgctgaccctgtcacattcaaaaccaagtcctcctacgtggcactcgccacactgcaggcgtacacatctatgcacctgtttttccaatttaaaaccacaagcttagacggacttattctgtacaactccggggatgggaacgacttcatcgtcgtggagctggtcaaggggtatctccactacgtattcgacttgggaaacggcgctaacctgatcaaaggcagcagcaataagccgctgaatgacaaccagtggcacaacgtaatgatctcccgggatacatcaaatctccacactgtgaagattgacactaagatcacgacccagatcacagctggcgctagaaacttagacttgaagagcgatctctacattggtggggtagctaaggaaacctataaatccctacccaaactagtgcacgctaaagagggatttcagggctgtttagccagcgtcgacctaaatggcaggctgccagacctgataagcgatgcgctgttttgcaatggccaaattgagcgcggatgcgagggcccaagcaccacatgccaagaagactcttgttccaatcagggtgtctgcctgcaacaatgggatggtttctcatgtgactgttcaatgaccagcttctctggacctctgtgcaacgaccccggtactacatacatcttttccaagggtggaggtcagataacatacaagtggccgccaaatgaccggccatcaacgcgtgccgaccggctagcaattgggtttagtacagtccagaaagaagctgtgctggtgagagtggattcttcttcggggctaggggattacctggagttgcatatccaccagggcaaaatcggggtgaagtttaacgtggggacagacgatattgccatcgaggaaagtaatgcaattataaatgatggcaagtaccatgttgtgcgcttcacacgcagcggaggtaatgccaccctgcaggttgactcctggccagttatcgagagatatccagccggaaacaatgataacgagcgtctggcgatcgccaggcaacggattccatatagactaggacgcgttgtcgacgagtggctccttgacaaaggtcggcaactgaccatttttaactcacaggccaccatcatcattggcggaaaagagcagggccaaccctttcagggacaactgagcggattgtactataatggtctgaaagtgctgaatatggccgcagaaaacgacgcaaatatcgccattgtgggtaatgtgagattggtcggcgaggttcctagcagcatgactactgaatcgacagcaactgccatgcaatcagagatgtctacatcaatcatggaaacaactacaacacttgccactagtactgcaaggcgaggcaaaccacccacgaaggagcccatctcacagacaactgatgatatcttagtggcatcggctgagtgcccgtcggacgacgaagatattgacccatgcgaaccgtccagtggaggcctagccaaccctacaagagctggaggcagggagccatatccaggcagcgcagaagtgatcagagaatcatccagcaccaccgggatggtggtcgggatcgtcgccgctgcagcgttgtgtatccttatccttctctacgcgatgtacaaatataggaacagggatgagggctcctatcacgtcgacgaatcgcggaattacataagcaattccgctcagagcaacggtgccgtcgtcaaagaaaaacagccttcatccgcgaagtcctctaacaagaacaagaagaacaaggataaggagtactacgtgtag

SEQ ID NO: 232293 - DNA, 4644 bp, Artificial Sequence
  Description of Artificial Sequence: Synthetic coding sequence
atggggacagcactgctgcagaggggcggttgtttccttctctgtcttagtttgttactcctgggctgttgggctgaactggggtcagggttagagttccccggagccgagggccaatggacgcgctttccaaaatggaacgcttgctgcgagtctgaaatgtcattccagctcaagacgcgtagcgcccgaggcttggtgctatattttgacgatgagggcttttgtgactttctagagctgattctgacacgtgggggtagattacagctgtctttctcgatattctgtgccgagccagccaccctgttagcagacactccagtgaatgatggcgcttggcactctgttcggattagacgccagtttagaaatacaactctgttcatcgaccaagtggaggcaaaatgggtcgaggtcaaatctaagcgcagggacatgaccgttttcagcggcctcttcgtgggcggtttgccccctgaactccgagccgctgctctgaaacttaccctggcatccgtacgggagcgtgagccattcaagggctggatccgagatgtgcgggtaaatagctcccaggtgctgcccgtggactcaggcgaagttaaactggatgacgaacctccaaatagcggcggagggagcccatgcgaggcgggagaggaaggcgaggggggagtgtgtctgaatggtggggtttgcagtgtcgtagatgaccaggctgtgtgcgactgcagccggacaggctttagggggaaagactgcagtcaagagattaaattcggcttgcaatgcgtgcttcccgtactgctgcacgacaacgaccaaggtaagtactgctgtataaatacggctaagcccctcacggagaaggacaataacgtcgagggcctcgctcacctcatgatgggagatcaaggcaaatccaagggaaaggaggaatatattgctactttcaaagggagcgaatatttctgttatgatctctcacagaaccccatccagtccagttctgacgagataactttgtcgttcaagactcttcaacggaatggcctaatgctgcacaccggcaagtcagctgactacgtgaatttggcgctgaagaacggagccgtgagcctggttattaatttgggatcaggggctttcgaagccctagtggagccggtgaacggaaagttcaatgacaatgcttggcacgacgtgaaggtgacccggaatctccgacagcattctggcatcggccatgccatggtgaataaacttcactgctccgtgaccatttcagtggacgggattctgaccaccaccggctacacacaggaggactatactatgctgggcagcgacgattttttttacgtgggcggttctccatcaacggctgatctacccggaagcccggtgagcaacaatttcatgggatgccttaaggaagtagtctataaaaataacgacgtgcgattagaactgagcagattagccaaacagggagaccctaaaatgaaaatacacggcgttgtggccttcaaatgtgaaaatgtggccacactggaccccatcaccttcgaaacccctgagagcttcatcagcctgccaaagtggaacgcaaaaaaaacaggctccatctcttttgatttcagaacaacagagcctaacggtctgatcctgttcagccacggcaagcccagacaccagaaggacgcgaaacacccccagatgatcaaggtagattttttcgcaattgaaatgctggatgggcacctctacctcctcttggacatgggaagcggcaccatcaaaataaaagcactgcttaaaaaggtaaatgatggtgagtggtaccacgtggactttcaaagggatgggagaagcggcacgatcagtgtgaatacactccggaccccctacaccgcaccgggtgaatctgaaatactggacctggacgacgagttgtatctggggggactgcccgaaaacaaagccggtctggtgtttccgacagaagtgtggacggcattactgaattatggatacgtgggctgcatcagagatctgtttattgacggccaatcgaaggatattagacaaatggccgaagtacaatccacggctggggtgaaaccctcctgctctaaggaaacagctaagccctgcttgtctaatccatgcaagaacaacggaatgtgtcgggatggctggaacaggtacgtctgtgactgctccggaactgggtacttagggagatcatgtgaaagggaggctacagtgttgagctacgatgggtctatgtttatgaagattcagctgcctgtagtcatgcacaccgaggccgaagatgtcagtttgcggttcaggagtcagagagcctacggaattcttatggccactacaagcagagattccgccgacacccttaggctcgagttagacgctggaagagtgaagctgaccgtgaacttagactgtattcgtattaactgtaattcctccaaaggcccagaaacccttttcgccggatacaatctgaatgacaatgaatggcacacggtacgtgtagtgaggcgaggcaagagccttaagcttactgttgacgaccagcaggccatgaccggacagatggctggagatcacacgaggctggaatttcacaacatcgaaaccggcatcatcaccgaacgccgatatctgagcagtgtgccttctaacttcattgggcacctgcaatccctgactttcaacgggatggcatatatcgacctttgcaagaacggcgacatcgattactgtgaattgaatgcacggttcggctttagaaacatcatcgccgatccggtgactttcaaaaccaagtcatcttatgtggcattggctaccctgcaagcctatacgtccatgcacctgttctttcagttcaagactacaagcctggacggactcattctatataactctggcgacggtaacgacttcatcgtcgtcgaactggtgaaaggttacctacattacgtctttgatttgggcaacggggcaaatctaatcaagggctccagtaataaacccttaaacgacaaccagtggcacaatgtgatgatctctagagacacttctaatctgcatacggtaaagatcgatacgaagattacgacacagatcacagcaggggcaagaaatctggaccttaagtctgatctttatattggaggcgtggccaaagaaacatacaaatccttaccgaagttggtgcatgccaaggaagggttccagggatgcctggccagtgtagaccttaacggcagactcccagacttgatctccgatgcactgttctgcaatggacaaattgaacgcggttgcgaaggtcctagcaccacgtgccaagaggatagttgtagtaatcagggggtatgcctgcagcagtgggatgggttctcctgcgactgctctatgacaagcttttccgggccactgtgtaacgatcctggaactacctatatcttctccaagggaggaggtcaaataacgtacaagtggcccccaaacgatcgccctagcacgagagctgaccgactggctatcggatttagcaccgtgcagaaagaggctgtgcttgtgcgtgtcgatagctccagtgggcttggcgattatctggaattgcatatccatcagggtaagataggcgtcaagtttaacgtaggtacagacgacatcgccattgaagagtcaaatgccattatcaacgatggtaaataccatgtggtgaggtttacaagaagcggcggtaacgctactctgcaggtggactcctggccagtcattgagcggtatcccgctggtaataatgacaacgaacggctcgctatagcaaggcagcgcatcccatatcggctgggtcgggttgttgatgaatggctcctggataaagggaggcagttgacaatcttcaattctcaggcgacgatcatcattggaggcaaggagcagggccagccctttcaaggacagttatcaggcctctactataatgggttgaaggtccttaatatggccgctgaaaacgatgccaacattgccattgtggggaatgtgcgattggtcggtgaggttccttcctccatgaccacggagtctacagccaccgcaatgcagtccgaaatgagtacatcgattatggagaccaccacaaccctggccacctccacagctaggcggggaaaacctcccaccaaggagcccatctctcagacaacagatgacattctcgtggcatctgccgagtgccctagtgatgatgaggacattgatccctgcgaaccgtcctcagggggacttgcaaatcccacacgcgcaggcggaagggagccttatccagggtctgccgaagtcatacgcgagagtagcagcactactgggatggttgtcgggattgtggcagctgccgcactgtgtattctaatcctgctgtacgcaatgtacaaatatagaaacagagatgagggctcttatcacgtggatgaatctagaaattacatcagcaatagtgcacagagtaatggcgctgtggttaaggagaagcagccaagttctgccaagtcctctaataaaaataaaaaaaacaaggacaaggagtattacgtgtag

SEQ ID NO: 232294 - DNA, 4434 bp, Artificial Sequence
  Description of Artificial Sequence: Synthetic coding sequence
atgggcactgcacttctgcagcgaggtggatgttttctcctgtgtctgtcactgcttctgctgggctgttgggccgagttgggatctgggttggagtttccaggggctgagggccagtggactcgctttcctaagtggaacgcatgttgtgaatcagaaatgagcttccagctgaagacgcggagtgctaggggactggtgctctacttcgacgatgagggtttctgcgattttctggaacttatcctaaccaggggaggtcgcctgcagctcagcttcagcattttctgtgcagaacccgcaaccttactggcagacacacccgttaacgacggcgcttggcactcagtgcggatcagaagacagttccgcaacacaaccttgttcatcgatcaggtagaggcaaaatgggtagaagtgaaatccaaaaggagagacatgactgtgttcagtggactatttgtcgggggtctccccccagagctgagagccgctgcactgaagttgacccttgcttctgttcgagagcgtgagcctttcaaaggctggatccgggatgtccgggtcaattctagccaagtgctcccagtagatagcggcgaagtgaagttggacgacgagcccccaaatagcggcggaggatcgccttgcgaggctggtgaggaaggagaagggggtgtgtgccttaatggtggcgtgtgctctgtggttgacgatcaggccgtgtgtgattgttctcggaccggatttcgcggaaaggactgttcacaagaggataacaatgtggagggactggcccacttgatgatgggggaccaaggcaagagcaagggaaaggaagagtacatagccactttcaaggggagtgaatatttctgttacgacctcagtcaaaaccctatccagtcgtcatcagacgagattactttatccttcaaaacacttcagcggaatggcctcatgctccacactgggaaaagcgccgactatgtgaacttggcactgaagaacggtgctgtctccctggtgatcaaccttggtagtggcgcattcgaagccctggtggaacccgtgaacggaaagttcaatgacaatgcctggcacgatgtcaaggtgaccagaaatttgcggcaacattccggcattggccacgctatggtcaccataagcgtcgacggcatcctgactacaacgggctacactcaggaggactacacaatgctgggatccgacgattttttctatgttgggggaagtccatcaacagcagatctgccaggctcccccgtttctaataactttatgggttgcctgaaggaggtcgtttataagaataatgacgtgcggcttgagctgagccgcttagccaagcaaggtgaccccaaaatgaaaatacacggtgtggtggccttcaaatgtgaaaacgtggcgacgttggatcccataaccttcgaaaccccagagtcttttattagtttacctaaatggaatgctaagaaaacgggtagcatctcctttgatttccgaacgactgagcccaatggcctgatcctattcagtcacgggaaacctcgacatcagaaggatgcgaagcacccacaaatgattaaagtggatttcttcgcgattgaaatgctagacggtcatctctacttgctgctagatatgggatcagggacaatcaagatcaaggcacttttgaagaaggtgaacgacggcgagtggtaccacgtggatttccagcgggatggacgaagtggtacgatcagtgtgaacacactgcgtacaccatacaccgctcctggagaatctgaaattttggatctggatgacgagctgtacctgggagggttaccggaaaacaaagcagggctcgtttttcccaccgaggtgtggacggcactgttaaattacggctatgtaggctgtattagagatctttttatagacggtcaatcgaaggacattcgtcagatggcagaggtgcaatccacggctggcgttaagccaagttgctctaaggaaaccgcaaaaccctgcctgtcgaacccgtgcaagaataacggcatgtgtagagacggctggaatcggtacgtatgcgactgcagtggcacaggatatctgggacgatcctgcgaacgcgaggccacagtcctctcttatgacggctccatgttcatgaaaatccagctgcctgtggtgatgcacacagaagcagaagatgtctccctaaggttcaggtcccagcgagcctatggaattttgatggcgaccacaagtcgggattccgcagacaccctgcgcctagagctcgacgccggacgcgtgaaactgactgtgaatctggactgcattcggattaactgcaactcaagcaaaggccctgaaacgctctttgccggttataacctcaatgataatgaatggcatactgtgcgcgtggtgcggcgtggcaagtccctcaaactcactgtggacgaccaacaggctatgacagggcaaatggcgggagaccacactcggctagaatttcacaatattgagacgggaattatcaccgagcgtcgttatctgagcagcgtgccgtctaatttcatcggccatctgcagagcctgaccttcaatgggatggcctacatcgatctctgtaaaaacggcgacatcgattactgcgaacttaacgccaggttcggctttcgaaacatcattgcagacccagtgactttcaagacaaagtcctcgtacgttgccctggctaccctgcaggcatatacctctatgcacctattcttccagtttaagacaactagtctggatggtctgattttgtataacagcggcgacggaaatgactttatcgtggtcgagctggtcaaaggttatctgcactatgtgttcgaccttggcaacggcgctaatctgataaagggaagcagcaacaagccgctgaatgacaaccagtggcacaatgttatgatatctagggacacatccaatctccataccgtcaaaatcgatacaaaaattaccactcaaatcaccgctggcgctaggaacctggatctcaaaagcgatctgtacatagggggagtcgcgaaggagacatacaaaagcttgcctaagttagtgcacgctaaggaggggttccaaggctgcctggcctctgttgacctgaacggacgcttgccagaccttatttcagacgctctgttctgcaatggccagattgaaagggggtgcgaagggccatcaacgacgtgtcaggaggacagctgttccaaccaaggcgtttgtctccagcagtgggatggattctcgtgtgactgtagcatgacttcattcagtggacccctctgtaacgatcccggtacaacgtatatctttagcaaaggcggtggccagattacctataagtggccgccaaatgaccgccctagcaccagggctgatagactggcaatcggcttcagtaccgtccaaaaagaggccgtcctggtccgtgtcgattcttctagtggacttggcgactatctggaacttcatatacaccagggaaaaattggcgttaagtttaacgtcgggacagatgatatagctattgaggaatcaaacgccataattaatgacgggaagtatcacgtggtgcggttcacccgcagcggagggaatgctacacttcaggttgattcttggcctgttatcgagcgataccccgctgggcgacagcttaccatcttcaactcccaggccacgattatcatcgggggaaaggagcaagggcagcccttccaggggcagttgtcaggcttatactacaacgggctgaaagtactgaatatggcagctgaaaacgatgcaaatatcgcaatcgtggggaacgtcagactagtcggggaggtgccctcaagtatgacaacggagagtaccgccaccgcgatgcagtccgaaatgtccacatccatcatggagactacgactaccctcgctacgtcaacagctcgcaggggcaagcctcccaccaaagaaccaatctcacagacaacagacgatatacttgttgcgtctgcagagtgcccatcagacgacgaggatatagacccctgtgagccctcaagtggagggctggccaacccgacaagagcgggaggcagggagccgtatcctggctccgcagaagtgatccgggagtccagcagtactacaggcatggttgttgggatagtggcagccgcagccctgtgtattctgatccttctgtacgctatgtacaaatatcgcaatagagacgaaggaagttatcatgtcgacgagtcaagaaattacatctcaaatagcgcccagtccaacggcgcagtggttaaggagaaacaacctagcagcgcgaagagctcgaataaaaataagaagaataaggataaagagtattatgtctag

SEQ ID NO: 232295 - DNA, 4434 bp, Artificial Sequence
  Description of Artificial Sequence: Synthetic coding sequence
atgggcactgccctgctgcagaggggcggttgtttcctcctgtgtctgagtttgctccttttaggttgctgggcagagctggggtccgggctcgagttcccaggggcagagggccagtggacccgttttccgaagtggaatgcatgttgtgaatctgaaatgagcttccagctgaaaacccgatctgcccgtgggctcgtcctgtacttcgacgacgaggggttttgtgatttcttggaactcatactcacaaggggagggagactgcagttatcgttttcaatattctgcgctgagccggctactctgttggccgacacgccagttaatgacggagcttggcactctgttcggattcgccgtcaattccgcaatacgaccctttttatagaccaggtcgaagcgaaatgggttgaagtgaaaagcaagagacgagatatgacagtcttttccggactgtttgtgggaggcctgcctcccgagcttcgtgccgctgcattgaagctgaccctagccagcgtgcgagaaagggaaccctttaaagggtggatccgcgacgtaagggtgaactcgtcccaggtccttcctgtggactcaggagaagtgaaacttgatgatgagccccctaactcagggggaggaagtccctgcgaagctggcgaggaaggcgaagggggtgtgtgcctgaacgggggagtatgtagcgtcgtcgacgaccaagccgtgtgcgactgctcccgcaccggattccggggtaaggattgtagtcaggcagatacgaatctcgaggggctggcacatctcatgatgggagaccaggccaaaagtaagagaaaagaagagtatatcgctacctttaaaggctcagagtatttctgctatgacctgagccagaatcctatacaatcttcttccgacgaaattacactgtccttcaagacactccaacggaacgggctgatgctacacacgggcaagagcgcagactatgttaacctggccctgaaaaacggcgctgtcagcctggtgatcaaccttggatccggcgctttcgaagcacttgtagagcctgtgaacgggaaattcaacgacaacgcctggcacgacgtaaaggttaccagaaacctaaggcaacattccggcatcggtcacgccatggttactatctcggttgatggcatcctgaccactacagggtacacgcaggaggactacacaatgcttggctctgacgactttttctatgttggcggtagccctagcactgcagacctgccagggagccccgtgtcaaataacttcatggggtgcctgaaagaagtggtttacaaaaataacgacgtgcgcctggaactgtcacggctggccaagcagggcgaccccaaaatgaagatacatggcgtcgtggctttcaagtgtgaaaatgtagccacacttgatcctattacattcgagacgccagaaagctttattagcctcccgaaatggaatgcaaagaagacgggctccatctccttcgacttcagaactacagagccaaatggcctgattcttttctcccacgggaaaccgaggcatcagaaggatgccaaacacccgcagatgatcaaggtcgactttttcgcgatagagatgcttgacggccacttgtatcttcttctggatatggggtctggaacaataaagattaaagccctgttgaagaaagtgaatgatggtgagtggtaccacgtggattttcagcgggatgggaggtccggaacgatcagtgtgaacaccctgcgaactccctacaccgcccctggcgagtctgaaattctggatctcgacgacgaactttaccttggcggactgcctgaaaataaggcgggactggtcttcccgacagaagtgtggacagcattattgaactacggctacgtcggatgcattcgtgatctgttcattgacggccagagtaaagatatcaggcagatggctgaggttcagagcaccgccggagttaagccttcatgttcgaaagaaaccgctaaaccctgcctgagtaatccgtgcaagaacaacggcatgtgtcgggacggatggaaccggtatgtgtgtgattgcagcgggaccggctaccttggcagatcttgcgagcgagaagcaactgttttgagctacgacggaagtatgtttatgaaaatccagctcccggttgtgatgcataccgaagcggaggacgtgagtctgcgtttcaggtcacagcgagcttatggcattctgatggctaccacgagtcgggacagcgctgatactttgagactagagctcgatgcaggtagggtgaagctcaccgtcaatctcgattgcatccgaatcaattgtaactccagtaaaggaccagagactctttttgccggatataacttgaacgacaatgagtggcatacggtgcgggtggtacgcagggggaagtctctgaaactaacagttgatgaccagcaggcaatgactggtcagatggccggagatcacactcgcctcgagttccacaatattgaaaccggcataatcacagagaggcgatatcttagtagcgtgccctcaaacttcattggtcacctgcaatccttgaccttcaacggtatggcttatatcgatctgtgcaaaaacggtgatatcgactactgcgagttgaatgctaggttcggcttcagaaacatcatcgcagaccccgttactttcaaaactaaatcctcatacgtggctctcgccactctgcaggcctacactagcatgcacctgtttttccaatttaagacgacatcactggacggcttaattctgtacaacagtggagacggcaacgattttatcgttgtcgagctcgtgaaaggatatttgcactatgtgttcgatctggggaacggagctaatctgattaagggaagttccaataaacctcttaacgataatcagtggcacaatgtaatgatctcccgtgacacaagcaatttacacacagtcaagattgatactaagattacaacacagatcaccgcaggcgcacggaacttggatcttaagagcgatttatatattggaggcgtggccaaggaaacctacaagagcctacccaagctggtgcacgctaaggaggggtttcagggttgccttgcttccgtggatctgaatggcaggttaccagatctgatttccgacgccctcttctgtaacggccagatcgagcggggttgtgagggtccttcaacaacctgtcaggaggattcctgctccaaccagggggtgtgccttcagcagtgggacggtttctcgtgtgactgctcaatgaccagtttctcgggcccactgtgcaacgacccaggtacaacatacatattctccaagggtgggggacagattacttataaatggcccccaaacgaccgacctagtactcgggcagatcggctagccatcgggttttcaacagtacaaaaggaggctgttctcgtgcgtgttgacagttcatcaggcctcggcgactacctcgaactgcacattcatcagggaaaaataggagtgaaattcaacgtcgggactgacgacatcgctatcgaggagagtaatgcgataatcaacgatggcaaataccatgtggtccggttcactcggtccggcggtaacgcaacgctccaggtggactcttggccagtaatcgaacgctatcccgcagggagacaactgactatcttcaattctcaggcaaccattatcattggcggaaaggagcaagggcagccgttccaagggcagctcagtggtctttactacaatggcctgaaagtcctgaatatggccgctgaaaatgacgcaaacatcgcaatagtcggaaatgtgagactggtgggggaggtaccttcttccatgaccaccgagtcaactgcaaccgcaatgcaaagcgagatgtccacgtcaattatggaaaccacgacaacactggcgactagcaccgccagaagaggcaaacccccaactaaggagcccatttctcagacgaccgacgatatcctggtcgcctccgctgagtgcccatctgacgatgaggacatcgatccatgtgaacctagctcaggaggtcttgcaaatccaaccagggccggtggcagagagccatacccgggaagcgccgaagtcattcgggagagtagctccactaccggcatggtagtgggaatagttgctgctgccgctctgtgtattctcatccttctctatgctatgtataaatatagaaatagagacgagggctcctaccacgtggatgaatctcgaaactatatttcaaattccgctcagagcaacggggctgtggttaaagaaaagcaaccctcctccgctaagtcctccaacaaaaacaagaagaacaaagacaaagagtattatgtctag

SEQ ID NO: 232296 - DNA, 4647 bp, Artificial Sequence
  Description of Artificial Sequence: Synthetic coding sequence
atgggtacggccctgctgcagagagggggatgcttcctgctgtgtctgagcctgctgctgctcggctgctgggcagaactcggctccggcctcgaatttcccggtgcagagggccagtggacccgattccctaagtggaacgcatgttgtgagtccgagatgagtttccagcttaaaactcggagtgctcgaggcctggttctctactttgatgacgagggcttctgcgattttttggagctgattttgacgcgaggtgggaggttgcagctcagtttttctattttctgtgctgaaccggctactctgctagctgacacaccggttaacgacggcgcttggcattcagtgcgaattcgtcgccaatttcgcaatacaacattgtttattgatcaggtggaagcaaagtgggtcgaggtgaaatctaaacgaagggacatgaccgttttcagcggcctgttcgtcggaggtctgccccctgaactgagagccgctgctctgaagctaaccctggctagcgtccgggaacgggaaccatttaagggctggattagggatgttagagtcaattcctcccaggttttgcccgtggattcaggcgaggtcaaattggacgacgaaccccctaatagtggcggaggaagtccctgcgaggcgggagaagagggggaagggggagtttgtctgaatggaggcgtatgttcagttgtggacgaccaggcggtctgtgattgcagtcgcactggcttccggggaaaggattgctcacaggagataaaattcggcctgcagtgcgtgctgcctgtcctcctccatgataatgaccaaggcaagtattgctgtataaacacagccaagcctctgaccgagaaaaaggacaacgattttgagggactcgctcacttgatgatgggagaccaggctaagagcaaacggaaggaagagtacatcgcaacgttcaaaggatctgagtatttctgttacgacctgtcccaaaatcctatacagtcgtccagtgatgaaataactctttcctttaaaacgctccagcggaatggcttaatgcttcacacagggaaatccgccgactatgtgaacttggcattgaaaaatggcgcagtatccctggttatcaatttaggaagtggtgctttcgaggctctcgtggagcctgtgaacgggaagtttaacgataatgcctggcatgacgtgaaggtcacgaggaatctgaggcaacacagcggaattggccatgccatggttaataagctccactgttccgtgacaatttcagtggacggaattctgaccactacaggatatactcaggaggattacacgatgctagggtctgacgacttcttctatgtcggcggtagccccagcacagccgacttgcccggatctcccgtgtctaataacttcatgggatgccttaaggaggtggtgtataaaaataacgatgtccggctggagttgtcccgcctggccaaacagggagacccaaagatgaaaatccatggggttgttgcctttaaatgtgagaacgtcgccactttggatcctatcaccttcgaaactcctgaatccttcatttccctccctaagtggaatgcaaagaagactggctcaatctcatttgacttccgcactacagagcccaacggcctcatcttgttctcacacggtaaacctcgacaccagaaggacgccaagcatcctcagatgattaaggtggacttcttcgccatcgaaatgctagacggccacctgtacttattactggatatgggcagcggaactataaaaataaaggctctgttgaagaaagtgaacgacggagaatggtatcacgtggacttccaaagagacgggaggtcaggcacgatctccgtcaatactctgcgaacgccttacacagcaccaggagagtcagagatcctggacctggatgacgaactgtatctgggagggctccctgagaataaggcgggactggtgtttccaacagaggtgtggactgcactgctcaattatgggtacgtaggctgcatcagggatttattcatcgatggccaaagcaaggatattagacagatggccgaagtgcagagtaccgccggtgtgaaacctagttgtagtaaggaaaccgccaaaccatgtttaagtaatccatgcaaaaataatgggatgtgccgggacggatggaacagatatgtttgcgactgtagtggcacaggataccttggtaggagctgcgaacgcgaggcaactgtgctgagctacgatggatcaatgttcatgaagattcagctgcccgtcgtgatgcacaccgaggccgaagatgtatccctgcggtttaggtcacagcgtgcttatggtatccttatggccaccacatcacgagactcagcagacactctgcgcttggagctcgacgctgggagggtgaagctcacggtgaatctcgattgcatccgcatcaattgtaacagctccaaaggcccagagactctgtttgcaggctacaacctgaacgacaacgagtggcacacagttagggtagtacggagaggaaaatctctgaaactaaccgtggacgaccagcaggcgatgaccggccagatggcaggagaccatacccgactggaatttcataatatcgagaccgggattataacggaacggcgttacctctccagcgtgccaagtaacttcattggccatctgcagagcctcacattcaacggaatggcatatatcgatctgtgcaagaacggggatattgactactgtgagctaaacgctcgcttcggtttccgcaacataattgccgaccccgtcactttcaagacgaagtcgtcatacgtagcattagcaaccctgcaggcttacacttccatgcacctctttttccagtttaaaaccacatctctggacgggttaatcctttataactctggggatgggaacgacttcattgtggtggaactagtgaaaggataccttcactacgtctttgacttgggcaatggtgcaaacctcatcaagggaagcagcaataagccattgaacgacaatcaatggcataacgtgatgatttcccgcgacacctcaaaccttcatacggttaagatcgacacaaaaatcacaactcagatcacggccggagctcggaacctggacttaaaaagtgacctttacataggcggagtggctaaagaaacatataagtccctgcctaaactcgtccatgctaaggagggtttccagggctgccttgcaagcgtcgatctcaacgggcgtctccctgaccttattagcgacgctctattctgcaatggccagatagaaagaggctgtgagggcccttccacgacttgccaagaggactcctgttctaaccagggagtatgcttgcagcagtgggatgggttctcgtgcgattgcagcatgacttcattctcgggccctctctgcaacgaccccggtactacttatatcttctcaaaaggaggcggtcagattacatacaaatggcccccaaacgaccgtccgagtacacgagccgatagactcgccattggattttccacagttcagaaggaagcggtcctggtgcgcgtcgacagttcatctggcctcggagactaccttgaactgcatatccatcaaggaaagatcggggttaagtttaatgtggggactgatgacattgccattgaggaatccaacgccattattaatgatggcaagtaccacgtggtccggtttaccagatcagggggtaatgctactcttcaggtggattcatggccggtcattgaaagataccctgccggaaacaacgacaatgagcgtcttgccatcgcgaggcaacgcatcccatataggctaggcagagtggtggatgagtggctgctcgataagggacggcagcttactattttcaacagccaggccacaattatcattggcggaaaagaacagggccaaccttttcaggggcagctgagtggcttgtactacaatggtctgaaagtattaaatatggctgctgaaaacgacgcaaacatcgcaatcgtggggaacgttcggctggttggtgaggtaccttctagcatgaccactgaaagtactgccactgccatgcagtctgagatgagcacttctataatggaaacgaccactactctcgccacctccaccgccaggcggggaaagcctcctaccaaggagcctatttcccagacaacagatgatatattggtggctagcgcagagtgtccatcagacgacgaagatatcgacccgtgtgaaccttcaagtggcggtctggcaaaccctacccgtgcgggaggtagagaaccctatccaggttctgccgaagtgatcagggaatcgtcatctaccaccggtatggttgttggcatagtggcagccgcagcactttgtattttaatactcctgtatgccatgtataaataccgaaatagggacgagggcagttaccatgtagatgagtcccggaattatatcagcaatagcgcacagtccaacggcgctgtggtgaaggagaagcaacccagctcagccaaatctagcaataagaataaaaaaaacaaggacaaagagtattacgtgtag

SEQ ID NO: 232297 - DNA, 1191 bp, Artificial Sequence
  Description of Artificial Sequence: Synthetic coding sequence
gccctcgaaatctgggagcagccccctgccccacggctcctctttcctgggctcccatttcgcacgagccctagccccgcagctttctaccgatcgccagcatcccttcgaggcggtcacgcgggaacgacgtatatcttctctaaaggcggtggccagatcacctataaatggccacccaatgacaggccctctacccgggcagataggctggcgattggcttctctaccgtgcaaaaggaagcagtgctggtccgggtggattcctcctcagggctgggtgactacttagagcttcacatccaccagggcaagattggagtcaagttcaacgttggtacagatgacatagccattgaggagtcaaacgccattatcaatgatggcaagtaccacgtggtgaggttcactcggtccgggggtaatgctacgctccaggtggattcctggcctgttattgagagataccctgccggacggcaactgacaatttttaatagccaggcaactataattatagggggaaaagagcagggccaacctttccagggacagctaagcggtctttattacaatggcctgaaagttcttaatatggcagccgagaacgacgcaaatattgccatagttggaaacgttaggcttgtcggagaggtaccatcttccatgacgactgagagtaccgctaccgccatgcagtctgagatgagtacttcgataatggagacaacgaccacgttggctacaagtaccgctcggaggggtaagccgcctaccaaggaacccatctctcagactacagacgatattctggtcgccagcgcagaatgccctagcgacgatgaggacatagatccttgcgaaccctcttcaggcggactcgcaaaccccacacgtgctggcggacgggagccatatcccggaagcgctgaggttataagggaatctagttccacaacaggaatggtggtggggattgttgccgctgccgctttgtgcattctgatccttctgtatgcaatgtacaagtatcgtaatcgagacgagggaagctatcacgtggatgagtctcggaattatatcagcaattccgctcaatccaatggtgccgtagtcaaagaaaaacagccaagcagtgctaagagttcgaataaaaacaaaaagaacaaggacaaggagtattacgtatag

SEQ ID NO: 232298 - DNA, 5139 bp, Artificial Sequence
  Description of Artificial Sequence: Synthetic coding sequence
atggctagcggatcccggtggcggccaacgccccctcctctgctgttgttgctgcttctggcactggcagcccgagctgatggcctggaatttgggggtggtcccggtcaatgggcgcgatatgctaggtgggcaggcgcagcttcaagtggagaactgtcatttagcctgcgtactaatgcaacgcgggctctgctgttgtatctggatgacggcggtgactgtgattttctggagctgctgttagtcgacggtcggcttcgattacgctttaccctgtcctgcgctgagcccgcaacattgcaactggatactccagtggccgacgatagatggcacatggtcctactaactcgagatgcccgacggactgctctggccgtggacggggaggcacgggctgcagaagtccgttcgaaacgccgagaaatgcaagtggcttctgacctattcgtagggggtatacctccagacgtcaggttgagcgccttgactctgtcgacggtgaagtacgagccgccattccgaggattgctcgcaaatttgaaactgggagagcgacctcctgcactgttgggctcccagggactgaggggagccacagctgacccactgtgcgccccagcccgaaatccgtgtgccaatggtggtttgtgcaccgtgctcgcacctggcgaggtgggctgtgactgttcacacacaggcttcggaggcaaattctgttccgaagaagaacatccaatggagggcccagcccatctcaccctgaattctgaagtcggatccctgctctttagcgaaggcggagctggccgtggaggtgccggtgacgtccatcagccgactaaagggaaggaggaattcgtcgcaacattcaaaggcaatgagtttttctgttatgatctttcccacaacccaatacagtctagcaccgatgagatcacgttggctttccggacactccagaggaatgggctaatgttgcatacaggtaaatccgcggactacgtgaacctttcactgaaatcgggggcagtgtggcttgtcatcaatctgggatctggtgccttcgaggcactcgtggagcctgtgaatggcaagtttaacgacaatgcgtggcacgacgtgagggtgacccgcaatcttcgccaacacgccggtatcggccatgcaatggtaaataagctgcactatctcgttactatatctgtggatggcatactgacaacaactggctacacacaggaagactacactatgctggggagcgacgatttcttctacatcggagggtccccgaacactgcagaccttccagggtctccggtgagcaacaatttcatgggatgtctcaaggatgtcgtgtacaaaaacaatgacttcaaactggaactgagtcgcctggccaaagaaggcgaccccaagatgaaactgcaaggcgatttaagtttcagatgtgaggatgtcgccgctctggaccccgtcaccttcgaatccccagaggcctttgtggcactccctaggtggagcgccaagaggactggatccattagtctggacttccgtactacggaacctaatggcctgctccttttctcccagggcaggcgagccggtggaggcgctggctcccattcctctgcccaaagggctgactatttcgccatggagctgctggacggacacctgtatctattgttggatatggggagcggcggaattaaacttagggctagctcgagaaaagtgaatgatggcgagtggtgccatgtggacttccagcgggacggaaggaaggggtcgatttccgtgaatagccggtccacccctttcctggctaccggcgattccgagattctcgacctcgagtctgagctgtacttgggtggccttcccgaaggcggacgcgtagatctgcccctccctccagaggtgtggaccgccgctctccgggctggttatgtgggctgcgtacgggacctattcatagatgggaggagtagagacctgcggggactggcagaagctcagggagccgtgggcgtggcccctttttgcagcagagagactctgaagcagtgtgcctccgccccttgtagaaatggcggagtgtgtcgagagggatggaaccggttcatatgcgactgcatcggcacaggctttctcggtcgcgtgtgtgaacgtgaagctacagtgctgtcatacgatggctccatgtatatgaagatcatgctgcctaacgccatgcataccgaggcggaagacgtcagtctgagatttatgtctcaaagggcctacggacttatgatggccacaacctctcgcgaatcagctgacactcttaggttagaactggacggaggccagatgaaactgacagtcaatctcgactgtctgcgggtggggtgcgctcccagcaagggaccagaaactctttttgccggacataaattgaacgataacgaatggcacaccgtgcgcgtcgtgagacgtggtaaaagtctgcagctctccgtggacaatgtgacagtggaggggcagatggccggtgcccacatgaggttagagtttcacaacatcgaaactggtattatgactgagagacgcttcatcagtgtcgtgccatccaactttatcggtcatctgtcagggttggttttcaatggacagccctacatggaccaatgcaaagatggggacattacatattgcgaattgaacgctagattcgggctcagggcaattgtggcagaccccgtgactttcaaatcacgcagttcttacctcgccctggccaccctgcaagcatatgcctcgatgcacctgttcttccagttcaagaccaccgctccagacgggctgctcctgtttaactcaggcaatggcaatgattttatcgtcatcgaactcgttaaagggtatatacattacgtattcgatctgggtaatggcccaagcctcatgaaaggcaacagcgataagccagtgaacgacaaccaatggcacaacgtcgtagtgagtagggaccccggtaacgtccacacacttaagatcgactcccgaactgtaactcagcactcaaacggagcccgtaatctcgaccttaagggagaactctatattggaggactgtccaaaaacatgttctcaaaccttccaaagctggtggcgtcaagagatggattccagggatgcttggcctctgtcgatctgaatggcagattgcctgatttgatcgcagacgcactgcatcgcatcgggcaggtcgagcggggttgcgatgggccatcgacaacctgtacagaggaaagctgcgccaatcaaggtgtgtgcctgcagcagtgggatggtttcacatgtgactgcacaatgacatcatacgggggtccagtttgtaacgatcccggaacaacctatatcttcggtaaaggtggagcgttgataacttacacatggcctcctaatgatagaccctccacaagaatggaccgactggccgtcggcttcagtacacatcagcggagcgccgtgctcgttcgcgtcgacagtgcttcggggttgggcgattatctccaactccatatcgatcaggggaccgttggtgttatcttcaacgttggcaccgacgatatcaccatcgacgagccgaatgccatcgtgagcgacggaaagtatcacgttgtccggttcactcgatctggaggcaatgctactctacaggtcgactcttggcctgtgaacgagagataccccgcaggcaacttcgacaatgagaggttggctattgccagacagcgcattccttatagactcgggagggttgtagacgagtggctactcgataagggccgacaactgaccattttcaattcccaggccgcaatcaagattggcggtcgggatcaaggccgaccatttcaggggcaagtcagtgggttatactacaatggattaaaagtgctggccctagcagccgagagcgatcctaatgttcggacggaggggcatctgagactcgtcggggaagggccaagtgtgttgctgagcgctgaaactactgctaccacactcctagctgacatggccaccaccatcatggaaaccactacaacaatggccacaaccactactagaagggggaggtcccctacactgcgcgacagtactacgcagaacactgatgacctgctcgtggcatctgctgagtgtcccagcgacgacgaggacctggaggagtgtgagccatccaccgggggtgagctgatactacccatcatcaccgaagactctctggacccaccccctgtcgccacaaggagtccttttgtcccccctcctccgacattttatcccttcttaacaggagtcggcgcaactcaagacacactgccacctcccgctgccaggcgcccaccgtctggcggtccctgccaggccgagcgcgatgacagcgattgcgaagagccgattgaggcaagcggcttcgcatccggtgaggtcttcgactcttctctgccacctaccgatgacgaggacttttatacgaccttcccactggtaaccgataggactacacttctttccccgaggaaaccagcacctaggccaaatcttagaacggatggagcaaccggcgctccaggggtactgttcgcaccttctgcgccagctcccaacctgcccgctggaaaaatgaaccaccgcgaccccctgcagcctctattggagaacccccctctggggccaggggctccaaccagttttgagccacgaaggcctccgcctctgcgtcctggcgtgactagcgctccaggatttcctcacttgcccacagccaatccgactgggcctggcgaaaggggacctccaggcgctgtggaggtcatccgtgagtcctccagcacaacaggcatggtggtcggcattgtggctgccgcagctctctgtatattgatactgctctacgcaatgtacaagtaccgcaacagagacgagggttcctatcaggttgatcaatcacgcaactacatctctaatagcgctcagtccaatggagccgtggtgaaggagaaggccccagctgcccctaaaacccccagcaaggccaaaaaaaataaggacaaagaatactatgtgtaa

SEQ ID NO: 232299 - DNA, 4928 bp, Artificial Sequence
  Description of Artificial Sequence: Synthetic coding sequence
atggcatctgggagcaggtggagaccaacacctcctccactccttttgctcctgctgttggccttagctgcccgagcggacggccttgagttcggaggtggtcccggacagtgggctagatacgctcggtgggctggcgcagcaagttccggcgaactcagtttctccctgagaaccaacgcaacccgggcactccttctatatctcgacgatggcggtgactgcgacttcctggaactgttgcttgtagacggccgtctgaggctgcgattcaccctgtcgtgcgcggaacccgctactctgcagttggatacccccgttgccgacgacagatggcacatggtgctgctgacgagagatgcgcgtaggaccgctttggctgtcgatggagaggccagagccgctgaagtgcgctcaaagcgacgagagatgcaggttgccagcgatctgttcgtaggaggcatccctcctgacgtgcggctcagtgctctcacccttagcactgttaagtatgaaccaccgttcaggggtctcctcgcaaatctgaagctgggcgaaaggccacctgctctcctcggctcacagggcctacggggagccactgccgacccactttgtgccccagcacgcaacccatgtgctaacggaggcctgtgcaccgtgctcgccccaggagaggtcggttgcgactgcagtcacaccgggtttggcggaaagttctgctctgaagcgccatccccattccagggtcccgcacacctgaccctgaatagtgaaggcaaagaggagttcgttgcaactttcaagggaaatgaatttttttgttatgatctttcacataatcctatacagagctccaccgacgagatcaccctggccttcagaaccctccagagaaatggactcatgttacacaccggaaaatccgcagactatgtgaatctatccctgaaatctggcgctgtctggctggtgattaatctggggtcaggcgcattcgaggcccttgtagagcctgtgaacggcaaatttaatgataacgcttggcacgatgttagagtgaccagaaacctcagacagcacgctggaattgggcacgccatggtgacgataagcgtggacggtattttgactaccaccggatacactcaggaagattataccatgctgggttctgacgactttttttatataggaggttccccaaacaccgctgatctgccaggatctcctgtaagtaataactttatggggtgcctgaaggacgtggtctacaaaaacaatgactttaaacttgagctctctcgcctggcaaaagagggggatcccaagatgaagctacagggcgatctatcctttagatgtgaagacgtcgccgcactcgatcctgttactttcgagtctccagaagcttttgtcgctctcccgcgttggagcgccaaacgtaccggttctatatccctcgacttccgcacaactgagcctaacggcttactcctgttttctcaggggaggcgggctggtggaggcgctgggagtcactccagtgcacagagagcggattacttcgcaatggaactgctagacggccatttgtatttgttattggacatgggatcggggggaattaagctgagggcctcatctcggaaggtgaatgatggcgaatggtgccatgtcgactttcaacgagacggcaggaagggatccatctccgttaattcccgcagcacgcctttccttgccacaggcgactccgagattctggacttggagtctgagttgtatctgggcggtctacccgaagggggtcgagtggatctgcccctgccacccgaggtgtggaccgctgcattgagagctgggtacgttggatgcgtgcgtgatctcttcattgacggaagatcacgcgaccttcggggtctggccgaagcacagggggcagtcggggtggcacccttctgttcccgcgagacactcaaacagtgcgcgagcgctccctgtaggaacggcggtgtatgccgggagggctggaatagatttatctgcgactgcattgggaccggatttttgggcagagtgtgtgaaagagaggccacagtactctcctacgacgggtcaatgtacatgaaaatcatgctgccaaacgcaatgcatacagaagcagaggacgtttcccttcgattcatgagccagagagcatacggcctaatgatggccaccacatctcgagaatccgcagacacgttgcgtttggagcttgacggaggtcagatgaagttaactgtcaatttaggaaaaggcccagaaacactgttcgctggacataaattgaatgacaatgagtggcacacagttcgggtggtccggcgaggaaaaagtttacagctatccgtggataacgtgaccgtcgaaggacaaatggcaggagctcacatgaggctcgagttccacaatatcgaaactggcataatgacagaacgcagattcatctcagtcgtcccttccaattttattgggcaccttagcggcctcgtgttcaatggacagccatacatggatcagtgcaaagatggagatattacatattgtgaactgaatgccagatttggcctgagggctattgtcgcggatccggttaccttcaagagccggtcctcttacctggcactggccacattgcaggcctatgcaagcatgcacttgttttttcagtttaaaaccacagcccctgacggtctccttttgttcaacagtggtaacggcaacgactttattgttatcgagctggtgaagggatatatacactacgtgttcgacttagggaatgggccttcgctgatgaagggcaacagcgacaagccggtcaatgataatcagtggcacaatgtggtcgtgagcagggacccgggaaatgtgcatacacttaagatcgattccagaaccgtaacacaacactccaatggtgcaagaaatctcgatctgaagggcgaattatacattgggggtttgagcaaaaatatgttcagtaacttgccgaagctggttgcttctcgagatggcttccagggatgcctggcatccgtggacctgaatggaaggcttcccgacttgatcgccgacgcattacacaggattggccaagtagaacggggatgcgacggcccatccactacttgtaccgaggagagttgtgctaatcagggagtgtgcctgcaacagtgggacgggttcacctgcgattgcactatgaccagctacggaggtccagtgtgtaatgaccctggaactacttatatttttggcaaggggggagcccttataacctacacctggccaccaaacgaccgacctagcacgcggatggaccgcttggcagtcgggttctccacccaccagcgaagtgcagtcttggtccgtgtagactctgcaagcggtctcggagattacctccagctacacattgaccaaggaaccgtgggggtaatatttaatgtgggcactgacgacataaccatcgacgagcctaacgcgattgtaagcgatggcaaatatcacgttgtgcggtttacccgaagtggagggaatgccaccttgcaggtcgactcttggcctgtgaatgagagatatcccgcaggaaggcagttaaccatctttaattcgcaggctgccattaagatagggggacgggatcaaggcagaccttttcagggccaggtgagtggactgtactacaatggcctaaaggtgctcgcactcgcggcagaaagtgaccccaacgtgcgaactgaggggcatctgcggctagtcggagagggaccatctgtgcttctcagtgcagagaccactgctaccactctgttagccgacatggctacaactatcatggagaccaccaccacaatggctaccacaactacccgtcgcggacggtctccaacattacgcgattccaccactcagaacacagacgaccttctggtagcatccgctgagtgcccgagcgacgatgaagacctcgaggaatgcgagccttccacaggaggtgagctcatcctgccaattattactgaggacagcttggacccacctcccgtagccacccgcagtcccttcgttccgcctccacctaccttttatccattcttaacaggagttggggctactcaggatactctgccaccgccagctgcacggcgaccaccctcgggcggaccctgtcaggcagaacgggatgactctgattgtgaggagcccatcgaagccagtggcttcgcttcaggagaggttttcgattccagtttaccccctacagacgatgaggacttttacaccacatttccattagtgacggacaggaccactcttctgtcgccaaggaagcctgctccgaggcccaacttaaggacagatggcgctacaggagcccctggtgtgttgttcgcaccatcggctcccgctcctaacctgccagctggaaagatgaaccacagggatcctctacagccactgctcgagaaccccccacttggtccaggcgctcccacttcatttgagcctcgcaggccaccacccttgcgcccaggtgtcacttcggcacctgggtttccccacctacccacggccaatcccacaggcccaggagaacgcggacctccaggggctgtcgaagtgataagggagtcttcatcaactaccgggatggtcgtcggtattgtggccgcagccgctctttgcattctgatcctgctgtacgctatgtataaatatcgaaatagagatgaggggtcataccaggtggaccagtctcggaattatatcagtaattccgcgcaatccaacggtgccgtcgtcaaagagaaagctcccgcagccccaaaaacaccctcaaaggctaagaagaacaaagacaaggagtactacgttta

SEQ ID NO: 232300 - DNA, 5138 bp, Artificial Sequence
  Description of Artificial Sequence: Synthetic coding sequence
atggcaagtggttctagatggcgtccaacaccaccaccgctattgcttttgctcttgctggccctcgccgcaagagcagacggtctggaatttggtggtggtccgggacagtgggctcggtatgcaagatgggccggagcggcttcgagcggagaactctctttcagcctccggacaaatgccacccgagctcttctgctctacctggatgacggcggtgattgcgatttcttggaattgctgctggtcgacggtagactcagactgaggttcaccttatcatgcgcagaacccgcaacactccagctggacacgcccgtcgcagatgaccgttggcatatggtgctgctgacccgcgatgctaggagaacagcacttgccgtggatggggaagcgagggccgctgaagttagatctaagagacgggaaatgcaggtggcctcagatctatttgttggaggcataccaccggatgtgagactgtctgcactgacactttccacagtcaaatatgagccccctttccggggtcttctggctaacctgaaattaggggaaaggcccccagccttattggggagccagggactgcggggtgcaacggcagatccattgtgtgcccctgccaggaacccgtgcgccaacgggggtctatgcactgtgcttgcacccggagaggtcggttgtgactgcagccacactgggtttgggggaaagttctgcagcgaggaggagcacccaatggaaggacccgctcatttgactctaaatagcgaggtggggtcgctgctgtttagtgaaggtggggctggacgaggtggcgcaggagacgtgcaccaacccaccaaagggaaagaggagttcgtagccacgtttaaaggcaatgagtttttctgttacgacctgtcccataacccgatccagtcctccacagatgaaattactcttgcctttaggaccctgcagaggaatggcttgatgcttcatactgggaagtctgccgattatgttaacctgagtcttaagagtggggcagtgtggttggttattaacttaggaagcggagcctttgaggcgctggtcgagcctgttaatggcaagttcaacgacaatgcgtggcatgacgtaagagtgacaagaaatttgaggcagcatgccggaatcggtcatgcaatggttaataagctgcattacctggtgactatttcagtggacggtattctgactactaccgggtatactcaggaagactataccatgctcggctcggatgactttttctacatcggaggtagtcctaacactgccgacctgcccggtagcccagtgtccaacaatttcatggggtgtctgaaagatgtggtgtataaaaataacgatttcaagttggaactgtctcggctggcaaaggagggcgatcccaaaatgaagctgcagggggatctctcctttcggtgtgaagatgtggcggcattagaccccgtcacattcgagtctccggaggcattcgtcgcgctccctagatggagcgcgaaacgtactggttctatctcacttgattttcgtaccactgagcctaatggccttctgctgttctcacagggaaggcgcgctggtggcggtgctggctctcatagctccgcacagcgggcagactacttcgccatggaactgcttgacggtcatctgtacttgctgctcgacatgggctctggcggtattaagctgagggccagttccagaaaagtaaatgacggcgaatggtgccacgttgactttcaaagggatgggaggaagggtagtatctcggttaattctcgatcaaccccgtttttagctacaggtgattcagagatccttgacctggagagcgagctctatctaggcggtttgcccgaagggggacgggttgatttgcctcttccacctgaagtgtggacggccgctctccgagccggatatgtgggttgcgtgcgcgacctctttatagatgggaggagccgggacctcagggggctggccgaggcgcaaggcgctgtcggcgtcgcccctttttgttctcgagagacattaaaacagtgcgcatcagccccttgtaggaacgggggtgtatgccgtgagggctggaaccgctttatttgcgactgtatcggtaccggtttcctggggagagtgtgcgagcgggaggctaccgtgctctcctacgatgggtccatgtatatgaagataatgttgcccaacgcaatgcacacagaagctgaggatgtgtctttgagattcatgtcacagcgtgcttatggtctcatgatggcaaccacaagccgtgaatctgcagataccttgaggctggagctcgatggcggtcagatgaagctgaccgtcaaccttgattgtctccgggtagggtgcgctccttctaagggccctgaaaccctgttcgcaggacataagctcaacgacaacgaatggcatactgtgcgggtggttcgacgcggtaagtccttgcagctgtccgtggacaacgtgacagtcgaaggacagatggccggtgcccatatgcgcctagagtttcacaatattgaaactgggattatgacggagagaagatttatctccgtggttccttccaatttcatcggccatctgagtggcctggtctttaatggccagccttacatggatcagtgtaaggacggggacatcacctattgtgagcttaatgcccgtttcggcctaagagcaattgttgcagatccagtcaccttcaaaagtaggagctcttacctggccttggcaaccctgcaggcctatgcttcgatgcacctcttcttccagtttaaaacaactgctccagacggcctccttttgttcaattctggaaatggaaacgacttcattgttatcgagctggtaaagggatacatccattacgtattcgatctgggaaacggtcccagtctcatgaagggaaacagcgataagcccgtcaatgataaccagtggcacaatgtggtagtgagcagagatccaggaaacgtgcataccctgaagatcgacagccgcacagtgactcaacacagcaatggggctagaaacctggacctaaagggtgagctttacatcggagggttgtctaagaacatgttcagcaatctgcccaaacttgtcgcctctagggacggatttcaaggttgcctggcaagcgttgaccttaacggtcgcttgcccgatttgatcgcagacgcgttgcaccggattggccaggtggagcggggatgcgacggcccttccacaacctgcaccgaggagtcttgtgccaatcaaggggtgtgtctgcagcagtgggacgggttcacttgtgattgtaccatgacctcctacggagggcctgtgtgcaacgatcctggaaccacctacatctttggtaagggtggagccctcatcacttatacttggcctccaaacgatcgcccttccacacggatggacagactagctgtgggctttagcacccaccagaggagcgccgtactggtgagagtggacagtgcctctgggttgggcgactatctgcaactgcacatcgaccaaggcacagtaggtgtcatctttaacgtaggcacggatgatatcacaattgacgagcctaacgcaatcgtgtctgatgggaaatatcatgtcgtccgattcacgcgcagcggtggcaatgctactctgcaggttgactcatggccagttaacgagaggtacccagcgggaaactttgataatgagcgattagccattgcccgtcaaaggattccctaccgcttaggaagagttgttgatgaatggctgctggacaaggggagacagctcactatattcaactcccaggctgcgatcaaaatcggagggagagatcaggggaggcccttccaaggacaagttagtggcctctactataacggtcttaaagtcttggcgttggccgctgagtccgaccctaacgttaggaccgagggccacctgcgtctggtgggtgaaggacccagcgtccttcttagtgcggagacaactgctaccacgctgctggctgatatggccacgaccattatggaaaccaccactactatggctaccaccacgactagacgtgggagatccccaacactcagagactccaccactcaaaataccgacgacctgctcgtcgcttccgctgagtgtccatccgatgatgaggatctggaagaatgcgaaccctccaccgggggagagctcattctccccattatcaccgaggattcgctcgacccccctcccgtggcaacacgctcaccgttcgtcccccctccacctactttctatcctttcctcacaggcgttggcgcaactcaggatacgttaccccctcctgcagctaggaggccgcctagtggagggccttgccaggccgagagggatgattccgactgcgaagaacctattgaggcatccgggttcgcttcaggggaggtctttgattcctcgctacccccaacagacgatgaggacttctataccacatttcctctggtgactgatcgaacgaccttgctcagcccaagaaagcccgctcccagacctaatctccgcactgatggtgctactggggctcctggagtattgtttgccccttccgctccagccccaaacctccctgcaggtaagatgaatcacagagatcccctccagcctttactggagaatccgccattaggaccaggggctcctacttccttcgagccccgacgcccaccaccattgcggccaggagtgacaagcgcacccggttttcctcatttgcccactgctaaccccacaggtccgggtgagagagggcctcccggagcagtagaggtgatcagagagagttcgtctactacaggcatggtagtgggtatagtagctgctgctgctttatgcatactgatcttactttacgctatgtacaaataccggaatagggacgagggcagctatcaggtcgaccaaagtagaaactacatttcaaacagcgcacagagcaatggagcggtggtaaaagaaaaggcccctgctgcgccaaagaccccatctaaagccaaaaaaaataaggacaaggaatactacgttta

SEQ ID NO: 232301 - DNA, 4929 bp, Artificial Sequence
  Description of Artificial Sequence: Synthetic coding sequence
atggcctccggctccaggtggagacccacgccacctcccctcttattactccttttactagcgctcgcagcgagggcagacggcctggaattcggcggtggaccaggccaatgggctagatatgcacgctgggccggtgctgcctcctccggggaactgtcctttagcctgcgaactaacgcgaccagagccctcctcctatatctggacgacggtggcgattgtgactttctcgagttgttgcttgtcgatgggagactgagattgcgcttcaccctttcttgtgccgagcccgctaccttgcagttagatacgcctgtggccgacgaccgctggcatatggttctgctgactagggatgcacgcagaacagctctggccgttgatggagaagcaagagccgcagaggtgcggagcaagagacgagagatgcaagttgcaagcgacctatttgtaggagggattcctccagatgtcagactgtccgcactgacactctccaccgtgaagtacgaacccccattccgtggcctgctggccaacctgaaactcggggagagacccccagctctgttgggatcacaaggtttgcgcggtgcgaccgctgaccctctctgcgcacctgcacgcaatccatgcgcaaatggtgggctgtgcaccgttctggctcctggcgaagttggctgtgactgctcccatacaggtttcgggggaaagttttgttccgaagaggagcaccccatggagggccctgcccacctgaccctcaatagtgaaggtaaagaagagtttgtggccaccttcaaaggaaatgagttcttctgttacgacttgtcccataaccctattcagtcttcaactgatgagataaccctggcatttcggacgctccaaagaaatggactaatgctccacacaggaaaatcagctgattacgtcaacttatctctaaaatcaggagccgtctggcttgtcatcaatctcggctccggggcatttgaggcactggtggaacctgtcaacggaaaatttaacgacaatgcgtggcatgatgttagggtaacccggaacctgcgccagcacgcgggaattggccatgccatggttactatctcagtcgacggaatcttgactacgactggctacactcaagaagattacacaatgctcggctcagatgattttttttatattgggggaagccctaacaccgctgatttaccgggttctcccgtgtctaacaacttcatgggttgcctgaaggacgtggtgtacaagaacaatgacttcaagcttgaattaagtcgactcgctaaggagggagatccaaagatgaaactccagggggaccttagtttccggtgcgaagatgtggccgcactcgacccggtgaccttcgaaagcccagaagccttcgtagcccttccacgatggtctgccaagaggaccggcagcatctcattagattttagaacgacagaaccaaacgggcttctgcttttcagccaaggccgacgtgctgggggaggagccggaagtcattcatccgctcagagagcagactacttcgccatggaactacttgatggccatctgtacctactacttgacatggggtccggtgggattaagctgcgggcatcatcccggaaagtgaatgatggagaatggtgccatgttgattttcagagagacggcaggaaggggagtatttctgttaactccaggtcaacacccttccttgcgacgggggatagcgagatcttggatctggagagcgaattgtatctgggcggactgcccgagggaggaagggttgatttgccactgccgcctgaggtttggacggccgcacttcgggcaggctatgtgggttgcgtaagggatctttttattgacggaaggagccgagatttgcgagggctcgctgaagcccaaggggctgtgggtgtcgctcccttctgttcaagagaaacactaaaacagtgtgcatcagctccttgccggaacggaggggtgtgcagggagggatggaacaggtttatctgtgactgcatcggaacggggtttctggggagagtgtgcgaacgggaggcaacagtactgtcctacgatggaagcatgtatatgaaaattatgctacctaacgctatgcacactgaggctgaggacgtctcattgagattcatgtcacaacgagcctatggtctcatgatggccactacttccagagagagcgctgacaccttacgcctggaactggacgggggacagatgaagctcaccgtcaacctgggaaaaggcccagaaaccctgtttgcgggacataaacttaatgacaacgagtggcacacagtgcgggtcgtgagaaggggaaagagcttgcagctgagtgtcgacaatgtgactgttgaggggcagatggctggggcacacatgaggttagagttccataacattgagacgggtatcatgaccgagaggaggtttattagcgtggtgcctagcaattttatcggtcacctttcgggacttgtgtttaacggccagccgtacatggaccaatgtaaggacggagatattacatattgcgagctgaatgcccgattcggacttagagcaattgtggccgatccagttaccttcaagtctcgatccagttacctggccctggctacgctgcaagcatatgccagtatgcacttatttttccagttcaagacgaccgctccagatggactgctgctgtttaattccggtaatgggaacgacttcatcgtaattgaacttgtaaaaggttatatacattacgtgtttgacttggggaatgggccttctctgatgaaaggtaacagtgataaaccagtcaacgataatcagtggcacaacgtggtggtgtccagggacccaggaaatgtgcataccctgaagattgactctaggactgtcacccagcacagtaatggagccagaaatctcgatttgaaaggagagttgtatatcgggggactctcgaagaatatgttcagcaacctgcctaaactggttgctagtcgcgatggcttccaggggtgcctggccagcgttgacctgaacggacgcctgcctgatttgattgcggacgcgctgcaccggattggtcaggtcgagaggggatgcgacggccctagcacaacgtgcacggaagagagttgtgccaatcaaggggtgtgccttcagcagtgggacggcttcacctgtgactgtacaatgaccagctatgggggaccagtttgcaacgaccctggaacgacttacatatttggcaaagggggagcgctgattacatatacctggccacccaatgataggccttcgactcgaatggacagactagctgtgggtttcagcactcatcagcgttccgcagtactggtgcgggttgactcagcatccggcctcggcgattacctccagttacacattgaccagggtaccgttggagtcatcttcaatgtgggaaccgatgacattaccattgacgagccgaatgctatagtaagtgacggcaagtaccacgtggtccgctttacgaggtctggcggaaacgcgactctgcaggtggacagctggccagtgaatgaacggtacccggcagggcgacagctcaccatttttaacagccaggcggctatcaaaatcggcggacgagatcaagggcgaccctttcagggacaggtcagcggactttattataatggccttaaggtactggccctggctgcagagtctgaccctaatgtgagaaccgaggggcatctgcggctagtgggggaaggacccagcgttctcctgtcggccgagactactgccactacactcctcgctgacatggccaccaccatcatggaaaccaccacaactatggcaacaacgacaactcgtcgcggaagaagccctactctgcgtgactcaacaacacagaatacggatgatctgctggttgcctctgccgagtgtccatcagatgatgaggacctggaggagtgtgagccaagcactggcggagagcttatacttcccataattaccgaggatagcttggaccccccaccagtggccactcgctctcccttcgtcccaccgcctcccactttctacccgttcctgacaggagtaggagccacgcaggacacccttccccctcccgctgcccgaagaccgccttctggtggcccatgccaggcagaaagggacgattcggattgcgaggagcctattgaggcctccggctttgctagtggagaagtcttcgacagctctctgccccctacagacgatgaggatttctatacaacctttcccctggtgaccgacagaacgacactgttgtctcctcgcaaacccgcacctcgccctaacttgcggactgacggagccaccggcgctccaggggtcttatttgccccttctgcacctgcccctaacttacctgccggaaaaatgaatcacagagatcccctgcagcccttactggagaatcccccactgggccctggggctcctaccagtttcgagcccagacgaccacctccattgaggccgggtgtgacgagcgcgcctggattcccacatctacctacagctaaccctacaggccctggggaacggggtccacctggagctgtcgaagtgataagagagagtagtagtaccaccggaatggtggttggtatcgtagccgctgcggctctctgtatactgatcctgctgtatgcgatgtataagtataggaatcgcgacgaaggctcctatcaggttgaccagtctagaaattacatctctaatagcgcacaatctaacggggcagtagtgaaagagaaagcacccgctgctcccaagaccccatctaaggccaaaaagaataaagacaaagagtattatgtatat

SEQ ID NO: 232302 - DNA, 5117 bp, Artificial Sequence
  Description of Artificial Sequence: Synthetic coding sequence
atggcttccggatctcggtggagacctactccaccgcctctactgctgttgctcctgctggctttggccgcaagggcggacggactggaatttggtggcggtcccggtcagtgggcccgatacgcacggtgggcgggagcggcttcaagcggtgaactgtctttcagtctccggacaaacgcgacccgggctcttctcctctacctggatgatggaggtgattgtgacttcctggagctccttctggtggatggacggctgcggctcagatttacacttagctgcgccgagcctgctaccctgcagcttgatacaccggtggcagatgaccgctggcacatggtgctgcttacacgggacgcaaggagaacagctcttgccgtggacggggaggctcgcgctgccgaggtacgttccaagagacgggagatgcaggtggcatctgacctctttgttgggggaattccacccgatgtgcgcctcagtgccttgactctatcaaccgtgaaatatgagcccccttttcgcggactgctggctaacctgaagctcggcgaaagaccacctgctcttctggggagccaaggattgcggggagccactgccgaccccttgtgcgcaccggctagaaacccgtgcgcgaacggcggattgtgtaccgtgttggcacctggcgaggtgggctgtgattgctcacatacaggatttgggggtaagttttgctcggaagaagaacatcccatggagggcccagcccatctaactctgaatagcgaggttggctcccttttatttagtgaaggtggggctggtcggggtggcgcaggggacgtgcaccaaccgacaaaaggaaaggaggaattcgtggcaacattcaaaggcaacgagttcttctgctatgacctgagccacaaccctatccagagctccaccgacgagatcacgttagctttcaggaccctgcagcgaaacggcttgatgttgcatacaggtaaaagtgcagattatgtgaacctatctctgaaaagcggcgctgtatggctggtcatcaacctgggctctggcgctttcgaagccctggtggaacccgtgaatggtaaattcaacgacaacgcatggcacgacgtacgtgtgacacggaatctcagacagcacgccggtatcggacatgcgatggtaactattagcgtggacggcattctcactaccacagggtacacccaggaggactacaccatgctgggaagtgatgattttttttacattggcggtagtccgaacacagcagacctgcctggctccccggtgagcaacaatttcatggggtgcttgaaagacgtagtttacaagaacaatgattttaagctggaattgtcccgcctagccaaggagggtgatccaaagatgaaactacagggagatctcagtttccgctgtgaggatgtcgccgctttagatcccgtcacattcgaaagcccggaggctttcgtggctcttcctaggtggagtgccaagcggacggggtcaattagcctcgacttcagaacgacagagccaaatgggctgctcctttttagtcagggacgcagagcagggggaggtgccggtagccattctagcgcgcagcgtgcagactatttcgctatggaactgctcgatggacacctctatcttttgttggacatgggttccggtggtataaaattacgcgctagcagccgcaaggtgaatgatggagagtggtgccacgtagacttccagcgggatggtcgcaaaggcagtatatcggtcaatagtcggtccaccccattccttgctaccggagacagcgaaattctggacctggaatcggagttgtatctgggcggactacccgaaggcggacgcgtcgacctgcccctaccaccagaggtgtggactgccgctctgagagccggatacgtgggatgcgtgagggacctcttcatcgacggccgttctcgggacctgcgcggtctagcagaagcccagggagcagtaggtgtggctcccttctgttctagggagaccctgaaacaatgtgcttccgcaccttgccgcaacggtggagtatgtcgcgagggctggaatagatttatttgtgactgtattggaaccgggttccttggcagggtgtgtgagagagaggctacagtgttgagctacgacggatccatgtacatgaagattatgctgccgaacgcaatgcatactgaagctgaggatgttagcctcaggttcatgagtcagcgtgcatacgggctcatgatggcgacgaccagtagagaatccgccgacacccttagacttgaattggacggcggacagatgaaactcaccgttaacctggattgcttaagagtcggctgcgcccctagcaagggcccagaaactctttttgctggccacaaattgaatgacaacgagtggcacacggtgagggttgtccggagaggaaaatccttacaattaagtgtggataacgtcactgtggagggccaaatggcaggggctcacatgcggctcgagttccataatattgagaccggcatcatgactgagcggaggttcatcagcgtggtcccgtcaaatttcattgggcatctgagcggccttgtcttcaacggccagccctacatggatcagtgcaaggacggggacatcacttactgtgagttgaacgcgagatttggactcagggctattgtggcggatcctgttacgttcaaatctagatctagctacctggccttggccaccctgcaagcatacgcttccatgcacctcttctttcagttcaaaacgacagcccctgatggactccttttatttaattctggcaacggtaacgacttcatcgtgattgaactcgtaaagggatatatacactacgttttcgacctggggaacggtcctagtctgatgaagggcaactctgacaaacctgtgaatgacaatcagtggcataatgtcgtcgtgagccgagacccaggtaatgtccacactcttaaaatagattccagaactgtaacacaacacagtaatggcgctcgcaatctcgacctcaagggtgagctgtacatcgggggacttagcaagaatatgttctcaaacctccctaagcttgtggcttcccgcgatggcttccagggctgtctggccagtgtggatctgaacggtaggctgcccgacctaatagctgatgctttgcatagaatcgggcaggtggaacggggttgtgatggaccatctaccacatgcacagaggaatcctgtgccaatcagggggtgtgtctgcaacagtgggacggttttacctgcgactgcaccatgaccagctacgggggaccagtatgcaatgatccagggacaacatacatcttcggcaagggaggcgctctaatcacctacacatggcccccaaatgaccgtcctagcacccgcatggacaggctggccgtgggtttctccacgcaccagagatcggccgtgctggtccgggtggacagtgcctccggcctgggcgattaccttcaacttcacatcgatcagggcaccgtgggtgtgatcttcaacgtgggcaccgacgatattaccattgacgagccaaatgccatagtttcagacggtaaataccatgtcgttaggttcacccgatccggtgggaacgccacacttcaggtggactcttggcccgtcaatgagcgttaccccgctggaaatttcgataatgagaggctcgctatcgcgaggcagaggattccatacaggctgggaagagttgttgacgaatggctgctggacaagggcagacagctgacaatttttaactcccaagccgctatcaaaatcggcggtcgggaccagggcagaccattccaggggcaagtgtccgggctttattataatggactgaaagtgctcgcgctcgctgccgaatctgaccctaatgtccggaccgagggacacctgcggttggttggagagggaccaagtgtgcttttgagcgccgaaacaactgcaaccacattgctggcagacatggcgactactattatggaaactaccactacaatggcaacaacgaccactcgaaggggaagaagcccaacacttagagactccaccacgcagaatacggatgatctgctggtcgcttctgcggaatgcccttctgacgacgaagacctggaggagtgcgagccgagcactgggggagagctgatattacctatcataacagaggacagcctggatccccctccagtcgccactcggagtccattcgtgcctccaccaccgaccttctatcctttcctaacaggcgttggagcgacccaggatacacttccccctcctgctgccaggcgccctccaagcgggggaccatgtcaggccgagcgggatgatagtgactgtgaagagcctatcgaagccagcggattcgctagtggagaagtgtttgacagcagtcttccgcctacagacgatgaagacttttacactacgtttccactggtgaccgacagaaccacactgctctctccaagaaagccagcacccagacccaatctcaggaccgatggcgctaccggagcccctggcgtactgttcgccccatcagcccctgctcctaatctccctgccggtaagatgaaccatagggatcccctacaacccctcttggagaatccacccctgggcccaggtgctcctacgtcattcgaaccccgtcgcccaccacccctgaggccaggggtgacatccgccccaggttttccgcaccttcctaccgctaacccaacaggccctggggagcggggaccacccggagcagtggaagtgatcagagagagttcctctactacagggatggtcgtgggcattgttgcagcagcagcgttgtgcatcttgatcctgctatacgcaatgtacaagtaccgtaaccgtgacgaggggagttaccaggtggaccaatcccgcaactatatctctaattcggcccagagtaacggagctgtggtgaaggagaaggcgccagcagcaccaaagacgccgagtaaagcgaaaaaaaataaggacaaagaatactatgtata

SEQ ID NO: 232303 - DNA, 2001 bp, Artificial Sequence
  Description of Artificial Sequence: Synthetic coding sequence
atgccgcctggcggatccggtcccggagggtgtcctagaaggccacccgctttggccggacctttgcctcctccgcctccacctccccctccccctcttctcccactgctgcctttacttctgttgctcctgcttggcgcagccgagggagccagagtgtcttcctctctgtctaccactcatcacgtgcaccattttcactcgaaacacgggacggtgcccatcgccatcaacagaatgccttttctcacccggggtggacatgccggtaccacctacatttttggaaaagggggtgctctgatcacatacacctggccccctaatgatagaccgagcacaagaatggataggctcgctgtgggattctcgactcatcagagatccgcagtcctggtgagggtcgacagcgcttccggcctcggtgactacctccagctacacattgatcaaggcaccgtaggagtgattttcaatgttggaactgacgacatcactatcgatgagcctaatgcaattgtgagcgatggcaaataccatgttgtacgcttcacccggagcggcggtaatgccactctgcaggtcgacagctggcctgtgaatgagagatacccagccggaaattttgataacgagaggttggcaattgcaaggcagagaatcccctatcgactggggagagttgtggatgagtggctgctggataaaggtcgacagttgactatcttcaatagtcaggctgctattaaaatcggaggacgcgaccaaggcaggccattccaagggcaggtcagcggcctgtattacaacgggctgaaggtgcttgctctcgcggctgagtccgaccctaatgtgcgcaccgaggggcatttgagactcgttggagagggaccttccgtcctcctgagtgccgaaaccacagcgaccacactcctggctgacatggctactacaataatggagaccacaactacgatggctacaaccactactcgcagaggtagatcccccacactgagggactccaccacacaaaatactgacgatctgttggttgcaagcgccgaatgtcctagcgatgacgaagacctcgaggaatgtgaacctagtaccggaggcgaactgatcctccccattatcaccgaggactcattagatccccctcccgttgctacacgcagccccttcgtgccgccaccacccaccttctacccctttctcaccggcgtcggcgcaacgcaggataccctgccccctcccgctgcgcgacgacctccttccggcggaccgtgtcaggcagagagggatgatagcgattgtgaagagcctatcgaagcctccggcttcgcctcaggagaggtgttcgattcatcactgcccccaacagacgatgaggatttttacacaacatttcctttggtgacagacagaaccacactccttagtcctcgcaagcctgcccctcggcctaacctgcgtacagacggcgctaccggtgccccaggtgtcctgttcgccccaagtgctcctgctccaaacctgccggctggaaagatgaatcatcgggacccactacaacctctccttgagaatccccctctgggccctggagctcctactagtttcgagcctcggaggccgccaccactccgccctggtgtgacgtccgcgccaggctttccacacctgccgacggccaatcccacgggccctggtgagcgcggtcccccaggtgcagtggaggttatccgggaaagtagttctaccacggggatggtggtcggcatcgtggcagcagctgccctttgtatcttaatcctcctgtatgcgatgtacaagtaccgcaaccgcgacgaaggatcatatcaagtcgaccagtctcggaattatatctcaaactccgcccaatcaaatggggcagttgtgaaggaaaaagctcccgctgctcccaaaacacccagtaaagctaagaaaaacaaagataaagaatactatgtgtag

SEQ ID NO: 232304 - DNA, 1299 bp, Artificial Sequence
  Description of Artificial Sequence: Synthetic coding sequence
atgcacctgcgcatacatgcccgacgatccccgccacggcgtccagcctggacgctgggcatttggtttctgttctggggctgcatcgtgtcgagtgtctggtcttctagtaatgtggcatcaagctcatccacttcctcaagcccgggatcccacagccagcacgagcatcactttcatggttccaagcatcacagcgtccccattagtatttacagatctcctgtttctctgagggggggtcacgctggggcaacctacattttcggaaagtcgggcggtctgatcctgtatacctggcccgcaaacgaccgcccaagcacgagatcagacaggttagccgtggggttcagtaccaccgttaaagacggaatccttgtaagaatagattcagcaccaggccttggggattttctccagctgcacatcgaacaaggaaagataggggtggtgttcaatattggcaccgtggatatctccattaaagaggagaggacacccgtcaacgacggtaagtatcatgtggttaggtttacccgaaatgggggtaatgcaactttacaagttgacaattggcctgtaaatgaacactacccaactggacgtcaacttaccatcttcaacacccaggcgcaaatcgcaataggcggaaaggataaaggcaggctgttccagggtcagctgagcggactatactacgatggcctcaaggtgctgaacatggcagcggagaacaacccaaacatcaagatcaacggcagcgtccgcctcgttggggaagtgccaagtatcttgggcaccactcagacgacatctatgccacccgaaatgtcaactacagtgatggagactacaacgactatggccacgacaacaacgcgtaagaataggagcaccgctagcatccagcccacatctgacgatttggtgtctagcgctgaatgctccagcgatgatgaggattttgtggagtgcgagccctccactggtagaagtgctaatcctacagaacccggtataagacgcgtgcccggagcctccgaggtgattcgtgaaagcagcagtacaaccggaatggtggtggggatagttgctgctgccgctctgtgtattttgatcctcctttatgctatgtataagtatcgcaatagagacgaagggtcttaccaagtcgatgagactcgcaactacatctcgaattccgctcaatccaatggcaccctaatgaaggagaagcagcagtcaagcaaatctggtcataaaaagcaaaagaataaggatcgagagtactacgtgtag

SEQ ID NO: 232305 - DNA, 4932 bp, Artificial Sequence
  Description of Artificial Sequence: Synthetic coding sequence
atgagctccaccctgcactccgtgtttttcacacttaaggtgtcgattctgctggggagtctgctgggcctctgcctcggactggagttcatgggcctccccaaccagtgggcccgatacctaaggtgggatgcgagcactcggtccgacctctcctttcagtttaaaacaaacgtgtcgaccggactgctcttatatttagacgacggaggcgtgtgtgatttcctttgtctgtcactggtagatggcagagttcagctgcgtttttctatggactgtgctgagaccgcggtccttagtaacaaacaagtaaacgattcaagttggcacttccttatggtctcgcgggataggttaaggactgttctgatgctggacggggaagggcagtccggagaactgcagcctcaacgcccttatatggatgtggtctccgatttatttctggggggtgttccaactgacattcgcccatctgccctaacccttgacggggtccaagctatgcccggattcaaagggctcatcctggacctgaaatacggaaatagcgagcctcgcttgctaggctcacgcggtgtccagatggatgcagaaggtccttgcggagagcgcccttgcgagaatggtggcatttgcttcctccttgatggccatccaacatgtgattgttcgaccactggttacgggggtaaattatgtagcgaaggatcctctggggacccttgcctgtctcacctcatgatgtccgagcaggcacgcgaggaaaacgtcgctacatttcgtgggagtgagtacctgtgctatgatctgagccagaaccctatccagtcaagctccgatgaaatcaccctctcattcaagacttggcagaggaatggtttgattttacacactggcaagtctgccgattacgtcaaccttgctctcaaggatggtgccgtgagcctggtaattaatctggggtcaggggcatttgaagccatcgtggagcccgtgaacggcaaattcaacgacaacgcatggcatgatgtaaaggtcactcgcaatctgcggcaggtgaccataagcgtcgatgggatcctcacaactacagggtacacacaggaggattacacaatgctggggagcgatgacttcttctatgtaggtggttcaccaagtactgcagacttgcctggttctccagtaagtaataacttcatggggtgtctgaaggaggtcgtgtacaagaacaatgacattcggctggaactcagccggctcgcaagaattgcagataccaaaatgaaaatctatggagaggtggtttttaagtgtgaaaacgtcgctacacttgatcctatcaatttcgagacccctgaggcttacatctcactgccgaagtggaatacaaagcggatggggtccatctcgtttgacttcagaactacagagcctaacggactgatcctctttacccacgggaaaccacaagagcgaaaggacgctcgctcgcagaaaaacacaaaagtagacttctttgcggtcgaactgttagatggaaatctgtacctgctgctcgatatgggttcagggacaattaaggtcaaagcaacacaaaagaaagccaacgatggcgagtggtatcatgttgacatccagcgggacgggagatcgggtaccatttcggtcaattctaggagaaccccatttaccgcgtcgggagaatctgaaatcctggatctggagggggatatgtatctggggggactcccagagaaccgagccggactcatcttaccaacggagctgtggactgctatgttgaactacgggtatgtcggatgcattcgtgacctctttattgacgggcgtagtaagaacatacgccagcttgctgagatgcagaacgctgccggagtgaaatcttcgtgcagtcgaatgtccgctaagcagtgtgactcatatccttgcaagaacaacgctgtgtgtaaagacggctggaatcgcttcatatgcgattgtactggcacaggatattggggacgtacttgtgaacgggaggcctccattctgagctacgatgggagtatgtatatgaaaatcattatgccaatggtgatgcacacggaagcagaagatgtgtcctttcggttcatgtcccagagagcttacggcctcctggtcgctactacgtcaagggatagcgcggatacactacggttggaattagacgggggtcgcgttaagctcatggtcaatttagattgtattagaataaactgtaatagctcgaaaggccctgaaacattatatgccggtcagaaattaaacgataatgaatggcatacagtgagggtcgtcagaaggggcaaatcactgaagttgacagtcgacgacgacgtggcagaaggaaccatggtgggtgaccacacccgcttagagttccataatatcgaaacaggaatcatgacggaaaagcgctatatctccgtggtaccaagctcgtttatcggacacctgcagtcactgatgttcaacggtttgctctatatcgatctgtgtaaaaatggggacatcgactattgcgagctcaaggcacgctttggacttagaaacattatcgcagacccagtcacatttaagactaagagttcatacctttccctagctacactccaggcgtatacatccatgcacttgttctttcagtttaagacaacgtccccagatggtttcatcctgttcaatagtggtgatggcaatgatttcattgccgtggagctggttaaaggatacatacattatgtgttcgatctgggcaatgggcctaatgtcattaagggtaactcagacaggccacttaatgataaccagtggcataacgtggtgattacccgcgacaactcgaatacccactcccttaaggtcgataccaaggttgtcacccaagtcattaatggcgctaagaacctcgacctgaagggcgacctctatatggccggacttgctcaggggatgtatagtaatctcccaaagctagtggcctctagggacggtttccagggatgtctcgcatctgtggacttgaacgggaggctgcccgatctgatcaacgacgctctgcatcggagcggacaaattgaacgtgggtgtgaggggccatctacaacttgtcaggaggattcttgtgccaatcagggcgtttgcatgcagcagtgggagggatttacttgcgattgctccatgacaagttactccggcaatcagtgcaacgaccctggagcaacctacatcttcggtaagagcggaggactgatactctatacatggccggctaacgatcgcccaagtacaaggagcgaccggcttgccgtgggtttctctaccaccgtgaaggatgggatccttgtgaggattgacagcgcacctggcctgggagacttcctgcagctgcacatcgaacaaggaaaaatcggcgtcgtgttcaacataggaacagtggacattagcattaaagaagagcggacacccgtcaacgatggcaagtaccatgtagtacgattcacccgtaacggagggaatgctacacttcaggtggacaactggccagttaacgaacattacccgacaggcagacagttgacgatttttaatacccaggcccagatagcaataggcggtaaggacaagggtcgacttttccagggtcagctttctggcttatattacgacgggcttaaggtcttgaatatggcggctgagaacaacccgaacataaaaataaatgggtctgtgcggctcgttggtgaagttccttccatcctgggcaccacgcagactactagcatgccacccgagatgtccaccacagtgatggagaccaccaccacgatggcaactacaacaacaagaaagaaccgatcgacagcctccattcaaccaacgtctgatgatcttgttagttcagcagagtgtagcagcgatgatgaagatttcgtggagtgcgagccaagcacggctcgtggcgagcttgtaataccgcttctggtcgaggaccctctggctacaccaccaattgccacacgagctcctagcatcaccctaccccctacgtttcgaccgctccttaccatcatcgagactacgaaggactcattgtccatgacaagcgaagcaggattgccatgtctctcagaccagggatccgatggatgcgatgacgacggtttggtcatatcggggtatggtagtggggaaacatttgactcgaatctaccaccgacagatgacgaggatttttacaccacttttagtctggtgaccgataagagtctgtccacatcgatcttcgagggtggatataaggcccatgcacccaaatgggagtcaaaggactttcggccaaataaggtttctgaaacttcgcggaccaccacaacctctcttagtcccgaactcattcgtttcactgcttcctcttcttccgggatggtccctaagctgcctgcaggtaagatgaacaatagagacctcaagccacaacccgatattgtgttgctgccactacctaccgcgtacgaactggatagtactaaactgaagtctcctctcatcacatcccccatgttccgcaatgtcccgacggcgaatcccaccgagcccggaatacgccgtgtgccaggcgcatcagaagtaattcgggagagctcctccaccactggaatggttgttggaattgtcgccgctgctgctctgtgtattctaattttgctgtatgcgatgtacaaatacaggaaccgggacgagggatcataccaggttgacgagactcgcaattacatcagcaactcagcgcagtctaatgggacgctgatgaaagaaaaacagcagtcaagcaagtcgggccacaagaagcaaaagaataaggacagggagtactatgtctag

SEQ ID NO: 232306 - DNA, 4179 bp, Artificial Sequence
  Description of Artificial Sequence: Synthetic coding sequence
atgtcatctacattgcactccgtattctttacacttaaagtaagtatcctgctgggcagtctgttaggcctgtgtcttggactcgaatttatgggactccctaatcagtgggctaggtacctgcggtgggacgcgtcgactaggagtgacctttcctttcagtttaagaccaatgtatccacagggctcctgctgtacttggatgatgggggtgtttgcgattttctgtgcctgtccttggtggacggcagggtgcaattgaggttctccatggattgcgccgaaaccgcagtgctgagtaacaagcaagtaaatgattccagctggcattttttgatggtgagccgggaccggctgaggaccgtgttgatgctcgatggcgaaggccagagcggggagctgcagcctcagagaccatatatggatgtggtatctgacctgttcctgggtggcgtccctacagacatccggccttccgccctcaccctggacggagtacaggctatgcctggttttaagggtttgatactcgatctgaagtacggaaatagtgagcccaggctgctcggcagcaggggcgttcagatggatgctgaggggccttgcggggagcgcccatgtgagaacgggggaatttgctttcttttagatggccatccaacgtgcgattgtagcaccaccggatacgggggaaagctctgctctgagggactgagccatctgatgatgagtgagcagggtcgctggaaggctcgtgaggagaacgtagccacctttcgaggctcagagtacctgtgttacgatctaagccagaatcctattcagagctccagcgacgagataactctatcgttcaagacctggcagagaaatggcctcatcctgcataccggtaagagtgccgactacgtgaaccttgctctcaaagacggtgctgtttcgcttgtgatcaacctcggctctggtgccttcgaggccatcgtcgagccggtgaatgggaaatttaacgataatgcgtggcatgacgtgaaggtcacgagaaaccttcgtcaagttaccatctcggtggacggaatcctgaccactacaggctacacgcaggaggactatacaatgcttggttcagacgacttcttttatgtgggcggttccccttctaccgcagatctcccagggtctccagtcagtaacaacttcatgggatgtctcaaggaagtcgtgtacaagaacaatgatatacgtctggagctgtccagactggcccgtatagcggacaccaagatgaaaatctacggcgaggtagtcttcaagtgcgagaatgtcgccacgctcgacccgataaactttgagacgcctgaagcgtacatcagcttgcctaagtggaacactaaaaggatgggcagtatctcctttgacttccgcacaacagaacctaacgggctgatactttttacgcacggtaagccacaagaacgcaaagacgcgagaagccagaagaatacaaaagttgattttttcgccgtagaattgctggatggaaatctttacctgctgctagacatgggaagcggcactattaaggtcaaggccacacagaagaaagcaaacgacggagaatggtatcatgtggacatccagagggacggacggagcggcacaatctcagtcaactccagaagaacaccctttaccgcgtctggcgaatctgagattctcgatctcgaaggcgacatgtatctgggaggcctcccggaaaatcgggctggcttgatactgccgaccgagctttggaccgcaatgctcaattatggttacgtcggttgcataagagatttgtttatcgacggccgttccaagaatattcgacagttggccgaaatgcagaacgctgccggagtgaaatccagttgctctcgaatgagtgctaaacagtgcgactcctatccctgtaaaaacaacgctgtttgcaaagacgggtggaacaggtttatatgtgactgcactggaacgggctactgggggaggacgtgtgagcgggaagctagcatcctgtcgtatgacgggagtatgtatatgaagatcattatgcccatggtgatgcacaccgaggcagaggatgtgagctttagatttatgagtcagagggcatatgggttgctcgtggctaccacctcccgggactctgccgacactctgcgccttgaattagacggcggtagggtcaagctgatggtgaaccttggaaagggtccggagacgctgtacgctggccaaaagctcaatgataacgaatggcataccgtccgagtggtaaggagagggaaatctttgaagctgaccgtcgatgacgatgttgccgagggaactatggttggagaccacacccgacttgaattccacaatattgagaccggcattatgaccgaaaaacggtatatcagtgtggtgccttcttcatttattggccacttgcagtcccttatgttcaacggattgctctacattgacttgtgcaagaacggagatattgattactgcgagctgaaggctagattcggactgaggaacattatcgcagaccccgtcacattcaagacaaagtcgtcctatctctccctagctacactgcaggcgtatacaagcatgcacctgtttttccagtttaagactacgagtcccgacggcttcatcctctttaattcaggagatggtaatgacttcattgccgtggagctggtgaaagggtacatacattatgtgttcgatttgggaaatggccctaacgtaatcaagggcaattctgacagaccattgaatgataaccagtggcacaatgttgtgatcacaagggataattcgaatacccactcgctcaaggtggacacaaaagtcgtgacccaggtcattaatggagccaagaacctagacctaaagggcgacctgtatatggctggtctcgcacaggggatgtacagtaatcttcctaaactggttgcttcacgtgacggctttcaggggtgtttggcctccgtggatctaaatggccgtctgcctgatttaattaatgatgcgctgcatcgctctggacagatcgaaagggggtgcgaggggccttccaccacgtgtcaagaggacagctgtgccaaccagggtgtctgcatgcaacaatgggaaggttttacttgcgattgttctatgacatcatactccggcaatcagtgtaacgaccctggcgcaacctacatcttcggcaaatctggcggattgattctctacacctggcctgccaatgatcgaccgtcaaccaggagcgacagactggccgtcggattctcaactaccgttaaggacggaatcctggtccgaatcgatagtgctcccggtctgggcgattttctacagttgcacatcgagcaaggcaaaatcggcgtcgtgtttaacattggcacagttgacatttctataaaggaagagagaacccccgttaatgatggcaaataccacgtcgtcagattcacaaggaacgggggaaatgctacactgcaggtggataactggcccgtgaacgaacactaccctacaggaaacaccgacaacgagaggtttcagatggttaagcagaagattccctttaaatacaatcggcctgtggaagagtggctacaggagaaaggcagacaactgacaatttttaacacccaagcccaaattgccatcgggggaaaagacaaaggcaggttatttcagggacagctttcaggcctgtactacgacggactaaaggtgctgaacatggccgcagaaaacaaccctaatatcaaaataaatggctctgtgcgacttgtcggggaggtccctagtatcctggggactactcagactacctccatgccgccagaaatgtctaccacagtgatggagaccacgactaccatggccaccaccaccacgcggaagaataggtccacagccagcatccagcctacttccgacgacctcgtttccagcgccgagtgtagttccgacgatgaggactttgtggagtgtgagccttctactggcaggagcgcccgaagcagcaacgccgcacgcagtctacgggctgctcttacctggacatggagactcacctatacttttactcccattatcttcattagttgtgtcgtccactcctag

SEQ ID NO: 232307 - DNA, 3186 bp, Artificial Sequence
  Description of Artificial Sequence: Synthetic coding sequence
atgctggggtcggatgattttttttatgtgggcggttcaccatccacagctgatttacccggatcccctgtgagcaacaattttatgggatgtctcaaggaagtcgtatacaaaaataacgacattcggttagaattgtctcgtctggccagaatagcagacaccaagatgaaaatctacggtgaagtcgtgttcaagtgtgaaaacgtcgctacgctggatccaattaattttgaaacccccgaagcttatattagccttcccaaatggaatacaaagaggatgggatctatctctttcgattttcgaaccacggagcctaacggcctaatcctgtttacccatggcaagcctcaggagcggaaggatgcaaggtcacaaaagaacaccaaggttgacttctttgctgtcgagctgctagatggcaacctgtatctgctgctagatatgggttccgggaccatcaaagtaaaggcaacccagaagaaggccaatgacggagagtggtaccatgttgacattcagcgggacggcagaagcgggaccattagtgtcaattctcgcaggactccgttcaccgcctccggcgagagtgaaatcctggacctcgagggcgatatgtacttaggcggactgcctgagaatagggccggactgatcctgccaactgagttgtggactgcgatgctaaattatgggtacgttgggtgtataagggatctgttcatagacggccgttccaagaatattcgccagcttgctgagatgcagaatgccgctggggttaaaagtagttgttccagaatgtccgctaagcagtgcgatagttatccctgcaaaaacaacgccgtttgcaaggacggttggaatagattcatctgtgactgtaccggaaccgggtattggggaaggacgtgtgagcgcgaagcgtccatcttgtcttatgacgggagcatgtatatgaaaattataatgcccatggtgatgcacactgaagccgaagacgtttcgtttaggtttatgagtcagagggcctatggtctcctcgtagcaactacaagccgcgattcggctgatacccttcggctggagttggatggtggcagggtgaagctcatggttaaccttgattgtatccgcatcaattgtaactcaagcaaaggcccagagaccttgtacgcaggtcagaagttgaacgataacgagtggcacaccgtacgagtggtgcggaggggcaagtctctgaagctgaccgttgatgatgacgtcgccgaagggactatggtgggggaccatacaagacttgagtttcacaatatcgagaccggaattatgaccgaaaagcgatatatcagcgtagtaccctcatcattcatcgggcacctgcagagcctcatgttcaacggccttctttacatcgatctgtgcaaaaatggggacatcgactactgtgagctgaaggcaagattcggactgcggaatatcatagccgacccagtcaccttcaaaaccaaaagtagctacctttcactagcgactctccaggcatatacttctatgcatctgtttttccagttcaaaaccacatctccggacggctttattttgtttaattccggcgacggcaacgattttatcgctgttgagctggtaaaggggtatattcattacgtattcgacctgggcaatggtccaaacgttatcaaaggcaacagtgatcgacccctaaacgacaatcagtggcataatgtagttatcacccgtgacaactccaacactcacagtctgaaggtcgacactaaggtcgtcacccaggtcatcaacggagccaagaatttggacctgaagggcgatctgtacatggcaggcctcgctcagggaatgtactcaaatttaccaaagttggtggcaagtcgcgacggcttccagggctgtctggctagcgtggatctgaatgggagactccctgacctgattaacgacgctctgcaccgatctgggcagattgagcgcggttgcgagggcccatccaccacctgccaagaagactcttgcgctaatcagggagtctgtatgcagcagtgggagggattcacctgcgactgctctatgacatcctattccgggaaccaatgcaatgaccccggagccacatatatattcggcaaatcaggcggtctgattttgtacacttggcccgctaacgatcgcccaagcactcgctccgatcgcctggcagtcgggttttccactactgtgaaggatggcatcctcgttcgcatcgactcggccccagggctgggcgacttcctccaactgcacatcgagcaaggcaaaattggcgtggtgtttaacataggcacagtcgatatcagcataaaggaagagcgaacccctgttaatgatggtaaataccacgttgttcgattcaccagaaatggaggcaatgccaccttacaagtagataattggccggtaaacgagcattaccctaccgggaggcaactgaccatatttaacactcaggcccagatagctatcgggggaaaagataagggcaggctgttccaaggccagctgagcggactctactacgacggcttaaaagtgttgaatatggctgccgagaataatccaaacattaaaatcaacggctcggtgcgacttgtgggcgaggtgcccagtatcttagggactacacaaactacaagtatgcctcccgagatgtcaaccacagttatggaaactacaaccacaatggcgacaactactaccagaaaaaaccggtcaaccgctagtattcagcccacctcagatgacctagtctccagcgctgaatgctcaagtgacgatgaagacttcgtggagtgcgagccttctaccgcaaacccaactgagcccggaatccgaagggttcccggtgcaagcgaagtcatacgtgagtcgagctcaaccaccggaatggtggttggcatagtggccgctgccgcactgtgtattctgatcctcttatatgcaatgtacaagtatcggaacagggacgaagggagctaccaggtggacgaaaccaggaattacattagcaacagcgctcagagtaacggtacactgatgaaggaaaagcagcagagttcaaagtctggacataagaagcagaagaataaagatagagaatattacgtctag

SEQ ID NO: 232308 - DNA, 1380 bp, Artificial Sequence
  Description of Artificial Sequence: Synthetic coding sequence
atgcacctccgcatccacgctcggaggagccccccacgaaggcctgcctggactctgggaatatggtttctgttttggggttgtatcgtgtcctccgtttggagttcttccaacgtcgcttcatcaagttcaacctctagctcccccggatcacatagtcagcacgaacatcattttcatgggtcaaagcatcacagcgtgcccatctcaatttatcggagcccagtgagcctaagggggggtcatgcaggagctacttacatatttggtaagtcaggtggcttgatcttatatacctggccagcaaatgaccgcccttctactcgaagcgaccgtctggcagtcggctttagcacaacagtgaaggatggtatcttggtccgaatcgattctgctcctgggctgggcgattttctccaactccacatcgagcaaggaaagatcggtgtcgtctttaatattggtaccgtggatatcagcatcaaagaagagaggacacctgtgaatgacggcaagtaccacgtcgtgaggtttacgcgcaacggcggtaatgccaccctgcaggttgataattggccagtgaatgaacattaccctacaggtaatactgacaacgagaggttccaaatggtcaagcagaagattccttttaagtataaccggcctgtggaggaatggctgcaggagaaaggtcggcagttaactatttttaatacacaggcacagatcgccatcgggggaaaggacaaaggtcgtctctttcaagggcagctctccggcttgtattacgacgggctgaaggtactgaatatggcggctgagaataaccccaacatcaaaatcaatgggtctgtacgcctggtgggcgaggtccccagcatcctcgggactactcagacgacaagtatgccaccggaaatgagcacaaccgtgatggaaaccacaacaacaatggcaacgaccacgacccgcaaaaatcggagcaccgcctctatccaacctacctctgacgacctggtttcgtccgctgaatgctcgtctgatgacgaggactttgtggagtgtgagccaagcactgccaatcctaccgagcctggtatacggagagttccgggtgcttccgaggtcatccgagaaagttcttcgaccacaggcatggtggtcggtatcgtggccgctgccgctttgtgtatactgattctgctgtatgccatgtacaagtaccggaacagggacgaaggatcttaccaggtcgacgaaactcgcaactacatcagcaattctgcacagtctaatggcacgctgatgaaggaaaaacagcagagttccaagtcgggccacaagaaacagaaaaacaaagatagggagtattacgtgtag

SEQ ID NO: 232309 - DNA, 3186 bp, Artificial Sequence
  Description of Artificial Sequence: Synthetic coding sequence
atgctcggttccgatgatttcttttatgtcggaggctcaccaagcaccgctgacttgccagggagcccagtcagtaataactttatggggtgcctgaaggaagttgtgtacaagaataacgatattcgcctggagctgagtaggctggcgaggatcgccgacaccaaaatgaagatctacggtgaagtcgtgtttaagtgcgaaaacgtggctactcttgaccccattaacttcgaaacgcccgaggcctacattagcctgccaaagtggaacacaaaaaggatgggctctatttcattcgatttccgtactactgagccaaacggacttatcctcttcacacatggaaaacctcaagagcgcaaagacgccagaagccagaagaatacaaaagtggacttcttcgccgtagagctcctggacgggaacctgtatctgttgcttgacatgggctcagggactatcaaggtaaaggccacacagaaaaaggcaaatgatggagagtggtatcacgtggacatccagcgcgatggaaggtccggcacaatcagcgtgaactcaaggcgtaccccttttacagcgtctggcgaatctgagatcctcgatcttgaaggcgatatgtatctgggaggcctgccagaaaatcgcgcaggtttaattctgccaactgagctctggacagccatgctgaactatggatatgtgggatgtattagggatctgttcattgacgggcgttcaaaaaatatccggcagttagctgagatgcagaacgcggctggtgtgaagtccagttgctctcgaatgtccgctaaacagtgcgattcctacccatgcaagaataacgccgtttgcaaggacggttggaaccgcttcatatgtgactgtaccggcaccggatactggggcaggacttgcgagagggaagctagcatacttagttacgacgggtcaatgtacatgaagataattatgccgatggtgatgcatactgaggccgaagacgtgtccttcagatttatgtcacagagggcctacggactgcttgtggctaccaccagccgtgactccgcagacaccctgcggttggaattagatggagggcgagtcaagcttatggtgaatctcgactgtattcgcatcaactgtaacagctccaaggggcctgagaccttatacgcaggacagaagctgaatgataacgagtggcacacagtgcgcgtggtgagacggggaaagagcctgaagctgaccgttgacgacgacgtcgctgagggaacaatggtgggggatcacactaggctggaattccacaacatagaaacagggataatgactgaaaaaaggtacataagcgtggtgcccagcagcttcattggacatttgcagagtctgatgtttaacggcctcctttatatcgatctttgcaagaacggagacattgactactgtgaactgaaagcacgatttggactgcggaacattattgccgaccccgttacgtttaagacaaagtctagttacctgtccctggctacgctgcaagcatatacatcaatgcatctgttcttccagttcaaaactacatcacctgacggctttatcctgttcaacagcggtgacggaaacgatttcattgctgtggaattggtgaagggctatatacactacgtcttcgacttgggaaacggtcccaacgttattaagggaaacagcgaccggcctctcaacgacaaccagtggcacaatgtggtaattactcgggacaactctaatacccattcactgaaggtggataccaaggttgtaacgcaagtgatcaacggtgccaagaatctggaccttaaaggggacctttacatggccggtctcgcacagggcatgtattctaacctgccgaaactcgtggccagtagggacggctttcagggttgtctcgccagcgtggacctaaatgggcgactccccgacctaatcaatgatgctctgcatcggtccggccagatagaacgtggctgcgagggtccctctactacatgtcaggaggacagctgtgctaatcagggagtgtgtatgcagcaatgggaagggttcacatgtgactgttctatgacgtcctactcggggaaccagtgcaatgacccaggagccacatacatctttggcaaatcaggcggactcatcctatacacctggcccgcaaacgatcgcccatcaacacgaagcgatagactagcagtgggttttagcaccaccgtgaaagatggtatcctggtgaggattgactctgcgcctggacttggcgactttcttcagttgcatattgagcaggggaaaataggggtcgtatttaacattggaacagtagacatatctataaaagaggagagaacacccgtcaatgatggcaagtatcacgtcgttagattcacaaggaatggcggaaatgccactctgcaggtggataactggccagtgaacgagcactatccaactggcaggcaacttactatctttaatacacaggcccagattgccataggcggaaaagacaaggggagactcttccagggccagcttagtggactctactacgatggcctgaaagttctgaatatggccgctgaaaacaatccaaatattaagatcaatggaagcgtgcggctcgtcggcgaagtcccctccatactgggcacaacacagaccacctccatgcccccagaaatgagcacgacagtgatggagaccacaactactatggcaactaccactacacgaaaaaaccggtctaccgccagcattcagccgacttcggacgatcttgtgtcttccgctgaatgttcctctgatgatgaggatttcgtggaatgcgaaccatcaaccgcgaaccctacagaaccagggattcgcagggtgcctggggcttccgaagtgatcagagaaagttcgtctacaaccggtatggtggtaggaatcgtcgccgctgctgccctgtgcatcctgatcctgctctacgccatgtacaagtataggaacagggacgaagggagctaccaagtggatgagacacgaaactatatctccaactctgcacagagcaacggaacactgatgaaggaaaagcaacagagttctaaaagtggacacaaaaaacagaagaataaagaccgcgagtactatgtttag

SEQ ID NO: 232310 - DNA, 1914 bp, Artificial Sequence
  Description of Artificial Sequence: Synthetic coding sequence
atgcacctgcggattcatgctcgcagaagtccgccaagaaggcccgcttggacacttggaatatggttcctcttctggggctgcatagtgagcagcgtctggtcttcatccaacgttgcctcatccagctctacatcatcctcccccggatctcactcacagcacgaacatcacttccatggtagtaaacaccactcagttcccattagcatctaccgctctccagtcagtctgcgagggggacatgctggtgccacgtacattttcgggaagagcggcggactgatcctatatacctggccagcgaatgatcgcccatctacgagaagtgataggctcgctgttggtttttcaaccacagtgaaggacgggattttagtgcggatagactccgcacccggattgggtgatttcctccagttacatattgaacaaggaaaaataggcgtcgtcttcaacatagggactgtggacatttctataaaggaagaaaggacacccgtcaacgatgggaagtatcacgttgtgcgttttactaggaatggcggaaacgcaacgttacaggtcgacaattggccggtcaatgaacattatcccactgggagacagctgactatcttcaacacccaggcgcagatcgccataggcggaaaagacaagggcagactgttccaagggcagcttagcgggctgtactatgacggcctgaaagtgctcaacatggcagcagagaacaatcccaatataaaaatcaacggctccgttcgtctggtgggcgaggttcctagcatccttggaactacgcaaacaaccagcatgccacccgaaatgagcactaccgtgatggagacaacaactaccatggcaacgaccaccacaagaaagaaccgcagtacagcctctatccaaccaacctccgacgacctggttagctcggctgagtgtagctccgacgacgaagattttgttgagtgtgagccctcaaccggtggggaactggtgattcctctgctggtggaggatcctttggctaccccgccaattgccacacgtgcacctagtataactctacctcctacatttaggcccttactcacaattattgagactacgaaagactcgttatcgatgacaagcgaggccggactgccctgtctgagtgaccaaggctctgacggatgtgatgacgacgggctcgtgatttctggctacggatccggggaaacattcgattccaacctgccaccaacagatgatgaagacttctatacaacttttagtttagtcactgacaaatctctgagcacctcaattttcgagggtggctataaggctcatgctccaaaatgggaatctaaggacttcaggcccaataaggtgtcagaaacaagcaggacgacaactaccagtctgagccctgagctgattcgattcaccgccagctcttctagtggaatggtgcctaagcttccggctggtaaaatgaataatcgtgacctgaagcctcaaccggacatcgtgctgctgcctctgcctactgcctatgaactcgactctacgaagctcaaatcaccgctgattacatctcccatgttccgaaatgtgcccactgctaaccctacagagcctggaatacgtagggtccccggtgcgtccgaggtaatccgagaaagttcgtctacgaccgggatggtggtggggatagtggctgcagccgcactgtgtattctgattcttctgtacgcaatgtacaagtatcgtaatagagacgagggctcctatcaagtcgatgaaacccgtaattacatcagtaacagtgcccagtcaaacggtactctgatgaaggagaagcagcaatcaagcaagagtgggcataagaaacaaaagaacaaggacagggagtattacgtgtag

SEQ ID NO: 232311 - DNA, 429 bp, Artificial Sequence
  Description of Artificial Sequence: Synthetic coding sequence
atgggcctcaaacttaacggcagatacataagcctgatcctggccgtacagatcgcttacctcgtccaggccgttcgcgctgccggaaagtgcgacgccgtgttcaagggtttcagcgattgtctcttgaagctgggcgactcaatggccaattatccccagggactcgatgacaaaacaaatattaagactgtgtgcacctattgggaggacttccactcctgcaccgtcacagcccttacagactgccaggagggcgctaaggacatgtgggacaagctgcgcaaagagagcaagaacttgaatatccaggggagcttatttgagctctgcgggtccggcaacggggctgccggttccctattgccagcattccccgttcttcttgtaagtctgtcagctgcactggccacctggttgtcattctag

SEQ ID NO: 232312 - DNA, 8840 bp, Artificial Sequence
  Description of Artificial Sequence: Synthetic coding sequence
atggctagtgagaagcctgggcctggcccaggtctggagcctcagcccgtgggactgatcgccgtgggggcagccggtggcggaggagggggttccggagggggtggaactggaggttctggaatgggcgagttacgcggagccagcgggtccggcagtgtaatgcttcccgcagggatgataaacccttctgtacctatcagaaatattcggatgaaattcgctgtgctaattggtctgatccaggtcggcgaggtcagcaaccgcgacatcgtggaaaccgtgcttaatttgctagtaggcggagaattcgatttggaaatgaattttatcatccaggacgctgaatcaatcacatgtatgacagagctcctagagcattgcgacgttacttgccaggctgaaatctggagtatgttcactgctattttgcggaagtccgtgcggaatctccagactagcactgaggttgggctcatagaacaggttttgctgaaaatgagcgccgttgatgatatgatcgcagatctcttagtcgatatgctgggggtactggcgtcctattccattaccgttaaagagcttaagctcctcttctctatgcttcgaggagaaagtggaatatggcctaggcacgctgtgaagctcctgagtgttctgaatcagatgcctcagaggcatggcccagacactttcttcaacttcccaggctgttcagccgctgcaatcgccctgcctcctatcgccaagtggccttaccagaacggtttcacactgaatacatggttccgcatggaccctctcaataacataaacgtggataaggacaaaccctatctgtattgcttcaggacttccaagggggtcgggtacagcgcacatttcgtggggaactgtcttattgtcacctccctgaagagcaaaggcaagggcttccagcactgcgtgaaatatgacttccaaccccgaaagtggtacatgattagcatcgtccatatctataataggtggcgcaacagcgaaatacggtgttacgtgaatggacagctcgtaagttatggagacatggcctggcatgtcaacactaacgactcgtacgataagtgctttctgggttccagcgagactgccgacgcaaatcgcgtcttctgcggccagctgggggctgtttacgtgttttccgaggcgctgaatccagctcagattttcgccatccatcagctcgggcctgggtataaaagcacatttaagtttaagtcagaaagtgacatccacttggccgaacaccataaacaggttctctacgatggaaagctggcctcatctatcgcctttacctacaatgccaaagcaaccgacgcccagctctgcctagagagttcgcccaaagagaacgcttccatatttgtacactcaccccacgctctgatgctgcaggacgtgaaagctatcgtgacacacagtatccactccgctatccactctatcggtgggatccaggtcttgttcccacttttcgcacagctcgacaaccgtcaactcaacgactcgcaagtggagaccaccgtgtgtgcaacccttttggcgttcttggtggaactcttgaagtcctctgtggctatgcaggagcagatgttgggaggaaaggggtttttggtgatcgggtacctgctggaaaagtcctctcgtgtgcacatcaccagagccgtgctggaacagttcctgtcatttgcaaagtatctggacggcctcagtcacggtgccccattacttaagcaactgtgcgatcacattctgtttaatcccgctatttggattcacacccctgcaaaagtgcagctatctctgtatacctacttatctgccgagtttatcgggacagccaccatctacacaactatcagacgtgtcggtactgtgctgcagctgatgcacaccctgaaatattattactgggtgataaaccccgctgactcttcgggcataacccctaagggcctcgacggcccaaggccctcgcagaaggaaattattagtctaagagcatttatgttgttattcctgaaacagttgattctgaaggatcgtggggtcaaggaagacgagctccagagtatcctgaattatctgctgaccatgcacgaggatgaaaacatacatgacgtcctgcagctgctggtcgcactcatgtcagagcatcccgcatctatgatccccgcatttgaccaacgaaacgggatcagagtgatttacaaactcctcgcctctaaatctgagtccatttgggtacaggctctgaaggtcctgggttatttcctgaaacacctgggccataagcggaaagtagagataatgcatactcacagcctgtttacgctgcttggcgaacggctgatgctgcataccaacacagtgactgttacaacttataacacgctgtacgagatcttaaccgaacaggtgtgcactcaggtggtgcacaaacctcatcccgagcccgacagcactgtcaagatccaaaacccaatgatcctcaaggtcgttgccacacttctaaagaatagcacaccctccgctgagctgatggaagtacgtcgcctatttttatctgatatgattaagttattcagtaacagccgcgagaatagacgctgtttgttgcagtgtagtgtgtggcaggattggatgttctcactgggatacattaaccctaaaaattccgaagagcagaagattacagaaatggtttacaatattttcaggattttattgtaccacgccattaagtacgaatgggggggttggcgcgtgtgggttgacaccctaagcatcgcccacagtaaagttacatatgaggctcataaagagtatttagccaaaatgtatgaagaataccagcggcaagaagaagagaatataaaaaagggaaagaaaggcaatgtttctactatatccggtctctcctctcagacgactggggctaaggggggaatggagataagagagatcgaagacctgtctcaaagccaaagccccgagagcgaaacagactatccggtatcaaccgatacacgggacctcctcatgtcaaccaaggtctctgacgatatactgggaaactctgatcggccaggaagcggagtgcacgttgaagttcacgacctcttggtggacataaaggcagaaaaagtggaggctactgaggtgaagctggacgacatggatctgagtccagaaacactggttggcggagaaaacggcgctttagtggaagtcgaaagcttgctggacaacgtatattccgccgcagtggagaagctacaaaataacgtacacggcagtgtagggataatcaaaaagaatgaggaaaaggataatgggcctctgattacactggctgacgagaaagaagatcttccaaactcctccacctcgtttctctttgataagatccctaagcaggaggagaaacttctgccagaactgagttcaaaccatatcattcctaacatacaggatactcaggtgcacctgggggtgtcagacgacctcggcctactggcccatatgaccggtagtgtggatctgacatgtacgagtagcataatagaggagaaagagttcaagatacacactacctccgatgggatgtcaagcattagcgaaagggacctggcctcgtctactaagggcctggagtatgccgagatgactgcaacaacactggagacagaaagtagctcctcaaagatcgttcccaacattgatgcgggatccatcattagcgatactgagagaagcgacgatgggaaagagtccggcaaggaaatcagaaaaatccaaactaccacaacgacacaagccgtgcaggggagatccatcacccagcaggaccgggatctcagggtcgacctgggattccgaggtatgccaatgactgaggagcaacggagacagttcagccctggaccacgcacgactatgttccgcatccccgagtttaaatggtctcctatgcaccagagacttctcaccgatctcctattcgccctggagacagatgttcacgtctggagaagccactccacgaagtctgtcatggactttgtgaactccaatgagaacataatttttgtacacaacaccatacacctgatctcccaaatggtggacaacatcatcattgcctgtgggggtatcttacccctgctcagcgccgcaacgtcgccgaccgtgagtaaaacggagttagaaaacattgaagtgacacaaggaatgtctgcagagaccgccgtcacctttctgtccaggctcatggctatggttgacgtgctggtgttcgccagcagcttgaatttttcagagattgaagcagagaaaaatatgtctagtgggggactgatgcgccagtgtctgcgcttagtgtgttgcgtagctgtcagaaactgcctggagtgcaggcagcggcagcgggaccgcggaaataaaagctctcacgggagctccaagcctcaggaagtgccccagagcgtgacggccaccgccgcatccaagacgccccttgagaacgtgcctgggaacttgtcaccaatcaaagaccccgaccgcttgttacaggatgtggacatcaatcgattgcgggcagtggtgtttcgggatgtcgatgatagcaaacaggcccagttcctggcactcgctgtcgtctattttatcagtgtgcttatggtgtccaagtacagggacatactggaaccccagagagagaccacaaggactggcagtcagccagggcgtaacatccgtcaggagatcaactcaccgacgtcaaccgtcgtggtgattccatccattccccaccctagtctgaatcatggttttctggccaagctgatacctgagcagagttttggccacagtttctacaaagagacccctgccgcattccctgatacgattaaagagaaagagacccccacccccggagaagatattcaggtcgaatcaagcattcctcatactgatagcgggatcggagaggagcaggtcgcgtcaatactgaacggagccgaacttgagacctccaccgggccagacgcaatgtctgaactcctgtcgacgctgagcagtgaggtaaaaaaatctcaagagtccctaactgagaacccgagtgagactttaaaaccagcgacctcaatctcatctatctcacagaccaagggtattaacgtgaaggagattcttaaatccttggtagctgctcccgtcgagattgctgagtgcgggcctgaaccaatcccgtatcccgaccccgctctcaaacgtgaaactcaggcaattttgcctatgcagtttcatagcttcgatcgttcagtagtggtcccagtcaaaaaacccccacccggaagtctggccgttacaactgtgggggctaccacagcgggatcaggtctgccgaccgggtcgacgtccaacatttttgcagcaaccggtgccacacccaagtctatgataaacaccactggtgctgtggacagcgggagttcttcgtcatcttcaagcagctcttttgttaatggggctacctctaaaaacttgcctgcagtccaaacagtagccccaatgcctgaagacagtgcagaaaatatgagtattacagctaagttagaacgcgcattggagaaagtggccccactgttgcgtgaaatcttcgtggatttcgcccctttcctgtcgcggacactgctgggcagccacggtcaggagctgctgattgagggtctggtctgtatgaaatctagcacctctgttgtggaattagtgatgctgttatgttcacaagagtggcagaatagtatccaaaagaacgccggactcgccttcattgagttaatcaacgagggacgactgctctgtcacgcgatgaaggatcatatcgtgagagtggctaatgaagcagagtttattttgaatcgccagagagctgaggatgtgcacaaacacgcggagtttgaatctcagtgcgcccagtatgccgcagaccgaagagaggaagaaaagatgtgcgaccacctgatctctgctgctaagcacagggaccacgtcacggcaaatcaattaaagcagaagatcttgaatatcctgactaataaacatggagcgtggggtgctgtcagccatagccaactgcacgatttttggcgcctggactattgggaagacgacctgcggaggcgcaggaggtttgtccgaaacgcctttggctctactcacgcagaagcgctgctgaaggccgctattgagtacgggaccgaggaggacgtggtgaagagcaaaaaaaccttcagatcccaggccatagtgaatcagaacgctgaaactgaacttatgctggaaggtgatgatgatgcagtgtctctgctgcaggagaaagagattgataatctcgcgggacccgtcgtcctcagtacacctgcacagctgatagcccctgtggtagttgcaaaggggactttatccatcacaaccaccgaaatctattttgaggtcgacgaggatgactcagctttcaagaagattgatacgaaagtgctcgcctacacagaaggcctgcacggtaagtggatgttctctgagattagggccgtgttctcacgtcggtatttactacagaacacggctctggaggtcttcatggctaaccgcacctcagtcatgtttaacttccccgaccaagccactgtaaaaaaagtggtttacagtctcccaagagtcggtgtcgggaccagttacggattaccacaggcaagacgcatttccctggcaaccccgaggcagttgtacaaatcatcaaatatgacccagcggtggcagcgcagagagatctccaacttcgagtacctgatgttcttaaacacgatagctggaagaacctacaatgacttgaaccagtacccggtcttcccatgggtactgacgaattatgagtctgaggagctcgacctcacgctcccaggcaatttccgcgacctgtctaagcccattggcgctctcaaccccaaacgggctgtcttttacgctgagagatacgagacatgggaagacgatcagtctcctccgtaccactataatacccactattcaaccgccacctcgaccctgtcctggctcgttaggattgagccttttactacattctttctgaacgccaacgatggtaagtttgatcacccagatagaacttttagctccgttgctcggtcctggagaactagccaaagggatacatccgacgtgaaggaactcatacccgaattctattatttgcccgagatgttcgtgaatagcaatgggtataatctcggcgtacgggaggatgaagttgtcgtgaatgacgtggatctgcctccgtgggccaaaaagcccgaagactttgtcaggattaatagaatggctctggagtccgaattcgtatcatgtcagctgcaccagtggatagatcttatcttcgggtacaagcaacgcggaccagaggctgtacgtgcacttaacgtgtttcattacctcacctacgagggctcagtaaacctggactcgattacggatccagtgctgcgcgaggccatggaagcccaaatccagaattttggacagactccaagtcagctcctcatagaacctcatcccccacgctcatctgccatgcacctttgtttcctgccacagagcccccttatgttcaaggaccaaatgcaacaagacgtgatcatggtactgaagttcccttccaatagtcccgtgacacacgtcgccgcaaacacactcccccacctgaccatccccgcagtcgttacagttacctgcagtcgtctgtttgctgtgaacaggtggcacaatacagttggattgagaggtgctccgggatacagcctagaccaggctcaccatttgcccatagaaatggaccctttgatcgctaataacagtggcgttaacaagcgccagattaccgatctggttgatcagagtatccagattaatgcccattgttttgtggtcactgccgataatcgctatatcctaatctgcggcttctgggacaagtcctttagggtatactccactgagaccggaaagcttacccaaatcgtcttcggtcactgggatgtggtgacctgtctggcaaggtctgaatcctacatcggtggggactgctacatcgtttccgggtcacgcgacgccactctgcttctttggtattggagcggcaggcatcatattataggagataacccaaatagcagcgactatccagcgcctagggctgtgttaactggtcacgaccatgaggtcgtctgcgtcagcgtgtgtgcggagctgggacttgtaattagcggcgctaaagagggtccctgcctcgtgcataccatcactggtgacctcctccgtgccctggaggggccagagaattgcttattcccacgcctgataagcgtgagctcagaaggccattgcataatatactatgaacggggaagatttagtaacttttctatcaacggtaagctactggcccagatggagatcaatgactctacaagagctatattgttatcttccgacgggcagaatctggtgaccgggggagataatggcgtcgtcgaggtatggcaggcctgcgattttaaacagctctatatttatcccggttgtgatgcagggatccgagcaatggacttgagccacgatcagcgcacccttatcaccgggatggccagcggctcgatcgttgcctttaacattgatttcaacaggtggcactacgagcatcagaataggtacta

SEQ ID NO: 232313 - DNA, 1575 bp, Artificial Sequence
  Description of Artificial Sequence: Synthetic coding sequence
atgttcgtgaactccaatggctacaatctcggagtccgggaggacgaggtggtagtgaacgacgtggacttacccccatgggccaagaaaccggaagacttcgtgcgaatcaataggatggccttggagtctgaattcgtatcatgtcagttacaccagtggatcgatcttatttttggctataaacagagaggccctgaagcggtgcgagctctgaacgtattccactatctgacatatgaaggcagcgtgaacttggacagcattacagatcccgtgctgcgagagattcccgaggcctattttatacgtgaccctcatacgtttttactaactaaggatttcattaaggctatggaggcgcagatccagaactttggacagactccatcccagctgctgatagagccacaccccccacgcagcagtgccatgcacctttgctttttgccccagtcccccttgatgtttaaagatcaaatgcaacaggatgtcatcatggtgctgaaattcccttccaacagcccagtgactcacgtcgctgctaacaccctgccccacctaaccatccctgccgtggtaacagtcacttgtagccgcttgtttgccgtcaacaggtggcataacactgtgggcctcagaggggctcccggatatagccttgaccaggctcaccacttgcccatagaaatggaccccctgatcgccaataactcaggggtgaacaagagacaaattaccgatttggttgatcagagcatacaaatcaatgcccattgcttcgtcgtgacagctgataataggtatattctgatttgcggcttttgggacaaatctttccgcgtatacagtacagaaacaggcaaactcacacagatcgtcttcggccattgggacgtcgtcacgtgtctcgccagaagtgagtcctacatcggaggagactgttacattgtctcaggttccagagatgccacacttctgctgtggtactggtcagggcgacaccacatcataggagataacccaaatagttccgactaccctgccccacgcgctgtgctaaccggccatgatcacgaagtggtttgcgtctctgtatgtgccgagctcggactcgtgatatccggggcaaaagaggggccatgcctggtgcacaccataacaggtgacttgttgagggcgctggaaggtccagagaactgcctgttcccaagattaatctctgtgagttcggagggccactgtattatctactacgagagaggacgcttctctaacttcagtatcaacgggaaactgctcgcgcagatggagattaatgatagtacaagagcaatcctgttgagctccgatggtcagaatcttgtcacaggtggcgacaacggtgtggtcgaggtgtggcaggcctgtgattttaagcagctttacatctaccccggatgcgatgccggaataagagctatggacctgtctcatgatcaaaggacgctcatcacgggcatggcctcgggttcaatcgtggcttttaatatcgattttaaccgttggcattatgagcaccagaatagatactag

SEQ ID NO: 232314 - DNA, 8831 bp, Artificial Sequence
  Description of Artificial Sequence: Synthetic coding sequence
atggcttccgagaagcctggacccggacctggattggaaccgcagcccgttggcctgatcgcagtcggcgctgccggaggtggcggagggggatctggtggaggagggactggcggttctggaatgggtgagcttaggggtgccagtggctccggaagcgttatgctccctgccggtatgattaatccatctgtgccaattaggaacatccggatgaaatttgcagtgctgatcggcctgatccaggtgggagaggtgagcaaccgcgacattgtcgagaccgttctgaatctccttgtaggaggtgagttcgacttggagatgaatttcattatccaggacgctgagtcaataacctgtatgactgaactgttagaacactgcgatgtgacttgccaagcagagatctggagcatgttcaccgccatcctgcgcaaaagcgtgcggaacctgcagacgtctacagaggtgggccttattgagcaggttctcctgaagatgtccgccgttgacgacatgatcgcagacttactggtggatatgctgggcgtccttgcgagttatagtatcaccgttaaagaactcaagctgctgttcagcatgctcaggggcgaatccgggatctggcctagacatgccgtgaagctccttagcgtgttgaaccaaatgcctcagagacatggtccagataccttcttcaatttccccggttgctccgccgctgcaattgctctccctccaatcgctaaatggccataccagaatgggtttaccctgaatacctggtttcgcatggaccctcttaataatattaatgtcgataaagacaagccttatctctactgcttccgcacatctaaaggcgtaggctactctgcgcactttgtgggcaattgtcttatcgtgaccagcctgaagtctaaaggtaaggggttccagcactgtgttaagtacgatttccagcccagaaaatggtacatgataagcatcgtacacatctacaaccggtggcgcaactccgagatacggtgttacgttaacggccagctcgtgagttatggagatatggcttggcatgtaaacaccaacgattcttatgacaaatgtttccttggctcatccgagaccgctgatgccaacagagtgttctgcggtcagctgggcgctgtatatgtcttctcagaagccctaaatcccgcacaaatcttcgcaatacatcagttaggacctggctataagtcaacatttaagtttaaaagcgagtccgatatccatttagcagaacatcataagcaggtgctgtacgatggtaagctggcatcttcaatcgcctttacttacaacgcaaaggccactgatgcccagctttgcctcgaatcttccccaaaagagaatgcatctatctttgtgcactccccccacgctctcatgttacaagacgtgaaagctatcgttacccacagtatccactccgccattcactcaattggaggaatccaggtgcttttccctcttttcgcacagttggataacagacagctcaatgattcacaggtcgagaccacggtgtgtgccaccctccttgcctttctggtcgagctgctgaagagctccgtggccatgcaggagcagatgctgggagggaagggttttctggtcattggctatctgctcgagaagtcatctagggtacacatcacccgcgcagtattggagcagtttctcagcttcgccaaatatttagacggtctctcccacggggctcccctgcttaaacagctttgcgaccacattctctttaatccagccatttggatccacacacccgcaaaagtccaactatcactatatacatatctttcggcagagttcatagggacagccacgatttatacaacgattaggcgggtcgggacggtgcttcaactgatgcacacccttaaatattactactgggtcataaatccagccgactcatccggaatcacaccaaagggactggacggcccacgtccttcacagaaagaaataatctctctcagggctttcatgctgctgttcttgaagcagctgatccttaaggacagaggagtgaaggaagatgagttgcagagcatactcaattacctgttgaccatgcatgaggacgaaaatatccatgatgtgctgcagctattggtcgccttgatgtccgaacatcctgcatcaatgattcctgcgtttgatcagagaaatggtattagggtaatttataagcttctcgcatcaaagtctgagtccatctgggttcaggccctaaaggtgctggggtatttcttgaagcacctgggccataagcggaaggttgaaataatgcatacacattccctgttcacccttctgggcgagcggttaatgctccatactaatacggttactgtaaccacctacaatactctctatgagatcctgactgaacaggtgtgcacccaggtagttcataagcctcaccccgagcctgactcaacggtcaagatccagaacccaatgattcttaaagtggtggctactctcctcaaaaattctactcctagcgccgaactgatggaagtcagacgcctgttcctttctgatatgattaaattgttttcaaattcacgggagaaccgaagatgccttcttcagtgctctgtgtggcaggactggatgttctcgttggggtacattaaccctaagaactctgaggagcagaaaattacagaaatggtctacaacatttttcgcattttgctgtaccatgccataaaatacgaatggggcggttggcgggtatgggtggataccctgtctatcgcccacagtaaggtgacatacgaagcccataaagagtacttagcaaaaatgtatgaagaatatcagcggcaggaagaagagaacattaaaaagggcaaaaagggcaatgtaagcacaatatccgggctgtcctcacagactactggggcaaaaggcggaatggaaatcagagagatagaggacttaagtcaatcgcagtctcccgagtctgagacagactatcccgtgtccacggacactagagatttgctcatgagcactaaagtctctgacgacattctgggaaatagcgaccggccaggaagcggtgtccacgtcgaagtccatgacttactagttgacataaaggccgaaaaggtggaggccacagaggtgaaactggatgacatggacctcagcccagagactctcgttggaggcgagaacggcgcactggtggaagtggaatctcttctggataatgtgtactctgccgcagttgagaaacttcagaataatgtgcatggctccgtcggtataattaaaaagaatgaagaaaaggacaatgggcctcttattaccctggcggatgagaaggaggatctaccgaactcttcgaccagcttcctcttcgataaaattccaaagcaggaagagaagctgttgcccgaacttagctctaatcacattatccccaacatccaggatacgcaggtacacttgggggtgtcggatgacctcgggcttctggcacatatgaccggcagtgtggatcttacatgcacctcttctattatcgaggaaaaagagttcaaaattcatactacctctgatgggatgagcagtatctcagagagagacctggcgtccagtaccaagggccttgagtacgccgaaatgacggcaaccacactcgagaccgagtctagctcctccaaaatagtgccgaacatcgacgccggttctatcatatccgacactgagcggtccgacgacggcaaagagagcgggaaagagatcagaaaaattcaaactacaaccacaactcaggccgtgcaaggcaggtccatcacccagcaggatagagacctgagagtagacctgggtttcaggggaatgcccatgacggaagagcagagacgccagttcagccccggaccgagaaccaccatgttccgaattcctgagtttaaatggtctccaatgcatcagcgcctcctgactgatttactcttcgcactggagacggacgtccacgtctggagaagtcattctaccaaaagcgtcatggattttgtcaatagcaacgagaacatcattttcgtgcacaataccatccacctgattagccagatggtcgacaatatcattattgcatgcggcggaatactgcctctcttgtccgctgccacttcacctaccactgaactggagaacatagaggtaacgcaggggatgtccgccgagacggccgtgaccttcctctctcgactcatggccatggttgatgtcctagtttttgcctctagcctcaacttctctgagatcgaggctgagaaaaacatgagctcaggaggccttatgcgccagtgcctgcgcctcgtatgttgcgtggcagttcgaaattgtttagaatgtaggcagaggcagcgtgacagagggaacaagtcgagccacggaagctctaagccacaggaagtgcctcagagcgtaacagccactgccgcatccaagacgccccttgaaaatgttcctggaaacctatctcctattaaggacccagatcgcctactgcaggacgtggacatcaacagacttcgtgccgtcgtgtttagagatgttgacgacagtaagcaggcgcagtttctggcactggcggtcgtgtatttcatcagtgtgctcatggttagtaagtaccgggacatcctggaaccacagagagaaacaacacgtactggtagccagcccggaagaaacattcgccaggagattaactcccccacaagtacagttgtggttatcccttccatcccacatccgtctctcaaccatgggttcctcgctaagctgattccagagcaatcctttggtcattcattctataaggagacacccgctgccttccctgatacaattaaggagaaggagacacctactcccggagaggatatccaggttgagtcaagcatcccacacaccgattccggaattggcgaagagcaggttgccagcatattaaacggagccgaactggaaaccagtacaggtcccgacgctatgagtgagcttttgtccaccctaagcagcgaagttaagaagtcccaggagtcattaaccgagaaccccagtgagacattgaaaccagcaacgagcatttccagcatctcgcagaccaagggcataaatgtcaaagaaattttgaagagtttggtggctgccccagtggagatcgccgaatgtggacctgaacccatcccttatcctgatccggctctgaaacgagaaacccaagccatcttgccaatgcagttccattcgttcgataggtcagtagtagtccccgtcaagaaacctccacccggaagcctagctgtgactacagtaggtgccactactgccggatccggccttcctacaggatctacatctaatattttcgcggctacaggtgccactcctaaatcaatgattaataccacaggggctgtcgactctggttccagtagctcctccagttcctcctcttttgtgaacggagctacctcaaagaacctacccgctgtgcaaacggttgcaccaatgcccgaggactcagccgaaaatatgagcatcactgctaaactcgaaagggctctggagaaagtagcccctttgctccgggagattttcgtggatttcgcaccttttctctcaaggaccttgctcggctcacacggacaggagctgctaatcgagggcctggtttgtatgaaatcaagcacctcagtcgtcgaacttgtgatgctattgtgttctcaggaatggcagaactccattcagaaaaacgctggactggctttcatcgaactaatcaatgaaggcaggctgctctgccacgcgatgaaggatcacatagtcagggtggccaatgaagccgagttcatattaaatagacaacgtgcagaggacgtgcacaagcatgcagagtttgagtcgcagtgtgctcaatatgccgctgatcggcgagaagaagaaaaaatgtgtgaccacctgatctctgcagcaaaacacagggatcacgttacagccaaccagttgaagcagaagatcctcaacatcttgaccaataaacacggcgcttggggtgccgtcagtcacagtcagttacacgatttttggcgcctggattattgggaagacgatctccgcagaagacgcagattcgtcagaaacgccttcggcagtacccatgccgaggcactgcttaaggctgcgatcgagtacgggacagaggaagacgtggtcaagagcaagaaaactttcagatcacaagccatcgtgaatcaaaacgccgaaacagagctaatgctcgaaggcgacgacgatgccgtgtctttgttacaggagaaagagatagacaaccttgctggccctgtggtgctatccacacccgctcaactgatcgctccagtggttgtcgccaagggtactctaagcataacaaccacagaaatctactttgaggtggacgaggatgactcagcctttaaaaagatcgacacaaaagtgctggcgtacactgaaggcctgcatggaaagtggatgtttagcgaaattcgcgcagtgttttctagaaggtacctgcttcaaaacaccgctctggaggtgttcatggcaaatcgaaccagcgtgatgttcaacttcccagaccaggcaactgtgaagaaggtggtgtactccctgccaagagtcggggtgggcacaagctacggattgcctcaggcccgtaggatttccctcgccacccctcgccagttgtataaatccagtaacatgacacagcggtggcagaggcgcgagattagcaactttgaatatctcatgtttcttaacacgattgcaggcaggacatataacgacctcaatcagtacccagtctttccctgggttctaaccaactacgagtccgaagagctggatctcacgctacctgggaatttccgcgatctgagcaaacccatcggtgccctcaatcctaagagagctgtgttttatgcagagcgatacgaaacatgggaggatgaccagagccccccttaccattacaacactcattatagcactgcgactagcactcttagctggttggtccgaattgaacctttcactaccttcttcttgaacgccaacgatggaaaattcgatcatcctgatcgcaccttttcgagtgttgcacgcagttggcgcacctcccagagggacactagtgatgtgaaggagctgatccccgagttctactacttgcccgagatgtttgtcaattccaatggctataatctgggcgttagagaagacgaagttgtagtgaatgacgtggacctccccccttgggccaagaaaccagaggacttcgtgagaatcaatagaatggctcttgaatccgagttcgttagctgtcagctccaccaatggatagaccttatcttcggttacaagcagcggggtcccgaggccgtgagggctcttaacgtctttcactaccttacctatgaaggctctgtgaatctcgactcgatcaccgatcccgtgctgcgtgaagcaatggaggcccaaattcaaaacttcgggcagaccccaagtcagctgctgattgaaccccatccgcctcgaagttctgcgatgcacttgtgtttcctgccccagagccccctgatgtttaaggatcaaatgcagcaagatgtaatcatggtcctaaagtttccctctaacagccccgtaacccatgtagcagctaatacactgccgcacctgacaatccccgctgtggttactgtgacctgctctcgcttgttcgcagtcaaccggtggcataacactgtaggtctgcggggagcccctggctattctctggaccaggctcaccacctgcctatcgagatggacccactcattgcgaataattcaggcgtaaacaagcgacagattaccgacttagtggaccagtctatacagattaacgcacactgcttcgtggtaaccgcggataatagatacatcctgatctgcgggttctgggataagtcctttcgtgtgtacagtacagagacaggcaaattaactcagattgtctttgggcattgggacgtagttacgtgcctagccaggagtgagtcttatattgggggagactgctacatcgtttccggctcaagggacgccactctgctgctctggtactggtcagggcgacaccatatcatcggtgataacccaaacagtagtgactatcctgctccgagagccgtgcttaccggccacgaccatgaggtggtatgcgttagtgtatgtgcagagctgggtctagtgatatctggagccaaagaaggcccttgcctggtacacaccatcaccggcgatttgctcagagctcttgaaggtcccgagaactgcctgttccccaggcttatctccgtgtcctccgagggccactgcattatatattatgagcggggaaggttttccaattttagtatcaacgggaagctgctcgcccagatggaaatcaatgactccaccagagccatcctactttcctcagatgggcagaatttggtgaccggcggtgacaatggggtcgtggaggtctggcaggcatgcgatttcaaacagctatacatttacccaggctgcgatgccggaattcgcgcaatggaccttagtcatgaccagcggactctaattaccgggatggcttctggctccattgtagcctttaacattgacttcaaccggtggcactacgaacaccaaaatcggtatta

SEQ ID NO: 232315 - DNA, 8840 bp, Artificial Sequence
  Description of Artificial Sequence: Synthetic coding sequence
atggcgtctgagaagccaggcccaggtccaggccttgagccacagccagtaggcctgatagccgttggtgccgctggcggtggaggaggcggaagcggtggaggcggtaccggtggatctggaatgggagagctcaggggcgcaagcggctccggctctgtaatgcttcccgcagggatgatcaatccgagtgtaccaattagaaatattcgcatgaagttcgcagtcctgatcggcctgatccaagtcggagaggtctctaatagagacatcgtggaaaccgtgttaaacctcctggtgggaggggaatttgaccttgagatgaactttatcatccaggatgccgaatctatcacctgtatgactgagctgctggagcattgcgacgttacgtgtcaggctgagatctggtcgatgtttaccgccattctccgtaagagcgtccggaacctccagacatctaccgaggtcgggctgatcgaacaggtgctgctaaaaatgagtgctgtggatgatatgatcgctgacctgctcgtggatatgctgggagttcttgcttcctatagtattacggtcaaggaactgaaactgctattctctatgctgagaggcgagtccgggatctggccaaggcatgccgtgaaactgctgtctgtgctcaaccagatgccacagaggcatggccctgacacattcttcaattttccaggctgtagcgctgctgcaatcgcactacccccaatagcaaaatggccataccagaatggattcacattaaatacatggttccgtatggaccctctgaacaatatcaatgtcgacaaagacaagccctacctgtactgctttagaacgagcaaaggtgtgggctactccgcccacttcgttggcaactgcttgatcgtgacatccctcaagtctaaagggaagggattccagcattgcgtgaaatacgattttcaaccaaggaagtggtatatgatttctatagtccatatttacaaccggtggaggaattctgagatccggtgttacgtaaatggacaacttgtgtcgtatggggacatggcctggcacgtaaatacaaacgactcttacgacaagtgcttcctgggctcttctgagaccgccgacgccaacagagttttttgtgggcaactgggagccgtgtatgtgttctcagaagcccttaatccggctcagatctttgccatccatcagctgggcccaggttataaatccactttcaagttcaaatccgagagcgatatccacctagctgagcatcacaagcaagtgctttacgatggtaagttagccagtagcattgccttcacatacaatgctaaggccacagacgcccagttgtgcctggaatcttctcctaaagagaatgcaagcatttttgtgcactctccacacgccttgatgctccaggacgtgaaagccatcgtgacccattcaatccattccgcaatacactctattggcggtattcaggtcctttttcctctattcgcccagttggataacagacaacttaatgactcgcaagtggagaccacggtgtgcgccacattgcttgcttttcttgtggagctgttaaagagttctgtcgccatgcaagaacagatgctaggcggaaaggggttcctggtaattggctaccttctggaaaagtcaagccgtgtgcacatcactcgagccgtcctcgagcagtttctgagtttcgccaagtatttagatgggttgtcccacggcgcacctctcctcaagcagctttgcgatcatatactgttcaatcccgctatctggatccacaccccagccaaggtgcagctttctctgtatacctatctgtccgcagagttcattggaacagccacgatctacaccacaatccggagagtgggaacagtacttcagctgatgcatactcttaaatattactactgggtcataaaccccgctgacagctccggcatcacgccgaaaggactggatggcccacgaccttcgcagaaggagataattagtttgcgagccttcatgttgttgttcctgaagcaactgattctgaaggatcgcggtgtgaaggaggatgagctacagtcaattctcaactacctgctcacaatgcacgaggatgagaacatccacgacgtattacagttactggttgctctgatgtccgaacatccagcgagcatgatcccagcttttgaccagagaaatggaattagagtgatatacaaattgctggcttcaaagagcgagtcaatctgggtgcaagccctgaaggttcttggctattttctgaaacatctcggacacaagagaaaagttgaaatcatgcacactcacagtctctttaccttgctaggggaacgcctaatgctccacacaaataccgtcactgtcaccacatacaataccctctatgaaatcctgaccgagcaggtgtgtacccaagtagtccataagcctcatcctgaacctgattccactgtcaaaatccagaaccctatgatcctgaaagtggtggccaccctgctgaagaattctactcccagcgccgagctgatggaagttagacggctcttcctttctgatatgatcaaattattcagcaattccagggaaaatcgtcgatgcctcttacagtgctctgtatggcaggactggatgttttcacttggctacattaatcctaagaactcagaggaacagaaaatcactgaaatggtgtataacatttttcggattctgctttaccacgccattaaatacgagtggggaggctggcgggtctgggtggacactctttcaattgcccactccaaagtcacatacgaagcccacaaggagtacctcgcaaaaatgtatgaggagtatcagcgacaggaggaggaaaacatcaagaagggcaaaaaggggaatgtgtccacaatcagcgggctgtcttctcagacgacgggcgcaaagggcggaatggagattagggagatcgaggatctttcccagagccaaagtccggagtctgagactgactaccctgtttcaaccgacacacgagatctcctcatgagcaccaaagtcagcgatgatatcctcgggaatagtgatcggcctggctctggggtgcatgttgaagtacatgatttacttgtcgatattaaggccgaaaaggtggaagctaccgaagtgaaactggacgacatggacctcagtcccgaaaccctggtgggcggtgagaatggggctctggtggaagtcgagtcactgctcgacaacgtgtattctgcagctgtggaaaagttgcagaacaacgtgcacgggtctgtgggaatcatcaaaaaaaatgaggagaaagataacggccctcttattactctggccgacgagaaagaggacttgccaaacagctctacctctttcttattcgataaaatccccaagcaggaggagaaactgctgccagaactttcgagtaaccacattattcccaacatacaggacacacaagttcacttgggggtgtcagacgacctagggttactggcccatatgaccggcagcgtggatttaacttgcacatcttccatcattgaggagaaagagttcaaaattcatactacaagcgacggtatgtctagcatctccgaaagggatctagcctccagcacaaagggccttgagtatgccgaaatgaccgcaactactcttgaaaccgaaagttcctctagcaaaatcgtgccaaatatagatgccggaagtattatctccgatacagaacgctcagacgacggaaaagaatccggaaaggaaattcgcaagatccagaccaccaccacgactcaagctgtccaggggcgatccattacacagcaggaccgcgacctgcgtgtcgatctgggctttcggggaatgccaatgacggaagagcaaaggcggcagtttagtcctggcccacggaccacaatgttcaggatcccagagtttaaatggagtcctatgcaccagcgtttactcactgatctgctgttcgctctagagaccgatgtgcacgtgtggcgtagtcatagcactaaatcagtaatggatttcgtcaattccaacgaaaacattatctttgtacataatacaattcaccttatttcacagatggtggacaatataatcatcgcatgtggtggtattctgccgctactcagcgctgccacctctcctaccggctctaagactgaactggaaaatatcgaggtcacccagggtatgtcagcggaaaccgcagttacttttctttcccgtctcatggctatggtcgacgtcctcgtgtttgcctccagcctaaatttcagcgagattgaggcagaaaagaatatgtcttctggtggactgatgagacaatgtctgaggctagtctgttgcgtggccgtaaggaactgccttgagtgtcgccagagacagcgagaccgtggaaataaatcctctcacggtagcagcaagccccaagaggtgccccaaagtgttactgccacagccgcttctaaaacacctttagaaaacgtgcccggtaatcttagtcccatcaaagacccagatcgactgctgcaggacgtagacataaatcgcctccgcgctgttgtctttagggacgttgacgactctaaacaggcgcaatttctggcccttgccgtggtttattttattagtgtgctgatggtgagtaagtacagagatatcctggagccccagcgagagacaactcgtactggtagccaacctggacgtaacattcgacaggagataaacagccctacaagcacagtggtcgttattcccagtatacctcacccttctctcaatcatggatttttggcaaagctgatccccgagcaaagtttcggtcactctttttataaggaaacaccagctgctttccccgatactattaaagagaaggagacccctacccctggcgaagatatccaggtggagtcttcaatcccccatactgacagcggcataggtgaggaacaggtggcctctatccttaacggggctgagttggagactagtaccgggcctgacgccatgagcgagctgctgagcactctgtcgagcgaagtcaagaaaagccaggaaagtttgactgaaaatccttccgagacactgaaaccagctacctctatttcctccatcagtcagaccaaaggcattaatgtcaaagaaatcctaaagtccctcgttgccgctccagtggagattgcagagtgtgggcctgaacctataccttatccggacccagccctgaaacgcgagacacaggctattctgcctatgcagttccattcttttgatcggtctgtggtggttcctgttaagaagcccccaccgggaagcctagcagtcaccacagtgggggctaccacagctggaagtgggctgcctaccggttccacatctaatatattcgccgctactggcgcaacaccaaagtcaatgattaacactacaggggctgttgactccggctcatcatcatcatcctcatccagctctttcgtaaatggagcaacttccaagaacctgccggcagtgcagactgtggcgcctatgcctgaagattcagccgaaaacatgtccatcactgctaaactcgagcgtgcccttgaaaaagtggcgcctcttttgcgggaaatctttgtcgatttcgcccctttcctgagcagaaccctgctgggctctcatgggcaggagctcctgattgagggcctcgtgtgtatgaaatcttccacttcagtagtggagctggtaatgttgctgtgttctcaggagtggcagaacagtatccagaaaaacgccggtctggccttcattgagctgatcaacgagggtcggctgctttgtcacgccatgaaggaccatatcgttagagtggccaatgaagctgagttcatcctgaacaggcaacgagcagaggacgtgcacaagcacgcagagtttgagtcccaatgcgcccagtatgctgcagaccgaagagaagaagagaagatgtgtgaccacttaataagtgcagcaaagcaccgggaccatgtgactgccaaccagctgaagcagaaaattctgaatattttgacaaacaagcatggagcatggggtgcagtcagccatagccagctgcatgacttctggcgcttggactattgggaagacgatctcaggcggagacggagattcgtcaggaatgcattcggttcaacccatgctgaagccctcctaaaggctgccattgaatacggaaccgaagaggatgtagtcaaaagtaaaaagacattcaggagtcaagccatcgtcaaccagaatgccgagacagagcttatgctcgagggggacgacgatgccgtgtccctgttacaagaaaaggagatcgacaacctcgccggacccgtggtgctctccacccccgcacagcttatagccccagtggtggtggccaaaggtaccctctccattaccaccaccgagatttatttcgaagtggatgaagacgattccgcctttaaaaaaatagacaccaaagtcttggcatacacagaggggctgcacggcaagtggatgttttctgagattagagctgtgttctctcgccgatacttgctgcagaataccgctttggaggtttttatggcaaatcggactagtgtgatgttcaactttcccgaccaggcgactgtaaagaaagtggtctactctttacccagagtcggagtgggaaccagttacggactacctcaggcaagacgcatttccctcgccacccccagacagctgtacaagtctagcaatatgacacagcgatggcaacggagagagatttctaacttcgaatatttgatgttcttgaacaccatcgcagggcgtacgtacaacgatctgaatcaatatccggtgttcccttgggtcctcacgaactacgagtccgaggaactggaccttacattgccaggaaatttcagggacctttcgaagcccatcggcgcactgaaccccaaaagagcggtgttttacgcagaaagatatgagacctgggaggatgaccaatctccaccctatcattacaacactcactactccaccgctaccagtaccctttcttggctggtccgaatcgagccttttacgacattctttctcaacgcaaatgacgggaagttcgatcatccggatcggactttctccagcgtggctcgctcttggcggacaagtcagcgggatacctccgatgttaaagaactaataccagaattctattatctgcccgaaatgtttgtgaactcaaatggatataacctgggtgtaagagaggatgaggtagtggtgaacgacgtggatctgccaccttgggctaagaaacccgaagactttgttagaattaatagaatggcactggaatcagagttcgttagctgccagctccaccagtggattgacctcatctttggttataaacagcgaggcccagaagccgtaagggccttaaatgtgttccactaccttacttacgagggctctgtgaacctcgactccattaccgatccggtgctaagagaagccatggaggcccagattcagaatttcggccagaccccctctcagctgctgatcgaaccccaccctccacggagctccgcaatgcacctgtgttttcttccacagtcacctctaatgttcaaggatcaaatgcaacaggacgtgataatggtcctaaaatttccctctaattcaccagtaacccatgtggccgcaaatactctcccccaccttacgatcccggctgtcgtgactgtcacctgctcccggctcttcgccgttaacaggtggcacaacactgtgggattacgcggagctcccggatacagcttagaccaggcgcatcacctgccaattgagatggatccgctaatcgctaataattccggagtaaataagaggcagatcacagatctggtcgaccaatcaattcaaatcaacgcgcattgctttgtggtgaccgcagacaacaggtacattctcatctgcggcttctgggacaagtctttccgggtgtatagcaccgaaactggcaagctgacacagattgtgttcggccactgggacgtcgtcacctgcctagccagaagtgagtcttacattggaggggactgctatattgtttcaggttccagggatgcaacgctgttattatggtactggagtgggaggcaccacattataggagacaatcccaactcctctgattatcccgctcccagagcagtcctcaccgggcatgaccacgaggtggtctgtgtgtcagtttgcgctgagttaggcctggtcatctccggagccaaagaaggcccatgtttagtgcacactataactggcgacctgctgcgcgctctggaagggccagaaaactgtctgtttcccaggttgatatctgtctcttccgaagggcactgcattatatattatgagcggggtagattcagcaacttctccattaatggtaaactcctggctcagatggaaattaatgattcgacacgagccattttactctcgagcgacggccagaatctcgtgactgggggtgataacggggtggtcgaagtttggcaggcgtgtgacttcaagcaactctacatctatcctggttgtgacgccggaattagagcaatggacctgtcacatgaccagcggaccctgatcacggggatggcttcaggcagcatcgtagcattcaatatcgacttcaatagatggcattacgagcaccagaacagatacta

SEQ ID NO: 232316 - DNA, 1575 bp, Artificial Sequence
  Description of Artificial Sequence: Synthetic coding sequence
atgttcgtgaactccaatggctataacctaggggtgcgtgaggacgaagtggttgtgaatgatgtagacctgcccccttgggcaaagaaacccgaagatttcgtgaggattaaccgcatggctctcgagagcgagtttgtgtcctgtcaattacatcagtggatagatctaatcttcggatataagcaacggggacccgaagcagttcgcgcactcaacgtcttccactacctcacatatgaaggcagcgtaaatctggatagtatcaccgatcccgtgctgcgcgagatccctgaggcttacttcatccgtgaccctcataccttccttctgaccaaggatttcatcaaggccatggaggcccagattcaaaatttcggtcagactcccagccagctgctgattgagccgcacccaccaagatcaagcgctatgcacctctgcttcctaccccagtctcctctaatgttcaaagatcagatgcagcaggatgttatcatggtgctgaagttcccatctaactcccctgtgacccacgtcgctgccaacacactgccgcacttgaccattccagccgtggtcaccgtcacttgctcgcggctgtttgctgtgaatagatggcacaatacggttggactgcgtggcgctccaggctattcgctggatcaggcccaccacttgcccatcgagatggatcccctgattgctaataattctggggtcaacaaaaggcagattactgacttggtggaccagtccattcaaattaatgcccattgttttgttgtgaccgctgataatcggtatatccttatctgcggcttttgggataagagctttcgggtctatagcacagaaactggaaagttgactcagatcgtatttggacattgggatgtggtgacatgcctggctagatctgagagttatatcggcggagattgttacattgtgtctggcagtcgcgacgctaccttgctgctgtggtactggtctggccgacatcatattatcggtgataaccccaactcatccgactatccagcccctagggctgttctcaccggtcacgatcacgaagtggtgtgtgtgtccgtctgtgccgagctggggctcgtgatatctggagctaaagaaggtccatgtctcgtccatacaataacaggtgatcttctacgcgctcttgaagggcctgaaaattgccttttccccagactgatttctgttagctcagaggggcactgcatcatctactatgaaagagggagattctcaaacttttccatcaacggaaagttactcgcacagatggagataaatgactcaactagagctatcctcttatcttcagatggacaaaatttggttactggaggtgataatggtgttgtggaggtttggcaagcgtgcgactttaaacagctgtacatctatcccggttgcgatgctggaatcagggcaatggatctaagccacgaccagcgcactctgatcaccggcatggcctccggttctattgtggctttcaacatcgatttcaatagatggcattacgaacaccagaatcggtactag

SEQ ID NO: 232317 - DNA, 4727 bp, Artificial Sequence
  Description of Artificial Sequence: Synthetic coding sequence
atgcatcaacgtcttttaaccgacttgctcttcgccctggaaaccgacgtacacgtgtggagatctcactccaccaagtctgtaatggattttgttaattccaacgaaaatataattttcgttcacaacacgattcacctaatcagccagatggtggataatatcattattgcatgcggaggcatccttcccctgctgtcagctgccacatcaccaactactgaattggagaacattgaagtgactcaggggatgagcgccgagactgccgtgactttcttgtcccgccttatggccatggtggacgtgctggtgttcgctagctctctcaacttttcagagattgaagccgagaagaacatgtcctcagggggattgatgcggcagtgtctacggttggtgtgttgcgtggctgtacggaattgcctggagtgtcgacagcgacagcgtgataggggcaataaaagtagccatggttccagcaagccccaagaggtgccgcaaagtgtcacagccacagcagcatccaagaccccactcgagaacgtacccggtaatttgagcccaatcaaagatcccgatcgcctgttgcaggatgtggacattaaccgattgcgagcagtggtgtttagagatgtggatgactcgaagcaagctcagttcctggcgcttgcagtagtttatttcatttcagtccttatggtgtctaagtatagagacattcttgaaccccagagagagacgactcgcacgggatctcagcctggcagaaacattcgacaggaaatcaattcccctaccagtactgaaaccccggcagctttccctgacaccattaaggagaaggagacccccacccccggtgaagacatccaggttgagtcctctattcctcacactgactctggcataggggaggagcaggtcgcatctatactcaacggggctgaactcgagaccagcacaggaccagatgccatgtccgaattgcttagtacactttcttctgaggtgaaaaagtcccaggagagcctcaccgagaatccttccgagaccctcaagccagctacaagcatctccagcatttcacagacgaaaggaatcaacgttaaggaaattctcaagtccttggtggcggctcccgtggagatagccgaatgtgggccagagcctattccttaccctgatcccgctctgaagcgggagacccaagccattttgccaatgcaattccattcatttgatcggagtgttgtggtacctgtcaagaagcccccaccaggatctctggcagtgacaactgtgggggctacgaccgccggttccggactgccaaccgggtccacttctaacatttttgccgcaacaggtgctacgcccaagagcatgattaatacgacaggcgctgttgacagtggatcctcatcttctagctcttcttcatcattcgtgaacggcgcaactagcaaaaacctgccagctgtgcagacagtggcgccaatgccagaggatagcgccgagaacatgtcaattaccgcaaaattagaacgggcactcgaaaaggtcgcccctctcctccgggagatttttgtggatttcgctcctttcctatcacgcaccctgctgggcagccatggacaagaactcttgatcgagggactggtttgtatgaagagtagtacgagcgtggtggagctggtcatgctcctctgctctcaggagtggcagaatagtattcagaaaaatgccggtctcgcttttatcgaactgattaacgaaggcaggttgttgtgtcatgcaatgaaggaccacatcgtacgcgttgctaacgaggccgagttcattctaaatcgccagagggccgaggatgttcacaaacacgctgaattcgaatctcaatgcgcacagtatgctgcggacagacgggaagaggaaaaaatgtgcgatcatctgatcagcgctgctaagcatagagaccatgtgacggccaatcaattgaaacagaagatacttaacatccttacgaacaaacacggcgcttggggagcagtttctcattcccagctgcacgacttctggaggcttgattattgggaggacgacctgcgccgaaggaggaggttcgttcgcaatgctttcgggtccacgcacgcagaggctctcctgaaggctgccatcgaatatggtaccgaagaggacgtggtcaagtctaagaaaaccttccgcagccaggcgatcgtaaaccaaaatgcagaaacagagttgatgctggagggagacgatgacgctgtgagcctgctccaagaaaaggagatcgacaaccttgctgggccagtggttctgagcactcctgctcagctgatagcacccgtcgttgtagcaaaggggaccctgagtatcactacgactgagatctactttgaggtcgacgaggatgactctgcttttaagaagatcgacacgaaggtgctcgcatacacagaagggttacatggaaaatggatgttctctgagatccgggcagtgttctccagaaggtatctactccagaacaccgccctggaagtgtttatggccaatcggacatctgttatgttcaacttcccggatcaggccaccgtgaaaaaagttgtttactctcttccaagagtaggcgtgggaaccagttatggccttcctcaggctcgccgaatttccctcgcaacccccagacagctgtataagtcgtctaacatgacacaacgctggcagcggagagaaatatcgaacttcgagtacctcatgtttctgaacaccattgcgggaagaacatacaacgatctcaaccagtacccagtctttccatgggtcctcaccaactacgagtctgaagagctggatctgactctgcccggaaacttccgggacctgtccaagccaatcggcgctctgaaccctaaaagagctgtcttttacgctgagaggtatgagacatgggaagacgatcagtctccaccttaccactacaacacccactatagcaccgcgacaagtaccctctcctggctggtgagaatagagcctttcaccactttttttttgaacgcaaatgatggcaagttcgatcacccagataggaccttctcctccgtcgcccgttcatggcggacttcccaacgagacacgagcgacgtgaaggaacttatccccgaattctactacttacccgaaatgttcgtgaactccaacggatacaatctcggagtgcgagaggacgaggttgtcgtgaatgatgtggacctgccaccctgggctaagaaacccgaagactttgttagaatcaatagaatggctctggagagcgaatttgtgagctgccagttacatcaatggattgatctcatctttggttacaagcaaagggggcctgaggccgttagagccctgaacgtgttccactacctcacctacgaaggtagcgttaacctggactccataacagatccagtgctccgtgaagctatggaagcccaaatccaaaactttggccagacgccttcccagctactgatagagccacacccgccacggagttccgcgatgcatctttgcttcttgccgcagtcaccgcttatgtttaaggatcagatgcagcaggacgtgatcatggtgttgaaatttccctccaattcccctgtgacccacgttgctgccaataccttacctcacctgaccattcccgcagtggtgactgtgacatgctcccggttatttgctgtgaacagatggcacaacactgttggtctgaggggtgcgccaggatactctttggaccaggctcatcacctgccaatcgagatggaccctttgatagctaataattcaggtgtgaataaaaggcagataacagaccttgttgatcaaagcattcagatcaacgcccattgcttcgtcgtgacagcagacaatcgatacattctcatttgcggcttctgggacaagtccttccgtgtctactccacggaaactggaaaattgacccagatagtcttcgggcattgggacgttgtgacttgccttgcgagatccgagtcctatatcgggggtgattgttacatcgtttctgggtctagggatgctacattgctcctctggtactggtctggacgacatcacatcattggcgacaacccgaattcaagcgagtgtgactatcctgcaccacgtgcagtattgactggccacgaccatgaggtggtgtgtgtgtctgtctgtgcagagctgggattagtgatttcgggtgcaaaggaggggccttgcctagttcacaccatcactggcgacctgctacgggctctggaggggccagaaaattgcttgtttcccagacttatctctgtgtctagcgaaggtcactgcatcatatattacgaaagggggcgatttagtaatttttccataaacggaaagctgctggctcagatggaaatcaatgactcaactcgcgcaatactcctgagtagcgacggacagaatctagttacaggtggagacaatggagtcgtggaagtatggcaagcttgcgacttcaagcagctttatatctatccaggctgcgatgctgggatccgggcaatggacttgtcgcacgaccagcggacactcatcaccggaatggctagtggatcaatcgtagccttcaacatcgattttaatcgctggcattatgaacaccagaaccgctacta

SEQ ID NO: 232318 - DNA, 2220 bp, Artificial Sequence
  Description of Artificial Sequence: Synthetic coding sequence
atgtttagcgaaatccgtgctgttttctctaggaggtatctgctccagaataccgcacttgaggttttcatggcaaaccgtaccagcgtgatgtttaactttccagatcaggccaccgttaaaaaagtagtttattcattgcccagagttggcgtgggcacttcatatgggctgccacaagcacggagaattagcctagctacgcccaggcagttgtataaaagcagcaatatgactcagagatggcagaggcgagaaatctctaattttgagtatctgatgtttctcaacacaatagccggtaggacctacaacgacctgaaccagtatcctgtgttcccttgggtgctcacaaactacgagagcgaggagcttgacctaaccttacctgggaacttcagagacctgtcaaagcccatcggtgccttgaacccgaagcgtgcagttttctatgcggaacgttatgaaacctgggaggacgatcagtcacctccttaccactacaatacccattactcaacagccaccagcaccctgtcttggctggtgaggattgaacccttcactaccttcttcttgaatgccaacgacgggaaatttgatcatcctgacagaaccttttcaagcgttgcacggtcctggagaacatcccagcgggacacctccgatgtgaaggaactcatacctgagttttattacctgcccgagatgttcgtgaattcgaacggctataatctcggggtgcgcgaagacgaggtggtggttaacgacgtggatctacctccctgggccaagaagcccgaggacttcgtgagaatcaatagaatggctttggagtcagaatttgtcagctgtcagctgcatcagtggatcgacctcatatttgggtacaaacagcgtggacctgaggcagtacgagcgttaaacgttttccactacctgacctacgagggctcagttaatctggatagtatcacagacccagtgctcagggaggccatggaggcacaaattcaaaattttggccagactccttctcagctgctcatcgagccgcatcctcccaggtctagcgccatgcatctgtgtttcctgccccagtcaccattgatgtttaaggaccagatgcagcaggacgtcattatggttctgaagttcccgtccaacagtcctgtgactcacgtggccgctaataccctcccacacctcaccatccccgctgtagtcacagtgacttgtagtcggttgtttgcagtgaatcgctggcacaacaccgtcggtctccgcggagccccaggatattcccttgatcaggcccaccacctaccaatcgagatggatcccctgattgccaataactcaggagtgaataagagacagatcaccgacctcgttgaccagagcatacaaataaacgcacactgtttcgtggtgacagccgataacagatatatactcatttgcggtttctgggataagagtttccgtgtctatagcaccgagaccgggaagcttacacagatagtatttggtcactgggacgtcgtgacttgtctagcgcgatctgagtcatatattggcggtgattgctacattgtcagtggatcaagagatgcgacccttctcctctggtattggtctggtcggcaccacatcatcggggataaccccaattctagtgactacccagcgccaagggccgttcttaccggccatgaccacgaagttgtgtgcgtcagcgtctgtgcagagctcggcctcgtgatttccggtgctaaagaagggccatgtctggtgcacactatcactggagacctcttgagagcattggagggcccagagaattgcctgtttccccgtctcattagcgtctcctcagaagggcactgcattatttattatgagagaggccgtttctccaacttcagcatcaatggaaaacttctggcacaaatggagatcaatgatagcacgagggctattcttctcagttctgacgggcagaacctcgtgacaggcggagacaatggcgttgtggaagtctggcaagcttgtgatttcaagcagctatatatctatcctggttgtgacgctggcatccgtgcaatggacctgtcccatgaccaacgaacactaattacaggcatggcatcaggctctattgttgctttcaatatcgatttcaacagatggcactatgaacaccagaatcggtattag

SEQ ID NO: 232319 - DNA, 8840 bp, Artificial Sequence
  Description of Artificial Sequence: Synthetic coding sequence
atggcctctgagaaacccggacccggacccggactggagcctcagccagttggcctgattgccgtcggagctgcaggtggcggtggcggtggcagtgggggaggtgggacgggcggttctggaatgggagaacttcgcggtgcctctggatctgggtccgtaatgctccccgcaggcatgatcaacccaagtgtgcccatccggaatatccgcatgaaattcgctgtgctgatcggtctgatccaggtcggggaagtgtccaacagggacattgttgaaacagtgctgaacctgctcgtggggggagaatttgacctggaaatgaattttatcatccaagacgcggagtccataacgtgcatgactgagttgttggagcactgtgatgtaacgtgccaggcggaaatttggagcatgtttacagccatcctgcgcaaatctgtgaggaacctccaaacctcaacagaggtgggcctcattgaacaagtccttctgaagatgtcagcggtagacgatatgattgcagacctcttagtagacatgttgggggtactggcaagctactctatcacagtgaaagaactgaagttgctgtttagcatgctgcgcggtgaatccgggatatggcctcgtcacgctgtaaagctcctgagcgtactgaatcagatgccccagcggcacgggcctgacactttctttaattttcccggttgcagtgccgcagctatagctctccccccaatagccaaatggccctatcaaaacggtttcactctcaatacctggttcagaatggaccctttaaacaacataaacgtagacaaggacaaaccctatttatactgttttaggacttctaagggggttggatacagcgcccatttcgtcggtaactgtttaatcgtaacatctctcaaaagtaagggtaagggattccagcattgtgtgaaatacgactttcagcctcgcaagtggtacatgatctccatcgtacacatctacaatcggtggcgcaattctgaaatcaggtgctacgtgaacggacaactggtgtcatacggcgacatggcctggcacgttaacaccaatgatagctatgacaaatgtttcctggggtctagcgagacggcagatgccaatcgcgtcttttgcggacagctcggtgcggtatacgtgtttagcgaggctttgaaccccgctcagatcttcgctatccaccagctggggccaggctacaagtccactttcaagttcaaaagtgaatccgacatccatctggccgagcatcacaagcaggtcttatacgacggcaagctggcatcaagtatcgcttttacgtacaacgcaaaggcgacagatgcccagctgtgcctggagagcagcccaaaggaaaacgcatctatcttcgtgcactctccccatgcactcatgctccaggacgtgaaagctattgtaactcatagtatccattctgccattcactcaatcgggggaattcaggtgctgtttccactgtttgcccagttagacaaccgacagctgaacgattcacaggtggagacgacagtgtgcgccactctcttggctttcctggtcgaactcctgaagagtagcgtggcaatgcaagaacaaatgctcgggggtaaaggctttctggtcattggataccttctggagaagtctagtagagtacacattactcgcgctgtgctggaacagttcctgtccttcgctaagtatttggacggtctaagccatggtgcacctctcttgaaacagctttgtgaccacatcctctttaacccagccatttggatccatacccccgcaaaggtgcagttatccctgtatacatacctgtccgccgaatttatcggcacagccactatctatacaactatccgaagagtggggacagtgctacagctgatgcatacgttgaagtattactactgggtgattaaccctgccgactcctccgggattaccccaaagggcctcgatggccctcgtcctagccaaaaagagattatttctctgcgggcattcatgctgctttttctgaaacagctgatcctgaaggatcggggagtgaaagaggacgagctgcagtctattttaaattatctgcttacgatgcacgaggacgagaatatccacgatgtattgcagttgctcgtggctttaatgagcgaacacccagcttctatgatacctgccttcgaccagcgcaatggcatccgagtgatctacaaactgcttgccagcaaaagcgagtcaatctgggttcaggccctgaaggtgctaggttatttcctcaaacatttgggacataagagaaaggttgagatcatgcacacccactctctgttcaccctgcttggcgagcggctgatgttgcatacaaacactgtaacagttaccacatacaacaccttgtatgaaatcctgactgagcaggtatgcacacaggttgtccacaagccacaccccgagccagactccactgtgaagatccagaatccaatgatcctcaaggtagtagcaacactgctcaagaactccactccctccgctgaactaatggaagtgcggagactgttcttatcagatatgattaagttgttctcaaatagccgggaaaataggcgctgtctgctccagtgcagcgtgtggcaggattggatgttctccctcggctacatcaatcccaagaacagtgaagagcaaaaaattactgagatggtctacaatatctttcgaatcctgttatatcatgctatcaagtacgagtggggaggctggcgggtgtgggtggacaccttaagcatcgcgcattcgaaagtcacatacgaggctcataaggaatacctggcgaaaatgtacgaggaataccagcgtcaggaagaagaaaatatcaagaaaggaaaaaaagggaatgtaagcacaatcagcgggctgtcttcccagacaaccggggcaaaagggggaatggaaatcagggaaatcgaagatttgagccaatcgcagagccctgagtccgagacggattaccctgttagcactgacaccagagacctgcttatgtctacgaaagtcagcgacgatatccttggaaattccgaccgtccaggctccggagtccacgtggaagtgcacgatctgcttgtggatattaaggcagaaaaagttgaggccactgaggtcaaactggacgacatggatcttagtccagagaccttggtcggcggtgaaaatggcgctctggtggaggtggagtccctgcttgacaatgtttactctgccgctgtggagaagctgcagaacaatgtccacggatctgtgggcataataaagaaaaatgaagaaaaagacaacgggccactcattacactagcggacgagaaagaggacctgccgaactcctccacctctttcctgttcgacaagattcctaagcaggaggagaaactgctgccagagctctcctcgaatcacataatcccaaacatacaggatacgcaggtgcatctgggtgtttcagacgatctagggcttctggcccacatgactggcagcgttgacctgacgtgtactagctcaattattgaagaaaaagagttcaaaattcataccactagcgacggcatgagtagtatttccgagcgggatctggcctcaagcacaaagggactggagtatgcagaaatgaccgcaaccactttagagacagaaagctcctcatccaagatcgtgcctaacattgatgccggtagcattatatctgacactgagcgtagtgacgacggaaaggaatctgggaaggagattcggaaaatccagaccaccactactacccaggcagtgcaggggagatccatcacccagcaggaccgcgacctgagggtggatcttgggttccggggaatgcccatgaccgaggagcagaggcgccagttctcgcccggtcccaggacgacaatgtttcgtatccccgagttcaaatggtccccaatgcaccagaggcttctcacagacttactgttcgctttagaaacagatgtgcacgtgtggagaagccattcaaccaagagtgttatggacttcgtgaattccaacgagaacattatctttgtgcataacactattcacctaatttctcagatggtggataacataataattgcctgcggagggatcctacccctcctttccgctgccacaagccctacagtgagtaagacggaattggaaaacatcgaggtcacacaaggaatgagcgcagaaaccgcggtcacgttcctctctaggctaatggccatggtagatgttctagtctttgctagctctcttaacttcagtgaaatcgaagccgaaaagaatatgtcgagcggcggactgatgcgccagtgcctgcggttagtgtgctgcgtggccgtccgcaattgtttagagtgtcgccagcggcagcgtgatcggggaaataagtcaagtcatggatcctctaaaccacaggaggttccgcagagcgttaccgcaaccgctgcctccaaaactccactggaaaacgttcccggtaatctgtctcccatcaaagatccggacaggcttttgcaggacgtggacattaaccggctgcgggcagtcgtctttcgcgacgttgacgacagtaagcaggctcagttcctagctttggccgtggtctacttcatctcagtactgatggtaagcaagtaccgagacatcctggagccacagagagaaactacccgtacaggtagccagcccggaagaaatattagacaggaaatcaactctccaacgagcactgtggttgtgataccctccatacctcacccttctcttaatcatggattcctggcaaaactgatccccgagcagtcttttggccattccttctataaggaaacccctgcagccttcccagacaccattaaggaaaaagaaaccccaacccctggggaggacattcaagttgagtcttccattccgcacactgattccggaatcggtgaagaacaagtggcgagtatactcaacggcgctgaattggagaccagcaccggacctgatgcaatgagtgaattgctgtctactctgtctagtgaagtgaaaaaatctcaggagtcgctgacagaaaacccgtccgaaactcttaaaccagccacttccatatccagtatttctcagacaaagggaattaatgtgaaggaaatcctgaaatcattggtcgcggcaccagtggaaattgccgagtgcgggcctgaaccaattccttacccagaccctgctctgaagcgcgagacccaggctattctcccaatgcaattccacagcttcgatagaagtgtcgtcgtgcccgtcaaaaaaccccctccaggctcactagcagtgaccactgtgggtgcaacgacagccggatctgggctgcccaccgggtccacctccaatatcttcgccgcaaccggggcaactcctaaatcaatgatcaacacaaccggagcagtggattccggctcgtcatctagttcatcatcatcctcatttgttaacggcgcaaccagcaaaaaccttcccgctgtgcagactgtggcccctatgccagaagacagcgcggagaatatgagtatcacagccaaactagagagggccctggagaaggtggctcccctgctcagggagatatttgttgattttgccccattcctcagtaggaccctcctgggcagccatggacaagaactactgattgaggggttagtgtgcatgaagagttccacatcagtcgtggaactggttatgctcttgtgtagccaggagtggcagaatagcatccaaaaaaatgcaggcctggcttttatcgagctcattaacgaaggcaggcttctgtgccacgccatgaaggaccatattgtgcgcgtggccaacgaggcagagtttatactgaaccgacagagagccgaggacgtccataagcacgccgaattcgagtctcagtgtgcacagtatgccgctgacagacgggaagaggagaaaatgtgcgaccatctgatcagcgccgcaaagcatcgcgaccacgtcacagctaaccagctgaaacagaaaattctaaacattcttacaaacaaacacggggcatggggggctgtgtcacactcacagctgcatgacttctggcgtttagactactgggaggatgatcttcggaggaggcgaagattcgttcgaaacgccttcggatcaacacatgctgaggctcttttaaaggccgcaatcgagtatggcacagaagaggatgtggttaagagtaaaaagacttttaggtctcaggccattgtgaatcaaaacgcagagaccgaattaatgctggaaggtgacgacgatgcagtcagcctcctccaggagaaggagatcgacaatcttgccggtccagtggtgttaagcaccccagcccagcttattgctccagttgtggtagccaagggaactctcagcattactaccacagagatttattttgaagtggatgaggatgactccgcattcaaaaaaatcgacactaaagtgctcgcatacactgagggactccatggcaaatggatgttcagcgaaatacgtgcggtattcagcagaaggtacctgctgcaaaacacagccctggaggtgtttatggcaaatcgcaccagtgtcatgtttaattttccagaccaggccacagtgaaaaaggtcgtctatagcttgccgagagtgggagtgggaacctcgtatggactccctcaggccaggcgaatttctttggcgaccccgaggcagctctataaatcaagcaatatgacccagcggtggcagaggcgcgaaatatcaaactttgaatacctgatgttcctcaatacgatcgccggacgcacatataacgatctgaatcagtacccagtattcccttgggtcctgacaaactatgagtctgaggaactggatctcacactgccaggcaactttagggatttgtctaagccaatcggtgcattgaatcccaaacgtgccgtgttctatgcagagagatatgaaacttgggaggatgaccaaagcccaccatatcattacaatactcactactccaccgccacgagcacactatcctggctcgtcaggatcgaaccattcactacattcttcctgaacgccaacgacggtaagtttgaccatcccgatcggacattctccagcgtcgcacgatcttggcgtacttcacagcgcgatacatctgatgtaaaagagcttattcccgagttctactatctgcccgagatgttcgtcaatagtaatggatacaaccttggagtgagggaagacgaggtggtagtgaatgacgtggatctccccccttgggcgaaaaaacctgaggatttcgtgcgcataaacagaatggccctggagtccgaatttgtgagctgccagctgcaccagtggattgacctgattttcggttataaacagagagggcctgaggcagttagagccttgaacgtttttcattacctgacctatgaaggctccgtcaacctcgactctatcaccgatccagtgctgcgcgaagctatggaggctcagattcagaatttcggccagactccatcccaattgctcattgagccccatccccctcggtcctcggccatgcacctgtgcttcctgcctcagagtcctctcatgttcaaggatcagatgcagcaagacgtgattatggtcctcaagttcccgtcaaattctccagtcacacacgtggcggctaacaccctgccccatctaaccatccctgccgtcgtgacagtgacttgcagcagacttttcgccgtcaatcggtggcacaatacggtggggctgcgcggtgcaccagggtactctctcgatcaagcccatcatctgccaatcgaaatggatcccctaatcgcaaacaactcaggtgtgaacaagcggcagattactgatctcgtggatcagagtattcagataaacgcccactgctttgtggtcacagcagacaatcgctacattctcatttgtggtttttgggacaagtcatttcgagtgtacagtactgaaacgggcaagctgacccaaattgttttcggtcattgggatgtagtgacctgcctcgccagaagtgagagctacatcggcggagattgttacattgtgtcaggcagcagggacgctacactgcttctttggtactggtcgggaagacatcatataataggcgacaaccccaacagctccgattatccggcacccagagcggttcttaccggacacgatcacgaggtggtctgcgtgtctgtatgtgcagagctcggcctggtgataagtggtgctaaagagggcccatgtttggttcataccattacaggggatctcttgcgggctttggaagggccagagaactgcctatttcccagattgatatcagtgtccagcgaaggccactgcatcatttattatgagaggggccgtttcagtaactttagcatcaacgggaaacttttggcccagatggaaattaacgattctactagggccatcttactatctagtgacggtcagaacctcgtcacaggcggagataacggcgtagtggaggtctggcaggcttgtgacttcaagcaactgtatatctaccctggctgcgatgctgggattcgcgctatggatctgtcccatgatcagcgcacactgatcaccggcatggcaagtggcagcatcgtggcgttcaatatcgatttcaacaggtggcattacgagcatcaaaatagatacta

SEQ ID NO: 232320 - DNA, 834 bp, Artificial Sequence
  Description of Artificial Sequence: Synthetic coding sequence
atgttttccgaaattcgagccgttttttctcgccgttatctacttcagaacacggccctggaagtttttatggctaacaggacaagtgtcatgtttaacttcccagatcaggctacagtgaaaaaagtggtctacagcctgccacgagttggggtcggcacaagctacggactgcctcaggcaaggcgcatatctttagcaacaccacggcaactctataaatcctctaacatgactcagcggtggcagaggagggagatttctaacttcgagtatcttatgttcctgaacactatcgccggtcggacttacaacgacctgaatcagtatcccgtgttcccttgggtgcttaccaactatgagagcgaggagcttgatttgacgctccctgggaactttcgcgacttaagcaaacctattggtgctctgaacccaaaaagagccgtcttctatgctgagcggtatgagacctgggaagacgatcaatctcctccttaccactacaacacacactacagcactgcgactagcacactctcgtggctggtgcgcatcgagccgtttactacctttttcctgaatgcaaacgatgggaaatttgaccacccagacagaacattcagtagcgtggctcgctcctggcggacttcccagcgcgatacgtccgatgtgaaggaattgatccctgagttttattatcttcccgagatgtttgtcaactccaatgggtataatctgggagtgagagaggacgaggtcgtggtaaacgatgtagacttgcctccatgggccaaaaacctcaaaactctctgtggcagcacaggttggccatag

SEQ ID NO: 232321 - DNA, 7814 bp, Artificial Sequence
  Description of Artificial Sequence: Synthetic coding sequence
atggcctcccgcgaacgactattcgagctttggatgctatactgcactaagaaggatcctgactatcttaaattgtggcttgacacttttgtgtcctcctacgagcagttcctggacgtcgactttgaaaaactccccacaagggtggacgacatgccacctgggattagtctgttaccagataatattttacaggtgcttcggatccagctgctgcagtgcgtgcagaaaatggccgatgggcttgaggaacagcagcaggccctgtctattctgttggtgaaattctttatcatcttgtgcaggaacttgagtaacgtggaggagatcggaacttgttcttatatcaattacgtcattactatgactaccctgtacatccaacaactcaagtccaagaaaaaagaaaaagagatggccgaccagacatgtattgaggagtttgtgatccatgcactcgcattttgtgagtctctgtatgatccgtatcgcaattggcgtcataggatttccggcaggattctgagtaccgtggagaaaagccgccagaagtataaacctgccagcctcacagtagaattcgtgcctttcttttatcagtgctttcaggagagcgagcacctcaaggaaagcctaaaatgctgtttgctgcaccttttcggagctattgtggcaggcggacaacggaatgcccttcaggcgatcagcccagcaaccatggaagtcttaatgagggtccttgccgattgtgattcctgggaagacggggacccagaagaggtgggccgtaaggccgagctcacgctgaagtgcctcacagaagttgtccacattcttctgtcatccaatagcgatcagaggcaggtcgagacctcaaccattctagagaattatttcaagctgctaaactctgatcactcagccttgcccaaccagcggaggtctagacagtgggagaacagattcattgcgctgcagatcaagatgctgaacacaataaccgctatgctggactgtacagatcggccagttctgcaggcgattttcctgaacagcaattgttttgagcacttaattcgcctgctgcagaactgcaaagtgttccaggggcagctggattgcttggctatctccacaattcaagctctgactgccgtcatgaataaaagccccgctgctaaagaggtgtttaaagagagaatcggatacacacacatgctcgaagtcttgaagagcctgggccagccgcctcttgaactcttgaaagagctgatgaacatggcagtggagggtgatcacacctccgtgggaatcttggggatcagtaatgtacaacctctgctcctgctgatccagtggctgccagagctgcagtctcacgacctgcagatctttatcagcgattggctaaagcgaatctgctgtattaaccgacaatcccgtacaacctgtgtaaatgccaacatgggcatcagaatcatcgaaacattggacctgcattcttctctccaccaaacttgtgccgagaacctcatagctatccacgggtctctaggctctcagagtgtgagctcagaagagatccgcagactgctgcgattgttaagagtagacgaatcagaaagtgtgcacccatacgttacgcccgttacacgcgctatcctaactatggctcggaaactgtcacttgaatctgctctccaatatttcaacctgtcgcatagtatggcgggaatctccgttccaccaatccagaaatggcccggatccgcttttagctttagcgcatggttttgtttagaccaagaccaactaacattgggcatagccaataagggcggaaagcgcaagcagctttattctttcttcaccggaagtggcatggggttcgaagctttcatcacacatagcggtatgttggtggtggcagtgtgtacgaagcgtgagtatgccacggtgatgctccccgatcatagtttctgcgattctctttggcacaacattactgtcgtgcacatgcccggtaaacgaccgtttggacagtcattcgtctatatttacgacaacggtcagcagaaggtgtctgcccctctgaggtttcctgccatgaacgagcccttcacatcatgctgtattggctccgctgggcagaggactacgacccccccacctagccagatacccgaccctccatttagtagtcctatcaccccccaccggaccagctttggaggtattctgtcatctgcatcctggggcggaactatagagaagtcaaaactgatcacgaagcttatctcggccggaactcaggactctgaatggggatgtcctacatcccttgaaggtcagctgggttctgtgatcatcttttatgaacctttacagcccccacaagtgaaggcgctttatctggctgggcctaactgtttatcaccttggaagtgccaggagagtgacatggccgatttacctggaaacattctcctgtactacaccgcgaaagcctgtaagaacagcatctgcctggacctcagcaccaactgcctgcatggaaggctgactggcaacaaggttgtgaattgggacattaaggacattattaattgtattggaggtctcaacgtgctgttcccactcttagagcagatctcacacttcagcgaaggccagatccccgaagagaagaatgagagtaccgttcccgagtctgtgacccccgtggaaggagactggctggtgtggacatccactaaagcctccgagagtagactagaacggaatctggtggcaactttcattctgatcgtgaaacattttatccagagacatcctatcaatcagggaaacctcatccacagccatggcgtggcgaccctcggagctcttttgcaaaaagttcctagcacattaatggacgtgaatgtgctaatggcagtccaattactcattgagcaggtaagcttggaaaaaaatatgcagctgctccaacagatgtaccagtatcttttgttcgactttcggatatggaaccggggagatttcccgtttcggatcggccatattcagtacctgagcaccatcatcaaggactcaaggcgcgtgtttcggaaaaaatacggggttcagtttttgcttgatactctaaggatatattacgggaatggatgcaaatataacgagctgtctttggatgacattaggaccattcggaccagcctgtacggcctcattaagtatttcttgtgtaagggcggtagtcatgaagaaatccagtctatcatgggctacattgccgctacaaatgaagaggaacaattatttggaatacttgatgtgctcttcagcctgctacggaccagcccaacgaggggccagctcttcctcctgctattcgaaccaggaaacgctgacatcctctacgccctactgctgaaccagaagtactccgatagactgcgggagattatctttaagatcatggagcagatgttgaaatgtactaacgtgtatgagcgatcaaagcagcacatacgcttgagggaggttggctatagcggcctgggactattactgaatgaggccctcgtgaatacctccctgatcaagaatttgactcatcaaatcatcaacactgaccccgtgattaattttaaggacctgttatctgttgtctatataagccatagggctcacatcaacgtgagagtggcaatatgccggaaggtactgcaaatcttgcaattccagccagatgctgcccatcaaatctctcagcaggttggctggcaggacactctggttaggctgtttctgaaagcaaagtttgaaaatggtaacaccctgcataagcacagtagggccgtgttgatgaaggacaacgataaaaatatgagcacagaggatacaaaaaagaattccgatgaaaagacggacgaagaaaaaatcacatcttttgcgtccgccaacgtgtcttctgaccagtggagccttgaagatagacattcactggattctaatacgccactgtttcccgaagactccagcgtgggggaacttagcttcaagtcggaaaaccaggaggaattctggcatagtaatccctctcacctgtcccttgatctaagcggaattgactcctgcgagatgagcgattctgggtctcaagttccagatagccttcctagtaccccaagtccggtggaatccacaaagagctttagcgtccactccgacagggaatcctcaatcacaaacgacatgggttttagtgacgacttctcgctactggaatcccaggagaggtgtgaggaagaactcctgcagctcttgacccacatacttaattatgtgatgtgcaaagggctggaaaaatcagatgacgacacatggatcgaacgaggacaggttttctcagccctgtctaaaccgggaatctctagtgaactactgcgccctagcgatgagattaagctcacattgctgcagaaaatgctagagtgggccattagcgaaaaccgggaggccaagaccaaccccgtgaccgctgagaacgcatttcggctcgtgctgattatccaggattttctacagagcgagggtctagtgaacagcaatatgtggactgaaaagctcctggaagacatgatgctcctgttcgactgtctgtctgtctgctattctgaatcccccgtctgggtgaaactgagtcaaatccagattcagctgctcctgggcttcatcggcagaggtaacctgcaggtatgcgccatggccagcgcgaagctgaacaccttgctccagacaaaggtcattgagaatcaggatgaggcctgctatatcctcggcaaactggaacatgtcctgtcacagtcaattaaggagcagacagaaatttacagcttcttaatacccctggtgcgcacactggtatctaaaatctatgagcttctgttcatgaatctccatctgccttccttgcctttcacaaacggaagttcaagcttctttgaagacttccaggagtattgcaattccaacgaatggcaagtctacatcgagaaatacattgtcccttatatgaaacagtatgaggcccacactttttacgatggccacgagaacatggctctttactggaaagattgctatgaggccctgatggttaacatgcataaacgggatagagagggaggggagagcaaactcaaatttcaagagctgttcgtagagcctttcaatcgaaaagctagacaagagaatcttcgatacaacaatatgcttaagcaactatccagccaacagctcgctaccttgagacgctggaaagctattcagctctacctcacctgcgaaaggggtccctgggccaagcgaaaacaaaaccccattcactggaagttggccaacgtggagaactattcaagaatgagattaaagcttgtgcctaactacaacttcaagacacatgaagaggcaagcgctctccgggacaatcttggcattcagcattcccagccgtcttcggatacattgctgttggaagttgtaaagcaggtaaaggtgtcagatatggtggaggataaactggatcttcctgaagaagacattaccgccagggttaacgttgatgaaaaagaagagcaggaccagaaggagaaactggtgcttatggaggattgcgagctgatcacgataatcgacgtcatcccagggaggttggaaattaccactcagcacatctacttctacgatgggtccattgaaaaagaagatggcgtgggatttgacttcaaatggcctcacagtcagatccgagagatccacctgcgaaggtataatctgaggcgaagtgcgcttgaaatctttcatgtagaccaatcaaactattttctgaatttcaagaaggaggttaggaataaaatatactcaaggctgttgagcctgcacagtcccaactcctattacggcagccgcagtccccaagagctttttaaggcctccggcttgacccagaagtgggtgaatcgagagatttccaattttgactaccttattcaaattaacactatggccggtcgaacatataacgatctggcccagtatccagtgttcccctggatcctgcaggactacaccagcgaggagctggatcttaataaccccgcagtgttccgggatttgtctaagccaattggggtggtcaacgagaaaaatgctaaagcaatgagggagaagtatgagaactttgaggatccaatgggaacaatcgataaatttcattatggcactcactattccaatagcgcaggtgtgatgcattacctcatcagggtggagccttttaccaccttgcatatccagctgcagagcgggaggtttgattgcgccgaccgtcagtttcactccatccccgcaacctggcaggcgcttatggataacccctatgacgtcaaggaattgattcctgaattcttttattttcctgagttcctcgagaatcagaatcagttcaacctgggaaggcttcaaatatccaaagaacttgttaatgatgttattctgccgaaatgggccaagtcagccgaggactttatctataagcataggaaagctctggaatccgagtacgtgtctgcccacttgcatgaatggatagacctcatcttcggatataagcaacgtggccctgctgccgtcgaggcactgaatgttttttactactgctcttatgagggtgcagtggacttagatgcactgacagacgaaaaggagcgtaaggctctcgagggaatgatcaacaatttcggccagaccccctgccagctcctgaaaataacaatttccatgaactatgttatcgggactcacggctggctcccctatgacagaaacatttctaactattttacttttataaaagatcagaccgttactaatcctaaaactcagcggtccattaatgggagtttcgctccaggactggagattacaagcaagctctttgtggtgtcacacgatgcaaaattactgttttccgccggttattgggacaatagcatccaggtcatgtccttgacaaagggaaagattatttctcatataatccgtcacatggacatcgttacctgcctcgccacagattactgcggcattcacttaattagcggtagtcgggacaccacttgtatgatctggcagattacccagcaaggcggtgttcccgtgggcctagccagcaagcctttccaaatcctgtatgggcacactaacgaagtgctgagcgtggggatttccacagagcttgatatggctgtgtccgggtctagggatgggactgtaattattcacacgatacccaatctggcaatttcttgggagggccatatcgtggtttattcctcgacagaggagaagactacgctcaaagacaaaaacgcgctccacctgttctcgatcaatggaaagtatctgggttcccagattctcaaagagcaggtaagcgacatatgtatcataggcgagcatattgttacaggatcaatccagggttttctatctatacgcgatctacattctctgaacctttcaataaaccctttggctatgcgcttacctatccattgtgtatgcgtgacaaaagaatacagtcatattctggtggggctggaagacgggaaacttattgttgtgggcgtgggcaagccagcggagatgcgatcagggcaactgtctcggaaattctggggcagcagcaaacggctgagccaaatctccgccggagaaacggagtacaacactcaggactcgaaata

SEQ ID NO: 232322 - DNA, 8084 bp, Artificial Sequence
  Description of Artificial Sequence: Synthetic coding sequence
atggcttcaagagaacggctctttgagttgtggatgctgtactgcaccaagaaggatcccgattatctcaagctgtggctggacacattcgtgtcgtcatacgaacagtttttggatgtggacttcgagaaactgccaacacgtgttgacgatatgccacctggtatctcactgctccccgacaatatcctgcaagtactccgcatccagctgctgcagtgcgtgcaaaaaatggcagacgggctagaagagcagcagcaagcgctgtccatcctcttagtcaagttttttatcattctctgtcgtaacctctcaaacgtggaagaaatcggtacttgcagttatattaactatgtcatcactatgaccaccctgtatatccagcagctcaaatccaagaagaaggaaaaagaaatggctgatcagacatgcattgaggaattcgttatccacgcactggctttttgtgagagcctttatgacccctataggaattggagacatcgcatcagcggacgcatcctgtcaactgtggagaagtcacggcaaaagtataagccagcatctctgaccgtggagtttgtgccgttcttctaccagtgttttcaagagagtgagcacctgaaggaatccctgaagtgctgtcttctccatctgttcggggcaatcgtcgccggaggccagcggaacgcattgcaggctatctcaccggcaactatggaggtcctaatgcgggtgctggccgactgcgatagttgggaagatggggacccagaggaggtgggacggaaagctgaactgaccttaaagtgtctcacggaggtggtgcacattttgctgtcctccaactccgaccagaggcaagtcgaaacttccactatcctagagaactactttaagttgctgaacagtgaccattccgcactgccaaatcagcggcgttcccggcaatgggagaatagattcattgctctacagatcaagatgctgaacaccattaccgcaatgctcgattgtactgatcggccagtactgcaggccatctttctgaactcaaactgttttgaacacctcatcaggttgctgcagaactgtaaggtgtttcagggtcagctggattgcctagccatcagcacgatacaggcgcttactgcggtcatgaacaagtcccccgcagccaaagaagtcttcaaagagcgcatcggatacacccatatgctagaggtcctaaaaagcctgggccaaccacctctggagctgctgaaggagttgatgaatatggctgttgagggggaccatacaagtgtcggaatcctgggcattagcaatgtccaacctttattactcctgattcagtggctaccggaactccaaagccacgatttgcagatctttatctcggactggctgaaacgcatttgctgcattaacagacagtcaagaaccacctgcgtgaatgcaaacatgggtatcaggatcattgaaacattagacctccattccagtttgcaccagacctgcgcggagaacctgatcgccattcatggttccctcggctcgcaatccgtctcctcggaagagatcagaaggctgcttcgccttctgcgggtggacgagagtgaaagcgtgcacccctatgtgacacccgtaacgagggcaatcctgactatggcccgaaagctcagccttgaatcagccctgcagtattttaacctttcccactccatggccggaatctccgtgccgccaatacagaagtggccaggttccgcctttagctttagtgcttggttttgtttggaccaggaccaactaacacttggtatagctaacaagggtggtaagaggaaacagctgtattcattcttcacagggagtgggatgggcttcgaagccttcattacgcatagtggcatgttagtcgtcgcagtctgcacgaagagagaatacgcaaccgtgatgctgcctgatcatagcttctgcgactcactatggcacaacatcacagtggtacacatgcccggaaaacgcccttttgggcaatccttcgtgtatatctatgataacggtcagcagaaagtttccgcccctctaaggttcccagccatgaacgaaccatttaccagctgctgtattggatcggccggacagcggaccacaacacctccaccctctcagattcccgacccaccgttttcatcacccatcactccacacaggacttcatttggcggaatcctgagttccgcatcttggggagggacgatcgaaaagtctaaacttattacaaagctgattagcgccggtacccaggacagtgagtgggggtgtccaaccagcctggaaggtcagttgggctcagtgatcattttttacgagcccttgcagccaccacaggtcaaagctctgtacctagctggtccaaattgcctctctccgtggaaatgccaggaatccgacatggctgatctgccaggcaatattctactatattacacggctaaggcttgcaagaattctatttgtctggacctctcaaccaattgtctgcacggaagactgactggtaataaggtggtgaattgggatatcaaggacataatcaattgcatcggaggcctgaacgttctattccccctgctggagcagatcagtcacttctccgaaggccagatccctgaagaaaagaacgagagtaccgttccggagtcagtaactcccgtggagggggactggctggtttggaccagtacaaaagcctcagagtcgagactcgaacggaatctcgttgcaacttttattctgattgttaaacattttattcaacggcatcccatcaaccaaggcaatttgatacactcccacggggtcgcaaccttgggagctttgctgcagaaggttccctcaacacttatggacgtgaatgtgttaatggccgtgcagttgttgatcgaacaggtctcactcgagaagaatatgcagctgttgcagcaaatgtaccagtatcttctcttcgactttaggatctggaacaggggtgactttccattcaggatcgggcacatccaatacttgtccactattatcaaagactcaagacgggtgttcagaaaaaaatacggtgtccaattcctccttgacacacttagaatttattatggcaacggctgcaaatataacgagctgtctctggacgacataaggacgataagaacgagcttgtacggtctcattaagtacttcttgtgtaagggcggttcccatgaggaaatccaatcaattatgggctacattgcagccactaacgaggaggagcaactgtttggcatactagacgtgctgttctcactcctcagaactagccctactcgcggacagctctttttgctcttgtttgagccaggcaatgcagacatcctgtatgcacttctgcttaatcaaaagtactcagatcggttgcgggagatcatttttaagatcatggaacagatgctcaagtgcacaaatgtgtacgaaagatctaagcaacatatccggctgagagaggttggctactctgggcttggcttacttctgaatgaagcgctggtgaacacaagtctgatcaaaaaccttactcatcagatcatcaacaccgaccccgtgataaacttcaaggacctactgtctgtcgtctacatcagtcatcgcgcacacataaatgtgcgcgtggcaatttgcaggaaagtgttacagatccttcagtttcagccagatgccgctcatcagatttctcagcaagtgggatggcaggacacgttagttagacttttcttgaaggcgaagttcgaaaatggcaacaccctccacaagcatagcagggcagtgctgatgaaagataacgacaaaaatatgtccacagaagatacgaaaaaaaactccgacgaaaaaaccgacgaggaaaagattacctcatttgcctctgctaacgtgagttctgatcaatggtcactggaagataggcatagcctggattctaatacaccgctcttcccggaagatagcagcgtcggagagttatctttcaagtcagaaaaccaagaggaattttggcactccaatccatctcatctgtccctcgatctgtcaggcatcgacagctgcgagatgtcagactcaggcagccaggttcctgactctttgccgtcgacccccagtcccgtggagtccactaagagcttctccgttcacagtgatagagagtcctctatcacaaatgatatgggctttagtgatgatttttccctgcttgagtcacaggaacgatgcgaggaggagctactgcagctgctaacccacatcctgaactatgtgatgtgtaagggactggagaagtcagatgatgatacatggattgagaggggacaggtgttcagcgctctgtctaagcccggaatttcatccgaattgctgcggccatccgacgagatcaagctgaccctgttgcagaagatgctcgaatgggccatttctgaaaatagggaggcaaagaccaaccccgttacggctgaaaatgcctttaggctcgtcttgataatacaagattttctccagagcgagggcctggtaaatagcaacatgtggacggagaaactgctcgaggatatgatgctactgtttgattgcctgagcgtttgctatagtgagtcccctgtttgggtcaagttgtctcagattcagattcagctgcttctgggctttatcggcagaggcaacctgcaagtctgcgcgatggcctccgctaaattaaacacactgctgcagacaaaagttattgaaaaccaggatgaggcctgttatattcttgggaagctggagcatgtcctcagccagagcattaaagaacaaacagaaatttactccttcctcattcctctcgtgaggacattggtgtccaagatatacgaattgctgttcatgaatctgcacctgccttctctcccatttaccaatggcagcagctccttttttgaggatttccaggagtactgcaacagcaatgagtggcaggtctacatcgagaaatacatcgtcccatatatgaagcaatacgaggctcacacgttttatgacggacacgagaatatggccctttattggaaagattgctacgaagccttgatggttaacatgcataagagagatagggaaggcggagaatcaaagctcaaattccaggagctcttcgtggagcccttcaatcgcaaagcgagacaggagaatcttagatacaataatatgctgaagcagctgtcctctcagcagctcgcgacccttaggcgctggaaggctatccaactgtacctgacctgcgagcgtgggccatgggccaaacggaaacaaaaccccattcattggaagcttgccaacgtagaaaactacagccggatgcggctcaaacttgtgcccaattataattttaagacccatgaagaggcctccgcactgcgagacaatctcggtattcagcatagtcagccatcctcggatacactgcttctggaagtcgtgaagcaggtgaaagtcagcgatatggtggaagataagctagacctgcctgaagaggacatcacagctcgagtgaatgtggatgagaaagaggaacaggaccagaaggaaaagctggtgctgatggaggactgtgagctgattaccatcatcgatgtgattcccggacggttggagattacaactcagcatatctatttttacgacggctcgattgagaaggaggatggagtcgggttcgacttcaagtggccacattctcagattagggagatccacctgcgacggtacaaccttaggcggtcagcgctagagatcttccacgttgaccagagtaactactttctgaactttaaaaaggaggtccgaaataagatttatagccgcttgcttagcttgcacagtcctaacagctattatgggtctagatctccacaggagctgttcaaggcatcaggcctaacacagaaatgggtgaatcgggaaatttccaatttcgattatcttatccagattaatactatggccggtcggacttacaacgatctagcacagtaccccgttttcccgtggattctgcaggactacacctctgaagagctcgacctgaataatcctgcagtattcagagatctcagtaagccaattggggtcgttaacgaaaagaatgcaaaggctatgagggaaaagtacgaaaacttcgaagacccgatggggaccattgacaagtttcactatggtactcattatagtaattccgcaggggtaatgcactatctcatcagagtggagccctttaccacacttcatatccagcttcagtcagggagatttgattgtgccgatcggcagttccacagcattcctgctacctggcaggcactgatggataatccctatgatgtgaaggaactaatacccgagtttttttattttccagaatttttagagaatcagaaccaatttaatcttgggcgactgcaaatttccaaagagctagtgaatgacgtgatcctgcctaagtgggccaaaagcgctgaggactttatttataagcatagaaaggcactggaatccgaatatgttagtgcccacctgcacgaatggatagatctcatcttcggctacaagcaaaggggccctgctgccgtggaagcactgaacgtcttctactactgctcttatgagggcgctgtggacctggacgcactcacagacgagaaagagagaaaagccctcgaaggcatgatcaataatttcggccagaccccctgtcagttattaaaggaacctcatccaccccgactttctgcggaggaagcagtccagaaacctaccaaaatcgatacttccacgctgaatttgtttcagcatctccccgagttgaaatcctttttcatagagggcatctcagatggcattccacttctgaaggctacaatcccaaaaaaccagtatcgcagtttcatgtcacagggatcccctgagcttcttatcacgatatcgatgaactacgtaattggaacccacggttggttaccctacgacaggaatattagtaactactttacctttatcaaagaccagacagtgacaaatcccaagacccagcgatccatcaacgggagtttcgctcccggactggagatcacatctaagctcttcgttgtgagccacgacgcgaagctcctgtttagtgctggatactgggacaactcaattcaagtgatgtctctgaccaagggcaagattatctctcacattattaggcacatggacatagttacttgtctggccaccgattactgcggaatccacctgattagtgggagccgtgacaccacctgtatgatttggcagatcactcagcagggtggtgtgcctgtgggcctggcctcaaagccctttcaaatcttgtatggccacacgaacgaagtcttatctgtgggtatttcaaccgaactggatatggcggtgagcgggagtcgagatggtacagttatcattcacaccattcagaagggacagtacatgagaaccttgcgtcccccttgcgagagcagtttattcctcacaatccctaacctcgctataagttgggaagggcacattgtggtgtattcaagcacggaggagaaaactactttgaaagacaaaaatgccttgcatctgttcagtataaacggaaaatatctggggtctcagatcttgaaggaacaagtgtcagatatatgtatcatcggcgagcatatcgtcacaggatctatccaaggattcctgtctatacgtgacctccatagtctgaacctcagcatcaacccattagccatgcggttgccaatccattgcgtatgcgtgacaaaggagtattctcacatactcgtaggcctggaagacgggaagctcattgttgttggcgtaggcaaacccgcagagatgcggtcgggacaactatctagaaagttctgggggagcagtaaacgtctttcccagatttcagctggagaaactgagtacaacacccaggatagtaaata

SEQ ID NO: 232323 - DNA, 7713 bp, Artificial Sequence
  Description of Artificial Sequence: Synthetic coding sequence
atggccgctagtgaacggctctacgagctctggctcctgtactacgctcaaaaggacttaggctatttacagcagtggctgaaggcgttcgtgggggctttcaagaaatctatttcactgagttccttggaacctaggagacctgaggaggccggagctgaagttcctctgctcccactcgacgaactccacgttctcgcagagcaactccaccaagcggatctggagcaggctctactattactcaaactgtttatcatcctatgcaggaatctagaaaacattgaagcgggtagagggcaagtacttgtgccacgagtgcttgctctccttaccaaactggtagccgagttgaaggggtgtccacccccacagggtaggggcacacagctagagaatgtggctctccatgctcttctactgtgtgaggggctgttcgatccataccagacttggcggcgacagagatccggcgaggtgatcagctctaaagaaaagtcaaagtacaagtttcccccagcagcgttacctcaagagttctctgccttcttccaggaatctcttcaaaatgctgatcacctgccgccaatcctgctgttaaggctgatccaccttttctgtgcagttctcgccggtggcaaagagaacggccaaatggctgtttctgacggttcagtcaaaggtctcctgtctgtagtgagggggtggagtaggggcccagcacccgacccatgcctcgtgcccctggctctcgaagccctggtcggggctgttcacgtactgcatgcatcccgcgctcctcctcggggtcccgagcttcgagccctgctcgaatcttatttccacgtactgaatgccgactggccagcaggtctaagttctgggccagaggaagccctcgttacacttcgcgtcagtatgctagatgccatccccatgatgctcgcgtgtgaggatagacccgtgctacaagcaacgtttctgtcgaacaattgcttcgaacacctcacaagactaatacagaattccaagctgtatcttcagtcccgagctccacctgagggcgactcagatctggccacgaggctgttgacggaacctgacgtccagaaagtgctggatcaagacactgatgccatcgccgtacacgtggttcgggtcctcacttgcattatgtccgatagtccttcagctaaggaggtgttcaaagaaagaatcggctaccctcatctccaagaggtgctccagtctcacgggcctcccactcaccgcttgctccaagagctgctcaatatggctgtggagggtgatcacagcatgtgtccaccacctcccatccgcaacgagcagccagttttggttctcgctcagtggctgccctctcttccaaccgctgaacttcgattgttcctggctcaacgcctcagatggctctgcgacagctgtccggcatccagagctacgtgcgtgcaggccggattggtaggctgcttattggaaaccctctctaccgggctggctttagaagccaggtgccaggagcagttactcgcccttttacaggcacttggacgagtttctattcggccaatggagctgcgccacttgctccgaccaaggcctggtctggattccgaacccggaggcgctgaggcaggcaaagcgagacacgctggggcagtcattaggacactctctggcatggctcggcatcaaggtcccgcacgggcactgcgctatttcgacctgactcccagcatggctggcatcatggtgccaccagtgcaacgctggccgggacccggttttacgttccatgcatggctttgcctgcacccaatggatacagccccaacgcccgcacccacacgcccactgcagaggaagcagctttacagcttcttcactagttcagggtccgggtttgaggccttttttactgcagccggtactctggtcgtagccgtgtgcactcgcaaagagtatctcactatgtcactgcctgaagtgtcgtttgctgattcagcttggcactgcgtcgctattgtccacgttcccggacggcgacccttttctcaaaatctagtccatgtgtacaaggacggacacctcgtcaaaacagctcctctgcgctgcccgagcctaagtgaaccttttagtagctgttgcatcggctccgcaggatatcggacaaccacaacaactacagggctcccaacaccccctgttcccgctacattggcctatactcatccagcccttacgagatctcagtcggtacctgccagcactggattgggatgggggtccggtttagtagctcctcttcaggaggggagcatcgattccacactagccggaacgcaggatactcgctggggtagcccaacaagtctagagggcgagctgggcgcagtggcgatatttcatgaggcactgcaggcgaccgcactgcgcaccctgtgcactctgggccctaacgagaccgccccatttaagcccgagggcgaacttcatgaactgtcaacccgtcttttgttgcattattccccacaggcgtgtaagaataatatctgtctcgacctgtccccaagtcatgggttagacgggagattgaccgggcacagggtggaaacctgggacgtgaaggacgttgtgaattgcgtaggcggaatgggagctctcctgccactcttggagcgggtggctgcccagcctaaggaagctgaggctgggcctgctgagacccatgatctggtgggcccagagttgacttctggacataatacccaaggcctggtattaccactcggcaagtcgtctgaggaacgcatggaacgtaatgccgttgccgctttccttcttatgctgaggaatttcctgcaggggcacatggtgaatcaggagtctctggttcagtgccagggacctgcaatcataggcgctttactgagaaaggtccccagttgggcaatggatatgaacgtgcttatgtctgctcagcttctcatggaacaagtggccgctgaaggctctggaccactcctttacctcctctaccaacatctccttttcaattttcacctctggaccctgagcgactttgccgtgagactggggcacatacaatacatgtccagtatagtgcgagagcataggcagaaattgcggaaaaagtacggagtgcagtttattctggacgcactcagaacccattactcaccacaaagagagcggcctctggccgcagacgatctcaggaccgtgcagactagtctgctcggtcttgcaagagaatttctggtacggtctttgtctgccgatgacgtgcaagttacacagaccatgttaagcttcctagccgcaaccggagatgatgggcaaatactacgtagactgcaacaaaacgaaaggctgcctgagagaagtcggcaaaggctcagactcagggaatgtggactacaggggctcgttgcatgcttacctgagggaacggtgtcaccgcagttgtgtcaaggactttacaagctgtttttaggcgctgggtccggaaacacggccggtgggggagggtccagcggaactctgacccctgcctctcagccgggaaccccgtcgcctcttgacggccctcgtccattcccagccgctcctggcagacactctagttctctgtccaatgtgctggaggatggttctctgcccgagcctacaatttccggagatgacacatccaacacatccaatccccagcagacaagcgaggaagagctttgtaacctgttaaccaatgtgctgttctctgtgacatggaggggcgtggagggaagcgacgaggccgcttggcgggagcggggacaagtcttctctgttttgacacagctgggtgcatcagccacacttgtccgcccacccgactgtatcaagcgaagtttgctggagatgatgctggagagcgccctcacagacatcaaggaagcgccagtgggggtattggccagtttaacacagcaagccctgtggctgcttcggttacttcaagacttcctgtgcgcagaaggtcatggtaaccaagagctgtggagtgagaagttatttgagggagtatgctccttgctggacagactcggagcgtggccacacttggctaatgggaccgcggacttgagagagatggcacagataggtctgcgacttgtgctgggctacatcctactcgaagatccacagctgcacgcacaggcctacgtgcggttgcatatgctgctgcaaacagccgtgccagcccgtcgtgaggaagcttgctatgtgctgagcaagctggaggcagccctggggagggtcctgaacacaagttctctggagagcgccaccgacgaggctggcagtcccttggctgccgcagctgccgctgccgcagccgaaagatgttcttggttggtgcctcttgtaagaactttgctggatagagcctacgaacccttgggcctgcagtgggggctgcctagcctgccgcctacgaacggaagtcccacttttttcgaggatttccaggcgttctgcgctacgccagagtggcgccatttcatcgataagcaagtgcagcccacgatgtcacaattcgagatggacacttacgcgaaatcgcacgacctaatgagcggcttttggaacgcctgctacgacatgctgatgagctctggacagagacgccaatgggagagggctcagtctcgaagggcattccaggagcttgtcttggaaccagcccagaggcgcgctcgattggagggcctcagatacacagcagtgctgaagcagcaggccacccagcacagtatggctttgctccactggggggctctttggaggcagctggcgagtccttgtggggcatgggcactgcgcgacacccctatcccacggtggaaacttagcagcgcagagacctactcccggatgcggcttaaactcgtcccgaatcaccacttcgacccgcaccttgaagcctcagcactgcgggacaatctgggagaagtccccttgacaccgactgaggaggcctcactcccgctcgccgttacgaaggaagctaaagtgtccacaccccctgagctcctgcaagaggaccaacttggcgaagacgaactggccgagcttgaaacgcctatggaagcagccgaactggatgaacagagggagaaacttgtgttgagtgcagagtgtcaactggtgacagtggtggcagtggtgccagggctgcttgaggtcactacgcaaaacgtatatttttatgacggatctaccgagcgggtggagacagaagagggaatcgggtacgatttccgtcgccctctagcccagctcagggaggtgcacttaaggagatttaatctgcgacgctccgctttggagctcttttttatagaccaggcaaattacttcctgaatttcccttgtaaggtgggcactacaccagtcagttcgccgtctcaaacacctagaccccagcctggccctatcccgcctcatacccaggtgcgtaatcaggtgtattcctggttgctgcggttacgacctccaagtcagggctacctgagtagtcgaagtccacaggagatgctgcgcgcttccggtctgacccagaagtgggttcagagggagatctcgaatttcgaatacctgatgcagctgaacaccattgccggaagaacgtacaacgacctgtcccagtacccggtcttcccatgggtactgcaggactatgtgtcacctacgctggatctgagtaatcctgccgtgttccgggatcttagcaaacccataggcgttgtaaacccaaagcatgcccagctggtccgggaaaaatacgagagcttcgaagatcctgcaggcaccatcgataaatttcattatggaacccattacagtaacgccgctggcgtgatgcactatctgatcagagtagagccattcaccagcttgcacgtacagttgcaaagcggcaggttcgattgctccgaccggcaattccatagcgtcgccgctgcatggcaggcccgactggagagcccagctgatgtcaaggagctcatcccagaattcttttatttccctgacttcctagaaaaccagaatggtttcgacctggggtgtcttcagttgacgaacgagaaggtcggagatgtagtcctgccaccttgggcctcctctcccgaggacttcattcagcaacatcgccaagccctggaatctgaatatgtgagtgctcacctacacgagtggatcgacctcatcttcggatataagcagcgcggacctgctgctgaggaggccctaaacgtcttctactactgcacttacgaaggagccgtggatttggatcacgttacagacgaaagagagcgaaaggcattagaagggatcatttccaatttcgggcagacaccctgccagctccttaaagaaccacacccaactcgactgagcgcggaggaggccgcacatcgtctggcaaggctggacacgaatagtcccagcattttccagcacctggacgagctcaaggcgtttttcgcggaagtggtgagcgacggggtacccctggttcttgctctcgtccctcatcgccaacctcactccttcattacacagggtagtcccgacctgctggtgaccgtctcggcttctggtctgcttgggacacactcatggctcccatatgaccggaacataagcaattacttctcattttccaaggaccccactatggggagccacaaaacccagcggttgctatccgggccttgggtgcctggcagcggtgttagcgggcaggcgctggcagtcgcccctgatggcaaactgctgttttctggcggtcattgggacggttctttgagagtgaccgcacttccccgagggaagctgctgtcacagctaagttgtcaccttgatgtagtaacatgcctggcccttgatacctgcggaatataccttatcagcgggtccagggatacaacgtgcatggtgtggcgactgctgcatcaggggggactgtctgtggggctcgcccctaagcccgttcaagtgttatacggtcatggggctgctgtgtcatgtgtggcaatttccaccgaactggatatggccgtgtcaggtagtgaggacggaacagtcatcatccacacagtgaggcggggacagttcgtcgccgcactgcgtcccctcggggctacgtttccaggtcccatcttccaccttgccctcggatccgagggtcagatcgtggtgcaatcaagtgcttgggagcgccctggcgctcaggtcacctactcgctccatctttattctgtgaacggcaagttaagggcaagcctacccctggccgagcaacccactgcactgaccgtcaccgaggacttcgtcctgctgggaaccgcacagtgcgccctgcatatcttacagctcaatacattgttacctgcagccccacccctacctatgaaggttgccattaggtccgttgctgttacgaaagagcgctcccacgtactggtaggcctggaggacggcaagctgatcgtcgtagttgcagggcagccttcagaggttaggagctcccaattcgcacgcaaactttggcgctcctctagacgcatctcccaggtgtcaagcggggagactgaatataatccaactgaggccagatag

SEQ ID NO: 232324 - DNA, 1848 bp, Artificial Sequence
  Description of Artificial Sequence: Synthetic coding sequence
atggagcccgcactcggaccaggggttcagaaggatttggggtatctacagcaatggctgaaggccttcgtgggcgcttttaagaaatcaattagcttgagtagcctggaaccacgtagaccagaggaggccggagctgaagtgcccctgctccccctcgacgagttgcatgtgctggcagaacagctacaccaggccgatctggagcaagctctgctgttactgaaactgtttatcatactctgtagaaacctcgaaaatatcgaagcaggtaggggccaggtgttagtgccgagagtccttgccctcctgactaagcttgtggcggagttaaaagggtgcccccctccccagggcagggggactcagctggagaacgtagccctccacgcccttctgttgtgtgagggcctgttcgacccttatcaaacttggaggcgtcagcgtagcggtgaagtgatctcatccaaggagaagtcgaaatataaattccccccagccgctctgccccaagaatttagcgcgtttttccaggaatccctccagaatgcagaccacctcccacctattctgttgctaaggctaatccaccttttctgcgcagttctggccggtgggaaggaaaacggccagatggcggtttccgatggctccgtgaaaggcctgctctctgttgtcagaggctggtctcggggaccggctcccgatccctgccttgttcctttagcattagaagctctggtgggtgcagtgcatgtgctccacgctagtagggcccctccccgagggccagagctcagggccttattggaatcctacttccatgtgctgaatgcggactggccagcaggactgtcatctggcccagaggaggccctggtcactctccgcgttagtatgctggatgctattcctatgatgctggcctgtgaagatcgccctgtgcttcaagcaaccttcctgtctaataactgttttgagcacctcacccggttaatccagaactccaaggttctggatcaagacacggatgcgattgcggtacacgtggtgagggtgttaacctgcattatgagcgactctcccagtgctaaagaggtgtttaaagagagaatcggctacccgcatttgcaggaagttctccagagccacggacccccaactcacagattgctacaggagctgctgaatatggctgtggagggagaccatagcatgtgcccaccacctcccattcgtaatgaacagccggtcctggtgcttgcacaatggctgccatccttgcccaccgccgagctgcggctttttctcgcacaaagactgaggtggctctgtgatagttgccccgcatcaagagctacatgtgtccaggccggtctggtcggctgtctgctggaaacactctctacagggctggccttggaggctcgatgccaggaacagctgctggcgctgctgcaggccctcgggcgagtgtccatcaggccgatggagctaagacatctgctcagacccagaccaggccttgactcagagcccggaggggcagaggcaggcaaggcaaggcacgccggtgccgtgatccgcaccctttcaggaatggccagacatcagggtcccgctcgagccttgaggtacttcgacctgacaccctccatggccggtattatggtacctcccgtccagaggtggcctggacctggatttacatttcacgcctggctctgcctgcaccccatggatactgcccctacgccagccccacctactctcccgtccagcggtataggaggtcgatgttaccccctccgggactggagggctgaagttccgccattagcaggttag

SEQ ID NO: 232325 - DNA, 3012 bp, Artificial Sequence
  Description of Artificial Sequence: Synthetic coding sequence
atgagccagttcgaaatggatacgtacgccaaaagtcacgacctgatgagcggtttttggaacgcctgttacgatatgcttatgtcatctggtcaacggcgacagtgggaacgggcacagtccagacgtgcttttcaggagctggtcctagagccggctcagcgccgagccagactcgaaggcctgcggtacacagccgtcctaaagcagcaggcaacccagcactccatggctttgcttcactggggcgctctctggcggcagcttgcatccccctgcggcgcttgggcattgagggacactccgatccccagatggaaattgtcctccgccgaaacatatagcagaatgagactcaaactggtgcctaaccaccacttcgatccacatctcgaggccagcgccctgagggataatctgggcgaagtgcccttgacacccaccgaggaggcttcactccctcttgcggtcacaaaggaggctaaggtgagcactccgcctgaactgctgcaggaggatcaattgggagaagatgagctggcggaattggagaccccgatggaggcagccgaactggacgagcaacgagagaagctggttctctccgccgaatgccagctcgttacagtcgtagccgtggtacctgggttattggaggtcacaacccagaatgtttacttctatgacggatctactgaacgtgtcgaaacagaggagggtatcggttatgactttcggagacccctggcacaactgcgggaagtacacctgcgcagattcaacctgcggagatcagctctcgaactctttttcattgatcaagccaactattttctcaatttcccctgtaaagtcggcacaacacctgtgagcagcccctctcagacccctcgtccccagcccggacccatccctccacatacacaagtgaggaatcaggtgtattcgtggttgttaagactgcgtcccccatctcaaggttatctgagctctcggtccccccaggagatgttacgtgcttcaggcctcacccagaagtgggtacagcgagagatatccaacttcgaatatctgatgcagctcaatactatcgccggacgaacctacaacgacctttctcagtatcccgtgtttccctgggtccttcaagattatgtgtctccaacacttgacctcagcaacccagctgtgtttcgcgatttgagcaagcctatcggagtggttaatcccaagcacgcccaactagtgagggaaaaatatgagtcttttgaggaccctgcagggaccattgataaatttcactatggaactcactattcgaatgccgcaggagtcatgcattacctgataagagtcgagcctttcacgtccctgcatgtgcagttgcagtccggcagatttgactgttctgatcggcagtttcacagtgtggccgctgcttggcaggcccgactggagtcacctgcagacgttaaagagctgattcccgagttcttttatttccccgatttcttagaaaaccagaacgggtttgacctgggatgtttacagttgaccaatgagaaggtgggcgatgtggtgctgccaccttgggcatcctcgccggaggactttatccagcagcacagacaggctcttgagagcgaatacgtgtcagcccacttacatgaatggatcgaccttatatttgggtacaagcagcgaggaccggcagctgaggaggctttgaacgttttctactattgcacgtacgagggcgctgtagatctggaccacgtgacagacgagcgcgaaagaaaagcgttagaggggattatcagtaactttggtcagacgccatgccagcttctgaaggagccacacccaaccagactctcagcagaggaagcagctcaccgcctcgctcgcctggatacgaattcaccaagtattttccagcatttagacgaactgaaagcattttttgcagaggtgacagtctctgcctctgggctgctgggaacccacagctggcttccgtatgatcggaacatctctaattacttctctttctctaaagaccctactatgggttcacacaaaacgcagagattgttgtcaggcccatgggtccctggctccggggtctccggacaggccctcgccgtggctcccgacggcaagctgctttttagcggcggacactgggatgggtcgctgcgagtgaccgccttgcctagaggtaaactgctaagccagctcagctgccatctggacgtggtcacctgtctcgcattggatacttgcggtatctacctgatctcggggagcagggatactacatgtatggtttggaggttgttacaccaagggggacttagcgtgggtctcgctcctaagccagttcaggtactgtatgggcacggggctgctgtatcttgcgtagcaatcagcactgagctagacatggctgtttctgggtctgaagatggcacggtcatcattcacacagttagaagggggcagtttgtggccgctcttcgaccactgggcgctacgttccccggtcctatcttccaccttgcgcttggctctgaaggacaaatcgtggtccaatcttccgcatgggagagacccggagctcaggttacttacagcctccacctttattcggttaacggcaaactgcgcgcaagtctacccctggccgagcagcccacagcactgacagtcacagaagactttgtgctgctgggcaccgcccagtgcgcactccatatattgcagctgaataccttgctacccgctgctcctccactgcccatgaaggtggctatacggtccgtggcggtaacaaaggaaaggagtcacgttctggtaggactcgaagatggaaaactcatagtcgtggtggctggacaaccttctgaagtgaggagttcacaattcgcaagaaagctgtggcgatcaagcagacgcatctctcaggtgtcctctggcgagacagaatacaaccctaccgaggcgagatag

SEQ ID NO: 232326 - DNA, 2094 bp, Artificial Sequence
  Description of Artificial Sequence: Synthetic coding sequence
atgttaagggctagcggtttgactcagaagtgggtgcagagagaaatttccaacttcgagtacctgatgcagctgaataccatcgcaggtcgaacctataatgacctgagccagtaccccgtttttccatgggtcttgcaggattacgtgtctcccaccctagacctgtcaaaccccgcagtctttcgcgacttgagcaagcccataggagtggtaaatccgaagcacgcccagctcgtcagggagaagtacgagtccttcgaagaccctgccggtacaatcgacaaattccactacgggactcattactccaacgcagcaggtgtcatgcattacctcatccgggtggaacctttcacatctcttcatgtgcagctccaatccgggcgattcgactgttcagacagacagttccatagcgtagctgcagcctggcaggcacgattggaatctcccgcagacgtaaaggagttgattccagagttcttctattttcctgattttctagaaaatcagaatggcttcgacctgggctgcctgcagctcacaaacgaaaaagtaggggatgtcgtgctccccccatgggcctcgagtccagaggacttcatacaacagcaccgccaggccttagaaagtgaatacgtgtcagcccacttgcatgagtggatcgaccttatcttcggatacaaacagcggggacctgctgctgaggaagccctgaatgtgttttattactgtacttacgagggcgctgtggatctcgaccatgtcaccgacgagcgggaaaggaaggccttggagggaattatttccaatttcggacagacgccatgccaattgctaaaagagccacacccaaccagactttcagccgaagaagccgcacaccggctggccagactcgatactaactcacctagtatcttccagcatctggatgaacttaaagcctttttcgctgaggttgtctcagacggcgtgcctttagtgctcgcgttggtgcctcatcgccagcctcactcgttcatcacccagggctctcccgatctgttagtgacagtgtccgccagcggtctactaggcacacactcttggctcccttatgatcgcaacatctcgaactatttctccttttctaaagatccgaccatgggatctcataagacacagcgcctgttatccgggccttgggtgcccggtagcggagtctctggtcaggcgctggcagtggccccagatggcaagttgctttttagcgggggacactgggacgggagcctccgcgtgacagccctccccagaggaaaacttctcagccagctgagttgtcatttagacgtcgttacgtgtctggctctcgacacctgcggaatatacctcatctccggcagtcgtgataccacatgtatggtttggaggctgcttcatcagggcggactgagcgttggcctggccccaaagcccgttcaggttctctatggacacggggctgcagtcagctgtgtagcaattagcacagagctggacatggctgttagtggcagcgaggacgggacagtcatcatacacacagtcagacgcggtcagttcgtggccgcacttagacctctcggggcaacatttcccggtccaatctttcacctggcattgggttcagaggggcagattgttgttcaatcaagtgcctgggaacggccaggtgcacaggtgacttatagtttacatctctattccgttaatggcaagcttcgggcttccttgcccctcgcagaacagccaacagctctaaccgtgacagaggactttgtcctgttgggaaccgcccagtgcgccctgcatattctccagctgaataccttgcttccggcagcgccaccactccccatgaaagttgctataagaagcgtcgctgtcactaaggaacgtagccatgtgctcgtagggctcgaggatggcaaactcatcgtagtcgtggctggacaaccatcggaggtacgatcgtcccagtttgcacggaaactttggagaagttcaaggcggatctcacaggtgtcaagtggcgagactgagtacaacccaactgaagcgagatag

SEQ ID NO: 232327 - DNA, 8264 bp, Artificial Sequence
  Description of Artificial Sequence: Synthetic coding sequence
atggcagcgtcagaaagactgtacgagctttggctgctttactacgcccaaaaggacttgggatacctccaacagtggctcaaagcatttgtaggcgcttttaaaaaaagtatttccctgtccagcctggagcccagaagaccagaggaggccggagccgaggtccctctcttgcccctggatgaactgcacgtactggcagaacaactgcaccaggccgatctcgagcaggccctgctgcttctgaaactcttcatcattctttgccgcaacctggagaacatcgaggcgggtcgaggacaggtgttggtgcctcgggtgctcgcacttctaacaaagcttgtcgccgagctcaagggttgcccccctccccaggggaggggcacacagctggaaaatgtggctttgcatgccttgctgctctgcgagggcctgttcgatccctatcagacttggcgaagacaacgcagcggcgaagtcatcagctctaaagagaaatccaaatataaatttccccctgctgctctgccccaagagttttccgcgttttttcaggagtccctgcagaatgcggatcacctgcccccaattttgttacttcggctgatacatttattctgcgctgtacttgcgggaggtaaggagaacggtcagatggccgtaagcgatggttccgtcaaagggctgttgtcagttgtcaggggctggtcacgcggacccgctcctgacccttgtctggtgcctttggccttggaggcgctggtcggcgctgtgcacgttttgcacgcctcgcgcgcaccaccgaggggtccagagctgcgcgctctgctggaatcgtatttccacgtgctaaatgctgattggcccgcaggcctcagcagtgggccagaggaagctctggtgacactgcgagtttccatgctggacgccatccccatgatgctggcctgtgaggacagacccgtgttgcaggcaaccttcctctccaataactgctttgagcacctcacccgcttgatacagaattccaagctataccttcaatccagggcgcctcccgagggcgactcagatctggccactcgcctgctcacagagcctgacgtacagaaagtgctcgatcaggatactgatgccattgctgtgcatgttgtaagggtgctgacgtgtataatgagtgactccccctcagcaaaagaggtgttcaaggagcggataggctatccacatctacaagaagtgcttcagtcccacggccctcccacccaccggctgctacaggaactcctgaatatggccgtcgagggggaccatagcatgtgtcctccccctccgatccggaacgaacagcctgttttagtactggctcagtggctgccatctctcccgactgccgagctcaggctgttcctggctcagaggcttcgatggctgtgcgactcgtgtcccgcttcgagagcgacatgcgtccaagcgggactcgttggctgcctgcttgagacactgtccacaggactggcccttgaggctaggtgtcaggagcagctgctcgcgctgctacaggcgcttgggcgtgtgtcgatacggccaatggaacttaggcacctacttaggcccagacctggactggattcagagccagggggtgctgaagccggtaaggcacggcacgcaggagcagtgatcagaacactgtcagggatggccagacaccaaggaccggcacgcgctttaaggtatttcgaccttaccccttctatggccggaattatggtccccccagtacagcgatggccaggaccaggattcacattccacgcttggctgtgtctgcatcccatggacacggcccctaccccggcacccacccgtcccctccagcgcaagcagctctattccttttttaccagcagtggcagcggttttgaagccttcttcacggccgctggcactttagttgtcgctgtctgcactcggaaggaatatctcaccatgagtctgccagaggtatccttcgcggacagcgcctggcactgcgttgcaattgtccacgtcccaggacgcagaccattctcgcagaacctagttcacgtgtataaggacggacacctagtgaaaaccgcgcctctgcggtgcccttctttatctgagcccttctcgagctgctgcattggaagcgccggatataggacgaccaccacaaccaccggcctgcccacgcctccggtccctgccacactggcgtacacgcaccctgctctcactcgcagccagtccgtccctgcaagcactggccttggttgggggagtgggttggtcgcccctctgcaggagggttcaatcgattctaccttagccggaacacaggacaccaggtggggaagccccacctcgttggagggcgagctcggtgccgtagccatttttcacgaagccttgcaggccaccgccctccggacactgtgtacactgggccctaacgaaaccgctccgttcaagcccgagggggagctccacgagctttctacaaggctcctgttacactacagcccccaagcttgcaagaataatatatgcctagacctgtcgccgagccatggcctagatggtagattgactggccaccgggttgagacatgggatgtgaaggacgtggtcaattgtgtgggcggtatgggtgcactgcttcccttgcttgaacgcgttgccgcacagcctaaggaagccgaggcgggtccggcagagactcacgacttggtgggtccggagttgactagtggtcacaatacccagggcctggtgcttcccttggggaagagttccgaggaaagaatggagagaaacgcagtcgccgcattccttctaatgctgaggaacttccttcagggccacatggtgaaccaagagtcactggtgcagtgccaggggcctgcaattattggggcacttctaagaaaggtgccatcctgggccatggacatgaacgtactgatgagcgcccagttgcttatggagcaggtcgcagcagagggaagtgggcctctgctctatcttctctatcaacacttgctctttaactttcatttgtggaccttatctgattttgccgtcaggctcggacatatccagtacatgtccagcatcgtgcgggagcaccggcagaaactcagaaagaagtatggcgtgcagttcatcctggacgctctacgcacccattacagcccacagcgcgaaagacccctggccgcagacgatcttcggaccgtacagacatctctcctggggcttgctcgagaattcttggtgcgctccttatctgccgacgacgtacaagtgacacagactatgttgtctttcttggccgctaccggcgacgacggacaagcagttggggctctggacctgctccttgcccttctgcatgggtccttggtgcaagaatcgctggctgtcttcctcctggagcccggtaaccttgaggtcctgctggcactgctggtgaggcccggatccctgcccttactaccagacagagtatgcaaaatcctgcggagactgcagcagaatgaacgtcttcccgaacggagcagacagcggctgaggctgcgggagtgcggcctacaaggactggtggcctgtctgccggagggcacagtttcccctcagctttgtcagggcttgtacaagttgttcttaggggctgattgtctgaacctttccgacttactagcggtggtgcaactatccctgcaagcagatctgagtgtcagattagatatatgtagacagctgttccatctcatctacggacagcccgatgttgtaagactcttggctcgacaggcgggatggcaggatgtcttgacaaggctgtacgttcttgaggccgcaacggcaggctccccccctccctcatccccagagtcgccaacctctcctaaaccagcccctcccaagccaccaacagaaagcccagcagaaccttccgatgtgtttctgccatccgaggccccttgtcccgacccggatggtttctaccacgctttgtcccctttttgtacaccattcgacttgggattggagcgatcctccgtaggctctgggaatacggccggtggtgggggtagcagtggtacactaactccagctagtcaaccagggacaccgtctcccctcgacggtcctaggcccttccccgcagccccagggaggcactcgtcatctttgagcaacgtgttagaagacgggagccttccagaacccacgatctctggagacgatacatccaacacatcaaatccacagcagacgtccgaagaagagctttgtaacctgcttaccaacgtcctgttttctgttacttggaggggcgtggagggctccgacgaggcagcatggagggaacggggtcaggtgttttctgtgctgacccagctgggcgcttcagccacattggttagaccgccagactgcatcaaaaggtcgctcctggagatgatgttagaaagtgcactgacagacattaaggaagctccagtaggggtcctcgctagcctcactcaacaggccctctggctgctgaggctgctgcaagacttcttgtgcgcggaagggcacggtaaccaggaactgtggtctgagaagctcttcgagggggtgtgctccctgctcgacaggctgggcgcatggcctcacctcgctaatggcactgctgacctgagagagatggcccaaattggcttgaggttagtgctgggttacattctccttgaagatccccaactgcacgcccaggcctatgttaggctccacatgctgctgcagaccgcagtccctgccagaagagaagaggcatgctatgtgctgtcaaaacttgaggccgctttgggcagagtgctcaatacctcgtccttagaatcagccacagacgaggctgggtcccctctcgctgccgcagccgcagcagctgcagcagagcgctgcagctggctagtgcccctagtgcggacactcctggatcgggcatatgaacccctcgggcttcagtggggtctgcctagtctgccgcctacaaacggcagcccaacttttttcgaggattttcaggctttctgtgcgactccggagtggcgtcacttcattgacaagcaagtccagccaaccatgtcccaattcgaaatggacacatatgccaaaagtcatgacctgatgtcagggttttggaatgcctgctatgatatgctgatgagctctgggcagcgcaggcagtgggagcgagcacagtcacggagagcgttccaggagttggtgttggagccagcacaaaggcgcgcacgcttggagggactgcgctacactgcggtattgaagcagcaggcaacccagcacagcatggcgctcctccactggggcgctctttggagacagttagcctccccgtgcggcgcttgggccctccgagataccccgataccacggtggaaactgtccagcgccgaaacctactccaggatgaggctgaagttggtgcctaatcaccacttcgacccccatctcgaagcctcagcgctcagggacaatctgggggaagtgccacttacgccaacggaggaggctagtctccccctagctgtcactaaagaggccaaggtttccaccccccctgagttgctgcaggaagaccaactcggagaagatgaattggccgaactggaaaccccaatggaggcagctgagctggacgagcagagggagaaattggtgctgtccgccgagtgccagcttgtgaccgtcgtcgctgtggttcctggccttctggaagtgactacccaaaatgtttatttttacgatgggagtacagaacgcgtagaaacagaggaggggatcggatacgattttcggaggcccctggcccagctgcgtgaggttcacctgaggcgcttcaacctgcgtaggtccgcgctggagctcttttttatcgatcaggcaaattattttctgaacttcccctgcaaagtcggcaccacgcccgtgtccagcccctcacagactcccaggccacaacctggaccgatccccccacacacccaagtgagaaatcaggtgtacagttggcttcttaggttgagacctcccagtcagggctacctttctagtagatctccccaggagatgctccgcgcttctggacttactcaaaaatgggtgcagcgcgagatctcgaactttgagtacctaatgcagttaaacactatagccggtaggacatacaacgacctgagtcaataccccgtgttcccctgggtcctgcaagactatgtgagcccgacactggatctttccaatcccgcagtgttcagagatctctccaaacccattggcgtcgtcaaccccaaacacgcccaactcgtacgagagaagtatgaatcttttgaggacccggcaggcacaattgataagttccactatggtactcactatagtaacgccgcaggcgtgatgcattacctaatcagagtcgagccctttacttccttgcacgtgcagctgcagagtggtcggttcgactgtagcgataggcagttccacagcgtggcagcagcctggcaggccagactggagtctcccgcagacgtgaaggaactgatccctgaatttttctacttcccagattttctggaaaaccagaatggatttgatttaggatgtctccagctgaccaacgagaaggtaggagacgttgtcctgccaccatgggcttcgtcccccgaggatttcatccaacagcatcgacaggctctggagtccgaatatgtcagtgctcaccttcatgaatggatagatttaatttttggttataaacagaggggtccagccgcagaagaggcgcttaacgtgttttactattgcacttatgagggtgcagttgatcttgatcatgtcacagatgaaagggaacggaaggccctggagggcattatctctaacttcggtcagaccccctgccaattactaaaagaacctcaccccacccgtttgagcgcagaggaggctgcacacaggctggcaagactggatactaatagcccttcaatcttccagcacctggatgagctaaaggcctttttcgccgaggttgtgagcgacggagtccctctggtgttggcactggtcccgcacaggcagccccattcatttataacccagggaagccctgacctcctcgtcaccgtcagcgccagtggactgctcggcactcacagttggttaccctacgatagaaacattagtaattactttagtttctcaaaagatcctaccatgggatctcacaagacacaaagactgctatctggcccttgggtacctggcagtggggtgagtggccaggcactggccgtagcgccagacggaaaactcctcttcagcggaggtcactgggacggatctctgagggtcaccgctttgccgcgaggcaaactactgtctcagcttagctgccatctggacgttgtgacctgtctagccctggatacatgcgggatttacctaatctctggatcccgcgatacaacctgcatggtttggagattattgcaccagggagggcttagcgtggggctggcccctaagcccgttcaggtcctgtatgggcacggcgcagccgtgtcgtgcgtggccattagtactgagctggacatggccgtctcaggctcagaggatggcaccgtgatcatccataccgtccgaaggggccaattcgtagccgcactgcgccctctcggggcaactttccctggtccgatctttcacctggcccttggaagcgagggacagatcgtggtgcaatcaagtgcatgggaaagacccggtgctcaggttacatatagccttcacttgtactctgtgaacgggaagctgcgcgcttctcttcccctggccgagcagccaaccgcgttaaccgtgaccgaagacttcgtgttgcttgggaccgcccaatgcgccctgcatattttgcagctgaatacactacttcctgcggcaccaccactgcccatgaaagtggcgatcagatcagttgctgtcacgaaggagaggtcccatgtgctagtaggtctcgaagatggcaaactcatcgtagtagtcgccggacaaccctcagaggtgcggagcagtcagttcgctaggaaattatggaggtccagtaggaggatatcccaggtcagcagtggtgagactgagtacaatcccactgaggcgaggta

SEQ ID NO: 232328 - DNA, 7116 bp, Artificial Sequence
  Description of Artificial Sequence: Synthetic coding sequence
atggccgcaccagagagtggcccagccctgagtcctggcacggccgagggagaagaagagaccatcctatatgatctcctcgttaatactgagtggccccctgagactgaggtacagccgcgaggtaatcagaaacacggggcaagttttataattacgaaagccattagagatagacttctctttctgaggcaatacatttggtatagtcctgctcctttcctgctgccagatggcctggtgaggctggttaataaacaaatcaattggcacctggtgctcgcgtcaaacggcaaactgctggcagccgtacaagaccagtgtgtggagatccgttctgccaaggacgacttcacgtctatcataggaaagtgccaggtaccaaaggacccaaaaccccagtggcgacgagtggcatggtcttatgattgcaccctcctggcatacgcagaatccactggaactgtgcgcgtcttcgatctaatgggctctgagctttttgttatctcacccgcatcctcctttatcggcgacctctcctatgcgatagcagggctgatcttcctcgaatacaaggcctcagcgcagtggtccgcagagctacttgttattaactatcgaggagagctgcgaagttatcttgtttctgtcggcaccaaccagtcttatcaggaatcgcactgtttttccttttcctctcattaccctcacgggatcaacaccgccatttatcacccaggacaccgcctgctgttggttggaggttgtgagaccgcggaggtggggatgtcaaaggcaagtagctgtgggctgtctgcatggagagttctatcaggctccccctattacaaacaagtgactaacgggggagatggagtcactgccgttcctaaaaccctcggattactgcggatgctttccgtgaagttctacagccgacagggtcaggagcaggacgggatcttcaaaatgtctttaagccctgatggcatgctgctggcggctatccacttcagtggaaagctatctatctgggcaattccatcccttaaacagcagggtgagtggggccagaatgagcaacctggctatgacgatctgaaccccgactggaggttgtccaccgagaagcggaaaaaaattaaggacaaagagagtttctatccactaatcgacgtaaattggtgggccgactcagcggtaactttggcccgatgctctggcgctttgactgtgagcagtgtgaaaacgctaaagaacctcctgggcaaaagctgtgaatggttcgaacccagcccccaggtgactgccacacacgatggcggattcttgtcgcttgagtgtgagatcaagctagctccaaagcggtcgaggctcgaaaccagggctggggaggaggacgaaggggaagaggatagcgattctgattacgaaatctcagccaaggcccgatattttggatatattaaacagggcctgtatctggtcaccgagatggagcgttttgctcctccacgtaaacgccctagaaccattacaaagaattacagattggtctccctgcgctccacaacaccagaagagctgtatcagcgaaagatcgagagcgaagagtatgaggaggccctctctctggcgcatacatatggtctcgataccgacctggtgtaccaacgacagtggcggaaatccgctgtgaatgtggcctcaatccagaattaccttagcaaaatcaaaaaaagatcttgggtcctgcacgagtgcctggagcgtgtgccagagaacgtggacgctgccaaagagctgttacagtatgggctcaagggaacagacttggaggcactcctggccatcggcaagggtgccgacgatggacggttcaccctgcctggcgagattgatatcgattcaattagttacgaagagttgtctccgcctgatgaagaaccagccaagaataagaaggaaaaagaattaaagaagaggcaggagctgctgaaacttgttaacttttcaaaacttactttggagcagaaagagctttgcagatgccgtcgcaagttgctgacctacttggaccgcctcgctacttacgaggagattctgggggtacctcatgcatcggaacagagatatgacgcagagttctttaaaaagttcagaaaccagaacatcgtactgtcggccagaacatacgcgcaagagagtaacgtgcaagccctggagatcctgttcacataccatggcagtgatcttcttccacacaggcttgctatactttctaacttccctgagaccacctcaccccatgagtactcagtgctcttgccagaggcttgtttcaacggggattcccttatgattatcccttggcacgaacataagcacagagccaaagactggtgcgaggagctggcttgccggatggtagtcgagcccaatctgcaggacgagagcgagtttctttacgcagcccaacctgagttacttcggttccgaatgactcaactgaccgtcgagaaggtgatggattggtatcaaactcgggctgaagagattgagcactatgcacggcaagtggactgtgctctcagtctcatcagactcgggatggagcggaacatccctggtttgctggtactgtgtgataatttagtgacactggagactctggtgtacgaagcacgctgcgatgtgaccttgaccctcaaagagctgcagcagatgaaggatatcgagaagttgagactcctaatgaattcctgttcagaggataagtacgtgacctctgcgtatcaatggatggtgcctttcctgcatagatgtgaaaagcaatctcccggtgtggctaatgaattactgaaggagtacctggttactctggccaagggggacctcaaatttccactgaagatcttccagcactccaagcccgatctgcagcagaaaatcataccagaccaagaccaactgatggctatcgccctggagtgtatatacacctgtgagcgcaacgatcagctctgcttatgctatgacctgcttgagtgcctacctgaacgcggttatggggacaagaccgaggccacaactaaactccacgatatggtggatcagctcgagcagatcctcagcgtgtctgagctgcttgagaagcacggtctcgagaagcccatcagcttcgtgaagaatacacagtcatcctccgaagaagcccgaaaactgatggtgcgacttacccggcacaccggcagaaaacaacccccagtgtctgagagccactggaggacactgttacaagacatgctgaccatgcagcagaatgtctatacttgcctggattctgatgcgtgctatgagatcttcacggaaagcctactctgttcttctcgtctggagaacattcatctcgctggtcagatgatgcattgttccgcctgtagtgaaaatccacccgctggcattgcccacaagggtaaaccacactaccgcgtctcctacgaaaagagcatcgacctggttctcgcagccagtcgcgaatactttaacagcagcactaacttgactgactcatgcatggatctggctagatgctgtttgcaactaattaccgatcgaccgcctgctattcaggaggaactggacctgattcaggccgtgggttgtctggaggagtttggagtcaaaatcctgcctctgcaggtgaggctttgccccgacagaatctctctaattaaagagtgcatctctcagagccctacatgttacaaacaatcgacaaagctcctgggcctggcggaattgctgcgggttgccggagagaatcccgaagagcggagaggccaggtgctgatcctcttggtggaacaggcccttcgcttccacgactataaagctgcctccatgcattgccaagagctcatggcgactgggtatcccaaaagctgggatgtgtgttcccaactgggacagtcggagggataccaggacctagccacaaggcaggaactcatggcattcgcactgacacattgccccccatcttctatcgaacttctgctcgccgcaagctcgagcctccagaccgagatcctgtatcagagagtgaattttcagatacaccacgaaggaggggagaatatttccgcctctccactcacgtcaaaagccgtccaggaggatgaggttggggtcccaggctccaactctgcggatcttctaaggtggaccaccgccactactatgaaggtgttgtctaataccactacaacaaccaaggctgtgctgcaggccgtatccgatggccagtggtggaagaagtcccttacttacctgcggccactccagggtcagaagtgcggtggtgcctatcaaatcgggactaccgctaacgaggatctagagaaacaggggtgtcatcctttttatgaatctgttatttcaaatccttttgtggctgagtctgagggcacctatgatacatatcagcacgtcccagtggagtcctttgctgaggtacttctgcggacgggcaaattagcagaggcaaagaacaagggagaggtttttcccacaactgaggtactgctgcaattggcctcggaggccctgccgaatgatatgaccctggcattggcttatcttctggcgttaccccaggtgttagatgccaataggtgttttgagaagcaaagcccttccgccctgtcactccagttggctgcctactactattccttgcagatttatgcccgacttgcaccgtgttttcgggataagtgccaccccctttacagagctgacccaaaggaattgatcaaaatggtgaccaggcatgtaacaaggcatgaacatgaggcttggccagaggatctgatctccctcacaaaacagctccattgttataacgagagacttctggacttcactcaggcccagattctgcaggggctcaggaaaggtgtggacgttcagcgattcaccgccgacgaccagtataagagggagacaattctcgggcttgctgagacccttgaagagtctgtatacagcattgccatctctctcgctcaaagatactcagtgagccggtgggaggtcttcatgacgcacctagagtttctattcacagatagcggcctgtcaacgctggagatagagaatcgcgcacaggacctacatctgtttgagacattaaaaacggaccctgaagcctttcaccagcacatggtcaagtatatctaccctactattggcggatttgaccacgagcgtctgcagtactactttactttacttgagaactgcggttgcgccgacctgggtaattgcgccatcaagccagagacacatatcagactactgaaaaaattcaaggttgtggccagcggtcttaactataagaaacttactgacgagaacatgagccccttagaagcattggaacctgttctgagttcacagaacatacttagtataagtaagctggttccgaagattcccgaaaaagatggccaaatgcttagcccgtcctcgctttacacgatctggctgcagaagctcttttggacgggggatcctcacctgatcaagcaagtcccgggatcatcccccgagtggcttcacgcctatgacgtatgtatgaagtactttgacagactgcacccaggcgacctgattaccgtggtcgatgccgtgacattcagccccaaagccgtaaccaaactgtcagtggaagccagaaaagagatgacaagaaaggcaatcaagaccgtcaagcactttattgagaagcccagaaaaaggaatagtgaagatgaagcccaggaggcaaaggactctaaggttacctacgctgatacactcaaccacctcgaaaaatctcttgcccacttggagacactctcccactcctttattttatcactcaagaactcagaacaagaaaccctacagaagtattcccacttgtatgatctgtcacggtctgagaaggaaaagctgcatgatgaggccgtcgccatctgtctggacgggcaacccctcgccatgatccagcaactcctcgaggtcgccgtgggccctttagacattagccctaaagacatagtccagagtgcgatcatgaagattatcagcgccttgtcaggtggcagcgctgacttggggggaccaagggatcccctgaaggtcctcgagggcgtggtggccgcagtccatgcctcagtggataaaggagaggaactcgttagccctgaggacttgcttgaatggttgcgtccattttgtgccgacgatgcttggccggtgcggcctagaatccacgtattgcaaattctggggcaaagttttcatctgaccgaagaggatagtaagcttctagtatttttcaggaccgaggccattctaaaggccagttggccacagaggcaggtagatattgccgatatcgagaatgaagaaaatcgctattgtctgttcatggagttgctggaaagcagccatcatgaggcagagttccaacaccttgttctgttgcttcaggcttggcctcccatgaaatctgaatacgtcattactaataatccctgggtgcgattagcgacagttatgctgactaggtgtacaatggagaataaagaaggtcttggaaacgaggtgctgaagatgtgcaggagtctctacaatactaaacagatgctccccgcagagggcgtgaaggaattatgcctcctcctattgaaccagtcactccttctccctagccttaagctcctcctggagtcacgcgatgagcatctgcacgagatggcgctcgagcaaattaccgccgtaacgactgtgaatgattctaattgcgatcaggagctccttagcctgcttctggatgctaaacttctggtgaaatgcgtgtcaacccccttctatccacgcatagtggatcatttgctggcaagcctgcagcaaggtagatgggatgcagaggagttgggacgccatctacgggaggctggacacgaggcagaagcaggaagtctactgctcgcagttcgcggtacccatcaggcctttagaaccttctctacagctctgcgggctgcacaacattgggtctag

SEQ ID NO: 232329 - DNA, 6755 bp, Artificial Sequence
  Description of Artificial Sequence: Synthetic coding sequence
atggctgcacccgagagtggcccagccttgtccccagggacggccgaaggcgaagaagagaccatcctgtatgatctgctcgtaaacaccgaatggcccccagagaccgaagtccagcccagggggaaccaaaagcacggagcgtccttcattatcaccaaagcaatccgggataggctgttatttctcagacagtatatctggtactctccagcgccattcctgcttcccgatgggttggtgcgccttgttaataaacagatcaactggcatttggtgctcgcctccaacggaaaattgttggctgccgttcaagaccaatgcgtggaaattagaagcgccaaggacgactttacctcaattataggcaaatgtcaggtacccaaggaccccaaaccacagtggagaagggttgcttggagctatgattgcacgctgttggcttacgctgaaagcactgggaccgttcgtgtttttgatctaatgggctccgaattgttcgtcatctctcccgctagcagcttcattggagacttgagttacgccatcgcaggcctcatctttctcgaatacaaagccagcgctcagtggtccgcagaactgctcgtgataaactatcgtggcgagttgagatcttacctagtgagtgtcggtaccaatcagagttatcaggagagtcactgtttttccttcagttcccactatccgcatggcatcaatacagccatttaccatcccggacatcgccttctcctggtcggtggctgcgaaaccgcagaagtgggcatgagcaaagcttcatcctgtggtctatccgcatggcgggtgctctcaggttccccctactataagcaggtgaccaatgggggtgacggggtcactgctgtgccaaaaacactgggcctactcaggatgctgtcggtaaagttttactcccgccagggacaagaacaggatggaatctttaagatgtccctgtctccagacggcatgctgcttgcggctatacattttagcggaaaactgtcaatctgggctattccctctctgaagcagcagggggagtggggtcagaatgaacagccgggatacgatgacctcaacccagactggaggttatccactgaaaaaaggaaaaaaataaaggataaggagtccttctatccgctaattgatgttaactggtgggcggattccgctgtgaccctggctagatgttccggagctctgacagtctcaagcgtgaaaaccctgaaaaatctgctgggcaagtcttgtgaatggttcgaaccctccccccaggtgaccgccactcatgacgggggtttcctgtccctcgaatgtgagattaaattggctcccaagcgatcacggctggagactagggctggggaagaggacgagggtgaggaagatagcgactctgactatgagatatccgccaaggcacgctacttcggatatattaaacaggggttgtacttagtaactgagatggaaaggttcgctccaccgaggaaacgcccacggaccattacgaaaaactacagattggtgtccttgcggtccacgacacccgaagaactgtatcagaggaagattgagagcgaagagtatgaagaggcattgagtctcgctcacacctacggcctcgatacagacctggtataccaacggcaatggcgtaagtctgccgtcaatgtcgcgagcattcagaactacctttcaaagatcaaaaagcgtagttgggttttgcacgagtgcctggaacgcgtgccagagaacgttgacgcggcaaaggaactgctacagtacggcctaaaggggaccgacttggaggccctgttagccattggaaagggcgcagacgatggacggttcacactccccggtgaaatagacattgatagtatctcttatgaagagctctcaccgcctgatgaagagcctgccaagaataaaaaagagaaagagttaaaaaaaaggcaggagctattgaagctcgtgaacttctcaaagctgacattggaacaaaaagagttgtgccgctgtcgacggaaactgctcacttacctggaccgactggcgacctacgaggagattctgggagtcccacacgccagcgagcagcggtatgacgccgagttcttcaaaaagtttaggaaccagaacatcgtcctgtctgcaagaacttatgcccaggagtcaaacgtgcaggccctcgagattctgttcacataccacggatccgacctactgccccacagacttgccatccttagtaatttcccagaaactactagtcctcatgagtatagtgtcctgctgcccgaggcctgcttcaacggcgacagcttgatgattatcccttggcatgaacacaaacacagggcaaaggattggtgtgaggagctggcttgtagaatggtagtagaacccaatttacaggacgaatctgagttcctgtacgctgcccagcctgagctgctacggttccgaatgacgcagctgaccgtcgagaaggtaatggattggtatcagacacgagcagaagaaattgaacattacgctagacagctgcagcagaaaatcattccagaccaggatcagcttatggccatcgccctagagtgtatatacacgtgcgagagaaacgatcagctgtgcttgtgctatgatctgctcgaatgtctgccagaaagagggtacggcgacaaaaccgaggctaccaccaagctccacgatatggtggatcagctggaacagatactgtctgtcagcgaactgctagagaaacacggcctcgagaagccaatttccttcgtcaagaacacacaaagttcatccgaagaagcgcgaaagctaatggtccgcctgactagacacactggaaggaagcagccaccagtttccgaatctcattggaggacactgttgcaggatatgctgactatgcagcagaacgtctatacttgccttgatagtgatgcgtgttatgagatattcacggagtcactgctctgttcatcccggttggagaatattcatcttgccggacagatgatgcattgttccgcctgttcagagaatcctccagcaggcatcgcgcacaaggggaaacctcattatagggtgtcctacgaaaagtccatcgacctagttttagctgcatcccgggaatatttcaactcctccactaatttgacggattcttgcatggacctggcacgttgctgcctgcagttgatcacggatcgaccccctgctatccaggaggaattggatctgattcaagctgtagggtgtctggaagaatttggagttaagattctgcccttacaagttcgcttatgtccagatagaatctctctcattaaagagtgcatcagccagagtcccacctgctacaagcagtccaccaagcttttgggactcgcggaattgctgcgggtggccggtgagaatcccgaggagcgacggggtcaagtgctgatattactggttgagcaggctcttcggtttcacgattataaggccgcttcgatgcattgtcaggagcttatggccaccggttaccctaaatcgtgggacgtttgctctcaactgggccaatccgagggttaccaggatctcgccactcgtcaggagctcatggccttcgctctcacccattgtccaccaagcagcattgaattgctcctggctgcatctagcagcctccagactgaaatcctctaccagagggtcaactttcagatacaccacgaaggcggtgagaatatatctgcaagtccccttacttccaaagcagtgcaggaagatgaggtgggagtacccggttcaaacagcgccgacctccttagatggaccacagctacgactatgaaggtgctgagcaataccactacaacgacaaaggccgtcctgcaggcagtttcggatggacaatggtggaagaagtcgctgacatacctcagaccactgcagggccaaaagtgtggcggtgcctaccagatcggaactaccgccaatgaagaccttgagaaacagggatgccacccattttacgagtctgtcatcagcaatcctttcgttgccgagagcgaggggacatatgatacttatcaacacgtgccagttgaatctttcgccgaggttttgcttcggactgggaaactggctgaggcaaaaaataagggcgaagtgtttcccactacagaggtgctcctacaattggcgtccgaggctcttcccaacgacatgaccctggcactagcttacctcctggctctcccacaagtccttgacgctaatcgatgcttcgagaagcagtccccctcagccctgagcctgcagctggccgcttattactacagtctacagatttacgctcgcttagctccctgtttccgtgacaagtgccacccactctatcgggcagatcctaaagagctgattaagatggttaccaggcatgtgacccgtcacgaacatgaggcttggcctgaggatctcatctcattgactaaacagctgcactgctataatgaaaggctgcttgacttcactcaggcgcagatactgcagggactgagaaagggggtggacgtccaaagattcacagcagacgatcagtacaaacgagagactatcctcggcttggccgagaccctggaggaaagcgtatactccattgccattagcctcgcgcaaagatattcagtgtccagatgggaggtattcatgacgcacctagagtttttgtttaccgattcaggcctctctactttagagatagagaaccgggctcaggatctgcatctgtttgaaacactcaagaccgaccccgaagcatttcatcaacacatggtgaagtatatttacccaaccataggaggcttcgatcacgaaagacttcagtattacttcacactcctggagaattgcggctgtgccgacctgggaaactgtgccatcaagcctgaaacccacatcaggttgctgaaaaagttcaaagttgtggcctccggactgaattacaagaaacttacagatgaaaatatgtcacctctggaagcattggagccagtgctgtcttcacagaacatactctcaattagcaaactcgtacctaaaatccctgagaaggacggacagatgctgtcaccatccagcctgtatacaatctggctgcaaaaactgttctggacaggcgacccccaccttatcaagcaagtcccaggctcctccccagaatggcttcacgcttacgacgtgtgtatgaagtacttcgatcgattacatcccggagacctgatcacagtagttgatgccgtgacatttagtcccaaggctgtgacaaaattgagtgtggaagccaggaaggaaatgaccaggaaggcaatcaagacggttaagcacttcatcgaaaaaccaagaaaacggaattctgaggacgaggcccaagaggccaaggacagtaaggtgacatatgctgatactctgaaccacttggagaaatctttggctcatctggagaccttaagccacagttttattctgagtctgaagaattctgaacaggaaaccctgcaaaagtattcccatctgtacgacctgagccgcagcgagaaggagaaactgcatgacgaggctgtggccatttgtctggatggccagcccctcgcgatgatccagcaactactggaggtggctgtgggtcctctggacattagcccaaaagacatcgtccaatcagccatcatgaagattatatcggctttgtctgggggtagtgccgacctgggagggcctcgggatccactgaaagttcttgagggcgtggtggccgcagtgcatgcctcagtggataagggggaggagctggtcagccccgaagatctcctggaatggctccggccattttgtgccgacgatgcatggcctgttcggcctagaattcacgtgttgcagattcttggccagtcattccacctaaccgaggaggactccaaactgctggtgtttttcagaacagaagcgatactcaaagctagttggccacagaggcaggtggacattgctgacatcgaaaatgaagaaaatagatattgcctgttcatggaactgctcgagtcttctcatcatgaggccgaatttcagcacctggtactcctgcttcaagcctggccccctatgaaatcagagtacgtgatcactaataacccatgggtacggctagccactgtgatgttgacccgctgcactatggaaaataaggaaggacttgggaacgaagtgttgaagatgtgtagaagtctctataacactaaacagatgttgcccgctgaaggggtaaaggagttgtgtctgcttctgctcaatcagagcctgttgcttccctccctcaaattgctcttggagagccgtgacgaacacttgcatgaaatggccttggaacagattactgcagtgacgaccgtcaatgactcaaattgcgaccaggaactcctctccttactcctagacgcaaagttactggtgaaatgcgtgtctactcctttctaccctaggatcgtcgaccatctgttggcatctcttcagcaaggaagatgggatgccgaagagttgggccgacatctccgcgaagccggtcatgaggcagaggctggctccctgttgctggccgtccgcggaacccatcaggcctttcgtactttttccaccgctctccgtgcagcccagcactgggttta

SEQ ID NO: 232330 - DNA, 10662 bp, Artificial Sequence
  Description of Artificial Sequence: Synthetic coding sequence
atggtcgtaagtgcaggcccttggagctctgaaaaggctgagatgaacattcttgagatcaatgagacccttcgaccccagctcgccgagaagaagcagcaattccggaaccttaaggagaaatgtttcctcacgcagcttgcgggatttctggcaaataggcagaagaagtacaagtacgaagaatgtaaggacttaattaagtttatgttaaggaatgaaagacaattcaaggaagagaaactcgccgaacaactaaaacaggccgaggagttgcgtcagtacaaagtcctggtccacagccaggaacgtgaactcacccaattacgagaaaagctacgcgaaggtcgcgatgccagccggtcactatatgagcatctgcaggcattgctgacccctgacgagcctgataagtcccaaggccaagatctgcaagaacaattagcagaggggtgtcgtctggcgcaacatcttgtgcagaagctctcaccggagaatgacgaagacgaagacgaggacgtgcaggttgaggaagccgagaaagtcctggaatcctctgctccaagggaggtgcagaaagccgaagagagtaaagttcctgaagattccctcgaggagtgtgctatcacctgtagtaatagccacggtccttgcgatagcaatcagcctcataagaacattaagatcacctttgaggaggacgaagtaaattctacacttgtagtggatcgcgagagctcacacgatgaatgtcaagacgcgctaaacatcctgcctgtgcctggcccaaccagttccgctactaatgtgtctatggtggtctcagcgggtcccctcagcagcgagaaggcggagatgaatatcctcgaaataaacgagaaactacggcctcagttggcagaaaagaagcagcagttcagaaatctgaaggagaaatgttttctaacccagctgtccggatttttggctaaccagcagaagaagtataagtatgaggagtgcaaagaccttattaagtttatgctaagaaatgagaggcaatttaaggaggagaaattggctgagcagctcaaacaggctgaggaactgcgtcagtataaggtcctggtgcacgcacaagaacgggagcttactcaactgaaggagaagctgcgcgaagggagagatgcaagtcgaagtctgaacgagcacctccaggcgctgctcacaccttatgagcccgacaagtctcagggccaggacctgcaagagcaactggccgaggggtgcaggttggcccagcaccttgtgcagaaactttcccccgaaaacgataatgacgacgacgaggatgtacaggtcgaggttgcagagaaagtgcaaaagtcatctgcaccgagggaaatgcagaaagctgaggagaaggaggtcccagaggattctttggaggaatgtgctatcacatactccaacagccatggttcatatgatagtaaccaaccacacagaaagactaagattaccttcgaagaagataaagtggatagcactttgatcggctcatcatctcacgtagagtgggaagatgctgtgcacattatcccagaaaatgaatctgacgacgaagaggaggaagagaaaggccctgtgtctcctagaaacctgcaggaaagcgaggaggaagaagtgccacaggaatcttgggatgaaggttactccaccctgagcatacccccagagatgttagcaagctatcagagctatagcagtaccttccattcactggaggagcagcaggtctgcatggctgttgacattggcaggcacagatgggatcaggtgaaaaaggaagatcaagaggccacggggccaaggctatcgcgggagcttcttgacgagaaagaacctgaggtgctccaggactcactggacagatgctatagcactccttctggatatctggagttgcctgaccttgggcagccttactccagtgcggtctattctctagaggagcaatatttggggctcgcattggacgttgataggataaagaaagatcaggaagaggaggaggatcaaggcccaccgtgccctcgcttgtcaagggagctgctggaagtggtagaaccggaggttctccaggatagtctggatagatgctattctactccaagcagctgtctggagcagcccgactcctgtcagccgtatggtagttctttttacgcgctcgaggagaaacacgtggggttctctttagatgtcggtgagatcgagaagaaaggtaaaggcaagaaacgaagggggaggcgctccaagaaagaacgtcgtcgtggtaggaaggaaggcgaggaggaccagaacccaccatgtccccgtctgagcagggaactgttggacgaaaaaggcccagaggtactgcaggatagtttagataggtgctattcgacaccttctgggtgcttagaactgacggatagctgccagccatataggagtgctttttacgtactggaacaacagagggtaggttttgccgtggatatggatgaaatcgaaaagtaccaagaagtggaggaggaccaggatccctcttgccctcgtctatcacgggagttattagacgagaaggaaccagaggttctgcaggacagcctggataggtgttactccacaccttccgggtacctggagcttccagatcttgggcaaccatattctagcgctgtgtattccctagaggagcagtatctcggccttgcactcgacgtggatcggattaagaaggaccaagaggaggaggaggatcagggcccaccttgtcccaggctcagccgtgagctcctggaagttgtggagcctgaggtcctccaggattccctggatagatgctactccactccctcatcctgtctggaacagcccgattcctgccagccctatggctcttctttttatgccctggaggagaagcacgtggggttctcgctcgacgtgggagaaattgagaagaagggcaagggaaagaaacgtagggggaggagaagtaaaaaggagcgccgtcggggtcggaaggaaggggaagaggatcaaaaccctccttgtcctagactctctcgagaacttttggacgagaaaggacccgaagtgctgcaggatagcctggaccgatgttacagtacaccatccggctgcctcgaactgaccgacagctgtcagccctatcgaagcgcgttttatgtgctggagcagcagcgagttggcttcgccgtggacatggatgaaattgagaagtaccaggaggtagaggaggatcaagacccttcttgtccaagactgagcagagagctcctggatgaaaaagaacccgaggtcctgcaggattccctggatcggtgctattccaccccatccgggtacttggagctacccgacttgggacagccgtattcctcagccgtgtattctcttgaagagcagtatctggggctggccctggatgtggatcgtattaagaaggatgaggaagaggaggaggatcaggatccgccatgtcctcggctgtctagggagcttttggaggtggtggcaccagaggtgctgcaagactcactggataggtgctatagcaccccatcttcttgcctggaacagcccgatagctgtcagccatatggcagcagcttctatgccttagaggaaaaacacgtcgggttcagcttagacgtgggcgagatcgagaagaagggtaagggaaagaagagacgcggtcgcaggtcaaaaaaagagaggaggaggggcaggaaggagggggaggaggaccaaaaccctccatgtcctaggctgagtcgtgagctactggatgagaaggggccagaagtgctgcaggacagtttggaccgttgctattcaaccccgagtggctgtctggaattgaccgattcttgccagccgtaccgatctgccttctacgtcttggaacaacagcgagtggggatggcggtcgacatggacgaaattgagaaatatcaagaagtggaagaggaccaggaccctagctgtcctaggctatcaagggaactgctcgacgaaaaagaacccgaggtgttgcaggacagcctcaacagatgttattcaaccccgtctggctacttggagctgcctgatctgggacagccctattcctctgcagtttattcattagaggagcaatatctaggtctagcgctcgatgtcgaccggatcaaaaaggatcaggaagaggaagaggatgaagaccaggaccctccctgtcctagactgagccgcgagctactggaagtcgtggagcccgaagtgctgcaggattccctggatcgctgttactctactccttcgtcctgtctagagcaacctgatagctgtcagccttacggttcatccttttacgcactggaggagaatcatgtgggtttctcgctcgacgtaggagagatcgagaagaagggtaaggggaagaagcgtaggggcaggaggagcaaaaaagaaagaagacgaggacggaaggagggcgaagaggatcagaatcctccttgtcccagactgtccagggaactactggatgaaaagggcccagaagtgcttcaggatagcctggatcggtgctatagcaccccatccgggtgtctggagttgacagactcctgccagccttatcgctccgccttctacgtactcgaacagcagcatgtgggccttgctgtggacatggatgagatagagaagtatcaggaggtcgaggaagaccaggatccaagctgccctcgtctaagcagggaactgttggatgagaaagagcccgaagtcctccaggattcactggatcggtgttactccaccccatctggctatttggagttacccgacctgggccagccctattcatctgctgtgtactcactcgaagaacagtatcttggactcgccttagacgtggaccggatcaagaaggatcaagaggaagaggaagaccaaggacctccatgtcctaggctctctcgagagctgctcgaggtagtggaacccgaagtccttcaggactccctggatcggtgttactcgactccaagctcctgccttgaacagcccgactcctgccagccatacggctcttcattctatgccctcgaagaaaaccacgtgggctttagtctggacgtgggcgagatcgaaaaaaaaggaaaagggaagaagaggaggggccgtcggtcaaaaaaggagcgacgacgaggtcgcaaggagggggaggaggatcaaaaccccccttgccccaggctctccagggagctgctggatgagaagggtccagaagtgctgcaggatagtttggaccgttgctatagcacaccttctggttgcctggagctaactgattcctgtcaaccttaccgtagcgccttctacgtgcttgaacaacagcatgtcgggctcgcggttgacatggatgagatcgagaaatatcaggaagtggaggaggaccaggacccaagctgcccaaggctttcacgcgagttgcttgatgaaaaggaacccgaggtgctgcaggattccctcgatcggtgctattccaccccctccgggtacctagaactgccggacctgggccagccatattctagcgctgtctattctcttgaggagcaatacctgggccttgccctggacgtggatcggattaaaaaagatcaagaggaggaggaggatcaagggccaccatgcccacggctatcgagggagctgttggaggtcgttgaacctgaagttctgcaggacagccttgaccggtgttactcaacaccgagttcctgtttggagcaacccgactcttgtcagccttacgggtctagcttctatgcgctagaggagaaccacgtgggattcagtttagatgtgggagaaatcgaaaagaagggcaaagggaagaagcgaaggggacgtaggagcaagaaagagaggcgacggggtcggaaggagggagaggaggaccaaaaccccccttgcccacggctgtcaagggagctactcgatgaaaagggcccagaggtgctccaggattctctggatagatgttacagtacgccaagcggctgtctggaactgactgactcctgccagccctaccgatccgcattctacgtgctagagcagcaacacgtcggcctcgctgtggacatggatgagatcgagaagtaccaggaggttgaggaggatcaggaccccagttgccctaggctttcaagagaactgttggatgaaaaggaacccgaagtgctgcaggacagtctggacagatgttatagcaccccctcagggtatttggagctgccagacctgggtcaaccctatagttcagcagtatatagtcttgaagaacagtatctcgggctggctctggatgtggatcgcatcaagaaggatcaggaagaggaagaggatcagggaccaccatgtcctcgactttcaagagaactcttggaggtcgtggagccggaggtgctgcaggactccctagaccgttgttattctactccgagttcgtgtcttgaacagccagacagttgccaaccctacggatcatctttctacgccctggaagagaatcatgtgggatttagtctggatgtgggcgagatcgagaagaaaggcaagggcaaaaagagaagagggcgaagatcaaaaaaggagcgacgcaggggtaggaaggaaggcgaggaggaccagaaccccccttgtccaagactaagcagggagctcctcgacgagaaaggccctgaagttctccaagattcactggacaggtgttattctactccatctggatgccttgagttgactgatagctgtcagccctacagaagcgcattctatgttctagagcagcaacatgtcggactcgcggtggacatggacgaaatagagaagtaccaggaggtcgaggaggatcaggatcctagttgtccgaggctttcccgggagttacttgatgaaaaagagcctgaggtgttgcaggattctcttgatcgatgctatagtacaccgtcaggatacctcgaactccccgatctgggtcaaccatatagcagtgccgtgtatagtctggaggaacagtatctggggctggcactggacgtagatcgtataaagaaggatcaggaagaggaggaagaccaagggccaccatgcccaagactgagtagggagctgctggaggtagttgaacctgaggtgcttcaggattccctagaccgctgctacagcacccctagcagttgtctggagcaacccgattcatgtcagccctacgggtcttccttttatgccctggaggagaaccacgtcggcttctcactggacgtcggcgagattgagaagaaggggaaaggaaagaaacgaagaggacgcaggtctaaaaaggaacgccgtcgcggacggaaggaaggagaagaagatcaaaatccaccatgccctagattgagcagagagttacttgacgaaaagggcccagaggtgttgcaggacagcctggataggtgctattctactccaagcggatgtctggaattaactgacagttgtcagccctaccgttcagcgttttacgttctcgagcagcagcatgtcggtctcgccgttgatatggacgagatcgagaaataccaagaagtggaggaggaccaggacccctcatgcccacgcctgagcagggagctactcgatgagaaagagcccgaggttttacaggactctctagatcggtgctactcaactccgtctgggtatttagaattgcccgatctcggtcagccgtattcgtctgctgtgtattccctggaggagcagtatcttggcctggccctggacgtggatcgcattaagaaagatcaggaagaagaggaagatcaggggccaccatgcccgcgactctccagagagctactagaagtggtggagccagaagtgctgcaggactccctcgacaggtgctactcaaccccatcttcctgtctcgaacagccagacagttgccagccatacggctcaagcttctatgctctcgaggaaaaacacgtgggcttttctttggatgtaggcgagattgagaagaagggtaagggaaagaagaggcgcggtaggcgctcaaaaaaggaaagaagacgcggaagaaaagagggcgaggaggatcagaacccaccctgtcctcggctgtctcgcgaacttctggacgagaaaggccctgaggttcttcaagatagtctggacagatgttatagcacaccctcaggatgcctcgagctgacagactcttgtcagccttacagatctgcgttttatgtcctggagcagcagcatgtgggcctggccgttgacatggacgagatcgagaagtaccaggaagtggaagaagaccaggatcccagctgccctcgcctcagcagggaactgctggatgagaaggagcctgaagtccttcaggactcactcgatcggtgttatagcacacccagcggctacctggagctgccagacttgggccagccatactcctccgcagtctattcattagaggaacagtatctgggactagcactagatgtcgacaggattaaaaaggatcaggaagaggaagaggatcaggggcctccatgtcctcgcctgagcagagaactgctcgaggtggtagaacctgaggtccttcaagacagtctcgacagatgctattctaccccaagcagctgcctggagcagcctgactcttgccagccatacggatccagcttctacgcgcttgaagaaaagcacgtagggttttccctggacgtaggagaaatcgagaagaagggcaaaggtaaaaagcgcaggggcagacggtcaaagaaggagcgccgtcggggacggaaagaaggggaagaagaccaaaatcccccttgccccaggttgtccagagagctgctggatgagaaggggccaaaggttctacaggactctctggacagatgctatagcacaccaagcggatgcctggaactttgcgattcatgtcagccgtatcggtctgctttctacgtcttagagcagcagcgcgtagggctggctgttgatatggacgagatcgagaagtaccaggaggttgaggaggatcaggatccttcctgcccacgcctgagcagggagctgctcgacgagaagggcccagaggtgctccaggacagcctggatagatgttacagcacaccgagtggatgtcttgaactttgcgactcctgtcagccatacagatctgcattttacattctggaacagcagagagttggtctcgctgtggatatggacgaaatcgagaagtaccaagaagtggaggaggatcaagatccttcttgtcccagactgtcccgggagctcctggacgaaaaggagcctgaagtactgcaggactcactggataggtgctatagtaccccttccggttacctcgagctacccgatctgggacaaccatactcctccgctgtttactccctcgaggaacagtacctggggcttgccttagatgttgacagaatcaaaaaggatcaggaagaggaagaagatcaagggcctccgtgtcccagactaagcagggagctgctcgaagtggtggagccagaggtgttgcaggactctctggaccgttgttactctaccccgagctcttgcttggagcaacccgactcttgccagccttatggctcctccttttatgcactcgaggagaaacacgtgggattctcattggatgtgggcgagatcgagaaaaaaggaaagggcaaaaagcgccgtggacggagatcaaaaaaggagaggcggagaggaagaaaggagggcgaagaggatcaaaaccccccttgtccccgtctgtctcgagagctcctggacgagaaggggccagaggttctgcaagacagtcttgaccggtgctactctacaccaagtgggtgcctcgagctctgcgacagctgtcagccttatagatctgctttttacgtgctggagcagcagcatgtgggtctggctgtggatatggacgaaatcgaaaagtatcaagaggtggaagaggaccaagacccttcttgtccccgattatcacgtgaacttctggacgagaaagagcccgaggtgcttcaggactcactggataggtgctattcaaccccctccgggtatctggagctacccgatcttgggcaaccatactcgagcgcagtgtacagcttagaagagcaataccttgggttggcactcgatgtggataaaattgagaagaagggaaagggtaagaagagacggggaaggcggagtaaaaaggaacggagacgcggacggaaggagggcgaggaggaccagaatcccccttgccctcgcctcaacggtgtgctcatggaggtcgaggaaagggaggtgttacaggactctctggaccgttgctacagtactccgtctatgtattttgagctgccagacagttttcagcactacagaagtgtgttttatagcttcgaggaacagcatatcagcttcgctctgtacgtggacaaccgtttctttacactgacagtaacttcgttgcatctggtcttccagatgggtgttatatttcctcagtag

SEQ ID NO: 232331 - DNA, 900 bp, Artificial Sequence
  Description of Artificial Sequence: Synthetic coding sequence
atggtggtatccgctggacctctctcaagcgagaaagccgagatgaacattctcgagattaacgagaagctcaggccacagcttgctgagaaaaagcagcaattcaggaatcttaaagagaaatgcttcctcacccagctcagcggctttctcgccaatcagcagaagaaatacaaatatgaggagtgcaaggacctcattaagtttatgctgcgaaatgaacgacagtttaaggaagagaaactggctgagcaacttaagcaggcagaggaacttcgtcagtacaaggtgctggtgcacgcccaggagagggaactgacacagttgaaggagaaactccgggaaggcagagacgcttccagatcgctgaatgagcacctccaggcactcctcaccccctacgaacctgataaatctcagggccaagacctgcaggagcaattagccgaagggtgccgtttggcccaacatctggtacagaaactgtcgccagagaacgacaatgacgatgacgaggatgtccaggtcgaggttgccgaaaaagtgcagaagtcatctgccccacgagaaatgcagaaagccgaggagaaagaggtgccggaggatagcctggaagaatgtgcaataacatactctaattcacacggctcctacgattctaatcagcctcaccgtaagaccaaaattacctttgaggaagataaggtggactcaactttgatcgggagctcatcccacgtggagtgggaggatgcggtccacataatcccagaaaacgaaagtgacgatgaagaggaagaggagaaaggaccagtgagtcccagaaccagtgtagggagttctgagaaaggtggaccccgtggcaaccggagccaggctcagcagggagctgcgggttag

SEQ ID NO: 232332 - DNA, 2010 bp, Artificial Sequence
  Description of Artificial Sequence: Synthetic coding sequence
atggtggtgtcagccggacctctgtcctccgagaaggcagagatgaatatcctggaaatcaatgagaagctaaggccgcaactcgccgagaaaaagcagcagttccgcaacttgaaggaaaaatgctttctgacccagctgtctggtttccttgccaatcaacaaaaaaagtacaagtatgaggagtgtaaggacctgattaaatttatgcttagaaatgaaaggcaatttaaggaagagaaactggcagaacagctaaaacaagccgaggaactaaggcagtataaggtgctcgtgcatgcccaggagagagaacttacacagctaaaggaaaaactcagggaggggagagacgcatcccggtcactgaatgagcatctgcaggccctgctgacgccctacgagcccgacaaatcccaaggccaggacctgcaggagcagctggccgaaggttgtcgtctcgcccagcatctggtgcagaaactgtcacccgaaaacgacaatgacgatgatgaggacgttcaggtggaagttgcagaaaaagtgcagaagagttcagccccaagggagatgcagaaggccgaggagaaggaggtgcccgaagattccctcgaggaatgtgccataacgtactccaattcgcacggctcttatgacagcaatcagcctcacagaaagacaaagataacgttcgaggaggataaagtcgactctacactgataggaagttcctcccatgtggagtgggaggacgcagttcacataatccccgagaacgaaagcgacgatgaagaggaagaggaaaagggcccagtttctccacgaaaccttcaggaatctgaagaggaggaagtgccacaggagagctgggatgaagggtattcgacactgtccatcccacctgagatgctcgcttcctatcaaagctatagtagcacctttcatagtttggaggaacagcaggtctgcatggccgttgacatcggcaggcaccggtgggaccaggtaaagaaagaagatcaagaggcgacaggcccttcacgggagttgctcgatgaaaaagggccagaagtgttccaggatagtcaggatcgctgttactccaccccttctgggtgcttggagctcactgattcatgccagccttataggtctgctttttacatacttgaacaacagcgcgtaggccttgctatcgacatggacgagatcgagaagtaccaggaggtggaagaagaccaggatccatcgtgtccgcgactgtccagagaactcctggatgagaaggagcccgaggtgcttcaggactcacttgatcggtgctatagtaccccatcaggctacttggaacttcccgatctcggccagccttactcttcagcggtgtacagtctggaagagcaatacctgggcctggctctcgacgtggacagaatcaagaaagatcaggaggaggaggaggaccaggggcctccttgtcctaggctgtctcgagaacttctggatgaaaaagggcctgaggtattgcaggattctctggatagatgctattccactcctagcggatgcctcgaactgacagactcctgtcagccgtaccgatccgccttttatgttctcgagcaacagcatgtgggtttggctgtcgacatggatgagattgagaagaaagggaagggcaagaagaggcgtggtagaagatccaagaaagaaagaaggcgtgggagaaaagaaggggaagaggatcagaaccccccttgtcctcgtttaaatggcgtccttatggaagtggaagagcgggaggtcctgcaagactccctggataggtgttattccactcctagcatgtacttcgagctccccgactcctttcaacactataggtccgttttctattcttttgaagaacagcacatcagctttgccctctatgtcgataaccggtttttcactttgacagtgacaagtcttcatctggtgtttcagatgggcgtgattttcccccagtag

SEQ ID NO: 232333 - DNA, 2022 bp, Artificial Sequence
  Description of Artificial Sequence: Synthetic coding sequence
atggtcgtttcagccggtccctggtccagcgagaaggctgaaatgaatatcctggaaattaatgaaacactcaggccacagctggctgagaagaagcagcagttcaggaatctaaaggagaaatgcttcctgacccagctggcaggtttcttggctaatcgacagaaaaaatataagtatgaggaatgcaaagaccttatcaaatttatgcttcgaaacgagagacagttcaaagaagagaaactggccgagcagttaaagcaggccgaggagttgagacagtacaaagtcctggtgcactcccaggagcgggaactcacccagctccgagaaaagcttcgtgagggaagggacgccagcaggagtctatacgaacatctccaggcccttctcacacccgatgaaccagacaagtcccaggggcaggatcttcaagaacagctggctgaagggtgccggttggcccagcatctggtgcagaagttaagcccagagaatgacgaagatgaagatgaggacgtgcaggtggaggaagccgaaaaggtgttggaatcctccgctcccagggaagtgcagaaggctgaggagagtaaagtgccagaggactccctggaggagtgtgctatcacatgctccaattctcacggcccatgtgatagcaatcagcctcataaaaatatcaagattacgtttgaagaggacgaagtgaattctaccctcgttgttgaccgtgagtcttcccacgatgagtgtcaggacgcactgaatattctgcctgagaacgaatctgacgatgaagaggaggaggaaaaaggaccagtgagcccacgaaacttgcaggagagcgaggaagaggaagtaccacaagagtcctgggatgaaggctattccacactgtctatacccccagagatgctggcctcttaccagagctactccagtacatttcactccttggaggagcagcaggtctgtatggctgttgatatcggcaggcaccggtgggatcaagtaaaaaaggaagaccaggaagccaccggtcccagactttcaagagaactcctggacgaaaaaggtccagaggtgttacaggatagcttggacaggtgctactccactccttccggctgtttggaattaactgacagttgtcagccttatcgttccgccttctacgtcttagagcagcagagagtgggatttgccgtggacatggatgaaatcgaaaaataccaggaggtcgaagaggaccaagatccttcttgcccacggctgtcccgcgagctgctcgacgaaaaagagccggaggtgctgcaagactcgcttgaccggtgttattctacacccagcggatacctggagctcccggatctcggccaaccatatagctctgctgtatactcactggaggagcagtaccttggccttgcactggacgttgaccgaataaagaaggatcaggaggaggaagaggatcaggggcctccttgccctcgccttagtcgagaactgctggaagtggtagaaccagaagtgttgcaggacagcctagatcgatgttactcaaccccgagttcgtgcctggaacagccagatagttgtcaaccctacggatcttcgttttatgccttggaagaaaagcatgtaggcttctctttagatgtgggtgagattgagaaaaagggaaaaggaaaaaagcgtcgcggacgtcgctccaagaaagaacgcaggagaggcaggaaagagggcgaggaagaccagaatccaccttgtcccagacttaacggagtgcttatggaggtggaagagcgtgaggtattgcaggacagtcttgatcgctgctattccacaccttctatgtatttcgaattgcccgactctttccaacattaccgtagcgtgttttatagctttgaggaacagcacattagctttgcgctgtacgtagacaatcgattttttactttgacagtcacatcacttcacctggttttccagatgggagtcatttttccacaatag

SEQ ID NO: 232334 - DNA, 519 bp, Artificial Sequence
  Description of Artificial Sequence: Synthetic coding sequence
atggctgtcgatatagggaggcaccgatgggaccaggtcaagaaggaggaccaggaggcgacagggcctagccgcgaattgctcgatgagaaaggacctgaagttttccaggacagtcaggatcgatgctattcaaccccaagcggatgcttggagctgacagatagctgtcagccctaccgaagcgctttctatatcctggagcagcagagggtggggttagctattgacatggatgaaattgaaaaataccaggaggtagaggaagatcaggaccccagctgcccaaggctgtcaagggaacttttggacgaaaaggagcctgaagtgctgcaggactcactcgaccgctgttattcaactcctagcggctacctggagctgccggatctcggacaaccctatagcagcgccgtatactctctggaggagcaatatttaggacttgctctggatgtggaccgtattaagaaggaccaggaagaagaggaagatcagggccctccctgccctcggtag

SEQ ID NO: 232335 - DNA, 2295 bp, Artificial Sequence
  Description of Artificial Sequence: Synthetic coding sequence
atgtttagcaattctacaggtaggctgccaggtcagcccacagaggagatccagcaatataaggtcctagtgcattcacaggagcgggagttaacccagctaagggagaaattacgagaaggtagagacgcttctcgctccttgtacgagcatctgcaggcacttctgacgccagacgagcccgataagtcacaaggacaagacttgcaggaacagctcgccgaggggtgtcgtttggcgcagcatctggtgcaaaaattgagtccagaaaatgatgaggacgaagatgaggacgttcaagttgaagaggccgagaaagtactggagtcttccgccccaagagaagtgcagaaggccgaggaaagcaaggttcctgaagactccttggaggaatgcgccatcacctgtagtaattcccacgggccttgcgattccaatcagccccacaagaatatcaaaataacctttgaggaggatgaggtcaacagtacattggtggtcgacagagagtcgtcacatgatgagtgtcaagacgcccttaatatcctccccgtgcctggacctaccagcagtgctacaaacgtgtccatggttgtctctgcaggccctctgtcatccgaaaaggctgagatgaatattttagaaatcaacgaaaaactcaggccacaactggccgagaagaaacagcagtttaggaatcttaaggagaagtgcttccttacacagctctcgggatttctggctaaccagcagaagaagtacaagtacgaggagtgcaaggacctgattaagtttatgttgaggaacgagaggcaatttaaagaagagaaattggcagagcagctgaaacaagccgaagagctccggcaatacaaggtgctggttcacgctcaggaacgggagcttacccagctgaaagagaagctgcgggaggggagggacgcttcccgcagcctcaacgagcacctgcaggcgttgctgacaccatacgaaccggacaaatctcagggtcaggacctgcaggaacagttggcggagggatgcagattggcacagcacttagtgcagaagttatctcccgagaacgacaacgatgatgatgaagacgtgcaggttgaggtggccgagaaggtccagaaatcgtcagccccacgagaaatgcaaaaggctgaggaaaaagaggtgcccgaggacagcctggaagaatgtgcgatcacatactcgaatagtcacggcagctatgactccaatcagccacacagaaaaacaaaaatcacttttgaggaagacaaagtagattcgaccctcattgggagcagttcccatgtggagtgggaagacgctgtgcacatcattcctgagaatgagagtgacgacgaagaggaagaggagaaaggcccagtttccccgcgaaacctgcaggagtcagaggaggaggaggttccccaggagagttgggacgaaggctactcaactctcagcataccaccagagatgctggcctcttatcagtcttattcttcaacctttcattcactggaagagcagcaggtgtgtatggctgttgacatcggcagacataggtgggaccaggtcaaaaaggaggatcaggaggccactgggccacgactgtcacgagagctgctcgatgaaaaaggccctgaggtgctccaggactccctggacagatgctacagcactccttctgggtgcctggagctgacagattcttgccaaccataccggtctgccttctacgtgcttgaacagcagcatgttggcttggcagtggatatggatgaaatcgagaagtaccaggaggtagaagaagatcaggatcctagctgtcccagactcagccgagagctgttggacgagaaagaacctgaggtgctgcaggactctctggataggtgctactctaccccatcagggtacttggaactgccagatcttggccaaccttattcctccgctgtatacagcttggaagaacaatatctgggtttggcactggatgtggatcgcattaagaaagatcaggaggaagaggaggatcaagggcctccatgcccccgactgagccgcgagcttttggaagtcgttgagccagaggtccttcaggactccttggacaggtgctacagtaccccttctagttgtcttgaacaacccgatagctgtcagccgtacggcagcagtttctatgcactggaggaaaaacatgtcggattttctcttgacgtcggcgagatagagaagaagggtaagggaaagaaacgcagggggcgatag

SEQ ID NO: 232336 - DNA, 105 bp, Artificial Sequence
  Description of Artificial Sequence: Synthetic coding sequence
atcggatcatcatcacatgttgaatgggaagacgcagtgcacatcatccccgaaaatgagtctgacgacgaggaagaggaggagaaaggtcccgtctcaccatag

SEQ ID NO: 232337 - DNA, 2517 bp, Artificial Sequence
  Description of Artificial Sequence: Synthetic coding sequence
atggtggtatctgccggaccatggagttccgagaaagccgaaatgaacatattagagattaatgagaaactgagaccgcaactggctgagaataagcagcagtttcgaaatttgaaagaacgctgcttcctgacgcaactagcagggttcctggccaaccggcagaagaagtataaatatgaggagtgcaaagacctgatcaaatttatgctaagaaatgaacgccaattcaaggaagaaaaattggctgaacagttgaagcaggccgaagagctacggcagtataaggtactcgtgcatagtcaggagcgggagctaacacagctccgggagaagctgcgcgaagggagggacgcctcccgctcactgaacgaacatctccaagcccttctcacgcccgatgagccggacaagagtcagggacaggacctccaggagcaactcgccgaaggctgtcggctcgcacagcacttagtacagaaactgagccccgaaaatgatgaagatgaggatgaggacgtgcaggttgaggaggatgaaaaagtcctagaaagtagcgcccctcgcgaagtgcagaaagccgaagaatctaaggtgccggaggactcccttgaggagtgcgccattacctgctcgaattcccacggaccctgtgatagtattcagccccacaagaacatcaagatcaccttcgaagaggacaaggtcaatagctctctggtagttgatcgagaaagctcacacgatggatgtcaggacgctctgaatattcttccagtccccggaccaaccagtagtgcaactaacgtgtcaatggtggtgagtgccggtccacttagtagcgaaaaggcagagatgaatattctggagataaatgaaaagctgtgtccccagctcgctgaaaaaaaacagcagtttagaagccttaaggaaaaatgcttcgtcactcaggtggcgtgcttcctggccaaacagcagaacaagtataagtacgaggaatgcaaagacctgattaagtccatgctgagaaacgaaagacagttcaaggaagagaagctggccgaacagctgaagcaggcagaggagcttaggcaatataaagtgctcgttcattcgcaggagagggaattgacacagctgagggaaaagctacgggaggggagggatgcctcccgctccctgaacgagcatttgcaggctctgcttacacccgacgaaccggacaaatcgcagggccaggatcttcaggagcagctggctgaaggatgtaggctggcacaacatctggtacaaaagctctcgcccgaaaatgataatgatgacgatgaagatgtgcaggtggaggtggccgagaaggtgcagaagagttcctcgccaagagagatgcagaaggccgaggagaaagaagtgcctgaagattcattggaagagtgcgccattacctgctccaatagtcacgggccttatgacagcaatcaaccacaccgaaagccaaagtcacatctgaggaaaactaagtcaacgcagttgtcgctggctcaccccttaatgctgaatggaagaatgctctatactctgtcacagaaaatgaaggtgatgatgaggaagaggaagaaaaaaggccaatgcttgcctggcatctgcagatctctcaaacgccgaaaatcacccaggagtccaggtatgaaggtaatccgcctcagccagttcctgctcaaagggcatcgctgggaccaggtcaaaaaagaagatcaggaggctactgggcctcgtctgtctagggagcttcttgatgaaaaagaaccagaggtgctccaggattctcttgaccgctgttacagcactccatctgtgtacctgggcctgacggacagttgccagccttaccgctcagctttttacgtgttggagcagcaacgtatcggtctcgccgtagatatggacgaaattgagaagtaccaagaagtggaggaagatcaggacccatcctgccccagattgagcagggagctgctcgcagaaaaggagccagaggtccttcaagatagcctcgatcggtgttactctacgccttccggctacctagaactgcccgacctaggacagccctatcgcagcgccgtttactctctggaggagcagtatcttgggctggcactggacgtggaccggattaagaaggatcaggaagaggaggaagaccagggcccaccctgtccccgactaagcagggagcttttggaagttgtcgagcctgaagtgctccaggattcacttgatgttatccaactcctgcctgtcgttctcaattccctgacgccagcctcacctacagaagtcccatttatgcactggagaaaaaacatgctcgccttcctcctaacttgggaaaaactgaaaaggcgcggacgcggaagaaaggaaggggaggaggatcagagaaggaaggaggagggggaggaaaaaaaaggaaaaaagataaaaactcatcatgctcccggatccgccgcttgctag

SEQ ID NO: 232338 - DNA, 2373 bp, Artificial Sequence
  Description of Artificial Sequence: Synthetic coding sequence
atgttttccaactctaccgggaggcttccagggcagccaaccgaagaaatacagcaatataaggttctggtgcattcacaagaaagggaactcacgcagttaagagagaagctgagagaagggagagacgcaagtaggtcgcttaacgagcatctccaagcactgctcacacccgatgagcccgataagtctcagggccaggaccttcaagaacagctcgcagagggttgtcggctggcccaacatctcgttcagaaactatcacccgagaacgacgaagatgaggacgaggacgtccaagttgaggaagatgagaaggtgcttgaaagtagcgcccctcgcgaagtccaaaaggccgaggagtctaaggtaccggaggatagtctcgaagaatgtgctataacctgcagcaattctcatggcccttgcgactccattcagccccacaaaaacattaagatcacctttgaagaggacaaggtgaactccagcctagtcgtggacagagaatcctctcatgatgggtgccaggacgccctcaacatcttgccagtgcctgggcctacaagttccgctaccaacgtcagtatggtagtatccgccggtcctctatccagtgagaaagctgaaatgaatattctggaaatcaatgagaagctatgtccccagctggccgagaagaagcagcagtttagatcgctcaaggagaagtgtttcgttactcaggtggcttgtttcctggccaagcaacaaaataaatataaatatgaggaatgcaaggacctcattaagtctatgctgcgcaacgagcgacagtttaaagaggaaaaattagcggagcaactcaaacaggcagaggaactgcggcagtacaaagtactggtacactctcaagagagagaacttacccagctgcgcgaaaaactcagggaggggagggacgccagccggagccttaacgaacatctacaggcgttgttaactcctgacgagcccgacaagagtcagggccaggatctccaggagcaacttgcagagggatgccgcctcgcccagcatctggttcagaagctcagccccgaaaacgacaacgatgatgatgaagacgtgcaggtggaggtggccgaaaaggtccagaagagctcatccccccgtgagatgcagaaagctgaggaaaaagaagttcctgaggatagcttggaagaatgtgctattacatgttcaaacagccacgggccttatgacagtaatcagccccaccggaagacaaaaataacgtttgaggaagacaaagttgactcgactctgattggtagctcatcccacgttgagtgggaggacgccgttcatatcatccctgagaacgagagtgacgacgaagaggaggaagaaaagggcccagtcagtccacggaacttacaagagagcgaagaagaagaggtgcctcaggaatcctgggacgaaggctactctacactctcgattccccctgagagactggcttcctatcagtcatactcatccacttttcatagtttagaagagcagcaagtgtgcatggccgttgacataggaagacacaggtgggatcaagtcaaaaaagaggaccaggaggctaccggaccacgcctttcacgggagctgctcgatgagaaagagccagaagttctccaggactcactggatcgctgttacagcacacctagcgtgtacctgggcctcaccgacagctgccagccctaccgatccgccttttatgtcctggagcagcagcggatcgggctggccgtcgacatggatgagatagaaaagtatcaggaggtagaggaagaccaagacccgtcatgtccaagactgagtagggaattgttggccgaaaaggagcctgaggttctgcaggacagcctcgatcgctgttactcgacccctagtggctatcttgagctgccagacctgggtcagccctacaggagtgcggtctattctctggaggaacagtacctgggcctagccctcgacgttgaccgaataaaaaaagatcaggaggaggaggaggaccaagggcctccctgccctagactttccagggagctgctggaagttgttgaaccagaagtgttacaggactctctggacgttattcagctgctgcccgtggtgctaaatagtttaaccccggcatcccctaccgaggtcccatttatgcactggcgtaagaacatgctggcattcttacttacttgggagaaactcaaacggcgagggaggggcagaaaagaaggggaagaagaccaacggaggaaagaggaaggcgaagaaaaaaaaggcaagaaaattaagactcaccacgccccagggagcgcagcatgctag

SEQ ID NO: 232339 - DNA, 258 bp, Artificial Sequence
  Description of Artificial Sequence: Synthetic coding sequence
gagatgcagaaggctgaagagaaagaggttcccgaagactccttagaagaatgcgccattacatgctctaacagtcatggcccttatgacagtaaccagccacatcggaaaaccaaaatcactttcgaagaagataaggtcgattctactctgataggttcatcttctcatgtggagtgggaggacgccgtacatattattcccgagaacgaatcagacgacgaggaagaggaggagaagggccctgtctccccatag

SEQ ID NO: 232340 - DNA, 1101 bp, Artificial Sequence
  Description of Artificial Sequence: Synthetic coding sequence
ctggcaagttaccaatcctatagcagcacgtttcacagcttggaggagcaacaggtctgtatggctgttgacataggacgacaccgatgggaccaggttaaaaaagaagatcaagaggctactgggccacgactgagtcgggaacttctggacgagaaggaaccagaagttctccaggactccctggatcgctgctacagcacccccagtgtttacctgggtctgacggattcatgccaaccatacaggtccgccttctacgttcttgaacagcagcgcatcgggttggcagtggacatggatgagattgaaaagtaccaggaggttgaagaggatcaggacccgtcctgccctcgtctgagtcgtgagctcttagcagaaaaagagcctgaggttttgcaggattctctggaccggtgctattcaacgccctctggatacctagaactcccagatctaggccagccttaccgctccgcagtctactcactggaggagcaatatctggggctcgctcttgacgtagacagaattaaaaaagaccaggaggaagaggaggatcaaggtccaccctgcccccgtttatccagggaacttctcgaagtggtggagcccgaggtcctgcaggattccctctgctatagcactccaagttcatgcctggaacagccggactcttgtcaaccatatggctcgtcattctacgcgctggaggagaagcacgtcggattctctctggacgtgggtgagatcgagaagaaaggcaagggcaagaagcggagagggagacggtccaaaaagaagcgacgcagagggaggaaggagggagaggaagatcaaaacccaccatgccccaggctgtcaagcgttctgatggaggtggaggtgccggaggtgctgcaggactctcttgacagatattacagcaccccttccatgtactttgagttacctgactcctttcaacactatcgatccgtgttttatagctttgaagagcagcacatcagcttcgcactggacatggacaatcggttctttacacttacagtcaggtcgctgcacctggtcttccagatgggcgtgattttcccccagtag

SEQ ID NO: 232341 - DNA, 2598 bp, Artificial Sequence
  Description of Artificial Sequence: Synthetic coding sequence
atggtcgtttctgcaggaccttggtctagcgaaaaggccgagatgaatatcctcgaaatcaacgaaaagcttcgccctcagttggccgaaaacaagcagcagtttaggaacttaaaagagcgttgtttcctcacgcagcttgcaggtttcctggccaaccgccagaagaaatacaaatacgaagaatgtaaggatctcatcaagttcatgctacgcaacgagcggcagtttaaagaggagaagctggctgagcagctgaagcaagccgaggaacttaggcagtacaaggtgctagtccactctcaggaacgtgaactgacccagttacgagaaaagctcagagaggggagagatgccagcagaagtctgaacgagcacctgcaggccctcctgacccctgacgaaccagacaagtcacaggggcaggaccttcaggaacagctcgccgagggctgcaggctcgcccagcatctcgtgcaaaaactttcgccggagaatgacgaggacgaggatgaggacgtccaggtggaagaagacgaaaaggttctggagtcctcggcccctcgtgaggttcaaaaggcagaggagagcaaagtgccggaggattcccttgaagagtgtgctatcacgtgttccaatagccacggcccatgcgactccatacagcctcataagaacatcaaaattacctttgaagaggacaaggtgaattcaagtctggtagtggaccgggagagtagccatgatgggtgtcaggacgctctcaacatacttcccgttccgggaccaacttcttctgctacgaacgtgtccatggtggtttctgctggcccactgagtagtgagaaggccgagatgaatattctcgagattaacgaaaaactgtgcccccaactcgccgagaagaagcagcaattccgtagcctgaaggagaagtgctttgttacacaggtcgcatgttttttggccaagcagcaaaataagtataagtacgaggagtgtaaggatctaataaagagtatgctgaggaatgagcgacagttcaaggaggaaaaactggctgagcagctaaagcaggctgaagagctgcgacagtataaggtgttagttcactcacaggaacgtgagctgacccagctgcgggaaaaactccgggaagggcgagacgcgagccgctccttgaacgagcaccttcaggcactgttgacccccgatgagccagacaagtcgcaagggcaagacctgcaggaacagttagcagagggatgccggctggcccagcatctggtgcaaaaactgtcccccgagaacgacaacgacgatgatgaagacgtgcaggtggaggtggccgaaaaagttcagaaatcctctagccccagggagatgcagaaggcggaagaaaaggaggtgccagaggactccctagaggagtgtgctatcacatgcagtaattcccatgggccatatgattcaaaccagccccatcgcaaaactaagattacctttgaagaggacaaggttgattctaccctgatcgggagctctagccacgtggagtgggaagatgctgtccacattatccccgaaaatgaaagcgacgatgaggaagaggaggagaagggtcccgtgagtccccgtaacttgcaggagtccgaggaagaggaagtgccgcaagaaagttgggatgagggttattcaacactctcaatccccccagagagactggccagctaccagtcctattcaagcacattccactcactagaggaacagcaggtttgtatggctgtcgatattggccgacacagatgggatcaggtcaagaaggaggatcaggaggccaccggtcccagactgtccagggaactgctggacgagaaggaaccagaggttcttcaggacagtctggaccggtgctactccacacccagcgtgtatctgggtctaacagattcatgtcagccctatcgaagtgcgttctacgttttagaacagcagcgcatcggactcgccgttgatatggatgagatcgaaaagtaccaagaagtagaggaggatcaggatccatcttgcccacggctgagcagggagctgctagcagagaaggagcccgaggtgctacaggatagcctcgaccggtgctactcaactccctcagggtacctggagctgcccgacttgggacagccataccggtctgcagtgtattcccttgaagaacagtacctgggcctcgcacttgatgtggatcggatcaaaaaggatcaggaggaggaggaagatcagggtcctccttgtccgaggttgtccagggagctgctagaggtggtcgagcccgaagtgttacaagactccctggatgtgattcagttgctccccgtggttctaaactccctgactccagccagccctaccgaggtgcctttcatgcactggagaaaaaatatgctggcatttctgctgacatgggagaagctaaagcggagaggaaggggcagaaaggaaggagaggaagaccagaggcgaaaggaagagggagaagagaaaaaaggcaaaaaaatcaaaacccaccacgcgcctggatctgccgcttgttag

SEQ ID NO: 232342 - DNA, 2373 bp, Artificial Sequence
  Description of Artificial Sequence: Synthetic coding sequence
atgttcagcaactccaccggacgcctgccaggacaacccacagaggaaatccagcagtacaaagtcctggtgcattctcaagagagagagctcacacagttacgggaaaaactacgcgaggggagggacgcttcccgctccctgaacgaacacctgcaggcactcctgacaccagacgaacccgacaaatcgcagggacaggacctgcaggaacagttggcagagggctgccggctagcccagcagctggtgcagaaactgagcccggagaacgacgaagatgaagatgaggatgtccaggttgaagaggacgagaaagtgttggagtcaagcgccccacgagaagtgcaaaaggcagaggaatcgaaggtccctgaggattcactggaagaatgcgctatcacgtgctctaacagtcacggaccgtgtgattcaaaccagcctcataaaaacatcaagattacatttgaggaagacaaagtcaattcttcactggtcgtggacagggaatacagccatgatgagtgtcaggatgcgctgaacattctgcccgtgcctggcccaacttcaagtgcaactaacgtcagcatggttgtgagtgccggacctctctcctccgaaaaagctgaaatgaacatcttggagatcaacgaaaaactgaggccgcagctagcggagaaaaaacagcaattcagatctctgaaagagaagtgttttgtgacacaggtagcttgcttcttagcaaaacaacaaaacaagtataaatacgaagagtgcaaggaccttattaaaagtatgttaagaaatgagctgcaattcaaggaagagaagttagctgaacagctgaagcaggcggaggaactccggcagtataaagtgctggtgcactcccaagaaagagaactcacccagctgcgagaaaagctgcgggaagggcgtgatgcctcccggtccctgaacgagcacctgcaggctctgctgactcctgatgagcccgacaagagccaggggcaggatctacaggagcaactcgcagagggctgccgcctggctcagcacctcgtgcaaaagctgtcccccgaaaacgacaatgacgatgacgaggatgttcaggtggaggtggcggaaaaagtgcagaagtcctcttctccaagagagatgcagaaagccgaagaaaaggaagttccggaagacagtctcgaagagtgcgccatcacctgttcaaatagccatgggccttatgattccaaccagccgcatcggaagactaagatcacctttgaggaggacaaagttgacagcacactgatcggatcctctagccacgtcgagtgggaggacgcagtccacatcattcctgagaacgagtcggacgacgaagaagaggaagaaaaaggaccagtgtcaccacgtaacttgcaggaaagcgaggaggaggaggtgccgcaggagagttgggacgaaggctacagcactctcagcattccacccgagcggctggcctcataccaaagttactctagtaccttccacagcttggaagaacaacaggtgtgtatggcagtcgacattgggaggcatcggtgggaccaggtgaagaaggaagatcaggaggcgaccgggccacgcctgagtcgggagctgctggctgagaaggaacccgaagtcctccaggattcactggacaggtgctattcaaccccctcagtctatctcggcctgaccgacagttgccagccgtaccggtcggcattctacgtgctggagcagcagcgcgttggattggccgttgacatggacgaaatcgagaaataccaggaggtggaggaggatcaggatcccagctgtcctagactgtccagggagcttctcgctgagaaagagcccgaagttctacaagatagcttggaccggtgttactctaccccgagtggctacctggagttaccagacttaggacagccctaccgcagtgccgtctatagtctcgaggagcagtacctcggattagccctcgacgtagacagaatcaaaaaggatcaggaggaggaggaagaccagggacctccttgcccccgactgtcccgcgagctactggaagttgtggaacccgaagtgctgcaagactccctggacgtcatccagctgctccccgtcgtgttgaactctctaacacccgcttctcccaccgaagtccccttcatgcattggaggaaaaatatgctggcctttctgttaacctgggaaaagctaaaaagacgcggacgtggcaggaaggaaggagaagaggaccagcgcaggaaggaagaaggggaggagaagaaaggtaaaaagatcaagacccaccacgctccaggaagcacagcatgctag

SEQ ID NO: 232343 - DNA, 234 bp, Artificial Sequence
  Description of Artificial Sequence: Synthetic coding sequence
atggatgaaatcgagaagtaccaggaggtcgaggaggatcaggatccttcctgccccagactcagccgggagctgctggccgaaaaggaaccagaagttctccaggatagcctcgatagatgttactctacaccatctggttatctagaactacccgaccttggtcagccctatcgttccgccgtctattctctggaggagcaatacttaggtctggcactcgacgtagactag

SEQ ID NO: 232344 - DNA, 234 bp, Artificial Sequence
  Description of Artificial Sequence: Synthetic coding sequence
atggatgaaattgagaagtatcaggaggtggaggaggatcaggacccttcttgtcctcgtctgtcccgcgagctgctagccgaaaaagaacccgaagtgctgcaagattcactggacagatggtattccaccccatccggataccttgagcttccagatcttggacagccttaccgttccgcagtgtattccttggaggagcaatatctcgggctggctctggacgttgattag

SEQ ID NO: 232345 - DNA, 234 bp, Artificial Sequence
  Description of Artificial Sequence: Synthetic coding sequence
atggacgaaatagaaaaatatcaagaggtggaagaggaccaggacccatcctgtccccgattgtcacgggagctcctggccgagaaggagccggaggtgcttcaagacagcttggacaggtgttatagcactccatccggctacctggagcttcccgatctggggcagccttatcgatctgcagtttattcattggaagagcagtacctgggcttggcactggacgtggattag

SEQ ID NO: 232346 - DNA, 207 bp, Artificial Sequence
  Description of Artificial Sequence: Synthetic coding sequence
gaaatgcagaaggccgaggaaaaagaagtccccgaggacagcttggaagaatgcgctatcacttgcagcaattcccacggcccttatgattctaatcagccgcatcgaaaaacaaagatcacatttgaggaagataaagtggattctactctgatcggcagctctagccacgttgagtgggaggatgcagtgcacatcatcccctag

SEQ ID NO: 232347 - DNA, 9996 bp, Artificial Sequence
  Description of Artificial Sequence: Synthetic coding sequence
atggtggtctccgctggcccttggtcctccgagaaggcagagatgaacatactggagatcaatgagaaacttcggccacagctagctgaaaataagcagcaattcagaaacctcaaagaaagatgttttctgacccagctggccggattcctagccaaccggcaaaagaaatataaatatgaggaatgcaaggacctcatcaaattcatgttgcgcaacgaaagacagttcaaggaagagaagctcgctgagcagctcaagcaggctgaagaacttagacaatacaaggtccttgtgcactcacaggagcgcgaactgacccaattgagggaaaagctgagagaaggcagagatgcaagtaggagcttgaacgaacacctgcaggctctcctcacccctgacgaacccgataagtctcagggccaggatctgcaggagcagctagcggaagggtgtcgcttggctcagcaactggtacagaagctctctccagagaatgacgaagatgaagatgaggatgttcaggtggaagaagacgagaaggtgcttgagagctcagcccctcgcgaggtgcagaaagctgaagagtctaaagtccctgaagatagtcttgaggagtgcgccattacctgctctaacagccatggaccttgtgactccaatcaaccccataagaatatcaagatcacgtttgaagaggacaaagttaattccactgtagtggtagatagaaagagcagtcacgatgagtgccaagacgcgctgaatatcttgcctgttcctggcccaacctcctctgcgaccaatgtatccatggtggtttcagcaggccctttatcttccgagaaagccgaaatgaacatactggagattaacgaaaaactgcggccacagttggccgagaagaagcagcagtttcggagcttaaaggagaagtgtttcgtgacacagctcgcagggttcctcgccaaacaacagaacaagtacaaatacgaggagtgcaaggaccttattaagagcatgcttcgcaatgagttgcagtttaaggaggaaaaactggctgagcagctcaagcaagccgaagagctcagacagtataaggtcttggtgcactcacaggaaagggagctaacacaacttagagagaagttgcgcgaaggacgggacgctagccggtctttaaacgaacatctgcaggccctgttaaccccagacgagcccgacaaatcccagggacaagacctgcaggaacaactcgcagaaggatgcaggctcgcacagcacctggtgcaaaagcttagtccagagaatgatgaggacgaggacgaggacgtgcaggtggaggaggacgaaaaggtgctggaatctagctctcccagggaaatgcagaaggctgaggagagcaaggtccctgaagactccttagaagagtgcgcgatcacctgcagtaactcgcatgggccatgtgatagtaatcagccgcataaaaatattaaaataacgttcgaggaggacaaggttaactcttcattggttgtcgaccgagaatactcgcatgacgaatgtcaggatgccctgaacattctcccggttccaggcccaactagctcggctaccaacgtttccatggtcgtaagcgccggtccactctctagtgaaaaggcagagatgaatattctagagatcaacgaaaaactcagacctcaattggcggagaagaaacagcagttccgctctctgaaagaaaagtgtttcgtgactcaggtagcctgttttctcgcaaaacagcaaaacaaatacaaatacgaggaatgcaaggacttgattaaatctatgctgcggaatgaactgcaatttaaagaggaaaaactggcagagcagcttaagcaggccgaggagctgcggcagtacaaagtgctggtccactctcaggagcgtgaattaactcagttacgcgagaaacttagagagggcagagacgcatcgcgctccttaaacgaacatctgcaggctctgctcacccccgatgaaccagataagagccagggccaggatctgcaggagcagctcgctgagggctgccgcctagcccagcacctcgtacagaagttaagccctgagaacgataatgatgatgatgaggatgtgcaggtggaagtggcagaaaaagtacagaaaagctcctcaccacgggaaatgcagaaggccgaagagaaggaagtgccagaagatagcctcgaagagtgcgccataacgtgttccaacagccacggaccttacgacagtaatcaaccacacaggaagactaaaataactttcgaagaggacaaagtggacagcaccctgataggatcttcttcacacgtggagtgggaagatgccgttcacattatccctgagaacgagtcggatgatgaagaggaagaagagaaaggtccggtgtccccacggaatctgcaggagtccgaggaagaggaggtgcctcaagagtcctgggatgagggctacagcacgctctcgatcccaccagagcgcctagcctcttatcaatcctatagctcaacattccattcactggaggagcaacaggtatgcatggctgtggatattggcagcgagtactctatcgtcaaagtgattaaattgcaatttatggctcagagtcaagcaatgccagtacccacttggacagattgccacgacattgagctgaaggcaggacacagatgggaccaagttaagaaagaggatcaagaggccacagggcctcgactatcacgggaactgcttgcggagaaagagccagaggttctccaggatagcctggatcgctgttattctactcccagcgtgtacctgggactgaccgactcctgtcagccatataggagcgcattctatgtgctcgagcagcagagggtcggacttgctgtggacatggatgaaattgagaagtaccaagaggtggaggaggaccaggaccccagctgtccgcgtctcagccgggaattgttggctgaaaaagaacccgaggtgttgcaagacagcctggacagatggtatagcaccccctccggatacctcgagctgcctgacctagggcagccataccgtagtgccgtgtacagcttggaggaacagtacctgggcctcgcgttagacgtggatcgaatcaaaaaagaccaagaggaagaggaagaccaggggcctccctgcccacgactaagcagagagttacttgaggtcgtggaaccagaggttctgcaggattcactagacagatgctacagtacgcctagctcatgcttggaacagccggacagctgccagccttatcggtctagtttttacgccctggaggaaaagcatgtaggattctccctggacgtaggcgaaatcgaaaagaaggggaagggcaagaagaggagagggaggcgtagcaagaagaaacgaagaagaggcagaaaagagggagaagaagaccagaaccccccttgccccagactttccagagagcttctcgcagagaaagaacccgaagtgctccaggattctctggatcggtggtacagcactccgtccgtgtacctaggtcttactgacccgtgtcagccctaccggtctgcattctatgttctggagcagcagagggtggggctggccgttgacatggatgagatcgagaaatatcaagaagtggaggaagatcaggatcctagctgcccaagactgtcaagagagctgctagctgagaaggagcctgaagtcttgcaggactcattggaccgatggtactcaactccttctggatacctcgaactgccagaccttggccagccctacagatcggcagtgtacagccttgaagagcaatatctcggcctggctctggatgtggataggatcaaaaaagaccaggaagaagaggaagatcaggggccaccatgtccacgtttgagccgcgagctcttggaggttgtcgaacctgaggttctgcaggattcgctcgataggtgttattccactccgagcagctgtcttgagcagccagactcctgccagccctacagatcttctttttacgccttggaagagaaacacgtgggattctccttggatgtgggggagatcgagaagaagggcaaggggaagaaaaggagagggaggcggtcaaaaaaaaaacgtcgtcggggtcgcaaagagggggaagaagatcagaacccgccttgccccaggctttctcgcgagttgctggctgagaaagagccggaggtgcttcaagattcactggaccggtggtacagcacacccagtgtctacttaggactgactgacccatgtcagccgtaccggagtgccttctatgtcttagagcagcagagagtcggcctcgccgtggacatggacgagatagaaaagtaccaggaggtggaggaagatcaggacccatcctgccctcgcttaagtagggagctgctggccgagaaggagccagaggtgctccaagactccctagacaggtggtactctacaccgtccggatatttggaactgccagatctgggtcagccatacagatctgccgtctactcactggaagagcaatatctgggtctcgcacttgatgtggacagaattaagaaagaccaggaagaggaagaggaccagggtcccccttgccccagactctctcgggagctgttggaggtcgtggaacctgaggtgcttcaggactctttggaccggtgttactctaccccctccagctgcctcgagcaaccagactcttgtcagccataccgttccagcttttacgcgctggaagagaagcatgtcggattttctttggacgtgggcgagatagaaaagaaagggaagggcaagaaaaggaggggccgacggagtaagaagaagcgcaggcgaggcagaaaagaaggcgaagaagatcagaatcctccttgccccaggcttagtcgggagttactagctgagaaggaacctgaggtgctccaagattccctcgatcgatggtacagcacaccctccgtctaccttggacttacagacccatgtcagccatataggtcggctttttacgtcctggagcaacagagagtgggactggccgtagatatggacgagatcgagaaataccaagaggttgaagaagaccaggatccaagctgtccacgcctctcccgggagctgctggctgagaaagagccagaggtgctccaggattcccttgatcgctggtattcaacccctagtggctacctcgaactgcccgaccttggccaaccttatcgttccgctgtatattctcttgaagagcaatacctgggcctggcccttgacgttgataggattaagaaggaccaggaggaagaggaagaccagggcccaccttgtcctcgcctctcaagggaactgctggaagtagttgagccagaggtcttgcaggactcactcgaccggtgctacagcaccccatctagttgtttggaacagcccgatagttgccagccttatcggagtagcttctacgcactggaagaaaagcacgtggggttttctctcgacgttggggagattgagaaaaagggtaaaggcaagaagagacgaggtaggcgtagtaagaaaaaacggagacgcggtagaaaagagggtgaagaagaccagaacccgccttgtcccaggctaagtcgggaattactggcagagaaagagccagaggtgcttcaggacagcctggatcgctggtacagcacaccgagcgtctacttgggactgactgacccatgccagccctatcggtctgccttctacgtactagagcagcagcgtgtgggattggctgtggatatggatgagattgagaagtatcaggaggtggaagaagatcaagacccgagttgcccccgtttatctagggaactgttggccgagaaggagccagaggttctgcaagactcactcgatcgttggtatagcacaccctctggctacctcgagttgcctgatctgggccagccgtaccggtccgccgtgtatagcttagaagaacagtaccttggcttagcactggacgtggacaaaattgagaagtaccaggaagtcgaggaagatcaggatccctcatgtccaaggctcagccgggagttgctggccgagaaagaaccagaggttctccaggacagtctcgaccggtggtatagcactccttcagtgtacttgggcctgaccgacccttgccaaccgtatcgttctgccttctatgtgttggaacagcaaagagtcggcctcgctgttgatatggacgaaatcgagaagtaccaggaagttgaagaagaccaggatccctcgtgtcccagacttagtcgagaactgttagccgaaaaggagccagaggtcctccaagactcgctggaccggtgctattctacacccagcggctatctcgagctgcccgatctaggccagccttaccgaagcgccgtatacagcttggaggagcagtacctgggattggcgctggacgtcgatcggattaagaaggatcaggaggaggaagaggatcagggaccgccatgtcctcgtctgagtcgggaactcctcgaagtggtcgagcctgaggtactccaggattctctggatagatgctatagtacccccagctcttgcctcgaacaaccagacagctgccaaccgtaccgaagttccttctatgcactcgaggagaaacatgtcggcttcagcctggacgtgggggagatagaaaagtatcaggaggtcgaggaggaccaggaccccagttgccccagactcagtcgagagttgctcgctgagaaagagccggaggtgctccaggactcactcgatcgatggtattcaactccctctgtctacttgggtcttaccgatccctgtcaaccttaccgtagcgctttctatgtcttagagcagcagagggtggggctggccgttgatatggatgaaatcgagaaatatcaggaggtagaggaggaccaggatccgagctgccctcgcttgagtcgggagctcctggcagaaaaggaaccggaggttctacaagattccctagatcggtgttattctaccccatcggggtatctggagttgcctgacctgggccagccgtatcgttccgctgtgtactccctggaagaacagtatctgggcctagccctggacgtggaccggattaagaaagatcaagaagaggaggaggatcagggtccgccatgcccaagactgtcccgggaactcctcgaggtggtggaacccgaggtgttgcaagatagcctcgataggtgctatagcaccccgagctcttgtctggagcaacccgattcctgccagccttaccgcagttcattctacgctttagaggaaaaacatgtcggctttagcttggacgtgggagaaattgaaaagaaagggaagggaaaaaaacgcagaggtcggagatcgaagaaaaagcggagacgtggccgtaaggagggagaagaggatcagaaccccccttgccctcgtctctcaagagagctactagcggagaaagaaccggaggtactccaggacagcctggacagatggtattctaccccgtccgtgtacctgggcctcactgacccttgtcaaccctacagaagcgctttttacgtgctcgagcagcaaagggttgggctcgccgtggacatggacgagatcgagaagtatcaggaagttgaggaagaccaagatccctcctgcccacggttgagccgagagctcctggctgagaaggaacctgaggttttgcaggattccttggaccggtggtattccacgccttccgggtaccttgagttacccgacctgggccagccctaccggagtgccgtgtattccttggaagaacaatacctgggacttgctctcgacgttgacaggattaagaaggatcaagaagaggaggaagaccagggtccaccttgtcctcggttgtcccgagagctgctggaggtggtcgagccggaggtcctgcaagatagcctggacaggtgctattcgacaccgagcagctgccttgaacaacctgacagttgccaaccttatcggtcaagtttttatgcccttgaggagaagcacgtggggttctcactcgacgtgggcgaaatcgagaagaagggaaaagggaagaaacgtcggggtaggcgctccaagaagaaacggagacgcggacggaaagagggggaggaggaccagaacccaccctgccctcggctgtcgcgcgagttgttagctgagaaagaaccagaggtacttcaagactctctcgaccggtggtattccacgccatcagtctacctaggtctgacggacccatgtcagccatatcggtccgcattttatgtgctcgagcagcaaagggtcgggctggccgtcgacatggatgagatcgaaaagtaccaggaagtcgaggaagatcaagatccgtcttgcccgaggctgagtcgcgaactgctggcagaaaaggaacctgaagtgctgcaggattctttggatcgatgctactctacaccttcaggctacctcgagctccctgatctgggacagccctaccggtccgctgtttattcccttgaggagcagtacctgggcctcgctctggacgttgatcgcatcaagaaggaccaagaagaggaggaagatcagggcccaccttgtccacgtctttctagggagttgctggaagtcgtcgagcctgaggtgctgcaggattcattggacaggtgctattctacccctagctcctgtctcgagcaacctgactcctgtcagccgtaccggagttcattctatgccctggaggaaaaacacgtggggttcagtctggatgtcggagaaatagaaaagaaaggaaagggcaagaagcggagaggccgaaggagcaagaagaaacgacgcagggggcgtaaggagggggaggaggatcagaatccaccctgtcctcgactgtctcgggagcttctggccgagaaggagcctgaggtgctgcaggatagtttggaccgctggtatagtacaccatccgtttacctgggccttactgacccttgtcaaccttgcaggtccgcgttctacgtcctggaacagcagcgagtcggcctggctgtcgacatggacgaaatcgaaaaataccaggaagtggaagaggatcaagacccctcgtgtcctcggctgagcagggagctcttagccgagaaagagccagaggtcctgcaagacagtctggatagatgctattccacaccatcaggctatctcgaactgccagacctcggccagccttaccgcagcgccgtctattccctggaggagcagtaccttggactggctctggatgtagacagaattaaaaaggaccaagaggaagaggaggatcaggggcctccgtgtcctcggctctcacgcgaattgttggaggttgtcgaacccgaggtcctgcaagatagccttgatcgttgctattcaactccaagctcttgtctggagcaacctgactcgtgtcagccatatcgtagctcattctatgcattggaggagaaacacgttggattcagccttgatgtgggcgagatagagaagaaaggtaaaggtaaaaagagacgaggtcgcagaagtaaaaagaagaggagacgcggtcggaaagagggggaggaggaccaaaatccaccttgtcccaggctcaactctgttctgatggaagtcgaggagccggaggtgttgcaggactccttggatagatgctactcaaccccttctatgtacttcgaattaccagattcgttccagcattatcgttcagtgttttacagtttcgaggagcagcatatcaccttcgcattagacatggataacagtttctttaccctaacagtgacctcgctgcatctcgtttttcaaatgggagtgatctttccacagtaa

SEQ ID NO: 232348 - DNA, 234 bp, Artificial Sequence
  Description of Artificial Sequence: Synthetic coding sequence
atggacgagatcgagaaataccaagaggtcgaagaagatcaggaccccagctgccccaggttatctagggagctgttagctgaaaaagagcccgaggttctgcaggactccctagatcgttgctactcaactccatctggctacctcgagttgcccgatctgggccagccctaccgatcggccgtttatagcctcgaagagcagtacctggggcttgcccttgacgtggactag

SEQ ID NO: 232349 - DNA, 2517 bp, Artificial Sequence
  Description of Artificial Sequence: Synthetic coding sequence
atggttgtgtcagccggtccgtggagctcggagaaggctgagatgaatatcctggaaatcaatgaaaagctgcgtccacagcttgcggaaaataaacaacagtttcgcaatttaaaggaaagatgcttcttgactcagcttgctgggttcctggctaatcgtcagaagaagtacaaatacgaagagtgcaaggacttgattaaatttatgttaaggaatgagcgccaatttaaggaggagaagctggctgaacagctgaagcaagctgaggagcttaggcagtacaaagtccttgtgcacagccaggaacgtgagcttactcaactaagggaaaagctacgggagggacgcgatgcctccagaagcctcaacgaacacctgcaagctttgttaactccggacgaacctgacaaatctcaaggccaggacttgcaggagcagttagcagagggatgccgtctggcccagcagttggtgcagaagctgtctcctgagaacgacgaggacgaggatgaggacgtacaggtcgaggaggacgagaaagtgctggagtcctctgctcccagggaagtgcagaaggcggaagaaagcaaagtacccgaggactcactggaagaatgcgccattacatgtagtaatagccatggcccatgcgactccaatcaaccccataaaaacattaagatcacatttgaagaagacaaagtgaacagttccctggtggtcgatagagaatatagccatgacgaatgtcaggacgctctcaatattttacctgtgccgggacccactagttcagctacaaacgtgtcaatggtcgtgagtgctggccctctgtcgtctgagaaagcggagatgaatatactcgaaatcaatgagaagcttcgtcctcagctcgcggagaagaaacagcaatttcgctctctgaaagagaagtgctttgttacccaggtggcctgctttctggcaaaacagcaaaacaagtataagtatgaggaatgtaaggacctgattaagagtatgctcaggaatgaactgcaatttaaagaggagaagctggctgaacaattaaaacaggctgaagagctccggcagtacaaggtgctggtacacagtcaggagcgggagcttacacagctgcgggaaaaactgcgcgagggaagggacgcttccaggagcctgaatgagcaccttcaagcacttctgaccccagatgaaccagacaagagccagggccaggatctacaggagcaactggccgagggctgtagacttgcccaacacctggtacagaagctgtcccctgagaatgacaacgacgatgatgaggatgtgcaggtggaggtggccgaaaaggtgcagaagtcatctagccccagagagatgcagaaagcagaggagaaagaagtgccggaagactcgcttgaggaatgtgctatcacctgctctaactcccacgggccttatgatagtaatcagccccaccgcaagccaaagagccacctgcgcaagacaaaatccacacagctttcacttgcgcatcccctaatgctgaatggcaggatgttgtacacactttcacagaaaatgaaggtgatgatgcgtaaacggaagaagaagggacaatgtctgcctggcatctgtcggagtcttaaaaggcggaagtcccctcgatcgccaggaatgaaggtgatccgcttatctcaattcttgttgaaaggacaccgctgggaccaggtgaaaaaagaagaccaggaggcaactgggccacgcctctcccgggaattactggccgagaaagaaccggaggtgctccaggactcccttgaccgttgttacagtacaccgagcgtctatctgggtcttacggacagctgtcaaccctacaggagtgctttctacgtgttagaacaacagagagtcgggcttgctgtggacatggacgaaatcgagaaatatcaggaagtggaagaagaccaggatccatcttgcccccgattgtcccgggagctgctggcagagaaagaaccggaggtcctccaagactcccttgatcgctgttattccactccttccggttatctggagctgcccgatctcgggcagccttatcgaagcgctgtgtacagtttggaagagcagtatctcggactggcactcgacgtagatcggatcaagaaagatcaggaggaggaggaagaccagggcccaccttgtccaaggttgtctcgcgagctgctcgaagtagttgaacctgaagtgctgcaagatagcctggacgttatccagctgctgccggtggttctcaactctctgacccctgctagccccactgaggtcccctttatgcattggcgcaagaacatgctggcctttctcctaacgtgggagaagcttaaaagaagagggcgtgggagaaaagagggcgaggaggatcaacgcaggaaggaagaaggagaggagaagaagggtaagaaaataaagactcatcatgcacctgggtctacagcatgctag

SEQ ID NO: 232350 - DNA, 288 bp, Artificial Sequence
  Description of Artificial Sequence: Synthetic coding sequence
atcgccgagatcgagaaataccaagaagtggaggaagatcaggatcccagctgtccccgactcagcagagaactgctggcagaaaaggaaccagaagtgttacaggacagccttgatcggtggtatagtacaccatctgggtatctcgagctaccagatctgggtcaaccttaccgcagtgccgtgtattctctagaagagcaatacctgggcttggcattggatgtggacaagatcgaaaagtaccaggaggtcgaggaggaccaggacccctcctgtccacgctag

SEQ ID NO: 232351 - DNA, 234 bp, Artificial Sequence
  Description of Artificial Sequence: Synthetic coding sequence
atggatgaaattgagaagtatcaagaagtggaagaggaccaagacccgtcgtgtccacggctgtctagagaactgctggctgaaaaggaacccgaagtgctccaggactcactggacaggtgttactccaccccaagcggctacctcgagctacccgacctcgggcaaccataccgttccgctgtgtactcgctggaggagcagtatcttggtctggccttggacgtcgactag

SEQ ID NO: 232352 - DNA, 2784 bp, Artificial Sequence
  Description of Artificial Sequence: Synthetic coding sequence
tgagaccttataaaatcaatgctgcgcaatgagcggcagttcaaggaagaaaaactggccgagcagctgaagcaggctgaggagttaaggcaatataaagtcctggttcatgctcaggagcgggaactgactcagttgcgagaaaagttacgggaggggcgagacgcctctcggagcctcaatgagcacctccaagccctcttgactccagatgagccggacaagtcacagggccaggatttacaggagcagctcgctgagggctgcagacttgcacagcaccttgtgcaaaagctgtcgccggagaatgataatgatgacgatgaagacgtacaggttgaggtcgctgagaaagtgcagaagtcttcagctccacgcgaaatgcagaaggcagaggaaaaggaggtgcccgaggactctttagaagagtgcgctatcacctgttcaaactctcacggaccctacgacagcaaccagccccatagaaagaccaagatcacatttgaggaagataaggtcgacagcaccttaattgggtccagcagtcacgtggagtgggaggacgctgtgcacatcattcctgaaaatgaatctgacgatgaagaagaggaggagaaagggcctgtgagccctaggaatcttcaggagtccgaagaggaagaggtaccccaggagtcttgggatgagggctacagcactttatccattccaccagaaatgctcgctagttacaagagctattcttctactttccactcactcgaagaacagcaagtgtgtatggcggttgacatcggcagacaccgctgggaccaggtaaaaaaggaagatcatgaggccaccgggcctcgcctgagccgcgaactgctcgacgagaagggcccagaggttctccaggactctctcgaccggtgctacagtacgccatccggctgccttgaactcacagactcttgtcagccctatagatcagcattctatgtcctggagcagcagcgtgtgggcttggcagtaaacatggacgagattgaaaaatatcaggaggttgaggaagaccaggacccaagttgccctagactaagcagggaactcttggacgagaaagagcctgaagtgctgcaggattccctgggacgctgctattcaactccctctggatacttggagctgcccgacctggggcagccctactcatccgcggtctattctctggaggagcagtatctggggcttgctctggacgtggacagaattaagaaagatcaggaggaggaagaggaccaaggccctccctgccctcgtttatccagagagctactggaagtggtggaacctgaggttctgcaggactccctggataggtgttactcgaccccttcatcatgcctggaacagccagatagctgccagccctacggatcaagcttctatgctttagaggagaaacatgtggggttttcactggacgtgggtgagattgaaaagaaaggtaaaggaaagaagcgtcgagggcgaagaagtaaaaaagagaggcgccgaggacggaaggaaggagaggaagatcaaaacccgccatgcccaagactctcccgggaactactggatgaaaaaggccctgaggtgctgcaggactcgttggatcgctgctattctactccttcgggatgtctcgagttgaccgactcttgtcagccatataggtctgctttttatatcctagagcagcagagggtgggactggccgttgacatggacgagatcgagaagtaccaagaggtggaagaagaccaagacccgtcgtgtcctcgtctctccggggaactgctggacgagaaagagcctgaggtcttgcaggagagtctagacagatgctacagcacccccagtggctgtctggagctgacggactcttgccaaccttatcggagcgctttttatatcttggaacaacaacgagttggcctggcggtggacatggatgaaatcgagaaataccaagaagttgaagaggatcaggacccctcatgcccgagactttccagggagctccttgacgagaaagagcccgaggtgctccaagacagcctgggaagatgctactccacccctagcggctacctggagcttcctgaccttgggcagccgtacagctccgcagtttacagtttagaagaacagtaccttgggctggctcttgacgtggacaggattaaaaaagaccaggaggaggaggaggaccagggacccccatgtcctcggctgtccagggaactgttagaagtggtcgagccggaagtgttacaagactcactcgatagatgctacagtacgccctcctcttgtctggagcagcccgacagttgccagccgtatggcagctccttttacgcattggaagagaagcatgtaggattttctctggacgttggcgagatcgaaaaaaagggcaaaggcaaaaagcgacgagggaggcgttctaagaaggaacggagaagaggcagaaaagagggagaagaagatcagaaccccccatgccctagactgaactctatgttgatggaagtggaggaacctgaagtattgcaggacagccttgacatctgttatagcacccccagtatgtacttcgagctccctgactcatttcagcattaccgctccgtgttctattctttcgaagaagagcatatatccttcgccttgtacgtggacaacaggtttttcacactgacagtgacctctcttcacttggtctttcagatgggcgtgattttcccacagtag

SEQ ID NO: 232353 - DNA, 2766 bp, Artificial Sequence
  Description of Artificial Sequence: Synthetic coding sequence
atgctgcggaacgaacggcagttcaaagaagaaaagttggcagaacagttgaagcaggccgaggagctcaggcagtacaaagttcttgtgcacgcacaagaaagggaactgacacagctgcgcgagaaactacgtgagggtagggacgcatctagatccctaaacgagcatctccaggccctcttaacccccgatgaacctgataagagccaggggcaggacctgcaagaacaactggccgagggatgccggctggctcagcatttagtgcagaagctgtccccggagaacgataatgatgacgacgaagacgttcaagtggaggtggccgaaaaagtgcagaaatcatcagcacctcgagagatgcagaaggctgaagaaaaagaagtccccgaggattctctggaggagtgtgctattacctgtagcaattcacatgggccttatgacagcaaccaaccacaccggaaaaccaagatcaccttcgaggaggataaggtggattctacactgatcggaagctcttcccacgtagagtgggaagatgccgttcatattattccagaaaatgaatcagacgatgaagaagaggaggagaaagggccagttagtccccgtaatctccaggaaagtgaagaagaggaggtgcctcaagaatcctgggacgagggctactccaccctcagcatccctccggagatgttggcctcctacaaaagttacagctccactttccattccctggaagagcagcaggtgtgtatggccgtggatataggacgccaccgttgggaccaggtgaagaaagaggaccatgaggcaactggtcccaggttgagccgcgagctgcttgacgagaaggggcctgaagtgctgcaggattcacttgatcggtgttacagtacaccatctggttgtcttgagttgacggatagctgccagccctaccgatctgccttctatgtactggaacagcagcgcgtcgggcttgccgtgaacatggacgagatcgaaaaatatcaggaggttgaggaagatcaagatcccagctgccctcggctcagtagagagctgctggatgaaaaagagccggaggtgttgcaggattccctgggtcgttgttactcgacaccatccggatacttggagttgcccgacctgggccagccatattccagcgctgtgtattctctggaggagcagtacctaggcctcgccctggatgtggacagaatcaagaaggatcaagaggaggaggaggaccagggccctccgtgcccacggctgtctagagaattactggaagtggtggaacctgaggtgcttcaggacagccttgatcggtgctattccacaccctcctcctgtcttgaacagcccgactcttgccaaccgtacgggtcttccttctacgctctcgaagaaaagcacgtgggcttttctctggacgtcggagaaattgaaaaaaaggggaagggcaagaaaaggcggggacgccgaagcaagaaggagcgcaggcgcggaaggaaggagggcgaagaggaccagaaccccccatgccccagattgagcagagagctcttggacgaaaagggcccagaggttctccaggacagcttggacaggtgttatagtaccccatcaggatgtctcgaactgacagattcctgccagccctaccgctcagcattttatattttggagcagcaacgcgtcgggctcgccgtggacatggacgaaatcgagaaatatcaggaggtcgaagaggatcaagatcctagctgccccagactgagtggagagctgcttgatgagaaagaaccagaagtgcttcaggagtcattggaccgctgttactcaacgcctagcggatgcttggagctgaccgactcctgtcaaccttatcgcagcgctttctacatccttgaacagcagcgcgtgggcctggcggtagacatggacgagattgaaaaataccaggaggtggaggaggaccaggacccttcctgtcctaggctgtcccgggaactgctggacgagaaggaaccggaagttctgcaggattccctggggaggtgctactcaactccatccggatatctggagctgcctgacttaggacagccatattcttctgctgtgtactccttagaggaacagtatctcggactcgctttggatgtggatcggatcaagaaggaccaggaggaagaagaagatcaaggacctccctgtcccagactgagtagagagctgttggaggtggtcgagccagaagtactgcaagattcgctggaccggtgttactccaccccctcttcctgtctggagcaacctgacagttgccaaccctacgggagcagcttttacgccctggaggaaaaacacgtcggattctctctggatgttggagagatagaaaagaaaggcaagggcaagaagcggcgtggacggaggtcaaagaaagaaaggcgtcgaggaaggaaagaaggcgaggaagatcagaaccccccttgcccgaggctgaatagcatgttaatggaagtggaggaacccgaagttctccaggattccctggatatctgctactccactccatcaatgtactttgaactgcccgacagctttcagcattatagatcagttttttacagttttgaagaggaacacattagctttgccctgtatgtggacaacaggttcttcacccttactgtgaccagtctgcatctggtattccagatgggggtaatctttcctcaatag

SEQ ID NO: 232354 - DNA, 810 bp, Artificial Sequence
  Description of Artificial Sequence: Synthetic coding sequence
atggacgagattgaaaagtaccaagaagtagaggaggatcaagacccttcatgccctcgcctgtctcgtgagctgctagacgagaaagagccggaagttctgcaggattctctgggcaggtgctactcgactcctagtggatacctcgagctgccggatctcggacaaccctactcgtcggccgtctactcactggaagaacagtaccttggcttggctcttgatgttgacaggattaagaaggatcaagaggaggaagaggaccaaggcccaccttgtcctcgactgtcacgcgagttactggaggtggtggagcctgaagtcctgcaggatagcctggatagatgctatagtaccccaagcagctgtctggaacagccggatagttgtcagccttatgggagtagcttttacgcgctggaggagaaacacgtcggcttcagcctcgacgtcggagagatagagaagaagggaaagggaaagaagaggcggggtaggaggtccaagaaggagaggagaaggggcaggaaggagggcgaagaggaccagaacccgccttgccccaggctgaatagcatgctgatggaggtcgaggagcctgaagtccttcaggacagtttggatatttgctatagtaccccttctatgtactttgaactgcccgattcattccagcattataggtccgtgttctattcctttgaagaggagcacatcagtttcgcgctttacgtcgataatcgattctttacactgaccgtgacttccctgcaccttgtgttccaaatgggggtgatcttcccacaatag

SEQ ID NO: 232355 - DNA, 1539 bp, Artificial Sequence
  Description of Artificial Sequence: Synthetic coding sequence
tgatatgaggaatgcaaagacctcattaaatcaatgcttcgcaacgaaaggcaattcaaggaggagaaactcgccgagcagctgaagcaagctgaggagctgcggcaatataaggtattggtgcacgcccaggagagggaactgacacagctgcgcgagaaactgcgtgagggaagagatgcctctagaagtctgaacgagcacttacaggcgttgctaactcccgacgagcccgacaagtctcagggccaggaccttcaggaacagctggccgaagggtgccggctggcccagcacctggtccagaagctctccccagaaaacgacaacgatgatgacgaggacgtccaggtcgaagtggccgagaaggtccaaaaatcctcagccccacgcgagatgcagaaggccgaggagaaagaagtgccggaagatagcctagaggaatgtgcgatcacttgttctaactcccatgggccatatgactccaatcagccccacaggaagaccaaaatcacttttgaggaggataaggtggattccaccctcatcggttcaagttcccacgtcgaatgggaggatgctgttcatatcatacctgagaacgagtcggacgatgaggaagaggaggagaaagggccagtctccccaagaaatctgcaagagtcagaggaagaggaagtgccccaggagtcctgggatgaagggtactccaccctttctattcctcctgagatgctcgccagctataagtcctacagcagcactttccactccctagaggaacagcaggtgtgcatggccgtagatattggaagacaccggtgggatcaggttaaaaaggaagatcacgaagccacaggtccgcgtctgagtcgcgagctgctcgatgaaaaggggcctgaggttctacaggattcacttgaccggtgttatagcacaccaagtggatgcctggaattaactgattcatgccaaccttacagatccgcattctacgtgctggagcagcagcgtgtgggcctcgccgtaaatatggatgagatagaaaagtaccaagaggttgaggaggaccaggacccttcctgtccacgcctgtcccgggaattactcgatgagaaggaacctgaggtcttgcaggatagcctgggtagatgttactccacccccagtgggtacctggagctgcctgacctcggccagccatatagctcagccgtgtattccctggaagaacagtacctcggtctcgccctagacgtagaccgaatcaaaaaggaccaggaagaggaggaggatcaggggcctccttgtcctagactgtccagggagctactcgaggttgtggaaccagaggtgctgcaagatagtctcgacagatgctacagcacccctagctcttgcctagagcagcccgatagttgccaaccatacggctctagcttctacgctctggaggagaagcacgtgggatttagcctggacgtaggggaaatagaaaagaagggtaaaggcaagaaaagacgcggtcggagaagctag

SEQ ID NO: 232356 - DNA, 567 bp, Artificial Sequence
  Description of Artificial Sequence: Synthetic coding sequence
atggatgagattgagaagtatcaggaagtcgaggaagatcaggacccttcctgccctcgcctctccagggagctgcttgacgagaaagaacccgaggtgctgcaggactcacttggtcgttgttattccactccttccgggtacctcgaattgcccgatctcgggcagccgtacagtagcgccgtctatagcctcgaggaacaatatctcggcctcgcactggacgttgacaggattaagaaggaccaggaagaagaagaggaccagggtcctccatgcccaagactgtctcgagagttactggaggtggtggagcccgaggttttacaggactccttagaccgatgctactccactcctagctcttgtctcgaacaacccgacagttgccaaccttatggcagttcattctacgctttagaggagaagcacgtgggtttttcactggacgtcggagaaatcgagaaaaaaggtaaggggaaaaaacgacggggtcggaggtccaagaaagagaggagacggggaagaaaggagggagaggaagaccaaaatccgccttgtccctag

SEQ ID NO: 232357 - DNA, 1539 bp, Artificial Sequence
  Description of Artificial Sequence: Synthetic coding sequence
tgatatgaggaatgcaaagaccttatcaagtcgatgctgcgtaatgaacgacagttcaaggaagagaagctggcagaacagcttaaacaggccgaggagttgcggcagtacaaggtactcgtgcacgcacaggagagggagctcactcagttgagggaaaaactaagggaaggcagagatgcatctcggagcctgaatgagcacctgcaggccttgctcacacctgacgaacccgataaaagccaaggtcaggacctccaagagcagctggctgagggctgtcgactcgcgcaacacctcgttcagaagctgagtcccgagaatgacaacgatgatgacgaagatgtacaggtcgaggtggccgagaaggtgcagaagagtagcgccccacgtgaaatgcagaaagcggaggaaaaagaggtccctgaagactctttagaggagtgcgcaattacgtgttctaattcacatggcccatatgattccaaccaacctcatcgaaaaaccaaaataacgtttgaagaagataaggttgatagtacgctcattggttcgagcagtcatgtagagtgggaggatgcagtccatatcattccagagaacgagtctgacgacgaagaggaagaggagaaggggccagtctcccctaggaacctgcaggagagtgaagaggaggaagtgccacaagaatcctgggatgaagggtatagcacactgtctataccccctgaaatgctggcatcatataagagctactcttcaacatttcatagccttgaggagcagcaggtgtgcatggcagttgacattggccgtcatagatgggaccaggtgaagaaggaggaccatgaggccactggccctcggctctcccgggagctgttggatgagaaagggcctgaagtactccaggactctctggatcgctgctatagtactccaagcggttgtctggagcttactgattcgtgccaaccttatcgttccgcattctacgtgctagaacaacagcgcgtcgggttagcagtgaacatggatgagatagaaaaatatcaggaggtggaggaagatcaagaccctagctgtcctaggctcagtcgggaactgcttgatgagaaggagccggaggtgttgcaagattccttggggaggtgctactcgactccctcgggctatctggaactgcccgacctgggccagccatacagcagcgccgtctacagccttgaggaacaatacctcggcctggcacttgacgtcgaccggataaaaaaagaccaggaggaagaagaggaccagggcccaccctgtcctagactgtctagagagctattggaggtcgttgagcctgaggtcttgcaggactctctggatcggtgttacagcacacccagttcatgcctcgaacagcccgactcttgtcagccatacggttccagtttctatgcgttagaagaaaagcatgtgggctttagtctggacgtgggagagatcgagaaaaaggggaagggcaaaaagcggagaggccgtcgtagctag

SEQ ID NO: 232358 - DNA, 1539 bp, Artificial Sequence
  Description of Artificial Sequence: Synthetic coding sequence
taatacgaggagtgtaaggacctgataaagtccatgttacggaacgaacggcagtttaaggaagaaaagctggcagagcagctcaaacaggcagaggagctgaggcagtacaaagttctggtccacgctcaggaacgggagttaactcagctacgtgagaaactgcgcgagggccgtgatgccagtaggtcactgaacgagcacctgcaggccctgcttacaccagacgagccagacaaatctcagggtcaggacctgcaagaacaacttgcggagggctgtaggctggcacagcacctggtccagaaattatcccccgaaaatgacaatgacgatgatgaagatgttcaggttgaggtggccgagaaggttcaaaagagttctgcccctcgcgaaatgcagaaagcagaagagaaggaggtccctgaagattctctggaggagtgcgctatcacatgctctaattcccacggcccatatgactccaatcaaccccatcgcaaaactaaaatcactttcgaagaagataaggtggacagcacactgatcgggagcagctcccatgtggaatgggaggatgccgtgcacattatccccgagaatgagagcgacgatgaggaagaggaagagaagggtccagtttctcctcggaatctgcaggagtcggaagaagaagaggtgcctcaggaatcttgggacgaaggctacagcacactgtctatcccccctgaaatgttagcgtcatataaaagttattccagtacgtttcactccctcgaagaacaacaggtttgtatggcggtcgacataggtcgtcataggtgggatcaggtcaaaaaggaggatcacgaagctacagggcctcgactttcccgggaacttctggacgaaaaaggccctgaagtcttacaggactcgctggacagatgctacagcactccaagcgggtgcctcgaactcaccgactcctgtcagccttataggtctgcattttacgtccttgaacaacagcgagtggggctggcagtcaacatggacgaaatcgaaaaataccaggaagtggaggaagaccaagatccttcttgccctcgcctgtcccgcgagttgttggacgaaaaggagcctgaagtccttcaagatagcctcggccgttgctattcgacaccctccggttatctcgagttgcctgacctggggcagccatattcctctgccgtgtattccttggaagagcagtacctgggcctggccttggatgtggataggatcaaaaaggatcaggaggaggaagaggatcagggcccaccttgcccccgactgtctagggagttgttagaagtagtggagcctgaggtactgcaggactctctggacagatgttacagcaccccttccagttgcctggaacaacctgatagctgccagccatacggctcttctttctatgccctggaggaaaaacacgtcgggttctccctggatgtcggcgaaatcgaaaaaaagggcaagggaaaaaaacgcagggggcgaaggtcctag

SEQ ID NO: 232359 - DNA, 753 bp, Artificial Sequence
  Description of Artificial Sequence: Synthetic coding sequence
gaaatcgaaaaataccaggaagttgaggaggaccaggatccatcttgccctcggctgagtcgcgaactgctggatgaaaaggaacccgaagtgcttcaagactctctcgggagatgttactccaccccctccggctaccttgaattacctgatctgggacagccctattcatccgcagtgtactcactggaggagcagtatctgggtttggccctggacgtcgaccgcattaaaaaggaccaggaggaggaggaggatcaaggcccaccatgccctaggctgtctagggaactgctggaggttgtcgaacctgaggtcctgcaagattctctggacagatgttactccactccgagttcatgtcttgagcagccagacagctgccagccgtatgggtcttcattctatgcactcgaagagaaacacgtgggcttttccctggatgtgggggagatagagaagaaaggcaaggggaaaaagcgtaggggacgacgcagtaaaaaggaacgtcgccgaggtcggaaagagggcgaggaagatcaaaatccaccatgcccaagactctctggagagctgctagatgagaaggaaccagaggtgttacaggagtccctggacagatgttatagcaccccatcaggatgcctagagctcacagactcctgccagccctacaggtctgctttctatattctcgagcagcagagggtaggattagccgtagatatggacggagagtacctgagcatgtag

SEQ ID NO: 232360 - DNA, 1539 bp, Artificial Sequence
  Description of Artificial Sequence: Synthetic coding sequence
tgatacgaagagtgtaaagacctcattaaatcaatgctcaggaacgaaagacagttcaaggaggaaaaactggcagaacagttaaaacaggccgaggagctgaggcaatacaaggttttagtccatgcccaggagcgggaactgacacagttgagagagaagctgcgcgaaggacgtgacgcctctagaagtctgaacgaacatctccaggcactgctgacacccgacgaaccggacaagagccagggccaggacctgcaagagcagctagccgaagggtgcaggttagcccagcacttagtccagaaacttagtcctgagaacgacaacgacgacgatgaagacgttcaagtggaggtggcagagaaggtacagaaatcctccgccccaagagaaatgcagaaagccgaagagaaagaagtacccgaagactcccttgaagaatgtgccataacttgttccaacagtcatgggccatatgactccaaccagcctcaccggaagaccaaaattacattcgaggaggataaggtcgactcgactcttatcggtagttccagccacgtggaatgggaggatgcggtgcatatcatacccgagaatgagagcgatgacgaggaagaggaagagaaagggccagtctcccccaggaacttacaggaaagcgaagaggaggaggtcccccaggagagctgggatgaggggtattcgactctgagcatcccaccagagatgctcgcgtcttacaaaagctacagttctactttccactcactcgaggaacagcaggtgtgcatggcagtcgacatcgggagacataggtgggatcaagtcaagaaggaggatcacgaagcaacgggtcctagactttctagggagctgttagacgaaaagggtcctgaggtgctgcaggattcattggatcgatgttatagtacaccaagcgggtgtcttgaactgacagactcatgtcaaccctacagaagtgcattttatgtcttagagcagcagcgagtagggctcgcagtgaatatggacgagatcgagaagtatcaggaagttgaggaggatcaggatccttcctgtccccgactttctcgggagctcctcgatgagaaggagccagaggtgttgcaggactctttagggcgatgctattcaacccccagcggctacctggaactacccgacctcggtcagccatattcttccgctgtttattctttggaggagcagtacttgggattagctttggatgttgataggatcaagaaagatcaagaggaggaagaggatcagggaccaccatgccccaggctgtcgcgcgaactgttggaggtagtggaacctgaagtgctacaggactcactcgaccggtgctattcaacacccagcagctgtctagagcaaccagactcctgccaaccctacgggtcaagtttctacgcacttgaggaaaagcacgtggggtttagtctcgacgtgggtgagatcgagaagaagggaaaaggcaagaaaagaagaggcagacgctcttag

SEQ ID NO: 232361 - DNA, 1539 bp, Artificial Sequence
  Description of Artificial Sequence: Synthetic coding sequence
tgatatgaagagtgcaaagatctgatcaaaagcatgcttagaaacgagagacagttcaaggaagagaagttggccgaacagctcaaacaagcggaagagctcaggcaatacaaggtcctggttcacgcgcaggagcgggaactgactcagcttagggagaaattgagggaggggagagacgcttcaagaagccttaatgaacatctgcaggcgctgctcacgcccgacgagcccgacaagtctcaaggacaggacctgcaggaacagcttgcagagggatgtagacttgcgcagcaccttgtccagaagctgagccctgaaaatgataacgacgatgacgaggatgtgcaagtggaggtggctgagaaagtgcaaaagagcagcgcccctcgggagatgcagaaggccgaagagaaagaagttccagaggactctctggaggagtgtgcgattacatgctccaatagtcatggaccctacgactccaaccaaccccatcgtaaaaccaaaatcaccttcgaagaggacaaggtggattcaactttgatcgggagctcctcacacgtcgaatgggaggacgcagtccacatcatacccgaaaacgaatccgacgacgaggaggaggaagaaaaaggacctgtgagcccgagaaatttacaggagtccgaagaggaagaagtgcctcaggagtcttgggatgaaggatattctaccttgagcatcccacccgaaatgcttgctagctataagtcctacagctctacgtttcactctctagaggaacagcaggtctgtatggccgtagacatcgggagacataggtgggatcaggttaaaaaggaggaccacgaagcgaccggcccacggcttagcagggaactgctggacgaaaaggggccagaggtgcttcaagactccctggacaggtgctactctacacccagcggctgtttggaactcacggatagctgtcagccctatcgctctgctttctatgtgcttgagcaacaacgagtgggcctggctgtcaatatggacgagatcgagaaataccaggaggtagaggaagaccaagacccctcttgccccaggttgtctcgcgagttgttggatgagaaggaacctgaggtactgcaggatagccttggacgctgttactctactccatccggttatttggaattacccgacctggggcagccatactcatcagccgtttatagtctggaggaacagtatctgggcctcgcattggacgttgacagaattaaaaaggatcaggaagaggaggaggaccagggtcctccctgcccaaggctgtccagggagctgcttgaggtggttgagcctgaagtgctccaggactccctggaccggtgttacagcacccccagctcttgcctcgagcagcccgacagttgtcaaccctacggatctagcttttatgccctggaagaaaaacacgtgggtttcagcctggatgttggcgaaattgagaaaaagggtaagggtaaaaaaaggcgcggaaggagaagctag

SEQ ID NO: 232362 - DNA, 1539 bp, Artificial Sequence
  Description of Artificial Sequence: Synthetic coding sequence
tagtacgaggagtgtaaggacttgatcaaatcaatgctgagaaatgaacgccagtttaaggaggaaaagctagccgagcagctcaagcaggccgaggaacttaggcagtataaagtacttgtgcacgcacaggagagagaactgacccagctgcgagaaaaactcagggaaggcagggatgccagccgttctctcaatgaacaccttcaggccttgctaaccccggacgagcctgataaatctcaggggcaagatctccaggagcaattggcagagggttgccgcctggctcagcacttggtgcagaaattaagtcctgaaaatgataacgatgatgatgaggatgtccaggtggaggtagccgaaaaggtccaaaagtcatctgcaccgagggagatgcaaaaagccgaggaaaaagaagttcccgaggatagcttggaggagtgcgctataacctgttcaaactcccatggcccttatgattcaaaccagccacacagaaagactaagattactttcgaggaagacaaggtggacagcacattgatcggctcctcctctcacgtagagtgggaagacgctgtccacatcattcccgaaaatgagagcgacgacgaggaggaggaggaaaagggcccagtatctcctcgcaatctacaagaaagcgaagaagaggaggtgcctcaggagagctgggacgaaggctactctacactgtcaatacctcccgaaatgctggctagttataaatcctactctagtacattccactctttggaagaacaacaggtatgtatggccgtggacatagggagacacaggtgggaccaggtcaagaaggaggaccatgaagccactggaccgcgactgagtcgggaactgctcgacgaaaaaggaccagaagtgttgcaggacagcctagaccgctgttatagcactccttctggatgtctggagctgacagatagctgccagccatatagatcagccttctatgtgctagaacagcaaagggtagggttagccgtcaacatggacgagattgaaaaataccaggaagttgaggaggaccaagacccaagttgtccaaggctgagtcgcgaactgctggatgaaaaggagcccgaagtattgcaggacagcctgggcaggtgctacagcaccccctctggctacctggagctacccgacctaggacagccatactccagtgccgtttactctcttgaggagcagtacctgggcctggcgctggacgtggatagaatcaagaaggaccaggaggaggaggaagatcagggcccaccctgccctcggctgtcaagggaattgttggaggtggtggaacccgaagtcttacaagattctttggacaggtgttattctacaccctcttcttgtctggaacagccggatagttgccagccctatgggtcaagcttttacgccctggaggaaaaacacgtgggcttttccctggatgtgggcgagattgagaaaaagggaaagggcaagaaaaggcgcggtaggcggtcatag

SEQ ID NO: 232363 - DNA, 1539 bp, Artificial Sequence
  Description of Artificial Sequence: Synthetic coding sequence
taatatgaggagtgtaaagacctcatcaaaagcatgcttaggaacgagcgacaatttaaagaggagaagctcgccgaacaactgaagcaggccgaagagctccggcagtacaaggtcctggtgcatgcccaggaacgagaattgactcaactcagggagaaattgcgcgaagggagggacgcatctcgcagcctcaatgaacatcttcaggccctgctaacaccagatgaaccagacaagagccagggccaggatttacaggaacaattggcagagggctgcagattggcccaacacctggtccagaagctgtcccctgaaaatgataatgacgatgacgaggatgtgcaggtagaggtcgcagaaaaagtgcaaaaaagttccgcccctagggagatgcagaaggccgaggaaaaggaagtcccagaggacagcctggaggagtgtgcaattacctgtagcaatagccacggcccttatgattccaaccagccacataggaagactaagatcaccttcgaggaggacaaagtggattctacacttattgggtcttcaagccatgtagagtgggaggatgcagttcacattattcctgagaatgagtccgacgatgaggaggaggaggagaagggaccagtgagcccaaggaatctgcaagaatccgaagaggaagaagtgccacaagaaagctgggacgaaggctattcaacgctgtccatccctccagaaatgctagcaagctacaagtcatattcctccacctttcactccctagaagagcagcaagtctgtatggctgtggatataggcagacatagatgggatcaggttaagaaggaggaccacgaggccacagggcctcgtttgtcacgcgagctcctagatgaaaaaggtccggaagtgctccaggactcccttgaccgttgctactccaccccttctggctgtttggagttgaccgactcttgtcagccttatagatcagcattctacgtgctggaacagcaacgcgtggggctggccgttaacatggacgagatcgagaaataccaggaggtagaagaggaccaggaccctagttgcccccgacttagcagggagctgttggatgagaaggaaccggaagttctgcaagacagcctggggagatgctacagcactccctctgggtatcttgaactgcctgatctcggtcagccctactccagcgctgtctatagcttggaggaacagtatctgggccttgccttggacgtcgatcgaataaagaaagaccaggaggaggaagaggatcagggacccccatgcccacgcttgtcacgggaactcctggaggttgtggagcccgaagttttgcaggactctcttgaccggtgctactctaccccttccagttgtctggaacaaccagacagttgtcagccttatggtagcagcttctatgccctcgaagagaagcacgtgggattttccctcgatgtcggcgaaatagaaaagaagggcaaggggaagaagcgcagaggccgaagatcctag

SEQ ID NO: 232364 - DNA, 2013 bp, Artificial Sequence
  Description of Artificial Sequence: Synthetic coding sequence
atggtcgtgtccgctggacccctgtcttctgagaaggcagagatgaacatcctggagatcaacgagaaactgagaccgcaactagccgaaaagaaacaacagtttcgaaacctcaaagaaaaatgtttcctcacacagctggcgggatttttagcgaataggcaaaaaaagtacaagtatgaggagtgtaaagacttaatcaagttcatgctccggaacgagaggcagtttaaagaggaaaaactagcagagcagctgaaacaggcggaggagttgcgacagtataaggtgctcgtgcacgcccaggagagggaactcacgcagctccgagaaaaacttagggaggggagggatgcttctcggagcctgaatgaacacctgcaggctttattgacaccagacgaaccggacaaatcacaggggcaggacctgcaggagcagctcgctgaaggatgccgattaacccagcacctggttcagaagcttagcccagagaacgacaacgatgacgacgaggacgtccaggtggaggtcgccgaaaaggtgcagaagtcaagtgcccctcgtgaaatgcagaaagctgaggagaaagaggttcccgaggattcactggaggagtgcgcgattacatgctccaattctcacggaccatacgatagtaaccaaccacataagaagactaagataacttttgaggaagacaaagtagacagtactctcataggtagcagctcacacgtggaatgggaagatgccgttcacatcatcccagaaaacgaaagcgacgacgaggaggaggaagagaaaggcccagtatcccctcggaatctccaggagtcagaagaagaagaagtgccccaggaaagctgggatgaggggtattctactctctcgatcccaccggagatgttggcctcttatcagtcttatagcagcaccttccattccctggaagagcagcaagtgtgcatggccgttgatattgggagacataggtgggaccaggtgaagaaggaggaccaggaggctactgggccacgtctgtcaagagaattgctggatgagaaggaacccgaggttctgcaagactccctggacaggtgctactccacgccttctgggtgtctcgagctgactgattcctgccagccttatcgctccgccttctatgtcctggaacagcagcgtgtgggcctggcgatcgatatggatgaaattgagaaataccaggaagtcgaagaagatcaggacccctcctgtccacgtctcagtagggaactgctggacgagaaagagccggaagttctgcaagactcactcgatcgctgttattctactccttctgactatctggagttaccagatctgggccagccatatagctctgccgtttatagtctggaagaacaatatctcggcctggccctggatgtggataggattaaaaaggatcaagaagaggaggaggaccaaggccctccatgcccccgtctcagccgagaattgctagaggtggtggagccggaggtgctccaggattctttggatcggtgctattcaaccccttcaagctgcttggagcagccagacagctgccaaccctatggatcttccttttatgctctggaggagaagcacgttggcttcagtctggatgttggcgagattgagaaaaagggcaaagggaaaaagaggaggggccgtaggtctaaaaaaaagagacgtaggggacgcaaggaaggagaggatgacaatcccccatgtcctagactgtatggggtacttatggaagtggaggaaccagaggtattgcaggacagtctagaccgctgttattcaacaccctccatgtatttcgagcagcccgactcctttcaacattataggagcgttttctatagcttcgaggaggagcacattagcttcgccctgtacgttgacaatcggtttttcaccctgaccgtgacttccttgcatctcgtgttccagatgggggtgatatttccccagtag

SEQ ID NO: 232365 - DNA, 2013 bp, Artificial Sequence
  Description of Artificial Sequence: Synthetic coding sequence
atggtggtgagtgctggccctctaagcagcgaaaaggccgagatgaatatcctcgagatcaacgaaaagttgagaccacaattggccgaaaagaagcaacaattccggaatctcaaagaaaagtgtttcctgactcagttagccggatttttggcaaaccggcagaaaaaatacaagtacgaggagtgcaaagatctgataaaattcatgctgagaaacgagcgccagttcaaagaggaaaaactagccgagcagttgaagcaagccgaagaactgcgccagtacaaggtgttggtgcacgcccaagagagggaacttactcagctccgcgagaaactcagggagggtcgcgatgcgtctcgctccctgaacgaacacctgcaggccctgttgacgcccgatgagccggataaatctcagggccaggacctgcaagagcaacttgcggagggctgcaggctgactcagcacttggtgcagaaattaagcccagagaacgataacgacgacgacgaagacgtgcaggtagaagttgcagagaaggttcaaaagtcaagcgcacccagggaaatgcaaaaagccgaagagaaggaggttcccgaagactccctggaagagtgtgcaatcacctgttccaactcccacggcccatacgatagcaaccagccccacaaaaagacaaagattacattcgaggaggacaaagtcgattcaactttgattggttcttcatcccatgtcgagtgggaggacgccgtccatatcatccccgagaacgaatctgacgacgaagaggaggaggagaagggaccagtcagtcctcgtaacctgcaggagagtgaagaagaggaggtgcctcaagaatcttgggacgaggggtattcaactctgagcatccctccggagatgctcgcctcctatcagagctatagctctactttccacagcctcgaagaacagcaggtgtgtatggctgtagacatcggaaggcaccggtgggaccaggtgaaaaaagaagaccaagaagccactgggccacgactgtcccgcgagctgcttgatgagaaagagccagaagttcttcaggactctctcgacaggtgttactccacaccaagcggctgcttggaacttacagacagttgccagccttacaggtccgctttttacgtcttagaacaacagagggtggggctagccatcgacatggatgagatcgaaaaatatcaggaggtcgaggaggaccaggatccctcctgccccaggctcagtagagagttacttgatgagaaagaacccgaagtgcttcaggatagtctagatcggtgttacagcacaccttccgactacctcgagcttcccgatctgggtcagccctactccagcgccgtgtattccttggaggagcagtatcttggccttgctctggatgtcgaccgcattaagaaggatcaggaggaagaggaagatcagggcccaccatgtcctcgtctgagccgcgaactgcttgaggtggtggaacctgaggtactgcaagactccttggacaggtgttactctactccttcttcatgcctggaacaacccgacagctgtcagccatacggcagcagcttctacgctctcgaagagaaacacgtgggattctcactcgatgttggcgaaatagagaagaaggggaagggcaagaagagacgtggcaggcgcagcaagaagaaacgtaggagggggagaaaggagggagaagatgataaccctccgtgccctcgactctatggagtgctaatggaagtagaggagccggaagtacttcaagatagtcttgataggtgttacagtaccccctctatgtatttcgagcagcctgattcctttcagcattatcggtcagtgttctattcttttgaggaggaacatatctcatttgccctgtacgttgacaatcgtttcttcacactcactgttacatccttgcatcttgtttttcaaatgggcgtgatttttcctcagtag

SEQ ID NO: 232366 - DNA, 2013 bp, Artificial Sequence
  Description of Artificial Sequence: Synthetic coding sequence
atggtcgtgtccgcgggtccgctgagctcggagaaggcggaaatgaatatcctggagatcaatgaaaagttgcgccctcagttggccgagaaaaagcagcagttcagaaatctgaaggagaagtgcttcttgacgcagctggccggatttctggccaaccggcaaaaaaagtataaatacgaggaatgcaaagacttaatcaaatttatgctccgcaacgaacggcaattcaaggaggaaaagctagccgaacagctcaaacaggctgaagaactgcggcagtataaggttctcgtacacgcccaggagagagagctgacccagctgcgcgaaaagctccgtgaggggcgagacgcttcccgaagcctgaatgagcatcttcaggctctcctcactcccgacgaacctgataagtctcaaggccaggacttgcaagaacagcttgccgagggctgtcgtctaacgcaacatctggttcaaaagctaagccccgagaacgataacgatgatgatgaggacgtgcaggtcgaggtggcagagaaagtgcaaaagagttcagctcctagagaaatgcagaaagccgaggagaaggaagtcccagaagacagtctggaagaatgtgccattacgtgtagcaattcacacggcccttatgattcgaatcagcctcataaaaagacaaaaattacctttgaagaggataaggtggattccaccctcatcggctcatctagccatgtagagtgggaggacgccgtgcatatcattcccgaaaacgagagcgacgacgaagaggaagaggaaaagggaccagtcagtccgcgaaacctgcaggagtcggaagaggaggaggtccctcaggaatcatgggacgaaggctactccacgctcagcatccctcccgagatgctggctagttatcaaagctattccagcacgtttcacagtctggaagagcagcaggtctgcatggccgtggacatcggtagacacaggtgggaccaggtgaagaaagaagatcaagaagccacaggtccccgactcagtagagagctgttggatgagaaggagcctgaagtgttacaggactctctagatcgctgttacagcacccctagtggctgcctggagctcacggatagttgccaaccgtacagaagcgccttttacgtgctggagcagcagcgagtcggcctcgccatagatatggatgaaatcgagaagtatcaggaggtggaagaagatcaagatcctagctgtcctcgcttatcgagggagctccttgacgagaaggaaccagaggtactgcaggactccctggacagatgctacagtacaccttccgactatctggaactgccggatttgggccaaccttactcgagtgctgtttatagcctggaggagcagtacctcgggcttgccctcgacgtggatcgaattaagaaggaccaggaagaggaggaggatcaaggccctccatgccctaggctatctagggagttgcttgaggttgtcgagccagaggtgttgcaggacagcctagaccgatactacagtacccccagctcctgccttgaacagccagatagttgtcagccatacggatcttctttttacgcactggaggagaagcatgtggggtttagtctggacgtgggggaaattgagaagaaaggtaagggcaaaaagcgcagaggtcgccgaagcaagaagaaaagaagaagaggaagaaaggagggtgaggacgataaccccccatgccctaggctgaacggtgtcctgatggaagtggaggaaccagaggtactgcaggatagtctggacaggtgctatagcacccaatccatgtattttgaactccccgatagcttccagcactataggagtgtcttttacagctttgaggaagagcacatttcatttgccttatacgtcgacaacaggttctttacgctgacagtcacatcccttcatttagtcttccagatgggggtgatctttccacagtag

SEQ ID NO: 232367 - DNA, 2013 bp, Artificial Sequence
  Description of Artificial Sequence: Synthetic coding sequence
atggttgtatccgccggacccctctccagtgaaaaggccgagatgaatatattggagatcaacgagaagctccggccacagctcgcagaaaagaagcagcagtttcgtaatctgaaagagaaatgttttcttacgcaactggccggattcctggcgaaccgacagaagaaatacaagtacgaggagtgtaaagacctgatcaaattcatgttgcggaatgaacggcagttcaaggaagagaaactggcagaacagctgaagcaggcagaagaactgcggcagtacaaggtgctagtacacgcgcaggagcgggaactgacacaactccgcgagaaactgagggaaggtcgggatgcatctaggtctctgaatgagcacttgcaggcgctgttaacaccggatgagcctgacaaatcccagggccaggacctgcaagaacagcttgctgagggctgccgtttgacacaacacctagtccaaaagctgtcgcctgaaaatgacaatgatgatgatgaggacgtccaggtggaggtcgccgagaaagtacagaagtccagtgcccctagggagatgcagaaagctgaagaaaaggaggtccccgaagactccctcgaggagtgtgccattacttgttcaaacagccacgggccatatgactctaatcagcctcacaaaaagaccaagatcaccttcgaagaagataaggttgatagcacactgatcgggagctcatcccatgttgagtgggaagatgccgtacacatcattccggaaaacgaatccgacgacgaagaggaagaggagaagggcccagttagtcctagaaacctgcaggagagcgaggaggaagaggttccacaggaaagctgggacgagggctacagcactttgtctatacctccagaaatgctagcttcctatcagtcatactcttctacattccattctctggaagaacagcaggtctgtatggcagttgatatcggcagacatagatgggaccaggtaaagaaggaggatcaggaagcaacaggtcctagactgagtagagagctgctagacgagaaggaaccagaggtgctgcaggacagtctggatcggtgctacagcactccatccgggtgccttgagcttaccgacagctgccagccatatcgtagtgcattttacgtgctggaacagcagcgtgttggcctggccatcgacatggatgaaattgaaaagtaccaggaggtagaggaggatcaggatccatcatgtcctagacttagccgcgagctactggatgagaaggaacccgaagtgttgcaggatagtctggataggtgctatagtactccaagcgactaccttgaattgccagacctgggccagccatacagttctgctgtgtacagcctggaggagcaatatctcggactggcactggatgtggatcggattaaaaaagaccaggaggaggaggaggatcagggaccgccatgtccaagactgtccagggagcttttagaagtggtggagccagaggtgttacaggactctctggacaggtattatagcacgccgagtagctgtctggagcagcccgactcctgtcaaccatacggatcaagcttctacgcgctggaggagaaacacgttgggttttctttggatgtcggcgagattgagaaaaaaggtaagggtaagaagcgacgagggaggcgaagcaaaaagaagaggagacggggtagaaaagagggtgaagacgataaccccccttgccccagattaaatggagtcttgatggaggtcgaggagcctgaagttctgcaagactcattagataggtgctacagcacccaatctatgtacttcgagttgccagacagcttccaacactatcggagcgttttttacagcttcgaagaagagcacatttcattcgctttgtacgtcgacaacaggttctttactctgaccgttacctctttacatctggtgtttcagatgggggttatatttccccagtag

SEQ ID NO: 232368 - DNA, 2526 bp, Artificial Sequence
  Description of Artificial Sequence: Synthetic coding sequence
atggttgtatcagccggaccttggtcaagtgagaaggccgagatgaacatcctagagattaatgaaaaattgaggccccagcttgctgaaaataagcagcagtttggcaacctgaaggaaaggtgcttcgtcacacaattggctgggtttttggctaatcagcagaagaaatacaactacgaggagtgcaaggacctcatcaagttcatgctcagaaacgagcgacaatttaaagaagagaagctcgccgaacaactgaaacaggccgaagaattgcggcagtataaggtgctggtgcacagccaggaaagggagttaacccaattacgggaaaaactcagggaaggccgagacgcttcgaggtctctcaatgaacatctgcaggctctgctaactttagatgagcctgataagagccaagggcaggatctccaggagcaattagccgaaggttgccgccttgctcaacatttagtgcagaaactgtcgcccgagaacgacgaagatgaagacgaagatgtgcaggtggaagaggccgaaaaggtgcagaaaagttccgcccctcgagaagtccaaaaaactgaggagtccaaggttccggaagactccctagaagagtgtgccatcacttgctcaaactcgcacgggccttgtgattctaatcagccgcacaagaatattaagatcacctttgaggaagacgaagtgaactcaaccctggttgttgatagagagtcctcccatgatgagtgtcaagacgctttgaatatcctgcccgtgccgggacccaccagcagcgcaaccaacgtaagtatggtagtttccgccggtcccttaagttccgaaaaggcagagatgaacatcctggagatcaatgagaagctccatccccagctagccgagaagaaacaacagtttcggaacctgaaggagcgctgcttcgttacacagctagctggctttctcgccaatcaacagaaaaagtataaatacgaggagtgcaaagacctaatcaagagtatgctgcgaaatgagagacagttcaaagaggagaaattggctgaacagctcaaacaggccgaagagctccgccagtacaaggtgctagtgcatgcacaggagagggaactgactcagcttagagagaagctgcgggaggggagagacgcctctaggtcactgaacgaacacctgcaagcactgctgacccctgatgagcctgacaagtctcaggggcaggatttgcaggagcaactggcagagggctgcagactcgcacagcacctggtccagaaattgtctcctgagaatgataacgacgatgacgaggatgtgcaagtggaactagccgagaaggtccagaaatcatctgcgcctcgcgagatgcagaaggccgaagagaaggaagttcccgaggatagtcaggaggagtgcgccatcacatatagcaactcacacggcccttatgattccaatcagccacacagaaagaccaagatcaccttcgaggaggacaaggtcgactctacgctgattggatcaagctcccatgtagagtgggaagacgctgtccatatcattcctgaaaatgagagcgatgacgaggaagaagaggagaagggaccagtttcacccagaaacttgcaagagagcgaggaagaagaggtgccacaggagagctgggatgagggatacagtaccctgtccattcctccggaaatgctcgcttcctatcagagttatagctcaaccttccatagcctggaggaacaacaagtatgtatggcagtagatatcggacgacataggtgggaccaggtgaaaaaggaagatcaggaggctaccggaccacggttatcgagagagctgctcgatgagaaaggaccggaagtattgcaagattcactcgatcggtgctattctactccctctggatgtctcgagctcacggattcgtgccaaccataccgcagtgcattttatgtgctcgagcagcaacgcgttggactggcagtggacatggacgaaattgagaagtaccaagaggtggaggaggatcaggaccccagctgtcccagactctcacgtgagctcctcgacgagaaggaacctgaggtcttgcaggacagtctggaccgatgctattctactccttctggctacctcgagctgccagatctcgggcagccctattcttctgcagtctacagcctggaagagcagtacctgggactggccctggatgtggatcgtactaagaaagatcaggaggaagaagaagaccaaggtcctccgtgtcctagactcagcagagagttattagaggttgtggaacccgaagtgctgcaggactcgctggacaggtgttattccacaccgagttcatgtctggagcaaccagacagctgccagccctacggatcatcattttatgccctggaagaaaagcatgtggggtttagtctggacgtgggcgaaatcgagaaaaaaggaaagggcaagaagcggaggggtcggagatcttag

SEQ ID NO: 232369 - DNA, 13866 bp, Artificial Sequence
  Description of Artificial Sequence: Synthetic coding sequence
atggtggttagtgccggtccctggagcagcgaaaaggctgaaatgaacatcctagagattaatgaaaagctacgccctcagttagccgaaaataagcaacagtttgggaaccttaaggagcggtgcttcgttacacagctcgctggcttcctcgcgaaccagcaaaaaaaatacaactatgaggagtgcaaggatctgattaagtttatgctgagaaacgagagacagtttaaagaggagaagctggcagaacagctgaagcaagccgaagagctgaggcaatacaaagttctggttcactcccaagagcgcgaactcacacagcttcgggaaaaattgcgagaaggacgggatgcatccagaagcctgaatgagcatctgcaggcacttctgacactcgatgaacccgataaatctcaagggcaggaccttcaggagcagctagctgagggttgccggctggcacagcatctggtgcagaaactgtcccctgaaaatgatgaggatgaggacgaagatgtccaagtggaagaggcagagaaggtccagaagtcatccgccccaagggaggttcaaaaaacagaagagagtaaggttcccgaagactcgttggaagaatgcgccattacctgctcgaacagtcacggcccttgcgattcgaaccaaccacataagaatatcaagataacattcgaggaggacgaagtgaattccacccttgtcgtggacagagagtcgtcccatgatgagtgccaggacgccctgaacatcctgccagtaccagggcctaccagttctgccacaaatgtgtctatggtggtctccgctgggccactgtcttcagaaaaggcagaaatgaacatccttgaaattaacgaaaagctccatcctcagctggctgaaaaaaaacagcagttccgcaatctcaaggaacggtgcttcgttactcaattagctggctttcttgcaaaccagcagaagaagtacaagtacgaggagtgcaaagacctcattaaatcgatgctgcgcaacgagcgtcagttcaaggaagaaaaactggccgagcaacttaagcaagcggaggagctgagacaatacaaagtcctggtgcatgcgcaagaacgggagctgacccagctccgggaaaaactccgagagggcagggatgcttcaaggtctctgaacgagcacctccaggcactcctgactcccgatgaaccagataagtcccaggggcaggatctccaggaacagctggccgaaggctgtaggctggcgcagcatctcgtgcagaaacttagcccagaaaacgacaatgacgacgacgaggacgtccaagtggagctcgctgaaaaggtgcagaaatccagcgcacctagggaaatgcagaaggcagaggaaaaagaggtccctgaagacagccaagaggagtgcgctattacctattcaaacagtcacggcccttatgactccaatcagccccaccgtaaaacgaaaatcacctttgaagaggacaaagtggatagtactcttattggcagctcttcccacgtggaatgggaagatgcagtgcacataattcccgagaatgagtcagatgatgaggaagaggaagagaagggccctgtcagcccaaggaatctgcaggagtccgaagaggaagaagttccccaggaaagttgggacgagggatacagcacactgtctatcccacctgagatgctggcctcctaccagagctactcaagcacttttcatagcctggaggagcagcaggtgtgcatggctgtcgatattggcaggcacagatgggaccaggtgaaaaaagaagaccaggaggccacggggcctcgtctttcgcgagaactcctcgatgagaaagggcctgaagtgcttcaagactccctggatcgatgctattccacaccatctgggtgcctggagctcaccgactcttgccagccttataggtccgcattctatgtcttggagcagcagaggatcgggctggccgtagacatggacgaaattgagaagtaccaagaagttgaagaggatcaagacccttcctgtccccgattgtcccgggaactgttagacgagaaggaacccgaggtcctacaggattccttggataggtgttattccacacccagcgggtatttagaactgcccgacttagggcaaccctacagttctgccgtgtacagtttggaggaacaatacctcggcctcgcactggacgttgacagaacaaagaaagatcaggaagaggaagaggaccaagggcctccatgccctcggctgtcgcgggagttattagaggtggttgaacccgaggtactccaggatagcctggacagatgttactccacaccttcaagttgtttggaacagcctgacagctgtcaaccttacggaagtagtttctacgcgctggaggaaaagcatgtaggcttcagcttagatgtaggcgaaattgaaaaaaaaggcaaaggcaagaagcggcgaggaaggcgcagcaagaaggagcggaggagaggacggaaagaaggggaagaagatcagaacccaccttgcccccgattatctcgcgagctcttggatgaaaagggcccagaagtgctacaagattccttggataggagctacagtacaccttcagggtgtctggaactcaccgattcctgccagccatatcgaagtgctttctacgttctggagcagcagagagtgggtcttgccgttgacatggatgagatcgagaaatatcaggaggtggaggaagaccaagaccccagttgtccgagactcagtagggagctgctagacgagaaggagccagaagtcttacaggattctcttgaccgctgctatagtacaccaagtggctatttagagttacccgacctcggacagccatactccagcgccgtatattctctggaagaacagtacctgggcttggccctggatgtggatagaactaaaaaagaccaggaagaggaggaggatcaaggacctccttgtcccagactttcgcgagagctcctcgaggtcgtggagccagaggtgcttcaggattctctggacaggtgctattctactccatcctcatgcctggagcagcctgacagttgtcagccctacggtagctccttctacgccctggaggagaaacacgtggggtttagcttagacgtgggcgaaatcgagaaaaagggaaagggtaagaagaggaggggaaggaggtccaaaaaggagcggcgtcgcggacgcaaagaaggggaggaggaccaaaacccgccttgcccgaggctgagtagagagctgctcgacgaaaaaggacccgaggtccttcaggattccctcgacagatgttatagtacaccatctggatgcctggagcttaccgattcctgccagccgtatcgcagcgccttctacgtgcttgaacagcagagagttggtctggcggtcgatatggacgaaatagagaaataccaggaagtcgaggaggatcaggatccgagttgtccacgactgtcccgggagctgctggatgagaaggagcctgaggtgctgcaagactcactagacagatgctactcaaccccttcgggctacctggagcttccagacctcggacagccttattcttcagcggtatactccttagaagagcagtacctagggctggccttggacgtggaccgtacgaagaaggaccaggaggaggaggaggaccaggggccaccatgcccaaggctgtccagggaactgctagaggtggtcgaacccgaggttcttcaggattccctcgaccggtgctattctacgcccagcagctgtctcgaacaacctgattcatgtcagccttatgggtccagcttctacgcactcgaggagaagcacgtgggcttcagtctcgatgttggagagatagagaaaaaaggtaaggggaaaaaacgcagggggcgacgatccaagaaggagagaagacggggacgaaaggagggagaagaagaccagaatccaccatgcccacgattatctcgcgagttactggacgagaagggaccagaagtgctccaggacagtcttgatcgctcctattctaccccgtccggatgtctggagctaactgatagttgtcaaccatatcgttcagcattctatgtgctcgagcaacagcgcgtgggtctggccgtcgatatggatgagattgaaaagtatcaggaagtcgaggaggaccaagacccttcgtgtcccagactgtccagagagctgcttgacgagaaagagccagaggtgctgcaggacagtctggatagatgttatagtacccctagcggctatctagaactccctgatctgggtcagccttatagtagtgcagtctactcactggaggagcaatacctgggtctggctttagacgtggaccgtacgaaaaaagaccaggaggaggaggaggatcagggacccccatgtcccagactcagccgagagttgctcgaggtagtggaaccggaggtgctgcaggacagcctggacaggtgctatagtacccccagcagctgcttggaacaaccagattcttgtcaaccatacggttcctcattctatgctctggaagaaaagcatgtggggtttagtctcgacgttggagagatcgaaaagaaaggaaaagggaaaaagcggcgaggacgtagatccaaaaaggaacgcaggaggggacggaaagagggagaggaggaccaaaatcctccttgccctcgcctgtccagggaactgctggacgaaaagggcccagaagtgctccaggatagcctggaccgctgctatagtacgccatccggctgcctcgagcttacggattcttgtcagccttataggtccgctttctatgtcttggagcagcaacgcgtgggtctggcggtagacatggacgaaatagagaaatatcaagaagtggaagaggatcaggaccctagttgtcccagactgagtagggagttactagacgaaaaggaacccgaggtacttcaggatagcttggacaggtgttatagcacgccctctggatacttggagctccctgacctcggccagccatatagctctgcagtgtactcacttgaagagcagtatctgggacttgccctggacgtagataggacaaagaaggaccaggaggaggaagaagatcaggggccaccctgtcctagactgagccgtgaactcctggaggttgttgagcctgaggtcttgcaggactccctcgaccgttgttactccacgccatcctcctgtctggagcagcctgatagctgtcagccatatggaagcagcttttacgcgctggaggagaagcatgttgggttttcccttgatgtgggcgagattgagaagaaaggaaagggaaaaaagcggaggggcaggcgtagcaaaaaagaaagacggaggggtcgcaaggagggagaggaggatcaaaatcccccttgtccacgattgtcccgcgagctgcttgatgaaaagggacccgaggttctgcaagattcactcgatcggtcttattccacgccatctggttgtttagagctcacagactcttgtcaaccatatagatctgcgttctatgttctggagcagcagagggtaggtctcgccgtagatatggacgagatagaaaaataccaggaggtggaggaagatcaggaccctagctgtccccgattaagtcgagagctgttagatgaaaaagagccggaggtgcttcaggactccttagaccgctgttactctacgcccagcggatatctggagctgcctgatctggggcagccttatagttctgcggtgtactcactggaggagcagtatctgggcctggccctcgacgtcgatcgcactaaaaaagaccaggaggaggaggaggatcaaggccctccctgtccccgactctctcgggagctactggaggttgttgaacctgaggtgctacaggattctctggaccgttgttattcaaccccaagctcttgcctcgaacagcctgactcttgccaaccctatggtagtagcttttacgccctcgaagagaaacacgtcggcttcagtctcgacgtgggggaaatcgagaagaaaggcaaaggaaaaaagcgcagaggtcgaaggtcaaagaaagagcgcaggcgcggtcgtaaggagggagaggaagaccaaaacccaccatgccctcgattgtcccgtgagctcctggatgaaaagggcccagaggtcctgcaagacagcttggatcgaagctactctacccccagtggatgtctcgagttaacagattcatgccagccttacagaagcgcgttctatgtcctggaacagcaaagggtggggctcgctgtggacatggacgagatagaaaagtatcaggaggttgaggaggaccaagacccaagctgtcctaggctgtcaagggagctgctggatgaaaaagagcccgaagtcctgcaggatagtctggatagatgctattcaacccccagcggctacctcgaactccctgatttggggcaaccatactcaagcgcagtctatagtctggaagagcagtatttggggcttgccttggacgttgacagaactaaaaaggaccaggaggaagaagaggaccaaggcccaccctgccccaggctgtctagagagctcctcgaggtggtggaacctgaggtgctccaggactctctagataggtgctactccaccccctcatcctgtctggagcagcccgatagctgtcagccctacgggagcagtttctacgccctcgaggaaaagcatgtaggatttagtcttgacgtgggggagatcgaaaaaaaaggcaagggtaaaaagaggaggggacggagatcaaagaaggagcgaagacggggaagaaaggagggagaggaggaccagaaccctccctgccccagactgagcagagagctacttgacgaaaaaggacccgaggtgttgcaggactcattggacagatcttatagtaccccttccgggtgcctggagttgactgatagctgccagccttatcgttctgctttttacgtacttgagcagcagcgagtgggtctggcagtcgatatggacgaaatcgaaaagtatcaagaggtcgaagaggaccaggatccttcctgccctagactttctcgggagttattagacgagaaagagcctgaagtgctgcaggactcccttgaccgctgttattctacaccttcaggctacctcgaactgcccgatctcgggcagccgtacagcagcgccgtttacagcctcgaagagcaatatctgggactcgcccttgatgtagatcggactaagaaggaccaagaggaagaggaggaccaaggtccgccttgccctagactcagccgtgaactgttggaggtcgtggaacccgaggtcctgcaggactctcttgaccgctgctactccacacctagcagctgtctggagcagcctgatagttgtcaaccctacggctcctctttttatgctttggaggagaagcacgtggggtttagtttagacgtgggagagatcgagaagaaaggcaagggcaaaaagaggaggggtaggaggtccaagaaggaacgtagaagaggcaggaaagaaggcgaggaagatcaaaatcccccttgcccgaggctgtctagagaacttctggacgagaagggacctgaggttctccaggatagtttggacaggtcttactccacgccatccggctgccttgaacttaccgactcttgtcaaccttaccgcagcgccttctacgtgctcgagcagcagcgagtcggattggccgtggatatggacgaaatcgaaaaataccaggaagtggaagaggatcaggacccaagctgtcctagactctcccgcgagctacttgacgagaaagaaccagaagtcctacaggattcgctggaccggtgctacagcaccccttctggatatctcgaattaccggaccttgggcaaccatactcctcagcagtgtatagtttggaggagcaatacctgggccttgccctagacgtggaccggacaaagaaagatcaggaagaagaagaagaccagggcccaccatgccccagacttagtagggaactgctggaagtggtggagcccgaggtcctgcaggattccctggaccggtgctacagcacccccagctcctgcctggagcagcccgattcctgtcagccctatggctcctccttctatgccctggaagagaagcacgtggggttttcattagatgtgggcgagatagaaaaaaaaggaaagggcaagaagagaagaggacgcagatctaaaaaggaaaggcggagaggcaggaaagagggcgaggaggatcagaaccccccttgtccacgcctgtccagggagttgctggacgaaaaagaacccgaggtgcttcaggactccctggatcgttgctatagcaccccaagtgggtacctggagttacctgatcttgggcaaccctacagctctgcggtctacagccttgaagaacagtatttagggctggccctggatgtggaccggaccaagaaggaccaagaggaggaggaggatcagggccctccttgccccaggctgagcagggagctgctcgaggttgtggagccagaagtcctccaagattctctggatagatgctactccaccccttcttcctgtttggagcagcctgacagttgccagccatacggttcgagcttttacgccttggaagagaagcacgtggggttctccctagatgtgggagagatcgaaaaaaagggtaagggcaagaaacggagagggcgacgctccaagaaagagaggcgaagagggagaaaggagggcgaagaagatcagaaccctccttgccccagactctccagagaactccttgatgagaaagaacccgaggtccttcaggacagtttggatcgctgttacagtaccccttcaggctatctggaattgcctgatttgggtcagccctactcctctgctgtctacagcctagaagagcagtacctgggcctggctctggacgtggaccgtacaaagaaagaccaggaagaggaagaggaccagggaccaccctgcccaagactgtcaagagagctgctcgaggtcgtggaacccgaggttctgcaggattccctggatcggtgttatagcacaccttccagctgtctcgagcagcccgactcatgccaaccctacggctcttcattttacgcactggaggagaagcacgtcggtttctccctggatgtgggcgaaatagagaaaaaggggaagggaaagaaaagaaggggtcgaagaagcaagaaggagcggcgacgaggcaggaaggaaggcgaggaggaccagaaccctccatgtcctaggttatcccgggaactgttggacgagaaagaacccgaggttcttcaagattccctggacagatgttactctaccccatccggttatctggagctgccagatttgggacaaccctatagcagcgcggtatattcccttgaagaacagtatctcgggctggcactggacgtcgacaggaccaaaaaggatcaggaggaggaagaggatcagggccctccctgtcctcgactgtcccgtgagttactcgaggtcgtcgagcctgaagtactccaggatagcctggaccgctgttatagcaccccatccagttgtctagagcagccggactcatgccagccatacggatcatctttttacgcacttgaagaaaaacacgtcggattctcactcgacgtgggggaaattgagaaaaagggtaaaggcaaaaagcggagagggcgaagatcaaaaaaagaacggaggaggggaagaaaagaaggcgaggaagaccagaaccccccatgccccagacttagcagggagctgctggacgagaagggtccagaggtgctgcaggactctctagatcgctgctactctacaccatcaggatgccttgaactgactgattcgtgccagccatatagatcggcgttctacgtactagagcagcagagggtgggcctggctgtagatatggacgaaattgagaagtatcaagaagtcgaggaggatcaggaccctagctgccctcgcctttccagggaactgctggacgaaaaagagcccgaagtcctgcaggattccctggatcggtgctatagtactccaagcgggtacctcgaactgcctgatcttggccagccttattcctccgccgtgtacagcctggaggagcagtacctaggtctcgctctggatgtggaccgaaccaagaaagaccaggaagaagaggaggaccaggggcctccctgccctcgccttagtagagaactgcttgaagtcgttgagccagaggtactccaagactcccttgaccgttgctactcaaccccttcttcatgtctggaacaaccagattcatgtcagccatacgggagttcattttacgcgcttgaagagaagcacgtgggtttttctttggacgttggggagatcgagaagaaaggaaaaggcaagaaaaggagaggtcgcaggtctaagaaggaaaggagaagagggcgaaaggaaggggaggaggaccagaatccaccctgtccaaggctgagtagggagctgctggatgagaagggaccggaagtcctccaggattctctggataggtgctatagtacccccagcgggtgcctcgagttgacagatagctgccagccttataggtccgcattctacgtcctggagcagcagcgcgttggtctagccgttgacatggatgaaatagagaaatatcaggaagtcgaggaagaccaggacccaagttgtcccaggttgtcccgagagttattagatgagaaggaacctgaagtgctgcaagactctttggatcggtgttatagcaccccgtccgggtacctcgaattgcccgacctgggacaaccctactcctcagcagtgtatagcttggaagagcaatacttgggactggctctggacgtggatagaaccaagaaagaccaggaggaagaagaagatcaaggcccaccctgtccacgactttccagggaactccttgaggtggtggagccagaggtgttgcaggactcactggaccggtgttactccacccctagcagctgtctggagcaaccagattcctgccagccttacggaagctctttctacgcattggaagagaagcacgtggggttttccctggatgtcggcgaaatagaaaagaaggggaagggaaaaaaacgccgaggacggagaagcaaaaaggagcggagaagggggagaaaagaaggggaggaagatcagaatcccccttgcccaaggctttcccgcgagctgctggacgaaaagggcccagaagttttacaggactctctggatagatgctattccacacccagcggttgcctcgagctgaccgactcgtgccaaccttaccgcagtgctttctacgtgctcgagcagcagcgcgtgggactcgcagtggatatggacgaaatcgaaaagtaccaggaagtggaagaagatcaggacccaagttgtcctcggctatctcgcgagctcctcgacgagaaagaacccgaggtcctgcaagatagcctggataggtgctactctactccctcgggttacctagaactgcctgatcttggtcagccatactcatcagccgtgtattcgttggaggagcagtacctggggctggccctggacgttgaccgaacaaagaaggaccaggaagaagaagaagaccaggggcctccatgtccccgacttagtagggagctattagaggtggtggaacctgaggtcctgcaagactctctggatcggtgctactccacaccaagttcctgtctagaacagccggacagctgtcagccatatggttccagcttttatgcactcgaggaaaagcatgtcggattctctctcgatgtgggggagattgaaaaaaagggcaagggaaagaagcgacgcggacgacgctctaaaaaggagcggagaagaggacgaaaggaaggggaagaagatcagacgccaccttgtccccgtctgagtagagaactcctggacgaaaaaggaccagaagtgctacaggactcactggaccggtgctatagcaccccaagcgggtgcctagaactgacagacagctgtcaaccttaccgatcggcattttacgtcctcgaacaacagagagtaggcctcgcggtcgatatggacgaaatagagaagtatcaggaggtggaagaggatcaggacccctcatgccccagactttctagagagcttctagacgagaaggagcccgaagtcctgcaggattcattggatcgatgctactctacaccctctggctatttggagctgcctgacctggggcaaccttactctagtgcagtgtactcactggaagagcagtacttgggtctcgccttagatgtggatagaacaaagaaagaccaagaagaagaggaagaccaggggcctccatgccccagactgtcccgggaactgctggaagtggtggagccggaggtcctccaagactcactcgaccgctgctattcaacgcccagttcatgcctagagcaacctgattcttgccaaccctatggtagttctttttatgctctggaggagaagcacgtgggcttttcgctcgatgttggcgaaattgagaaaaaaggaaaaggcaaaaagcgcaggggtaggagatcaaaaaaagaacggagaaggggacgcaaggaaggcgaagaggatcagaatcctccctgccctcgactgagtcgcgaattgctggacgaaaagggtccggaggtcttacaggattcactcgatcgctgttatagtaccccgagtgggtgcttagaactgacagactcctgccaaccctaccgcagtgccttttacgtgctggagcagcagcgagtgggcctggcggtagacatggacgaaatagagaaataccaggaggtcgaggaggatcaggacccaagctgtccaagactgtcccgggagttgcttgatgaaaaggaacctgaggtgctgcaggatagtcttgatcgatgctacagcacccccagtggatacttagagctgccagacctgggccaaccgtactcctccgctgtttattcactggaggagcaatatctcggactggccctcgacgtggaccgcaccaaaaaggatcaggaggaagaggaggatcaagggccaccgtgtccgcgattgtcacgagaactgctcgaggtggtggaaccggaggtgctacaagatagcttagatcggtgttatagcaccccatcgtcctgtcttgagcagcccgatagttgtcaaccttatgggtcttcattctacgcattggaggagaagcatgttggcttcagtttggatgtcggtgaaatcgaaaagaagggaaaggggaaaaaaaggcggggtaggagaagcaagaagaagcgtcgcagaggtaggaaagaaggggaagaagaccaaaacccaccatgtccccgactgaatggcgtcttgatggaagttgaagagcccgaagtgcttcaggatagtctagatggatgttactccacacctagcatgtatttcgaacttcctgacagctttcagcactatcggagcgtcttttattcctttgaagagcagcatatttcatttgcgctgtacgtcgacaatcgctttttcacgctcaccgttaccagtctccatctggtgttccagatgggcgttattttcccccagtag

SEQ ID NO: 232370 - DNA, 780 bp, Artificial Sequence
  Description of Artificial Sequence: Synthetic coding sequence
atggtggtgagcgccggtccttggtcgtctgagaaggctgagatgaacatcctagagatcaatgagaagctgagacctcagcttgccgaaaataagcagcagtttgggaatctgaaagaacgctgctttgtgacccaactcgccggttttctcgccaatcagcagaagaagtacaattacgaggagtgtaaggatctgattaaattcatgcttcgcaacgagagacagtttaaggaggaaaagctggccgagcagttgaaacaagctgaggagctcagacagtacaaggtattggtccatagtcaagaacgtgagttgacgcagttgagagaaaaattgagagaggggagagacgcatcccggtctctgaatgagcatcttcaggctctcctgaccctggatgagcctgacaagtcccagggacaggaccttcaagaacagctcgctgagggctgcagactggcccagcaccttgtgcagaaactgtctcctgagaatgatgaggacgaggatgaagacgtccaagtggaggaggctgagaaagtccaaaagtcctccgcaccgagggaagttcaaaaaacagaagaatcgaaggtgcccgaggattccctcgaggagtgtgccatcacctgctctaacagccacggcccatgtgatagcaatcaacctcataaaaatatcaagatcaccttcgaggaagacgaggtaaattctaccctagtagtcgatcgggagtcttcacacgatgagtgccaagatgcactcaacattctcccatag

SEQ ID NO: 232371 - DNA, 456 bp, Artificial Sequence
  Description of Artificial Sequence: Synthetic coding sequence
ctatcacgcgaactcctggaagttgtcgaaccggaagtgcttcaggactccctagacaggtgttactcgacaccgagctcctgtctagagcaacctgattcttgccagccttatgggtctagtttctatgcccttgaggaaaagcacgtggggttttcactggacgtcggggaaatcgagaaaaaggggaagggtaagaaacggagaggcaggagaagcaagaaagaaaggaggaggggccgaaaagagggcgaggaagatcaaacgcccccatgtccgcgactgtcccgcgagctgcttgacgaaaaagggccagaggtcctgcaggacagtctggatagatgctactccacaccctccggttgcctggaactgacggatagctgtcagccttaccgatccgccttttatgtacttgagcaacaacgcgtagggctggccgttgatatggactag

SEQ ID NO: 232372 - DNA, 456 bp, Artificial Sequence
  Description of Artificial Sequence: Synthetic coding sequence
ctaagtcgggagttactggaggtcgtggaaccagaggtcctacaggactcattggatcggtgctattctacaccttcatcttgcctggaacaacctgacagctgtcaaccatatggatcctcattttacgcactggaggaaaagcacgtcggcttttcccttgatgtgggagaaattgagaagaaaggaaaaggaaagaagaggagggggagacggtcaaaaaaagagcgcaggcgaggtagaaaagagggagaagaggaccaaaatccaccttgcccaaggctgagccgagagttactggacgaaaaggggccagaggtcctgcaggattcattggataggtgttactctacaccctctggctgcttggagctaactgacagctgccagccatatcgctccgccttctacgtgcttgaacagcaaagggttggactcgcagtggatatggattag

SEQ ID NO: 232373 - DNA, 456 bp, Artificial Sequence
  Description of Artificial Sequence: Synthetic coding sequence
ctgtccagggaactgctagaagtcgtcgagcccgaagtattacaggattccctggatagatgttatagcacccccagcagttgccttgaacagcccgactcctgccagccttacggtagcagtttttacgcactggaagagaaacatgtgggcttctctcttgacgtgggcgagatcgagaaaaaagggaagggcaagaaaaggcggggacgtcgctctaaaaaggagcgcaggcgcggacggaaagagggggaagaggaccagaatccaccatgtcctaggctgtctcgagagctcctggacgagaagggacccgaggtgctgcaagactcactggaccgatcttatagtactcccagtgggtgtcttgaacttacagacagctgccaaccatatagatcggcattctacgtcctcgaacagcagcgcgtcgggctggccgttgacatggattag

SEQ ID NO: 232374 - DNA, 456 bp, Artificial Sequence
  Description of Artificial Sequence: Synthetic coding sequence
ttaagtagagagttattagaagttgttgaaccagaggtccttcaagactctctggataggtgctactctaccccatcttcctgcctggagcagcctgattcttgccagccttacgggtcttcgttctacgctctcgaggagaagcatgtaggtttctctttagatgtgggggaaattgaaaagaaaggcaagggcaaaaagaggagaggccgtagatcgaagaaggagcggcgaaggggccgtaaggaaggcgaagaagatcagaatccaccttgccctaggttatcccgcgagctcctcgacgaaaaggggccagaagtgctccaggactccctggatcgctgttacagcaccccttcaggctgtctggaactcacagactcgtgccaaccgtaccgctccgccttctatgtgctggaacagcaaagagtcggcctcgccgtggacatggactag

SEQ ID NO: 232375 - DNA, 2016 bp, Artificial Sequence
  Description of Artificial Sequence: Synthetic coding sequence
atggtggtctcggccggacccctctctagcgagaaggcagaaatgaacatcctagaaatcaacgaaaagcttcatccacagctggcagagaagaaacagcagtttcggaacttaaaggaacgctgtttcgttacacagctggctggtttcctcgccaatcaacagaagaagtataagtacgaggagtgcaaagatctgattaagagcatgcttcgtaacgaaagacagttcaaggaggagaagctcgccgagcagttgaagcaggcagaggaactgaggcagtacaaggtgcttgttcacgctcaggagcgagaattaacccagctccgggaaaagctgagagaaggaagggatgccagccgctctctgaacgagcaccttcaggcactactcactccagatgaaccggataagtcacaggggcaagacttgcaggagcaactggccgaagggtgccggcttgcccagcacttagttcagaaactgtcccccgaaaacgacaacgacgatgatgaagacgtgcaagttgagctggctgagaaggtgcagaaatcatccgcccctagagaaatgcagaaagcagaggagaaagaggtgcccgaagacagccaggaggagtgcgctattacgtattcgaatagtcacggcccttacgattccaatcagccccacagaaaaaccaagatcacttttgaagaggacaaggtggactccactctgatagggagttccagtcacgttgagtgggaggatgccgtccacattatccccgagaatgagagcgacgatgaggaggaagaggagaagggcccagtctcccctcggaacttacaggaaagcgaagaggaagaggtcccacaggaatcctgggacgaaggatactctaccctctctattccccctgagatgctggcgtcttaccagtcatactcaagcacttttcactcactggaggagcagcaagtgtgcatggccgtggacatcggaagacacagatgggatcaggtgaagaaggaagaccaggaggcgactggaccgcgtctgtcaagggagctgctcgatgagaaggggcctgaggtgctgcaagactccctagaccggtgctactcaacccctagcggctgtctggaattgacagactcctgtcaaccctatagatctgcattttatgtgctcgaacagcagagggtgggcctcgccgtggacatggacgagattgaaaaataccaagaagtggaagaggaccaagaccccagctgccctcggctgagccgcgagctgttggacgaaaaggaacctgaggttctgcaggatagtctggatcggtgttattccacacccagcggctatcttgaattgccggatctcggacagccttattcgagcgctgtgtactcattggaggagcaatatctaggcctggctctggatgtagatcgcaccaagaaggaccaggaggaggaggaggaccagggccctccttgccctcgactcagtcgcgaactgctggaggtggtcgagcccgaggtgttgcaggacagtctggataggtgctacagtactccctcgagctgtctggaacagcccgacagctgtcagccttatggaagttccttttacgccctggaggaaaagcatgtgggcttctcgctggatgtcggtgagattgaaaagaagggaaagggaaagaaaaggcgcggtcggagatccaagaagaagcgtcggagaggcagaaaggagggcgaagaagatcagaaccccccatgtcccagattaaatggtgtgttgatggaggtcgaggagcctgaggttctccaagactcccttgacgggtgctactccaccccttccatgtatttcgagctgcccgactcttttcagcattacaggagcgtgttctatagcttcgaggagcagcacatctcttttgccctgtacgtagataatagattttttactctgactgttacttcactacatctggtattccagatgggtgtgatttttccacagtag

SEQ ID NO: 232376 - DNA, 474 bp, Artificial Sequence
  Description of Artificial Sequence: Synthetic coding sequence
ttgtccagggaactcctggaagttgtggagcctgaggtgctccaggattccttggacaggtgctactcgaccccctcttcttgtctcgagcagcctgatagctgccagccctatggatcatctttttacgcacttgaagaaaaacatgtggggttctctctggacgttggggaaattgagaaaaagggtaagggcaagaagaggcggggtcggaggagcaaaaaggaaaggcgtcggggaagaaaagagggcgaggaggaccagaatcctccttgccctaggctgtcacgggagcttctggacgagaaggggccagaagtgttacaggattccctcgatagatgttactctaccccttctggctgtctggagctaacggacagctgtcaaccatataggtccgccttctatgtccttgagcagcagcgtgttggcctggccgtggatatggacggcgagtacctgtccatgtag

SEQ ID NO: 232377 - DNA, 681 bp, Artificial Sequence
  Description of Artificial Sequence: Synthetic coding sequence
ctcagccgggaactgctggaagtggttgaaccagaggtacttcaggactccttggaccgctgttattctactccaagctcttgcctggaacaacctgattcatgccagccttatggcagctcgttttacgcactagaagagaaacacgtgggcttttctctggatgtcggcgagatcgaaaagaaaggcaagggtaagaaaaggcggggtagaagaagcaaaaaagagaggcgcaggggacggaaagagggggaggaggatcagaaccctccctgcccaagattaagtagggaactacttgatgaaaagggtcctgaggtactacaggattcgctggatcggtgttattcaactccttcaggctgcctcgagcttactgactcctgccagccctaccggagcgccttctatgtgctagaacaacagcgcgtgggattggccgtggatatggatgagatagaaaagtatcaggaggtggaggaggaccaagaccccagctgcccgaggctgtcaagagaactgctcgatgaaaaggagcctgaggtgctgcaggacagtctcgatcgatgctattcaacgccatctgggtatctcgagcttccagacctgggccagccgtacagtagtgcagtctatagcttggaggagcagtatcttggccttgctctggacgtcgattag

SEQ ID NO: 232378 - DNA, 810 bp, Artificial Sequence
  Description of Artificial Sequence: Synthetic coding sequence
atggacgaaattgaaaaatatcaggaggtggaggaagaccaagacccctcatgcccgagactctcacgtgaactactggatgagaaagagcccgaagttctgcaggatagtttagaccgctgctacagcaccccctccgggtatttggaactaccggacctcgggcagccatattccagcgctgtatatagtctggaggagcagtatctggggctagctcttgacgtggacagaacaaaaaaagatcaggaggaggaggaggaccaggggccaccttgccctcgtctatcccgagaactgttggaggtggtagagcctgaagtacttcaggactccctggaccgctgctacagcaccccctctagctgtctggagcagccagactcttgccaaccctacggttccagtttttatgctctcgaggagaagcacgtgggattctcactcgacgtgggggaaatcgagaaaaaaggtaaaggcaagaagcgaaggggcaggcgctctaagaagaagagaaggcgtggacgcaaggaaggggaagaagatcagaacccaccgtgtccacggctcaacggcgtattgatggaagttgaggagccggaggtcctgcaagacagtcttgacgggtgctatagtacaccatccatgtattttgaactccccgacagctttcagcactaccggagtgtgttctatagtttcgaagaacagcacatctctttcgctctgtatgttgacaatcggttcttcacactcaccgtgacaagccttcacttagtgttccaaatgggcgttatttttccccaatag

SEQ ID NO: 232379 - DNA, 474 bp, Artificial Sequence
  Description of Artificial Sequence: Synthetic coding sequence
ctgtctagggagctcctggaggtggtggagccggaagtcctgcaagactccctggaccgttgctattcaacacctagttcatgccttgaacagcctgattcttgccagccgtacggctcctccttttacgctttggaagagaagcatgtgggcttcagccttgacgtgggggaaattgaaaagaagggcaaagggaagaaaaggcgtggacgtcgctccaaaaaagaacgacggaggggcagaaaagaaggagaggaagaccagaaccccccatgtccccgtctgtcccgggagttgctggatgaaaaaggtcccgaggtgctccaggatagtcttgaccgatgctacagtaccccgtccggctgtctggaactaaccgacagctgtcaaccctatcggagcgcgttctacgtccttgaacagcagagagtcggcttagccgttgacatggatggcgagtatttgtcaatgtag

SEQ ID NO: 232380 - DNA, 525 bp, Artificial Sequence
  Description of Artificial Sequence: Synthetic coding sequence
ctcagtagggaactgctggaggtcgtggaacccgaagtgctccaagactcactggatcggtgctattccactccaagtagctgtctggaacagccggacagctgtcagccctatggatccagtttttacgccctggaggagaagcatgtgggattctccctggacgttggagagattgagaagaagggcaagggtaaaaaacgcagaggacgcaggtctaaaaaaaagcggagacgagggagaaaggagggagaagaggaccagaatcctccttgtccgagactaaacggtgtgctgatggaagtggaggagcctgaggtactgcaagacagtctggacggttgctactctacaccctctatgtactttgagctgcccgacagcttccagcattaccggtcagtgttctactcgtttgaagagcagcatatttcatttgccctttacgtcgataataggttctttacacttacagtcacaagtttacatcttgtcttccagatgggtgtgatcttcccacagtag

SEQ ID NO: 232381 - DNA, 456 bp, Artificial Sequence
  Description of Artificial Sequence: Synthetic coding sequence
ctttctagggagcttctggaagtggttgagccggaagttttacaggattccttggaccgatgttactctacgccttcctcctgtctggagcagccagactcctgccaaccatatggcagcagtttctacgcgttagaagaaaagcacgttggttttagcctggacgtgggggaaatcgaaaaaaaaggtaaaggtaaaaagcggcgtgggcgtcgatccaaaaaggagcggcgaagggggagaaaggaaggagaagaggatcagaatcctccctgtccacggctgtcacgcgaactcctcgatgagaaaggcccagaggtactgcaggattcgctagacaggtcttattcgactcctagcggctgcctagagctgacagattcttgccagccttatcggtcagctttctatgtgctcgagcaacagagggtaggactcgctgtggacatggactag

SEQ ID NO: 232382 - DNA, 759 bp, Artificial Sequence
  Description of Artificial Sequence: Synthetic coding sequence
atggacgaaatcgagaaatatcaagaagtcgaggaagaccaagacccatcctgtccccgactcagccgtgagttgctggacgagaaggagccagaggtgttgcaggactccctcgaccggtgctactccacgccctccggatacttagaactgcctgacttgggacagccttatagtagtgctgtgtacagtttggaggaacagtacctcggcctggcccttgacgttgataggaccaaaaaggaccaggaagaggaagaggaccagggcccaccgtgcccaaggctctcgagggaattgttggaggtcgtggaacctgaagtcctgcaggactctctcgacagatgctactccacacctagctcatgtctcgagcaacctgatagttgccaaccttatggctcctcattttatgccctagaggagaaacacgtaggcttttccctggatgtgggggaaatcgaaaagaaaggcaaaggaaagaaacggcgaggacggcgaagcaaaaaagaaaggaggagaggacgaaaagaaggggaagaagatcagaaccccccttgtcctcggttgagcagagaactgcttgatgagaaggggcctgaggtactccaggactccctggaccgctgttactctaccccatcggggtgtcttgaacttaccgatagctgccagccgtaccggtccgcgttctacgtcctggagcagcaaagggtggggctggccgtcgatatggacggggaatatttgtccatgtag

SEQ ID NO: 232383 - DNA, 1734 bp, Artificial Sequence
  Description of Artificial Sequence: Synthetic coding sequence
atggtagtatctgcagggccatggtccggagaaaaggctgagatgaatattctggaaattaacaagaaaagccgccctcagcttgccgagaataagcagcagtttcggaacctcaagcaaaagtgcctagtgacccaggtggcctacttccttgcgaacagacagaacaactatgactatgaggactgtaaagatctcatcaagtccatgctccgcgatgaacgcctgctgactgaggaaaaactcgctgaagaactgggccaagcggaagagctcaggcagtataaagttctggttcatagtcaggaaagggaactgacacaactgcgtgaaaaactgcaggagggcagggatgccagccgcagtttgaaccagcacctgcaggccctgctaactcccgacgaacctgataacagccaaggcagggacctccgagagcagctcgctgaaggatgtcgtcttgctcagcacctcgtgcaaaagctgtctcctgaaaatgacgatgacgaagatgaagacgtgaaggttgaagaggcggagaaggtacaggagctctacgccccaagagaggtacagaaagccgaggaaaaagaagtgccagaggattccctggaagagtgcgctataacttgctccaatagccatcatccctgcgagagtaaccagccctacggcaacaccagaataacattcgaggaggatcaggttgatagcacactgatcgactcttcaagccacgatgaatggcttgacgccgtgtgcattatcccagaaaatgaatccgatcatgagcaggaagaggagaagggccctgtcagtcctcgcaatctccaggagtctgaagaggaggaagcgccacaggaatcgtgggacgagggcgactggacactgagtattccaccagatatgtctgcaagttatcagtctgaccggagcacctttcattccgttgaagagcagcaggtgggtctagcactagacattggtagacactggtgtgatcaggtaaagaaagaggaccaggaggccacctctcctcggctctctagagagctgctggacgagaaagaacccgaggtgcttcaggactctttggaccgattctattccacacccttcgagtacctcgagctgccagatctgtgccagccttaccgaagcgacttttacagcctccaggagcagcatctaggcctggcactagatctcgacagaatgaaaaaagatcaggaagaagaggaggatcagggccctccctgccctcgactgagccgcgaattaccggaagtggtcgagccagaggacctgcaggactcactggaccgatggtattcaacaccattcagctatccagaactgccagatagctgccagccctacggcagctgcttttactccttggaagaggagcatgtcgggttctcactggacgtagacgagatagagaaataccaggaaggagaggaggaccagaaacccccttgtcctaggctaaacgaggtgctcatggaagccgaggaaccagaagtcttgcaagactccttagatcgctgctattctaccacaagcacatactttcaattgcatgctagctttcaacagtatagatccgcgttctactcatttgaggagcaggacgtgagtttagccctggacgtagacaacaggttcttcactcttacagttattagacaccacctggcatttcagatgggagtgatttttcctcactag

SEQ ID NO: 232384 - DNA, 1902 bp, Artificial Sequence
  Description of Artificial Sequence: Synthetic coding sequence
atgcccttgacccctaccgtacagggattccagtggaccctgagaggcccagacgtggagacttcacccttcggtgccccacgggctgcctcccacggcgtcggacgccatcaggaactgcgggatcctaccgtgcctggtcccacttcatctgcaactaatgtcagtatggtggtgtctgccggaccctggtctggcgagaaggccgaaatgaatatcctggagatcaacaagaagagcagaccccagttggcggagaataaacagcagttccgaaacctcaaacaaaagtgcctggtgactcaagttgcatacttcctggccaatcggcagaataattatgactatgaagattgcaaggatctgattaaatcgatgctaagagacgagagattactcacagaagaaaagttggcagaagaactcgggcaggcagaggaactgcgacagtacaaggtgttagtgcatagccaggagcgagaactgactcaactgcgagagaaattacaggaggggcgagacgccagccgatcactcaaccaacatctgcaggctttgcttactcccgatgaacccgataattcacagggacgggaccttcgcgagcagttagcagaaggatgccgcctggcccagcacctcgtccagaagctttcacccgagaatgacgatgacgaagatgaagacgtgaaagtcgaggaagccgagaaagtccaggaactgtacgccccaagggaggtacagaaggctgaggagaaggaagtaccagaggactcattagaggaatgcgcaattacatgctctaacagccaccacccgtgtgagtcaaatcagccatacgggaataccagaatcacctttgaggaggaccaagtggattcaaccctcatagatagttcctctcatgatgagtggttagacgctgtgtgtatcatacctgaaaacgagtctgatcacgagcaggaggaggaaaaaggcccagtatcacccaggaatctccaggaaagtgaggaagaggaggcacctcaggaaagctgggacgagggagactggaccctgagtatcccacctgacatgtccgccagttaccagagcgaccgctccacttttcactccgtggaggaacagcaggtgggattagcactcgatattggccgtcactggtgcgaccaggtgaaaaaagaggaccaggaagcgacctcccccaggctctctcgcgagctgcttgacgaaaaagagcccgaggtgttacaagattctctcgatagattttacagtactccttttgaataccttgaactgccagacttgtgtcagccttacagatcagatttctactcgttacaggagcagcatttaggactggcactggacttggaccggatgaaaaaagaccaggaggaggaagaggaccagggcccaccctgtcctcgcctgtccagagagttacccgaagtagtggagcccgaagatctgcaggactccctcgataggtggtacagcacccctttttcctacccagaactgcctgactcgtgtcagccatacggaagctgcttttactccctcgaggaagagcacgttgggttcagtctcgatgtggatgagattgaaaagtatcaggaaggtgaggaggatcagaagccaccctgcccacggctgaacgaagtgctcatggaggccgaggagcccgaggtgctgcaggacagcctggaccggtgctattctacaacaagtacctacttccagctgcacgccagtttccagcagtataggtcagcgttctactccttcgaagaacaggatgtcagtctggctctcgatgtagataacaggttttttactctgaccgttatcaggcaccacctggctttccagatgggcgttatctttcctcattag

SEQ ID NO: 232385 - DNA, 1866 bp, Artificial Sequence
  Description of Artificial Sequence: Synthetic coding sequence
atgcccttgacgccaaccgtgcagggctttcagtggacattgcgtggccctgacgtggaaacaagtccattcggcgctcccagggctgcttctcatggggtgggtcgtcaccaagaactgcgggaccccacagtaccgggtcctacaagctctgcaaccaatgtttccatggtcgtctctgctggcccatggagcggagagaaagcagaaatgaacatcttggagattaataaaaaaagccgccctcagctcgctgagaataagcaacagtttcgcaaccttaaacagaagtgtttggtgacccaggtggcttatttcttagcgaatcggcagaacaactatgactacgaggactgtaaagatttgatcaagtccatgctgcgagatgagagacttttgacagaagagaaactagcagaggaactcggtcaagcggaggagctccgccaatataaagttttggtgcatagtcaggagagggaactgacgcagctgagggaaaagctgcaggaagggagggacgccagcagaagcttgaatcagcacctgcaggctttactcactccagatgaacctgataactctcagggcagggacctgagagagcagcttgcggaaggctgtcgtctcgcacagcatctcgtccaaaagctgtccccggaaaacgacgacgatgaggatgaggacgtcaaggtggaagaagcggagaaggtacaggagctttacgctccacgggaggttcagaaggcagaggagaaagaggtccctgaggacagtctggaagagtgcgctataacatgctcaaattcccatcatccttgcgaatctaatcagccttatggtaacaccagaatcaccttcgaagaggatcaagtggacagcacgctgattgacagcagctcacatgacgagtggctggacgcagtttgcataatcccagagaacgaaagcgatcatgaacaggaagaagagaaaggtcctgttagcccccgatcgtccgggagattttgttgcctgatttccgtcgggtacatcttttgccatccatgtccagcttggcttatacggaacctgcaggaatccgaggaggaggaggcacctcaggagagctgggatgaaggccactggtgcgatcaagtaaaaaaggaggatcaggaagctacctcccctcgtttgtcccgggagttactggacgaaaaggagcccgaagttctgcaggacagccttgatcgcttctacagcacccctttcgagtatctcgagctgccagacctgtgtcagccataccgtagcgacttctacagcctccaggagcaacacctgggattagctcttgacctcgatcgtatgaaaaaggatcaggaggaagaggaggatcagggcccaccttgtcctcgcctgtcccgcgaactccctgaagttgttgagcctgaggacttgcaggattccctcgaccgatggtacagcaccccattctcctatcccgagttacccgattcttgtcagccctacggctcatgcttttacagtcttgaggaggagcacgtcggcttttccctggatgtggatgagattgaaaagtaccaggaaggggaagaggatcagaaacccccttgtcccagactcaatgaggtcttgatggaggccgaagagcctgaggttctacaagacagcctcgaccgctgctattcgacaacaagcacctacttccaactccacgcctccttccagcagtatcgatccgccttttactcatttgaagagcaggatgtgtccctcgctctcgacgtggacaataggttttttaccctgaccgtgatacgtcatcacttggccttccagatgggcgtgatcttcccacactag

SEQ ID NO: 232386 - DNA, 1062 bp, Artificial Sequence
  Description of Artificial Sequence: Synthetic coding sequence
atggtcgtgtccgctgggccttggtccggtgagaaggcagaaatgaacatactagaaattaataaaaagagccggccacagctggccgaaaataagcaacaatttcgcaatcttaaacagaagtgccttgttactcaagtggcctacttcctggccaaccggcagaataattacgactatgaagattgcaaagatcttatcaagtctatgcttcgtgacgagagactgctgacggaagaaaaactcgccgaggagttgggccaggccgaggagttgcggcagtacaaagtcctggtacacagccaggaacgggaactgacacagctacgcgagaagctccaggagggaagggacgcaagcagatctctcaatcaacatcttcaagcactcctcactccggatgagcctgataatagtcaaggccgtgaccttagggagcagctagccgaaggctgtcgactagcacaacatctggtgcaaaagttgtcaccggagaatgatgacgatgaagacgaggacgttaaagtggaggaggcagagaaagtccaggagttatacgctccacgggaggtgcagaaagcagaggagaaggaggtgccggaagatagcctggaagaatgcgcgattacctgctccaattcccatcacccatgcgaatccaatcagccctacggcaacacacgtatcactttcgaggaggatcaagttgactcaaccctcatcgacagtagtagtcacgatgagtggttggatgcagtgtgtataatacccgaaaatgagtctgatcatgagcaagaagaggagaagggaccagtgtcccccagaaacctccaggaatcggaggaggaagaggcaccacaggagtcctgggacgaaggagactggactctatctattcctcctgatatgtccgctagctaccagtctgatcggagtacattccacagtgttgaagagcagcaggtgggtctggccctggacatcggccgtcactggtgcgaccaagaaaaagggggtcccaggggccataagtctcaggcccagcagggggctgcaggatag

SEQ ID NO: 232387 - DNA, 1668 bp, Artificial Sequence
  Description of Artificial Sequence: Synthetic coding sequence
atggtggtgtccgccggtccgtggagcggtgaaaaagctgagatgaatatcctcgaaatcaacaagaaaagccgcccacagctcgctgaaaataagcagcagtttagaaacctcaaacaaaagtgcttagtgactcaggttgcttattttttggcaaatcgacagaataactacgactatgaggattgcaaagatctgataaaaagcatgttaagagatgaaaggttgctaactgaagaaaagcttgcggaggaacttgggcaggctgaggagctgagacagtacaaagttctcgttcactcacaggagcgagaactcacacagctccgcgaaaagctgcaggaaggacgtgacgcgtccagaagcctgaatcagcacctgcaggccctccttacccctgacgaacctgacaattctcaggggcgagatttgcgggaacaattggcagaggggtgtagactcgcgcagcacctcgtacagaagctgtctccggagaacgacgacgatgaggatgaagatgtaaaagtcgaagaggccgaaaaggtgcaggagctgtatgcgcctcgcgaagttcagaaggcggaagaaaaggaagtccccgaagactcgttagaggaatgcgcgataacctgctcgaacagccaccacccttgcgagagcaatcagccctatgggaatacacgtatcacatttgaagaggaccaagtagatagtaccctgatcgactcttctagccacgatgaatggctggatgccgtctgcataatacctgagaacgagagcgatcatgagcaggaggaggagaaagggccagtgagccctcgcaaccttcaagagtcggaagaagaagaggcaccccaagagtcatgggacgagggggactggacactttccattccaccggatatgagcgcctcatatcagtctgaccggtccaccttccattctgtagaagaacagcaagtgggtcttgcgcttgatatcggaagacattggtgtgatcaggtgaaaaaggaggaccaggaagctaccagcccgagactgtctagggaattacttgatgaaaaggagccagaagtgttacaagactccctcgatcgcttttatagtacgccctttgagtatctggagctgccagacttatgtcagccataccggtcagatttttactcactccaggagcagcaccttggactcgccctggatctggatcggatgaagaaggatcaagaagaggaggaagaccagggacccccatgcccaagactttcccgggaactccctgaagtggtggaacccgaagatctccaggactctttagacagatggtattcgactcctttttcatatccggagcttcctgattcatgccaaccttacggcagctgtttttatagtctagaggaggaacatgtaggattcagcctggatgtagacgaaattgaaaagtatcaggagggagaagaagatcagaaacccccatgtccaaggctgaatgaggtcctgatggaggctgaagagccagaagtcctgcaggacagtctggacagatgctactccaccacatcaacctatttccaactccatgcaagcttccagcagtaccggtcagccttctattctttcgaggagcaggacgtcagcctggctcttgatgttgacaattag

SEQ ID NO: 232388 - DNA, 1692 bp, Artificial Sequence
  Description of Artificial Sequence: Synthetic coding sequence
atgccgcttactcctacagtccagggctttcaatggacattaaggggccctgatgtggagacatctccatttggcgctcccagggccgcatcacatggcgtgggcaggcaccaggagttgcgggacccaactgactacgaagactgcaaggatttgatcaagtctatgttgagggacgagcgtttgttaactgaagagaaactagcagaggaactgggtcaggccgaggagttaaggcagtataaggtcctcgtgcacagccaggagagggagctaacccagttacgcgaaaaactgcaggaggggagagacgcctcccgctctctcaaccagcatttgcaggctctgcttaccccagatgaacccgacaattctcaaggacgggatctgagggaacagctggccgaggggtgcaggcttgcgcaacacctggtccagaagctgtcacctgagaacgacgatgacgaagacgaggacgtgaaagttgaggaagcggaaaaggtgcaagaactgtacgcaccgagggaggtgcaaaaggccgaggagaaggaggtacccgaggacagtctggaagaatgcgcgattacttgttccaacagtcaccacccgtgcgaaagtaaccagccctatgggaatacccgtatcacctttgaggaggatcaggttgattccactcttatcgactccagctctcatgacgagtggctcgatgcggtttgcatcataccagagaatgagtctgatcacgagcaggaagaggaaaagggacctgtctccccaagaaacctgcaggagtctgaagaagaagaggctccgcaggagtcatgggacgagggcgattggaccctctccattcccccagatatgagcgccagctaccagagcgatcgtagtacttttcactctgtggaggaacagcaggtgggcctggccctggatatcgggcgacattggtgcgaccaggtcaaaaaggaggaccaggaagctaccagccccagactaagcagagagctccttgatgaaaaggagccggaagtgttacaggattctctcgaccgattctattctacaccgttcgaatacctggagctaccggatctttgccagccataccgcagcgacttctacagcctgcaagagcaacatctcggtctggcgcttgacctcgatcgcatgaagaaggaccaggaagaagaagaggaccaagggccaccatgtcctcgtttatcccgtgagctccccgaggtggtggaaccagaggatcttcaagacagcttggatcggtggtattcaacccccttctcctacccagagctgccggattcttgccaaccatatggtagttgcttttactcactcgaagaggagcacgtcggtttttccctcgacgttgatgagattgagaagtatcaggaaggcgaggaagatcagaaaccgccttgtcccagactgaacgaggtccttatggaggccgaagagcctgaggtattgcaggactcactggatagatgttactccacaacaagcacatacttccagctgcatgcatccttccagcagtatcgaagcgcattctactcctttgaggaacaggatgtctccctggctcttgacgttgacaacagattcttcaccctgacagtcattcgtcatcatttggctttccagatgggcgtcattttccctcattag

SEQ ID NO: 232389 - DNA, 1917 bp, Artificial Sequence
  Description of Artificial Sequence: Synthetic coding sequence
atggtggtgtccgccgatcctctctcttctgaaagggcagagatgaatatcctggagattaatcaggagctccgcagtcagcttgctgaatcaaaccagcagttccgcgatttaaaggaaaaatttctgatcacacaagcgacagcttatagcctggcaaatcaactgaagaagtataagtgcgaagaatataaggacatcattgattctgtgctgagggacgagctccaatctatggaaaagctcgccgagaagcttcgacaggcggaggagctgcgccagtacaaggctctcgtgcatagtcaggccaaagaactcacccagttgcgggagaaactccgtgagggaagggacgcttctagatggctgaataaacatttgaaaaccctgttgactccagacgacccagataagtcccagggtcaggacctgagagagcaactcgcagagggccaccggctggccgagcacctggttcacaagctgtcccctgaaaatgacgaggacgaggacgaagacgaggacgataaggacgaggaggtggaaaaagtgcaagaatctcctgcccctagagaagtgcagaaaaccgaggaaaaagaagtgcctcaggatagcctcgaggaatgtgctgtcacttgttctaactctcataacccctctaattctaatcagccccatagatcaactaagatcacatttaaggaacatgaagttgattctgcgctcgtcgtggaaagcgaacatcctcatgacgaagaggaagaggctttgaacatcccacctgagaatcagaacgatcatgaggaggaagaagggaaggcccctgtgcctccaaggcatcatgacaaatcaaacagttaccgacatcgcgaagtgtctttcctagccctcgatgagcaaaaagtctgcagcgcccaggacgtggctagggattacagcaacccaaagtgggacgagacatctctaggttttctggaaaagcagtcggatctcgaggaggtgaagggccaagaaacagtagccccaagactgtccaggggacctctacgggttgataagcatgagatcccccaagaatccctggatgggtgctgtctgacaccgtcaatcctgccagaccttactccttcttaccatccatactggagtaccctgtatagcttcgaggacaagcaggtctcactcgccttagttgacaagataaagaaagatcaggaggaaatcgaggaccagtcaccaccatgccccaggctcagccaggagctgcctgaggttaaagaacaagaagttccggaagacagcgtgaacgaagtgtatttaacccctagcgtacaccacgacgtgagcgattgccaccagccttactccagtaccctatcctccctcgaagatcaactcgcatgttcagccctggatgtagccagtcctacggaagccgcttgtccgcaggggacatggagtggagacctatcccaccatcagagcgaagtccaggtgagccaggcgcagctggagccatcaaccctcgtccccagctgtctccgccttcagctggatcagggattccactgcggcaacgggctggcgcagcgcggattatccagcacaacttgctcgttttcggcgaatgcggattccggaaaccaatggccttttcaggagctggtgctggaaccttcactaggcatgaaaaatccaccacagctggaagatgatgccctggagggcagtgccagcaacacccagggtcgccaagtcaccggccgaatcagggcaagtttagtgttaatcctgaagacaatccgtagacggctccccttctcgaaatggcggctagcttttaggtttgcagggccacacgctgagtcagccgagatacccaataccgcaggccgaacacagaggatggctggctag

SEQ ID NO: 232390 - DNA, 1917 bp, Artificial Sequence
  Description of Artificial Sequence: Synthetic coding sequence
atggtggtcagcgctgaccccttatcatccgagagagctgaaatgaatatcctagagatcaatcaggagttgaggagtcagttagccgaatccaatcaacagttccgtgatctgaaagaaaaattcctcatcacacaagcaacagcgtactcacttgcaaaccagctcaaaaaatataaatgcgaagaatataaggacataatcgacagtgtgctgagagatgaattgcagtccatggaaaagcttgcggaaaagctgagacaggccgaggagctcagacagtacaaagcgcttgtccactctcaggccaaggagctgacacagcttcgagaaaaactgcgcgaggggagggacgcctcaaggtggttaaataagcacctgaaaacgcttctgacacctgatgatccggacaaatcccagggacaagacctacgggagcagctcgcagagggccacaggctggcagaacatctcgtgcacaagctgtccccggagaatgatgaggatgaagacgaggatgaggacgacaaagacgaggaagtagagaaggtgcaggagagcccagcccctcgggaggtgcaaaagaccgaggagaaggaagtgcctcaggattctcttgaggagtgtgccgttacctgtagtaacagtcacaatcccagcaacagtaaccagcctcaccgaagcaccaaaattactttcaaggagcatgaagttgatagtgccctcgtggttgagtccgaacatccccacgatgaggaggaagaagcgttgaatatacccccagaaaaccagaatgaccacgaggaagaagaaggcaaggctcctgtgccgccaaggcaccatgacaaatctaattcctacagacaccgagaagtgagcttcctcgccctcgacgaacagaaggtctgcagcgcccaggacgttgcacgcgattacagcaatccgaagtgggacgagacatctctggggttcctggagaagcaatctgacctcgaagaagtgaaggggcaggaaacagttgcgcctaggctgtcgcgcggacctctcagagtagataagcatgagataccgcaggagtctctggacgggtgctgcctgaccccatcaatcctccccgaccttactccatcttaccacccttactggtcaacactgtactctttcgaagataagcaagtcagcctggccctggtggacaagatcaaaaaggaccaagaggaaattgaggatcagtcaccgccttgtccaagattgtcccaggaactcccagaagtcaaagaacaggaagtaccggaagacagcgtgaacgaagtctacttaacgccctctgtgcatcacgacgtcagcgactgccaccagccctattcctctaccctgtcgtcgcttgaagaccaactggcctgtagtgccctggatgtggcttcacccacggaggccgcatgcccgcaaggtacctggtcgggcgatttgtcgcaccatcagagtgaagtacaggtttcacaggctcagctggagccaagcacgctcgtcccttcatgtcttcggctacagctggatcaggggttccactgtggtaatgggctcgcccagcgcggactttcctcaaccacttgctcctttagtgctaatgccgactctgggaatcaatggccctttcaggagctggtcctcgaaccaagcctcggaatgaaaaatcctccacaacttgaggacgacgctcttgaggggtctgcatccaacacacaaggcaggcaggtgaccggaaggattagagccagcctggtgctcattctgaaaacaatcaggagacgactcccattttctaagtggagactggcctttagattcgccggacctcacgctgaatcagcggagatcccgaacacagctgggaggacgcagcgcatggctggttag

SEQ ID NO: 232391 - DNA, 1722 bp, Artificial Sequence
  Description of Artificial Sequence: Synthetic coding sequence
atggttgtcagtgccgatccgcttagcagcgagcgcgcagagatgaatatattggagattaatcaggaactcaggagccagctggctgaatcaaaccaacagttccgtgacttgaaagaaaaattcctcatcactcaggcgacagcgtatagtcttgctaatcaactgaagaaatataagtgcgaggagtataaggatattatcgacagcgtccttagagatgaactccagtcgatggagaaactggctgagaagctgcggcaagccgaggaactccgccagtataaggccttggtccactctcaggctaaggagctgactcagctgagagagaagctgagagaaggcagggacgcctcacgctggctgaataaacatctgaagacactgttgacaccggacgaccccgataagtcacaaggacaggaccttagagagcagttggccgaaggacaccgcctggccgaacatctggtgcacaaattgagccccgagaatgacgaagacgaggacgaggacgaggatgataaagatgaggaagtggaaaaagttcaggagagtccagctccgagggaggtccagaaaactgaggagaaagaggttccacaggactccctagaagagtgtgccgtcacatgcagcaatagtcacaatccatcgaattccaatcagcctcacaggtctacaaagattacctttaaggagcatgaagtcgactcagccttggtggtagagtctgaacatccccatgatgaggaggaagaggcactgaatattccccctgagaaccagaatgaccatgaagaagaggagggcaaagctcctgtccctcctagaaaccggcagagcctcgaaccgggagaactcaccaacttacgcgatttccttatatctccagtagtaagtcacgtggccaaccctggtcatcacgacaagagcaactcctatcggcacagggaagtgagctttttggctctcgatgagcaaaaggtttgcagcgcgcaagatgttgctagagactacagtaaccccaagtgggatgagacttcactcgggttcctggaaaagcaatccgatctggaggaggtaaagggccaggagaccgtcgccccaaggctgtctaggggccctctgcgtgtggataagcacgaaataccccaggaatctctcgacggctgttgtcttacaccttcgattctgccagatctgaccccgtcttatcatccatattggagcacactctattcatttgaggataagcaggtttccctagccctcgtcgacaaaatcaagaaagatcaggaggaaattgaagaccaatcacctccctgccctagactttctcaagagctcccggaagtgaaagaacaagaagtcccagaggattctgtcaatgaggtgtatttaacaccatccgttcatcacgatgtgagcgattgccaccagccttatagtagcacacttagcagtcttgaggaccaactggcctgttcagcgctggacgtggccagccctacggaagccgcatgcccccaggggacatggtccggagacttgagccatcatcagtccgaggtgcaagtaagccaggcccagctcgaaccttcgacccttgttccaagttgcctgcgccttcaactggaccagggcttccactgcgggaatggcctggcacagagaggcctgtccagcacgacctgctcattttctgctaacgcatag

SEQ ID NO: 232392 - DNA, 372 bp, Artificial Sequence
  Description of Artificial Sequence: Synthetic coding sequence
atggtggtgtctgctgatccactttcttcagaacgagctgagatgaatatactggagattaaccaggaactgcgctcacagctcgctgaaagcaaccagcagtttcgcgacctgaaggaaaagttccttatcactcaggcaactgcctattctcttgcaaaccagctcaagaagtactcgtgcttgaaatacaggaatcacctgccaccagaacgctgtcgcaggctgaagaaacgaaaatcactgcgcacccattggaggaacgtgctatccctcgttcagatagtgacgacactactgactcccacatctctcacaggggcacccaagagtcacctgcgcaataccaaaagcactctgctgtggctgtag

SEQ ID NO: 232393 - DNA, 2004 bp, Artificial Sequence
  Description of Artificial Sequence: Synthetic coding sequence
atggtggtctcagcagacccactgagtagcgaacgcgcagagatgaatattcttgagatcaaccaggagttgagatcacagcttgcagaaagtaatcagcagttccgcgacttaaaagagaagttcttaatcacacaagccactgcctattctctggcaaaccagctgaaaaagtacaagtgtgaggagtataaagacattatagactctgttctcagggatgaattgcagagcatggagaaactggctgagaaattaagacaagccgaggaactaagacaatataaagcactcgtccactcacaggccaaagaactgacacagctgcgagaaaaactccgcgagggacgcgacgcctccaggtggttgaataagcaccttaagactttgctgacacccgacgatcccgacaagagccaaggccaggacctgagagagcagctggccgaaggtcatagattagctgagcacctcgtccacaagctgagtcctgaaaacgacgaagatgaggacgaggatgaggatgataaagacgaagaggtggagaaggtccaggagtccccagctccccgtgaagtacaaaagacggaggagaaagaggtgccccaggattccctggaggagtgtgctgttacttgttccaattcgcacaacccttccaactcaaaccagccgcatcgatccaccaaaatcacttttaaggagcatgaggtggattccgcactggtcgtagagtccgagcacccacatgatgaggaggaagaagctctgaatatcccaccagaaaaccaaaatgaccacgaggaagaggagggcaaagcacctgtcccgccaagaaatcgtcagagcttggaacccggagagctgaccaacttaagggactttttaatcagtccagtggtctcgcacgtggcgaacccgggacaccacgataagtcaaattcctacagacaccgtgaggtgtctttcctggcattggacgagcaaaaggtttgttctgcccaggacgtggccagagattactctaaccctaagtgggatgaaacaagcttaggattcctggagaaacaaagtgacttagaagaggtaaaggggcaggagacagtggctcctaggctctctagagggccactccgggtggacaagcatgagatcccccaggagtctctcgatgggtgttgcctcaccccctcaattcttccagacctgacaccctcctatcatccttactggtcaacactttacagtttcgaggataaacaagtgtcgctggctctggtggataagattaaaaaggatcaggaagaaattgaggaccagtccccgccatgtcccaggttgtcacaggaacttcccgaagtcaaggagcaggaggtgcctgaagacagcgttaatgaggtgtacttgactccaagcgtgcatcatgacgtttctgattgtcaccagccttactcttccaccctgtcctcgcttgaagatcaactcgcttgttccgcccttgatgtcgctagtcctaccgaggccgcttgtcctcagggaacctggtcaggcgaccttagccaccatcgatccgaagtgcagatcagtcaagcccaactcgaaccatctacactcgtgccctcttgcctccggcttcagttagaccagggctttcactgtggcaacggtctcgctcagagggggttgtcctccactacatgctcctttagcgccaacgcagactctgggaatcagtggcccttccaagaactggtccttgagccaagtctgggaatgaaaaacccaccccagttggaagacgatgccctggaaggatccgcttctaacacccaggggagacaggtgacaggcaggatccgggctagcttggtcctaatcctgaaaacaatacgcaggaggctgccgttctctaaatggcggctcgcctttcgtttcgccggtccacacgcggaaagcgctgagatccctaacaccgcggagagaatgcagaggatgattggatag

SEQ ID NO: 232394 - DNA, 1722 bp, Artificial Sequence
  Description of Artificial Sequence: Synthetic coding sequence
atggtcgtttcagccgatcctctatcatctgagcgcgcagaaatgaacatactggaaataaaccaggagctgcgcagccagttagcggaatctaatcagcaatttagagacctaaaagagaagtttctcatcactcaggcaactgcctatagtctggctaaccagctgaaaaagtataagtgtgaggagtataaggatatcatagactctgtgttgcgagatgagctgcagagtatggagaaactggcagagaaactgcgccaggccgaggagctacggcagtacaaagccttggtgcattcacaggccaaggaattaacccaactccgagagaaactgagggaggggagggacgctagtagatggctgaataaacacctgaagactctgttgaccccggacgaccctgacaagtcacaggggcaggatttgagagagcaactagccgagggtcacaggctcgccgaacacctggtccacaaactaagcccagagaacgatgaggatgaggatgaggatgaggacgataaagacgaggaagtggagaaagtccaagagagtcctgccccaagggaagttcaaaagacagaagaaaaggaagtgcctcaggattcactcgaggagtgtgctgtgacttgtagcaacagccacaatccttccaacagcaatcagccacaccggtcaacaaaaattaccttcaaggaacacgaggtcgacagcgccctggtggtagaatccgaacacccacacgacgaagaggaggaggctttaaatatccccccagagaatcagaacgaccacgaggaggaagagggcaaggctcccgtgcccccaagaaaccgccagagtctcgagcctggcgagttgaccaatcttcgtgactttctcatctcccccgtagtgtctcatgtcgctaatcccggacaccatgacaagtcaaatagttaccggcatcgggaagtgtcttttctggcacttgatgagcagaaggtgtgcagcgcacaggacgtagccagggattactctaaccctaagtgggacgagacctcactgggatttctcgagaaacagtctgatctagaggaggtcaaggggcaagaaactgtggcaccacgcctcagcagaggcccactccgggtggacaagcatgagattcctcaggagtctctggacggttgctgtctgacaccaagtatcttacctgacttgaccccctcttatcacccctattggtcaactttgtactcgttcgaagacaaacaggtatcactggctctggtagataaaatcaaaaaggaccaggaagaaatcgaggatcaaagccccccttgtcctaggctgtcccaggaattacctgaagtcaaggagcaagaagttccagaagactccgtgaatgaggtgtacctgactcccagcgtccaccacgacgtatcagattgccaccagccctactcatcaacgttgtcgtccttagaagatcagctagcctgttcagcactggatgtggcctctcctacggaagctgcctgcccccaagggacatggagcggagacttaagccaccacagatctgaggtccagataagccaggcacagcttgaaccatctacgctggtgccctcttgcctgcggttgcagttagatcagggatttcactgcggtaacggcttggcgcaacgagggttatcttccaccacttgcagcttctctgctaacgcttag

SEQ ID NO: 232395 - DNA, 1917 bp, Artificial Sequence
  Description of Artificial Sequence: Synthetic coding sequence
atggttgtttccgccgacccactctcttcagagcgagcggaaatgaatattctcgagatcaaccaggagcttcgtagtcaactggccgaaagtaatcagcagtttcgggatctgaaagagaagttcttgataacccaagcaacggcctattccctcgcaaaccagctcaaaaagtataaatgcgaggagtataaggacattatagatagtgtgctgagagatgaattgcagagtatggagaagctagccgagaagctgcgtcaggccgaagagctaagacagtacaaagccctggtccactcccaagcaaaggagttgactcagctgagagaaaaactgcgtgaaggtagagacgcttcccggtggctgaacaagcatctaaagacccttctgaccccggatgaccccgataaaagccaaggtcaggatttgagagagcagctagcagaggggcaccggctggctgagcacctggtccacaaattgagccccgagaacgatgaagacgaggatgaggacgaagacgacaaggatgaagaagtcgaaaaggtgcaggagagccccgctcctagagaggttcagaaaacagaagagaaagaagtcccccaggactctctggaggagtgtgccgttacatgttccaatagccacaacccgagtaactcaaatcagcctcacaggagtacaaagattacttttaaggaacatgaagtcgattctgccctcgtggtagaaagcgaacatccgcatgacgaagaagaagaagctctcaacatcccccctgagaaccaaaacgatcatgaggaggaagagggaaaagcgcctgtgccaccccgacaccacgataaatctaattcctatcggcaccgggaggttagcttcctggccctggacgaacagaaggtctgttcggctcaggacgtggctagagactatagtaacccaaaatgggacgagacatcactaggattcctagagaagcagtctgacctcgaagaggtgaaggggcaagaaacagtggccccacgactttccagagggccactcagggtggacaagcacgagattccccaggagtctttagatggctgttgcctcaccccatccatcctaccagatctgacgccctcttatcatccgtactggtccaccctgtacagtttcgaggacaagcaggtctcgctagcattagtcgacaagatcaagaaagatcaggaggaaattgaggaccagagcccaccatgcccacggctgtcccaagaactgccggaggtgaaagagcaggaggtgccggaggactccgtcaacgaagtgtaccttacaccgtccgtccatcacgacgttagcgattgtcatcagccctattcttctaccctgagttctttggaggatcagctggcctgctcagcgctggatgttgcctccccgaccgaagcagcctgcccacaggggacatggtccggggacttgtcacatcaccgctcagaagtacagatcagtcaggcacagctggaaccgtcaacgctggtcccctcatgcctccgcctacaactggaccaaggtttccattgcgggaatggtcttgctcagaggggcctcagttctaccacatgttctttctccgctaatgcagacagcggtaaccaatggccttttcaagagctggttctggagccttcattgggtatgaaaaaccctccacaactcgaggacgatgcactcgaagggagtgcttctaatacccagggcaggcaggtaaccggtagaattcgggcaagtctggtcctgatattgaagacaatccggcgtaggctgcctttttcgaagtggcggctggcgttccgatttgcgggtccccacgcggaatcagcggagatccctaacactgcagaacgaatgcagagaatgataggatag

SEQ ID NO: 232396 - DNA, 1917 bp, Artificial Sequence
  Description of Artificial Sequence: Synthetic coding sequence
atggttgtgagtgccgaccccttaagttcagagagggctgagatgaacatcctggagattaaccaggagttgagatcacagctagctgagtcaaaccagcagtttcgcgacctgaaggagaaatttcttattacccaagcaaccgcatactcgctcgccaaccagttaaaaaagtataagtgtgaggaatataaggatattatcgacagtgttcttagagatgagctgcagtccatggaaaagctcgcagaaaagcttaggcaagccgaagagctcagacaatacaaagctctagtgcatagtcaagcgaaggagttaacccagctgcgcgaaaagctgcgggagggcagggacgcttcccgctggctcaacaagcacctcaagaccctcctgacccctgacgaccctgacaagagtcagggccaagatctgagagagcaactggcagaaggtcatcgtctagccgagcatctggttcacaaacttagtcctgagaatgatgaggatgaggatgaagacgaggatgataaggacgaagaggtggaaaaagtgcaggagtctcccgcacccagggaggtccagaagacagaggaaaaggaagttccccaagattccctggaggaatgcgctgttacttgctccaactcccacaatccttccaatagcaaccagccccataggagcaccaaaattacatttaaggagcatgaggtggattccgctttggttgtggaatccgagcatcctcatgatgaagaggaggaagccctaaacatacccccagagaatcaaaatgaccacgaggaggaggagggcaaggctccggtccctccacggcaccatgacaagagtaattcctaccggcatcgagaggtgtcttttctggctcttgacgagcagaaggtatgcagcgcacaggacgtggcccgtgactactcgaatccgaagtgggacgagacttcactcggctttctggagaaacaatctgacttggaggaagtaaaaggtcaggaaacagtagcccctcggcttagccgcggaccactaagggttgacaagcacgaaatcccccaggaaagcttagacggatgttgtctcacaccatcaatcctgcccgacttgaccccctcctaccacccatattggtcaacactctactcttttgaggacaaacaggtgagcctggctctggtagataagattaaaaaggatcaagaggagattgaggatcagagccctccctgcccgaggctgagccaagaactcccggaggtaaaggaacaggaggtgcctgaagacagtgtgaacgaggtgtatctgacaccttcagtgcaccatgacgtgagcgattgccatcaaccttatagttctacactgtcctcattggaagaccaattagcctgcagtgctctggacgtagcaagtccgacagaagccgcttgtccacaagggacctggagcggggacctgagtcatcacagatcagaggtgcagataagtcaggcccagctggagcccagtaccctagtcccctcttgtcttcggcttcagttggatcaggggttccactgtggaaacgggttggcacaacgcggtcttagcagcaccacgtgttccttcagtgcgaacgctgacagtggcaatcagtggccattccaggaactcgttctggagccctctctgggcatgaagaacccaccccagttggaagatgatgctcttgagggatcagcttccaacactcaggggagacaggtgactggtaggatcagggcatcattggtcctgattctcaaaaccataagacgtaggttgcccttcagcaagtggaggttggctttcagattcgcaggcccacacgccgagtccgcagaaatccccaacacagcagaacgaatgcagagaatgataggctag

SEQ ID NO: 232397 - DNA, 624 bp, Artificial Sequence
  Description of Artificial Sequence: Synthetic coding sequence
atgctggcgagttacaagtcttacagttctacctttcatagcctggaagaacagcaggtttgcatggcagtcgatattggcagacaccggtgggaccaggttaagaaagaagaccaggaagctacgggaccacgtctctctagagaattattagacgagaagggacccgaggtactgcaagattcgctctataggtgctactctacacccagtggctgcctggagttgacggactcctgtcagccttataggtcagccttttatgttttagaacagcagcgggtggggctggccgtggatatggatgaaattgagaagtaccaggaagtggaagaagaccagggaagatgggaagaggaccagaatccaccctgcccgagattaaatggtgttctcatggaggttgaggagccagaggtgcttcaggacagcttggacggatgctactccaccccatcaatgtatttcgagctgcccgactcttttcagcattacagaagcgtattttactcttttgaagaacagcacatcagctttgccctttacgtcgacaacaggtttttcacgctaacagttacatctcttcatctggtttttcagatggaggttatttttccccagtag

SEQ ID NO: 232398 - DNA, 1830 bp, Artificial Sequence
  Description of Artificial Sequence: Synthetic coding sequence
cctgtgcctgggccaacctcaagtgctaccaacgtaagtatggttgtaagcgcgggacctctctccagcgaaaaagcagagatgaacatcttggaaatcaacgaaaaacttagaccacagttggctgaaaagaagcagcagttccgaaacctcaaagagaaatgctttctcacccagttgtctgggtttctggctaaccaacagaacaaatataagtacgaggaatgtaaggatctgattaaattcatgctgcgcaatgaaaggcagtttaaagaagagaagctagctgagcagctgaagcaggcagaagagctgcggcagtataaagtcttggtgcatgcccaggagcgcgaactaacccaattgagagaaaagctcagggagggccgagatgccagtcggagtctgaacgaacacttacaggctctgttgacacctgacgagcctgataagtcccaggggcaggacttgcaggaacagctggctgaggggtgtcggctcgcacagcacctggtccaaaaactgagcccggagaacgataacgacgataacgaggatgtccaagtcgaggtggcggagaaggtccagaaaagcagtgcgccacgggagatgcaaaaggcagaggagaaagaggtccccgaagattctctggaagagtgcgctatcacctactctaacagtcacgggccatatgatagtaaccagcctcatagaaagacaaaaataacttttgaggaggataaggtggactctaccctgatcggatcttcatcacatgttgaaagggaagacgcggtccacatcattccggagaatgagagcgatgatgaagaagaggaagaaaagggcccagtgtcaccacggaacctgcaagagtctgaggaggaggaagtgcctcaagagagctgggatgagggctatagcacaccatcaatcccaccagaaatgttggcatcctataagtcctactctagcaccttccacagtttggaggagcagcaagtatgcatggctgttgatatcgggaggcacagatgggatcaggtcaaaaaggaggaccaggaagccaccggaccgcgtctgtcccgcgaactcctggacgaaaagggtcccgaagtcctgcaggatagtctttacaggtgctattcaacccccagcgggtacctggagctgcccgatctgggacagccttactcatccgctgtctactctctcgaggagcagtatctcggtctcgcattggacttagacaggataaagaaggaccaagaggaggaggaagaccaggggccaccttgcccacggttgtctcgcgaacttctggaggtcgttgaaccggaagtgttgcaggatagccttgataggtgctacagtactccgagtagctgtttagagcaacctgattcatgccaaccgtatggctcctccttctatgccctggaagaaaagcacgtgggattttccttagatgtgggcgaaatcgagaagaagggaaaggggaaaaagaggagaggcagacggagcaaaaaagagcggcgtcgcggtcgaaaagagggtgaggaggatcagaaccccccatgccctcgattgaacggggtgttgatggaagtcgaagagcctgaggtcctacaggatagtctcgacggctgctattccacaccttctatgtactttgagctccccgactctttccagcactatagaagtgttttttactccttcgaagaacaacacatctcattcgctctgtatgtagacaatcgctttttcactctgacagtcaccagtctgcatctcgtgttccagatggaggtgatttttccccaatag

SEQ ID NO: 232399 - DNA, 2052 bp, Artificial Sequence
  Description of Artificial Sequence: Synthetic coding sequence
tagccgggacctacgtcatctgccaccaatgttagcatggtggtgtccgcagggccattgagctctgaaaaggctgagatgaacattctggaaatcaacgaaaaacttcgtcctcagctcgctgagaagaaacagcagttccgtaacctgaaggagaaatgttttctgacccagttgagtggtttcctcgctaaccagcagaataaatacaaatatgaagagtgcaaggatctgattaaatttatgttaaggaatgagaggcagtttaaggaagagaagctggctgagcagctgaagcaggccgaggaacttcgccagtataaggttctcgtgcacgctcaagaaagagagttgactcaactgagggaaaaactacgtgagggtagagacgcttcccgcagcctgaatgagcatctacaggccctattaacgcccgacgagcctgataagagtcagggacaggacctccaggagcaacttgccgagggttgcagattggcccagcatttagttcagaaattgagtccagagaatgataacgacgataacgaagatgtccaggtggaggtcgcagaaaaggtgcagaaaagttctgcgcctcgagagatgcagaaagcggaagaaaaagaggtacctgaggattccctggaagagtgtgccattacctatagtaattcccatgggccatatgactctaaccaaccacacagaaagaccaagatcacgtttgaggaggataaggtcgattccaccctaatcggtagttcaagccacgtcgagcgcgaggatgctgtgcacataattcccgagaatgaaagcgatgatgaagaggaagaggaaaagggccctgtgtcccccaggaatctccaggagtccgaagaggaggaggtaccgcaagaatcttgggacgagggctatagtactcccagcatcccacccgaaatgctggcctcctataagagctactcatcaacattccattctcttgaggaacagcaggtctgcatggcggtggacattggaaggcatagatgggatcaagtgaagaaggaagaccaggaggctactggtcccagactgtcccgcgagctcctggatgagaagggacccgaagtgctgcaagacagcctgtaccgatgttatagtactccctcaggatgtctagagctgaccgattcttgccagccctacaggtcagccttctatgtcctggagcagcagcgggtgggcctagccgtcgatatggatgagatcgaaaaataccaggaagtcgaggaggaccaagatccatcttgcccgagacttagcagagagctcctggacgagaaagagccagaagtcttacaagactccctggggaggtggtactccacacctagtgggtacttggagctgcccgacctaggccagccctactcctccgccgtctacagcctcgaggaacagtatcttgggctggctttagatctggaccgtattaaaaaagatcaggaggaagaggaagatcagggcccaccatgtcctcggttgagccgggagctcctggaagtggtcgagcctgaagttctccaagatagtcttgatagatgctacagtactccgtctagctgcctggaacagccggattcttgccagccatacggttcctccttctacgccctggaggaaaaacacgtgggtttctccctggatgtgggcgagatagaaaagaaaggcaaaggaaaaaaaaggcgcggtagacggtctaaaaaagaaagacgcagaggtcggaaggagggcgaggaggaccagaatcctccatgtccaaggttgaacggtgtcctgatggaggtcgaggagcccgaagtcctgcaggattccttagacggctgctattcaaccccatccatgtatttcgagctgcctgattcctttcagcattatcggagtgtgttctattccttcgaggagcagcatatctctttcgccctctacgtggataaccgcttttttactctgacagtgacctccctgcatctggtgttccagatggaggtcattttccctcagtag

SEQ ID NO: 232400 - DNA, 1824 bp, Artificial Sequence
  Description of Artificial Sequence: Synthetic coding sequence
cccgtgccaggccctacatctagtgccactaacgtttccatggtggttagcgccggacctctatcgagcgaaaaggcagagatgaatatacttgaaataaacgagaaactgagaccacaattagccgaaaaaaaacagcagttccggaacttgaaggaaaagtgctttctcacccagctgtccggttttttagccaaccagcagaacaaatataaatacgaggagtgtaaagaccttatcaaatttatgctccggaatgagcggcagttcaaagaggagaagcttgcagagcagctcaagcaggccgaggagctccggcaatacaaggttctggtgcacgcacaggagcgggagctgactcagttaagggaaaagctacgagagggcagagacgcatccagaagtctcaatgagcatctccaggctctcctgacacctgatgaacccgacaaaagccagggccaagacctacaggagcagcttgccgaaggttgtagacttgcccagcacctggtacagaagctttcccctgagaatgataacgatgataatgaggacgtccaggtggaagtagcagagaaggtccagaagtcctcagcgcctcgcgaaatgcagaaagctgaagagaaggaggtccctgaggactctcttgaggagtgtgccatcacttattccaatagccacgggccatatgatagtaatcagccccataggaaaaccaagatcactttcgaagaagacaaggtggactccacgctgattggttcctcatcccacgtggagcgcgaggatgccgtgcatattataccggagaatgagtccgacgacgaggaggaggaggagaagggccctgtatctccccgaaacttgcaagagtcagaggaagaggaggtcccccaagaatcttgggatgaagggtactctaccccttctatccccccagagatgctggccagctataagagttattctagcacattccatagcctggaagaacaacaggtgtgcatggccgttgacatcggaaggcacaggtgggaccaggtaaaaaaagaagatcaagaggccaccggcccacggctttcccgggagttgttagacgaaaaaggaccagaggtgctgcaggattccctatatcgctgttattcaaccccatctgggtgtctcgaactcacagacagctgtcagccctataggagtgccttctatgtgctggaacagcagcgagtcggactggcagtggatatggacgagatcgaaaaatatcaggaggtggaggaggaccaagatccaagctgcccacggctcagccgggaactgctggatgaaaaagagcccgaggtcctccaggacagtctggggcgttggtacagcacgccttccggctatctggagctccctgatctgggccagccgtattcaagtgccgtgtactcccttgaggaacagtatttaggcctggccctggatctggaccggatcaagaaagatcaagaagaagaagaggaccaggggccaccatgccccaggctgtcacgagaattgcttgaggttgtcgagcctgaggtactgcaggacagtctagatgtcatccagttactgccggtggtactaaacagcctgacaccggcatcccctatggaagtgcctttcatgcattggagaaaaaacatgctggccttcctcctgacttgggagaagcttaagaggcgtggtcgcggacggaaggagggggaggaggaccagcggagaaaggaagagggggaggagaaaaagggtaagaaaattaagactcatcatgcacctgggagtacagcctgttag

SEQ ID NO: 232401 - DNA, 396 bp, Artificial Sequence
  Description of Artificial Sequence: Synthetic coding sequence
atggccgatgtggtggtgggaaaggacaaagggggagaacaacgactgatctcccttccccttagccggatccgcgttatcatgaaatcatccccagaggttagcagtatcaaccaggaggctttagtcctgaccgccaaagccactgagctgtttgtgcagtgccttgccacctacagctacagacacggtagtggcaaagagaaaaaggtcctaacttattctgatttagccaacacagcccagcagtctgagactttccagttcctggcagacatcctccccaaaaagatcctggcgagtaaatacctaaaaatgcttaaggaggaaaagcgcgaggaggacgaggaaaatgataacgacaatgaatcagaccacgatgaggctgattcttag

SEQ ID NO: 232402 - DNA, 582 bp, Artificial Sequence
  Description of Artificial Sequence: Synthetic coding sequence
atgggtaaacaaaattcaaagctcagacccgaggtgatgcaggacctcttagaatctaccgatttcaccgagcacgagatccaagagtggtataagggatttctgagagattgtccgtcaggacatctgtcgatggaagagtttaaaaaaatttatggtaatttttttccctatggcgacgcttccaaattcgcagaacacgtgtttcgtacattcgatgccaacggagatggaaccattgacttcagagagtttattatcgcactctcagtcacctcacgaggtaagcttgagcagaagcttaagtgggccttctccatgtacgatctcgatggtaacggatacatttctaaagctgaaatgctcgaaatcgtgcaggcaatctacaagatggtttctagcgtaatgaaaatgcccgaagacgagtccaccccagaaaaaaggacagagaaaatcttccgacagatggacacgaacagggacggcaagttgtccctggaagagttcattcgcggagccaagtccgaccccagcatcgtaagactgctgcaatgcgatcccagcagcgcaggacagttctag

SEQ ID NO: 232403 - DNA, 582 bp, Artificial Sequence
  Description of Artificial Sequence: Synthetic coding sequence
atgggcaagcagaactctaagctccgcccagaggtcatgcaagatctcttagagagtactgacttcaccgaacatgagatccaggagtggtacaaagggttcctgcgagactgtccttcaggacacctctctatggaggagtttaaaaagatttacggcaatttcttcccctatggtgatgcaagtaaattcgccgagcacgtcttcagaacttttgacgccaatggcgacggcaccatcgacttcagagagtttattattgccctgtctgttacgagccgcggaaaactagagcaaaaattaaaatgggcctttagtatgtatgatctggacggcaacggttacatatcgaaggccgagatgctcgagatcgtgcaggctatctacaagatggtatcctcagtaatgaaaatgccagaggatgagtccacaccagagaaacggacagaaaaaatattccgccagatggataccaaccgcgacgggaaactctctctggaggaatttatcagaggggcaaagagtgacccctctatcgtgaggctcttgcagtgcgatccttccagtgcaggacagttctag

SEQ ID NO: 232404 - DNA, 582 bp, Artificial Sequence
  Description of Artificial Sequence: Synthetic coding sequence
atggggaagcagaactcgaagctgaggccagaggtcatgcaggacttgctcgagtccacggacttcaccgagcacgaaattcaagagtggtacaagggcttcctccgggattgtccctccggacacctgtctatggaggagtttaagaagatttacgggaacttctttccgtacggggatgcatccaaattcgcagagcacgttttcagaacgttcgacgctaatggggatgggacgatcgattttagggagttcattattgcgctatcagtcacctccagagggaagctcgagcaaaaacttaaatgggccttctcaatgtacgatttagatggaaacgggtacatcagtaaagccgagatgctggagatcgtccaggccatctacaaaatggtctcttccgtcatgaaaatgccagaggatgagagcacccccgagaaacgcacggaaaaaatttttcgccagatggacaccaaccgggatgggaagctctcgttggaggaattcattaggggcgctaagtccgatccctctattgtgagacttctgcaatgtgacccaagctcagccggtcagttctag

SEQ ID NO: 232405 - DNA, 582 bp, Artificial Sequence
  Description of Artificial Sequence: Synthetic coding sequence
atgggcaaacagaacagcaaactcagacctgaagtaatgcaggacctgcttgagagtactgatttcacagagcacgagattcaggagtggtacaagggatttttacgcgattgcccctctggccacttgtcaatggaagagttcaaaaaaatctatggcaattttttcccttacggagacgcctcaaagtttgctgaacatgtgttccggacatttgatgctaatggggatggcacaatagacttcagggagtttatcatcgccctgtccgtcacgagtcggggaaagctggagcagaagctgaaatgggccttttccatgtacgatctagatggtaatggttacataagcaaagctgagatgctggagatcgtgcaggccatttataagatggtgagctcggttatgaaaatgcccgaggatgagtccacccctgaaaagcggacggagaaaatttttcgccagatggatactaaccgggacggtaagctgtccctcgaggagttcattaggggggctaaatcggacccatctattgtccgcttgcttcaatgtgacccctcaagtgcgggtcagttctag

SEQ ID NO: 232406 - DNA, 3966 bp, Artificial Sequence
  Description of Artificial Sequence: Synthetic coding sequence
atgggtgcccctttcgtgtgggccctgggtctactgatgctgcagatgttactgtttgtagccggtgagcaaggcacacaggatatcaccgacgcttccgaacggggactccacatgcagaagttgggttccggttcggtgcaggcagctttggccgaactagtagctctcccttgtctgttcacactgcagccaagacccagtgccgcacgggatgcccctcgcatcaaatggaccaaggttcgcacggcgtcaggtcagcggcaagatttaccaatcttggttgccaaagacaatgtggtgagggtggccaagagctggcaagggcgagtgtctctgccttcctatccacgtcgtagagccaatgcaaccctgttgttggggcctctgcgggctagtgattctggcctatatagatgccaagtagtccggggtattgaagatgagcaagatctggtgccactggaggtgaccggggtcgtctttcattacaggtccgcacgagaccggtatgcacttacctttgccgaagcgcaggaagcctgccgcctaagtagcgcgattattgccgcacccagacatcttcaagccgcattcgaggatgggtttgacaactgcgacgctggatggctcagcgatcggactgttaggtaccccattacccagtccagacctgggtgctacggcgaccgatcctcactccctggagtccgatcatacggtcgccgaaatccccaggagctgtatgatgtctactgcttcgccagagagctcggtggagaggttttttatgtggggccagccaggagattgacactggccggtgcccgagcccagtgtaggaggcagggcgctgcactggcctctgtgggccaactgcacctggcctggcatgaaggtctcgaccagtgtgatccaggatggctggcagacgggagcgtgcggtatccaattcagaccccccgtcgacgctgtggaggccctgctcccggtgtgcgcacagtgtataggttcgcgaataggacgggattcccttcccctgctgagaggttcgacgcctactgctttagagctcaccacccaacatcccagcacggtgacctcgaaactccgagctctggagacgaaggcgaaatactgagcgccgaggggccacctgtgcgggagcttgagcctaccttagaggaggaggaagtggttactcctgactttcaggagcctctcgtaagctctggggaagaagagaccctgatcctggaggagaagcaagaatcgcagcagactctgtctcctactcctggagatcccatgctggctagttggcctaccggagaggtgtggctgagcactgtggccccatcccctagcgacatgggcgctggcaccgcggctagcagtcacacagaagttgcacccaccgatccaatgccaaggcgaagaggcagatttaagggtctcaacggacgatacttccagcagcaagaacccgaaccaggtctacagggaggaatggaagccagtgctcagccccctacatcagaggccgctgtgaatcaaatggagcctcccttggcaatggcagtgacagagatgctggggagcgggcagtcccgatcaccgtgggccgaccttactaacgaggtggacatgcctggggctggatctgctgggggtaagtcctctccggaaccgtggttgtggccccctactatggtgccaccctccatcagtggccattcacgggctccggttcttgagctggaaaaggccgaaggcccaagcgcccgtcctgcaaccccggatctcttctggagccctctggaagccaccgtgagcgctccctctcctgctccctgggaggcatttcctgtggctacctctccagacctccccatgatggctatgctgcgtggcccaaaggagtggatgcttccccacccaactcccatttccactgaggctaaccgcgtggaggcccacggggaggcaacggctacagctcccccatccccagccgcagaaacaaaggtgtactctctgccgctgagtttgactccgactggccagggcggagaagctatgcctactactcctgagtcaccgcgtgccgacttccgcgaaactggcgaaaccagccctgctcaggttaataaggcggagcacagttcaagtagtccctggccttccgtgaacagaaacgttgcagtgggattcgtgcctactgaaaccgccacagaacctacgggtctgaggggtataccgggttcagaatcgggagtgttcgacacagctgaatctcccacaagcggattacaagctaccgtggatgaggtgcaagacccatggccatccgtatattctaaagggttggacgcctccagtccttctgctcccctgggctccccgggagtctttttggtgcctaaagtgacgcctaacttggaaccatgggtggcaacagacgagggccctactgttaaccccatggactcaacagtcacgcccgcaccatccgatgcctctgggatatgggagcccggatctcaagtgttcgaggaagccgagagcacgacattgtctccacaggtcgcacttgatacgtctatcgttaccccactcactaccttggaacagggggataaagttggcgtgcccgcaatgtcaaccctcggtagcagcagctcccagcctcatcctgaacccgaagaccaggtagagacacaggggacttcaggcgctagtgtgcccccacaccaatccagtcccctaggcaaacccgctgttcctccaggtactcccacagctgccagcgtcggggagtcagccagtgtgagttccggcgaacccacagtgccctgggatccctcctcaacactactgcctgtgacgctggggatcgaggatttcgagctcgaggtgctggctggctctcctggggtcgagtcattctgggaggaggttgccagtggcgaggagcccgcactgccaggcactcctatgaatgccggagcagaggaggtacactccgatccttgtgagaataacccttgcctacacggtgggacatgcaatgccaatggcactatgtacgggtgcagctgcgaccaggggttcgccggtgagaactgtgagattgatatcgacgactgtctgtgttcaccctgcgaaaacgggggtacctgcatcgatgaggtcaacggattcgtgtgcctgtgtctcccatcatacgggggatctttttgcgagaaggatactgagggctgtgatagaggatggcataagtttcaggggcattgttaccggtatttcgcccatcggagggcatgggaagatgctgagaaggactgcagacgacggagcggccatctgacatccgtgcacagtccagaagagcattcatttattaacagcttcggccatgaaaacacatggattggccttaatgacagaatcgtggagcgggattttcagtggactgacaatacaggcttgcagtttgaaaattggcgtgaaaaccaaccagataatttcttcgccggaggcgaggactgcgtcgtgatggtcgcccacgagtccggtaggtggaacgatgttccttgcaattacaaccttccttacgtttgtaagaaaggcactgtgctctgcggccctccccctgccgttgagaacgccagcctcataggtgccaggaaggctaagtacaatgtgcacgcgaccgtgcgctaccagtgtaacgaagggttcgcacaacaccatgtcgctacaattcggtgtagatctaacggcaaatgggatagaccgcaaatcgtgtgcacaaaacccagacgatcacaccgaatgaggaggcatcaccatcaccatcagcatcaccatcaacatcaccatcataaatcgcgcaaggagagacgcaagcacaaaaaacacccgacggaggactgggaaaaggatgagggcaacttctgttag

SEQ ID NO: 232407 - DNA, 2319 bp, Artificial Sequence
  Description of Artificial Sequence: Synthetic coding sequence
atgcctggcgcagggtcagccggaggaaaatcttctcccgaaccatggctgtggcctcccactatggtgcctccatctatcagtggtcactcacgagccccagtattggagctagagaaagcagaagggcctagcgcccgtcccgctacccctgacctgttctggtcccccctggaggctacggtttcagccccttctcccgctccttgggaggctttcccagtcgccacctcaccagaccttccgatgatggccatgttgcgtggtcccaaagagtggatgttacctcaccctaccccgattagcaccgaggctaatcgcgttgaagcgcatggagaagcaacagctacagcccctccatctcccgcagcggagacaaaggtgtacagtttgccactttcccttacacctacaggacagggaggagaagccatgccgacgaccccagagagtcctcgggctgacttccgagaaacaggcgagacatcccctgcccaggtcaacaaagccgaacactcctccagtagcccttggccttctgtgaaccggaatgttgccgttggatttgtgcctactgagacggctacagaacccaccgggctgcgcggaataccgggttccgagagcggagtgtttgacacagccgagtcacccactagtggcctgcaagcgaccgtagacgaggtgcaggacccatggccgtctgtttactctaaggggctcgacgccagctcaccctcagccccactgggatcgccaggcgttttccttgtaccgaaagtcacacctaacctggaaccctgggtcgctaccgacgagggccctacagtcaatcctatggattctaccgttactcccgcaccatcagacgcatcaggcatatgggagccaggaagccaggtgttcgaggaagccgaatctaccactttgagcccacaggttgcactggataccagcatcgtgactccactcactaccttggagcagggtgataaggtgggagtgccggctatgtccactctcggaagcagcagcagccagccacaccccgagcccgaagatcaagtcgagacacagggcacctccggcgcttcagtgcctccccaccagtccagccctctcgggaaacctgcagtccccccaggaacacccacggccgctagtgtaggggagtccgccagcgtgtcctctggggagcctacagtgccctgggatcccagtagtactcttctacctgtgacgctgggaattgaagactttgagctcgaggtacttgctgggagtcccggtgtggaatcattctgggaagaggtggcctctggggaagaacctgcactgccgggtacacctatgaacgctggggctgaggaggttcactcagatccatgtgagaacaacccttgcctgcacgggggaacctgcaatgcaaacggaaccatgtacggctgctcctgcgaccagggctttgctggtgagaattgcgagatagatatcgacgattgtctgtgtagtccctgcgaaaacgggggaacctgtattgacgaagtgaacggattcgtctgtctgtgcctgccttcctatggcggatccttttgtgaaaaagataccgagggctgcgatcggggttggcataagttccagggccattgctatcggtacttcgctcacagaagggcatgggaggacgcggagaaggattgtcggcgacgaagcggccacttgactagcgtgcatagcccagaggagcactcctttatcaatagctttggccatgagaacacgtggatcggtctcaacgatcgcatcgtcgagagagatttccaatggaccgataacacgggcctccagttcgaaaattggcgggagaatcagccggacaatttcttcgcgggaggagaggactgtgtcgtaatggtggcacatgaatcagggaggtggaatgatgttccctgcaattacaacctcccctatgtgtgcaagaagggaactgtgctatgcggccctcctcctgctgttgaaaatgcttctctgattggagcacgcaaagcgaagtataatgttcatgctactgttcggtatcagtgcaacgaaggcttcgcccagcatcatgttgctacaattagatgccgctccaatggaaaatgggatcgccctcaaattgtatgcactaaacctcgacgaagtcataggatgcgacgccatcaccaccatcatcagcaccaccaccagcaccaccaccataaatcccgcaaggagcgtcgcaagcacaagaagcacccgacagaagactgggagaaagacgagggcaatttctgctag

SEQ ID NO: 232408 - DNA, 4008 bp, Artificial Sequence
  Description of Artificial Sequence: Synthetic coding sequence
aggcctccgagggacgcttcagaactgggagctagaagccggatgggcgctcctttcgtatgggcattgggcctattgatgttgcagatgctcttgttcgtggcaggagagcaggggacacaggatattactgatgcctcagagcgaggcttacatatgcagaaacttggcagcggatcagtacaagcggcactggcggaactggtggcgcttccctgccttttcactttgcagccacgacccagtgctgccagagacgcacccaggataaagtggaccaaggtgcggactgccagcggtcagaggcaggatctgcccatccttgtagcaaaggataacgtcgtcagagttgcaaagtcatggcagggaagggtcagtttaccctcctatccgaggcgcagagcaaatgccacacttctgctagggccactcagagcatccgactctggactatacaggtgccaggttgtgagggggatcgaagatgaacaagacctcgtccccctcgaagtcaccggggtggtgttccactatcggtctgcacgagatagatatgccctgacgttcgctgaagcacaggaggcctgccgcctgtcgagtgccatcatcgctgccccaaggcaccttcaggcggcatttgaggatggattcgataactgtgacgcagggtggctctcagacaggacggtcagatatcctatcacccagtccagaccgggatgttacggtgacaggagtagccttcctggggtaaggagctacggaaggagaaacccgcaagaactgtatgacgtgtactgcttcgctagggagctggggggagaagtcttctatgtaggcccagccaggcgcctgacactggctggtgcacgcgctcagtgcaggcgccagggagccgctctcgcttcagtgggacagctgcatctggcttggcacgagggcttggatcagtgcgacccgggatggttagcagacgggtcagtgcggtatcctatccagactccccgtagacgctgcggcggacctgcgccaggcgtacggacggtctatcgatttgccaacaggactggattcccaagcccggcagagcgttttgatgcttattgctttagagcccatcatcctaccagccagcacggggatcttgagacaccaagcagtggagacgaaggagagattttgtctgccgaaggaccacccgtacgcgagctggagcctaccctggaggaggaggaagtagtgacccccgatttccaagaacccctcgtaagcagcggggaggaggagaccctgatactggaggaaaaacaggaatctcaacagactctatctcccactcccggagaccccatgctggctagctggccaacaggggaggtctggctgtccacggtcgctccctcaccttctgacatgggagcgggaaccgcggctagcagtcataccgaggtggctcccacggacccaatgcctcgtaggcggggaagatttaagggattgaatgggagatacttccaacagcaggagcccgaaccgggattgcaggggggaatggaagcctccgcacagccacccacaagcgaggccgctgtgaatcagatggagcctccactggccatggctgtgactgagatgctcggttccggccaatccaggagcccttgggccgacctcactaatgaagtggacatgccaggagccggttccgccggagggaagtcttcacccgagccgtggctctggccccctaccatggttcccccttccatctctgggcactcccgagccccagtgctcgagcttgaaaaagcagaggggccttctgccagacccgcaactcccgacctgttttggtcacctcttgaagccactgtttctgccccaagtcctgccccttgggaagcgttcccagtggctacaagccccgatcttccaatgatggcaatgttgcgtgggcctaaggagtggatgttaccgcatcctacccccatttctactgaagcaaaccgtgtagaagctcacggggaggctactgcaacagctccaccctccccagccgctgagacaaaggtgtacagtcttcctctgtctctaacacccaccgggcaaggcggagaggcaatgcctactacaccggaatcaccccgtgccgatttccgtgagaccggagaaacttcccctgctcaggtgaacaaggccgaacacagtagctcttccccctggccatctgtcaacaggaacgttgcagtcggtttcgttcctactgaaacagctacagagccaaccgggctgcggggaattccaggatctgagagcggggtgttcgacactgccgagagccctacctcgggtctgcaggcgacagttgacgaggtgcaggatccctggccttctgtgtacagcaagggtctcgacgcctcaagtccttctgcgcctttgggtagtccaggcgtgtttttagtcccaaaagtcacccccaatctcgaaccgtgggtggctaccgacgagggacctactgtgaatccaatggactccacagtgacaccagcgccttctgatgcctcgggaatttgggaaccaggaagtcaggtgttcgaggaggccgagtcgacaacccttagtcctcaggtggcactggacacatcgatcgtcacccccctgactacactggagcagggggataaggtgggggtgccagcaatgagcacacttggatcgtccagctctcagccccaccccgagccagaggatcaggtggagacgcagggaacaagtggtgcatccgtgccccctcatcagagctcccccttaggtaagcctgccgtgcctccaggaacccctacggcagcaagtgtaggcgagtctgctagtgtgtccagcggggagccgacagtgccctgggatccttcctctacacttttgccagtcacccttggcattgaggactttgagttagaggtgcttgccggaagtccaggtgtcgaatctttttgggaagaggtcgcttctggcgaagaacccgcactgccagggacccctatgaacgccggagcagaggaggtccatagcgatccatgtgagaataatccgtgtctccacggtggaacttgtaacgccaacggaaccatgtatgggtgctcatgcgaccaaggttttgctggagaaaactgcgagatcgatattgacgactgcctgtgctccccctgcgagaacggcggaacatgtatcgacgaggtgaacggtttcgtatgcctctgcttgcccagctacggcggttccttttgtgaaaaagacactgaagggtgtgaccgcggatggcataagtttcaaggccactgttatcggtatttcgctcaccgtcgcgcatgggaggacgctgagaaagattgccgcaggagatctggccaccttacgtccgtccatagcccggaggaacacagctttattaactcgttcgggcacgagaatacatggataggactgaatgaccgcatcgtagagcgtgacttccagtggacagacaatacaggcctgcagtttgagaattggcgggaaaaccagccagataacttcttcgccggaggcgaggattgtgtggtgatggtggcacacgaatctggccgatggaatgacgtcccatgtaattacaacctgccatatgtgtgcaaaaaaggaaccgtgctgtgtggaccaccccctgcagtggagaatgcgtcactgatcggagccagaaaagccaagtacaatgttcatgccacagtgcgctaccagtgtaacgaggggttcgctcagcaccacgttgccacgatacgctgtcgcagcaatggtaaatgggaccgacctcaaatcgtgtgtaccaagccacggaggagccaccggatgcgcaggcaccaccaccaccaccaacaccaccaccagcatcaccatcataagtctcgaaaggaacgtcgaaaacataaaaagcaccccaccgaggactgggagaaggatgagggaaatttctgttag

SEQ ID NO: 232409 - DNA, 2190 bp, Artificial Sequence
  Description of Artificial Sequence: Synthetic coding sequence
atgtcctgctgcgacttggctgccgcaggtcaactggggaaggcgagcattatggcttcagactgtgaacctgcattgaaccaagctgagggccgaaatcccactttggaaagatatcttggcgctctgcgcgaggccaaaaacgattcggaacagtttgcggcactgctgctcgtaactaaggctgtgaaagccggagacatcgacgcaaaaacacggagacggattttcgacgcggtgggcttcacgtttccaaataggctgctcactacgaaagaggcgcctgacggatgcccggaccacgtcctgagggctctgggggttgcactgctggcttgcttttgctctgaccctgagcttgccgcacatccccaggtgctgaacaagattcctatcctgtcaacattccttaccgcaagaggagacccggacgacgcggctagacgcagtatgatagacgatacctaccagtgtttgacagcagttgccggaacaccgagaggtccccgacacctcattgccggaggcaccgtgagtgctctgtgccaggcatatctcgggcacggatatgggtttgaccaggccctggctctgctcgtcggcctcttggcagccgctgagacccaatgttggaaagaggctgaaccagacttgctggccgtcctccgcggactgtctgaggatttccagaaagcggaagacgcctccaagttcgaactctgccagctgttgccactcttcctcccacctacaactgttcctccagagtgctatcgcgacttacaagccggtttggcaaggatcctgggatctaaactctcaagttggcagaggaatcctgccctgaaactggctgccaggctcgcccatgcctgtggctcagactggattcctgctgggagctctggctctaaatttttggctctcctagtgaacctggcgtgcgttgaagtgcggctagctttggaggaaaccggaactgaggtgaaagaagacgttgtgaccgcatgttatgcactgatggaactcggcattcaggagtgtacccgatgtgagcagagcctgcttaaggagccacagaaggtgcagctcgttagcgttatgaaggaagcaatcggagcagtgatccactacctgctgcaggtgggtagcgagaagcagaaagaaccattcgtgttcgcctctgtgaggatactgggagcgtggctcgctgaggagacatcttctttacgcaaggaggtgtgtcagttgctgccatttcttgtgaggtacgccaaaaccctgtatgaggaggcagaggaagctaatgatctgagccaacaggtcgcaaaccttgccatctcgccaaccacccctggtcccacctggccgggtgacgccctgcggctcctgcttccgggttggtgtcatctgactgtggaagacggaccgagagagatccttatcaaggagggcgctccaagcctgctgtgcaaatactttttgcagcagtgggagttgactagtcccggacatgatacatccgtcttgcctgactccgtggagataggactgcagacttgttgtcacattttcctgaatctggtcgtgactgctcctgggctgattaaacgagatgcttgcttcacctccctgatgaacactcttatgacatctctgccagcacttgtccagcagcaagggaggctgttgctagctgctaacgttgctaccttggggcttctgatggcgaggctcctaagcacatctccagcactacaaggcacccctgcttcccgaggattctttgccgctgccatccttttcctgagtcagagtcacgtggcccgagccacaccaggtagtgaccaggctgttctggcgctgagccccgaatatgagggcatctgggctgatctgcaggaattatggtttctgggaatgcaggctttcacaggttgcgtacccttgctgccatggttggctcccgctgccctaaggagtcgatggccacaggagctgctccagctgctgggaagtgtaagccccaactctgttaaacccgagatggtagccgcttaccagggagtattggtcgagcttgcgagagccaaccgattgtgcagagaagctatgcgccttcaggcgggtgaggagaccgccagccactataggatggccgcattagaacagtgtctgtccgagccatag

SEQ ID NO: 232410 - DNA, 2190 bp, Artificial Sequence
  Description of Artificial Sequence: Synthetic coding sequence
atgtcctgttgtgatctcgctgcagccggtcaactaggcaaggcctccattatggcctccgattgcgagccagcccttaatcaggccgaaggccgtaacccaactctagagcgatacttgggggcactaagggaagccaaaaacgattcagagcagttcgcggctctgctcctggtgaccaaagctgttaaagccggagacatagatgcaaaaacaaggaggcggatatttgacgcagtgggctttacattccccaacagactgttaacaactaaagaggctccagatggctgtcccgaccacgttctgcgcgcactgggtgttgccctgctcgcctgcttctgctccgatcctgagctggctgcgcacccacaggtgcttaataagatacctatcttgtccacatttcttacagcccgaggagatcctgatgatgccgcaagaagaagcatgattgatgatacctatcaatgtctcacagccgtcgcaggcacccctaggggcccacgccaccttattgccggaggtaccgtgtcggctctgtgtcaggcgtacctgggtcatggttacgggttcgatcaggccctagccctgctggtggggctgctcgcagccgctgagacacagtgctggaaagaagcggaacctgatcttctcgctgtattgcgagggctgtcagaagattttcagaaggcagaagacgcaagcaagtttgaactttgccagctgctacctctgttcttgcctccaaccactgtcccacccgaatgttaccgcgacctacaagctgggctcgccaggatcttaggcagtaaactgtcatcctggcagcggaacccggctttgaaacttgccgcaagactcgcccacgcgtgcggcagcgactggattcctgccggttctagcggtagtaagttcctggcattgctcgtgaacctcgcctgtgttgaggtgcggctcgcgctggaagagaccggcacggaggtgaaggaagacgtggttaccgcctgttatgctctgatggagctgggaattcaggagtgcacgcgctgtgagcagtctctccttaaggagccacaaaaagtgcagctcgtctctgtgatgaaggaagctattggtgccgtcatccactatctgcttcaagtgggctctgaaaagcaaaaagagcccttcgtgttcgcgtccgtgcggatactcggagcatggcttgccgaggaaaccagctccttgcggaaagaagtatgccagctcttgcctttcttggttcgctacgccaaaacactctacgaggaggcagaggaggccaatgatttgtcccagcaggtcgccaatcttgctattagccccaccacacccggaccaacttggccaggtgatgcactgcgactcctcctcccagggtggtgtcacctcacggtcgaagacggacctagagaaattctgatcaaagaaggggctccaagcttactttgcaagtatttcttacagcagtgggagctaaccagccccggtcacgatacctccgttctgcccgattccgttgaaataggcctccagacgtgttgccatatctttcttaacctggtggttacagcacctggtctgattaagcgagacgcttgcttcacttcactgatgaacacactgatgacaagtctgcccgcattagtgcaacagcagggtagattgctgcttgctgcaaatgtggccacattaggactgctcatggcacgtctgctatccacttctccagctctccagggcaccccggcaagccggggattctttgccgctgctatcttatttctgagccagagtcacgtagccagagctactcctgggtcggaccaggcggtgctagctcttagtccagagtacgaaggaatatgggcggacttacaggaactgtggtttttaggcatgcaagctttcactgggtgcgtgccgctacttccttggctcgctccagctgcgctgaggtcaaggtggccacaggagctcctgcagcttttgggatccgtgtcaccgaacagcgtcaagccagagatggtggccgcttaccaaggcgtgctggtggaactggcccgagcaaaccgactgtgtcgcgaggcaatgagactgcaggccggtgaggaaactgcttcccactataggatggctgcattggaacaatgtctgtccgaaccctag

SEQ ID NO: 232411 - DNA, 2139 bp, Artificial Sequence
  Description of Artificial Sequence: Synthetic coding sequence
atggcctctgactgtgagcccgcattgaatcaagccgagggacggaatcctaccctggaacggtacctcggggctctccgtgaggctaagaacgactccgagcagttcgccgcattactgctagtcactaaggccgttaaagcaggcgacatcgacgcaaagacgagacggaggatctttgatgccgtaggtttcacattccccaatagactgctgaccactaaagaggccccagacgggtgtcccgaccatgtgctgcgagccctgggtgtggcgttgctggcatgcttttgctctgatccagaactagccgcacatccgcaagtgttgaacaagatccctatcctatcaacattcttaacagcccgaggagacccggacgacgctgccaggagaagcatgattgatgatacataccagtgccttacagccgtggcaggcacccctcgcggacccagacacctcatagccggagggacggtgagcgcgttgtgccaagcttatttgggccatgggtatggatttgatcaggctctggcacttcttgtgggactactcgccgcagctgaaactcaatgctggaaggaggccgagccagacctgctggccgtcctgaggggcctgtcagaggattttcagaaggccgaggatgcctctaagtttgagttgtgtcagttgctgcctctatttctgcctccaacgacagtgcctccagagtgctatagagatctgcaggccggtctggcacgtattctgggtagtaagctgtcaagctggcaacgcaaccctgctctgaagctcgcggctcggcttgcccatgcttgtggatcagattggatccccgcagggtcttctggaagtaagtttctggcattgctggttaacctggcctgcgttgaggtccggctcgccctggaagaaaccggcacagaagttaaggaggatgttgtcacagcatgttatgccctgatggagctcggaatacaggagtgcactagatgtgaacagtccctgctcaaagagcctcagaaagtgcagctggtgtccgtgatgaaggaggccatcggtgccgtgatccactatctgctgcaggtcggctctgagaaacaaaaggagccctttgtgttcgcatcggtcagaatcctgggtgcttggttggcagaagagacgtcttccctgagaaaggaggtgtgtcagctcctgccctttctggtccggtatgctaaaacattgtacgaggaggcagaagaggccaacgatctgtcccagcaggttgccaatctggctattagtcccactaccccaggccctacttggcctggggacgctctccgattacttttgcccggatggtgccacctcacggtggaggatgggcctagggagattctcataaaagaaggtgctcccagtctgctgtgcaaatacttcttgcagcagtgggagctcaccagtccgggacacgacaccagcgtgctcccagactcagtggaaattggcttgcagacatgttgccacatctttctcaatttagttgttaccgcccctggacttataaagcgcgatgcatgcttcacgagtctgatgaataccctcatgaccagcctgcccgcactcgtgcagcagcaaggaaggctccttttggctgcaaacgtcgctacattgggcctgctcatggcaaggctcttaagcacaagcccagccttgcagggcacacccgcatcacggggattttttgcggctgcaatactctttctgagtcagtcccatgtggctcgggctaccccaggtagcgatcaggcagtactggccctgtcgccagaatatgaagggatctgggccgacctgcaggagctgtggtttcttggcatgcaagcctttactggatgtgtcccactgctcccttggcttgcccctgccgctctacgcagtcgatggcctcaagaactgctgcagctgctggggtcagtttcacccaattctgtgaaacctgagatggtcgccgcataccagggcgtgttggtggagctggccagggcaaaccgtctgtgcagagaggctatgcgtcttcaggccggagaggaaaccgcttcccactacagaatggcagcactggagcagtgtctgtctgaaccatag

SEQ ID NO: 232412 - DNA, 531 bp, Artificial Sequence
  Description of Artificial Sequence: Synthetic coding sequence
atgccacacagctttcgatacttagcagctctgcaaggcacaccagcctctagagggttctttgcagctgcgatcctgtttctctcccagtcccacgtagccagagccactcccggtagtgaccaagctgtgctcgcccttagtccagagtatgaggggatttgggctgacctgcaggaactgtggttcctagggatgcaggctttcactggatgtgtccccctgctgccatggcttgccccagctgcactgcgctcacgttggccacaggagctcttgcagctcttaggaagccagccgcagctgtgccaagccagagatggaggcaggctttccgggtgtccaggcggagccggagccggacagcccgcagtgccaggtggtcatgaggctgcaggagggaggggagatggccagccactgccacatggatgcctgggcgctgtcccagtgcgagcactcaggggcgttcatagagggcagacccagggacgtgccgagcgggagggcggacgccgacacttgccttag

SEQ ID NO: 232413 - DNA, 582 bp, Artificial Sequence
  Description of Artificial Sequence: Synthetic coding sequence
tgaagcagtctcaggaaagaggtttgtcaattgctcccattcttggtgagatacgctaagaccctctatgaagaagctgaagaggccaacgacctctctcaacaggttgccaacctcgcaatttctcctaccacacccggtccaacctggcccggagatgcactgcgcctcctgctcccaggctggtgccatctgaccgtcgaggacgggccacgtgagatccttattaaagagggtgccccatcccttctctgcaagtattttctgcagcagtgggagcttaccagcccaggccatgatacctctgttctgcctgacagcgtggagatcggcctccagacttgttgccacatcttcttgaatcttgtggtaacagctcctggtctgattaaaagggatgcgtgttttacaagtttaatgaacactctgatgactagcctgcctgcattggtacagcagcaagggagactgctgcttgccgctaacgtcgccacactgggacttttgatggcccgtctactctcgacatcacctggttcaattagctctcagttgcccggagcagagcatatgccatgctag

SEQ ID NO: 232414 - DNA, 735 bp, Artificial Sequence
  Description of Artificial Sequence: Synthetic coding sequence
atggccagcgattgcgaaccagcgctcaatcaggcggagggaagaaatcccacgcttgaaagatacctgggggctttaagagaagccaaaaatgattccgaacagttcgctgcattgctgctggtaacaaaagctgtcaaagcgggtgacatcgacgcgaagacaagaaggaggatcttcgacgccgtcggttttacctttccaaaccgtctgctgacgaccaaagaggcacccgatggatgtcccgaccacgtactgcgggcactgggcgtggctcttctggcgtgtttctgttctgacccggagttagcagcccaccctcaggttctcaacaaaattcccatactaagcactttccttacagccaggggggatcccgacgacgccgctcgtcgtagcatgattgatgatacataccaatgtctgactgccgtcgctggcactcccagaggccctaggcatcttattgcgggaggcacagtgtcagctctgtgccaagcgtacctcggccatggttacggatttgatcaggctcttgcgttgctcgtgggtctgctggcggcagccgagacgcagtgctggaaggaagctgaaccggaccttctggccgtgctgcgaggtctgtctgaggatttccagaaggcagaggatgcaagtaagtttgaactttgtcagctgctccctttatttttgcctcccactaccgtgcctcctgagtgctaccgggatctgtag

SEQ ID NO: 232415 - DNA, 1791 bp, Artificial Sequence
  Description of Artificial Sequence: Synthetic coding sequence
atggagccagagttggccgcacaaaagcaacccaggccccgtcggaggtctcgcagggccagcgggcttagcaccgagggagccactggccctagcgccgacacatctggcagtgaattggatggtagatgcagtcttcgtcggggatcctcttttacctttctgacgcctgggcctaactgggacttcacactaaaacggaaacggcgagaaaaggatgatgacgtggtgtccctgtcttctctagatctgaaagagccttccaataagcgcgtgaggccactggccagggttacctccttggcaaacctcatttcacctgtgaggaacggggcagtccgcaggttcggccagaccattcagtcattcactcttcggggtgaccataggagccccgcaagtgcacaaaaatttagcagtcgcagcactgttcccacccccgcaaagaggaggtcaagcgccctctggagcgagatgctcgacataaccatgaaagaatccctgacaacacgggagattcgacgtcaggaggctatctacgagatgtcgaggggagagcaagatcttatagaagatttgaaactggcccgaaaggcctaccatgatcccatgctgaagctgagtatcatgagtgaagaggagcttacgcatatttttggcgatctcgactcctatatccccttgcacgaggacctcctgacgcggataggagaagccaccaaacctgacgggacagtcgaacagataggccatattctcgtctcctggcttcctcgattgaatgcctaccgtggctattgtagcaaccagctggccgcaaaagccctcctagaccagaagaaacaggacccaagagtccaggacttcctccagcgttgtctggagtcgcccttcagcaggaaactcgacctgtggagcttcctagacatccccagaagccgactggtcaaatacccactgttgctgaaagagatcctgaaacatacacccaaagagcatcctgacgtccagctgctggaggatgcaatattgataattcaaggggtgctatcagatatcaatctgaagaaaggagagagcgagtgtcagtattacatagacaagctcgagtacctggatgaaaagcagagggaccctagaatcgaggccagcaaggtgctgctctgccacggcgaactgaggtcgaaaagcggccataaactgtacatttttctgttccaagatatcctggtgttaactagacccgtgacccggaatgagagacacagttatcaggtttaccggcagcccatcccagtacaggagttagtgctggaggatttacaagatggtgatgttcgcatgggtggaagcttccggggtgccttcagcaattcagagaaagctaaaaatattttcaggattcgcttccacgacccctcaccggcacagtcacacaccctgcaggctaatgatgtttttcacaaacagcagtggtttaattgtatcagagcagctattgcacccttccagtcggccggatctcccccagagctccagggcctccccgagctgcacgaagaatgtgagggtaatcacccctcagccagaaagctgactgcgcagaggagggctagtacggtcagttccgtaacgcaggtggaggtcgacgaaaatgcttaccggtgcgggtctggaatgcaaatggccgaggattctaagtccttaaaaacacatcagacccagcctgggattcgccgagccagggacaaagcactgtctggaggcaaacgcaaggagaccctggtgtag

SEQ ID NO: 232416 - DNA, 483 bp, Artificial Sequence
  Description of Artificial Sequence: Synthetic coding sequence
atggttgctcacgacgagacaggaggcttactgccaatcaaaagaacaatccgcgtgctagacgtcaacaaccaaagtttcagagaacaagaggaattaacccacatcttcggagatttggatagttatatccctctgcacgaggatctgctcacccgaatcggtgaagcaaccaagcccgacggaactgtggaacagatcgggcacattcttgtgagctggctgccccgactgaacgcctaccggggatattgctctaaccagctggctgccaaagctctcctagaccaaaaaaaacaagaccctagggtgcaggactttctccaaaggtgtctcgaatcccctttcagccggaagttagacctgtggagcttcctggatatccctaggtcccggctcgtgaaatatcctctgctgctgaaagaaattcttaagcacaccccaaaagagcatcccgacgtgcagttgcttgaagacgcctag

SEQ ID NO: 232417 - DNA, 1629 bp, Artificial Sequence
  Description of Artificial Sequence: Synthetic coding sequence
atggtggcgcacgacgagactggaggcctgctccctataaagaggaccattcgcgtacttgatgttaacaaccagtcattccgggagcaagaagagccctcaaataagcgggtgagacctctggccagagttacctcactggccaatctgattagtcctgtccggaacggcgcagtgagaaggttcggccagaccatccagtcgttcacactccgcggagaccaccgtagcccagcctcggcccagaagttttcttctcggagcacggtaccaacccccgctaaacgcagatcctccgccctgtggagcgaaatgctggacattactatgaaggagtctctgacaacacgagaaatccgacgacaagaggcgatctatgagatgagcaggggggagcaggatctgatcgaagacctgaagctcgccagaaaggcataccacgaccctatgctgaaactttctatcatgtcagaggaggaactgacgcatattttcggcgacctagattcttacatcccactacacgaggacctgttgactcgcatcggtgaggctaccaagccagatggcactgtcgagcagatagggcatatattggtatcatggctgccccgactcaatgcgtatcgcggatattgttccaatcaactggcagccaaagccctgttagaccagaaaaagcaggatccgagagtacaggacttcctacagagatgcctcgaaagcccattctccagaaagcttgatctgtggtctttccttgatattcctcgatccagattggtgaaataccctttgctcctgaaggaaatcctgaaacacactccaaaagaacatccggatgtccagctgctcgaggacgccattctgattatacaaggtgtgctttctgacattaatctcaaaaaaggcgagagcgagtgtcagtactacatagataagctagagtatctggatgaaaaacaacgcgaccccagaattgaagccagcaaggtattgctgtgccacggggaattgcggtctaagtctggccacaagttgtatatttttctttttcaagatattcttgtgctcacacgtccagttacaagaaatgagaggcattcttaccaggtgtacaggcaaccaatccctgttcaggagctggtacttgaagatctgcaagacggggacgtgaggatgggcggaagtttccggggagcctttagtaatagcgagaaagctaagaacatcttccggataaggttccatgatccctccccagcgcagtcccatactctccaggcaaacgatgtctttcataagcaacaatggtttaattgtatcagggcggcaattgccccatttcagtccgcgggatctcctcccgagctccagggcttacccgagctgcatgaagagtgcgaaggaaaccacccttcagcaaggaagttaacagcccaaagacgagcctccacagtatctagtgtaacacaggttgaggtggatgagaacgcgtatagatgcggatccggaatgcagatggctgaggactccaagtcactgaagacacaccaaacccaaccaggtatcagaagagctagagataaagccttgtccggaggcaaacgaaaagaaacattggtttag

SEQ ID NO: 232418 - DNA, 483 bp, Artificial Sequence
  Description of Artificial Sequence: Synthetic coding sequence
atggtcgcacatgacgagacaggtggactgctccccataaaaaggactatccgggttctagatgttaataatcagtccttcagagagcaggaagaattgacacacatcttcggcgacctcgactcctacatccccctccatgaggacctcctgacaaggatcggagaagcaacaaagcccgacgggacagtggagcagatcggccatatcctcgtgtcttggctaccaagactaaatgcctacaggggatactgcagcaaccagctggcagcaaaggcgcttctggatcagaaaaagcaagacccgcgagtacaagactttttacagaggtgtctggagtcgccattcagtcgaaagctggacctgtggtccttcctcgatataccacgtagccggctggttaaataccccctgctccttaaggagatcttgaagcacacccctaaggagcatccagacgtgcaactgctcgaggatgcatag

SEQ ID NO: 232419 - DNA, 1248 bp, Artificial Sequence
  Description of Artificial Sequence: Synthetic coding sequence
atgtcccggggagaacaggacctgattgaggatctgaagctagccaggaaggcctatcatgacccgatgctgaagctgagtataatgtctgaagaggagttaacacacatcttcggcgatctggattcttacatacctctccatgaggacctgctgacaagaatcggtgaggcgacgaaacctgatggtaccgttgaacaaatcggccatatattggtgtcttggcttcctagattgaacgcctaccgcggttattgcagtaatcagctggccgctaaagccctcctcgaccaaaagaagcaggatccaagagttcaggattttctacaacggtgtctggaatcaccttttagtcgtaagctagacctgtggtctttcctggatatacccagatcccgactcgtgaagtaccccctcttgctgaaggagatcctgaaacatacacctaaggaacaccccgatgtgcagttgctcgaggatgctattctcattatccaaggggtgctgtccgatatcaacctcaagaaaggtgagtccgagtgtcagtattacatcgacaaactggaatatctcgacgaaaaacagcgtgacccccgaatcgaggctagtaaggtcctgttgtgtcatggtgagctccgctccaaaagtggtcacaagctgtatatttttctcttccaggatatactcgtcctcaccaggccagtgacccgaaatgagcgccactcctaccaggtctatcgccagcctataccagtacaggaactcgtcctggaggacctccaggacggtgacgtaaggatggggggatctttcagaggcgcattctccaattcggaaaaggctaagaatattttcagaattcgatttcatgatccctcaccagcccaatctcataccctgcaggccaatgacgttttccataagcagcagtggttcaattgtatcagagccgcaattgctccattccagtcagctgggagcccccctgaactacaagggctccctgaacttcacgaggaatgcgaaggaaaccacccctctgcgcgtaaactgaccgcacagcgtcgggcttccactgtaagctccgtgacacaggtggaagtggatgaaaatgcctatcggtgtggctccgggatgcagatggcggaggactctaagtcactcaagacccatcaaactcagccaggtattaggagggcgagagacaaggcgctgagtggcggtaagcgcaaggagaccctggtttag

SEQ ID NO: 232420 - DNA, 3063 bp, Artificial Sequence
  Description of Artificial Sequence: Synthetic coding sequence
atgatgtccttcggcggagccgatgctctgctcggagccccattcgcccctctgcatggagggggaagcctgcactacgcgttggcccgaaagggcggagcaggtgggaccagatctgctgcaggctccagctcaggcttccacagttggaccaggaccagcgtgtcctccgtctccgcttctccatctcgatttaggggagctggagcagcatcatccaccgacagtctcgacaccttgtccaacggacccgagggatgtatggttgccgtggccacgtctcgttcagagaaagagcagctacaggcgcttaatgaccgcttcgccggttatatcgacaaggtgcgacagttggaagcgcacaatcgaagcctggaaggggaagcggctgccctgagacagcagcaggctggcagaagcgctatgggcgaactttatgagcgcgaggttcgcgagatgcgaggcgctgttcttcgcttaggagccgctcgtggacagctgagactcgagcaggaacacctcctggaggatatcgcccacgtccgccagcgattggatgatgaagccagacagcgtgaggaagcagaggccgcagctagagccctggccagatttgcccaagaagctgaagcagcaagagttgatctccaaaagaaggcccaggccctgcaagaggagtgcggatatctgcggaggcaccaccaggaggaggtcggcgagttgttaggtcagatacagggcagcggggctgcgcaggcccaaatgcaggctgagacccgtgacgccctgaaatgcgacgtaactagtgctctgcgggaaatcagagcccagctagaaggccacgctgtgcagtctacactccagtcggaggagtggttccgggtcaggctggaccgcctgagcgaagccgctaaggtaaacaccgatgccatgcgctcagcccaggaggagatcacagagtatcgccgacagctccaggcacgcacgaccgagcttgaggctctcaagtccaccaaagattccctggaaagacagcggagcgaactggaggatcgccaccaagccgacattgcatcttatcaggaagcaatccaacagctggacgcagagctgcggaacacaaagtgggaaatggctgcacagctgcgagaataccaggatctcctgaacgtaaaaatggccctggatatcgaaatcgcggcatatcgaaagctgttggagggcgaggagtgtaggattggtttcggccctatcccattttccctccccgaaggcctgcccaagatccccagcgtgtccactcacatcaaagtgaaaagtgaagagaaaatcaaagttgtcgagaaaagtgaaaaggagacggtgatcgtcgaggaacagactgaggaaacccaggtgaccgaagaggtgacggaagaggaggagaaggaagccaaggaggaagaggggaaagaggaagagggcggtgaagaggaggaggcagaaggtggcgaggaagagacgaagagtccacctgctgaggaagctgctagcccggagaaagaagcaaaatcccccgtgaaagaggaggctaagtctccagctgaggcaaagtcaccagagaaagaagaggccaaatctcccgctgaggtgaaatcccccgaaaaggctaaatcccctgcaaaggaagaagccaaatcccctccagaggcaaagtctccagagaaagaagaggccaaaagtcctgcagaggttaaaagcccagaaaaggctaagagcccagcaaaggaagaagctaagtcacccgcagaagccaagtccccggagaaggcgaaatctcccgtgaaggaggaggcaaagtcccctgccgaggcgaaatcacccgttaaagaggaggccaagagtcctgccgaggtgaagtctcctgaaaaagccaagtctccgaccaaggaggaagcaaaatcccccgagaaggcaaagagcccagaaaaggaagaggcaaagtccccagaaaaggctaagagtcctgtcaaggcagaagcaaagtcacccgaaaaggctaaaagccccgtgaaagccgaagctaaaagccctgagaaggctaaatcacctgtgaaagaggaagctaagtcccctgagaaagcgaagtcacctgtgaaagaagaagcaaagagcccagagaaagcaaaaagccccgtgaaagaggaagcgaaaacaccggagaaggccaagagtccagtaaaggaggaagccaaatccccagagaaggcaaaatcccccgagaaagcaaaaacactggacgttaagtcgcctgaagccaaaactcccgctaaggaggaggctagatctccagccgacaaattccctgagaaggcgaaatctcctgtcaaagaggaggtgaagtcacccgaaaaggcaaagtctccgctcaaggaggacgctaaggcgccagagaaagaaatcccgaagaaggaagaagtgaagagccctgttaaagaagaggagaaaccccaggaagtgaaggttaaggaacctcctaaaaaagccgaggaggagaaagcgcctgcaaccccaaagactgaggaaaagaaggatagtaagaaggaagaggcccctaaaaaggaggcacctaagccaaaagtggaagagaagaaggaaccagcggtcgaaaagcccaaggagagcaaagtcgaggccaagaaagaggaagcagaggacaagaaaaaggtccccaccccagaaaaggaagcacccgcaaaagtggaggtgaaggaggatgcaaagccgaaagaaaaaaccgaagtcgctaaaaaagagccagacgatgcgaaagccaaagagcccagtaaaccagccgaaaagaaggaggccgctcctgaaaaaaaggacaccaaagaagaaaaagccaaaaaacccgaagagaagcctaagacggaggccaaggccaaggaggacgataagacattgtctaaggagccaagcaagccaaaggccgaaaaagcagagaaatccagttccacagatcagaaagatagcaaacctcccgagaaagccaccgaggacaaggctgctaaaggcaagtag

SEQ ID NO: 232421 - DNA, 2916 bp, Artificial Sequence
  Description of Artificial Sequence: Synthetic coding sequence
atgatgtcatttggtggagctgacgcccttctgggcgcaccgtttgcccctctccacgggggtggctcgctgcattatgctctcgcacgtaaaggaggggctggaggcaccagaagcgcagctggaagtagtagcggattccactcttggactcggacttccgtaagctccgtctcagcaagtccgagcaggttccgcggagcgggtgcagcgtcttccaccgatagtctggacacgctttctaatggtccagaaggctgtatggtcgcagtcgccacgtccaggagtgagaaagagcagttgcaggcattgaatgataggttcgcaggctatatcgacaaagtccggcagctggaggcccacaatcggtccctggagggcgaagccgctgctctgaggcagcagcaggctgggcgaagtgccatgggggagctctatgaaagggaggtcagggaaatgaggggtgctgtgctgcggctgggcgctgctcggggacagctgcgactggaacaagagcacttgctggaggacatcgctcacgtccggcagaggttggatgacgaagctagacaacgcgaggaagccgaggctgcagcccgtgctctggcaagatttgcccaggaggccgaggcagccagagtcgacctgcagaagaaagctcaagcactgcaggaggagtgtggctatctgcgtcgtcaccaccaggaggaggtcggcgagctgctgggacagatccaggggagtggcgcagcccaggcccaaatgcaggcagagacaagggacgctctgaagtgtgacgtgaccagtgcactgagagaaattcgggcacagctggagggacacgctgtgcagtctactctgcagagcgaggagtggttccgcgttaggcttgaccggttaagtgaggctgccaaagtcaacaccgatgccatgaggtcagcccaggaagaaatcacggaatatcgtaggcaacttcaggcaaggacaaccgaactcgaagcgctcaaatcaactaaggacagcctcgagcggcagaggtctgagttggaagaccggcaccaggctgatatagcctcataccaggaagccatacagcagctggatgctgagttgcggaataccaagtgggaaatggcagcccagctgagagaataccaggacctgcttaacgtgaagatggcattggacatcgagattgctgcttatcgcaaactgttggagggcgaggagtgcagaatagggttcggcccaattccattctcactgcctgagggcttgccaaaaataccatcagtcagcacacatataaaagtgaagtctgaggagaagattaaggtcgtggaaaaatccgaaaaagaaaccgtcatcgttgaggaacaaaccgaggagactcaggtgaccgaagaggtcacagaggaggaggagaaggaggccaaagaagaggaaggcaaagaggaggagggtggcgaagaggaagaggcagagggtggtgaggaggagaccaagagccccccagccgaggaagccgcttcgcctgagaaagaggccaaatctcctgttaaggaggaagccaaaagccccgctgaagctaagtcccctgaaaaagaggaagccaagtctcctgccgaagttaagagcccagagaaggcaaaatctccagcaaaggaggaggccaagagtccgccagaggccaagagtcctgagaaggaggaagctaaatctcccgctgaagtcaaatcacccgagaaagccaagagccccgctaaagaagaggctaagtctcccgctgaggctaaatcccctgagaaagcaaagagcccagtcaaggaggaggccaagagcccggcagaggcaaaatcccccgtgaaagaagaggccaaatcccctgcagaggtaaaatctccagaaaaggccaagtctcctaccaaggaagaggcaaagagtccagaaaaggcaaaatcaccagaaaaggaggaagcgaaaagccccgagaaagccaagtcgcctgtaaaggccgaagccaaatcgcccgaaaaagccaaatcacccgtgaaagctgaggccaagtcaccagaaaaggctaaaagccctgtcaaagaggaagccaagagtcccgagaaggcgaagtctcctgtgaaagaggaggccaagtctcctgagaaggctaagtcacctgtgaaagaggaagctaagacgccggagaaggcaaagagcccagtgaaggaggaggctaaatccccagaaaaggccaaatctccgttaaaggaagatgccaaagctccagaaaaggaaatcccaaagaaagaagaggtcaagagcccagtgaaggaggaagagaagcctcaggaggtgaaggtgaaagagcccccaaaaaaggctgaagaggagaaggcaccagccacccccaaaacagaagaaaagaaagatagcaaaaaggaagaggctcctaaaaaggaggctccgaaaccgaaagttgaggagaagaaggaacctgcggtggagaaaccaaaagaatccaaagtagaggccaagaaggaagaggccgaggacaagaagaaagtgccaacacctgagaaggaagcccctgctaaggtcgaggttaaggaagatgcaaagcccaaagagaagaccgaggtagcgaaaaaggaacctgacgatgcaaaagctaaggaaccctcgaagcctgccgagaaaaaagaggctgccccagagaaaaaggacaccaaggaggagaaagccaagaagcccgaggaaaagcctaagacggaagccaaagctaaagaggatgacaaaacgctctctaaagaaccaagcaagccgaaagcggaaaaagcagaaaaatcctcttccaccgaccaaaaagacagtaaaccacctgaaaaagctacggaagataaggccgctaagggtaagtag

SEQ ID NO: 232422 - DNA, 930 bp, Artificial Sequence
  Description of Artificial Sequence: Synthetic coding sequence
atggatgacaaagccttcacgaaagagttagatcagtgggtggaacagctcaatgagtgtaaacagcttaatgagaatcaggtccgaaccttatgcgagaaggccaaggagattttaactaaagaaagcaatgtccaagaggtgcgctgccctgtcaccgtgtgcggagacgtgcacgggcagttccatgacctaatggaactcttccgaattggcggaaagtcccccgacacaaactatctctttatgggagattacgtggatcgcggttactattccgttgagacagtcaccttactagtcgcgctcaaagtgcggtatccagagagaatcaccattctgcggggtaatcacgagagtagacaaatcacacaagtgtatgggttctatgacgagtgcttgcggaaatatggcaatgccaacgtctggaagtattttactgatttattcgattacttgcccctgaccgccctggtggatggacagatcttttgcttacacggagggctctctccgtcgattgacactctagaccacattcgggcattagaccgacttcaagaagttccgcatgaggggcctatgtgcgaccttctgtggtctgacccagatgaccggggagggtggggtatctctccacgcggagccggatatactttcggccaggatatcagtgagacttttaaccatgctaacgggctaactttggtctcccgcgctcatcagttggttatggagggctacaactggtgccatgaccggaacgtcgtgacgattttttcagccccaaattactgctacaggtgtgggaaccaggctgctataatggagcttgacgacaccctgaagtactcttttctgcagtttgatcccgcaccccgacgcggagagccccacgtcacacgaagaactccagactacttcttatag

SEQ ID NO: 232423 - DNA, 1623 bp, Artificial Sequence
  Description of Artificial Sequence: Synthetic coding sequence
atggccagacacctgagggagtaccaagacctcctgaatgtcaagatggcactggatatcgagatcgcagcgtaccgcaagctgctggagggagaggaaacgagattctccacattcgccggaagtatcacaggcccattatacacacatcgccctcccattactatctcctccaaaattcaaaagccgaaagtggaagccccaaagttaaaggtgcagcataaattcgttgaggaaatcattgaagaaactaaagtcgaagacgagaagtccgagatggaggaagcattgacagctattactgaagagctggctgtgtcaatgaaggaggaaaagaaggaagcagctgaggaaaaggaggaagagcccgaggccgaggaggaggaagtggccgctaagaaatcacccgtgaaggcaactgccccagaagttaaagaggaggaaggcgaaaaggaggaagaggaagggcaggaggaagaagaggaagaggatgagggggctaaatccgaccaggcagaggaagggggtagcgagaaagaaggatcatccgagaaggaggaaggagagcaggaagaaggagagaccgaggccgaagctgaaggggaagaggctgaggccaaggaggagaagaaggtcgaggagaagtcagaagaggttgcaacgaaggaggagttggtggcggacgctaaggtggagaaacccgagaaggctaaatcacctgtccccaagtccccagtagaggaaaaagggaaatcaccggtgccaaaatcgcccgtcgaggagaaaggaaagtctcccgttcctaagtctccagtagaagagaagggaaagagccccgtacccaaatctcctgtggaggagaagggcaaaagtccagtctcaaagagccccgtggaggagaaggcaaagtcgcctgtgccaaaaagcccggtggaggaggctaagtctaaggcggaggttggcaagggggaacagaaggaggaggaggaaaaagaggtcaaggaagccccaaaagaggagaaggtggaaaaaaaggaggagaaacctaaagatgttcctgagaaaaaaaaagcagagagccctgtcaaggaagaggctgtcgccgaggtggtcacaattacgaagtcagttaaggttcaccttgagaaagaaactaaggaggagggcaagccgttgcagcaggaaaaagaaaaagagaaggcgggaggcgagggaggtagcgaagaagaaggttcggacaagggcgctaaaggctcaaggaaagaagacatcgctgtgaacggcgaggtggaggggaaagaagaggtggagcaagagacaaaagaaaagggtagcgggagggaggaagaaaaaggtgtagtgacaaacggtctggatctctctcccgcagacgagaaaaagggtggtgataagtctgaggagaaggtggtggttactaagacggtagaaaagattacgtccgagggaggcgatggagccacgaaatacattacgaagtcggtaaccgttactcagaaggtcgaagagcatgaggagacctttgaggaaaagcttgtgagcacaaagaaggtggagaaggtcaccagccatgcaatcgtaaaggaagtgacgcagtctgactag

SEQ ID NO: 232424 - DNA, 2634 bp, Artificial Sequence
  Description of Artificial Sequence: Synthetic coding sequence
atgtcatacaccctggattccctgggaaatccaagcgcctataggcgtgtcaccgaaacacggagctctttcagtagagtgagcggcagtcccagctccggatttagaagtcaatcttggagtcggggtagcccgtccacagtatccagctcttataagcgtagcatgctggcacctcgattagcttattcttccgcaatgctctcctcggcagagtcttccctggacttttcccagtccagtagcctgttaaatggtggctccggcccaggcggagattacaagctatctagatccaacgagaaagagcagctccaaggtctcaacgaccgattcgccggatacatcgagaaggtgcattatttggagcagcagaataaggagatcgaggcggagattcaggcattgcgacagaagcaggcttctcacgcccagttgggcgatgcttacgatcaggaaattagagaactgagagccactctggagatggtcaatcacgagaaggctcaggtccagttggattccgaccatctggaggaagatattcaccggctgaaagagagatttgaggaagaggcacggcttagagacgatactgaagccgctatccgggctctgcgcaaggatatcgaggaggcctccctggtgaaagtagaactagataaaaaggttcagtccctccaggatgaagtggctttccttcggtcaaaccatgaggaggaagtggccgatttgctggcacagatccaagcttcccacatcaccgtggaacgaaaggattacctgaagactgatattagtaccgccttaaaagaaattagatctcagctggaatcccactccgaccaaaacatgcatcaggccgaggagtggttcaaatgtcgatatgccaaactgactgaggccgctgaacagaataaggaggctattcgaagcgccaaggaggaaatagctgagtacagacgccagctgcagagtaaatctatcgaactcgaatccgtgcggggtaccaaagagtcgcttgagcggcaactttctgatatcgaggaacgccataatcacgatctctcttcttaccaagacaccatccagcagctcgagaacgaactccgtggaacgaagtgggagatggcccgacacttgcgagaatatcaggatctcctcaatgtgaagatggctttggatatcgagatcgccgcatacaggaaattactggagggagaagaaactcgcttttcaacatttgccggtagcatcaccggcccactgtatacccatagaccacctatcaccatatcaagcaaaattcagaagcccaaagtagaggctccaaagcttaaggtacaacacaagttcgtggaggaaatcattgaagaaactaaggttgaggatgagaaatcagaaatggaagaggcgctcacagcaatcactgaagagctcgctgtctccatgaaggaagaaaaaaaggaagcagctgaggaaaaagaggaagagccagaggccgaagaggaagaggtagctgcaaagaagtcacctgtcaaagcaactgccccagaagtgaaggaggaggaaggggagaaggaagaagaagagggtcaggaagaagaagaagaagaagatgaaggggctaaatccgatcaagcagaagaggggggatcagagaaggaggggagttcggaaaaggaagagggagagcaagaagagggggagacggaggccgaggccgagggagaggaggccgaggcgaaagaggaaaaaaaagtagaggagaaaagcgaggaagtcgccacaaaggaggaattggtggcagacgctaaggtggaaaaacctgagaaagctaagagccccgtgcctaaaagtcccgttgaagagaagggcaaatctcctgtctctaagagtcccgttgaggaaaaggcaaagtccccagtgcctaaaagtcctgtcgaggaagccaaatccaaagctgaagtgggtaagggcgaacaaaaggaggaggaggagaaggaagtgaaagaggccccaaaagaggagaaagtcgaaaaaaaggaggagaagcctaaggatgttccggagaaaaaaaaagccgagtcccccgtgaaggaggaggccgtggccgaggtggttacaattaccaagtctgttaaggtgcacctggagaaggagactaaagaagaaggcaaaccgctccagcaggaaaaggagaaagagaaggccggaggagaggggggaagtgaagaggaaggaagcgataaaggagcaaaaggctcccggaaagaagacatcgctgtgaatggagaagtggaagggaaagaggaagttgaacaagaaactaaggagaagggcagcggacgggaggaggagaagggagtggtgaccaatgggttggacctttctcccgcagacgaaaaaaaagggggtgacaagagtgaggaaaaggtcgtcgtgactaaaaccgtcgaaaaaattacctccgagggcggtgacggggctactaaatatattaccaaatcagtaaccgttacccagaaggttgaggaacacgaggaaacctttgaagagaagctggtatccactaagaaagtcgagaaggtgacttcacatgcgatcgtgaaggaggttacccagtcagattag

SEQ ID NO: 232425 - DNA, 1071 bp, Artificial Sequence
  Description of Artificial Sequence: Synthetic coding sequence
atgaccaaaagctacagtgagagcggacttatgggggaaccgcagccacagggacccccttcttggactgacgagtgcttatcatcccaagatgaggagcacgaagccgacaaaaaggaagacgacctcgaaacaatgaatgccgaagaggacagtcttcgaaacgggggtgaagaggaagacgaggatgaggatctggaggaagaagaggaagaggaggaagaggacgatgaccagaaaccgaagcggagagggcctaaaaaaaaaaagatgaccaaggcccgactcgagcgatttaagttgcggaggatgaaggcaaacgccagggagcgtaatcgcatgcatggcctcaacgcagccctcgataatctgcgaaaagtggtgccttgctacagcaagactcaaaaactgtctaaaatcgagactctcagactggcaaagaactacatttgggccttatccgagatactccgctctgggaaatctcccgaccttgtcagcttcgtgcaaacactttgtaagggtctatctcagcccacaacgaatctggtggccggttgcctgcaactgaatccaagaacctttctgccagagcagaatcaagatatgccaccacacttaccaaccgcttctgcaagttttcctgtacatccctactcttaccagagtcccggactcccttcccccccatacgggaccatggacagtagccatgtgtttcacgtcaaacccccaccccacgcttatagcgcagccttggaaccattttttgagtcacctctgaccgactgcacctccccatcattcgacggcccactgagtcccccactgtctattaatggcaacttttctttcaaacacgaaccaagcgccgagtttgaaaaaaattacgcttttaccatgcattatccggctgcaaccctcgcaggagcacaaagtcacggctctattttttctggcaccgccgctcctaggtgcgagatccctatagacaatattatgtcatttgactcgcacagccatcacgaacgcgtcatgagtgcgcagttaaatgccatctttcacgattag

SEQ ID NO: 232426 - DNA, 1149 bp, Artificial Sequence
  Description of Artificial Sequence: Synthetic coding sequence
atgctgactagactgttcagcgaaccaggacttctctctgatgtgccaaaatttgcaagctggggagatggcgaagacgacgagcccagatctgataagggagatgcacctccacctcctccccctgcaccaggtcccggtgcacccggtccggcaagggccgctaaaccagtcccactgcggggagaggaggggactgaagctaccctggcagaagtaaaagaggaaggcgaactgggcggagaggaggaggaagaagaagaagaggaagagggactggatgaggctgaaggcgagcgacccaagaaacgaggtcccaaaaaacgcaagatgactaaagcacgactagagagaagcaagctccgcagacagaaggcaaatgcaagagagcggaatcggatgcatgatctgaatgctgcccttgataatctccggaaggtggtgccctgctattccaagacccagaaacttagcaaaatagaaactctccgtcttgcgaagaattacatctgggcgttgtccgagatcttgcgctctgggaaacgacccgacttggtgagctatgtgcagaccttgtgtaaggggctgtctcagccaacaacaaatttagtagccggatgtttacagttgaactcgcggaattttttaaccgaacagggcgcagacggcgcaggcagatttcacggcagcggaggaccatttgctatgcatccttatccctatccatgttcacggctcgcgggtgctcaatgccaggccgcagggggactgggaggaggagccgcacatgctttacgcactcatggttactgtgccgcatatgagaccctctacgctgctgccggaggcggaggtgcctctccggactacaactcatcggaatacgaggggccactctcaccccctctgtgtttaaatggcaactttagtctgaagcaggattcaagcccagatcatgagaaatcttatcattactcaatgcattactcagcattgccaggctcccgtccaaccggacacggacttgtgtttggtagctcagccgtgcgtggaggcgtgcattccgagaatctgttgtcctacgacatgcatcttcaccacgacaggggtcctatgtacgaggaactaaatgccttcttccacaactag

SEQ ID NO: 232427 - DNA, 996 bp, Artificial Sequence
  Description of Artificial Sequence: Synthetic coding sequence
atgagcaaaactttcgtcaagtccaaagagatgggtgaattagttaacacaccaagttggatggacaaagggctgggctcccagaatgaagttaaggaagaggaatcccggcctgggacttatggaatgctatcttctctgacggaagagcacgactctattgaggaagaggaggaagaagaagaagacggagaaaagcctaagagacgcggtccgaaaaaaaaaaaaatgacaaaagccaggcttgaacggttccgtgcgaggcgcgtgaaggccaatgctagggagcgaacaaggatgcacggactgaatgatgcgttagacaacctaagaagagtcatgccctgctactccaaaacgcagaaactttccaaaatcgagacactgcggctggctagaaattacatatgggcccttagcgaagtccttgagaccgggcagactcctgaaggtaagggtttcgtggaaatgctctgtaaaggcctgagccagccaactagcaatctggtggccggatgcctacagctcggtccacagagcgtactgttggagaaacatgaagataagtccccaatctgcgattccgctattagcgtacataacttcaattaccagagccctggactcccctcgcccccttatggccacatggagacccatctgttacacctcaagccccaggtcttcaagtcactgggcgaatcaagtttcggatcgcacctgccggattgctctactcctccgtatgaagggcctctgacgccacccttgtccatatccggcaatttttcattaaagcaggacggtagccccgacctggagaaatcctattctttcatgccccattatccctccagctccctcagcagcggccatgtgcacagcacgcctttccaggctgggacccctcggtatgacgtccccattgatatgtcgtacgacagttatccccatcatggcatagggacacagcttaacaccgtattcactgaatag

SEQ ID NO: 232428 - DNA, 1014 bp, Artificial Sequence
  Description of Artificial Sequence: Synthetic coding sequence
atgttgacattgccatttgatgaatctgtggtcatgcccgagtctcaaatgtgccgcaagttcagcagagagtgtgaggatcaaaaacaaattaagaaaccggaatccttctcaaagcagatcgttttgcggggaaagtccatcaagcgtgccccaggagaggagactgaaaaagaggaggaggaagaggatagggaggaagaggatgaaaatggcctgcctcgaaggaggggacttcgaaaaaaaaaaacaacaaagcttagactagaacgcgtaaagttcaggcgacaggaggccaatgccagggaaagaaacaggatgcacggcttgaacgacgccttagacaatctgaggaaggtggttccgtgctactctaagactcagaaactcagcaagatcgaaacccttagattagccaagaactatatctgggcattatcggaaattctccggatcggcaaaaggccggacctactgacctttgtgcaaaacctgtgcaagggtttgtcgcagcctaccaccaacttggtggctggctgtctccagctgaacgccaggagtttcctgatgggccagggaggggaggctgcccaccatacacgaagcccttactccactttttatcctccttaccatagtccagagctcaccactccacctgggcacggcaccctggataactcaaagtccatgaaaccatacaactattgctctgcttatgagtcattctatgagagcacctcaccagaatgcgcctccccacaatttgagggacctctgagtccccctcctattaactacaacggcatcttttctctcaaacaggaggaaacccttgactacgggaaaaattacaattacgggatgcactattgcgctgtgcctcctcggggtcctttagggcaaggggctatgttccggctgccgacggactcacactttccctacgatctccacctccggtcccagtcattaaccatgcaggatgagcttaacgccgtctttcataactag

SEQ ID NO: 232429 - DNA, 714 bp, Artificial Sequence
  Description of Artificial Sequence: Synthetic coding sequence
atgcctgcacgcctggagacctgcattagcgatctagactgcgcctcttcctccggctccgacctgtctggctttctaacagacgaagaggattgcgcgcgactgcagcaggccgcaagcgctagcggccctcccgcaccagcgaggaggggggctcccaacatttcccgagcctcggaggttccaggcgcacaggacgatgaacaggaaagacgccgtcgtcgaggaagaacacgtgtgcgtagcgaagccttgctgcacagcctgcggcgttcccgacgggtgaaggcaaatgaccgggaaaggaaccgcatgcacaaccttaacgccgcactggacgctttgcggtccgtgttgccttcattcccagatgacacaaaattgaccaaaattgaaaccctccgcttcgcttataattatatttgggcccttgccgaaacattacgcctggctgaccaggggctgcccggtgggggagctagggagagactcttaccaccccagtgtgtcccctgtctgcccggacctcctagccccgctagtgacgctgaaagctggggcagcggtgccgcagccgcaagtccgctctctgacccatcctccccagctgcgtctgaggactttacctatagacctggggaccctgtcttcagcttccctagtctgcccaaagatctgctgcacaccacaccctgtttcattccctatcattag

SEQ ID NO: 232430 - DNA, 645 bp, Artificial Sequence
  Description of Artificial Sequence: Synthetic coding sequence
atgactccccagccaagtggagctccaaccgtgcaggttacacgggaaacagagaggtcttttcctagagcctctgaagatgaggtaacatgtccgacctcagctcctcccagcccaacgaggactaggggcaattgtgccgaagctgaagaaggcggttgcagaggcgcacccaggaagctgcgcgctagacgcggaggtaggtcacggcctaagagcgaactcgccctcagtaaacagcggagatcgcggagaaagaaggccaatgatagagagcgcaatcgtatgcacaatttgaattccgcattagacgcactgcgcggtgtgcttccaaccttcccagatgacgcaaagctgaccaaaatagagactctccgatttgcgcacaattatatatgggccctcacacagaccttacgaattgccgatcactccctttacgcattggaaccaccagcgcctcactgtggcgagctggggtcaccaggcggatctcctggggactgggggtctctgtactcacctgtaagtcaagccggatcactgagcccagcggcatcacttgaagaacggccaggccttctgggggcaactttttctgcttgcttgtctccagggtcattggctttctcagatttcctctag

SEQ ID NO: 232431 - DNA, 456 bp, Artificial Sequence
  Description of Artificial Sequence: Synthetic coding sequence
atggaacgccctgaacccgagcttatcagacagagctggcgggcagtgtcccgttcacctttggagcacggaaccgtcctcttcgcccgtcttttcgccttggagcccgacttgcttcccttattccagtacaactgtcgtcaattcagttctcccgaagattgcttgagcagccctgaattcctcgaccatatccgcaaggtcatgttggtgattgacgctgccgtgaccaacgtggaggacctgtctagtctcgaggaatacctggcttctctcggcaggaagcatagggccgtcggcgtgaagctctcatccttttctacagtgggcgagtccctgctctacatgctggaaaaatgcctaggcccagcctttacaccagccacacgggcagcttggtctcagctctacggcgcagtagtgcaagcaatgtctagagggtgggacggggagtag

SEQ ID NO: 232432 - DNA, 237 bp, Artificial Sequence
  Description of Artificial Sequence: Synthetic coding sequence
atggactgttgtaccgagaacgcttgcagtaagcctgacgacgatatcctcgacatacccctcgatgaccccggagcaaacgcagccgctgccaagatccaggctagttttcgcggtcacatggccagaaaaaagataaagtccggtgagagaggacgaaagggcccaggtccaggaggccctggtggggctggggtggccagggggggtgctggagggggtccatccggtgactag

SEQ ID NO: 232433 - DNA, 237 bp, Artificial Sequence
  Description of Artificial Sequence: Synthetic coding sequence
atggattgttgcacagagaatgcttgctctaagcctgatgatgacatactcgatattcctctggatgatccaggtgcaaacgccgcagcagccaagatccaggccagcttccgtggtcatatggcacgcaagaaaataaaatccggcgaaagggggaggaaggggcctggccctgggggaccgggaggcgcaggagtggccaggggcggagccggaggaggccctagcggcgactag

SEQ ID NO: 232434 - DNA, 237 bp, Artificial Sequence
  Description of Artificial Sequence: Synthetic coding sequence
atggactgttgcaccgaaaatgcgtgctctaagcccgatgatgatatattggatatacccctagatgaccccggtgctaacgcagcggctgcgaagatccaggcatcatttcggggacacatggcccgaaaaaagataaaaagtggggaacgcggaagaaagggcccagggcctggagggcctggtggagctggggttgcacgtgggggagccggagggggtccctctggagattag

SEQ ID NO: 232435 - DNA, 936 bp, Artificial Sequence
  Description of Artificial Sequence: Synthetic coding sequence
atggctgccctcggagtcctcgaaagcgacctcccgtctgcggtcaccctgttgaagaaccttcaggagcaggtgatggcagtgactgctcaggtcaaatcactgactcagaaggtgcaggcaggcgcttatcctaccgagaagggcttatccttcctggaggtcaaggaccagttattactgatgtatctgatggatttgacacatctgattttggataaggccagtggaggatcactccaaggccacgacgccgtgctgcggctagtggaaataagaactgtgctggagaaactgaggccgctggaccaaaagctgaaatatcagatcgacaagctcattaaaaccgccgtcaccgggagcctgtccgaaaatgacccgttgaggttcaagccccatccaagcaacatgatgtctaaactctctagcgaggatgaagaggaggatgaggcggaagatgaccagtctgaggcctccggaaagaaatcagtcaagggggtaagcaaaaagtacgtgcctcccaggctagtccccgtgcactacgacgaaacagaggctgagagggagaagaagcgtctagagcgggctaagcggcgagccctcagtagtagcgtgattagggagctcaaagaacaatattctgacgctccagaggagatacgggacgcacggcatccccacgtgactaggcagtcccaggaagaccagcatcgtatcaattacgaagagagcatgatggttagattaagcgtctctaagagggagaaaggcaggaggaagcgggctaatgttatgagctcccagctccactcactgactcacttctctgacatcagtgctcttacaggcggtactgtccatctcgatgaagatcagaaccccatcaaaaagagaaagaaaatcccacaaaaaggaaggaaaaagaaaggacagtag

SEQ ID NO: 232436 - DNA, 948 bp, Artificial Sequence
  Description of Artificial Sequence: Synthetic coding sequence
atggcagccctgggagtactcgaaagcgacttgccttccgctgtgacactgctaaagaatctccaggagcaggtcatggcagttaccgctcaggtgaaatctctaactcagaaagtacaggccggagcctaccctactgaaaagggcctgagctttttagaggtcaaagaccagctcctcctaatgtacttgatggaccttacccacctgatcttggataaggccagcggcggatctctgcagggacacgatgcagtattgcggctggtggagatcagaaccgtgttagaaaaactgagacctttagaccagaaactgaaataccagatcgataagctgatcaaaaccgcagtcacaggatctttatcagagaacgatcctctgcggttcaagccccacccttccaacatgatgtcaaagctctcttccgaggatgaagaggaggatgaggccgaagatgaccaatcagaggcctcagggaagaaatctgtcaaaggcgtgagcaagaagtatgtcccccctaggctcgtgccagttcattatgacgaaaccgaggccgaaagggaaaaaaagaggcttgagagggcaaagcggcgagccttgtcctcgtccgttattagagaactgaaagaacagtactccgatgctccagaagagatccgagacgcgcgtcacccacacgtgacgcggcaatcccaagaggaccagcaccgaatcaactatgaggagtccatgatggtgagactgtctgtgtccaaaagagaaaaaggacggaggaaaagggctaatgtgatgtcaagccagcttcactccctgacccactttagtgacatatcagccctgaccggtggtaccgttcacctcgacgaggaccagaaccctatcaaaaaaaggaaaaagataccccagaaaggcagaaaaaagaagggttttcggaggagacgctag

SEQ ID NO: 232437 - DNA, 2472 bp, Artificial Sequence
  Description of Artificial Sequence: Synthetic coding sequence
atggcactgccacgttgcacctggccaaactacgtttggcgagccgttatggcttgcctggtgcaccgagggctaggtgccccattaactttgtgcatgttgggctgcctgctccaagctgggcatgttctgtcgcaaaaactcgacgatgtagaccctctggtggctaccaactttgggaagattcgcggtataaagaaggaactgaacaacgaaatcctcggaccagttattcaattcctgggcgtgccatatgcagctccccctacaggagagagaagattccagccacctgaaccacccagtccctggagcgacattaggaatgccactcagttcgctcccgtctgtcctcagaacatcatagacggacggctccccgaagtgatgctgcccgtctggttcaccaacaatctggatgtcgtaagctcttatgtgcaggatcagtcagaggattgcctgtacctgaacatctacgtcccaactgaggacgacatcagggatagtgggggtccgaagccagtgatggtttacattcatggtggctcatacatggagggcacgggcaatctgtatgatgggtcagtgctcgcttcttacgggaacgtaattgtaattaccgtcaactaccggctaggtgtgctggggtttctcagtacgggtgaccaagcggcaaaaggaaactatggactgctggacctgattcaggccctgagatggaccagtgaaaatatcggattttttgggggagatcctttgagaattaccgttttcggaagcggagcagggggatcatgcgtaaatttattgacgctgtctcactactccgagggaaatagatggtctaatagcaccaaaggtctgtttcagcgggctattgcgcagtcgggtactgctctatcctcctgggctgtgtcattccagccagcaaagtacgccaggatgctcgctacaaaggttggatgtaacgtgagcgacacggttgaactggttgaatgcctccagaagaaaccttataaagagctcgttgaccaagacattcagccggctagataccacatagcttttgggccagtgattgacggagatgtgatccctgatgatccccaaatcctcatggagcagggggaattcctaaattacgatataatgcttggggtcaaccaaggcgaagggcttaagtttgttgagaacatcgtggattcagatgacgggatctccgcatccgactttgacttcgccgtaagcaattttgtggacaatttatacggttatcccgaaggaaaagatgtcctacgagaaaccattaagtttatgtacacagattgggccgatagacacaatcctgagactaggcgcaagacactgctggcactgtttactgaccaccagtgggtcgcacccgctgtggctaccgccgatctgcacagcaattttggctctccaacctacttctatgccttctatcatcactgtcagaccgatcaggtaccagcatgggccgacgctgcacacggtgacgaagtaccatatgtgctgggaatacccatgattgggccaaccgagttgtttccctgtaacttttctaagaacgatgtcatgctgtcagccgtggtgatgacatattggaccaactttgcaaaaactggggatcccaaccagccggttccccaggacactaagttcatccacacaaagccaaacaggtttgaggaggtggcttggacaagatattcccaaaaggaccagctgtacctgcacattggcttaaaaccacgcgtaaaagagcattacagagcaaacaaggtcaatctttggctcgagttggtcccccacctgcataacctgaacgatatctctcagtatacttcaactacaactaaggttccgtccaccgatatcaccttcagacccactcgaaaaaacagtgttccagtgacaagtgctttcccaactgcgaaacaagatgacccaaaacagcaaccaagccctttttccgtggatcagagagattacagcacagagcttagcgtcaccatagctgtcggcgcatcactgctgtttctaaatatactcgcattcgccgctttatattacaagaaggacaagaggcgccatgacgtccatcgaaggtgctccccccaacggactacaaccaacgatctgacccacgcacaagaggaggagataatgagtctccagatgaagcataccgatttggaccacgaatgtgagtcaattcatcctcatgaggtggtcctgcgcaccgcatgcccccctgattataccctcgccatgcgcaggagcccagacgacgtgccattgatgacccctaataccatcacaatgattcctaacaccatcccaggaatccagccattgcacacctttaacacttttacagggggacaaaacaacacactgccccatccacatcctcacccgcactcccactctaccacccgggtgtag

SEQ ID NO: 232438 - DNA, 2592 bp, Artificial Sequence
  Description of Artificial Sequence: Synthetic coding sequence
atggctctccctagatgcacctggccgaattacgtttggagggcagttatggcctgtctggtacaccgaggcctgggagcacccctgaccctttgcatgctgggctgtcttcttcaagccggtcatgtgctcagccaaaagctggatgatgtcgacccccttgttgccaccaatttcggaaagatccgcggtatcaagaaagaattgaataacgaaatccttggaccggtaattcagttcttgggggtcccatatgccgcaccaccgacgggcgagcgccgatttcaaccgcctgagccaccttctccatggagtgacataaggaatgcgacccaattcgccccagtgtgccctcagaatatcatcgatggccgtctgccagaggtgatgctgccggtgtggtttacaaataacctcgatgtagtttccagctatgttcaggatcagtcagaggattgtctctatctcaacatttatgttccgaccgaggatgtaaaaaggatctccaaagaatgtgccaggaagccaggtaaaaagatatgtagaaagggcggacccctgaccaagaagcagactgacgatctcggggacaacgacggagccgaggatgaagatattagggatagtgggggtcccaaacctgtcatggtgtacatccacggcggaagctatatggaggggacagggaatttgtatgatggcagcgttctggcctcctatggcaatgtaatcgtaataacggttaattatcggttgggagtactcggatttcttagcaccggcgaccaggctgctaagggaaactatgggctactcgacctgatccaggcgctgaggtggacttccgaaaacatcgggttctttggaggcgaccccttgagaatcactgtcttcggcagcggggcaggcggttcatgtgtaaacctgctgactctttcccattactcagagggaaaccgttggtccaactctaccaagggcctctttcagagagcgattgctcagtccggaacagccctcagctcctgggcagtgtctttccagcccgcaaaatatgcccgaatgctcgctaccaaagtgggttgcaatgtgagcgataccgtggagctggttgagtgtctccagaagaagccctataaagagctggttgaccaggatattcagcctgcgagatatcacatcgccttcggacccgtcattgatggtgatgttataccagacgacccacagatactgatggagcaaggcgaatttctgaattacgatataatgctgggcgtgaaccaaggagagggacttaaattcgtcgagaacattgtggattccgacgacggaatttctgcctccgattttgactttgctgtgtcaaacttcgtggataatctgtatggttacccggaaggtaaagacgtgctgcgggaaactattaagtttatgtacacagattgggcggatagacataatcccgagaccagaagaaagaccctcctggcactgttcacagatcaccaatgggtggcaccagcagtggccactgccgatctccattctaactttggctcgcctacatatttttacgctttctaccaccattgtcagacagatcaagtgccggcatgggctgatgccgctcatggcgatgaggtgccctacgtgttggggatccctatgattgggcctactgaactgttcccatgtaacttctcaaaaaacgatgtgatgctctcagcagtggtcatgacttattggacaaactttgccaaaaccggggacccgaaccagcccgtaccgcaagacactaaatttatccataccaagccaaacagatttgaggaagtcgcatggacgcgctactcccagaaggatcagctgtatcttcatattggtctcaagcccagagttaaggagcactaccgcgctaataaggttaatctgtggctggaactggtaccccatttgcacaaccttaatgacattagccagtacacttctaccaccacaaaggtcccttctacagatattacatttagaccaacgcgaaaaaatagtgtgccagtgacttcggctttcccaaccgcaaaacaagatgatccaaagcagcagccttcacccttttccgtcgaccagcgtgactactcaactgagctgagtgtgactattgcagtcggtgcttccctcctgttcctgaatattttggcctttgccgctctgtactacaagaaggacaagcggaggcatgatgtgcacaggcggtgctctcctcagaggactaccacgaacgacctgacacatgctcaggaagaggagatcatgtctcttcagatgaagcataccgatcttgaccatgagtgcgagagcattcatcctcacgaggtggttttacggaccgcatgtcctcccgactataccttggcgatgcggagatcgcctgacgacgtccctttgatgacacccaacacgatcactatgatcccaaacacaattcccggaatccagcctctccatacgtttaacacttttacgggtgggcagaacaatacactgccccaccctcatcctcacccgcactcccactcaaccactcgtgtatag

SEQ ID NO: 232439 - DNA, 33 bp, Artificial Sequence
  Description of Artificial Sequence: Synthetic coding sequence
atggccctcccgagatgcacctggccaaactag

SEQ ID NO: 232440 - DNA, 42 bp, Artificial Sequence
  Description of Artificial Sequence: Synthetic coding sequence
atggcactccccaggtgtacttggccaaactacgtttggtag

SEQ ID NO: 232441 - DNA, 2472 bp, Artificial Sequence
  Description of Artificial Sequence: Synthetic coding sequence
atggcactccctcgttgcacgtggcccaactacgtgtggcgggctgtgatggcgtgcctggtgcataggggccttggcgctccgctaactttgtgcatgctcggatgcctcctgcaggcgggtcacgtccttagccagaagctagatgacgtggatcctcttgtagctacaaatttcggtaaaatcaggggcattaagaaggagcttaacaacgagattctggggccagttatccagtttctgggagtgccatatgcagctccccctacaggtgagcgtagatttcaacccccagaacctcccagcccatggtctgatattcggaacgccacccagtttgcgccagtctgtccccaaaatatcatcgatggcaggctccctgaggtcatgctaccagtgtggttcaccaacaatctggatgtcgtgagtagttatgtgcaggaccagtctgaggactgcctttacctcaacatctatgtgcccaccgaggatgacatccgcgatagtggtgggccaaaacccgtgatggtgtatatccatgggggttcctacatggaaggaacagggaatctttatgatggcagtgtgctggcatcttacggaaacgttattgtgattacagttaattaccggctgggcgttctcggcttcctcagtacaggcgaccaagccgcaaaaggtaattacggccttcttgacctcatacaagcactccgatggactagcgagaatatcggcttttttggcggagatccactccggatcaccgtgtttggatcaggcgctggaggatcctgcgtgaacctgctcacactgtctcattatagcgaaggaaacagatggtcaaacagtacaaaaggattgtttcagcgcgctatagcacagtctggcacagctttgtcttcctgggccgtgtccttccaacctgccaaatacgctcggatgttagcaactaaggtgggctgtaatgtcagcgatacagtggagctggttgagtgtttgcagaagaaaccctataaggagctcgttgatcaggacatccagcctgcaaggtatcatatagcctttggccctgtaatcgacggggacgtcatccccgacgaccctcagatactcatggagcaaggagaattccttaattacgatattatgttaggcgtcaaccagggcgagggacttaaatttgtggagaacattgtggactccgatgacgggatcagtgctagcgattttgacttcgctgtgtcaaactttgtcgataacctctatggatatcccgaaggcaaggatgttctgcgggagactatcaaattcatgtacaccgattgggccgatcggcataatccggaaacccggaggaaaactcttctggccctttttacagaccaccagtgggtcgctcctgcggtagcaaccgctgatctccactctaattttggtagccccacctatttttacgccttctatcatcactgtcagactgaccaggtgcccgcttgggcggatgccgctcatggagatgaagtgccatacgtcttgggaattcccatgatagggccaaccgagctattcccatgtaacttctctaagaatgacgtaatgctatcagccgttgtgatgacatattggacaaatttcgcaaaaacgggggatccaaatcagcctgtgcctcaggatactaagttcatccacacaaagcccaaccgatttgaagaagtggcttggacccgctactcccagaaggatcagttgtatctgcatatcgggttgaaaccacgggtgaaggagcactaccgggctaataaggtcaatttgtggctcgagcttgtgcctcatctgcacaaccttaacgatatcagtcagtacacctcaaccaccaccaaggtgcccagtacggacattacattccgccctaccagaaagaactccgtccccgtcacttccgcctttcctacagcaaagcaggatgacccaaagcagcagccctcacccttctctgttgaccagagagattattctaccgaactgagtgtgaccatcgccgtgggagcgtcgcttctgtttctcaatatcctcgcctttgccgctctgtactataagaaggataaacggagacatgatgtccatcggaggtgttctcctcaaagaactacaactaacgacttaacacatgcccaggaggaagagattatgagtttgcagatgaagcacactgatctggatcacgagtgcgagtctattcacccccacgaagtggtcctacgaaccgcatgcccaccggactatacactggcaatgcggagaagtccggacgacgtcccgcttatgacccccaacaccatcacgatgatacctaacacaatccctgggattcagccactccacaccttcaacacgttcacaggagggcaaaacaataccctgccccatccgcacccccaccctcactcccattcgactacaagggtgtag

SEQ ID NO: 232442 - DNA, 2472 bp, Artificial Sequence
  Description of Artificial Sequence: Synthetic coding sequence
atggccctgcccaggtgtacctggcccaactacgtctggcgggcagttatggcttgcctagtgcatagaggtctgggtgcccctctcactttgtgcatgctggggtgcctgctccaagccggacacgtactgtctcagaagctcgatgatgttgatcccctcgtagccaccaacttcggcaagatccgcggtatcaaaaaggagctgaacaatgagattctgggacctgttattcagttcctgggcgtcccctacgctgctcccccaacgggagagagaagattccagccaccagagcccccaagcccctggtcagatatccgtaacgccacccagttcgcgcctgtctgtccccagaacatcattgacggccgactccccgaggttatgttgcctgtctggttcaccaataacctggacgtggtcagcagctatgtgcaggatcaaagtgaggattgtctgtatcttaacatctatgtgcctaccgaggacgacatccgagactcaggagggcctaaaccggtcatggtgtacattcatggtggatcatacatggaaggtactggcaacctttacgacggttctgttctcgcatcttatggtaatgtcatagttatcaccgtgaactatcgcctgggggtgctgggattcctgtcaacaggggatcaggctgccaagggcaactacgggctactcgacctcattcaagcattgcgatggacatccgaaaacattggattcttcgggggagatcctcttcgtataaccgtgtttggctcgggggctggagggtcatgcgttaatctactgactttgtctcactattctgaaggcaaccggtggagcaatagcactaaaggactttttcagcgagccattgcccagagcggaacagctctgtcctcatgggctgttagctttcaaccagccaagtacgccaggatgctggcgacaaaggttgggtgtaatgtgtccgacaccgtcgaactagttgagtgtctgcagaagaaaccctataaggaattggtggatcaggacattcagcccgcaagatatcatatcgcttttggccctgtgattgacggggatgttatccctgacgatcctcaaatcctgatggaacagggggagtttcttaactatgacatcatgctgggagtcaatcagggcgagggcctcaagtttgtagaaaatatcgttgactccgacgatggaatcagtgcctctgactttgatttcgcagtcagtaatttcgtggacaacctatacggctaccccgaaggcaaggatgtgctgagggagactatcaaatttatgtacacggattgggcagacagacacaatcctgagacgcgtcgcaagaccttattggctctttttacagaccatcaatgggtggccccagccgtcgcgacagccgacctccactctaatttcggatcccccacctacttctatgctttttatcaccattgccagacagatcaagtgcccgcttgggctgatgccgctcatggtgatgaagttccatacgtactgggcatacctatgatcgggccaacagagcttttcccgtgcaacttcagtaaaaatgacgtgatgctgtctgcggtggtcatgacctactggaccaattttgccaagaccggcgaccccaatcagcctgtacctcaggacactaaatttatccatactaaacctaatcgtttcgaagaggtcgcatggaccaggtactctcagaaggaccagctgtacctgcacatcggattaaaaccgagggtgaaagagcactatcgcgctaacaaagttaatctctggctcgagctggtacctcatctccacaatctcaatgatatatcccagtacacatcaactaccactaaagtcccatctaccgatatcacctttagaccaactcgaaaaaactccgttcctgtgacaagtgcatttccaacggctaagcaagatgatcctaagcagcagccttctccattcagcgtggaccaaagagactattccacagagctaagcgttaccatcgccgtgggcgcatctctgctctttctgaacatcctggcctttgccgctctctactacaaaaaagacaaacggagacatgatgtccaccggagatgcagtccacagcgcaccactactaacgacctgacacatgcgcaggaagaagagataatgagtctccagatgaaacacacggacctggaccatgaatgtgaaagcattcacccacacgaagtggttctgaggactgcctgccccccagattacactctggccatgagacgttctcctgacgacgtgcctctaatgacaccaaatacgattaccatgatccctaataccattccaggaattcaaccactacatactttcaacacctttactgggggtcaaaacaacaccctgccacaccctcatccccatccccacagccactctacaacccgagtgtag

SEQ ID NO: 232443 - DNA, 2508 bp, Artificial Sequence
  Description of Artificial Sequence: Synthetic coding sequence
atgtggctgctagccctgtgcctggttgggcttgccggtgcacagcgcggaggcggtgggccaggtggtggtgctccaggagggccaggcctcggacttggatcactcggtgaagagagattcccggtagtgaatactgcctatggtcgggtcaggggggtgaggagggaactgaacaacgagatcctcgggccagtcgtccagtttctgggcgtcccatacgctactcccccactcggcgctcgaagattccagccacctgaagcccctgcctcctggccgggagtacgcaacgctacaactctccctcctgcttgtccacaaaacctccatggggctctgcccgcaataatgctgcccgtgtggttcactgataatctggaggccgcagcaacctacgtgcaaaatcagagcgaggactgtctgtatctgaacttatatgtgcctaccgaggatggaccgctgacgaaaaaacgagacgaagcgacgttgaatcctccagatactgacattagggatcctgggaaaaagcctgttatgttatttctgcatggcggttcttatatggaaggtacaggaaatatgtttgatgggtccgttttggcagcctacggcaacgtcattgtggccacgctaaattacaggctaggagtcctaggatttcttagtaccggcgaccaggcggctaaagggaattatggccttctagaccaaatacaagccctccggtggctgtccgagaatatcgcacatttcggcggagaccctgaaaggattaccattttcgggtcaggagctggggcttcgtgtgtgaacctactgattttgtcccatcatagcgaaggtttgttccagaaagccattgcgcaatcaggaaccgctatttctagttggagtgtcaattaccagcctcttaagtataccagattgctggctgccaaggtaggctgtgatagggaggacagcgccgaggccgtggaatgcctcaggaggaagcctagtcgtgagctggtggaccaagacgtgcagcccgcaaggtatcacatagcttttggacccgtagtggatggcgacgtggtccccgatgatcccgagatcctaatgcaacagggtgagtttttgaattatgacatgctgattggggttaaccaaggtgagggtttgaagtttgtggaagattccgcagagtctgaagacggggtctcagcgtccgcctttgactttacagtatcgaatttcgtggacaacttgtacggctaccctgaagggaaggatgtgctccgcgagaccatcaagttcatgtatacagattgggccgatagggacaatggcgagatgagaaggaagaccctcctggccctgttcaccgaccaccaatgggtggctcccgctgttgcgactgctaagcttcatgcggactaccagagtcccgtgtacttttacacattctaccatcactgtcaggccgaaggaaggcctgaatgggctgacgcagctcacggtgacgaactgccttatgtctttggcgtcccaatggtgggtgcgactgacctcttcccatgtaacttttctaagaacgatgttatgctgagcgccgttgtcatgacctattggaccaatttcgccaaaactggggatccgaatcagccagtgccccaagacacaaagtttattcataccaagcccaatagattcgaggaagtggtgtggagcaaattcaattccaaagagaaacagtacttgcacatcggattgaagccaagggtccgcgataattaccgggcaaacaaggtggccttttggctggaactggtgccacacttgcataatctgcacacagagctgtttaccacaaccacacgcctccctccctatgcaacgagatggccgcctaggcctcccgcaggtgcccctggtactagaaggcctccaccaccagccacactaccaccggagcccgagcccgaacccggtccccgtgcatacgatagattcccgggagattccagagactatagcacagaactgagtgttacagtagcagttggggcatctcttctctttcttaatatccttgcattcgccgcactatattacaagcgcgacagacggcaggagttgcgctgtagaaggttgtctccaccaggcggatcaggcagtggtgtgccaggaggaggtccgctgctccctgccgcaggtagggagttaccgcctgaggaggagttggtttcgctgcagcttaagcggggagggggagtgggagcagacccagcagaggcccttcgccctgcctgcccacccgattacactcttgcactgaggagggcgcctgatgacgttcccttgttggcgccaggcgcactgaccctcctgccatcagggctggggccaccaccccctcctccacctcctagcttgcacccgtttgggccatttccacctccgccacccaccgccacctctcataacaacaccttaccacacccacatagcaccactcgcgtgtag

SEQ ID NO: 232444 - DNA, 2547 bp, Artificial Sequence
  Description of Artificial Sequence: Synthetic coding sequence
atgtggctgagactgggaccgccttctctaagtctgagcccaaagcctacagtgggtcgatcactgtgtttaaccttatggtttttaagtctcgccctgagggccagcacgcaagcgccagctccaaccgtcaacacccattttggcaaacttcgcggagctcgagtacccctgccctccgagatcctgggcccagtggaccagtatctcggggtgccgtacgccgctccccctattggcgagaaacggttcctgccacccgaaccacccccatcatggtcgggtattagaaacgcaacacactttcccccagtgtgtccgcagaacatccacactgctgtccctgaggtgatgttgcccgtgtggtttaccgcaaacctcgacatcgtggctacttacatacaggagcccaacgaggattgcctatacctcaacgtgtacgtgcctacagaagatgtcaaacgcatctccaaggagtgtgccaggaagcctaacaagaaaatatgccggaaaggtggcagcggcgctaagaaacagggagaggatctagctgacaacgacggagatgaagacgaggatatcagggacagtggggcaaagcccgtgatggtctacatccacgggggatcatatatggagggaacaggcaacatgattgacggctccatcttggccagttatggcaacgtcatcgtgatcaccctgaactatagagtgggggttctgggcttcctaagcacgggggaccaggcggcaaaaggaaactacggactgctcgaccagattcaggcattgcgctgggtgtctgagaatatagccttttttggaggcgaccccaggcggatcactgtttttggctctggcattggagcctcctgtgtcagccttctcaccctgtctcaccatagcgagggcttattccaacgggctataattcagtccggtagcgcactgtcctcttgggccgtgaattatcagccagtcaaatacacaagcctgttggccgacaaagttggctgtaatgtgcttgacaccgtggatatggtggattgcctccgccaaaaaagcgcaaaggaactggtagagcaggacattcaaccagccagataccacgtcgcattcgggccagtcatcgacggcgacgtgatccccgacgatcctgaaattctgatggaacaaggggagttcctgaactacgacattatgttgggcgtgaatcagggagagggcctgaaatttgtagagggggttgttgaccctgaggacggagtgtctggtactgactttgattactcagtgagtaatttcgtagacaacctgtatgggtaccctgagggaaaggacacgctacgagaaacgataaagttcatgtacactgactgggcagatcgagacaatcccgaaaccagaaggaagacacttgtggccctgttcaccgatcatcagtgggtggaaccctccgtcgtgacggcggacctgcacgcacggtatgggagtcctacatacttttacgctttttatcaccactgtcagagtttgatgaaacccgcttggtccgacgcggctcatggcgacgaggtgccttatgtgtttggtgtgcccatggtcggtccaaccgaccttttcccttgtaactttagcaagaacgacgtcatgctgtccgcagtggtaatgacttactggaccaatttcgcaaaaacgggcgatccaaataagcctgtgccgcaagacactaaatttattcacacaaaagccaatcgatttgaggaagtggcctggagtaagtataatcctcgcgaccaactttatttgcacatcggcctcaaacctcgggtgcgcgaccactatagagcaactaaagttgccttctggaagcacttagtgccgcacctctataatctccacgacatgtttcattatacttccacaaccacaaaggtgcccccacctgacacaacccattcatcacatatcacgaggcgccctaacggcaagacctggagcacaaaacgacccgcaatctcgcccgcttacagcaatgagaacgcacaagggtcatggaatggtgatcaggatgcagggcctctactagtagaaaaccctagagattacagcactgagttgtcagtcacaatcgccgtcggagcctccctgttattcttgaacgtgttagccttcgcagccttatactaccgcaaagacaagaggcgccaggaaccgctcagacagccctcaccgcaacgaggcgctggggctcctgagctgggcgctgcccctgaggaggaactcgccgctctgcagcttgggcctacccatcacgagtgtgaagccggtcctcctcacgacacactgcgtctgacagccctccccgactacacactgacacttaggagaagtcctgatgacattcccctcatgacacccaacacaatcacaatgatccccaattccctcgtgggattgcagaccctccatccatataacaccttcgctgcagggtttaactccaccgggttgccgcatagtcacagcactactcgcgtgtag

SEQ ID NO: 232445 - DNA, 2487 bp, Artificial Sequence
  Description of Artificial Sequence: Synthetic coding sequence
atgtggcttcggcttggcccacctagtctttcactgtctccgaagccgactgttggccgtagtctttgtctgaccctttggtttctaagtctggccttgagggcatctactcaggcccctgctccaacggtgaatacccattttggcaagcttcggggtgcacgggtacctcttccatccgagatccttgggccagtggatcagtacctgggcgtgccttacgccgctcctccgatcggagaaaagcgttttctgccccctgaaccccctccatcctggtccggaattcgtaacgctacacattttccacccgtgtgtcctcagaacatccacacggccgtgccagaagtcatgttgccggtgtggtttacagctaacctcgatatagtggcgacgtatatccaggaacctaacgaagactgtctttatttgaacgtttacgtacccactgaagatggttcgggggcaaagaagcagggagaggacctcgcagacaatgacggagacgaggacgaggacataagggattcaggcgctaagcccgttatggtatacatacacggagggtcttacatggagggaactgggaacatgatcgacggcagcattctggcctcctacggcaatgtgatcgttatcaccctgaactatagagtcggagtgctcggatttctcagtaccggagaccaggctgcgaaaggaaattacgggttactggatcagattcaagccttgcgatgggtcagtgaaaacatcgcctttttcgggggtgaccctcggcgaattactgtttttggaagcggcattggagctagttgcgtctcgctcctgaccttaagccaccacagtgaaggtcttttccagcgcgctatcattcagagtggttccgctctgtccagctgggccgtgaattatcaacctgtcaaatatactagcctgctggccgacaaagtaggctgtaatgtgttggacaccgttgacatggttgattgtcttcgccagaaatccgccaaggagctggtagagcaggatatccaacccgctaggtaccacgttgcattcggcccagttattgacggcgacgtcatcccggatgaccctgaaatcctgatggagcagggagagttccttaattacgatattatgctcggcgtcaaccagggggaaggtttaaagtttgtggagggtgtggtggatcctgaagacggtgtcagtggaactgattttgattattctgtcagtaatttcgtggacaacctttacgggtaccctgaggggaaggataccttgagagaaaccataaaatttatgtataccgactgggccgacagggataaccccgagacccggagaaaaactctggtcgctctgttcaccgatcaccaatgggtcgagccatctgtggttacagccgacttacatgcaagatacgggagcccaacgtacttttatgctttctatcaccattgccagtcacttatgaaacctgcatggtccgatgcagcccacggcgacgaggtgccctatgtgtttggagtgcccatggtgggacccaccgatttatttccctgtaacttctcaaagaacgacgtgatgctcagcgccgtggtgatgacctattggacgaacttcgcaaagacaggtgatccaaacaaacctgttccacaagacaccaagttcatacataccaaggccaaccgattcgaggaggtcgcttggagcaagtataatccgagggaccagttatacttgcatattggattgaagccacgggtgcgggatcattaccgagctactaaagtcgccttctggaagcacctggtgccacacttgtataacctacacgacatgttccattatacctccacgacaaccaaggtgccgccaccggatactacacatagctcccatattaccaggagaccaaatggtaaaacctggtctacaaaacgccctgcaatatcacccgcatatagcaacgaaaatgcacaggggtcctggaacggggatcaggatgccggaccattactggtggagaacccgagggactattctaccgagctatccgtgacaatagcggtgggagcgtcactcctattcctgaatgtgctggcattcgcggcactgtactaccggaaggacaagcgacggcaggaaccactccggcagccatccccacaacgcggagccggagctcctgagctgggcgctgcgccagaggaagagctggcggcactccaactaggtcctacccaccacgaatgcgaagctggcccacctcatgatacattaagactgactgcgctgccagattataccctgacgctaagacgcagccccgacgatatccccctgatgacaccaaacaccataacgatgatcccaaactcacttgttggcctccaaacattgcatccctacaatacatttgcagcaggctttaacagcaccgggttgccccatagccacagcacaacccgggtctag

SEQ ID NO: 232446 - DNA, 1542 bp, Artificial Sequence
  Description of Artificial Sequence: Synthetic coding sequence
atgtggctgcggctgggacctccttctctaagccttagcccaaagccaactgtaggacgatcactctgccttaccttgtggttcttgtcactcgccctgagagccagcacccaggctcctgcgccaaccgtgaatacgcacttcggtaagctgaggggcgctagggttcctctgccgagtgaaatcctcgggcctgtggatcagtatctgggggtcccttatgcagccccacccattggagaaaaacgtttcctgcctccagagccccctcccagctggtcgggaatcagaaatgctacccattttccccctgtgtgtcctcagaacatccacacggcagtccctgaggttatgttgcccgtgtggtttactgccaacctggatatcgtggccacatatattcaggagcctaatgaggactgtctgtatcttaacgtttacgtccccaccgaggatgacatacgcgatagtggggctaaacccgtcatggtgtacattcatggaggctcctacatggaaggtacgggaaatatgatagatggatcgattcttgcgtcttatggcaatgtcatcgttataacactgaattaccgggttggggtgctcgggttcttgagcacaggggaccaagctgccaaaggtaactatggcctcctagaccagatccaggccctgcgttgggtttccgagaatatcgcttttttcggcggagaccctcgcagaattactgtttttgggagtggaatcggagcctcatgtgtatccctgctgactttgtcccaccatagcgaagggttgttccagcgggctatcatccagtccggttcggccctctcttcttgggctgtgaattatcagcctgtcaagtacacttctttgctggctgacaaagtagggtgcaatgtgctcgataccgtggatatggtggactgcctccgccagaaatccgccaaggagcttgtggaacaagacatacaacctgccagatatcacgtggcctttggacccgtaattgatggggacgttatcccagacgacccagaaatcctgatggagcagggtgaattcctcaactacgatatcatgctcggggtgaatcaaggagagggcttgaaattcgtcgagggcgtcgtggacccagaagacggagtgtcaggaactgacttcgattacagtgtgagtaacttcgttgacaacctttatgggtatccggaaggaaaggatacgctgcgcgaaaccatcaaatttatgtatactgattgggcagatcgcgacaaccctgaaaccagacggaaaacccttgtggcattattcacagaccaccagtgggttgagcccagcgttgttaccgccgacttacacgctagatacgggtctcctacctatttctatgccttttaccaccactgccagtcactgatgaaacctgcctggagtgatgcagcccatggggatgaagtgccttacgttttcggggtgcccatggtggggccaacggatctgtttccctgtaacttctcaaaaaatgacgtcatgttgtag

SEQ ID NO: 232447 - DNA, 2427 bp, Artificial Sequence
  Description of Artificial Sequence: Synthetic coding sequence
atgtggctgaggcttgggccaccaagtcttagcctgagcccaaaacctacagttgggagatccttgtgcctaacactctggttcttatccctcgccctccgcgcatccacccaggcgccagctccaactgttaatacccattttggtaaactaaggggcgcaagggttcccctgcccagcgaaatactgggacctgtggaccagtatctaggagttccttacgcagccccacccatcggcgaaaagcgatttcttccacccgagcctccaccttcctggtctggtatccgtaatgcgacccactttccaccagtatgcccccagaacatccacacggcagtccctgaggttatgctgcctgtgtggtttacagccaacctcgatatagtggcgacctatattcaggagcctaatgaggattgcttgtacctgaatgtttatgtcccgactgaggatgatatacgagacagtggggctaagcctgtcatggtctatattcacggcggttcatatatggaggggaccggtaacatgatagatggctcgattctcgcaagttacggcaatgtgatcgtcatcactttgaactaccgtgtgggcgtgctaggctttttgtctaccggggatcaggcagcgaaggggaattatgggcttctggaccagatccaggctctgaggtgggttagtgagaatatcgcttttttcggcggtgacccacggaggatcactgttttcgggagcggaattggggcttcctgtgttagcctgttaacactgtctcaccactccgaaggcctattccagagagccatcattcagagtgggagcgctctgagtagctgggcggtcaactaccagccggtgaagtacacttccctgctagctgataaggtgggatgtaatgtgttagataccgtggatatggtcgactgcctcagacagaagtccgcgaaggaacttgtggaacaggatatccagccggctcgctatcacgtcgcgtttggtcctgtgatcgatggggatgtgattcctgatgaccctgaaatcctgatggagcagggggaatttctgaactatgatataatgctgggggtgaatcaaggagaagggctgaagtttgtggaaggggtggtcgaccccgaggatggcgtgtctggcaccgattttgactacagtgtgtctaacttcgtggataacttgtatggatatcctgaaggcaaggatactctgcgggagaccatcaaattcatgtatacagactgggccgatagggacaacccagaaaccagacgtaaaaccttggtcgcactgtttactgatcaccagtgggtagaaccatcagtggtgaccgcggacctccacgcgcgttatgggagccccacttacttttacgctttttatcaccactgccaaagcctgatgaaaccggcatggagcgatgccgctcacggtgatgaggttccctacgtattcggggtccctatggtaggtcccacggacctttttccatgtaacttcagtaagaacgacgtaatgctgtcggcagtggtgatgacttactggactaatttcgcgaagaccggagatcctaataagccggttcctcaggacacaaagttcatacatactaaggccaatcgtttcgaggaggtggcatggagcaagtacaacccgagagaccaactgtacttacatatcgggctgaagccgcgagtaagggaccactatagggcgactaaggtcgccttctggaaacacctagttccgcatctgtacaacttacacgatatgttccactacacgtctactacaaccaaagttccccctcccgacacaacccattcttctcatattactagacgcccaaacggaaagacttggtccacaaagcgccctgccatcagtcccgcatactccaacgagaatgctcaaggcagttggaatggtgatcaggatgcagggccactgctggtggagaacccccgtgactattccactgagctgtcagtgaccatcgccgttggagcatctttgctgtttctgaatgtgttggcttttgcagctctgtattataggaaagacaaaagacggcaggaaccgttacggcagcctagcccccagagaggcgctggcgctcctgagcttggggcagcaccggaggaggagctggcggctttgcagttggggccaacccatcacgaatgcgaggcagggccaccgcacgacaccctaaggctgacagccttaccagactacacattgactctgcgtagatcccctgatgacatacctctgatgactccaaataccattactatgattcctaacagcttggtgggccttcagaccttacacccttataacacgtttgccgctggcttcaacagtacaggcctcccccactctcattcgacgaccagggtatag

SEQ ID NO: 232448 - DNA, 1056 bp, Artificial Sequence
  Description of Artificial Sequence: Synthetic coding sequence
atgcttcctgtctggttcacagccaacctggatattgttgctacctacatccaggaacctaatgaagattgtctctatctcaacgtgtacgtacccactgaggatggctccggtgcgaagaaacagggcgaggatctcgccgataacgacggagatgaggatgaggatatccgggactccggggctaaacctgtgatggtgtatatacatgggggatcctacatggagggaaccggtaatatgatagatggctccatcttggctagctacggcaatgtaatagtgatcaccctgaattaccgggtaggggtgctcggattcctttctacaggagatcaggccgcaaagggtaactacggcctgctcgaccagattcaagctctgcgttgggtgagcgagaacattgctttctttggcggagatccacgaaggattacagtctttggctcaggaatcggcgcatcatgcgtgtcgctgctgacattgagccaccacagtgaagggctgtttcagcgggctatcatacagtccggcagcgccctatcttcgtgggcggtgaactatcagcctgttaagtatacaagtttgctggccgataaggtgggatgcaacgtattggatactgttgatatggtcgattgcctgaggcaaaagtctgcgaaagagctggtagaacaggacatccagcccgcaaggtaccatgtggccttcggtcctgtcatcgacggagatgtgattccggacgaccctgagatcctgatggaacagggtgagttccttaactacgacatcatgctgggagtgaaccaaggagagggtctcaaatttgtggagggtgtagtggatcctgaagacggagtgtccggcaccgacttcgactacagcgttagcatcctctggaccatctgtatggctattctgcgggtccggacaccatgcgagcgtcctagttcttcctgtatccagaccggtcagaccgtcaccacactgaggcccgctgtcaaacactggtggcattcatctctaactaccagcggttggtccccccagtggtag

SEQ ID NO: 232449 - DNA, 771 bp, Artificial Sequence
  Description of Artificial Sequence: Synthetic coding sequence
atgttacgaccccaggggcttctgtggctgcccctcctattcacatccgtttgtgtgatgctcaacagcaacgtcctgttatggataactgccctggcaattaagttcaccctaatcgactcccaggcacagtacccggtggtgaacacgaactacggaaagattcagggtcttagaacccccctaccatccgagattttaggtcccgtggaacagtatctgggggtcccatatgccagccccccaacaggagagcgccgtttccagcctccagaatccccgtcttcctggactgggattcgaaacgcaacccagttcagtgctgtgtgcccacagcacctggacgagagattcctgctgcacgacatgcttcctatctggttcacaacgtctctggacacactgatgacttacgtgcaggaccaaaacgaggactgcttgtacttaaatatctacgttccaatggaggacggcacgaacatcaagcgaaatgccgatgatataacaagtaatgatcacggggaagataaggatatccacgagcagaacagcaaaaagccagtcatggtgtacattcacggcggttcctatatggagggtactggcaatatgattgatggctctatcctggcatcctatgggaatgtcatcgttatcacaattaactaccgtctgggcatactcggcatgcaggaagccagactgtgcggatcgagcaaaatgtttaattattttaaatccccatttaccaacctgatcaattttttttag

SEQ ID NO: 232450 - DNA, 2451 bp, Artificial Sequence
  Description of Artificial Sequence: Synthetic coding sequence
atgctgagaccccagggtttgctttggctacctctcttgttcaccagtgtttgtgtgatgctgaacagcaacgtgttactctggatcacagctctggcaataaagttcactcttatcgacagccaggcacagtaccccgtggttaatactaattacggtaagattcagggattgagaacacctctgccctcagagattctggggcctgtggagcagtacctgggtgttccctatgcgtccccgccaacaggggaaaggagattccagccacctgagtcaccctcctcgtggacagggattcggaacgccacccaattctctgccgtgtgcccgcaacacctcgacgagagattcttgctccatgatatgctgcctatctggttcaccacctctctcgatacactaatgacgtatgtgcaagatcagaacgaagactgtctgtacctcaatatttacgtcccaatggaggatgatatccacgagcaaaacagcaaaaagccggtgatggtttacattcacggagggtcttacatggaaggcactggaaacatgatcgatggttcgatcctggcctcttatggcaacgtcatcgtcatcacaatcaattataggctgggaatcctaggatttctgtcaacaggcgatcaggccgcaaaggggaactatggactactggatcagattcaggcactgaggtggattgaggaaaacgtcggagcttttggaggcgatccaaaacgggtgacgattttcgggagtggggctggcgcaagctgtgtaagcctgttgacgctatctcattacagcgagggcctctttcagaaggcaattattcagtcaggcaccgctctaagtagttgggccgtcaactaccaacccgctaagtacaccaggattctcgcagataaagtgggatgtaatatgttggacaccaccgatatggttgaatgtctgaaaaataaaaattataaagagcttatccagcaaacaataacccccgcaacttaccacatcgcgtttggcccagtcatcgacggggacgtaataccagacgatcctcagatcctgatggaacaaggggaattcctgaattatgacattatgctcggtgtgaatcaaggagaaggtctgaaattcgtcgacggtatcgttgataatgaagatggcgttacacccaacgacttcgacttctctgtgtccaatttcgtcgataacttgtatggctatccagagggcaaggacacccttcgggagacgatcaaattcatgtatactgactgggcagacaaagagaaccctgagacgcgtcgcaagactctggtggccctgttcaccgatcaccagtgggttgccccagctgtggcaacagctgacttacacgcccagtatggctcccccacctatttttacgctttttatcaccactgtcagtccgagatgaaacctagctgggcagacagcgctcacggagacgaggtgccatatgtttttggcattcccatgatcggtccaaccgagttatttagctgcaatttctcaaagaatgatgttatgttgtcggcagtggtcatgacctattggacaaacttcgccaagacaggcgacccaaatcagcctgtgccacaagacaccaagttcatccacaccaagcctaataggttcgaagaagtcgcctggtctaaatacaatccaaaggaccagctgtacctgcatattgggctcaagcccagagtccgtgatcattatagggcaaccaaggtggctttttggttagaactcgtccctcacctccacaatctcaacgagattttccagtatgtgtccacaaccactaaagtgcctccgccagacatgaccagtttcccctacgggacccgacgaagccctgccaagatttggcctacaacgaagagacccgctatcacaccagcaaacaaccccaaacattcaaaagacccacacaagaccgggccagaggatactacagtgctcatagaaacaaagcgagactatagcaccgaactctccgttaccatagccgtcggcgcaagtttactgtttctgaatatactggccttcgcagcactttattacaaaaaagataaaagaaggcatgagacccaccgacaccccagccctcagcgtaataccaccaatgacataacacatattcaaaatgaagagataatgagtctgcaaatgaagcagttggaacatgaccacgaatgcgaatccctgcaagctcacgatacactaagactgacctgccctcccgactacaccctaaccctcagacgcagccctgatgacatccccttcatgacaccaaacacaatcactatgatccctaataccttgatggggatgcagccactgcatactttcaaaacattctccggcggacaaaactctacaaaccttccacacgggcactccaccacccgtgtgtag

SEQ ID NO: 232451 - DNA, 2451 bp, Artificial Sequence
  Description of Artificial Sequence: Synthetic coding sequence
atgctgaggccacaggggctgctctggctccctctcctctttacaagcgtctgtgtgatgttaaattccaatgtgttgttatggatcaccgccctggcaatcaagttcactctcatcgacagccaggcgcagtatcctgtggtgaacacaaattacggaaaaatccagggtttgagaaccccgctccccagtgaaattttgggcccagtggagcagtatcttggggttccctacgctagcccccctactggggagcgcagattccagcctccagaatcgccctcctcctggacagggattcgaaacgccacgcagttttccgcagtgtgcccacagcacttggatgaaaggtttttgctccacgacatgttgcctatctggttcaccacctcgttagataccttgatgacctatgtgcaggatcagaatgaggattgcctttatctgaacatctacgtgccaatggaggatgatatccacgaacagaattctaagaaacctgttatggtgtatatccatggaggatcctacatggagggaaccggcaacatgattgatgggtctatcctggcgtcttatggaaacgtaatcgtcattactattaattaccgcctaggcattctaggcttcctttctactggtgaccaggctgcgaagggtaactatggccttttggatcagatccaggcgctgcgctggatcgaagagaacgtcggagcattcggcggtgatccgaagagggtaaccatcttcggctccggggctggggcatcctgcgtgagcctgctgacgctgtcccattattctgaggggctgtttcagaaggccattatccaaagcgggacggccctctctagctgggctgtcaattaccagccagctaagtatactagaatcctggccgataaagtcggctgcaatatgttggatacaaccgacatggtggagtgcctgaaaaataaaaactacaaagagctgattcaacagaccattacacccgcaacttatcatatcgccttcggacccgtgatagacggagatgttatcccagacgacccgcagatattaatggagcagggagaatttctcaattacgacattatgctcggggttaaccagggtgaagggctgaaattcgtggacgggatcgtcgataacgaagatggagtcacaccaaatgacttcgacttctcagtgtccaattttgtcgataatctgtatggatacccagagggcaaggatacccttcgagaaacaattaagttcatgtacacagactgggcggacaaggaaaaccccgagactaggcgtaaaacactcgtcgctctgtttacagatcaccagtgggtcgcccctgccgtagccaccgcagatctccacgcccagtatgggagccccacatacttctatgcattctaccaccattgccaatccgagatgaagccctcttgggcggattccgctcacggcgacgaggtaccctatgtttttggcattcccatgattggcccaacagaattattcagctgtaatttcagtaagaacgatgttatgctgagcgccgtcgtaatgacatattggaccaactttgccaaaacaggcgacccaaatcagcctgttccacaggacaccaaattcattcacaccaagccaaaccgcttcgaggaagtggcctggagcaaatacaaccccaaagatcagctgtacctgcacatcggcctcaaacctagagtgcgcgaccattacagagccactaaagtagccttctggctcgagcttgttccacacctgcacaacctgaacgagatctttcagtatgtcagtactacaaccaaagtacctccgccagatatgacctcattcccgtacgggacacgacgatcacccgctaaaatctggcctacaacaaagcggcctgccattactcccgcaaacaaccccaaacactcaaaagatccacataaaacaggccctgaggacactacagtcttgatcgaaaccaaacgcgactattcaacggaactctcagtcaccatagccgtcggagcctctttgctgtttttgaatatcctggctttcgcggctctgtactacaagaaggataagaggcggcatgaaacccaccgccatcccagccctcagaggaataccacaaatgacatcacccacattcagaatgaggagatcatgtcacttcagatgaagcaactcgaacacgatcatgagtgtgagtctcttcaggcccacgacacactgagattgacgtgtccgccagattatacgctgacattaagaagaagccctgatgacattccattcatgacccccaacactattactatgattcccaatacgctcatgggaatgcagcccctccatactttcaagactttcagcggaggccaaaatagcacgaatttgccccacggtcactcgacaactcgcgtgtag

SEQ ID NO: 232452 - DNA, 2622 bp, Artificial Sequence
  Description of Artificial Sequence: Synthetic coding sequence
atgttacggccacaagggctgctatggctgcctctgctctttaccagtgtgtgcgtgatgctcaacagcaacgttttgctgtggatcactgcgctggccataaaattcacactcatagacagccaagctcagtaccctgttgtcaataccaactatgggaagatccagggtctgaggaccccccttcctagcgagattctggggccagtagagcagtaccttggggtgccctacgcaagtccacctacaggcgaaagacggttccagccacctgaatcgccatcctcctggacaggcatacgcaacgctacccagtttagtgccgtgtgcccccagcatctggacgaacgcttcctactccacgatatgttgcctatctggttcaccacgagcttggatacactcatgacctatgtgcaggatcagaacgaagactgcctatatttgaatatctatgtcccaatggaggatggaaccaatattaaacgaaatgcggatgatattacatcaaatgatcacggcgaggataaagacattcacgagcagaacagcaagaaaccagttatggtgtacatccacggcggtagctacatggaaggcactggcaatatgatagatgggtccatcttggcaagttacggtaatgtcatagttattaccatcaactatcgactgggaattctggcccaaaacaccttggctcacggtaattgcaagcataggtgtcaactgcatctgcaggcacctcgcgactgtaagtctgcatatccttttcggaatgaggacgaaattaggggcttcctgagcacaggtgatcaagccgcaaagggcaattatggccttttagaccagatccaggctctccggtggattgaggagaatgtgggcgcttttggcggtgatcccaaaagagttaccatcttcggaagtggcgcaggcgcaagctgtgtgtctctgcttactctgagccattactctgagggcctttttcagaaagccatcattcagtccggcacagcactctcttcttgggctgtgaattatcaacctgccaagtacaccagaatccttgccgacaaggtggggtgcaatatgctcgacacgaccgatatggtggaatgtctgaaaaacaagaattacaaggaacttattcaacagactattacaccagccacttaccacatcgcattcggccctgtgatcgatggagatgtgatacctgatgacccacagattttaatggagcagggagagttcctgaactacgacatcatgctgggcgtgaatcagggcgaggggctgaagttcgtcgacggaatcgtggacaacgaggacggtgtgacccccaatgatttcgacttttcagtgtccaattttgtggacaacttatacgggtaccctgaaggaaaagatactctgagagagacgatcaagttcatgtacacagattgggcagacaaagagaaccctgaaaccagacgaaaaaccttagtggcactatttacagatcatcaatgggttgcccctgctgtagccacggctgacctccacgcccagtacgggagtcctacctacttctatgcgttctaccatcactgccagagcgaaatgaagcctagctgggccgactctgcacacggggacgaggtgccatacgtattcggaatccctatgattggccctacagagctgttctcctgtaacttcagcaagaatgacgttatgctgagcgcagtggtcatgacatattggaccaacttcgccaagaccggagatcccaaccaacccgtacctcaggatacgaaatttattcatacaaaaccaaaccgcttcgaagaggtggcctggtccaagtataatcccaaagatcagctctatctgcatattgggctgaaacctcgagtacgtgaccattaccgggctacaaaggtggctttttggctcgaattagtgcctcatttacataacttaaatgaaattttccagtatgtttctacgaccacgaaagtgcctcctccagacatgacatcgtttccatatggaacacgcagatcaccagccaagatttggcccacgaccaagagacctgccattacaccagctaataatcctaaacattccaaagacccacataaaaccggccctgaggacacgacagtcctcattgagactaaacgcgactactccaccgagctcagtgtgaccatcgctgttggagcctctttgctgtttttaaacatcctcgcttttgccgctctttactataagaaggacaaacggagacatgagacccacaggcaccccagtccacaaaggaataccactaacgatattacacacatccagaatgaagagatcatgagccttcagatgaagcagctggagcacgatcacgaatgtgagtctctccaggcgcacgatacattgcgtctgacatgtcctcctgactacacccttaccctcagaagatctcctgacgacattccatttatgactccgaataccatcacaatgatcccgaacacgctgatgggcatgcagccccttcatacctttaaaactttcagcggagggcagaacagtacaaatctcccacacggccactcgactacacgggtgtag

SEQ ID NO: 232453 - DNA, 1947 bp, Artificial Sequence
  Description of Artificial Sequence: Synthetic coding sequence
atggtttatatccacggaggctcttacatggagggcacgggcaatatgatcgacgggagtattcttgcatcatacggaaacgttattgttattaccatcaattaccgattaggcattttaggattcctttctaccggcgatcaagcagccaagggcaactacggccttttggaccagatacaggcccttaggtggatcgaagagaatgtcggggcatttggaggggaccccaagagggtaactatctttggatctggtgccggtgcctcgtgcgtgagcctcctgacattgtctcattactcagagggtctgtttcagaaagcgattatacagagtggcacggccctgtcttcctgggcagtaaattaccagcctgccaaatatactaggatcttagcggacaaagtcggatgcaatatgctcgacacaactgacatggtggaatgtctgaagaacaagaactacaaggagctgattcaacaaaccatcacccccgctacgtatcacattgcctttggacctgtgatcgacggggacgtaatccccgacgatccccaaattctcatggagcaaggtgagttcctcaattatgatatcatgctgggggtgaatcagggagagggtctgaagttcgtggacggtatagtggataacgaggacggggttactcccaacgattttgacttctctgtgtctaattttgtggataacctctacgggtaccctgagggtaaagacacacttcgggagaccataaagttcatgtatactgattgggccgacaaagagaaccctgagacccgcagaaagactctcgtggcactttttactgatcaccaatgggtcgctccggctgtcgccacggctgatctgcacgcccagtacgggtcccccacatatttctacgcattttaccaccactgtcagtctgagatgaagccttcctgggctgactcagcccatggcgacgaggtgccatatgttttcggaattcctatgatcggtccaaccgagctgtttagttgcaatttcagtaaaaacgacgtgatgctgtcagctgtggtgatgacttactggactaacttcgcgaagacaggcgacccaaaccagcctgtacctcaagataccaagttcattcataccaaacccaacagattcgaagaggttgcctggagtaagtataaccccaaggatcagctgtacttacacattggcttaaagccgagggtaagagaccattatcgagccacgaaagtcgccttctggctagaacttgtgcctcatcttcacaatctgaacgaaatcttccagtatgtcagcacaacaactaaggtgccacccccagacatgaccagcttcccctacggcacacgtcgctcgccagctaagatctggccaacaactaaacgtcctgcgattaccccagccaacaaccccaagcattctaaagatccccataagacgggacccgaggacacaacagtgttgatcgaaacaaagcgggactattctacagaattatctgtaacaatagccgtcggggctagcctgttgtttcttaatattttggctttcgcagccctatattataagaaggataaacggcgtcacgagacccacagacacccaagcccccagcgaaatacaacgaacgacatcacacatatacagaatgaggagattatgtccctgcagatgaaacagcttgagcatgatcacgagtgcgagagtttgcaggcacacgatacactgagattgacctgtccgcctgactacactctgacgctgcggcgaagcccagatgatattccgtttatgacccctaatacaattactatgatccccaacacattaatgggaatgcagcccctgcacacattcaagactttcagcggcggacagaactctactaacctgccacatggccattctaccacgagagtgtag

SEQ ID NO: 232454 - DNA, 711 bp, Artificial Sequence
  Description of Artificial Sequence: Synthetic coding sequence
tgaaactccaacgtgttgctgtggattaccgccctggctatcaagtttacactgattgactcccaggctcagtatcctgtggtcaatactaattatggaaagatacaaggactcagaactcccctcccctcagagatcttgggaccagtggagcaatatctcggagtgccgtatgcgagccctcctacaggcgaacggcgattccagccaccggaaagtccaagcagctggactgggatcagaaatgcgacccagttttcggctgtatgtcctcaacacttggatgaaaggttcctactgcatgacatgctgccgatatggttcacgacatctttggataccctaatgacttacgtgcaggatcagaacgaagactgtctttacctcaatatttatgtcccaatggaggacggaacaaacatcaagaggaacgcagacgatattacttcaaatgatcatggggaagataaggatattcatgaacagaactcaaaaaagcccgttatggtgtacattcacgggggatcctacatggaaggaaccggtaatatgatcgacgggagtatcttggccagctacgggaacgttatagtgattaccatcaattacagactcggcatcctcgggatgcaggaggctaggctgtgtggcagctccaagatgttcaattatttcaagagtccattcaccaatttgattaacttcttctag

SEQ ID NO: 232455 - DNA, 2511 bp, Artificial Sequence
  Description of Artificial Sequence: Synthetic coding sequence
atgctccggcctcagggcttactctggctgcccctgttatttacctctgtctgcgtcatgctaaacagcaacgtcctgctgtggattactgcccttgcaattaagttcacactgatcgactcccaagcccagtatcctgtggtgaacaccaactacggcaagattcaggggttgcgcacacctctcccaagtgagattttgggtccagtggagcagtacctgggcgttccctatgcaagcccccctacaggagagcgccgttttcagccacccgagtctcctagctcttggacaggaatccgtaacgccacacaattcagtgccgtgtgcccacagcatctcgatgaacgattcctcctgcacgatatgctcccaatttggttcactacctcacttgacacgctcatgacctatgtccaggaccaaaacgaggattgtctctacctgaatatatacgtgcccatggaggacgggacaaacatcaaaagaaacgccgatgacataacctccaatgaccacggtgaggataaggatatacacgaacagaattccaagaaacctgtgatggtctacattcacggcggatcatatatggaggggacagggaacatgatcgacggcagcatcctggctagttacggcaacgtgattgtaatcacaatcaactaccggctgggaattctcggttttctgtccaccggagaccaagctgccaaaggcaactacgggctgcttgatcagattcaagcactgaggtggattgaggagaacgtgggggcatttggaggcgatcctaagcgggtgaccatctttggatcaggagctggtgcatcctgcgtgtcccttctgactctgagtcactacagcgagggactcttccagaaggccatcatccaatccggtaccgctctgtcatcatgggcggttaattatcaaccagcaaaatacacccggattttagctgataaagtgggatgtaatatgctggacactactgacatggtggagtgtttgaaaaacaagaattacaaggaactgattcagcaaacaatcacacctgcgacctatcacatagctttcggtcccgtcatcgatggtgacgtaatccccgacgatccccaaattttaatggaacagggtgagttcctgaattatgacataatgctcggtgtgaatcagggagagggcctgaagtttgtggatgggatcgtagataacgaggacggggttacccctaatgactttgactttagtgtgagtaactttgtagacaacctgtatggttaccctgaaggcaaagataccctacgggagacaataaaattcatgtatacagactgggccgacaaagagaatccagaaaccaggagaaaaacactcgtggctctgtttacagatcaccagtgggtcgccccagcagtggccacagcggacctgcatgcccagtatggctctccaacttacttctacgctttttatcaccactgtcagtctgaaatgaaaccaagctgggccgattcagctcacggagatgaggtgccttacgtatttggcatccccatgataggcccaacagagcttttctcctgcaatttttctaaaaacgacgtaatgttgagtgctgtggtaatgacctactggacaaatttcgcaaagactggcgaccctaatcagcctgtgccccaagataccaaattcatccacaccaagcctaacagatttgaagaagtagcctggagtaagtacaacccaaaggaccagctttatctgcacattggcttaaagccaagggtgagagaccactatcgtgccactaaggtggccttttggcttgagctggtgcctcacctccacaatttgaacgagatatttcaatatgtgagcaccaccaccaaggtcccccctcctgatatgacaagttttccatacggcacccgcagatcacctgccaagatctggcccactaccaaaaggcctgccattacaccagccaataatcctaagcacagtaaggacccacacaagaccgggccagaagataccacggtcctgatcgagaccaagagggactactccacagaattgtcagtcacaattgctgtaggagcttccctcctgttcctgaatattctggcattcgccgctctgtattacaagaaggataaacggagacatgagactcatcgccacccaagtcctcagcgcaatacgactaacgacattacgcacatacagaacgaggaaattatgtctctgcaaatgaaacagctggagcatgatcacgagtgtgagagcctccaggctcacgacacacttagactgacctgtccccctgattatacacttaccctgagacgtagccctgatgatatccctttcatgactccgaacacaattacaatgattcccaacacgctcatgggcatgcagcctctgcacacctttaagaccttttccggaggtcaaaacagcaccaatctgcctcatggacactccactacacgcgtgtag

SEQ ID NO: 232456 - DNA, 1824 bp, Artificial Sequence
  Description of Artificial Sequence: Synthetic coding sequence
atgatcgcaaggtgcttgttggcggttaggtctctgaggagggtcggcggtagcagaatattgcttagaatgacccttggacgggaggtgatgagcccactgcaggccatgtcaagctatacagttgccggacgaaatgtcctcagatgggacttgtctccagaacagatcaagacccgcacagaagaacttatcgtgcagacaaaacaagtgtatgacgccgtcggtatgctggggatcgaagaagtgacatatgagaactgtctgcaggcactggctgatgtggaagtcaagtatattgtcgagagaactatgttggattttccccaacacgtttctagtgacaaggaagtcagggctgcctctactgaggctgacaaaaggctgtctcggtttgacatcgagatgtctatgcgcggagacatcttcgagagaatcgttcatctacaggaaacatgtgatttgggcaagataaaaccagaagccaggcgatatctagagaagagtatcaaaatgggaaaacgaaatggacttcatctcccggagcaagtacagaacgaaatcaaatcaatgaagaagcgaatgtcggaactgtgcattgactttaacaaaaatctgaacgaggatgacaccttcttggtgttttctaaagccgagctaggggcactgccggacgacttcatcgacagcctggaaaagacggacgacgacaagtacaagataaccctcaaatatccccactacttccctgtgatgaagaagtgttgcattccggaaacaaggaggcggatggagatggccttcaacacaaggtgtaaggaggaaaacacgatcattcttcaacagctcttaccgctgcggacgaaggtcgccaaacttcttggatacagtacccatgcggactttgtcctggagatgaatactgccaagagcacgagcagagttaccgcgtttctcgatgacttaagtcagaagctcaagcccctcggggaagccgagcgggaattcattctgaacctgaagaagaaagagtgtaaggatcgcggattcgaatacgatggaaagattaacgcatgggatctgtactattacatgacccagactgaggagctcaagtacagtatagaccaagagttccttaaagaatacttccctatcgaggtcgtgacagagggtctgctgaatacctatcaggagctgctcggcctttccttcgagcaaatgactgatgcacatgtgtggaacaagtctgtcaccctgtataccgttaaggacaaggccactggggaggtgctggggcagttttacctcgacttatacccgcgagaagggaaatacaaccacgccgcttgctttggactgcaaccagggtgccttttgcccgacggttccagaatgatggccgtggctgccttggtggtaaactttagccaaccagttgctggaagaccttcactcctcaggcatgacgaagtcagaacctatttccatgagttcggccatgtcatgcatcagatttgtgcacaaaccgacttcgccaggttctctgggacaaacgtcgagacagatttcgttgaagtcccctctcagatgttggagaactgggtgtgggatgtggattctctgcgacggctgagtaaacactacaaggatggctcgcccattgcagatgatctgcttgaaaagctggtggcctccagactggttaataccgggctattgacgctgaggcaaatagtcctgagtaaggttgatcagtcactgcacacaaacacatctctggacgccgcaagcaatatgcccaacacagctcagaaatactag

SEQ ID NO: 232457 - DNA, 2115 bp, Artificial Sequence
  Description of Artificial Sequence: Synthetic coding sequence
atgatcgcacgctgcctgttagccgtgcgtagtttaaggcgggtgggtggatcacggatccttctcaggatgacacttggaagggaagttatgtcgccgctccaggctatgtcctcatatacagtcgccggaaggaacgtgctgagatgggatctaagcccagaacagatcaagacgcgcaccgaggaactcatcgttcagactaagcaggtatatgacgcagtgggtatgttgggaatcgaggaggttacatacgagaactgcttacaggccctggctgacgtcgaggtcaagtacattgtggaaaggaccatgctcgatttcccccagcatgtatcttcagacaaagaagtaagggccgcttcaactgaggcagataaacgactctctagatttgacattgaaatgtccatgagaggcgacatttttgagcgcatagttcatctgcaggagacttgcgatttgggcaaaattaaaccagaagctaggagatatttagaaaaaagcatcaaaatgggcaagagaaatggactccacctgccagagcaagttcaaaacgagatcaagtctatgaagaaaagaatgtcagaactctgcattgacttcaacaaaaatttaaatgaagacgataccttcctcgtcttctctaaggccgagcttggagccctgcctgacgatttcatcgatagtcttgagaagaccgatgacgataagtacaagataacactaaagtacccacactacttccccgtcatgaagaaatgctgcatccctgagactcggagaaggatggaaatggcatttaacacgaggtgcaaagaggaaaataccataattttacagcaacttcttccgctgaggacgaaggtggctaagttgctgggctattccacgcacgccgattttgtgctcgagatgaataccgccaaaagcacttctagagtgacagctttccttgatgacctctctcaaaagctcaaaccacttggcgaggctgaaagagaattcattctcaatttaaaaaagaaagagtgtaaagacaggggcttcgagtacgacgggaagatcaatgcttgggatctgtactactatatgacacagaccgaagaactcaagtactctatcgatcaagagtttctgaaggagtactttcccattgaagtagtaactgagggtctgctgaacacttaccaggagctcctgggcctgagttttgaacagatgactgatgcacacgtctggaataaatccgtgacactctacactgtcaaggataaagccaccggggaggtcttaggccaattttacctagacctgtaccctcgggagggcaagtacaaccatgctgcttgttttggactgcagccagggtgtctattgcctgacgggtcccgcatgatggccgtagctgccctcgtggtcaatttcagtcagccagtcgctgggagaccctccctccttcgtcatgacgaggttagaacatactttcacgaattcggccacgtaatgcatcaaatctgtgcccaaaccgactttgcgagatttagcggaaccaacgttgagacagacttcgtggaggtcccgagtcagatgctggagaattgggtgtgggacgtagatagtctccgacggctgagtaagcattacaaggatgggtcccctatcgctgatgacctgctggagaaacttgttgcgagcaggcttgtgaatactggcctgctgaccttgaggcaaatcgtgttgtccaaggtggaccaaagcctccacacaaatacttccctcgacgcggcttctgaatacgcaaaatactgtagtgagattctcggtgtagcagcaactcctggaactaacatgcctgctaccttcggacatctggcaggtggttatgatggccaatattacggatatttatggagcgaggtttttagcatggatatgttttatagctgttttaagaaagagggcatcatgaatcctgaggttggaatgaaatatcgcaacttgatacttaagccgggtggctctcttgatgggatggacatgctgcataacttcctgaaacgagaaccaaaccagaaggcattcctgatgtcccggggactccacgcaccctag

SEQ ID NO: 232458 - DNA, 1803 bp, Artificial Sequence
  Description of Artificial Sequence: Synthetic coding sequence
atgttggatttcccacaacatgtgagctccgacaaggaggtgcgagccgcatccacggaagcagataagcgcctctctaggtttgatattgagatgagcatgagaggagatatatttgagcgcatcgttcacctgcaggaaacctgcgacttaggcaagataaagcctgaggcaaggcgatacctcgaaaaaagcatcaaaatgggtaaaaggaatgggctgcacctgcccgaacaggtccaaaacgagattaagagcatgaagaagagaatgtccgagctgtgtatcgattttaataagaatctaaatgaggatgatacctttcttgtattcagtaaagcagagctgggggctctcccggatgatttcatcgatagtctggaaaagaccgacgacgacaaatacaagatcacacttaaatatccccactacttcccagtgatgaagaagtgttgcatacccgaaactcgacgcaggatggagatggccttcaacacccggtgcaaggaagaaaacacaatcattcttcaacagctcctgccgctaaggaccaaagtagctaagctgctcggatatagtacgcatgccgattttgtgctagaaatgaatacggcaaagtcaacaagccgggtgactgccttcctagacgacctcagtcagaaactcaagccactgggagaggccgagagagagtttattttgaatctgaaaaagaaggagtgcaaggatagaggttttgagtatgacggtaagatcaacgcttgggatctgtactattacatgacccagaccgaagagttgaagtacagtatcgaccaggagttcctaaaagagtattttccaattgaggtggtgacagaagggctcttaaatacttatcaagagcttttaggtctgagctttgaacaaatgaccgacgcccatgtgtggaataaatcggtaacactgtacacagtgaaagacaaggcaacaggggaggtgctgggacaattttatcttgacctttaccccagagaaggcaagtacaaccatgctgcctgcttcggcctgcagccagggtgtctgctgccggatggcagccggatgatggccgttgccgctctcgtggtgaacttctcccagcccgtagctggacgcccaagtctgctgcggcacgacgaggttcggacttactttcatgaatttggacacgtgatgcaccagatctgtgcccagaccgactttgctaggttctccggaaccaacgtggaaaccgactttgtagaagtgccaagtcaaatgctggagaattgggtgtgggacgtggactccctgagacggctgtctaagcactataaggacgggtcacctattgctgatgatttgttagaaaaattagtggctagcagactggtgaacactggccttctgacccttcgacagatcgtgctgagcaaggtggaccagagcctccatacgaataccagtctcgatgctgcaagtgaatatgctaagtattgctccgagatcctgggggtagccgcaacccctggcaccaacatgccggctacctttggacaccttgccggtgggtacgatggacagtactatggatatctgtggtcggaggtgttttcaatggatatgttttactcctgtttcaaaaaagagggaatcatgaatccagaagtggggatgaagtatcggaacttaatcctgaagcccggaggatcacttgatggtatggatatgcttcacaattttttgaagagagaaccaaatcaaaaggcatttctaatgtccaggggactgcatgctccttag

SEQ ID NO: 232459 - DNA, 366 bp, Artificial Sequence
  Description of Artificial Sequence: Synthetic coding sequence
atggccagaagggcgggaggcgctcggatgttcggctctttgttgttattcgctctcttggccgctggggtcgctcccctgagctgggatctgccagagccccgtagccgcgcatcgaaaatcagggtccactctcgagggaacctttgggcaaccggccactttatgggaaagaagagcctggaaccaagctccccgagccccctagggaccgcccctcacacttctcttagggatcagcgccttcagctgtcacacgatctgcttgggatacttctcctgaagaaagctctgggagtatccctgagtcgacctgctcctcagatccagtaccggaggctgttggtgcagatactgcaaaaatag

SEQ ID NO: 232460 - DNA, 465 bp, Artificial Sequence
  Description of Artificial Sequence: Synthetic coding sequence
atggctagaagagctggcggagctaggatgtttggcagtctattactgttcgctctcctagctgctggcgtagcccctctgagttgggatctgccggagccccgtagtcgggcatccaagatccgggtgcacagccgcggaaacctctgggcaaccggtcattttatgggcaaaaaatctctcgagcccagtagccccagtccacttgggaccgcaccccacacctctttgcgggaccagcgccttcagctatctcatgatctcctgggaatacttctactcaagaaggctttgggcgtgtctctgtctcgtcccgctccacagatccaggaggcggctgggaccaacaccgccgaaatgacaccgattatggggcaaacacagcagagaggactggactgtgcacaccccggtaaggtgctgaacggaacccttctcatggccccttccggatgtaagagctag

SEQ ID NO: 232461 - DNA, 1173 bp, Artificial Sequence
  Description of Artificial Sequence: Synthetic coding sequence
atgccttctaagtcactgagtaatctgtcagttactacaggggcaaacgaatcaggttcagtgcccgaaggatgggagagagacttcttgccggcatcagatggcactaccaccgagttagttatcaggtgcgtcatcccctccctctatcttcttataattactgtaggcttgctgggcaacattatgttggtgaaaatctttattaccaattccgctatgagaagtgtgccgaatattttcatcagcaacctggctgctggcgatcttttgcttctgctgacatgtgttcccgtggacgcctcgcggtatttcttcgacgaatggatgttcggcaaagtcgggtgcaagctgattccagtaattcagctgactagtgttggggtgtcggtgtttacactgaccgcgctgagcgccgaccggtatcgcgctatagtaaaccccatggacatgcaaacttctggggctctgttgcggacttgtgttaaagctatgggaatttgggtggttagtgtattgctggccgtcccagaggcagtgttttcagaggtggcacggataagcagcttggacaactcctcatttacagcctgtatcccatatccccagacagacgaactgcatccaaaaatacacagcgtgttaattttcttagtttacttcttgatcccactcgccatcatctccatttactactaccacatagccaaaacactcattaagtccgcccataatctcccaggagaatacaacgagcatacaaagaagcagatggagaccagaaaacgtctggcaaaaatcgtgcttgtgtttgttggatgcttcatcttctgttggttccccaatcacattctgtatatgtaccgctcattcaattacaacgaaattgacccctcgctgggccacatgattgtgaccttagtcgccagggtgctgtcgttcggtaattcctgtgtcaacccttttgccctctacctgctgtcagaatcttttagaaggcacttcaactcccagctttgttgcgggcgtaagtcctatcaagaacgaggcaccagctatctgttgtcctcatcggcagtgagaatgaccagcctgaaaagcaatgcaaaaaacatggtcaccaactcagtgctcctcaatggacacagcatgaaacaagagatggccctgtag

SEQ ID NO: 232462 - DNA, 1281 bp, Artificial Sequence
  Description of Artificial Sequence: Synthetic coding sequence
atgactcctctgtgccttaattgctccgttcttccaggcgatttatatcccggaggcgctcggaatcctatggcgtgcaatggcagtgctgcccgaggtcactttgacccagaggacttgaatcttactgatgaagccttgcgacttaagtacctgggccctcaacaaaccgaattgtttatgccgatatgcgcaacatatctcttgattttcgtcgtcggagccgtaggaaatggcttgacatgtctcgtgattctccggcataaggctatgcgaacacctactaactactacttatttagtctggctgtgagcgacctgctcgtgctgcttgtaggactcccccttgaactttacgaaatgtggcataattacccctttctcctgggggttggcggatgctactttcgaacattgctcttcgaaatggtgtgtttggcctctgtgttaaatgtaaccgccctgtcagttgagagatacgtcgccgtggtacacccattacaggcccgatcgatggtgacccgggcacacgttcgacgagtacttggggctgtctggggactggctatgctctgctccctccccaacacctctttacacggtataagacagctgcacgtgccatgtcgtggccctgtgccggactccgcagtctgcatgttggtgcggcctagggcgctgtacaacatggtagttcagaccaccgctttacttttcttctgcctgcccatggcgattatgtctgtgctctaccttctgattgggctgcgccttagacgggagagattgcttctgatgcaggaggccaaagggcgagggtccgctgccgctcggtcacgatatacctgccgtctccagcagcacgaccggggtagacgacaggtcactaagatgctgtttgtgctggttgtggttttcgggatctgctgggctcctttccatgccgatcgcgtgatgtggtccgtcgtttcccaatggacagatgggcttcacctggcttttcagcacgtccatgttatttcagggatctttttttatcttggatcagctgctaacccagtgctgtactccctcatgtccagccgatttcgcgaaacatttcaggaggcattgtgcctgggagcctgctgtcacaggctgagacccagacactcatctcactctttatccagaatgactacaggctctacactctgcgacgttggtagcctcggttcctgggttcacccgctggctggaaacgacgggccagaagcacagcaagagacagacccttcctag

SEQ ID NO: 232463 - DNA, 1248 bp, Artificial Sequence
  Description of Artificial Sequence: Synthetic coding sequence
atgtccggcatggaaaaactccagaatgcgtcttggatctatcagcagaaacttgaggatcctttccagaagcacctgaattccaccgaagaatacctggctttcctgtgcggaccaaggagatctcatttctttctgcccgtatccgtcgtgtatgtccccattttcgtagtcggggtgatcggaaatgtgctcgtgtgcctcgttattctgcagcatcaagcgatgaaaactcctaccaactattacctgttctctctggctgtgtccgaccttttagtgctgctcctgggtatgcccctggaagtgtacgagatgtggaggaattatcccttcttatttgggccagtgggatgctattttaaaaccgccctgttcgagacagtctgcttcgcctccattctgtccatcactacagtctctgtcgagcgatatgtcgccatactgcatccttttagagccaagctacagagcacgagacgcagggccctccggatccttggtattgtgtgggggttttccgttctgtttagcctgccaaacacatccattcacgggatcaaatttcattacttcccaaacggcagcctggtgccaggaagtgcaacctgtaccgtgattaaaccgatgtggatctacaactttatcatccaagtcacctcattcctgttctacttgctgcccatgactgtgataagcgtgttgtactatcttatggccctgcgacttaaaaaagacaagtctctcgaggcagatgagggaaacgccaatattcagaggccttgccgcaagtcagtcaacaaaatgctattcgtgcttgtgctcgtgttcgccatctgctgggccccatttcacatagatagactcttcttttcctttgtagaggagtggagcgagtccctggccgcagtgttcaatctggtgcatgtggtcagcggagtttttttttacttaagcagtgcagttaacccaataatttacaatctgctctcccgaaggttccaggccgcttttcagaacgtgatttcatcattccataagcagtggcactctcaacacgacccccagttgccccctgctcaaagaaacatcttcctgacagagtgtcattttgtggaactcaccgaagacattggaccccagttcccctgccaaagctccatgcataactcacatttacctgcggcactgtcctccgaacagatgtccaggactaactaccagtcattccatttcaataaaacatag

SEQ ID NO: 232464 - DNA, 5625 bp, Artificial Sequence
  Description of Artificial Sequence: Synthetic coding sequence
atgctcggcagtagcgtgaagagtgtgcaacctgaggtcgaactgagttccgggggtggcgacgagggtgctgacgaaccgaggggcgctggacggaaggccgctgctgcggatgggaggggcatgttgcccaagagggccaaggcgccaggcggagggggaggcatggccaaagcaagtgctgcggaactgaaagtgttcaaatcaggctcagtggacagccgtgttcctgggggtcctccagcgagcaatttaaggaaacagaagagtctgaccaatttgtcatttctcaccgactctgagaagaaattgcagctgtacgagcctgaatggagtgatgatatggcaaaggccccaaaaggtctgggaaaggtgggaagtaaagggcgagaggcacccctcatgagcaagaccctgagtaaatccgagcacagcctatttcaggctaagggcagccccgcaggaggcgctaaaactccactggcaccactggcacccaaccttggaaagccttctcgaatcccacgtggcccatacgcagaggtgaaaccccttagtaaggcccctgaggcagccgtatccgaggatggtaaaagtgacgatgagctgttatcatctaaagccaaagcccagaagagttccggcccagtcccctcagccaagggtcaagaggagagggcatttctgaaggttgatcccgagctggtggtcaccgtcctaggcgatttggaacagctcctgttttcccagatgctggaccccgaatcccagaggaaacggacggtgcagaatgtccttgaccttcgccagaacttggaagaaacgatgtcttcactacgcggaagccaagtcacacacagctctctggagatgacgtgctatgactctgacgatgcaaaccctaggagcgtcagtagtcttagcaacaggtcgagtccgttgagctggcgttacggccagtcaagtcctcgccttcaggccggtgatgctccctctgttgggggatcatgcaggagcgaagggacgcccgcttggtatatgcatggcgagcgtgctcattactctcacaccatgcccatgagatccccaagcaagctctctcatatctcacgattggagctggtggagagcctcgactcggacgaagtggatctcaaatccggctacatgagtgacagcgatctgatgggtaagactatgacggaggatgacgacatcactaccggttgggacgaaagctcgagcatttcttcagggctctctgacgctagcgataatctgtctagcgaggagtttaacgcatcctcatccctcaattcattgccaagcacaccgaccgcctctaggcgtaactccactatcgtgctccgcactgacagtgaaaagcgctctctcgccgaaagtggcctgagctggttttcagaaagtgaggagaaggccccaaagaagctagaatatgactccggcagcctaaaaatggagccgggtaccagcaaatggaggcgcgagagaccagaatcatgtgacgacagcagtaaggggggtgagcttaagaagccaatctccctgggacacccaggctctctcaagaaaggaaagacaccccctgtcgccgtcacatccccaatcacacataccgcccagtcggctctcaaagttgctggcaaaccagaagggaaagcaaccgacaaaggcaagctggctgtgaaaaacacaggactccaacgcagcagttcagatgcagggagagataggctatccgatgcgaagaagcccccatccggcattgcgagacctagcactagcggaagttttggctacaagaagccaccccctgccactggtacggctacggttatgcagaccggcggaagcgccaccctgagtaaaattcagaagagtagcggcatccccgtaaaacccgtgaatgggcgaaagacctcactggatgtgtctaacagcgcagaacctggattcctggcaccgggtgcacgctctaatatccagtacaggagcctgccaaggccggcaaagtcaagttccatgtctgtaaccggaggccgagggggtccccgaccggtatcttcgtctattgacccctctctgttgagtacaaaacagggagggcttacaccgtcaagactgaaggagcccactaaggttgcgtctggaagaactacacctgccccagtcaaccagacagacagagagaaagagaaggcgaaggccaaagcggtagccttagattccgacaatatcagcctgaaatcaattggtagtcctgaaagcacacccaagaaccaggcttctcatccaacagcaactaaactggccgagctgcctcctacaccactaagggcaactgctaagtctttcgtgaaacctccaagtttagccaatcttgataaggtcaattctaactccctggatcttccaagttcctcggatacaacgcatgcctcaaaggtgccagatctgcatgctacatcatccgctagcggcggtccgttgcctagttgctttactccttctcctgcgcctatattgaatattaacagcgctagtttttcccaaggcctggaattaatgtcagggttcagcgtgccgaaggagacccgtatgtacccgaagctcagcggactgcatcgctccatggaaagtctgcagatgcctatgtcactcccctccgcctttcctagcagcaccccagtaccgacccctcccgcaccgcctgctgctcctacagaggaggaaaccgaggaactcacatggtccggcagcccccgtgccggacagttggactcaaatcagcgggatagaaataccctgcctaagaaaggcctgcggtaccagctgcagtcacaagaggagactaaggagaggcggcacagtcatactattgggggactgcctgagagtgacgaccagtctgaattgccttcaccacccgcacttcctatgagcctgtcagcaaaaggacagttaacgaacatcgtgtctccaaccgccgctaccactccgcgaattactagaagcaatagtattcccacacatgaggccgcttttgagttgtatagcgggtcacagatgggcagcaccttgtctttggcagagcgcccaaaaggaatgatccggtcaggttcattcagagacccgaccgacgacgtgcatggttctgtactgtctttggcctcttccgcttcttccacatactcatcagcagaagagcggatgcagtccgagcagatcaggaagctccgtcgcgagttggagagctcccaagaaaaagtagcaaccctcacctcccagctgtccgctaatgctaatctagtggcagcttttgaacaatcactggtaaatatgacttctagactccggcaccttgctgagactgcggaggagaaggatactgagcttctggatctcagagagacaattgactttcttaaaaagaagaacagtgaagcccaggccgtgattcagggagctctgaatgcttccgaaaccacacctaaggagttgagaattaagagacagaactcaagcgattctatatcctctctcaattccatcacctctcacagttcgatcggctccagcaaggatgcagacgcgaagaagaagaagaaaaaatcatggcttaggagtagctttaacaaggcatttagcatcaagaagggcccaaaaagtgcatcttcctatagcgacatcgaagaaatcgccacccctgattcctcagctccaagctcacccaaacttcaacacggctcaacagagactgcctctcccagcattaagtcttctacctccagcagcgttggaacggacgtgactgagggccctgcacatcctgcacctcatacccgcctgttccatgccaacgaagaagaggagccggagaaaaaggaggttagcgagctgagatccgagctgtgggagaaggagatgaagctgactgacatccggctagaggccttgaattccgcccaccagctggaccagttgagggagacgatgcataacatgcagcttgaagttgacctattgaaggcagaaaatgacaggttgaaggtggcgccaggaccttcttctggttcaacaccaggtcaggttccgggatcctcagctctgagtagccccaggcgttctttgggtctggcgttgactcactcctttgggccttctttagcggatacagatctatcacctatggacgggatttccacctgtggacccaaggaggaggtgacgctgagggtcgttgtccggatgcctccgcagcatatcattaagggtgacctgaagcagcaggaattctttctaggttgttctaaagtttctgggaaagtggactggaagatgctggacgaagccgtgttccaggttttcaaagactatattagtaagatggatcctgcatccacccttggcctttcaactgagtcaattcacgggtattctatttcccacgtgaaacgggtgttggacgcggaaccaccggagatgcctccgtgcagaagaggggtgaacaacattagcgtcagtctaaaaggtctcaaggaaaagtgcgtggattccctcgtttttgagactctgatcccaaaaccaatgatgcagcactatatcagtctgctgttaaagcaccggaggttagtgctcagtggaccttctgggaccggaaaaacatatctgaccaacaggctcgcagagtatctggtggaacgatctggcagggaggtgacagaggggattgtctctacgtttaatatgcatcagcaatcctgcaaggacctgcagttatacctctccaacctcgccaaccagatcgatagagagacgggaataggcgacgtgcccttggtgatcttactggacgacctcagcgaagcaggctcaatctctgaactggttaatggggcactcacatgcaaataccataagtgcccttacatcatcggtacaaccaatcagcctgtcaagatgacacctaaccatggactccacttatcgttcagaatgttgaccttctctaataacgtggagcccgctaatggttttctggtcagatacctccgaagaaaacttgtcgagtcagactccgatatcaacgctaacaaggaggagctcctcagggtgctggactgggtccccaaactctggtaccacctccatactttcttggagaagcacagcacttctgactttctgatcggaccgtgcttttttctaagctgtcctatcgggatcgaagatttcagaacttggtttattgatttatggaacaatagcataattccttatctgcaggagggagctaaagatggaatcaaagtgcacgggcagaaagccgcatgggaggacccggtcgagtgggtgagggacactctgccatggcctagcgcacagcaggaccagtcgaaactgtaccacctgcctccgcctacggttggcccacacagcatagccagccctccagaggaccgcaccgttaaggattcaactccctcctcgctggattccgaccctctcatggccatgctgctaaaactgcaggaagccgctaattacatcgagagcccagaccgggaaaccattttagaccctaaccttcaagccacgctttat

SEQ ID NO: 232465 - DNA, 5633 bp, Artificial Sequence
  Description of Artificial Sequence: Synthetic coding sequence
atgctgggttctagtgtgaaatccgtgcagcccgaggttgaattgagctcagggggaggtgatgagggtgcggacgagcccaggggggcaggacgaaaggctgctgcggcagatggtagggggatgctacctaagagggctaaggcacctgggggagggggaggcatggccaaggcttcggctgcagagctgaaggtgttcaaatcaggctctgtggacagtagggttcccggagggccacccgcttccaacctccgcaaacagaagagtttgacaaatttgagctttctgacagactccgagaagaagctgcagctgtacgagcccgagtggagcgacgacatggccaaggcacctaaagggcttggcaaggtgggctccaaagggagggaagccccactaatgagcaaaacattatctaagagcgagcactccttgttccaggctaagggatctccagctggcggagcaaagaccccccttgcccctctggcccctaatctagggaagcctagccgaattccgcgtggcccatatgccgaagtgaagcccttgtcaaaggcaccagaagctgctgtgagcgaagacggcaaatccgacgatgagctgctgtcctctaaagctaaagcccagaagagctcagggcctgtcccaagcgcaaaagggcaggaagaaagagcatttctcaaagttgaccctgaactcgtggtcaccgtactcggcgacctcgaacagcttctgttttcccaaatgctcgaccctgagagccaacggaaacggaccgtgcagaacgttctagacttgcgccagaacctggaggaaacgatgtccagcctgcgcggatcacaggtcacccactcatccttagaaatgacgtgctacgattcagacgacgctaaccccagatcagtttcgtccctgtccaaccgatcctctcctctctcctggcgctacgggcaaagttcacctagattacaagcaggcgatgcgccttcagtgggaggaagttgccggtccgaggggacccctgcatggtatatgcatggagaaagggcccactactctcacactatgcccatgcggagcccctccaagctttcacatatcagtagactcgagcttgtagagtctttagattcagatgaggtggatctaaaatctggctatatgagcgacagtgacttgatgggcaaaacaatgaccgaggatgacgatattactaccgggtgggacgagtccagctcaatttcctcaggactttcggacgcctctgataatctttcctctgaagagttcaatgctagttccagtctcaactccttgccgtctactccaactgcctcaaggcgaaacagcaccattgtgcttcggacagacagcgagaagaggtctctcgccgagagcggtctttcctggttcagcgagagcgaggagaaggcgccaaaaaaactggagtatgatagcggatcattgaaaatggagccgggaacctccaagtggaggcgcgagcggcctgagtcctgtgacgatagttccaaaggaggcgagctaaagaaaccaataagtctgggccatccagggtcactcaaaaagggtaaaacccctccggtggcagttacttctccaattacccacacagctcagagcgcccttaaagtggccggaaaacctgagggaaaagctactgacaaagggaagctggccgtcaagaacactggactacagaggtcatcgtcagatgcgggtagggacaggctttcagacgcgaaaaaaccaccatccggaatcgcgcgaccttcgaccagcggatcatttggctataaaaaaccaccccctgccactgggaccgccaccgtcatgcagactggtggaagcgccactctcagtaagatccagaaaagcagcggaataccagtgaagcctgtcaatggcaggaagacctcccttgatgtgtctaattctgccgagcccggtttccttgcaccaggggcacggtcgaacattcagtatcggtccttgccacggccagccaaaagctcgtccatgagtgtgacaggcggtagaggtggccctaggcctgtgagtagctcaatagatcccagcctgctctccaccaagcagggcggactgactcccagtcgcctcaaagaaccaaccaaggtggcgtcagggcgaaccacaccagcccctgtaaatcaaaccgacagagagaaagaaaaggcaaaagctaaggccgttgctctggactcagataacatcagcctgaaaagtatcggatcgcccgaatcgacacctaaaaaccaggctagccacccaaccgcgacgaagctggccgagctgcctcccactccactccgcgctaccgccaagagctttgttaagcccccatcactcgctaatctcgataaggtgaattctaactcattggacctcccatcatcctcggacaccacacacgcttcgaaagtccccgaccttcatgcaaccagcagtgcctctggtggtcctctcccatcgtgcttcaccccaagccccgctcctattcttaatataaattcggccagtttctctcaggggcttgagctgatgtcgggattcagtgtcccaaaggagaccagaatgtaccctaagctgagcggtctgcacagaagtatggaatcacttcagatgccgatgtccctgccaagcgcctttccctcatcaacaccagttcccacaccaccagctccgcctgccgctcctactgaggaggaaaccgaagaactgacctggagcgggtctccacgcgcaggtcagttagactccaatcagcgcgaccgtaacactctcccgaagaagggactgaggtaccagttgcagtctcaggaagaaaccaaagaaagacggcactcccatacgattggcggtttaccggagtctgatgaccagagcgagttgcctagccccccagccttaccaatgtctctgtcagctaagggtcagctgactaacatcgtatcccccacagccgctactacccctcgcatcacaaggtctaactccatcccaacccacgaggcagcatttgagttgtactccggatctcagatgggtagtactctgtcactggctgagcgcccaaagggtatgatcaggtctggctcgtttagggaccctacagacgatgttcatgggagcgtgctgagtctggcatctagcgcctcctccacatattcatccgcggaagaacgcatgcagtcagaacagattcgtaaacttcgccgagagctcgagagtagtcaggagaaagtcgcaacactcacttcacaactgtccgccaatgctaacctggtagctgcttttgagcagagccttgtgaacatgacttctcggcttcgccacttggccgaaactgccgaggaaaaagacactgaattgctggacctgcgggaaactatcgactttcttaaaaagaagaatagcgaagctcaggccgtgatccagggggcactaaatgccagtgagaccacacctaaggagttaagaattaaacgccagaactcaagcgactccattagctctcttaacagtatcacaagtcatagcagcattgggtcgtccaaagacgctgacgccaaaaaaaaaaaaaaaaagtcttgggtttacgagctgagaagcagctttaacaaagcattctccatcaagaaaggcccaaaatccgcgtcctcatactcggatatagaggagattgccactcccgattcttcggcacccagttcacccaaactgcagcacggctctaccgaaactgccagcccgtctatcaagtcctcaaccagctcttctgttgggacagacgtcaccgaaggccctgcccaccccgcaccccatacacggctatttcacgcgaacgaagaagaagagcctgaaaaaaaagaagttagcgagctgcggagtgagctgtgggagaaggaaatgaaattgacggatatcagattggaggcactgaatagtgcccatcaactggaccagcttcgggaaaccatgcacaatatgcagctagaggtggatctgctgaaggctgagaacgatcgtctgaaagttgcgccaggacctagtagtggctctacacccggtcaggtgcccggaagctctgcattgtcttcacccagaagatcactgggcttggcattaacccattcttttggaccttcactggctgacacagaccttagtccaatggatggaatctctacatgtgggccaaaagaggaagtcacgctgagggtggtcgtgcgaatgcctcctcagcacattatcaaaggcgacctgaagcagcaggaattctttctggggtgttctaaggtttctgggaaagtcgactggaaaatgcttgacgaagctgtgttccaggtcttcaaagactacatatctaaaatggacccagccagcacattgggtctgtccacggagagtattcatggatactctatctctcacgtcaagcgcgtccttgatgctgaaccgcctgaaatgcccccatgtaggaggggagtcaataacatctcagtgagccttaaggggttgaaggaaaagtgtgtggattccttggtgtttgagacattaattcctaaacctatgatgcagcactatatctcactgctccttaagcacaggaggctcgtgttgtcaggtccatctgggacaggaaagacatatcttactaaccggctagctgagtatctggtcgaacggtcaggaagagaggtgaccgagggtattgtgagtaccttcaatatgcaccaacaaagttgtaaggacttacagctgtacttgagtaatctggccaaccagattgacagggagactgggataggggatgtcccactggtgattcttctggacgatctgtcagaagccggtagcattagcgagctggtgaacggggcattgacgtgcaaataccacaaatgcccttacattataggtacaacgaatcagcctgtgaaaatgacacctaaccatggcctgcacttgtcattcagaatgcttacctttagcaacaacgttgagccagcaaatggattcctggtaagatacctgcgaaggaagcttgtggaatctgatagcgatattaacgccaataaggaggaacttctgcgggtgctggactgggttccaaagctatggtatcatttgcacaccttcctcgaaaaacactcaacttcggactttctgattggaccatgtttctttctgagttgtccaattggaattgaagacttcaggacctggtttattgacttgtggaacaactcaataattccctacttgcaggaaggcgctaaggacggcatcaaagtgcatggtcagaaagccgcttgggaggatccagttgagtgggtccgggacactttgccttggcccagcgcacagcaggaccagtccaaactgtatcatttacccccacctactgtcggtcctcactctatcgccagcccgccagaggaccgcacagtgaaggacagcaccccctcctctctggatagtgatccattaatggccatgttgttgaaattacaagaagccgcaaattatatcgagagcccagatcgtgagactattctcgacccaaaccttcaggccaccctata

SEQ ID NO: 232466 - DNA, 5609 bp, Artificial Sequence
  Description of Artificial Sequence: Synthetic coding sequence
atgctgggatcttccgtgaagagtgtgcagccagaggtggagttgtcatccggcggtggtgacgagggcgcagatgagccgcgaggagccggaaggaaggctgctgcggctgatggcagaggtatgctgcctaagagggctaaggcacccggtggtggcggaggcatggcgaaggctagcgcagcagaactgaaggttttcaaaagcggaagcgtagactcgcgagtgcccggaggaccacccgcttccaacctacgtaagcaaaagagccttaccaatttgtcttttctcactgactcggagaagaagcttcagctgtatgagccagagtggagtgacgatatggccaaggcaccaaaaggccttggcaaggtgggctcgaaaggcagagaagctcctcttatgagtaaaacactatcaaagagtgagcactccctgtttcaggccaaagggtccccagccggaggcgctaaaacaccattagcacctctggcccctaatctcggcaaaccttctcgaatccctaggggcccttatgccgaggttaagccactctctaaagccccagaagctgccgtctctgaggacggtaaatcggacgatgagctgttatcttcaaaggcgaaggcccagaagtcctctggtccagtgccaagcgctaaggggcaggaggaacgcgctttcctaaaagtggaccctgagttggtggtgaccgtgttaggcgatcttgagcagctgctattctcacagatgctcgaccccgaaagtcagaggaagcgcacggtgcaaaatgttctcgacctccgacaaaacctcgaggagacaatgtccagtctgaggggctctcaagtcacacactcatccctggaaatgacctgctatgactctgacgatgccaatcctcgctcagtatcctctctttcaaacaggtccagccccctgagttggagatacgggcaatccagtcctaggctgcaggctggagacgccccttcggttggaggatcatgtcgttccgaagggacccccgcttggtatatgcacggggagagagcacattactcccatacgatgcctatgagatcacccagcaagctgtcccacatctccaggctggagctggttgagtcgctcgattctgacgaggtagatctgaagtccgggtacatgagcgattcagacctgatggggaagaccatgacagaggacgacgacatcaccaccggatgggacgaatcctcaagcattagctctggactgtcagatgcaagtgataacctcagctcggaggagttcaacgcaagctcctcgctcaactctttaccgtctacccccacagcgtctaggaggaattctactatcgtcctccgcactgacagcgagaagaggagtttagctgagtcaggtctttcatggttctccgagagcgaggaaaaagccccaaaaaagctggagtacgattctggatctctcaagatggagccgggaacatctaagtggcgcagggagcgacccgagagctgtgacgattctagcaagggaggcgaactgaaaaaaccaattagtctgggacacccaggatccctcaagaaagggaagacccccccagtcgccgttacgtctccaataacccataccgcacaaagtgctctcaaggtagcaggcaagccagaggggaaagccacggacaagggaaagttggcagtaaagaatacaggcctgcagcgcagcagtagcgatgctggtagggatcgactctccgacgccaaaaaaccccctagtggaatcgcaaggcctagtacttcgggaagcttcggatataaaaagcccccacctgccacagggaccgctactgtgatgcagactggcggatcagccaccctgagtaaaattcagaaaagctctggcatcccagtaaaacccgtgaacggaaggaaaaccagccttgatgtttctaattctgctgagcccggattcctagccccaggggctaggagcaatatccaatataggtccctcccaagacccgctaagtctagtagtatgtctgttaccggagggagaggaggccctcgtcctgtctccagctcaatcgacccaagtttgttaagcacaaagcaaggcggtctgacacccagtcgactcaaggagccgaccaaggtcgcgtcaggacggacaactccagcccctgtgaaccagaccgatcgcgagaaggagaaggccaaagcgaaagctgtcgcgctggactctgataacattagcttgaaatccattggaagtcctgagtccacgcccaaaaaccaggctagtcaccccacagctactaagctcgccgagctccccccaacaccactgagagctactgccaaatcttttgttaaacctccctccttagcaaacttagacaaggtgaatagcaattcactcgacctgcccagcagcagcgacacaacccatgcgtccaaggtgcctgacctgcatgctacatcgtccgcctctggcggacccctcccttcttgcttcacgccatcaccagctcccattcttaacattaacagtgcatcctttagccagggccttgagttgatgtccggcttttccgtgccaaaggagacccgtatgtacccaaaattatccggccttcacaggagcatggaatctttacagatgcccatgtcgctgccttctgctttcccttcgtcgacgcctgttccaactccacccgctccacctgcggcaccaacagaggaggaaaccgaggagctcacttggtccgggtcccccagagcaggccaactggatagcaatcagcgcgaccgcaataccctgcctaagaagggtttgcggtaccagctgcagtctcaagaggagaccaaggagaggagacactctcataccatcgggggactcccagagtctgatgatcagagtgaactgccctcccccccagccctacccatgtcactgtccgccaaaggccagttaactaacattgtcagtcccaccgcggctaccacacccagaattacccgctccaattccatccctacacacgaagcggcttttgagctttactctgggtcccagatgggctcgaccctgagcctcgccgaaagacctaaggggatgatccgatctggcagcttccgagaccccactgacgacgtacatggcagtgtgttgagcttggccagttccgcctccagtacatattcctctcaaattcgaaagctgcgcagggagcttgaatcttcacaggagaaagttgcaacacttaccagtcaactttcagccaacgcaaacctagtggcggcttttgagcaatcactcgttaacatgaccagccggcttaggcatctcgccgaaaccgctgaagaaaaggacacggagctccttgatctccgcgagaccatcgatttccttaagaaaaagaattccgaggcccaagcagtgatccaaggggctttgaatgctagcgagaccaccccaaaagaactccgaatcaagaggcagaatagttccgacagcattagtagcctcaatagcataaccagccactcgtccataggatcatccaaggatgccgacgccaagaaaaaaaagaaaaaatcctgggtctacgagctacgaagttccttcaataaagctttctccatcaagaagggcccaaagagcgcgtcttcatattctgacatcgaggaaatagctacgcccgacagttcagctccttcgtccccaaagcttcagcacggaagtactgagaccgcctctccttccatcaaatctagcacttctagtagcgtgggaacagacgtgaccgaagggcctgcccaccccgctcctcacacccggttgtttcacgcaaacgaagaagaagagcctgagaagaaggaggtaagtgagttgagatctgagctctgggaaaaagagatgaaactgacagatataagattagaagctctgaactctgctcatcagctggatcagttaagagagaccatgcataacatgcagctagaggtggatttgctgaaggctgagaacgaccgcctgaaagtggcccctggcccaagcagtggatccacccccggacaggttcccggttccagtgccttgtcctctccacggaggtctctgggattagcacttacacacagctttggacctagcctggcggatacggacctttctcctatggacggaatctccacttgtggcccaaaagaggaggtgaccctccgggtcgtggttaggatgcctccccagcacatcatcaaaggcgacctgaaacagcaggagttctttctcggttgttccaaggtctccgggaaagttgattggaagatgttggacgaagcagtgtttcaagtatttaaagactatatatctaaaatggacccagctagcacgctgggcctctccaccgagagtatacatggctattccatcagccatgtaaagagggttctggatgccgaaccccctgagatgccaccgtgtcgacggggagttaataatattagcgtttccctaaaagggctcaaggaaaaatgtgtggactcactggtctttgaaactctcattccaaaacccatgatgcagcactatatatccctgctgttgaagcacaggcgactggtgctcagcggaccaagtggtaccggtaaaacataccttactaatcgactggccgagtacctggtggagcgctcagggagagaagtcacagagggcattgtgagcactttcaatatgcatcagcagagttgcaaggacctgcaactctacctttccaaccttgcgaatcagatcgatcgcgaaaccggtattggggacgtgcccctggttatactgcttgatgaccttagcgaggctgggtccataagtgagctggtaaacggggcactgacctgcaagtaccataaatgtccttacattattggtaccacaaatcagcctgtgaagatgaccccaaaccatggactgcatttgtctttcagaatgctcacattttccaacaacgtggaaccagccaacggcttcctagtgcggtatctgcgaagaaaactcgtagagtcagactctgacatcaacgcgaataaggaggagctgttacgtgtgttggattgggtgcccaagctgtggtaccaccttcatactttcctggagaaacattccacatccgacttcctcatcggaccttgcttctttctgtcttgtccaataggcattgaggatttccggacatggtttatcgacctgtggaacaactctattattccttatctacaggagggagcaaaggatggcatcaaagtccacggacagaaagccgcttgggaagatccagtagagtgggtacgggacactcttccttggccatcagcgcaacaggaccaaagtaaattgtaccatctgccgccacctacagtgggaccacatagcatcgcttctccaccggaggaccgcaccgtaaaagatagtacgccttcctccctggactctgaccctcttatggcaatgctgttgaaactgcaggaggctgccaactatatcgagtcacctgatcgcgagacaatcctggacccgaacttacaggcgacactgta

SEQ ID NO: 232467 - DNA, 5454 bp, Artificial Sequence
  Description of Artificial Sequence: Synthetic coding sequence
atgctgggctcttccgtcaaatctgttcagcctgaggtggaattgagcagcggtggaggcgatgaaggggcagatgaacccaggggcgctggaagaaaggctgcagccgcagacggacgtgggatgctcccaaagcgcgctaaggcaccaggtggtgggggaggcatggccaaggccagcgctgccgagctgaaggtgttcaaatccggaagcgtggacagtagggttcctggcggaccacccgcttctaatctcagaaaacaaaagtctctgacgaacctgtcatttctgactgatagtgagaaaaaacttcaactttatgagcccgaatggtccgacgatatggccaaggcacctaaaggcctgggcaaggtcggctccaaaggcagggaagctccacttatgtccaagacactcagcaagtctgagcattcactgtttcaagcaaagggaagtccagcagggggtgcaaagacaccactggcgccactcgcacctaacctgggaaagccatcccgaatacccagaggcccatacgcagaggtcaagcccctgtccaaagccccagaggcggctgtgagcgaggacggaaagtcagacgacgagctgctgtcttcgaaagcgaaagcccagaaatcttccggcccagttccctccgcaaagggacaagaagaaagggcctttctgaaagttgatcccgaactagtggtcactgtcctgggagaccttgaacaactgctcttcagccagatgcttgatcctgagtctcagaggaagcggactgttcagaatgtgctcgacttgagacagaatcttgaagagactatgtcttctttaagagggtcccaggtaactcactcaagcctggaaatgacctgctatgactccgacgacgcaaatccgcgttccgtcagttcactgtccaatcgctcttcacctttgtcatggaggtacggacagtcctctcctcgcctccaggcaggtgacgcaccttctgtcgggggtagttgccggtcagagggcactcccgcatggtatatgcatggagagcgggctcattattctcacaccatgcctatgagatcaccttccaaactgtcccacatttcccgattagaacttgtggagagcctggatagcgacgaagttgacttaaagtctggctacatgtctgactcggacctgatgggcaagaccatgacggaggacgacgacattactacagggtgggatgaatccagctcaatcagcagtggattgagtgacgcttccgacaacctgagctcagaagagttcaatgctagtagcagtcttaattccctgccttcgactcccacagcctcacgtagaaactcaacaatcgtgctgaggacagattcagagaagaggtcactggccgaaagcgggctgtcatggttttcagaaagcgaggagaaggccccaaagaaactggaatacgattctggctcactcaagatggaaccgggaacatcaaagtggagacgggaaaggcctgagtcttgcgatgacagcagcaaggggggagaacttaaaaaacctatctcccttggacaccctggatctctgaaaaaggggaagacaccgcctgttgctgtcactagcccaataactcataccgcacagtctgctctgaaggtcgcgggtaaacctgagggcaaggctactgataaaggcaaactggctgtgaaaaacacggggcttcaacgttccagctccgacgcaggcagagataggcttagtgatgcgaagaaacctccgagtgggatagcccgacctagtacaagcggatcttttggttacaaaaagccacctcctgcgacaggtactgcaaccgttatgcagactggaggttctgccacgttgagtaagattcagaagtcttccgggatccccgtgaagccagtgaacggacgcaaaaccagcttagatgtgagtaacagcgctgagccagggttccttgctcccggagccaggagtaacatccagtatcggagtttacccagacctgccaaatcaagtagcatgtcagttacgggcggaaggggcggacccagaccagtgtctagctcaattgacccgtctctactctctaccaagcaggggggactgaccccgagtaggctcaaggagcctacaaaagtcgcctcggggaggaccacccctgcgcctgtgaaccaaaccgaccgagaaaaggaaaaggctaaagccaaggccgttgccttagattcagataatatcagccttaaaagcattggctcgcctgagagcacacccaaaaatcaggcatcacaccccactgcaaccaagttagcggaacttccacccacgccattgagagccactgccaagagtttcgtgaagcccccatctctggcaaatctcgacaaagtgaattccaactcattggatttaccgtcttctagcgataccacacatgccagcaaagtacccgatttacatgcaacgtcatctgcttccggtggacccctgcctagttgctttacacctagccccgcaccaatacttaatatcaattccgcttccttcagtcagggtttggagctaatgtctggcttcagtgtccccaaggaaacccggatgtaccccaagttgagcggtctgcaccgcagcatggaaagcttgcagatgcccatgtcgttgccctcagcttttccgtcttctacgccagttcccactcctcctgcccctccagctgccccaactgaggaagaaactgaggagctgacttggtccggctctccacgggcaggccaactggattcaaatcagagagaccgaaacactctgccgaagaaggggctgagatatcagctccagtcccaagaggaaaccaaggaaagacgccactcccacaccattggcggtcttcctgaaagtgatgaccagagtgagctgccatcccccccagctctgcccatgtctctctctgctaagggccaattgacaaacattgttcacggctcggtgctgtcactggcttcttccgccagttctacgtatagttctgctgaagaacgaatgcagtctgagcagatcaggaaactgagacgcgagctggaatcatcacaagagaaggttgcgactttgacgtcccagctgtccgcaaacgcgaacctggtggccgcattcgaacaaagcctagttaacatgaccagccgcctgcgacacctggccgagaccgctgaggagaaagacaccgaactactggatttaagagagacgatcgacttcctgaagaagaaaaactctgaggctcaggcagtgatccaaggggcactcaatgcctccgaaactaccccaaaagaacttaggatcaagcggcagaattccagcgattccatcagttctcttaacagtatcacatctcacagctctattgggagcagtaaggacgcagatgccaagaagaaaaaaaagaaatcttggctacgcagcagttttaacaaggctttcagcattaaaaagggcccaaagagtgcttcctcatatagtgacatagaggagatcgctactccagacagttctgcccctagttcccccaagctgcaacatggcagtacagaaacagccagcccttctataaagagttctacctcctcatccgtagggaccgatgtaactgaaggaccagcacatcccgctcctcatacaaggttgttccatgccaatgaggaggaagaaccggagaagaaagaggtctctgaactaaggtcagagctgtgggagaaggaaatgaaactcacagacattcggcttgaagcgctgaattccgctcaccaattggaccagttaagagagactatgcataacatgcagctggaggtcgatttgcttaaagctgaaaatgacaggcttaaagtagccccagggcctagctccgggagcacacctggccaggtgcctggcagctctgccttgtctagtcccagacgctcactaggcctcgcactgacccacagctttggcccatcgttagctgatacagacctttcacccatggacggcatcagcacctgcggtcccaaggaggaagtgacacttagagtcgtcgtgcgcatgcccccacagcacatcattaaaggtgatttaaagcagcaggagttcttcctggggtgctccaaggtgtcaggcaaagttgattggaagatgctcgacgaagcggttttccaggtgtttaaggattacatctctaaaatggacccagcctctaccctgggcctgtccaccgagtctatccacggatactccatttctcacgtaaagcgagtgctggatgctgaacctccagagatgcccccatgccgcagaggcgtaaataacatcagcgtctccctgaagggactgaaagagaaatgcgtagactctctcgttttcgaaaccctgattccaaaaccgatgatgcagcactacatttccttactgctgaaacacaggcgcctggtgctgtctggccctagcggcaccggcaagacgtacttgaccaataggctcgcagagtacctcgtcgaacggtcagggagggaagttactgaggggattgtatctacattcaacatgcatcaacagtcttgcaaagatctgcagttgtatctaagcaacctggctaaccaaatcgatcgcgagacaggaattggtgatgttcccctggtgattctgctcgatgatctcagcgaggccggtagtatttctgaattggtcaatggagcattaacatgtaaatatcacaaatgcccatacatcatcgggactaccaatcagccagtgaagatgacacctaaccacggcttgcacctgtcctttagaatgctgacgtttagtaacaacgtggagcccgcaaatggatttctggtgaggtacttaaggagaaaattggtggaatccgattctgatattaatgccaacaaggaggagcttcttcgggttctggactgggtccccaagctgtggtatcacctccatacctttctcgagaaacactccacaagcgattttttgatcggtccctgcttttttctcagttgtcctatcggtatcgaagatttccgaacctggtttattgacctctggaacaactcaattataccgtacctacaggaaggagccaaggacggcatcaaagtacacgggcagaaggcggcatgggaagaccctgtggaatgggtgagagacactctcccctggccgagcgcacagcaggaccaatccaaactctaccacctcccaccaccaacagtggggcctcactccattgcctcccctcccgaagatcggactgttaaggattccacacctagctcgttggactctgatccacttatggctatgctgttgaaactgcaggaagcagcaaattacatcgagagtccggacagagagacgatcctcgacccaaatctgcaggccaccctgtat

SEQ ID NO: 232468 - DNA, 783 bp, Artificial Sequence
  Description of Artificial Sequence: Synthetic coding sequence
atgcatcagcaatcctgtaaggatctacaactgtacctcagtaatctcgcaaatcaaatcgaccgcgagacgggcatcggcgacgtgcctctggtgattctactggacgatctgtctgaggccggatccatctctgaactggtgaatggtgctcttacttgcaagtaccacaagtgcccgtacattattgggactaccaaccagccagttaagatgacaccaaaccacggcctccatctgagctttagtcggatgctgacttttagtaacaatgtggagcccgctaatggctttttggtcagatatctgcgtcgcaaactggtcgaatccgactctgatatcaatgctaacaaggaggaacttctgcgagtgcttgattgggtcccgaaactttggtaccacctgcacactttcttggagaagcattctacttctgactttttgatcgggagtccttgctttttcctgtcctgtcctattgggatcgaggattttagaacttggttcattgatctttggaacaacagtatcattccttatctgcaggaaggggctaaggacggaataaaggtgcatggccagaaggcagcttgggaagatccagttgaatgggtcagggacacactgccgtggcctagtgcccaacaagatgacagcacaccctcatcgctcgacagcgaccctctcatggctatgctcttgaaactgcaagaggcggctaactatattgaaagtccagaccgggaaaccattctcgaccctaacttacaggccaccttgtag

SEQ ID NO: 232469 - DNA, 2193 bp, Artificial Sequence
  Description of Artificial Sequence: Synthetic coding sequence
atggagcccggaactagcaagtggcgcagggagagacccgagtcttgcgatgactcatcaaaggggggagagcttaagaagcctatctctttagggcacccaggatcactgaagaaaggaaagaccccgccagtcgcagtgacgtcacccatcacccacacggcgcaatccgccctgaaggtggctgggaagccggagggaaaggccactgataagggtaaactggcagtgaaaaacacaggactgcagcggagtagcagtgacgctggcagagatagactctctgatgcgaaaaagcccccaagtggtatagccaggccctcaaccagcgggtcgtttggctacaaaaaaccccctcccgcaaccggtactgccaccgtcatgcagaccggcggatccgctaccctgtcaaaaatccagaaatcgagtggcatccctgtgaaacctgttaacggcagaaaaacctccctggatgtctctaactccgctgagcccggttttctggcacccggagcgcgttctaacatccagtatcgatccttacctaggccggctaaatcttccagtatgtccgtgaccggcggacggggaggtccaaggcccgtcagcagtagcatagacccctccttgttgtctacgaaacagggcggattgactcccagcagattgaaggagccaaccaaggtggcatcaggcagaactacaccagcgccagtaaaccagaccgaccgggaaaaggaaaaagcgaaagctaaggccgttgctctcgactccgacaacatttctctcaagtccattggctctcccgagtctaccccgaagaatcaggcctcccaccccacggccaccaagctcgccgagttaccacccactcctctgcgagctacagctaaatctttcgtcaagcccccttccttggccaacctggataaggtgaactctaacagtctggacctcccgtcctcgagcgacacaacacacgcttcaaaggtgcctgatctccatgccaccagtagcgcaagtggaggtcccctgccttcttgtttcaccccctcccccgctccaattctgaacatcaactcggcatcatttagtcaagggctagagctaatgagtggcttttccgttcccaaggagaccaggatgtaccctaaactgtcagggctgcataggtcaatggaatctctccagatgcctatgagtctcccgtccgccttcccatcgagtacacccgtgcccacccctcccgcacctcccgctgcccctacagaggaagaaacagaagagctgacttggagcggaagccctcgcgctggccagctcgattcaaatcagcgagacagaaacaccttgcctaaaaaaggactgcgctatcagcttcagagtcaagaggaaacaaaagaaaggaggcactcccacactattggcggtctgcccgagtccgacgatcagtccgagctgccctcgccacctgctttaccaatgtctttgagcgcaaagggtcagttgacaaacatagtaagccctaccgctgctaccacacccagaatcacacggtcaaactcaatcccaactcacgaagccgctttcgagctgtacagtggaagtcagatgggcagtacactctctctcgcggaaaggcctaaggggatgattcgaagtgggtccttccgagatccgacggatgacgttcatgggagtgttctgtccctggccagcagtgcaagttcaacatacagctcacagatccggaagttgcggagggaactcgagtcatctcaagaaaaggtggccacactcacctcacagctttccgccaacgcaaacctggttgcagcttttgagcagtcactcgttaacatgacaagtcgactgaggcacctggcagaaaccgcagaggaaaagatggagttccgcagttgccaccccggttggagcgccctggcacgaagttggttgacagccaattctgcctcacaggatactgagctcctggaccttagggaaacgattgattttttgaagaagaagaactccgaagcacaggccgtgattcaaggcgcattgaacgcctcggaaacaacccccaaggagttacgcattaaacgtcagaactccagcgatagcattagtagccttaactctattactagtcacagctcaattggatctagcaaagatgcagacgcctag

SEQ ID NO: 232470 - DNA, 4451 bp, Artificial Sequence
  Description of Artificial Sequence: Synthetic coding sequence
atgctccatctgcccctgcctcgctctggaaggaccgttaactttccccgaagctgggacgagtcatcctccatctcctctgggctgagcgacgcttctgacaacctgtcttccgaggagttcaacgcaagtagcagtctgaattctctcccttctacacctaccgcgtcgaggcgcaactcgaccatcgtcttgcggaccgactccgagaaacgctccctcgccgaaagtggcctttcgtggttctcggagtctgaggaaaaggccccaaagaaactcgaatatgactcaggcagcctgaagatggagccaggcacttctaagtggagaagggagaggcccgagtcttgcgacgactcttctaaggggggagagctgaagaaaccaatcagcctgggacatcccggttcacttaaaaaggggaagacacctccggtggcagtcacatcacctattacgcacacggcccagtctgcccttaaagtcgccggtaaacccgaaggaaaggccacggacaaggggaaactcgctgtcaagaacactggcttacagcgctccagcagtgatgcgggtagggaccgtctgtcggatgcgaaaaagcctcccagtggaatcgctcgaccttcgaccagcgggagctttgggtataaaaaaccccctcctgcaaccggtaccgcaaccgtaatgcagacaggagggtcggccacactctcgaagatccagaagagctctggcatccccgtgaaaccggtgaacggacgaaagactagtctggatgtaagtaatagcgcagagccgggttttcttgctcccggagcaaggagcaacatccaataccgctctctgcctagacctgcgaaatcgtcttcaatgtctgtgacaggcggtagaggaggtccacgacccgtatcttcatcgattgacccttctttgttgagcaccaagcaaggtggccttactccttcccggctcaaggagcccactaaagttgcctcaggacgaacgacaccggcacctgtcaatcaaacagacagagaaaaggagaaagctaaggcgaaagcagtggccttggatagcgataatatctcacttaaatcgatcgggtcacctgagagcactccgaaaaatcaggcttctcaccctaccgctactaagctcgccgagctgcctcccacaccactacgggctacagcaaagtcatttgtcaaaccccctagccttgccaacctagacaaggtgaactcgaatagcctcgatttgccttcaagctctgatactacccatgcaagcaaagtcccagacctgcacgccacatcctctgctagcggtggcccactgccatcgtgcttcaccccttctcccgcacctatccttaacattaattcggcttcgttctctcagggacttgagctgatgtctggattttccgtcccgaaagaaacgagaatgtaccctaagctctccggtcttcatcggtccatggagagtctccagatgccgatgtccctgccctcagcttttcccagtagcactcccgttcccacgcctcctgcaccccctgcggctcctacagaggaggagacggaggagctcacctggagcggttcgcccagagctggacagctcgattcaaaccagcgagatcgcaacactttgccgaaaaaagggttgagataccagctgcagtcccaggaggagaccaaagagcggagacactctcacactataggagggctgcccgagtccgacgaccagagcgaattgccgtcaccaccggcactgccaatgtctttgtccgcgaagggccagttgactaacatcgttagtccaacagctgctaccaccccacgcatcaccaggtcaaactccatcccgacccatgaagcagctttcgaactttactctgggtcccagatgggatccacattaagcctcgcagagaggcctaaggggatgattaggtccggaagcttcagggacccaacagatgatgtccacggatccgtcctgagtcttgcctcctccgccagctccacctattctagtgctgaagagaggatgcagtcggagcagatcagaaagctgcgacgggaattagagtcctcccaggagaaggtggctactctaacgtcacaattgtcagctaacgcaaacctggtagccgctttcgagcagagcctggtcaacatgacgagcaggctgagacacctggctgagaccgcggaagagaaagacacagaactgctcgaccttagggagaccatagattttctaaagaaaaagaactcggaagctcaggccgtgattcagggagcactgaatgctagcgagacaactcctaaggaactgcgaattaaacgccagaactctagtgattctattagcagtctgaacagcataacttctcacagctcaatcggctcctctaaggacgccgacgccaagaagaagaaaaagaagagttggttgaggtcatcctttaataaggcgttctctatcaaaaagggccctaaaagcgcttcctcatactctgatattgaagaaattgcaactcctgactccagcgcccctagtagcccaaaactgcagcatgggagcactgagacagcctcaccttcgatcaaatctagcacgtctagcagcgtcgggaccgacgttaccgaaggcccagctcatccagccccacatactagactgtttcatgccaacgaagaggaggagcctgagaaaaaagaggtgagtgagctgcgaagtgagctgtgggaaaaggagatgaaactcaccgacatcagacttgaggcattgaacagtgcccatcaactggatcagctccgcgagactatgcacaacatgcagttggaagtggacttactgaaagctgagaatgaccggttgaaagttgcaccaggcccttcttccggtagtactccgggacaggtgcctggatcttccgccctatcttcccccagacgctctctcggccttgcattaacccacagcttcggccctagcctcgccgacaccgatttgtctcctatggacggcatctcaacctgcggtccaaaggaagaggtgacattgcgcgtggtcgtcaggatgccaccccagcacatcatcaagggcgatcttaagcagcaggaattttttttggggtgttctaaggtttctgggaaagtggattggaaaatgctggatgaggccgtgttccaggtgtttaaggactacatatcaaaaatggatcccgcttccaccctggggctgtctactgagtcgatccatggctactccatatcacatgtaaaaagggttctggacgcggagcccccagaaatgccgccttgtcgtcggggagtcaacaatatttctgtgtctctgaaggggctgaaggagaaatgcgtggacagtctggtgtttgaaacactcataccgaagccaatgatgcagcattatataagcctccttctgaagcacagaagactggtgctgtccgggccttctggcactgggaagacctacctgacaaatcgactcgccgagtaccttgtggagcgcagtggaagagaagtcacagagggcatcgtatccactttcaacatgcatcaacagagctgtaaggacctccaactttatttaagtaacctggcgaatcaaattgatagagaaactggcattggggatgtgccactggtgatattgctggacgatctgtctgaggccggatctatatcagagctggtgaacggtgccctcacctgtaagtaccataagtgtccatatatcattggcacgaccaaccagcccgtgaagatgactccaaatcatggtctccatttgagtttccgcatgcttacctttagcaataacgtcgagcctgccaacggtttcctcgtgcgatacctgagaagaaagctggtggagtctgactccgacatcaacgcgaacaaggaggagttactgagagtgctggactgggttcccaagctctggtaccacctgcatacattcctggagaagcactcaactagcgattttctgattggaccatgctttttcttgtcatgccccatcggcattgaagatttccggacctggttcatagacctgtggaacaacagcatcatcccatatctgcaagagggggctaaggatggaatcaaggtacacgggcaaaaagctgcgtgggaagatccggtggagtgggtgagagacaccctaccatggccctccgcacagcaggatcagtccaaactttatcaccttccgccaccaaccgtggggcctcactccattgcatcccccccagaggaccgaaccgtgaaagattcgacgcccagtagtctggactctgacccacttatggccatgttactcaaactccaggaagccgctaattacatcgaatctccggaccgggaaaccattctggaccccaacctgcaagccaccctgta

SEQ ID NO: 232471 - DNA, 4482 bp, Artificial Sequence
  Description of Artificial Sequence: Synthetic coding sequence
atgctgtggcctcgcaatctgacttcctgggacgattccagctctgtgagcagtggcatcagtgatactatcgataacctttctaccgatgatatcaacacatcttcctccattagcagctacgccaacacacccgctagctcacgcaaaaaccttgacgtgcagaccgatgcagagaaacactctcaggtggagagaaattcattgtggtcaggggacgacgtgaagaagtcagacgggggatctgactctggaattaaaatggagcccggttccaaatggcgacgcaacccatctgatgtgtctgatgagtccgacaaatctacaagtgggaagaagaatcctgtcatctctcaaactggcagctggcgcaggggaatgacagcgcaggttggtatcacgatgccgcgaaccaagccttcagcgcctgccggtgcgctcaaaacacctggcactgggaagactgacgatgctaaggtgtcagagaagggcagactgtccccaaaggccagccaggtgaagaggagtccctccgatgccggacgaagctccggcgacgagtccaaaaagcctctgccttcatcctcccggacccctactgccaatgcaaatagctttggattcaagaagcagagcggtagcgccgcaggactagcaatgatcaccgcatccggagtgactgtcacaagcagatctgcaacccttggcaagatccccaagtcgtctgctttagtgtcacgctctgcgggtcggaagtcgtcaatggatggcgcacagaatcaggatgacgggtatctggcactgtcctcccggaccaacctccagtatcgttctctgccaagaccatctaagtcaaactctcggaacggcgcagggaataggagctccacctcctccattgactctaatatttctagcaagagcgccggtttgccagtacccaaactcagagaaccttccaaaactgctctgggatccagcttgcctgggttggtcaatcaaacagacaaagaaaagggcatcagctctgacaatgagagcgtcgcatcctgcaactccgtgaaagtgaatccagccgctcagcctgtttccagccccgcacagacaagccttcaaccgggagccaagtaccccgatgttgcctcaccaacccttcggaggctcttcggagggaagcccaccaagcaagttcctatcgcgaccgcggagaacatgaagaattcggtggtgatttcgaacccccatgctactatgacacagcaaggcaatctcgatagccccagcgggtcaggcgtcctgagctcaggttctagcagtcccctgtattccaaaaacgtggacctcaaccaaagcccgcttgcgagctcgccctcctccgcacatagtgcaccctctaacagtctgacatggggcaccaatgcctcctcatcatctgcagtgtccaaagatggactggggtttcagtccgtatccagcttacacacctcttgtgaatcaatcgacatctccctgtcatctggcggagtgcctagtcacaacagcagcaccggtctcatcgctagtagcaaagatgattcactcacgccattcgttcgtaccaattctgtgaaaacaaccttgagcgaaagcgaccctcacttagaccggaacactctgccaaaaaagggccttcggtacaccccaactagtcaactccgcacacaggaagatgcgaaggaatggcttcgttctcacagcgcaggcggtctccaggataccgctgccaactcaccattctccagcggttcttctgttaccagccccagtgggacacgattcaatttttcacagctggcatcaccaacaactgtcacacagatgagcctatccaatcctaccatgctgcggacacactccctgtccaacgctgacgggcagtatgacccgtataccgatagccggtttaggaacagttctatgtccctcgacgagaagtcaaggacaatgtccagatctggaagttttcgtgacgggtttgaagaggtgcacggcagctccctgtctctggtctcttccaccagctccgtgtacagtactcccgaagagaagtgccagtcagagatcaggaaacttagacgagagctggacgcatcacaagaaaaggtctcagcacttaccacccagctaaccgccaatgcccatctggtagccgctttcgagcagagcctcggcaacatgactatcagattgcagtctctgacaatgactgcggagcagaaagactccgagttaaatgagctgagaaagactattgagctcctgaagaagcagaatgccgcagcccaggccgctattaacggtgttataaataccccagaactcaactgcaaggggaatgggacagctcagtcagctgatctccggattcgaagacagcactcatcagactcagtgtcctccattaattctgcaacctcgcatagctctgtgggcagcaatatagaaagcgactcgaagaaaaagaaaagaaaaaattggttgagatcttccttcaagcaggctttcggcaaaaagaagtcgcctaagtccgcctctagccactccgatattgaggaaatgaccgacagcagcctaccctcatctccgaagctgccacacaacggcagcacaggttctaccccacttctgcgaaactctcatagcaattctcttattagtgagtgtatggacagcgaagcggagaccgtgatgcaattaagaaatgaactgcgcgacaaggaaatgaagctgaccgatatccgcctggaggcgctaagctctgcccatcagctggaccagttgagggaggcgatgaaccgaatgcaatcagagatcgagaaattgaaagccgagaatgacaggctgaagtcagagtctcagggctctgggtgcagccgagccccttctcaggtttcaatctccgcttctcctaggcaatcaatggggttgtcccagcacagtctgaacttgaccgaatctacctccctggacatgctcctagacgacaccggggagtgtagtgctagaaaggaagggggacgccatgtgaaaattgtggtgtcttttcaggaagagatgaagtggaaagaagactcccgaccccacctgttccttatcggttgtattggtgttagtggaaagacgaagtgggacgtgctagatggtgttgtcaggagactgttcaaggagtatattatccacgtggatcctgtctcccagctcggcttgaattctgatagtgtgctggggtatagtattggggaaattaagcgaagtaacacgtcagaaaccccggagctcctcccctgtggctacctcgttggggaaaataccactattagtgtgaccgtcaaaggccttgccgagaatagtctggattcattagtctttgagagtctaataccaaaaccaatactccaaagatacgtgtctctcctgatcgaacaccggagaatcatattaagcggcccaagtgggacaggtaagacatatttggcgaaccggctctcagaatatatcgttctgcgcgaaggcagggaactcacggatggcgtcatcgcaacatttaacgtcgaccataaatcatctaaagaacttcgccagtatctgtctaaccttgccgatcagtgtaactctgagaacaatgcggtggatatgcctctggttattatcctcgataaccttcaccacgtatctagtttgggcgagatatttaacgggctgctgaattgcaaataccataaatgcccttacattattgggaccatgaaccaggccacctcatctacgcctaatctccagttacatcacaacttccgctgggtcctgtgcgccaaccataccgaacccgtcaaaggtttcctgggtagatttctgcgcaggaaactcatggaaacagaaatcagcggcagggttcgaaacatggagttagttaagattatcgactggattcccaaagtctggcatcatcttaatcggtttctggaagcccattcttcatcagatgtgaccattggaccaaggctgttccttagctgtcctatcgatgttgatgggagcagggtatggtttaccgatctctggaattactctattattccttacctgctcgaagcggtaagggaaggtcttcagttatatgggagacgggctccctgggaagatccagcaaagtgggtgatggacacatacccttgggcagcgagtccgcagcagcatgaatggccgcctctgttgcaattgcgcccagaggatgttggttttgatggatactccatgccaagggaagggtcaactagcaagcagatgcctcccagtgacgccgagggagatcccctgatgaacatgctgatgcgccttcaggaagctgctaattactcttcccctcagtcttatgattccgattctaatagcaattctcatcatgatgacattctcgatagtagtcttgagtccaccctgtag

SEQ ID NO: 232472 - DNA, 7289 bp, Artificial Sequence
  Description of Artificial Sequence: Synthetic coding sequence
atgcccgctattcttgtggcaagcaagatgaagtccgggctgcctaagccagtgcattcagccgctcccatcctccacgtgcctccagcccgagccggacctcagccctgttatcttaagctgggcagcaaagttgaggtgtccaagacgacttatccttctcagatcccccttaaatcgcaagtgctgcaaggtttacaggaacctgctggagagggtctgcctctccgtaaatccggaagcgtcgagaacggcttcgacacccaaatctatacagactgggctaaccactacctagcaaaaagtggccacaagcgtcttattcgggatctgcaacaggacgttaccgatggagtgctcctcgcacagattatccaggtggtagccaacgagaagattgaggacatcaatggctgtcctaagaataggtcccagatgattgaaaatatcgatgcatgtctgaatttccttgccgctaaaggaatcaatatccaaggattgtccgctgaagaaatacgaaacggtaaccttaaagctattttaggccttttcttttccctcagcagatacaagcaacaacagcagcagccacagaaacagcatctcagctcacccctgccaccagcagtttcgcaggtagccggagcccctagtcagtgccaggcaggcaccccccaacaacaagtacctgttacacctcaggccccttgtcagccacatcagccagcccctcaccaacaaagcaaagcacaggcagagatgcagtcccgcttgccaggaccgaccgccagggtgtctgctgccggatccgaggctaaaaccagaggcggatccactacggcaaacaatcggcgatcccagagctttaataattatgacaagtctaagcccgttactagtcctccccctcctccttcttcccacgaaaaagagccgctagcctcaagcgctagcagccaccctggcatgagcgacaacgctcccgcttcattagagtcgggatcaagctcaacaccaaccaattgctctaccagcagcgccattccgcagcccggagcagctaccaagccatggcgatccaagtcgctttcggtgaaacactcagctactgtgagtatgctgagtgttaaacctccaggaccagaagcacccaggcccactcccgaggccatgaaaccggctcctaacaatcaaaagtcaatgctggagaaactaaagctgttcaactctaaaggcggatctaaagctggtgaaggtcctggaagccgtgacactagctgcgagagactggagacgctgcctagtttcgaggagagcgaggagttggaggcagccagtcgcatgctaacaacagtgggccctgcaagctcgtctcctaaaatcgctttgaaggggatcgcccagcgaaccttttcgcgtgcactcaccaacaagaagagctcattaaaaggcaatgaaaaagagaaagaaaagcagcagagggaaaaagacaaagagaaatcgaaagatctagccaaacgggcttccgtgacagagcgcctcgacctcaaagaagagccaaaggaagatccatcgggcgcagccgtaccagaaatgccaaaaaagagcagcaaaattgcaagtttcattcctaaagggggaaaacttaactctgcaaagaaggagccaatggctccctcacacagtggcatcccgaagcctggcatgaaatcaatgcctggaaagtctccctctgcgccagctccgagcaaggagggtgagagatcgagatctggcaagctcagttcagggctgcctcagcagaaacctcagctggacggacgacactcttcatctagttcctccctggcttcatcagaaggcaagggacccggaggaacaaccctaaatcatagcatctcctctcaaacagtgtctggaagtgtgggcactactcaaactactggtagcaacacggtttctgtgcaactgccccagccacagcagcagtataatcaccccaacacggcaactgtggctccctttctctaccgatcacagactgacactgagggcaatgtgaccgctgaatcatccagtaccggcgtcagtgtcgagcccagtcactttaccaagacgggacagccagccctcgaggaactgacaggcgaagaccccgaggccagaaggctccgcaccgtgaagaacattgcagatctgcgccaaaacctcgaggaaaccatgagctccctgcgaggaacacaggtgacacatagtacactagagactacttttgataccaatgtcactaccgagatgagcggtcggtcaatcctgtctttgacgggccgacccaccccactgtcctggcgtctgggccagtcatcccccaggcttcaggccggagacgctccctccatgggcaatggctatccgcctcgcgctaacgcctccagattcattaacacagaaagcgggcgttatgtctactcagctccactacggaggcaattggcaagtagaggcagctctgtgtgtcatgtggacgtgtccgacaaggctggagatgagatggacctggaaggcattagcatggatgccccaggttacatgagtgacggcgacgtgctttctaaaaatatacgtaccgatgacatcacgagtggatacatgacggacggtggattgggcctatataccagaaggctgaatcggctgcctgatggcatggcggtcgtccgggaaaccctccagcgcaacaccagtctggggcttggcgatgccgactcctgggacgatagcagcagtgtttcgtccggtatttctgacaccattgacaacctgagcaccgacgatatcaataccagctcatccatcagtagttacgcaaatacaccagcttcgagtagaaagaatctcgatgtacaaactgatgcggaaaagcatagtcaggtggagaggaattccctgtggagcggagatgatgtgaagaagagtgatgggggttccgactctggcatcaagatggagccaggctctaaatggcgcagaaatcccagtgatgtaagcgatgagagtgacaaatcaacgtccgggaaaaaaaaccccgtgatttcgcagactgggagctggagacgagggatgacagctcaggtaggtatcacaatgcccaggaccaagccctccgcacccgctggggcattgaagacgcctggcaccggcaaaaccgatgatgctaaggtttccgagaagggtaggctgagtcccaaagcgagccaggtgaaaaggagcccgtctgacgctggccgttctagtggagatgaatcaaagaaaccccttccttccagctctaggacccccaccgcaaacgctaatagctttggtttcaagaagcagtcggggtcggcggcagggctcgcaatgattacagccagtggtgtgaccgtaacatcacgctccgcaacactggggaagattcccaagtcgagcgctctggtctcaagatctgccggaagaaagagcagtatggacggcgctcaaaatcaggacgatgggtatctcgccctaagttcgagaaccaatctgcagtacaggagcctaccacgccctagcaagtccaactcaaggaacggcgcaggtaacaggagctccacgtcgtccattgacagtaacatctccagcaaaagcgcgggactcccagtgccgaagctcagggaaccatccaagacagcgcttggatctagcttgcctggcctggtgaaccagactgataaagagaaagggatctcatcagacaatgagtctgtggcctcctgcaactctgtgaaagtgaatcctgccgctcagcctgtgtcctcccctgcccagacttctctacagcccggtgcgaaatacccagatgttgcctctcctaccctccggagactgtttggcggtaaacctacaaaacaggtgcccatcgcaacggctgaaaacatgaagaactcagtcgtgataagtaatcctcacgcgacaatgacccaacagggcaacctggacagccctagcgggtccggggtgctcagcagcggcagctcttccccactttacagcaaaaacgtcgatttaaaccagtccccactggcctcctcgccatctagcgctcatagcgcgcctagcaattccctgacttgggggaccaatgcatcttcttcatccgctgtttctaaagacgggctcggatttcagagtgtgtccagtctacacacttcatgtgaatccatagatatctctctgtcctcaggcggagttccctctcacaatagctccacaggactgatcgcctctagcaaggatgatagcctcacccctttcgtacgtaccaactctgtgaagaccacattatccgagagtccgttgtcatccccagcggcaagccctaagttttgccgtagtacactgcctcgcaagcaggacagtgacccgcatctggatcgcaataccctgcccaagaaaggtctgcggtacaccccaactagccagctccgtacccaagaggatgctaaggaatggctcaggagccactccgcaggaggattgcaggacactgccgctaactctcccttttcatccggtagcagcgtcacctccccatcaggaacacgcttcaatttcagccaactggctagccctacaaccgtgacccaaatgagcctctctaatcctaccatgttacggacgcactctctctctaacgccgacgggcaatacgacccctatactgacagccggttcaggaattcatcaatgtctcttgatgaaaagtcgagaacgatgagtcggtcaggctcctttagagacggctttgaggaggtgcatggatccagcctgtctctggtgtcatccacctcctcggtctacagcacacctgaggagaaatgccagtcagagatcagaaaactgcgtcgggagttggacgccagccaggaaaaggtttcggccttgaccactcagctgacagccaatgcccacctggtcgccgctttcgagcagtctttaggtaacatgacgattagacttcagagcctgacaatgacagcggagcagaaagattccgaattaaatgagctacgcaagacaattgagctgctgaagaagcaaaacgcagccgcacaggccgcaataaacggggttataaatacgcccgagctgaattgcaaaggtaacgggacggcccagtctgcggatctgcgaatccggcgtcagcattcttccgattctgtgtccagcatcaattccgcaactagccactcatctgttggtagtaatatcgaatcggacagtaaaaagaaaaagagaaagaactggctgagatctagctttaaacaggctttcgggaaaaagaagtcccccaagagcgcctcctctcacagcgacatcgaagaaatgacggattcctctctaccgtcctccccgaaactgcctcacaatggatccacgggtagtactcccctgctcagaaatagccacagcaactccctgatcagtgagtgcatggactctgaggcagaaactgtcatgcagctgaggaacgaactgcgagacaaggagatgaaactgactgatatccggctggaggctctctcgtccgcccaccagctggaccagctgcgagaggctatgaacaggatgcagtcagaaattgaaaagctgaaggccgaaaacgaccgacttaaatcagagagtcaaggcagtggctgctcaagagctccttctcaagttagcattagcgcctccccaaggcagagcatgggtctcagccagcactccctcaatctgaccgagagcactagcctggacatgttactagacgatacaggagaatgttcagcccgaaaggagggagggaggcatgtgaaaatcgtggtgtcattccaggaagaaatgaaatggaaagaggactctcgccctcacctgtttctgataggatgcatcggtgtttctgggaaaaccaagtgggacgttctagatggagtcgtccgcaggctatttaaggagtatatcattcatgtagacccggtctcgcagctaggtctgaattccgacagtgtcctgggctacagcatcggagagattaagcggtccaacacatcagagacaccggagctcctcccctgtggttacctggtgggggaaaacaccacaatcagcgtgacagtgaaaggcctggccgagaattcactggactcccttgtgtttgaatccttgatcccgaagccaatcctccagaggtatgtgagtcttctgatcgagcatagacgcatcatactgagtgggccatccggtaccgggaagacttacctggcaaataggctgtcagaatacattgttctgcgtgagggccgagaactgactgatggggtgatagcaaccttcaatgtagatcacaaaagctccaaggagcttagacaatatcttagtaacctcgctgaccagtgcaattccgagaacaatgccgttgatatgcccctggtcataattctggacaacctgcaccacgtatcgtctctgggcgagatctttaacgggctgttgaactgcaaatatcataagtgcccatatattatagggactatgaatcaggcaacatccagcacgccaaacttacagcttcaccataactttcgatgggtgctctgcgccaaccacactgaaccagtcaagggcttcctcggtaggttcctacgacgcaagctcatggagaccgaaatttctggacgggtgcgaaatatggaattggttaagatcatagactggatacccaaagtctggcaccaccttaaccggttcctggaggcacactcatcgagcgacgttacaattgggcctcgactctttttgtcctgtcccatcgacgtggatggctctagggtatggttcacagacctgtggaattacagtatcattccctatctcctcgaagccgttagggagggtctgcagctgtacggccgaagggcaccctgggaggatcccgcaaaatgggtcatggacacttacccttgggcggctagccctcagcagcacgaatggcctcccttattacagttgcgtccagaggacgtaggatttgatggatactcaatgccccgagaaggctccactagcaaacagatgcctccttcagacgcggagggtgatccattgatgaatatgctaatgcgccttcaggaggctgcaaattactcgagcccccagtcctatgactcagattccaattccaatagccatcacgacgacatcctagatagttcactcgaaagtactctgta

SEQ ID NO: 232473 - DNA, 7298 bp, Artificial Sequence
  Description of Artificial Sequence: Synthetic coding sequence
atgcctgcaattctggttgcgtccaagatgaagtcaggactccccaaaccagtgcattctgctgccccaattttacacgtgccccctgcaagagctggtccccagccctgttatctgaagctcggaagcaaggttgaagtgagcaagacaacttatcctagccagatcccactcaagagccaggtccttcagggtctccaggaaccagctggcgagggcctacccctgagaaagagcggatccgtcgaaaatgggttcgacacacaaatttacactgattgggctaatcactacctcgcaaagtctggccacaagcgattgatcagagacctccagcaagacgttacagacggggtgctgctcgcccagattattcaggtcgtggcaaacgagaaaatagaggacataaatggctgtcccaaaaaccgctcccagatgatcgaaaacatcgatgcttgcctgaactttttagctgctaaagggataaacatccagggccttagcgccgaggagatccggaacgggaacctaaaagctattctcggcttgtttttcagtctcagtagatacaaacagcagcagcaacagccacagaagcagcacctgtcgtctccattgcccccagctgttagtcaggtggctggggcaccaagccagtgccaggctggaacacctcaacagcaggtgcctgtgactccacaggcaccgtgccaacctcaccagcctgcacctcatcaacagtctaaagcgcaggcagagatgcaatctaggttacccggtccaactgccagggtgtccgccgcaggctcagaggcaaaaacacggggtgggtccacaactgccaacaacaggagatcccagagctttaacaactatgataagtccaagccagtcacaagccccccacccccaccttcgagtcacgagaaggagccgcttgcttcttctgccagctctcaccccggaatgtccgataatgcacctgctagtcttgagagtggatcttcatcgacccccactaactgcagtacttcctctgccataccccagccaggcgctgcgacaaagccttggcgcagcaagtcattgtccgtgaaacacagtgccacagtgagcatgctttccgtgaagccacccggtcctgaggcccctcgtccgacccctgaagccatgaaacctgccccaaacaatcagaagtccatgctagaaaaactcaaattgtttaacagcaaaggaggcagcaaggccggagaaggcccagggtctcgcgacacctcgtgtgaaagattagagactttaccgtctttcgaggagtccgaggagctggaggcagcttcccgaatgttgaccaccgtgggacccgcaagctcatcccccaaaatcgctctgaaagggatcgcccagaggacattctctcgcgcactgacaaacaagaaatcttcgctgaagggaaacgagaaggagaaagaaaagcagcaaagagagaaggataaggagaaaagcaaagatctggcaaaacgggctagtgtgaccgaacgtctcgatctgaaagaggaaccaaaagaggacccctcaggcgcagcagttccagaaatgcccaaaaagagctccaagatcgcaagtttcatccccaaaggtgggaagctgaattctgcaaagaaggagcccatggcacccagccactccgggatcccaaagcctgggatgaaaagcatgcctggtaaaagtccctccgcaccagctcctagcaaggagggggagagaagtcgctccggtaaacttagctccgggctacctcagcagaaaccacaattggatggaaggcattccagttcatcttcaagcctggcctcctctgagggcaagggcccaggcggtactactctcaaccactctatctcctctcagacagtgagcggctctgtcggaacaacccaaacaacaggctccaacacagtgtccgttcagctgccgcaaccacaacaacagtataatcatccaaacaccgccacagtggctccttttctttatagatcacagaccgatactgagggtaacgtgactgctgaaagttctagtaccggcgtatcagtggagccctcacattttacgaaaaccggccaacctgccttggaggagcttactggtgaagatccggaggctaggcgactgcggactgtaaaaaacatcgcagatttgagacagaatttggaagagacaatgagttctctgcggggtacacaggtaacccacagcaccctggaaaccacttttgacacaaacgtcaccacagagatgtcaggcaggtcaatccttagcctgaccggtaggcccacacccctgagttggcgcctgggtcagagttctcctcgattgcaggccggagatgcaccgtctatgggcaacggatatccacccagggccaacgcgtctcgcttcatcaatacagaatctggcagatatgtttacagcgcccctctccggaggcaactggcttctaggggctcctccgtgtgtcatgtcgacgtgtcggacaaagcaggggacgagatggacctggaggggatatccatggacgccccaggctacatgagcgacggcgacgtactgtcaaaaaacatcaggaccgacgatattacatcaggctatatgaccgatggtggtcttggtctgtatacacgcaggctgaatcgcctgcctgacggaatggcagtcgtccgggaaactttgcaacgcaatacctctctgggacttggagacgccgatagctgggacgattcatcgagcgtgtcatcaggcatttccgatactatagacaacttatccaccgatgatatcaatacaagctcatctatcagctcttatgccaataccccggcatcaagccggaagaatctagacgtccaaactgatgctgagaaacactctcaggtggagcgcaattccctctggagtggagacgatgtcaagaaaagcgacgggggttccgattcaggtattaagatggagccaggctctaaatggagacgcaaccctagcgacgtctctgatgagagtgataagtcaacgtctggaaaaaaaaacccagtcatctcacagaccggcagttggcgcagaggaatgaccgctcaggtaggtatcactatgcctagaacgaagccctcagcaccggctggggctctcaagacccccggaacagggaagactgacgacgctaaggtgtcagaaaaaggccgactaagccccaaagccagccaggtcaaacgctctccttccgatgccggaagatcttccggagacgagtctaaaaaaccactgccgagtagcagtcggacgcctactgcaaacgcgaattcttttggattcaaaaagcagtccggcagcgcagctggactagccatgattaccgcatcgggcgtcactgtgacctccagatccgctacactcggcaaaatcccgaagtctagcgccctggtttcacggtcagccggtcgaaaaagctctatggatggagcccaaaatcaggacgacggatatctggcgctctcatcacggactaatcttcagtatcgatcactccccaggccaagcaaaagcaacagtcgcaacggcgctggcaatcggagcagcacatcctcaatcgatagcaacatctctagtaagagcgccggtctaccagtacctaagctcagggagcccagcaaaacagctcttgggagctctctgcctggtctcgttaaccagaccgataaagaaaagggcatctcttctgacaacgagtctgtggctagttgcaacagcgtgaaggtaaaccctgcagcacagccagtgagtagccccgcacagacctctcttcaacctggagcaaaataccccgacgttgccagtcccacactgcggagattgtttgggggtaagccaactaagcaggtaccgattgcgacagccgaaaatatgaaaaattccgtcgttatctcaaatccccatgctaccatgacccagcaggggaatctggactctccctccggctcaggcgtcctgtcttctggctcaagcagtcctttgtatagcaaaaatgtcgacctgaatcagtccccactagcctccagccccagttcagcgcatagcgcgcctagcaacagtcttacttggggaactaacgcaagctcttccagcgctgtatcgaaagacgggttgggcttccaatctgttagcagtctccacacatcatgcgaaagtattgatatttccctctcctcgggtggcgtgccttctcataattcctccactggactgatcgctagttcaaaggacgactccctgaccccatttgtgagaacaaacagcgttaagacgacactgagtgagagtcctctgtcttctcctgccgcttccccaaagttttgtcgctctaccctcccacgcaagcaggactcagatccacacctggacaggaacaccctccccaaaaaaggccttcggtacactcctactagtcaacttcggacgcaggaagacgccaaggaatggcttcggagccattccgctggcggactgcaagatacagctgctaacagtcctttttctagcgggtcatctgtgaccagcccaagtggaaccaggttcaatttcagtcagctcgcatcccccaccacagttacccagatgtcacttagtaatcctaccatgctaaggacccactcactttctaacgctgatggtcagtacgatccatacaccgatagccgtttccgaaattcttcgatgtcattagatgaaaaatcccgtactatgagccgcagcggtagctttcgcgacgggtttgaggaggtgcacggaagctccttaagcctcgtatcaagcacttcgtctgtatacagtacccccgaggaaaagtgccagtctgaaatcagaaaactccggagggaactggatgccagccaggagaaagtgtctgctcttaccactcagctgactgccaacgctcacctggtggccgcatttgagcaatccctgggcaatatgacaataagattgcagtccttgacaatgaccgccgagcagaaggattcagagttgaacgagctgcggaagactatcgaattgcttaagaagcagaatgctgctgcgcaggcagctatcaatggtgttattaataccccggagttaaattgtaagggaaacggaactgcgcaatccgccgacctcaggatccggagacagcactcatctgatagcgtctcttccatcaactccgccacttcacactcttctgttggctctaacatcgaatcagatagcaaaaaaaaaaaaagaaagaactgggtcaacgagctcaggagttctttcaaacaggcattcgggaagaaaaagtctcccaagagcgccagcagccacagtgatattgaggaaatgactgattcatccctgccctcctcccctaagcttccccacaatggatctacaggtagtacccccctgctacggaacagtcacagcaattcacttatttcggaatgtatggacagtgaggctgaaactgtgatgcagctgagaaatgaactcagggacaaggagatgaaactaacagacattcgccttgaagctctttcatccgcacatcagctcgaccagctgagagaggcaatgaatcgcatgcagtctgaaattgaaaagctgaaggccgaaaacgaccgactcaagtcggagtcccaggggtctggctgctccagagctccaagccaggtgtcaatttctgcatctcccaggcagtccatgggccttagtcaacacagtctcaatctgacggagtctacctctctggacatgctcttggacgacaccggggagtgttcagcaaggaaagaaggcggacgccacgtgaaaatagtcgtttcttttcaggaagagatgaaatggaaggaagacagcaggccacacctgttcctgatagggtgcataggcgtctccggaaagaccaagtgggatgttctggacggggtcgtgcggcgactcttcaaggagtacataatccatgttgacccggtttcccaattgggcctgaatagtgactctgtcctcggctattccatcggggagatcaagcgctctaatacttctgagacacctgagctcttgccatgcggatacttggtgggtgaaaatacaacaatctctgtgactgtcaagggcttggccgaaaactccctggattccctggtcttcgagtccctcatccccaaacccatcctgcagagatatgtgtcattgctgatagagcatcgccgaataatcctgtccggacctagcggtaccggtaaaacgtacctggccaaccgactgtccgagtatatcgtcctcagggagggcagagagctcactgacggagtgattgctacctttaatgtggatcacaagagctccaaggaacttaggcagtacttgagtaacctcgcagaccaatgtaattcggaaaataacgccgtcgacatgcccttagtcataatactggataacctccaccatgtgagctctttaggtgaaatttttaatggcctcctgaactgtaagtaccataagtgcccgtacattatcggaaccatgaatcaggcgacgtcaagcaccccaaatctccagcttcaccacaactttagatgggttttgtgtgccaatcatacagagccagttaaaggctttcttggcagattcctcaggcggaagctgatggagaccgagattagtggtagagtgcggaatatggaattagtaaaaattatcgactggatccccaaagtctggcaccacctgaaccggtttctggaagcgcattccagctcagatgtgaccatcgggcctcggctgtttctgtcgtgccccatagacgtcgacggatcacgcgtctggttcacagacctgtggaactactccatcataccataccttttggaggccgtgagagaaggcttacagttatatggcaggcgagccccttgggaggaccctgccaaatgggtgatggacacatacccctgggctgccagcccccagcaacacgagtggcctccattgctgcaactccggcctgaagatgtgggcttcgacgggtattctatgcccagggagggctcaacctcaaaacagatgcctcctagcgatgctgagggtgaccctttgatgaacatgcttatgaggctccaggaagccgctaattactccagcccccagtcttacgatagcgattccaactctaattctcaccacgatgacatcctggactcaagcctcgaaagcaccctgta

SEQ ID NO: 232474 - DNA, 7466 bp, Artificial Sequence
  Description of Artificial Sequence: Synthetic coding sequence
atgccagctatccttgtggcgagcaagatgaagtccggcctgccaaaacccgtccacagtgccgcacctatcctgcacgtgccgccagcaagagccggaccccagccctgctatttgaagctgggctcaaaggtggaagtttccaagacgacttatccatctcagatcccattgaagtcacaagtattacaggggcttcaggaacccgctggcgaagggttgcctctgagaaagtctggtagtgttgagaatggatttgatacccagatctatactgactgggctaatcactatctagctaagtctggacacaagcgactaatcagagacttgcagcaagatgtgaccgacggcgtgttgctcgctcagatcattcaagttgtcgccaacgagaagattgaagacataaacgggtgtccaaaaaacaggtcccagatgattgaaaatatcgacgcctgcctgaattttctggcagccaaaggaataaatattcaagggctttccgctgaggagatcagaaatggtaatctcaaagcaatcttgggactatttttttctctttcacgctataaacagcagcagcaacagcctcagaaacagcatctgtcttcacctctcccccctgccgtgagccaggtcgctggggctcccagtcagtgtcaggcaggcactccccagcaacaggtcccagttacccctcaggctccttgccaaccccatcagccagcccctcaccagcagtctaaagcacaagccgagatgcagtccagtgcaagcagcaaagattcgagccagagcaagatcatcaggtttacgctcggtcagaagaaaatttccagattaccgggaccgaccgccagggtgtctgccgcagggagcgaagcgaagactcgcggaggctctacaacggccaataatcgaaggtcacagtccttcaacaactatgataaaagcaagccagttacatcccctccgcctcctccctccagtcacgagaaagagcccttggcctcctctgctagttcacaccctggcatgtcagacaacgctcccgcaagtttggagtcgggcagtagtagtactcccacaaattgttcaaccagcagtgcgattccccagccaggtgccgctacaaaaccgtggaggtccaagagtctcagtgtgaagcattccgccactgtgtccatgctgtccgtaaaacctccaggcccagaagcccctagaccaacccccgaggccatgaagccagcaccgaacaatcagaagtccatgttggagaagctgaaactctttaatagtaagggcggtagcaaagcaggggagggcccaggctcaagggacacatcctgtgaacggcttgagactttgccatctttcgaggagtctgaggagctggaagccgcaagccgcatgttgactactgtgggacctgcatcttcatctccgaagatcgcacttaagggaatcgcccagcgcaccttttcccgggctctgacaaataagaagagctctcttaaaggtaatgagaaagaaaaggagaaacaacagcgcgaaaaggataaggaaaagtccaaggacctagctaagagggcaagtgtgactgaacgactggatctgaaagaggagcctaaagaagacccgtccggggctgccgtacctgagatgccaaaaaagtccagtaagattgcttctttcatccccaagggaggcaagctgaatagcgctaaaaaggaaccaatggccccttcacattctggaattcccaagcccggaatgaagtccatgccaggcaagtctccttcggcacccgcacctagcaaagaaggggagaggtccagaagtggcaagctgagctctggactgccccaacaaaaaccgcagctggatggtaggcattcatcctcgtcttcttccttagcctctagcgaaggtaagggaccaggtggtactactctcaaccattccataagctcacaaaccgtgagcggctccgtgggaacaacccagactaccggttcgaatactgtaagcgtgcagctgccccaaccgcagcagcagtacaatcatcccaacacagcaaccgtagcaccttttctgtaccgcagccagaccgatacagagggaaacgttaccgccgaatccagctccacaggcgtgagcgtcgaaccaagccacttcactaagaccggccagcctgccttagaggaactcacaggcgaggatcccgaagccagacgtctgcgtacagtgaagaatatagctgatctgcggcagaacctggaagagactatgagctctttgaggggcacacaggtaactcacagtactctggaaacaacattcgatacgaacgtaaccacagaaatgtccggacgatccatcttatcactcaccggacgccctaccccattatcatggcggctgggacagtcgagtccacgactgcaggctggcgacgcaccaagcatgggaaacggataccccccacgcgctaacgcttcacgtttcatcaacactgaatcgggcaggtatgtttatagcgccccattgaggcggcagctcgctagccgcggaagtagtgtgtgccatgttgatgtttccgacaaggctggtgacgaaatggacctcgaaggcatcagcatggacgctcctggatatatgtctgatggcgatgttttgagcaaaaacatcagaacagatgacataactagtggctatatgaccgatgggggtcttggattatacactaggcggctgaacagactgccagatgggatggccgtcgtgagggagacattgcaaaggaatacgtccttgggtctgggcgatgccgatagttgggacgactcatcttcagtgagttctggcatttctgatactatcgataatctctccaccgacgacatcaacactagtagcagcatttccagttacgctaatactccagcttcttctaggaaaaacctggatgttcaaaccgatgccgagaagcactctcaggtcgaaagaaattccttgtggtcaggcgacgacgttaaaaagtcagacgggggatcggactcaggcataaaaatggagcccggatctaaatggcggagaaatccgagcgacgtctctgatgagagtgacaaaagcactagcggtaagaagaatccagtcattagtcagaccggatcctggcgtcgcggtatgacggctcaggttgggatcaccatgcctcgtaccaagccctcagcaccagcaggcgctctgaaaacacctggaacgggaaagacagatgatgctaaggtttctgaaaaaggacgcctgtctccaaaggcatcccaggtgaagagatctccctccgatgcaggaaggagtagtggcgacgaatctaagaagccgcttcccagttcatcccggacccctacagctaatgctaattcctttggtttcaagaaacaatccggatctgccgctggccttgcgatgatcacagctagcggggtgactgttacatcaagatcagccaccctaggaaaaattcctaagtcttcagcactggtgtcaagatctgcgggtcgaaaatcttctatggatggcgcacagaatcaggacgacggatatctggccctgtcttccaggaccaacttacagtaccgctctctcccccgtccgtctaaaagtaattcccgcaacggtgccggaaatcgctcctccacgtcaagcatcgattccaatatcagctcgaaatcagccggactgcccgttccaaagttaagagaaccatccaagacagcgctggggagttctctgcccggacttgtgaaccaaaccgataaggagaagggcatcagctctgataatgagagtgtggcgagctgtaacagtgtcaaagttaaccctgcggctcagcctgtcagctcacctgctcaaacctcgctgcagccaggggcaaaatatccagacgtagcctcccccaccctgcggaggctattcggcggaaagcccaccaaacaggtgcccatcgcaaccgcagagaacatgaaaaactccgttgtcatcagtaacccgcacgctacgatgacccagcaggggaacctcgattccccttcaggctctggtgtgctgtccagcggaagctcctcccccctgtacagcaagaacgttgacctgaatcagagccctctggcctcttccccctcaagtgcccattctgcgcctagtaactcgctgacctgggggacaaacgcatcctcctcatccgccgtttctaaggacggactgggatttcagagcgtctcatcccttcacacctcatgcgagtccatcgacatctccctctcgtccgggggagtccctagccataactcctccacaggcctgatagccagctcaaaggatgactccctcacaccatttgtgcggaccaatagtgtgaagactacactgtcagaatcaccgctttctagccccgctgcaagcccgaaattctgtagaagtactctgccgcgtaagcaggactccgacccccacctggaccgtaatactttgcccaagaagggactgcggtatacccctacgtcacaacttagaacccaggaggacgcgaaggagtggctgagatcgcactccgctggcggactgcaagacactgctgccaatagtccgttctcatcgggctcttctgtcacttccccctccggaacccgcttcaacttcagtcagttggcctcacctacgacagtcacccagatgagcctgagcaaccccactatgctacggacacactctctctctaacgcagacggacagtacgatccatataccgattcaagattccgtaatagcagtatgagccttgacgagaagtcaaggactatgtccagatccggctcgtttcgggacgggtttgaagaggaaagctgggagaagtcatctgtggacaatttcgtttcaagattacattcgagcctgcatttctccctgcccctgtttcaccacgctagatatgagctggtccacggttcctcactttcactggtcagctccacatctagtgtgtactctactcctgaggagaagtgccagtccgaaatacggaagttaagaagagaactcgatgcgtcccaggaaaaagtgtctgcccttaccacccagctcacagcaaatgctcacctcgtggccgctttcgaacagtcacttggaaatatgacaatacgcttgcaatcccttaccatgactgctgagcagaaagactctgagttgaacgagctgcgtaagacaatcgaattgctgaaaaagcagaacgctgcagcccaggccgctatcaacggcgttattaatacccctgagttaaattgtaagggcaacggcacagcacaatcagctgacttaaggattcgtagacagcactcttccgatagcgtgtctagcatcaatagtgccacatctcatagcagcgtaggaagtaacatcgaaagcgactctaagaaaaagaagagaaaaaactgggttaacgagctgagatcatccttcaaacaggcattcgggaagaagaagtctcccaaaagtgctagcagtcactccgacatcgaagaaatgaccgactcttctttgccatcgagcccaaaattgcctcataacggcagtactgggagcacacccttgcttcggaactcccactcaaactcactgatcagcgagtgcatggactccgaagcagaaacagtgatgcagcttcgaaacgagcttcgagacaaagaaatgaagctaactgatataaggttggaggctctctccagcgcacatcagctggatcagttacgagaagcaatgaacaggatgcagtccgagattgagaagctgaaagccgaaaatgatcgcctgaagagcgagtctcaaggatcaggatgtagcagagcaccgtcccaggtcagcatcagcgccagtccacgccaaagcatgggtctgagtcagcattcgctgaacctgacggaaagcacttccttagacatgctgcttgacgatactggcgaatgcagtgcgagaaaagagggaggcaggcatgttaaaattgtagtgtccttccaagaagagatgaagtggaaagaggattcccggccacacctgttcctcatcgggtgcattggagtcagtggcaaaacaaaatgggatgtgctggatggcgtggtgagacggctgtttaaggaatacatcatacacgtcgaccctgtgagccagctgggcctgaattcagattccgtcctgggatactcgatcggcgagattaagagatccaacacatccgaaacaccagagttgctcccctgcggctatctggtcggcgagaataccactataagcgtgacagtcaagggccttgccgaaaacagcctagactccctagtcttcgaaagcctcattcccaagcctattttgcagaggtacgtcagcttactaatcgagcaccgccgtatcatcctgagcgggccaagcgggactggcaaaacatacctagctaacaggctgagtgagtatatcgtgcttcgcgaggggagagagcttaccgacggcgttattgccacattcaatgttgatcataaaagcagtaaggaattacgccagtacctctccaacctggccgaccagtgcaatagcgaaaacaacgcagtggacatgcctctggtgattatcctcgacaatctgcatcacgtcagttctctcggtgagattttcaatgggctgctcaactgcaagtatcacaaatgtccttatatcatcggaacaatgaatcaagcaaccagctctacgcccaatctgcagctgcatcacaatttccgctgggtgctgtgcgccaatcacaccgagcccgttaagggctttctggggcgtttcctgcgacgaaagctgatggaaacagagatcagtgggagagttcgcaatatggaactcgtgaaaattattgactggatcccgaaggtttggcatcacttgaatcggtttctggaggctcacagcagcagcgatgtcaccattgggccaaggctgttcctgagttgtcccatcgatgtagacggaagtcgtgtgtggttcactgatctatggaactactctattatcccatacctgctggaggccgtcagggaaggtctccagctatacgggaggcgcgctccatgggaggacccagctaaatgggtcatggacacgtatccttgggctgccagtccacaacaacacgaatggccccctctgctgcagcttaggccagaggatgttggtttcgatggttactcaatgccccgtgaaggaagtacatctaagcagatgcctccgagcgacgcagagggcgatcccctgatgaacatgttgatgcgcctgcaggaagccgcaaactactcctccccccaaagttacgactccgatagtaactcaaactctcatcatgatgatatcttggacagtagcttggaatcgaccttata

SEQ ID NO: 232475 - DNA, 7253 bp, Artificial Sequence
  Description of Artificial Sequence: Synthetic coding sequence
atgtcagttatgctgtggcgatgggaacagaataataccaccatgaaattgcaaatatatactgactgggccaatcactacctggcaaagagtggccataaaaggctgattcgcgaccttcagcaggatgtcacagatggcgtgctgctcgcccagatcatacaagtggttgcgaatgagaagattgaggatattaatggttgccctaaaaatcgctcccagatgatcgagaatattgacgcatgcttgaacttcctggccgctaagggcattaacattcagggactaagtgccgaggagataagaaatgggaatctcaaggctattttgggcttgttcttttccctcagcaggtataagcagcagcagcagcagccacagaaacagcacctttcgtcacccttacctccggctgtgtcacaggtggctggagctcctagccagtgtcaggctgggacacctcagcagcaggtccctgtgacaccacaagcaccatgccagcctcaccagccagcaccccaccagcaaagcaaggcacaggctgaaatgcaaagctccgccagttccaaagacagtagccagtccaagattatcaggttcaccctgggccagaagaaaatttcccgacttcccggtcctactgccagagtatctgctgctggaagcgaagcaaagacacgcggtgggagtactaccgccaacaatcgtcggtcgcagtcttttaataattatgataagtcaaagcccgttacttccccacccccacctcccagttctcatgaaaaggagccactggcctcctcagcttcatctcaccccggtatgtcagacaatgccccagccagcctggagtcagggtcgagttctacaccaaccaattgcagtacgtcatcagcaattcctcaaccgggagcagcaacaaagccatggagaagcaaaagcctgtcagtgaagcactcggccactgtctcgatgttgagtgtaaagcctccgggacccgaggcaccccgaccaacccctgaggccatgaaaccggcacccaataatcaaaagagtatgctagaaaagcttaaattgtttaacagcaagggcggaagcaaggcaggcgaaggtccgggatcccgtgatacctcttgcgaacgcctggagacacttccctccttcgaagaaagtgaagagctggaagccgcttctcggatgctgacaaccgttggcccagcctcctcaagtcctaagatcgcactgaagggcattgcacagaggacgttctcgcgggcacttaccaacaagaaatcttcgctgaaaggcaatgagaaagagaaagaaaaacaacaacgggaaaaagataaggagaaaagcaaggatcttgcgaaacgagcgtcagtaactgaacggttagatctcaaagaagaacctaaagaggacccaagcggtgccgcagtgcccgaaatgccaaagaagtcttcaaaaatcgctagctttatccccaagggaggaaaactcaattctgcaaaaaaagagccaatggcaccctctcactcagggattcctaagcctggcatgaagtctatgcccggaaaaagtccttccgcaccagccccaagcaaagaaggcgaacgctccaggtcagggaaactgagctccgggttgccgcagcagaagccacagctggatggtcgccattcgtccagtagttcatccctagcgtccagtgagggcaagggtcctgggggaaccaccctgaaccattcgatttcttcccaaacggtgtccggtagcgtgggaacaacacaaacgactggtagcaatactgtttcggtccagctgcctcaacctcagcagcaatataaccaccccaacaccgctactgtggccccttttctatacagaagtcagacagacacagagggaaatgttaccgccgagtcaagctcaacaggggtgtctgtggaaccatcacacttcactaagacaggtcagcccgcactggaggagctcactggagaggatccagaggccaggagattacggaccgttaaaaatattgctgacctgagacagaacttggaagaaacgatgagttccttgaggggcacccaggtcacccactctacgttggagaccacttttgacaccaatgtgacaacagagatgtccgggagatccatacttagcctcactggacgccctacacctctctcttggcggctcggccagtcctcacccagactacaggccggtgatgcaccatccatgggcaatggatacccacctcgggctaatgcaagccggtttattaacaccgagtccggcagatatgtttacagcgcaccgctccgcagacagctcgcctccagaggaagttctgtgtgtcatgtggatgttagtgataaagcaggagacgagatggatttagaaggaatttccatggacgctcctgggtacatgtccgatggtgatgtactgagcaaaaacatcagaacggatgatattacgagcggttatatgactgacggcggactgggactctacactaggagactgaataggttgcccgatggaatggccgttgtccgggaaacactgcagagaaacacatcactgggtttaggcgatgctgattcttgggacgactcaagttctgtttcaagcgggatcagcgacactatcgataaccttagtaccgacgatatcaacaccagctctagtatctcctcctacgccaacacacctgctagcagccggaaaaacctggacgtgcagacggacgccgagaaacatagtcaggtcgaaaggaattccctgtggtcaggcgacgacgtgaaaaaatccgatgggggttccgattcagggataaagatggaacctggttctaagtggagaagaaacccctctgacgtgtccgatgaatcagacaagagcacttcaggcaagaaaaaccccgtgatatctcagacaggcagctggagaaggggtatgaccgcccaagttgggatcactatgccacgaacaaaaccctccgctccagccggagccttgaagaccccaggaaccgggaaaactgacgatgccaaggtgtccgaaaaaggcaggttgagccccaaagcatcccaagtcaagagatctccatctgatgcagggagatcgagtggagatgagtctaaaaagcccctacctagttctagcaggacgcctaccgcgaacgccaacagtttcggtttcaagaagcaatctggaagtgccgcaggacttgctatgatcaccgcttctggggtgacagtgacaagcaggagtgctaccctcggcaaaattccaaagtcaagcgctctcgtgtccagatctgccggacgcaagtccagcatggacggcgcacagaatcaggatgacgggtacttagccttatctagccgcacgaacctgcagtaccgatctttgcccaggccttctaagagcaatagccgaaatggcgctggcaataggagctccacttcttcaatcgactcgaatatctcaagcaaatccgcaggtttgccagtgcccaagttgagggagccgtcaaaaaccgctttggggtcatccctccccggactggtgaaccagacggacaaagaaaagggtatctcttctgataacgagtctgtcgcttcatgtaacagtgtgaaggtgaatccggctgcacagcccgttagtagccccgcacagacaagtttgcagcctggggctaagtaccctgacgtggcatcgccaacccttcgaagactctttggtggaaagcccactaagcaggtccctatcgccaccgcggagaatatgaagaattccgtagtgatttctaatccacatgccactatgacacaacagggcaatttagattcccccagcgggagcggggtgctttcatcggggtcttcatctccgctttattctaagaacgtggacctgaaccagtcaccactcgcatcttctccatcctccgcccactccgctccatcaaactccctcacgtggggaaccaacgcttcttcatccagtgccgtgagcaaagatggattgggatttcaatccgtgagctctttgcacactagttgcgagagcatcgacattagcttgagtagcggcggtgtgccatcccataactctagtacaggcctgatagcttcaagcaaggacgactcactaaccccctttgtacgtacgaattctgtcaagactaccctgtctgagtcccctctaagttcacccgcagcatctcctaaattctgcaggtccaccctgccacgcaagcaagattctgaccctcatctggaccggaataccctgcccaaaaaggggctgcggtacactccaacgagccagctgcgaacgcaagaggacgccaaagaatggcttaggtctcatagtgccggaggcctacaagacactgcagcaaactctccatttagtagtggctcctcagtgacaagtccttcaggaacaagattcaatttctcccaactcgcttctcctaccacagtaacccagatgtctctctccaacccaacgatgctccgcacccattcattgtccaatgcagatggacaatacgatccctatacggatagtcggttcagaaacagtagtatgtctctggacgagaaaagccggacaatgagcaggagcggtagcttccgggatggattcgaggaggagagctgggaaaagtcatccgttgacaatttcgtatcccgcctccactcgtctctgcattttagtttgccactgttccatcacgcaaggtacgagctggtccatggttcctctctgtcactcgtgagttcgacctcctccgtttactctacccctgaagagaagtgtcaatctgagatcaggaaactgagaagagagctggacgcgtctcaggaaaaggtgtcagcattgaccacccagctcaccgcgaacgctcacctggtagccgcttttgaacaatcgctcggaaacatgaccatccgcttacagagtctaactatgaccgccgaacaaaaagattccgagctgaatgaattgcgaaagactattgagctgcttaaaaagcagaacgccgcagcacaggcagcgatcaatggggtgattaatacgccggaacttaactgtaagggaaatggtaccgcccagtccgccgacttgcggattcgccgacagcactcgagtgactccgtatcatcaatcaatagtgctacaagtcattctagcgttggatccaatatcgaaagtgacagtaagaaaaaaaagcgaaagaattgggtgaatgaacttcgtagcagtttcaagcaggcctttggtaagaagaagagtcccaaatccgcctcctcacatagtgacatcgaggagatgactgacagcagcttgccgagcagccccaagctgccccataatggctcaactggctcgaccccactactgagaaattctcatagtaacagccttatcagcgaatgcatggatagcgaagctgaaaccgttatgcaactaagaaatgagctgcgtgacaaggagatgaagttgaccgacatcaggctggaagcgctaagttctgcccaccagttggaccagctgcgtgaagctatgaacaggatgcagtctgagattgaaaagcttaaggcggaaaatgataggctgaaatctgagtctcaagggtcaggctgctccagggcaccctcccaggtgtctataagcgcctctcccaggcagtctatgggtctgtctcagcactcccttaatctgactgaaagtacgtcactggatatgctgctggacgacactggcgaatgttcggcgcgtaaggaaggcggtaggcacgtcaagatagtagtctctttccaagaggaaatgaagtggaaagaagattcgagaccccatcttttcctgatcggatgcatcggagtttccgggaaaaccaagtgggacgtgctggatggcgtcgtgagacggctttttaaggagtatattatccacgtagatcctgtgtctcaactgggtctgaactcagatagcgtgcttggctactcaattggggagatcaagcggtcaaatacatccgagactcccgagctccttccctgcgggtaccttgtgggggagaacacgaccatctcagtcacggtcaagggcctcgctgaaaactcactggactctctagttttcgaatcccttattcctaagcccatccttcaacgatacgtaagcctccttatcgagcaccggaggattatattgagtggcccatctggaacaggaaagacatacctcgcaaaccgactttccgagtatatcgtgttgagagaaggcagggagctcaccgatggcgtcatcgctaccttcaacgtggatcacaagtcttctaaagaactgcgtcaatatttgtctaacctcgctgaccagtgtaattccgagaacaacgcagtcgatatgcccctcgtaatcatcctcgataacctgcatcatgtgagcagtctcggtgaaatttttaacggcctcctgaattgcaaatatcacaaatgcccctatatcattggcacaatgaaccaggccacaagtagcacaccaaacttgcaacttcatcataatttccggtgggtcttatgtgcaaatcacactgaaccagtgaaaggctttctcggcaggttccttagacggaaattgatggaaacggagatttccgggagggtacgcaatatggagttggtaaaaattattgattggatccccaaggtatggcaccatctgaataggttcttagaagcacattcctcgtctgacgttaccattggtcctagattgtttcttagttgcccaatcgatgtggatggtagcagagtttggttcaccgacctgtggaactactctatcatcccttatctgttggaagcagtcagggaggggctgcaactatacggccgtcgcgcaccatgggaggaccccgcaaagtgggttatggatacctatccttgggctgcctctccccagcagcacgagtggccgccactcctgcagctaagacccgaggacgtggggtttgatggatattccatgccacgggagggctcaacctctaagcagatgcctcctagtgacgcagaaggggaccctctaatgaacatgcttatgcggctgcaggaagccgctaattactcctccccacaaagttacgattcagactctaatagcaattcccaccatgatgacatccttgactcctctctggaatctactctcta

SEQ ID NO: 232476 - DNA, 4482 bp, Artificial Sequence
  Description of Artificial Sequence: Synthetic coding sequence
atgttatggcctcgaaatcttacttcgtgggatgacagtagctcagtgagcagcggcattagtgataccattgacaacctttctaccgacgacataaacacgagttcctctatcagttcttatgccaatacaccagcctcttcaagaaaaaatctagatgttcagactgatgccgaaaaacactcccaggtcgaaagaaattcgttgtggagcggtgacgacgttaagaagtccgacggaggcagcgactctggcataaagatggagcccggatcaaaatggaggcggaatccctcagatgtgagtgacgagtcggataagtcaacatctggcaaaaagaaccccgttatatcccagacgggctcctggagacgcggaatgaccgcacaagtgggtatcactatgccgcgaaccaagcctagcgcacccgctggggcactcaaaactcctgggaccgggaagactgacgatgccaaggtgagcgaaaaggggaggcttagtcccaaggctagccaggtgaagaggtctccttctgacgcaggcagaagtagtggcgatgagtctaagaagccactgccctcaagctcccgtacacctaccgccaacgccaacagcttcggcttcaaaaaacagtccggctcagcggcaggacttgcaatgattactgcttcgggagtaactgtgacctcccgaagcgccacactaggcaagattccaaaaagcagtgctttggtctccagaagcgccggtcgcaaatcatccatggacggggcacagaaccaggacgacggataccttgccctatcaagcagaacaaatctacagtatcgctcactgccaaggccgagcaaaagtaatagtcgcaatggggctggaaacaggagctcgacaagctcaattgactccaatatcagtagcaaaagtgccggacttccagttccaaagctgcgtgaaccatcgaaaacagctcttggctcttctctgccaggactggtgaaccagacagacaaagagaaaggtatatctagcgataacgaatctgtagcctcttgcaactctgtcaaagttaatccagctgcccaaccagtgagttcaccagcgcagacatcactgcagccaggagcgaaatatcccgatgtagcctcgccaacgctgaggcgactgtttggcggtaagccaacaaagcaagtgccaattgccacagccgaaaacatgaagaactccgtggttatcagcaatccccacgccactatgacgcagcagggcaatctggatagtccttctggaagcggcgttttgtctagcgggtcatcgagcccgttatatagtaagaatgtcgatcttaatcagtcaccactggcctcctcacctagcagcgcacactccgccccaagtaacagtctgacttggggaaccaatgcctcaagctcgtccgcagtgagtaaagatggattgggttttcagtctgtatcgagccttcacactagctgtgagagcatcgacatatccctgtcaagtggaggcgttccatctcacaattcctccaccggcttaatcgcttcttccaaagatgatagtctcactccttttgtgcgaaccaactctgtgaagacaaccctgtctgaatccgatcctcatctggaccggaacactctacctaaaaaggggctgcgctatacccctacaagtcagctgcgcacacaggaggacgcgaaagagtggctgcgctcacactccgctgggggattgcaagataccgcggcaaattccccattttcctcaggttctagtgttacaagtccttctggcacccgtttcaacttttctcagctggcttccccaacgaccgttacacagatgagcttatccaatcccacaatgctgcgcacacatagcctttcgaatgctgatgggcagtacgacccctatactgacagccggtttagaaattcttctatgtcactggatgagaagtcacggaccatgagccggtccggatcttttcgggacggtttcgaggaggtgcacggctcttctctttcgctggtgagttcaacctcctctgtttacagcacccccgaggaaaagtgtcagtcagagatcaggaagttgagaagagaactggacgccagccaggaaaaagtttcagccctgaccacacagttgacagcaaacgcacatctggtcgccgcttttgagcagtcgctcggaaatatgacaataaggctgcagagcttgaccatgaccgcagagcagaaggactccgagctgaacgaacttcgcaaaacgattgagctgttgaaaaaacagaatgccgctgcccaggccgctatcaatggagtgattaacacgcccgagctgaattgcaagggaaacggtacagcacagtccgctgatctgaggataaggagacagcactctagcgatagcgtgagttctattaacagtgcgacctcacatagcagcgtgggtagcaatattgaatccgactccaagaagaagaaaagaaaaaattggctgcgatcatcctttaaacaagccttcggtaagaaaaagtccccaaagtcagcctcttcccacagcgacatcgaagagatgaccgacagttccctaccatcgtcgccgaagctgccacacaacgggagcaccgggtctacacctctgctgagaaattcccacagcaactccttaatatctgagtgcatggatagtgaagccgagaccgtaatgcaattacggaacgagctccgggacaaggagatgaagctcaccgacattaggttggaagccctgtcgagtgcgcatcagcttgaccagctgagagaggctatgaaccggatgcagtcagagatagaaaaacttaaggccgagaatgacagactcaagtctgagagccagggctcaggatgtagtcgggctccatcccaggtctctatctctgccagccctaggcaatctatggggctctcacagcacagtttgaatctcaccgagtccacatctttggacatgctgctggacgacacgggcgagtgttcggcgaggaaggagggtgggagacatgtgaagattgtcgtctcgttccaggaggaaatgaaatggaaagaggacagtaggccccatcttttccttatcggctgcattggtgtcagcggaaaaaccaaatgggatgtcctcgacggtgtggtacggagattgttcaaagaatacattatccacgtagaccccgtttcccagctgggcttaaactctgactcggtgcttggctactccatcggcgaaatcaaacgcagtaatacgagtgagaccccggagctgcttccctgtggatacctcgtgggcgaaaacactaccatctcggttaccgtcaagggcctcgccgagaactccctcgattccctggtttttgagagcttgatccctaaacccatcctgcaaagatatgtaagtctgttgattgagcaccggcgaattattctcagcgggccttctggcacaggaaaaacatacctggccaaccggctttctgaatatatcgtgctgagggagggccgagaattaaccgatggagtgatagccaccttcaacgtcgaccataaatctagcaaggagctacggcagtacctctccaacctggcagatcagtgtaattctgaaaacaacgcagtggatatgcctctggtcatcattctggataacttacaccacgtgtcttccctcggggagatcttcaacggactcttgaattgtaaataccataaatgtccctatatcatagggaccatgaaccaggccactagtagtacgccaaatctgcaactccatcataatttcagatgggtgctgtgtgctaaccacaccgaacccgtcaagggtttcttgggccgatttctgaggcggaaattgatggagacggagatctctggccgagttaggaacatggaactggtgaaaatcatcgattggatccccaaggtatggcaccatttaaatcgcttcctggaagcccactcttcatcggatgtgaccattggaccacgattgtttctttcttgccccatagacgtcgacggcagccgcgtgtggtttaccgatttgtggaactacagcattataccgtacctgctcgaagctgtgagagagggtctgcagttgtacggacgtcgtgcgccttgggaggatcctgccaagtgggttatggatacatacccttgggcagcctcgccacagcagcacgagtggcccccattactgcaattgcgcccagaagacgtcggtttcgatggatacagtatgccaagggaaggttccacttccaagcagatgcctccttcggacgccgagggagaccccttaatgaacatgcttatgcgtctgcaggaagctgcaaactactcctctccccaatcttatgactcggattcaaacagcaattcccaccatgatgatattctcgatagctccctcgagtctacactgtag

SEQ ID NO: 232477 - DNA, 2451 bp, Artificial Sequence
  Description of Artificial Sequence: Synthetic coding sequence
atgctgtggcccagaaacctgacttcgtgggatgattcctctagcgtaagttccggcattagtgacaccattgacaatctgtctactgacgacattaacaccagctctagcatttcttcgtacgctaacaccccagcctcttctcggaagaatctagacgtccagactgatgcagagaagcacagccaggtggaacgcaactccctgtggagcggcgacgacgtcaagaagagcgacggcggaagcgactccggaataaagatggagccagggtccaaatggaggagaaatccatccgacgttagtgatgaaagcgacaagagtacctccgggaagaagaatccggtcatctcacaaaccggatcttggaggcggggaatgacagcacaagttggcattactatgcctagaacaaaaccctctgcgcctgccggagcactcaagacccctggaaccggcaaaaccgatgatgccaaagttagcgaaaagggtagactgtccccaaaagcctctcaggttaagaggtccccaagcgatgctggtcgctcttctggtgacgaatctaagaaaccccttccctcctcatcaagaacccccaccgctaatgccaacagctttggtttcaagaagcagtccggctctgcggctgggctggccatgatcaccgcttctggagtgacggtcacttctagatctgcaactcttgggaaaatcccaaaatcaagcgcccttgtcagcaggtccgctgggagaaaatccagcatggatggggctcagaatcaggacgatggctacttagccctcagctcccgtacaaatcttcaatatagatcactccctaggccctctaaatcaaacagcagaaacggagccggaaacagaagttcaacaagctcgatcgatagcaacatttcctccaagagtgcagggcttcccgtcccaaaactgagagagccaagtaaaacagccctggggtcatccctgccaggactagttaaccagacagataaagagaagggcattagctccgacaacgaaagcgtggctagctgcaatagcgtgaaggtcaatcccgcagcccagccagtctccagtcctgcccagacttctctccagcctggagctaagtatcctgacgtcgcgtcgcccaccctgcgcagactgttcggtgggaaaccaaccaagcaggtgcccatcgcgacggccgagaatatgaagaactcagtcgttatatctaacccacacgcaaccatgacacagcagggcaatctggacagccctagtggcagcggtgtcctctctagcggctcatcgtcccccctgtactccaaaaatgtggacttgaatcagagccctctggcgagttcaccctcctctgcccacagcgctccttccaactccctcacatgggggacaaatgcctcctcttcttccgcggtctcaaaagatggtctgggtttccagagcgtcagttcgctccacaccagctgtgagagcatagacatctctctgagcagcggcggagttccttcccacaattcaagcactggattgattgctagttccaaagacgactccctcacaccatttgttcgcaccaactccgtgaaaacaaccttatccgaacgctatactcccaccagtcagctgcggactcaagaggacgctaaggaatggctgcggagccacagcgccggagggttacaggatacagccgcaaactccccattttcttcaggctcctccgttacaagcccatccgggactcggtttaatttttctcaactggcatctcctaccaccgttacccaaatgagcctaagtaaccctacaatgctgcgaacacactccctgtccaacgctgacgggcagtacgacccttataccgactcacgattccgcaatagctctatgtcactggatgagaaatcacggactatgtccaggtctggttcttttagagacgggttcgaggaggtgcacggtagcagcttgagcctggtttccagtacttcctccgtgtatagtacacctgaggaaaagtgtcaatcagaaatcagaaaattgaggagggaactcgatgcttcccaggagaaagtatctgcccttaccacccagctgacagccaacgcccatttagtcgcagcttttgagcaatctctgggaaacatgaccatccgcttgcaaagcttaacgatgactgcagagcagaaggactcggaactgaacgagcttaggaagactatagagctgctaaagaaacagaatgccgctgcacaggccgctataaacggggttattaacacccccgagctcaactgcaaaggaaatgggacagcccaatccgccgacttgaggattaggcggcagcacagctctgactccgtgtccagtattaattccgctacatcacactcttcggtggggagcaacattgaaagtgattcttag

SEQ ID NO: 232478 - DNA, 7259 bp, Artificial Sequence
  Description of Artificial Sequence: Synthetic coding sequence
atggctatagacctctattgcggtttagcatgcttgtggggcatacatgagccaaggcagatctacaccgattgggctaaccactacctcgcgaaaagcggacacaagaggctgattagggacctacagcaggatgtgacggacggagtgctgctggcccaaatcatccaggtagtcgcaaatgaaaaaattgaagacatcaatggatgtccaaaaaatagaagtcaaatgattgagaatatcgatgcttgtttaaattttctcgcagctaagggaatcaatatccaagggctgtccgccgaggagatcagaaacggaaacctgaaagccatcctcgggctattctttagcttgtccaggtataaacagcagcagcagcagccacagaagcagcatctaagtagtcccttgcctccagccgtatcccaggttgccggagcgccttcccagtgtcaggccggaaccccacaacagcaggtgccagtcacaccacaggctccatgtcagccccatcagcctgcaccacaccagcagtcgaaagcacaggccgaaatgcagagcagcgccagctctaaagactctagccagtccaaaattattcggttcaccctgggccagaaaaagatttcccggctacctggccctaccgccagggtttcagcagccggttccgaggcaaagactagaggcggttctaccactgccaacaatagacgctcacaatccttcaacaactatgacaagagcaagcctgtgacatcaccccctcctcctccgagcagccatgagaaagagccactggccagcagtgccagttcacacccaggcatgtccgacaacgccccagcctccctggaatcggggtcgtcttctacgccaactaattgttctacaagctctgctatccctcagccgggagcggctacaaagccttggaggagcaagtccctgtccgtgaagcatagtgccactgtatccatgctctccgtgaaacctcctggtcctgaagcccctcgtccaacaccggaagcaatgaaaccggcaccgaataaccaaaagtctatgctggagaagctgaagctattcaactcaaaaggaggctccaaagcaggggaaggtcctggctctcgcgacacgtcctgcgagcgtctggaaacattacccagcttcgaagaatcggaagaactggaggctgcgtcgagaatgctaacaactgtgggccctgccagcagcagtcccaaaattgcgctgaagggaattgcccagagaacattcagcagggcccttacaaataaaaaatcctctctgaaggggaacgaaaaagaaaaagaaaagcagcaacgcgaaaaagataaggagaagagcaaagatttagccaagagagccagcgtgaccgagaggctggacctgaaagaggagccaaaggaggaccctagtggggctgcagtgccagaaatgcctaagaagtctagcaaaattgcctccttcatccctaaggggggaaaactgaattctgcaaagaaagaaccgatggccccttcgcattctggaatcccaaagcctggcatgaaaagtatgcccggaaagtcaccctctgccccagccccttccaaagagggcgaacgatcgagatctgggaaactcagttctggcctgcctcaacagaagcctcaattggacggcagacattcatcatcctcatcctctcttgcttcttctgagggcaaagggcctgggggaacaaccttgaatcacagcattagctcccaaaccgtatctggatcagtggggaccactcagactacaggctctaatacagtgagcgtgcagctgccacagccacagcagcaatataaccaccctaatactgcaacagtggcaccctttttgtacaggtcgcagacggatacagaagggaacgtcacagcagagtcttcatctactggcgtgtcagtggagccctcccactttactaaaaccggtcagcccgctttagaggaactgacgggggaagatcctgaagctcggagactgcggacggttaagaatatcgctgacctacgacaaaatctggaagagactatgtcctccctccggggtacccaggtgacccacagcacgctggagacgactttcgatacaaacgtgaccacagagatgtcaggcaggtccatcctgagcctcactggtaggcctacacccctgagttggcgtctggggcagagctcgccgagactgcaggcgggagatgccccttcaatgggtaatgggtaccctccccgtgccaacgcaagcagattcattaatacagaatctggacgatatgtgtattccgcaccactgcggcgtcagttggctagtagaggttcatccgtgtgccatgtggatgtgtctgacaaagccggtgacgaaatggacctcgaagggatcagcatggatgctcccggttacatgagcgacggagacgtcctcagcaagaatataaggacagatgatattacctccggctatatgaccgacggcggtcttggcctgtacactcgtcgcctcaatcgcttaccagacgggatggcggtggtgagagagaccctgcagcgtaacactagcctcgggctcggggatgccgattcctgggatgactcctcttcagtcagctcaggcatatctgacaccatcgacaacctgtcaacggatgacattaataccagttcatccattagttcttacgctaacactccagccagcagccgaaaaaacctagacgttcagaccgacgctgaaaaacattcgcaggtggagaggaacagtctgtggagcggagacgatgtaaaaaaatccgacggtgggagcgactcgggcatcaaaatggagcctggcagtaagtggcggcgaaacccatcagatgtgtcagacgaatccgataaatccaccagcgggaagaaaaatcccgtgatctcccaaacaggctcatggcgccgaggtatgaccgcacaggtgggtatcaccatgcctcgcacgaagccttccgctcctgctggcgcactgaaaacccccggtacggggaagacggatgacgccaaagtgtctgaaaagggccgtttgtctcctaaggcatctcaagtaaagcggagcccctccgacgccggacgctctagcggtgacgagtcgaaaaagccactaccttcctcttcacgcacccctactgcaaacgccaatagctttggttttaagaaacaaagcgggtcagccgcaggtcttgccatgatcaccgcatctggcgtgacggtgacatcccggtcagccacattggggaaaatacctaagtcatccgcattagtgtcacggtcggccggaaggaaaagcagcatggatggcgcacagaaccaggacgacggatacctagccctcagcagccggacaaacctgcaatatcggagtctgcccaggcctagtaagtcaaacagcagaaatggcgctggaaaccgttcctctacttcatcaatcgactctaatatcagttccaagtcagcaggactccctgttccaaaactgagagagccctctaaaaccgctctggggtcttccctgcccggtctggtgaatcagaccgataaagaaaagggcatcagctcagataacgaatcagtagccagttgcaatagtgttaaagtgaacccagcggctcaacccgtgtcctcgcccgcacagacctctttgcaaccaggagccaagtacccagatgtagcatcgccaacactgcgcaggctgttcggcggtaaacctacaaaacaggtaccgatcgccacggccgagaatatgaaaaactccgtggttatctcgaacccccacgccactatgactcagcaaggcaacttggattcaccttctggtagcggcgttctgtcatctggtagttccagccctctctactctaagaacgtggatttaaatcagtccccactcgccagctcgccaagctctgctcactccgccccttcgaatagcctcacatggggtacaaacgcctcatcctcatcagctgtttccaaggacgggctcgggtttcagtcagtttcgtccctgcacactagttgtgaaagcatcgatatctcactttccagcggaggggttccaagccacaatagttctaccggccttatagcttcaagtaaggacgacagccttaccccgtttgtgaggacgaattcggttaaaaccacactttcagaaagcccactctcctctccagccgcatcacctaaattctgtcgtagcaccctgcctagaaagcaggactcagatcctcatctggacagaaacactcttccaaagaaaggccttaggtacactcctacttcccagcttaggacccaggaggatgcgaaggagtggctccgatcgcattctgctggtggcctacaggataccgcggcaaattccccattcagtagcggcagcagcgtcaccagtcccagcgggactcggttcaattttagtcaactcgcttccccaactacagtgactcagatgtccctgagcaaccctacaatgcttaggacccattcgctgtctaatgccgatgggcagtatgacccatacactgacagtagatttaggaacagctcaatgagcctcgacgagaagtctcgaactatgagccgcagcgggtccttccgtgatggattcgaagaagagagctgggaaaaaagtagcgtcgacaacttcgtcagcaggctccactcatctcttcacttctccttgccactgtttcatcacgccagatacgagttagtacatggatcgagcctcagcctggtgagctccaccagcagtgtgtacagcacacctgaggaaaagtgtcagtcagagattagaaagctgagacgggagctcgatgccagtcaggagaaggtttcagcactgacaacacagctgacagctaacgcgcacttagtcgccgctttcgagcagtcgttaggtaacatgactattcggctgcaatcattgactatgacagctgaacagaaggatagcgagcttaatgagctgcggaagactatcgagttgttgaagaagcagaacgccgcagcacaagcggcaattaacggagtgatcaataccccagagctgaactgtaaaggtaacggaacagcacagtcggcagacctgcgtatacgacggcagcattcctccgactccgtgtcgtccataaatagcgctacatctcacagtagtgtgggtagcaatattgagagtgactccaaaaaaaagaagcggaaaaattgggtcaatgagctgaggtcttctttcaaacaggcgttcgggaaaaaaaagtccccaaaaagcgcatcatcccactccgacatcgaggaaatgaccgacagctctcttccttcatcccccaaactacctcataacggctccaccggatccacgcctctgcttcgcaatagtcacagtaattcacttatttccgagtgcatggactccgaggccgagaccgtaatgcagctgaggaatgagttgagagacaaggaaatgaagcttacggatattcggctagaagctctgtcctctgcacatcagctggaccaactgcgagaggctatgaacagaatgcagtccgagattgagaagctgaaggctgaaaatgatcggctcaaaagtgaatctcagggcagcggatgtagccgagcccctagccaagtgagcatttcggcgtcaccaagacaatctatgggcctgtcacagcactcattaaatctgaccgaatcaacctctctggacatgctgctggatgataccggggaatgcagcgctcgaaaggaaggtggcaggcacgtgaagatagtggttagcttccaagaggagatgaagtggaaggaagactccagaccgcatctgtttctgataggctgtattggggtgtccggaaaaacaaagtgggacgtcctggacggagtggtgagacggctatttaaagaatatatcatccatgtagatcccgtgtcacagctcgggctgaactctgattctgttctgggatattccatcggggaaatcaagcggtctaacaccagtgaaactccggaacttttaccgtgcggatatctggtgggcgagaacacaaccatcagcgtgactgtgaaaggcttggccgagaactctctggatagccttgtgttcgagtctctgatacccaagccaatactccagagatacgtatcacttttaattgaacaccggaggattattctgagtggccctagcggaacggggaagacttatttggcgaatcgactcagcgaatacattgtactgcgggagggacgcgaacttacggacggtgtgattgccacctttaatgtcgaccataagagctcaaaagaactgaggcagtacctgtccaatctcgcagaccagtgcaactcggagaacaatgccgtagatatgccgctggtgattatccttgacaacctccatcatgtgtcctctctcggagagatattcaatggcctgctcaactgtaagtatcacaagtgtccatacatcatcgggactatgaaccaggcgacatccagcacgcctaatctgcagttgcaccacaactttcgctgggtgctgtgtgctaatcacaccgaaccagtgaaaggctttttaggcaggtttctccgcagaaaattgatggaaacagagatctccgggcgtgtgcgcaatatggaactcgtcaaaattatcgattggattccaaaggtgtggcatcacctaaatcggttcttagaagctcactctagcagcgatgtgaccatcgggccacgactgtttctttcttgcccaatcgacgttgacggcagccgcgtgtggtttacggatctgtggaattatagcataattccgtacctgttagaggccgtgagggaaggcctgcagttgtatggcagacgggcaccgtgggaggacccggctaagtgggtgatggatacatatccctgggccgcttctccccaacaacatgagtggcctcctctgcttcagctgaggccagaagatgtcgggttcgatggctactccatgccccgagaaggatcaacatctaaacaaatgccacccagcgacgcggagggcgatcccttgatgaacatgctgatgagactacaggaagcagccaactatagcagcccccagagttatgacagcgattctaatagcaacagtcaccacgatgatatcctggacagctccctagagtctaccctcta

SEQ ID NO: 232479 - DNA, 7097 bp, Artificial Sequence
  Description of Artificial Sequence: Synthetic coding sequence
atggagtcagttagcgaatcctcccaacagcagaagaggaaaccggttatacacggactggaggaccagaagagaatttacacagattgggctaaccactatctggctaagagcggacacaaacgccttatccgcgacctgcaacaggatgtgaccgacggtgtactccttgcccagataatacaggtcgtagcaaacgagaagatcgaagatattaatggctgccctaaaaaccggagtcagatgatcgaaaatattgatgcatgcctgaactttcttgccgcaaagggcatcaatatccagggcctttcagccgaggaaattcgaaatggaaatctgaaggccattctaggtctgtttttttccctgtcccgctataaacagcagcagcagcagccacaaaagcagcatctcagtagcccgttacccccagcagtctcccaggtggcaggcgctccctcccagtgccaggctggcacgccacagcagcaggttcccgtaactcctcaggcaccgtgccagccacaccagcccgcaccccatcaacaatctaaggcacaggctgagatgcagtcaagattaccaggcccaacagcccgtgtgagtgctgctggaagtgaggccaaaacaagaggaggttcgaccacagccaacaaccgacgtagccagtccttcaacaactatgataagtctaagcctgtcacaagcccccctcccccacctagtagccatgaaaaagagccgctggcgtccagcgcaagctctcacccaggaatgtctgacaatgcccctgcctcactggagtcaggctcctccagcacacctactaactgttcgaccagctccgccatccctcagcctggtgctgccaccaagccgtggcgtagtaagtctctgagtgtcaagcacagcgcaacagtttcaatgctttccgtgaaacccccagggcctgaagcccctcggccaacacccgaagccatgaaacctgcgcctaataaccagaagagcatgctggaaaagctgaaactgtttaactcaaaaggcggaagtaaagctggcgagggtccaggatctagagacacttcctgcgaaagactggaaacattgccttcattcgaggaaagcgaggagttagaagccgcaagtcgcatgttaaccaccgtagggcctgcaagttcatctcctaagatagctctaaagggcattgcgcagcgcactttttcaagagctcttactaataaaaaaagcagtctcaaaggcaatgaaaaagagaaggagaaacagcagagagagaaggataaggaaaaatccaaggatctcgcgaagagagcaagtgtgacggaaaggctagacttgaaagaggagcccaaagaagacccctctggggcagcagtaccggaaatgcctaagaagagctcaaagattgccagcttcattcctaaaggaggtaagctgaacagtgctaagaaggagcccatggccccaagtcatagcgggatcccaaagccaggtatgaagtcgatgccgggaaagtcccccagcgccccagcaccatccaaggagggagaaaggtcccggagtgggaagctgagttctggtttacctcaacagaaacctcaactggatggacggcattcatctagcagttcctccttggcctcttcagaagggaaggggcctggagggacaactttaaaccacagtatcagtagccagaccgttagcggctccgtcggaaccacacagactacaggctcaaacacggtgtctgttcaactgccccagccccagcaacagtacaaccatccaaacaccgctaccgttgcgccatttttgtatcgctcccaaactgatactgaaggtaatgtgacggcggagtcttcttcaaccggtgtttccgtggaaccttctcattttacgaagactgggcagcctgccctggaggaactcactggcgaggacccggaggccagaaggctgcggactgtgaaaaatatcgctgatctgcggcagaatctcgaggagaccatgagtagccttaggggcacccaagtgacacacagtacactggaaacaacctttgatactaacgtcactaccgaaatgagcggacggagtatattatcccttacagggaggcccacccccctctcctggcggctgggtcagtcttcacccaggctccaggctggcgacgctcctagcatgggcaatggctacccccctcgagctaatgcttcacgattcattaatacagaaagcggcaggtacgtgtattccgctccgctgcgaaggcagctagcttcaagaggcagctcagtctgccacgtcgacgtcagcgataaggctggcgacgagatggacttggaggggatttccatggatgctccgggatatatgagtgacggtgacgttctcagcaagaacattaggacagatgatattacctcaggttatatgacagatgggggactgggcctgtatactagacgcctgaaccgtcttcccgatgggatggcagttgtgcgggagacactacaaaggaatacctcactcggccttggggatgcggattcttgggacgactcatcgtctgtatcatctggcatctccgataccatcgataacctgagcacggacgacattaatacctctagcagcatctcttcttatgccaacacccctgcctctagccgcaagaacctggatgtccagacagacgccgagaaacactctcaggtcgaacgcaattctttgtggagcggcgacgatgtgaagaagtctgatggagggtccgacagtggtatcaagatggaacccggatcaaagtggcggagaaacccttccgatgtgtctgacgagtctgacaagtccacttccggaaagaaaaaccctgtgatttctcagaccggatcctggagacgtggcatgactgcacaggtcggaataaccatgccgagaacaaaaccctctgcgcctgcaggtgccttgaagacaccaggcactgggaaaactgacgacgctaaggtgtcagaaaagggacgcttgtctccaaaagcatcccaggtcaaacggtccccatctgacgctggcaggtctagtggggacgagagcaagaagcctctccccagctcctctcgcacgccaaccgctaatgcaaactcatttggattcaagaagcagagcggctctgcagccggattggcaatgattactgcttcaggcgtgacagttacctccaggagcgcgaccttagggaagatcccaaagtcctctgccttggtgtcccgcagcgccggacgtaaatcctctatggatggagcccagaatcaggatgatggctatttggctctgtcttcccgcacaaacctccagtatcgctcactccctcggccaagtaaaagcaattcgcgtaacggggctggaaaccgtagctcaacctcaagcatagactctaatataagctctaagagtgctggtctcccagttcccaaactcagagaaccgtctaagactgccctgggatcctcattgcctggactggttaaccagacagataaggaaaaaggaatcagctctgacaacgaatcagtggcttcttgcaactccgtcaaagtcaatccagccgcacagcctgtgtccagccctgcgcagacatccctgcagcccggtgccaaataccctgacgtagctagtcctaccctgaggcgactgtttggcggaaagccaaccaagcaggtgcctatcgccacagccgaaaatatgaaaaattctgttgtgatcagcaatccccacgcaacaatgacccaacaaggcaacctggactcaccatccgggagtggtgtgctgtccagtggtagcagcagccccctgtattccaaaaacgtggacctgaatcaatcaccgttggctagcagtccgagctcagcccattctgcgccaagcaactcacttacttggggtaccaacgcgtccagtagttctgccgtgtccaaggacggactggggttccaaagcgtttctagcctgcatacaagttgcgaaagcatcgatatctctctcagcagcgggggtgtcccttcccataatagcagtactgggctgattgcctcaagcaaggatgacagtttaacccctttcgtgagaactaacagcgtaaaaacaacgttgagcgagagtcccttaagctcccctgccgcaagccctaaattctgccggtcaacgctgccaagaaaacaggactcagatccacatcttgaccgaaacaccctcccgaagaaaggacttagatatacgccaacaagtcaattacgcacgcaggaggacgccaaggagtggttgagaagccatagtgcaggcggtctgcaggataccgcagccaactctccgttctcatccggatcgtctgttacttccccttctggcactaggtttaactttagccagctggcctcgccaaccacagtgacacagatgtctttgtctaacccgaccatgcttcgcacccactctctgagcaatgccgacggtcaatatgacccttataccgattccaggtttaggaacagtagcatgtcactggacgaaaaaagtcggacaatgagccgatctggcagttttcgcgacggcttcgaggaggtgcacggctctagcctgtccctcgtatcctccacctcttctgtttactctacgcccgaagaaaaatgtcagtctgaaattaggaaattgagacgggaactggacgcgagtcaggaaaaagtgtccgccctgaccactcagcttacggcgaatgcacatcttgtggcagcttttgagcagtccctgggaaatatgaccataaggctgcagtcactgactatgacagcggagcagaaagactcagaacttaacgaactgaggaagaccattgagctgctcaaaaagcaaaatgcggcagcgcaggcagccatcaatggagtgattaatacaccagagctgaattgtaaaggaaacggcacggcacagagcgcggacctgcgcattaggcggcaacatagctccgatagcgtcagttctatcaacagcgcgacctctcacagttctgttggcagtaacatcgagagtgacagcaaaaagaagaaaaggaagaattggctgagaagttcttttaagcaagcctttggcaaaaagaaatctccaaagagcgcttccagccattctgacatcgaagagatgacggacagtagcctgccttcgtcccccaagctgcctcataacggcagtactgggtccacccccttactgcgcaactcacattcgaattccctgatcagtgagtgcatggacagcgaggctgagaccgtcatgcagttgcggaacgagctgagggataaggaaatgaagctgacggatatccggcttgaagcattgagcagtgctcatcaactggaccagctacgcgaagccatgaaccgtatgcaaagtgagatcgaaaagctcaaggccgagaacgaccgcctgaagtcagaaagccagggtagtgggtgtagtcgggcaccatctcaggtttccatctctgcttcccctaggcaaagcatgggcctttcccagcacagcctcaacctgaccgagtcaacctccctcgatatgttactagacgatactggtgaatgctccgctaggaaggaagggggtcgccatgtaaaaatcgttgtgtcctttcaggaggaaatgaaatggaaggaggatagccgtccccatctgttcctgatcggttgtattggagtgtctggcaagacaaaatgggacgtcttagacggggttgtgagacgtctcttcaaggagtacatcatacatgtagatcccgtgtcccagctgggcttgaactcagattcggtgctcggctactccattggcgaaatcaagaggtctaacacctctgaaaccccagagctacttccatgcggctacttggtcggcgagaacactaccatttctgtcaccgtgaagggcctggcggaaaatagccttgattccttggtttttgagagtctcattcccaagcctatcctgcagcgttatgtatctctgctgattgagcaccgtagaatcatcctgtctgggcctagcggaacaggaaaaacatatttagcaaatagactgtccgaatatattgtgctgagggaaggcagggagctcaccgatggagtgattgccacatttaatgtggatcacaagtcttctaaagagctgaggcagtaccttagtaatctggccgatcagtgcaactccgagaacaacgcagtcgatatgccgctggtcatcattctcgataacctgcaccatgtgagctccctgggagagatctttaatgggctgctcaactgtaagtatcacaaatgcccgtacatcattggaaccatgaatcaggccacaagtagtacaccaaacctgcagctgcaccataattttcgctgggtactctgcgcaaaccacacagaacccgtgaaggggtttctaggcaggttcctacgtcgcaagctcatggaaaccgagatcagtggccgtgtgcgcaacatggagctggtgaagatcatcgattggattcctaaggtgtggcaccatcttaacagattcctggaggcacactcatccagcgacgttaccatcggccctagactgtttctttcctgtcccattgacgtggacggaagtagagtttggtttaccgacctgtggaattatagcatcataccctatttgttggaggccgttcgggagggacttcagctttacggcaggagggccccttgggaagatccggcaaagtgggtgatggatacttacccttgggctgcttcacctcagcagcatgaatggccgcctttactccagctccgacccgaagacgtaggtttcgacggatacagcatgcccagggaggggtcgacctccaagcagatgcctccctccgatgcagagggggatcccttaatgaatatgctgatgcgactgcaggaagcagccaactatagctcgcctcagtcatatgacagcgatagtaattctaattctcatcacgacgacattctggacagctcgctggagagcactctgta

SEQ ID NO: 232480 - DNA, 1089 bp, Artificial Sequence
  Description of Artificial Sequence: Synthetic coding sequence
atgttcagtagcgtggctcatctagcgagggctaacccctttaacacgcctcacctccagttagtgcacgatggcctcggagacctgcgcagttccagcccagggcctacagggcagcccagacggccacgtaaccttgctgcggcagctgtcgaggaacagtattcatgcgactatggttccgggaggttcttcatactgtgtggactcggtggaattattagctgtggcaccacacacacagccctggtcccacttgatttggtaaaatgccgaatgcaggtggaccctcagaaatataaaggtatcttcaacggcttcagtgtgaccctcaaagaggacggtgtcagaggactggcaaagggctgggcccctactttcctaggatactccatgcagggcctgtgtaaatttggcttctacgaggtttttaaagtcctgtatagcaacatgctgggagaggagaacacgtacctgtggcggacctccctgtatctggctgccagcgcctcagccgaattctttgccgatatcgcgctggcccctatggaggccgcaaaggtgcgaatccagacacaaccgggttacgccaacacactcagggatgcagctcccaaaatgtataaggaagaaggcctgaaagctttctataaaggcgtcgccccactgtggatgcgtcagatcccctacactatgatgaagttcgcctgcttcgaaagaacggtggaagcactctacaagtttgtggtccccaaaccgcgaagcgaatgtagcaaacccgagcaattagttgttacattcgtcgctggctatatcgctggggtattctgtgccatcgtttcacatcccgctgatagcgttgtgtctgtgctcaacaaggagaaaggaagctccgcttctctggtccttaagcgactggggttcaagggagtgtggaagggccttttcgcacgaattataatgatagggactctaaccgcactgcagtggttcatctacgactcagtcaaggtctattttcgactgcccagacccccacctcccgagatgcctgagtcattgaaaaagaagcttgggctcacccaatag

SEQ ID NO: 232481 - DNA, 6561 bp, Artificial Sequence
  Description of Artificial Sequence: Synthetic coding sequence
atgccagtcctcggtgtcgcctcaaaactacggcagccagccgtgggttctaagccggtgcacacggcgttacccattccaaaccttggcaccacaggcagtcagcactgttcatcccggcctctcgagctgactgagactgaaagttccatgctgtcatgccagttggctctcaagtcaacatgcgagttcggggaaaagaaacccttgcaggggaaagcaaaggaaaaggaggacagtaaaatttatacagactgggcgaaccactacttagcaaagagcgggcataaacgcctcatcaaagatctgcagcaagatatagctgacggggtcctgctagccgagatcatacagattatcgccaatgagaaagtcgaagatatcaacggctgtccaagaagccaaagccagatgatagaaaacgtggacgtttgtttgtcatttctggccgctaggggagtgaatgtgcaaggcctgtccgccgaggaaatcaggaatggtaatttgaaggcaattttgggtctgtttttctccctgtctagatacaagcagcagcagcatcaccagcagcagtactaccaatcactggttgagcttcagcagcgcgtgacacacgcgtccccgcctagcgaggcctcacaggcaaagacacagcaggatatgcagtcctcgcttgccgctcgatacgccacacagtccaaccactcgggtatagctacatctcagaagaagccgacacgcctgccaggcccatcccgtgtacctgctgcaggttctagcagcaaagtgcagggcgcttccaacctgaacagacggagtcagagttttaactctatcgacaaaaataaaccacctaattacgccaacggtaatgagaaagattcaagcaaagggccacagtcaagcagtggagttaacggtaatgtgcagccaccttctaccgccggacagccgccagctagcgctatccccagccccagcgccagcaagccttggcgaagtaagtccatgaacgtaaagcacagcgccacttctaccatgttgacagtgaagcagagcagcacggcaacaagcccgacaccctcatcggatagactcaagcccccagtaagcgagggagttaaaaccgccccaagcgggcaaaagtcaatgctcgagaagttcaaactggtcaacgccagaaccgccctgagacctccccaaccaccgagctcggggcctagcgatgggggtaaggatgacgatgcattttctgagtccggtgagatggagggtttcaattcaggcttaaactctggagggagcaccaatagtagccccaaagtgagccccaaactcgccccacccaaagctgggtccaaaaatctttcaaataaaaaatcactgctgcagcccaaggaaaaggaagaaaagaaccgagacaagaacaaggtttgcacagagaagcctgtaaaggaggagaaggatcaggtcacggagatggcccctaaaaaaacaagcaaaattgcaagtctgatccccaagggttcaaaaaccactgcggctaaaaaagagtcacttataccatcttccagcggtatccctaaaccgggatccaaggtccctacagtcaagcagactatatctcctggatctacagcatccaaagaaagtgaaaagtttcgaacaaccaaagggtcgccatcccagtccctatcgaagccaattaccatggaaaaggcatcagctagctcatgtcctgctccccttgagggcagagaagccggtcaggccagcccatccggcagctgcaccatgaccgtcgcgcagagttcaggtcagtctactggaaacggcgcagtacagctcccgcaacagcaacagcacagtcaccccaatacggcaacggttgcacctttcatttaccgggctcacagtgaaaacgaggggaccgctctgcctagtgctgacagctgtacatctccaacaaaaatggacctgtcctactctaaaacggcaaaacaatgccttgaagagattagtggagaagaccctgaaactcggaggatgaggaccgtgaaaaatatagccgatctacggcaaaatcttgaggaaaccatgtcctcccttaggggaacacaaattagtcactctactcttgaaaccactttcgattccacggtcactacagaagtaaacggcaggaccattcctaacctgacttctcggcctaccccgatgacttggcgtttagggcaggcctgtcctcgcctgcaggccggagatgcccctagtctcggagccggttaccctaggtccggaacttccaggtttatccatactgatcccagccgctttatgtatactacgcctttgcgccgagccgctgtttctaggcttggcaacatgagccagatcgatatgtccgagaaggcaagctcagacttagatatgagcagtgaggtcgacgtcggcggatatatgtctgatggcgacattcttgggaaaagcttgcgaacggacgatatcaatagtggatacatgacggacggaggcctgaacctctatactcggagtctcaataggatcccggatactgctacctctagagacatcatccagcgcggtgttcacgacgtcactgtggatgccgattcctgggatgattcgagctctgtatcctcaggcctctccgacactttagacaatatatctaccgatgacctgaacaccaccagttctgtgtcaagttattccaacatcacagtgcctagcaggaaaaatacacaactcaggacagacagtgagaaaaggtctactacagacgagacatgggatagccctgaggagctcaagaagccggaagaggattttgactcgcacggcgacgccggaggaaagtggaaaacggtcagctctggtctcccagaagatccggagaaagcagggcagaaggcttctctttctgtcagccagactggcagttggagaagaggcatgtccgcacaaggcggagcaccctctcgacagaaggctggtacctctgcccttaagacccctggcaaaacggatgacgcgaaggctagcgaaaaaggaaaagctccccttaaaggtagttcgctgcagcgatctccaagcgatgctggaaagtcatcgggcgacgaagggaaaaaacccccaagcggaattgggagaagcacagccacttcgagctttgggttcaaaaagccgtctggagtcggcagcagtgcaatgatcacctcaagcggtgctactatcacaagcggttcggctaccctggggaagataccaaagagcgccgctataggcggaaagagtaatgcgggacgaaaaacatccctcgacgggtcacagaaccaagatgatgtggtgctccatgtgtcctccaagaccactcttcagtacaggagcttacctagaccatcaaaatcctcaacgagcggcatccccggtagaggcggtcaccgctccagtacttctagtattgactctaacgtcagcagtaagagcgccggtgcaaccacctcaaaactcagagagccaacaaagattggatccggcagatcctctccagtcacagttaaccagaccgacaaagagaaggaaaaagtcgccgtctcagattccgagtccgtgtctctgagcggctctccaaaatcgtctcccacctccgcctcagcttgtggcgctcagggattgcgccagcccggatcaaagtatcccgacattgcttcacccactttcagacgatacaccccctccagtcgtcaggctaaccaggaagaaggaaaggaatggctgcgctcccatagtaccggcggactgcaagataccggcaaccaatcgccgttagtatctccctcagccatgagtagctcagcagctggcaagtaccacttcagcaatctggtatcacctaccaacctatcccagttcaatctcccaggaccgtcaatgatgcgcagtaactcgatccctgctcaggacagcagcttcgacttgtacgacgatagccagctatgtggaagcgccacatctctggaggaacgtcctcgggctatttcccattctgggtcatttagagatagtatggaggaagtccacggctctagtctaagccttgtgtcatctacttcaagcctgtatagcacagcagaggcagggggtagtcttgagcagatccacaaactcaggagagagcttgtggcttcacaagaaaaggtagccacactcacttcccagctaagcgcgaatgctcacctggtagccgcatttgaaaagtctctggggaatatgacggggaggctacagagtcttacaatgaccgccgaacaaaaggaatccgaactcattgagctccgtgaaaccattgagatgctgaaagcacaaaattccgccgcacaggccgctattcagggagccctcaatgggcctgatcatccacccaaggacttgagaatccggcgacagcattcctcagaaagtgtaagctcaatcaatagtgccaccagccactcctcaatcggctctggcaatgatgctgacagcaagaagaagaagaagaaaaattgggtgaattcacgtggaagcgagctacgatcatcttttaagcaggcatttggcaagaaaaaaagcacaaaacctccgagcagccatagtgacatcgaagagcttacagatagctctttgccggctagtcccaagctgccccacaacgccggtgactgcggtagcgcctccatgaagccaagccagagcgcaagcgctatctgcgagtgtactgaagctgaggctgaaattatcctccaactaaagtcagaactaagggaaaaggaactcaagctcacagacatccggttagaagccctgtcgtccgcccatcacctcgatcagattagggaagcaatgaaccggatgcagaatgaaatcgagatactcaaggcagagaatgatagactgaaggccgagacaggcaacacggcgaagcccacacgcccaccaagcgaatctagttcgtcaacgagctcgtctagcagtcggcagagcctcggcctcagtctaaacaatttgaacatcacagaggctgttagttccgatatattgctcgacgatgccggtgatgccaccggtcacaaggatggccgttctgtgaaaatcatcgtctcaataagcaaaggatacgggagagccaaggaccaaaagtcccaggcctacctgatcgggtccattggagtctctgggaagaccaagtgggacgtgctggatggtgtcatcaggcggctctttaaggaatacgtttttaggatcgacacctccacttccctagggctttcgtccgactgcattgcctcgtattgtattggagacctgattcgctcgcacaacctggaggtgcccgagctcctcccctgcgggtatctcgtcggggataacaacataatcaccgtcaacttaaaaggagtagaagaaaattccctggattcctttgtgttcgacacgctgatacctaaacctattactcaacgatacttcaatttgctaatggaacaccatagaatcatactctcgggaccatccggcacaggcaagacctatttagccaataaactggccgagtatgtgatcaccaagagcggccgaaaaaagacagaggatgccatagcaacttttaacgttgatcataaaagcagcaaagaactacagcaatacctcgccaatctggcagagcagtgcagcgcagacaataatggggtggaattacctgttgtcattattctggataatctccatcatgtcggctcgttgtccgacatctttaacggtttcctgaattgtaagtacaacaaatgtccttacatcattggcacaatgaatcagggggtgagtagtagcccaaatctggaactgcaccacaacttccgatgggtcctttgtgccaaccatactgagccagttaagggatttctaggtaggtacctgagaagaaaactgatagaaatcgagattgagaggaatatccgaaacaacgacctggtgaaaattatcgactggattcccaaaacatggcatcatcttaattcatttctggaaacccattccagcagcgatgtgactatcgggcctagactttttttgccatgtccaatggatgttgagggtagccgagtgtggtttatggacctgtggaattattctctggtgccctatatactcgaagctgtcagggaaggactccaaatgtacgggaagcggacaccttgggaggacccttcaaagtgggtcctggacacctacccatggagctctgcaacactcccccaggaatctcccgcactattgcagttgcggccagaagatgtcggctacgagtcttgcaccagcacgaaagaggcaacaacatccaagcatataccccagacagacactgagggtgatccactcatgaatatgcttatgaaattacaggaggcagcgaactactccagtacacagtcctgtgactctgagtcaacaagccatcacgaggatatcctggatagctccctagagtccaccctttat

SEQ ID NO: 232482 - DNA, 2376 bp, Artificial Sequence
  Description of Artificial Sequence: Synthetic coding sequence
atgactagcctgcacacaagttctgagtccatcgatctgcccctcagccatcatgggtccctgagtgggctgaccacaggaactcacgaagtccagtcactcctgatgcggacaggttctgttcggtctactctttccgagcgctatacccccagcagcaggcaggcgaatcaggaagagggaaaagaatggctgcggtctcactccacaggagggctccaagacactggtaaccaaagtcctctagtgagcccatccgccatgagcagctccgctgccggtaaataccacttttctaacctggtgtccccaaccaacttgtcacagtttaatctgcccggaccttcgatgatgagatccaattccattcctgcacaggatagctcctttgatctttacgacgacagtcagctctgcggttcagcaacctctctggaagagagacctcgggcaatcagccactcagggagctttagggattccatggaagaagttcacgggtcgagtctctctctggtttcgagcacttcaagcctgtatagtactgccattcagaagcctaatatccagcagattcacaagctgagaagagagctggttgcatcacaggagaaagtggctaccttgacctcgcagctgagtgcgaatgcacacctggtagccgcattcgagaagagtttggggaatatgactggaaggttacaatccttgaccatgaccgctgagcaaaaggagagcgagctgattgaattgagagagaccatcgaaatgttgaaagcgcaaaatagcgcagcgcaagcagcaatccagggcgcacttaatgggccagaccacccgccaaaggacttgcgaatacgcagacagcacagcagtgagagcgtatcctccattaactctgctacttctcatagctctatcggctcaggcaatgatgctgatagtaagaagaagaagaaaaagaattggttaagatcgtcctttaaacaggcctttgggaagaaaaagtctacaaaacccccatctagccactccgatatagaagagctgaccgattcctctctgcccgcttcccctaagctgccccataatgcaggggattgcggcagcgcctcaatgaagccaagccagagcgcctcagccatctgcgaatgtacggaagctgaggctgagatcatactccagttaaagtccgagctgagagaaaaggaactgaagttaaccgatataaggcttgaggcactatccagcgcacaccatctggatcagattagggaggcaatgaacagaatgcagaacgagattgaaatactgaaagccgaaaatgaccggttgaaagccgagacaggcaataccgctaaacccaccagacccccatcggaatcaagctcgtccacgtccagcagcagctctaggcaatcacttggcctttcattgaataacttaaatattacagaagcagtgtcgagcgacattctactggatgacgcaggagacgccacgggccacaaggacggcaggtctgtaaagatcattgtctccattagcaaaggctatggacgcgctaaagatcaaaagtcccaggcatatttgattgggtctatcggggtttcaggtaagaccaagtgggatgtactcgacggcgtgattcgacgcctcttcaaggagtacgtctttcgaatcgacaccagcacgtccctgggcttatcttcagactgcatcgcaagttattgcattggggacctgatcaggagccacaatctcgaggtgccggaactcttaccttgcggttacctggtgggtgacaacaatatcataaccgtaaatttaaaaggggttgaggagaacagtcttgatagctttgtgtttgatacactgatccccaagccaattacgcaaaggtacttcaatctgctgatggaacaccaccgcataatattatccggcccaagtggcacggggaagacctacttagcaaacaaactggcagagtacgttataactaagtccggcagaaagaagacggaggacgccatcgcaactttcaacgtcgatcacaaaagcagcaaagaactgcagcagtatctagcaaatttggctgagcagtgttcggccgacaataacggcgtggagttgcccgtggttatcatactggacaaccttcatcacgtggggtctttatcagatatcttcaatggcttcctgaactgtaagtataataagtgtccatatatcattggtacgatgaatcaaggggtttcttcctcgccaaaccttgagttgcatcacaacttcaggtgggtgctgtgtgccaaccatactgaacccgtgaagggctttctcggcagatacttaagaaggaaactcatcgagatctag

SEQ ID NO: 232483 - DNA, 7158 bp, Artificial Sequence
  Description of Artificial Sequence: Synthetic coding sequence
atgcccgtgctgggggtggccagtaagctcaggcagccagcagtggggtccaaacccgtgcacactgccctgccaattcccaatttgggaacaacaggttctcagcactgttccagtcgccctctggagctgaccgaaacagagagttcaatgctttcatgtcagctggcattaaagtccacctgtgaattcggagagaaaaaacctctgcagggcaaagctaaggaaaaggaggactctaaaatttacaccgactgggcaaatcactatctggcaaaatcaggacataagaggctgattaaagacctgcagcaggacatcgccgatggggtgctcctggccgaaatcatacagattatcgcgaacgaaaaggtggaggatatcaacgggtgccctcggtcccagtcgcaaatgatagaaaatgttgacgtgtgcttatcctttctcgccgcaaggggagtgaacgtgcaggggctatctgctgaagaaattcgaaacgggaatctgaaggctattcttggactgtttttcagcctatcccgctacaagcagcagcaacaccaccagcagcagtactatcagagcctggtagagctgcaacagagagttacacatgccagcccaccatcggaagctagccaggcaaagacgcagcaggatatgcaatcttctctcgccgcacgctatgccacgcaaagcaaccattccggtattgctactagccagaaaaagcctaccaggctgcccggtcctagcagagtacccgctgcgggatcctcgagcaaggtacaaggggcatccaatctcaatcgccgatcacagagcttcaattccatcgataaaaataagcctcccaactacgcaaacggtaacgagaaagacagcagcaaagggccacagtctagctcaggcgttaacgggaatgtgcagcccccaagcaccgctggacagcctcctgcctcagcaattccatcaccctcagcatccaaaccatggcgcagcaaatctatgaacgtcaaacactcagccacatcaaccatgctgacagttaaacaaagctccacagcgacttccccgactccctcttcagatcgattgaaacctcctgtgtccgaaggagtaaagacagctcccagcggacagaagtcaatgctggagaaattcaagctggtgaacgccagaactgccctcagaccccctcagcccccaagctctggtccttctgacgggggtaaagatgatgacgcattcagcgaatccggcgaaatggagggatttaacagcggcttgaactccggcggatccaccaactcttccccaaaagtgtctccaaaactagcaccaccgaaggcagggtccaagaacctgagtaacaagaaaagcctcctccagccgaaggaaaaggaggaaaagaacagagacaagaataaggtatgtacagaaaaacctgttaaagaagagaaagaccaagttacagagatggcccctaaaaaaactagtaagatcgcctctttgatccctaagggttccaaaaccacagcggctaagaaggagtcgctgatacccagcagctccggcattcctaagcctgggtcaaaagtgccaacagtgaagcagactattagcccgggttcaacagcatcgaaagagtccgagaagttccgtaccacgaaggggagtcctagccagtccctgagcaagcccattaccatggagaaggcgagtgcgtcctcttgtcccgctcctctggagggtcgtgaggccggtcaggcgtcacccagcggaagctgcacgatgactgtcgcacaatccagtggtcagagcaccggcaacggcgctgtccagcttcctcagcagcagcaacattcccaccccaacaccgccaccgtggctccttttatctatagagcccattctgaaaatgaaggaacggccctgcctagcgcagacagctgtacctcccccacaaaaatggacctgtcctacagtaagaccgccaaacagtgcttggaggagatctcgggggaagatcctgaaacgcgaagaatgcggaccgttaaaaacatcgctgacctacggcagaacctggaggaaaccatgagtagcctccgagggacacaaatcagccactccaccttggaaactaccttcgactccacagtaacaactgaggtcaacgggcgaactatccctaacttaacttcccggcctactccgatgacgtggagactaggccaggcatgcccacgactacaggcaggagacgcgccaagccttggggctggatacccacgctcgggcacgagccgttttattcacaccgacccatcgcgatttatgtatacaacacctcttcgtcgtgctgctgtgtcacgcctcgggaacatgtcccagatcgacatgtcggagaaagcgtcctctgatctggatatgagctcagaagttgacgtgggtgggtacatgtctgacggcgacatcctggggaagtccctgagaaccgatgacatcaacagtgggtacatgacagatggtggactgaacttatatactagatcccttaaccgcattcccgacaccgcaacatccagggatatcatccagcgcggagtgcatgacgtgaccgtcgatgcggattcctgggacgactctagcagtgtgtcttcagggttgagtgataccctcgacaacatttccaccgacgaccttaatactacatcttcagtttcttcttactctaatatcactgtgccatcgaggaaaaatactcagttacggaccgattccgagaaacggagcactaccgacgaaacctgggattcacctgaggagctaaaaaagcctgaggaggacttcgactcacatggagacgcagggggaaaatggaaaaccgtctctagcgggcttcccgaggacccggagaaggctggccagaaggcctcactgagtgtgtcacaaacaggctcctggcgacgtggcatgtctgctcaggggggagcgcctagtcggcaaaaagcaggaaccagcgctctaaagactccaggtaaaacagatgatgccaaggcttccgaaaaggggaaggcccctttaaaaggcagcagtctccagcgaagcccatcagatgccggaaaatcctcaggagatgaaggcaagaaaccaccaagcgggattgggagatcaactgccacctccagttttggatttaaaaagccctctggcgtcggctccagcgcaatgattactagcagtggcgctacgattacttccggaagcgcgacactaggtaaaattcccaagagtgcggctatcggcggtaagtctaacgccggtcgaaaaactagcctggatggatcccagaatcaagacgatgtggtactccatgtgtctagtaaaacaactctgcagtaccgtagcctgcctcgacctagtaagtctagtacctctggcattcctgggaggggaggacatcgctcatccacaagttctattgatagcaatgtctctagcaagtccgccggagctaccactagtaagctgagagagccgactaaaatcggaagtggcaggagctcaccggtcaccgtgaatcagacagataaggaaaaggagaaggtcgcagtgtcagactccgaaagcgtgagcctgtcaggaagcccgaaaagcagtcctacatccgctagcgcctgtggagcccaggggttgcgccagcccggttctaaatatccagatatcgcctcaccgacattccgaaggctgttcggggcaaaagcagggggtaagagcgctagtgcacctaacacagagggcgtgaagtcaagtagcgttatgccatccccctccaccacgctggctaggcagggtagtctagaaagcccaagcagcggcaccggatcgatgggatctgcgggtggactgtccgggtcgtcctcacctctgtttaataagccctccgaccttaccacagatgttatttcgctcagtcactcactggcaagttcccctgcatccgtccattcctttacctcaggcggtctagtctgggcagcaaacatgtctagttccagcgctgggagtaaagacaccccgtcttatcagtcaatgaccagtttgcatacctccagcgagtcaattgatcttccactcagtcaccacggatccctgtcaggactcacaaccggaacgcacgaggtgcaatcactgcttatgagaactggttccgtcaggtccacattaagcgagagtatgcagttggatcggaatacattgccaaagaagggcctgaggtacactccgtcaagtcgccaggcgaaccaggaagaagggaaggagtggctgaggtctcattctaccggcggactgcaggacacaggaaatcagtcccccctggtgagcccatctgcaatgtcctctagcgccgctgggaagtaccacttcagtaaccttgtgtctcctacaaacctgagtcagtttaatctccctggccctagtatgatgcgctccaactccatccctgcgcaggactccagcttcgatttgtatgacgacagccaactgtgtgggagcgccacttcattggaggagaggcccagagccatctcacactctgggagcttccgagacagcatggaggaagtccatggcagctccttatccctggtcagcagcactagctctttgtactccaccgcagaagagaaggcacactccgagcagatccacaagctacgccgtgagctggtagcctcccaggaaaaagtcgctaccctgacatcccagctttctgctaacgcacaccttgtggccgcttttgaaaagtctctgggcaatatgacgggaagactacaatctcttactatgaccgccgaacaaaaggagtcggaactgattgagcttagggagactattgaaatgctcaaggcccagaatagtgccgcacaggccgctatccagggggcactgaatggtcctgaccaccccccaaaggacctgaggatacgtagacaacactcctctgaatctgtgtcatctattaactcagctacatcccattcatctattggttccgggaacgacgccgactcaaagaaaaaaaagaagaagaattgggttaacagtaggggctctgaactgcgatcttcctttaagcaggcctttgggaaaaagaaatctaccaaacccccttcttcccattctgacatagaagagctcaccgacagctctctccccgcttctcccaagctcccccataacgcgggtgattgtggtagcgcttcaatgaaaccaagtcaatcagcgagtgccagccccctggtgtggccccctaaaaaacgtcagaatggtcccgtcatctacaaacaccgcagcaggatttgtgagtgcaccgaggcggaagctgaaattatactacagctcaaatccgagctccgagaaaaggaactcaaactgacagacattcgtttggaggcactgtcttctgcacaccatctggatcagattcgggaagcgatgaatcggatgcagaacgagatagaaatcttgaaggccgaaaacgacagactcaaggcggagaccggtaacacagcgaagcccactcgcccaccatcagagtcaagttctagcacctcctccagcagcagtaggcagagccttggcttgagtttgaataacttgaacataacagaagctgtctcaagcgacatcctcctggacgatgcaggggatgccactggccataaggacggtagaagtgtgaaaataatcgtctcaatctcaaaaggttacggtcgggcaaaagatcagaaaagtcaggcatatctcataggatcaatcggcgtctccggaaaaaccaagtgggacgtactggacggggttataaggagattgtttaaagagtacgtctttaggattgataccagcacctccctcggattaagctccgattgtattgcttcatattgcataggcgacctgataaggtctcataacctcgaagtgccggagctgctgccatgcggttacctggtcggcgacaacaatattattacagtaaaccttaagggggtggaggaaaatagcctggattccttcgtcttcgacactcttatccccaagccgatcacacagagatactttaatctgctaatggagcaccaccgcattatcctgtcaggccctagcggtacaggaaaaacctaccttgccaacaaactagctgagtacgtgataacaaaatccggacggaaaaagacagaagacgcaattgcaacttttaatgttgatcataagtctagcaaagagctccagcagtaccttgcaaatctagctgagcagtgtagcgctgataataatggagtggaactgccagtggtgatcatcttggataacctgcaccacgttggcagtttgtctgatatcttcaatgggtttctgaactgcaaatataacaagtgcccctatatcatcggtacgatgaatcaaggtgtctctagcagtcctaacttagagctccaccacaatttccgctgggtactgtgtgcaaaccataccgagccagtgaagggctttttgggccgttacttgcgcaggaagttaatagagatcgagatcgaacggaatatccgcaataatgatttagttaaaattattgactggatccctaaaacatggcaccatctgaactcctttcttgaaacgcatagctcttcagatgtcacgattggtcctcggctcttcctgccctgcccaatggatgtggagggcagtagggtgtggtttatggacttgtggaattatagtttagtgccgtacatccttgaggctgtgagggagggtctacagatgtacggtaagagaaccccttgggaagacccgtcaaaatgggtcctggacacttacccgtggtcatcagcaacactccctcaggaatctccagccttactgcagctaaggccggaggatgtgggatatgaaagttgtacttccactaaagaggctaccactagtaagcacataccccagaccgatacagagggggatccgttgatgaacatgttgatgaagctccaggaagcggctaattattccagcacccagagctgcgatagcgaatcaacttcgcatcacgaggacatactagattctagtctcgagtccaccttgtag

SEQ ID NO: 232484 - DNA, 7091 bp, Artificial Sequence
  Description of Artificial Sequence: Synthetic coding sequence
atgcccgtgttgggcgttgcttcaaaattgagacaacctgcagttgggagtaaacccgtccatacagcgttgcccatccccaacctggggaccaccggaagccagcactgcagcagtcgacccctggaactgacagaaacggagtcaagcatgctttcctgtcagctcgccctgaaaagcacctgcgaattcggggagaagaagcccctgcaaggaaaagctaaggaaaaggaagactctaagatttacaccgactgggcaaatcattacttggcaaaatccggtcacaaacgattgattaaggacctgcaacaggatattgctgacggggtgttacttgccgagattatccagatcatagctaatgaaaaggttgaggatataaatggatgtcctcgctctcaaagccaaatgattgaaaacgtagacgtgtgcctgtcgtttctggctgctagaggcgtgaatgtccagggtctaagcgccgaagaaatacgcaacgggaatctgaaggccattctggggctctttttctcgctgagccgttataagcagcagcagcaccatcagcaacaatactaccagagcctggtggagctgcagcagagagtgacccacgctagcccaccttctgaggcctcccaggcgaagactcagcaagatatgcaaagctcgctggctgctaggtacgcgactcagagcaaccacagcggaattgccacatctcagaaaaagcccacacgcctgccaggccctagccgagtaccagcagctggatcatcttcgaaagtgcagggcgcaagcaacttaaacagacgcagccagagttttaactcaattgacaagaataagcctcctaattatgccaacgggaatgaaaaggactcttctaagggaccccagtcaagctccggagtgaacggaaatgtgcagcctcctagtacagcgggtcagcctccagcatctgcgatcccgtccccatcagcaagcaagccatggcggtccaaatcaatgaacgtcaaacattctgcgacctcaaccatgctgacagtaaagcaatcaagcacggcgacctcacccacacccagctccgacagattaaagccccctgtgtctgagggggtgaaaacggctccctctggccagaaatccatgctcgagaagttcaaactcgtcaatgctaggaccgctctgaggccccctcagccaccgtcgagtggcccttccgacggaggtaaagacgacgatgcattttctgaatcaggcgaaatggaggggttcaatagcggactcaactcaggcggaagcaccaacagtagcccaaaggtgtccccaaaactggctccaccaaaggcaggaagcaagaacctgtccaacaaaaaatccctactgcagcccaaggaaaaagaggagaagaaccgggataagaataaggtctgtaccgagaagcccgtcaaggaggagaaagatcaggtaacagaaatggcaccaaagaaaacgagtaagattgcctcattgatcccaaaaggctcgaagacaaccgcagcaaaaaaggagagcctcataccgtccagttccggaattccaaaacctgggtccaaggttccaaccgtgaaacagacaatttctcctggcagtaccgcaagtaaggaatcagaaaagtttcggacaacaaaggggtccccatcccagtcactgtccaagcctataaccatggaaaaggcctcagccagtagttgccctgcccctctcgagggaagagaggctggtcaggcgtccccctccggatcctgtactatgacagtggcccagtcaagtgggcagtctaccggaaatggcgctgttcaactcccccagcaacagcagcacagtcatccaaatacggccacagttgctccgttcatctatagagcacatagtgaaaatgaaggaactgctctcccatccgctgactcatgtacctctccaacgaagatggacctgtcctactcaaagaccgcaaaacagtgtttggaagagattagtggagaggacccagagacacgacgcatgaggactgtgaagaatatcgccgatctgcgccagaaccttgaagagacaatgagttcccttaggggaactcagatatctcacagtacactcgagacgacatttgatagcacggtcactaccgaggtcaatgggagaaccatccctaacctgacctccagacccacgcctatgacgtggcggctaggccaggcatgcccgagattgcaggctggcgacgccccttctctgggcgcaggctaccctcgatccgggacgagccggttcatccacaccgatccctcaagattcatgtatacaactcctctgcggagggccgctgtgtctcggctggggaatatgagccagatcgatatgagtgaaaaagccagcagcgatctggatatgtccagtgaggtggatgttggaggttatatgagcgatggcgacattctgggaaagtccctccgaacagatgacatcaattctggctatatgacggacggtggcctgaacttgtatactcggagtctgaaccgtatccccgacaccgcaacaagccgggatatcatccagcgcggtgtgcacgacgtgaccgtggatgcggactcatgggacgattcctcatccgtgtcgtctggattatccgacaccttggataacatttcaaccgacgacctgaacaccaccagtagtgtgagctcctattcaaacataaccgtgccctctcgaaagaatactcagctaaggactgacagcgagaaaagatccacgaccgatgaaacgtgggatagccccgaggaactgaagaagccggaggaagattttgactcccacggcgatgcaggtggcaagtggaaaaccgtaagctctgggctgccagaagatcctgaaaaagccggtcagaaagcatctctctcagtgagccagacaggctcctggcgtaggggcatgtctgcgcaggggggagcccctagccgtcagaaagcaggcacatccgccttgaaaacacccggaaaaacggacgacgctaaggccagcgaaaagggaaaggcaccgctgaaaggttctagtttgcaaagaagtccttctgatgcaggaaagtcatctggggacgaaggcaagaagcctcctagtggtattggcaggtccaccgcaacgtcaagtttcgggtttaaaaagccatctggtgtgggctcatcagcaatgataacctctagcggcgcaactattacatcagggagcgcaaccctgggaaagataccgaaatctgcggctataggaggaaaaagtaacgccggacggaagacctcacttgacggaagtcaaaaccaggatgatgtcgttttacacgttagcagtaagacgacacttcagtataggtctttacccaggccctcaaaatccagcacaagcggaataccgggaagagggggtcaccgcagcagtacctctagcatcgactcaaacgtgtcaagcaagtccgcaggagctacaacctcaaaactgagagaacccacgaagattggtagtgggaggtcctcccctgtgacagtgaatcagactgataaggagaaggagaaggtggcggtatctgatagcgagagcgtaagtctgtcaggaagccccaagtcgagccccacttccgcaagtgcctgcggtgcccagggccttcgtcagccgggaagtaagtacccagacatcgcctctccaacctttaggcgacttttcggcgctaaggccggtgggaagtctgcatctgccccaaataccgaaggtgtcaaatctagcagtgtcatgcccagtccgtctacaactctggcaagacagggcagcctggaatctccctcatccggcactggctctatgggatctgctgggggactctccgggagctcgtcgcctttgtttaacaagcctagcgatctaacgactgatgtcatcagcctcagccactctctcgcttcgtccccagcgagcgtccacagctttacttcgggtggactggtatgggcagccaacatgtccagttcttctgcgggatctaaggatactccttcctatcagtcaatgactagcctacacactagtagcgagtctattgatctccctctttcgcatcatggaagtttgtctggtctgaccactggcacccatgaggtgcagtctctcttaatgcgtacagggagcgtccgaagtacactctccgagagcatgcagctagaccggaataccttaccaaaaaaggggctaaggtacacaccttcctcgaggcaggcgaatcaggaggagggcaaggagtggctgcgaagtcacagtactggaggcctgcaggacacagggaaccagtcccctctggtgtccccaagtgccatgtccagctccgccgctggcaaataccatttcagcaaccttgtttcccctacgaaccttagccaatttaaccttcccggtccctccatgatgaggtcgaacagtatccccgctcaggactccagcttcgacctgtacgatgacagccagttgtgtggcagcgctacatccctggaggaacgccctcgagctatttctcattccggcagttttagggattctatggaggaagtgcatggaagctcactgtccctagtttccagcacgtcatccctctactcaactgcggaggaaaaagctcactctgaacagatccacaaactccgcagggagctggtggcaagccaggaaaaggtggctaccctgacaagtcaactgtctgctaatgcacatctcgtggcagccttcgaaaagtcattgggtaatatgacgggccgtctacaaagcctgacaatgacggcagaacagaaggagagcgaactaattgagcttagagagacgattgaaatgctcaaggcacagaattccgctgcacaggctgcgatccagggtgccctaaatggacccgatcatcccccaaaagatctgagaattaggaggcagcatagctctgaatctgtttccagtatcaacagcgccacctcacatagcagtatcggatctggcaacgatgctgacagcaaaaagaaaaaaaagaagaactgggtgaacagtcgtgggtctgagctcaggagttcctttaagcaggccttcggaaagaagaagtccacgaaacccccaagctctcatagtgatatcgaggagttgaccgatagcagcctcccagccagccccaagctgccacataacgccggtgattgcgggtctgcttctatgaaaccaagccaatccgctagcgctatctgtgaatgtactgaagcagaggccgagatcatactgcaactaaaaagcgaactcagggagaaagagctgaaattgactgacatcaggctcgaggcactgagttccgcccatcacctcgaccagatccgggaggccatgaatagaatgcagaatgagattgagattctcaaagcagaaaacgacaggcttaaggccgaaacaggcaacaccgccaaacccactaggcctcccagcgaaagttctagcagcaccagctctagctcctcacgtcaaagtctgggccttagccttaataatctgaatataacagaggctgtgtcctcagacatccttttggacgatgccggagatgccaccggacacaaggatggccgttccgtcaaaattatcgttagcatttctaagggttacggccgagccaaggatcagaaaagccaggcttacctgatcggcagcatcggcgtatcagggaaaactaagtgggatgtgctagacggagtgatcaggcgcctgtttaaggaatatgtgtttcgtattgatacatcaacttccctcgggttgtcttcagattgtatcgcttcttattgcataggcgatctgatccgatcccataatctggaggtgccagaacttctgccctgtggctatcttgttggggacaataatattatcaccgtgaatctgaaaggggtcgaggagaacagtctggatagctttgtgttcgacaccctgattcccaagcctataacccagcgatactttaatctgctgatggagcatcatagaattatcctgtccggcccttccggaaccgggaaaacatacttggcaaacaagctcgcggagtatgttattaccaaaagtggacggaagaagacagaggacgcgattgccacatttaacgtggatcacaaaagttcaaaagagctccagcagtacttagcaaaccttgcagagcagtgttccgctgataacaatggcgttgagttgcccgtggtgattatcctggacaatcttcatcacgtcggtagtttgtctgatatcttcaatggctttcttaattgtaagtacaacaaatgtccatacataatcgggactatgaaccagggtgtgagtagttcaccgaatctggaactgcaccacaacttccgttgggtgctttgtgcaaaccatacagagccagttaagggcttcttgggtagatacctgagacgtaaactgatcgaaatcgagattgaacgtaacatcaggaacaatgatctggtgaaaataatcgattggattccgaagacgtggcaccatttaaactcttttctggaaacacacagtagtagcgacgtgaccatcggcccacgattattcctgccatgcccaatggacgtggaggggtctagagtgtggttcatggacctgtggaactatagtctggtgccttatattctggaggcagttcgcgaaggactccagatgtacggcaagaggaccccttgggaagacccatccaaatgggttctcgacacatacccctggtcctccgcaaccttgccccaggaatccccggcactactccagttgcggccagaggatgtcggctatgagtcctgcacttcaaccaaagaagccaccactagcaaacatattccacagaccgacactgaaggcgacccccttatgaacatgctaatgaaactgcaggaggccgctaattatagtagcacgcagtcttgcgattctgagtccacaagtcaccacgaggacatcctggactcaagtttggaaagcaccttgta

SEQ ID NO: 232485 - DNA, 648 bp, Artificial Sequence
  Description of Artificial Sequence: Synthetic coding sequence
atgaaaaggtgggtcctgtgtgctaatcacacagagcccgttaaagggtttttggggagatacctcaggcgaaaactcatcgagatcgaaattgagcggaacatcagaaataacgatctggtgaagatcatcgactggatacccaagacttggcaccaccttaactctttcctggagacccattcgtcttctgacgtgacaatcggaccaaggctgtttctcccctgtccaatggatgtggaaggttctcgcgtctggttcatggacctctggaactactctttagtcccctacatcctggaagccgtccgcgaggggcttcagatgtatggaaagcggacaccttgggaggatccatccaagtgggtgttggatacatatccctggagctctgccacgctgcctcaggagagccccgctttgctccaactccgcccagaagatgttggctacgagagctgcacatctacaaaggaagccacaacttccaaacatattccacagacagacactgagggggacccgctgatgaatatgctgatgaagctgcaggaggcggctaattactcctcaacccagtcatgtgattccgagtccacttctcaccatgaggatatccttgatagcagtctggagtcgacattgtag

SEQ ID NO: 232486 - DNA, 573 bp, Artificial Sequence
  Description of Artificial Sequence: Synthetic coding sequence
atggggaagtcaaacagtaaactgaagccggaggtggttgaggagctgacaagaaagacatacttcaccgagaaggaggtccaacaatggtataaaggtttcatcaaagactgtccctccgggcaacttgacgccgcaggatttcaaaagatttataaacagttcttcccattcggcgatccgacaaaattcgcaacatttgtttttaacgttttcgacgagaacaaagatgggagaattgaattttctgagttcatacaggccctgtctgtcaccagcagaggcaccctggatgagaaactcagatgggcatttaaactttacgacctagataatgacggatatatcactcgaaatgaaatgctggacatagtggatgcgatctaccagatggtcggcaacactgtggagttacccgaggaagagaatactcctgaaaaacgggtcgaccgcatcttcgctatgatggacaaaaatgccgacggcaagctcacgttgcaggagtttcaggaggggagtaaggctgatccatctatcgtgcaggccttatctctttatgatggattagtttag

SEQ ID NO: 232487 - DNA, 519 bp, Artificial Sequence
  Description of Artificial Sequence: Synthetic coding sequence
atggcaacgatcactgagaaggaggtgcagcagtggtataaagggtttataaaggactgcccctccggccagctggacgcagccggtttccagaagatttacaaacagttcttcccctttggggatcctacgaaatttgccacattcgttttcaatgtgtttgatgagaacaaagacgggcgtatcgagtttagtgaattcatacaagccttatccgtcacttcaagaggaaccctcgacgaaaagctgcgctgggcctttaagctgtacgatctcgacaatgatgggtatatcacccggaatgagatgctggacattgtagatgctatctatcaaatggtgggtaataccgttgagctgcccgaggaggaaaacacccctgagaagcgggttgacagaattttcgccatgatggacaaaaatgcagatgggaagctgacgctccaggagttccaggaagggagcaaagctgatccttcaatagtccaggcactttcgctttacgacggcctggtgtag

SEQ ID NO: 232488 - DNA, 3552 bp, Artificial Sequence
  Description of Artificial Sequence: Synthetic coding sequence
atgcagcttaaaattatgcctaagaaaaagaggctgtctgccggtcgtgtgcccctgatcctgttcctgtgccaaatgatttcagccctggaggtccctcttgacctcgtgcaaccccctaccattacacagcagtctcctaaagattacattattgatcctagggagaacattgtgatacagtgtgaggccaaaggaaaacctcccccaagtttttcatggactcgcaacgggacccattttgatattgacaaagatcctttggtgacgatgaagcctggcaccggaaccttgatcattaacattatgtccgagggcaaagcagaaacatacgaaggcgtttaccagtgtacagcaaggaacgagcgaggggcagccgtctcaaacaatatagtcgttcgaccaagtcgtagccccctgtggaccaaggagaaacttgaaccaattactctgcagagcggtcagagtctagtcctgccttgccggccaccaatcggcctcccacccccaattatcttttggatggacaactccttccagcgcctgcctcagtccgaaagagtgtcccaagggctgaatggggacctctatttctcgaatgtcctgccagaggatactcgtgaggattacatctgttacgctcggtttaatcatacccagacgatccagcaaaagcaaccaatttcggtgaaagtgatctcagttgacgaattaaatgatacaatcgcggctaatctttcggacacagaattctacggagcgaaatccagccgcgaacggccaccaactttcctgaccccagagggcaatgctagcaacaaggaggagttacgtgggaacgtactttctctagagtgtattgcagaggggcttcccaccccaataatttactgggcgaaggaagatggcatgttgcctaagaacagaacggtgtacaaaaacttcgagaaaacactgcagatcatccacgtgtccgaggcagactccggaaattatcagtgcatagccaagaacgccttaggcgctattcaccataccatttccgtgcgcgtgaaagctgccccatattggatcacggctccacagaatctggtcctgtcacccggagaagacgggacactgatctgccgcgctaatggcaatcccaagccccgaatctcttggcttacaaatggtgtgccaattgagatcgcacccgacgatccatcacggaaaatcgatggggataccatcatcttctctaatgtgcaggagaggtcttcagcggtgtatcagtgcaatgctagcaacgagtatggctacctacttgctaacgcctttgttaacgttcttgccgaacccccaaggatcctgacgcccgcaaatactctttaccaggtaattgccaatcgcccagccctgctggactgtgccttctttgggtcaccactccccaccatcgaatggtttaaaggagcgaaggggagcgcactgcacgaggatatatacgtcttgcacgagaatggaaccttagagataccagtggcccaaaaggattcaaccggcacctacacctgtgtcgccaggaacaaactgggcatggccaaaaacgaggtgcatctagaaataaaggaccctacttggatcgtgaagcagcccgagtatgctgtggtgcagagggggagcatggtttctttcgaatgcaaagtgaagcacgaccacacactcagcctgactgtactgtggctcaaagacaatagggagctgccttctgatgaacgcttcaccgttgacaaggatcacctcgtggtcgctgatgttagcgacgacgattcaggcacctacacttgcgttgcaaatactacactcgactcggtatcggctagtgcggtcctgagtgtggtcgatgtcccgaacccccctttcgacctcgaactcactgatcaactcgacaagtcagtacaactgagctggaccccaggagatgataacaactcgccaattacaaaattcataatagagtatgaagatgctatgcacaagcctggtctttggcaccaccagactgaggtctctggcactcaaacaacagcccaactgaaattaagcccttatgtgaactatagcttcagagtgatggccgtaaattctatcggtaaatcactgcccagcgaagccagtgagcaatacttgacgaaggcatccgagcctgacaagaaccctactgcagtcgaaggactgggcagcgaaccggataatctggtcatcacctggaagccactgaatggttttgagtccaacggccctgggctccagtacaaagtctcttggagacagaaggacggggacgacgagtggacaagtgtggtggtcgccaacgtcagcaaatatattgtcagcgggaccccaacatttgtcccttatctaatcaaggtgcaagccctgaacgatatgggcttcgcacccgaacctgctgtggtgatgggacacagcggcgaggacctgcctatggtggctccaggaaacgttcgcgtgaatgtggttaactcgacactagccgaagtccactgggatccagtgcccctcaagtcaatcaggggccacctgcagggctacagaatttactattggaagactcagagcagctcaaagagaaaccgccgtcatattgagaagaagatcttgactttccagggtagcaaaactcacggaatgttgccaggccttgagcccttcagccactatactctgaacgtcagggtagtcaatggaaagggggagggccctgcctcacctgaccgggtctttaatacgcctgagggtgtgccttccgctccaagcagtttgaaaattgtgaacccgacactggattccttaactttggaatgggatccacctagtcatcccaatggcattctgactgaatacaccttgaagtatcagccaatcaattctacacatgaacttggacctttggtcgatcttaagatacccgctaataaaacaagatggaccctgaagaacctgaacttcagcacacgctataagttctacttttacgcccagacttccgccggtagtggtagtcaaattaccgaagaagctgtgacaactgtggacgaagctatggcttccaggcaggttgacattgccactcaggggtggttcattggcctcatgtgcgcggtggctctgctgatcctgatcttactgatagtctgcttcatccgcaggaacaagggcggtaaatatcccgtgaaggaaaaggaggacgcacatgccgatcctgaaatacagccaatgaaggaagacgacgggacctttggagagtactcagatgccgaggaccataagccgttgaaaaagggaagcaggacacccagcgacagaaccgtcaagaaagaagatagcgacgacagtctggtggattacggggaaggggtgaatggacaattcaatgaagatgggagcttcattggacaatattctggaaagaaggagaaggaacctgccgaagggaacgaaagctctgaagcgccatcacccgtcaacgccatgaacagttttgtctag

SEQ ID NO: 232489 - DNA, 3711 bp, Artificial Sequence
  Description of Artificial Sequence: Synthetic coding sequence
atgcagctcaagatcatgcccaaaaagaaacgcctgtccgccggaagagtccctttgatcctgtttctctgccagatgatcagcgctttagaggtgcccttggatcaaaagtctactgaagtgatggtacagccccctaccatcacccagcagtcccccaaagattacatcatcgaccctagggagaacattgtcattcaatgtgaggccaaaggcaagccaccaccatcttttagttggacccggaatgggacgcatttcgacatagacaaagatcccctggttaccatgaagccaggcactggcactctgatcattaacattatgtctgaaggaaaggctgaaacatatgaaggcgtgtatcagtgtactgcacgcaatgagcgcggagcagctgtgagcaataatatcgtggttagaccttctaggagcccactatggactaaggagaagctggagccaatcactctccaatcaggccagagtctcgttttgccatgcagacccccaattggcttaccacccccaatcatattttggatggacaatagcttccagcgcctaccccaaagcgagcgcgtcagccagggcctgaatggcgacctctattttagcaacgtgctcccggaggatacgagggaagactacatttgttatgcccgattcaaccatacccagaccatccagcagaaacagccgatctcggtcaaagtaataagcgtcgacgagctaaacgataccattgctgcgaatttgtctgataccgaattttacggggctaaatcatcccgcgagagaccacctacctttttgacaccagaaggcaatgcttcaaataaggaagagcttcggggtaacgttctttccttagaatgcatcgcggagggcttacccactccgatcatatactgggccaaggaggatggaatgctaccaaagaaccggaccgtgtacaagaacttcgagaagactttgcaaatcatccacgtttctgaggccgacagtggcaattatcaatgcattgccaaaaacgcccttggagctattcatcacaccatctcagtcagagtaaaagccgcaccctactggatcactgccccacagaatctcgtgctgtctcctggtgaagatggcacgttgatttgcagggctaatgggaatccgaagcccagaatctcctggctgaccaatggcgtgccaattgaaatcgccccagacgatccttctaggaaaatcgatggtgatacaattatttttagcaatgtccaggaacggagctccgccgtgtatcaatgcaacgcctctaatgagtacggttatcttctggccaacgccttcgtgaacgtcctcgccgagcctcctcggatcctaactccagccaacacactgtaccaggtgattgccaatcggccagccctactggactgtgctttttttggctcgcctctgcccacaatagaatggttcaagggggctaaaggctcagccttacatgaggacatttacgtcctgcatgaaaatggtacactcgaaatccccgtggcgcagaaggatagtacgggaacctatacatgtgttgcacgcaacaagctggggatggcaaagaatgaagttcacctggagattaaggaccctacctggatcgttaaacagccagaatatgcggtcgtgcagcgcggatctatggtgtctttcgagtgtaaggtgaagcacgaccacacattatctcttacagtcctttggctcaaggataacagggagttacccagtgatgaaagatttacggtcgacaaagatcatctagtagtggcggacgtgtccgacgatgattccggtacctatacatgtgtggccaatacgactctggatagcgtgtccgccagtgcagttttgtctgtggtggctcctacaccaacacctgcaccggtctacgacgttccaaacccccctttcgatctcgagctcacagatcaactggataagtctgtccagctatcgtggacacccggagacgacaataatagccctataactaaatttatcattgaatatgaggatgccatgcacaagcctgggctctggcatcatcagaccgaggtctctggcacacagactactgctcagctgaagctaagcccgtacgtgaactactctttccgcgtgatggccgtgaatagcatagggaagtccctgccttcagaagcatcagagcaatatctcacaaaggcctctgagcccgataaaaaccccacagcagttgagggcctggggtcagagcccgacaacttagttattacttggaaacctctcaacggttttgagagcaatggcccagggcttcagtacaaagtgtcttggagacagaaagatggggatgacgagtggaccagcgtagtggtagcaaacgtttccaaatatatagtcagcgggactccaacatttgtgccatacttaatcaaagtccaggcgctgaatgacatgggtttcgctcccgaacccgcagtggtgatggggcattcaggcgaagacttacctatggtggcacccggaaatgtgagagtaaacgtggtaaactccacccttgccgaagtacactgggacccagtaccacttaagtccattcgcggtcacctgcagggataccgcatctactattggaagacacagagctcttccaaaagaaatagaagacacatcgaaaagaagatcctaactttccagggctcaaaaacccacgggatgttgccaggtctcgaaccattttctcattatactttaaacgttagggttgtgaatggcaaaggggaagggccagctagtcccgatagagtgttcaacacccctgaaggcgttccatcagctcccagctccttgaagatcgtgaaccccaccctggatagtctgacgctggagtgggaccccccaagtcaccctaatggcattctcacagaatacactctgaagtatcagcctatcaatagtacacatgagctcggaccactggtggacttaaaaatcccagccaacaagactaggtggacactcaagaatctgaattttagtacccgctacaaattttacttttacgcccagactagcgccggatccggcagtcagattaccgaggaggcagttactacagtcgatgaggccggtatcctgcccccagatgtcggagcaggtaaagtacaggctgttaaccctaggatatcaaatttgaccgcggcagccgctgaaacatacgccaatattagctgggagtacgagggccctgagcatgtcaacttctatgttgaatacggtgttgcgggtagcaaggaggagtggcgtaaggaaattgtaaatggcagcagatcctttttcgggctgaagggtcttatgccaggaacagcctacaaagtgagagtgggggctgttggtgactctggatttgtctcgtctgaggacgtcttcgagaccggtccggctatggcttctcgccaggtcgacattgctactcagggctggtttattggactgatgtgcgcggtcgcactgctgattctgattctgctgattgtatgctttatacggcgaaacaagggaggtaagtaccctgtgaaggaaaaagaggacgcacacgccgatcccgaaattcagccgatgaaagaggacgatggcacatttggcgaatataggctattcagttttgtttcatcggcaagtttttag

SEQ ID NO: 232490 - DNA, 3579 bp, Artificial Sequence
  Description of Artificial Sequence: Synthetic coding sequence
atgcagcttaaaatcatgcccaaaaagaaacgcctctccgccggacgcgttccactgatactctttctgtgtcagatgatcagcgccttggaggtgcctctggacccgaaactgttggaagacctagtccaacctccaacaatcacacagcagtccccaaaggattatattatcgacccgagggagaacatcgtgatccaatgcgaggccaaagggaaaccacctccatccttttcctggacccggaacggaacacattttgatattgataaagatcctctggtgaccatgaagcccggaactgggactctcatcatcaatattatgtccgaagggaaagccgaaacatacgaaggtgtgtatcagtgtactgcaagaaatgaacggggagctgctgtgtctaataacattgtagtacggccatctcgttccccgctgtggacaaaagagaagctggaacccattaccctccaaagtggccagtccctggtgttgccctgtcggccacccatcggtctgcctccccctatcattttttggatggataactcttttcaaaggttgccccagtccgaacgggtctctcaaggattgaacggcgatctgtacttttccaatgtgctgcccgaagacacacgtgaggactatatttgttatgctcgcttcaaccatacgcagaccattcagcaaaagcaacctatcagcgttaaagtaatttcagcaaagtccagtagagaacgaccaccaacttttcttacacccgagggcaatgctagcaacaaggaagagctgcggggaaacgttctatcactggaatgtatcgctgagggtctccctactcctatcatctactgggccaaggaggacggtatgttgcctaaaaatcgtacagtatacaagaattttgagaagacattacagattattcatgtgtctgaggccgattcagggaattaccagtgtattgccaagaacgcgcttggagccatccaccatacaatttccgtgagagtgaaggccgctccctactggatcactgcgcctcagaatctggtactgagccccggtgaggacggaacactgatttgccgcgcaaatgggaaccctaaacctcgaatctcctggctgacaaacggcgtccctatagaaattgcccctgacgacccttcacgcaagatcgacggggacactatcatcttttccaacgtccaggagaggtctagcgctgtgtaccagtgtaacgcatctaatgaatatggctacttgctggccaacgcttttgtaaatgttctcgccgagcccccacggattctgacgccggctaacactttataccaggtcattgcaaaccgcccagccttgctcgactgcgccttctttgggtccccactgcctacaattgaatggtttaagggcgcaaagggcagcgcactacacgaagacatatacgtgctgcacgaaaacggtacattggagattcctgtcgctcagaaagattctactgggacctacacctgtgttgcaaggaataagctgggcatggcaaagaacgaagtgcacctggaaatcaaagacccaacttggatcgtgaagcagccagaatacgcagtcgtgcaaaggggcagcatggtcagcttcgaatgcaaggttaagcatgatcacactctcagtcttaccgtgctgtggttgaaagacaaccgcgagctgccctccgatgaaaggttcactgtcgataaagatcaccttgtggtcgccgacgtctcagacgacgactcaggcacatatacatgtgtagctaatacgaccctggacagtgtgagtgcatctgcagtactgtctgtagtggctcctacacccacccctgccccagtgtatgatgtacccaacccccctttcgatctcgaacttaccgaccaactggacaaatctgtccagctcagctggacccccggagacgacaataattctccaatcacgaagtttatcattgaatatgaggacgcgatgcataagccaggactgtggcatcaccaaacagaggtctcaggaactcagactaccgcgcagctaaagttatcgccttacgtgaattacagcttcagagtgatggccgtcaattcaattggcaagtcgctgccttccgaagcctctgagcagtacctgactaaggcctccgagccagacaaaaacccaacagctgtggagggcctaggtagcgaaccagacaatttggttattacctggaagccactcaacggctttgagtccaacggacccggtctccaatacaaggtgtcttggagacaaaaggacggcgacgacgagtggacaagtgtggtggtcgctaatgtttctaaatacatagttagcggtacacccacatttgtgccttaccttattaaagtgcaggcattaaatgacatgggcttcgcgccagaacccgctgtggtaatgggccacagcggcgaggatctgccaatggtggcacccggtaatgtgcgcgttaacgtggtgaatagcacactcgctgaagtccattgggaccctgtcccactcaaaagcatccgcggacacctgcaggggtatagaatctattactggaaaacccagtctagtagcaaaagaaatagacgccatatcgagaaaaagatccttactttccaggggagtaaaactcacggaatgctccccggtcttgagccttttagtcactatacactgaatgtgcgggtggtgaatggtaagggcgaaggcccagcctctccggacagggtttttaatactcctgaaggggtgccttccgccccatcctctctaaaaattgtgaatcccacgttagattcactgaccctcgagtgggaccccccttctcacccaaatggaattctgaccgagtacactctgaagtatcaacccatcaactctactcatgaactggggcctctagtggacctgaagatccccgctaataaaacacgttggacactcaagaacctgaacttctcaactcgatacaagttctacttttacgcccagacgagcgcaggctccggcagtcagattactgaggaggccgtgaccactgtggatgaggccggtatactgcctcctgacgtcggggctgggaaggccatggccagccggcaggtcgacatcgcaacacaaggctggtttattgggcttatgtgcgccgtagccctgttaattctcatcttattgatagtttgtttcatcagacgaaacaaaggtggtaagtatccagttaaggaaaaagaagacgctcatgcggacccagagattcagccaatgaaagaagacgatggtacttttggagagtactccgacgcggaagaccacaagcccctgaagaagggatcgaggacaccatcagatcgtaccgtgaagaaagaagacagtgatgactctctggtggattatggtgagggcgttaacgggcagttcaacgaagatggttctttcatcgggcagtattctggtaaaaaggaaaaggagcccgctgaaggaaatgagtcaagcgaggctcccagcccagtgaatgccatgaactcctttgtttag

SEQ ID NO: 232491 - DNA, 3915 bp, Artificial Sequence
  Description of Artificial Sequence: Synthetic coding sequence
atgcagctgaagattatgcccaagaagaagcgcctgtccgcaggtagggtcccactgattctctttctgtgccagatgatctccgcactcgaagtgccactcgatccaaaactgctggaggaccttgtgcagccacccacaatcactcaacagtcaccaaaagactatattatagacccaagagaaaacatcgtgattcaatgtgaagctaaagggaagccgcctccttccttcagttggactagaaacgggactcacttcgacatcgataaggacccattggtcacaatgaagcccggaactggaaccctgataataaatatcatgtccgaggggaaggcggagacatatgaaggggtttatcagtgcactgccagaaacgaaaggggggctgccgtcagcaacaatatagtcgtacgaccatctcggtcacccttgtggaccaaagaaaagttggaacctatcacgcttcagtctggacaatcgctggtgctcccctgtagacccccaataggcctcccacccccaatcatcttttggatggataattcttttcagaggctccctcaatcagaaagggtgtcacagggcttgaacggagacctatacttctccaatgtcctgccagaagacaccagggaggactacatttgctatgccagattcaatcatacccagaccattcaacagaagcagcctattagcgtcaaagtgattagcgtggacgaactcaatgacacgatcgctgccaacttatccgacactgagttctacggcgctaagtcctcaagggaaagaccacccacgttcttgaccccggaaggaaacgcttccaacaaagaggagctgaggggcaacgtactatccctcgagtgtatagctgagggcctccctactccgatcatttattgggccaaagaggacgggatgctgccgaagaaccggacggtgtacaaaaactttgagaagacccttcagattatccatgtatctgaagcagatagcggaaactaccagtgtatagccaaaaatgctctcggggcaattcaccataccatttcagttcgagtgaaagctgcgccatactggataacagcaccccagaatctagtcctgtccccgggagaagacggaaccttaatctgtcgggcaaacggaaatcccaaacccaggatatcttggctgacgaacggcgttcctattgaaatagccccagacgaccctagcaggaaaatcgatggggacaccatcattttttcgaatgtacaggagcgttcctccgctgtgtaccagtgcaatgccagcaatgaatacggttatctgctggctaatgcattcgtcaatgttctggccgagccacctagaatcctcacgccagccaacactctgtaccaggtgatagctaaccggccagcgttgctcgactgcgccttcttcgggagtcccctgcctactattgagtggttcaaaggcgctaaagggagcgccctccacgaggacatctatgtcctgcacgagaacggaaccctggagattccagttgcgcagaaggactcgacgggcacatatacttgtgttgcccgtaataagcttggcatggctaagaatgaagtgcacttggaaataaaagacccgacttggattgtgaagcaacctgagtacgcagtggtgcagcgcggttctatggtctcatttgaatgtaaagtcaagcatgaccataccttaagccttactgtgctgtggctgaaggataaccgcgaactcccctccgacgagcgctttacagtcgataaagaccatttggtcgttgcagacgttagtgatgacgactccggtacttacacatgtgtcgcaaacaccactctagacagcgtgtcagcttccgcggtcctttcagttgtggccccaaccccgacgcccgctcctgtgtatgacgtaccaaatccaccattcgacctggagctgacagaccaactggacaaaagtgtgcagctgagctggacccccggagacgacaataattcccctatcacaaaatttatcatcgagtacgaggacgcaatgcacaagccaggcctgtggcaccaccagaccgaagtgtcggggacccagaccaccgcacagctcaagctttctccctacgtaaattattcatttagggtcatggccgtgaactcaattggcaaaagtctcccctctgaagcctcagaacaatacctcactaaggcatccgagcccgacaagaaccccaccgcagtcgaaggcctcggtagcgagcccgataaccttgtcataacatggaagcctctgaacggtttcgagagcaacgggcctgggttgcagtacaaggtcagctggcgccagaaggacggggacgacgagtggactagcgtggtggtcgcaaatgtctccaaatacatcgtgtccggaacccccacttttgtcccgtacctgattaaagtccaggctctcaatgacatgggcttcgctcctgaacctgcagtcgtcatggggcatagcggcgaagaccttcccatggttgcacccggaaatgttcgagtcaatgtggtgaactctaccttagccgaagtgcactgggatcccgtcccccttaaatcgattcggggacatttgcagggttaccgcatctattactggaagactcaatcctctagtaaacgaaaccgcaggcatatagagaagaagatactgacattccagggcagcaagacccatgggatgctgcccggacttgaaccgttcagccattacacactgaatgtgcgagtagtgaatggcaaaggagaagggcctgcatcccccgaccgcgtcttcaacacccccgaaggagtcccttcagcccctagttctctgaagatcgtcaacccgacattggactctttgacacttgagtgggacccccctagccaccccaatggaattctgacagaatataccttgaaataccaacccatcaactccacccacgaactagggccactggtcgatttgaagatccccgctaacaaaactagatggactttgaagaacctcaatttttctactaggtacaagttttacttctatgctcaaacctctgccggttcaggctcgcagattacagaagaagccgtcacgaccgtcgatgaggctgggatactgcccccagatgtcggtgctggcaaagtgcaggcggtgaatccacgtatttcgaatctcactgctgccgcagcagagacctacgcgaacattagttgggagtacgaggggcctgagcacgtgaatttctatgtcgagtacggcgtcgctggaagtaaggaggaatggcgcaaagaaatagtgaacggaagccgcagcttcttcggcctgaagggcctgatgccaggcaccgcttacaaggtcagggtgggcgcagtgggggatagcggatttgtgtcatccgaagacgttttcgaaacggggcctgccatggccagtagacaagttgatattgctactcaaggctggttcattggtcttatgtgcgccgtcgcattactaatcctgatcctgttgattgtgtgctttattaggaggaataaagggggaaagtaccctgtgaaggagaaggaagacgctcatgctgatccagagatccagccgatgaaggaggacgacggcaccttcggagagtactctgacgcggaggatcataagccactgaagaaagggagcaggaccccatctgaccgaactgtcaagaaggaggatagtgatgacagcttggttgattacggtgagggcgttaatggccaatttaatgaagatggatccttcatcggacagtactccggtaagaaggagaaagaaccagccgaagggaatgagtcctccgaggcaccttctccagtgaatgccatgaattcctttgtctag

SEQ ID NO: 232492 - DNA, 3927 bp, Artificial Sequence
  Description of Artificial Sequence: Synthetic coding sequence
atgcagctcaagattatgccaaaaaaaaaacgactgagtgctggcagagtccctttgatcctgttcctttgtcagatgataagcgcattagaggtgcccctagatcagaagtcaactgaagtcatggtgcaaccacctacaattactcaacaatcccccaaggactatatcattgacccaagagagaatatagtgatccagtgcgaggcaaagggcaagccgccaccaagcttcagctggaccaggaacggtacacacttcgatatcgacaaagatccactggtcacaatgaagccaggaacagggaccctgatcatcaacataatgtcagagggcaaggcagaaacttatgagggcgtctaccagtgcaccgcaaggaatgaaagaggagccgctgtgtcgaataacatcgtggtgcgaccttccaggtcaccactctggaccaaagagaagttagaaccaatcaccctccagagcggccaatcccttgtcctcccgtgcaggcctcccatcgggttaccccctcctatcatattctggatggataatagttttcagaggctgcctcagtctgagcgagtgagtcagggacttaacggagacctgtacttctccaacgttttacccgaagataccagagaggattatatctgctacgccaggttcaatcacacacagacaattcagcagaaacagccaattagtgtcaaggtgatcagcgtggacgagctgaacgataccatagccgctaacctgtcggacacagagttctacggtgccaagagctccagagagcgacccccaacgttcctcactcccgagggaaatgcttcaaacaaggaggagctgcggggaaatgtgttatccttggagtgcatagcagaaggattgccaacccccatcatctattgggctaaagaagacgggatgttgcccaagaacaggacagtctataaaaacttcgaaaagacgctgcagattattcatgtcagcgaggctgactcaggcaattaccagtgcattgccaagaacgcactaggagcaatccaccacaccatatctgtacgggtgaaagccgcaccctactggataacagcccctcagaacttggtgctttcgccaggagaggacggaaccctgatctgccgagctaacggcaatcccaaaccacgtatcagttggctgaccaacggagttccaatcgagatcgctcccgatgacccatcgagaaaaatagacggcgataccatcatcttcagcaatgtacaggagcggagcagcgccgtgtaccagtgcaacgcttcaaatgagtacggatacctgcttgccaatgctttcgtcaacgttctggctgagccacctcgaatactaacccctgcaaacactctttatcaggtcattgcaaaccggccagctctgctcgattgcgcattttttggctccccattgcccacaatcgaatggtttaagggtgccaaagggagcgctctacacgaagatatctacgtcctgcatgagaacggtactcttgaaatacccgttgctcagaaggatagcaccggaacctacacatgtgtggcccgtaacaaactcggtatggctaagaacgaggtgcaccttgagattaaggaccctacttggattgtcaaacagcctgagtacgctgtcgtccaacgcggttcgatggtaagtttcgagtgtaaggtgaagcacgatcataccctttcccttactgttttgtggcttaaggacaaccgggagctaccaagtgatgagagattcaccgtcgacaaggatcacctcgtggttgccgatgtcagcgatgacgactcgggcacctacacgtgtgtcgcaaacactaccctggacagcgtgagtgccagcgcagttctatcggttgtcgccccaaccccaacacccgcacccgtgtatgatgtgccaaatccaccctttgaccttgaacttactgaccagttggataagagtgtgcaactttcatggaccccaggggacgataacaacagccccatcactaagttcatcatagagtacgaagacgctatgcacaaaccaggattatggcatcatcagactgaggtctctgggacccagaccaccgctcagctaaagctgagcccgtacgtgaattatagcttccgcgtgatggctgtgaactctattggtaaatccttgccttccgaggccagtgagcagtatttgacaaaggcaagtgaaccagacaaaaacccaacagccgttgaaggattgggctcggagcccgataatttggtgattacctggaaacctctcaatgggttcgagtctaacgggcctggactgcagtacaaagtctcctggcgacagaaagatggtgacgatgagtggacctcggttgttgttgctaatgtcagcaagtacatcgttagtggcacacccacgtttgtgccatatcttataaaagtgcaggcactcaacgacatgggatttgctcctgaacctgccgtcgtgatggggcattcaggcgaagatctacccatggtggccccagggaacgtaagggtgaacgtggtcaatagcactctggctgaggtccactgggatccagtgccattgaaaagcatccgtggtcatctacagggctatagaatctactattggaagactcagtctagttccaagcgaaacaggcgccacatagaaaaaaaaattcttacctttcagggatctaagacccatgggatgctgccagggcttgagccttttagtcattatacattgaatgtgagggttgttaacggcaagggggagggacccgctagccccgatcgagtgttcaatactccagagggagtgccaagtgcccctagctcactcaaaatagtcaatcctacactcgactctctcacgctggagtgggatcctccgtcccaccccaatgggattttgaccgagtataccctcaagtatcagccaataaattctacgcatgaactgggccctcttgtggacctgaaaatccccgctaacaagactagatggacgctgaaaaacctgaacttttccacacgatataaattttacttttacgcacagacatcagcaggatccggctcccagatcaccgaggaggctgtgaccactgttgacgaggccggaattctgcctcccgatgttggcgctgggaaggtccaggcggttaatcccagaatttccaacctgaccgcggctgccgctgagacctatgctaacataagctgggagtacgaggggcctgagcatgttaacttctacgtggaatacggagtggctggttcaaaagaggaatggcgcaaggagattgtgaatggttcccggtccttctttgggctgaaaggtttaatgccaggtacagcttacaaagtgagggtgggagcggtgggagattcaggattcgtgtccagcgaggacgtcttcgagactggacccgctatggcgagtcggcaggtggatattgctacccagggatggttcatcggccttatgtgtgctgttgctctcttgatcctcatactgctgatagtgtgctttataaggagaaataagggtggaaagtaccctgtgaaggaaaaagaggacgctcatgccgaccccgagatccagcccatgaaggaagacgatggaacgtttggagagtactcctcactgaaaaatgacgccgaggatcataagccacttaagaaaggcagcagaactccgtctgacaggacagtgaaaaaggaagattcagacgacagtctggtagactatggcgagggggtcaatgggcagttcaacgaagatggtagtttcattgggcagtacagcgggaagaaagaaaaagaaccagcagagggcaatgagagttcagaagcaccaagtcctgtgaatgctatgaactcatttgtgtag

SEQ ID NO: 232493 - DNA, 3543 bp, Artificial Sequence
  Description of Artificial Sequence: Synthetic coding sequence
atgcagctgaagatcatgcctaagaagaaacgcttgtccgccggtcgggtgcctttaatcttgtttctgtgtcagatgatctcagctctggaagtgcccctggatcagaagagtaccgaagtgatggttcagccacccacaattacgcagcaatcccccaaggactatattattgatccaagggaaaatatagtgatacagtgcgaagccaagggcaagccccctccttctttttcctggacacgaaacggtactcactttgatattgacaaagaccctctggtgacgatgaagcccggtaccgggaccctgatcattaatattatgtctgaggggaaggccgagacctacgaaggcgtgtatcagtgtaccgcacgcaacgagagaggtgcagccgtatcgaacaatatcgtggtgaggccttcaaggagtcccctctggaccaaggagaaattagagccgatcaccctccagtcgggacagtcgcttgttcttccttgtaggccccctatcggactccctccgccaattattttctggatggacaactcattccagaggttaccccagtctgagcgggtttcacagggtctcaacggagatctgtatttcagtaatgtgctgcccgaggatacacgggaagattatatctgttacgccagatttaatcacactcagacaattcaacagaagcagcccattagcgtgaaagtgatctctgctaagagttccagggagaggcccccaacgtttttgacacctgaaggcaacgcatctaataaagaagagctgcggggtaacgtcttatcgctggaatgcattgcagagggcctaccgacacctattatatattgggcaaaggaggacggaatgctcccaaaaaaccggaccgtctacaagaattttgagaagaccctgcaaatcattcatgtgtccgaggccgattccggtaactatcagtgcatagcaaagaacgctttgggggcaatccaccacacaataagcgtgagggtgaaagccgcaccctattggattactgctccccagaatctggtgttgtccccaggggaggacgggaccctgatctgcagggccaacggaaacccaaaaccccgaatctcctggttaacaaacggtgtacccattgaaatagcaccagacgaccctagccggaagatcgacggcgacaccatcatctttagcaacgttcaggagcgctcctccgcagtgtaccaatgtaatgccagcaacgaatatggttacctgctggccaatgcctttgttaatgtgcttgcagagcctccccgaattttgacacctgccaacacactctatcaagtgattgccaatagacctgccctgcttgactgtgctttttttgggtccccattgcccaccatagagtggttcaagggagctaaaggctccgctctccacgaagatatctatgtgcttcacgagaacggaacacttgagataccagtcgcccagaaagatagcaccggaacttatacttgtgtggcacgcaataagttaggcatggcaaagaatgaagtgcatttggagatcaaggaccctacttggattgttaagcagccagaatatgctgtggtgcagcggggttcaatggtatcctttgagtgcaaggtgaagcacgaccataccctcagtctgactgtactgtggctgaaggacaatcgcgagctcccttcggatgaacgatttaccgtggataaagaccatcttgtggtcgcggatgtgtccgatgacgattcagggacatacacctgtgtagctaacactaccctcgactccgtgtctgcttcagccgtgctctctgtagtcgcccctacgccgactccagctcctgtatacgacgtgcccaatccgccatttgacctggaactgacagaccagctggataagtccgtccagcttagctggacacccggtgacgataacaatagcccaatcactaaattcataatcgagtacgaagacgccatgcacaaacctggactgtggcaccaccaaacagaggtgtccggaacccagactactgcccaactgaagctttcaccctacgtgaactactcttttcgcgtgatggcagtcaacagcatcggaaagagtttacctagtgaagcctcggaacagtacctgaccaaggcgtccgaacctgataagaaccctaccgcagtggaaggcctggggagcgaacctgataacctggtaattacttggaaacctctaaacggattcgagagcaacggcccaggactgcagtacaaggtgagctggagacagaaggacggtgacgatgagtggacctcagttgtcgtcgctaatgttagcaagtatatcgtttcaggtacgcctaccttcgtgccctacctgatcaaggtccaagccctgaacgacatggggttcgcgcctgagcccgcagtagtcatggggcatagcggggaggatctacctatggtggctccaggcaacgtgagagtgaatgtggtgaatagcaccctggccgaggtgcattgggatcctgttccactcaagagcatccgcggtcacctccaggggtataggatctattattggaaaacccagtcttcttccaaacggaataggcggcatatcgagaagaaaatccttaccttccagggaagcaaaacacacggtatgctgccaggcctggagccattcagtcattatacgttgaatgtgcgtgttgttaacgggaagggtgaaggacctgcgtctcccgacagggtgttcaatacacctgagggagtgccaagtgcgccttccagcctcaaaatagtgaacccaacactagacagcctgacactagagtgggacccgcctagtcatccaaatggaatactgacggagtatacacttaaataccaacccattaatagcacccacgaacttggaccccttgtggaccttaagatcccagccaacaaaacaaggtggacgttaaagaaccttaacttcagtacgcgttataagttctacttttatgcccaaacctcagcaggttccgggagccagataactgaggaagccgtgactactgttgacgaagcaatggctagtcgacaggtagacatcgcgactcagggttggttcatcggcctgatgtgtgcagtggcacttctgatcctcattctgctgattgtctgttttatccggagaaataaggggggaaagtatccggtaaaggagaaggaggatgctcacgctgacccagaaattcagccaatgaaggaggatgatgggacctttggggagtactcagacgcggaagatcataagccgcttaagaagggcagccggacaccgtccgatcgaacagtcaagaaggaggattctgatgactcccttgtggattacggggaaggggtgaatggacagttcaacgaggacggcagctttattgggcagtattccgggaaaaaggagaaggagcccgctgaaggtaacgaatcaagtgaggcccctagtcccgtcaatgctatgaacagcttcgtgtag

SEQ ID NO: 232494 - DNA, 1296 bp, Artificial Sequence
  Description of Artificial Sequence: Synthetic coding sequence
atgcagttgaagatcatgcctaaaaaaaagaggctcagcgccggtcgggtaccgctgatccttttcctgtgtcagatgataagtgcgctggaggtgcccctagacctggtgcagccccctaccattacccagcagagtcctaaggattatattattgatccaagggagaacattgtgatccagtgcgaagctaagggaaaacccccaccaagttttagctggactcggaatggtacccactttgacattgacaaggatccactggtgaccatgaagcccggaaccggtacactgatcattaacataatgtccgagggaaaagccgagacgtatgagggtgtctaccagtgtacagccagaaacgaaaggggtgctgccgtgtccaacaatatcgttgtgcggccttccagaagtcctttgtggaccaaggagaagcttgaaccaatcacactgcagtccggccagtcactggtactgccatgccgccctccaataggcctccccccaccaattatcttttggatggacaattcttttcagcgtctaccccagagcgagcgggttagccaaggcctgaatggcgacctgtacttttccaatgtgctgcccgaggacacccgtgaagactatatatgctatgctcgcttcaatcatacacaaaccattcagcagaagcagcctatttcggtcaaagtgatctctgttgacgagctgaacgatacgattgccgcaaatcttagcgataccgagttctatggggcaaaaagctccagagagcggcctccaacgttcctgacaccagaaggcaatgccagcaacaaggaagagctgcgaggtaatgtcctgagtctggaatgtatagccgagggcctgccgacgccaatcatttactgggcaaaggaagacggaatgcttcccaagaacagaactgtgtacaaaaattttgagaagactcttcagatcattcacgtttctgaagctgatagcggcaactatcagtgcatcgctaagaatgctctgggagcaatccatcacacaatctctgtgagggtgaaggcagcaccgtactggatcacagccccacagaatctggtcctcagccccggagaggacggcaccttaatctgccgtgctaatggaaaccccaagcccaggattagctggttgactaatggagttcccattgaaatcgccccagatgacccctccaggaagatcgatggggataccatcattttcagcaatgtgcaagaacgttccagcgccgtgtaccagtgcaacgctagcaacgagtag

SEQ ID NO: 232495 - DNA, 186 bp, Artificial Sequence
  Description of Artificial Sequence: Synthetic coding sequence
atgcagctgaaaatcatgcctaagaagaagaggctctctgccggacgcgtgccactcatattattcctctgccagatgatttccgccttggaggtgccactcgaccctaaactcctggaagacctggtgcagccccctaccataactcagcaaagtccgaaagactacattattgaccctaggtag

SEQ ID NO: 232496 - DNA, 321 bp, Artificial Sequence
  Description of Artificial Sequence: Synthetic coding sequence
atgcagctgaagataatgccgaaaaagaaaaggctgagtgctggaagagtacctcttattcttttcttatgccagatgatatctgccctggaagtacccctcgacctggtccagcctcccactattacacagcagtctccaaaggactacatcattgaccccagggaaaatattgttattcagtgcgaagctaagggtaagcccccaccctcgttcagctggacccgtaatggaacgcattttgatattgataaggatccattggtaaccatgaaacccggaacaggcactctgatcataaacatcatgtctgaggggtag

SEQ ID NO: 232497 - DNA, 3915 bp, Artificial Sequence
  Description of Artificial Sequence: Synthetic coding sequence
atgcagctcaaaatcatgcccaaaaagaaaagactgagtgctggaagagtgcctctgattttgtttctgtgtcagatgatctcagccctcgaggttccactcgatcctaagttattagaggacctcgtgcagcctccaaccatcacccagcagtccccaaaagattacattatcgatcccagggaaaatattgtgattcagtgtgaagcaaaggggaaaccacctccgagtttcagttggacccgaaacggcacccacttcgatattgacaaggatccactggttacgatgaaacctggcacgggtacattgatcataaatatcatgtccgaggggaaagctgaaacatatgaaggcgtgtaccagtgtaccgctcgcaacgaaagaggtgctgctgtctccaacaacattgtggtcaggccttctcgctcaccactatggactaaggagaaacttgaacctatcacactgcagtcgggccaatctcttgtgctgccctgcaggccccctatcgggcttcctcctcctataattttctggatggataattccttccagagactgccgcagtccgaacgagtgtcacagggactgaacggcgatctttacttttccaatgttcttcccgaggacaccagagaggattacatttgttatgcccgtttcaaccatacacagacaatccagcagaagcaaccaattagcgtaaaagtcataagcgtggatgagctgaacgacactattgccgcaaacctgtccgataccgagttttatggcgcaaagagctcccgagaacgccctcccacttttctcactccagaggggaatgccagtaataaagaagagttacgcggtaacgtgctgtccctggaatgtattgctgaagggctccctacacctatcatctactgggccaaggaggatggtatgctgcctaaaaataggacagtctacaagaatttcgaaaagaccctgcagattatccatgtgagtgaagcggacagcggtaattaccagtgcattgctaaaaatgctttgggggctatccatcacaccatctctgttcgtgtgaaagctgccccatattggataactgcaccccagaacctggtgctttccccaggggaggacggcaccctgatctgccgagccaatggaaaccccaaacctcgcatctcatggctgactaacggcgttcccattgagatcgctccagatgatccctcccggaaaatcgacggcgacacaattatttttagcaacgtgcaggagcgaagtagcgcagtgtaccagtgtaacgcctcaaatgagtatggatacctcctggccaatgcttttgtgaatgtgctcgcagagccacctagaatcctgaccccagccaacacgctgtaccaggtaatcgctaatcgccctgccctgctcgattgcgcgttttttggctccccacttccaacaatcgaatggttcaagggggctaaaggatctgccttacatgaagacatctatgttctccatgagaacgggaccctggaaataccagtcgctcagaaggatagcactggtacatacacttgcgtggcacggaataagcttggtatggccaaaaacgaagttcacctggagatcaaggacccgacctggatcgtcaagcaaccagagtacgctgtcgtgcaacggggaagcatggtctcatttgagtgcaaagtcaaacatgatcacacgctgtctttaaccgtgctctggctgaaagacaatagggaacttccttctgatgagcgctttaccgtggacaaggatcaccttgtggtggccgacgtcagcgatgacgacagtggtacatacacttgtgtagccaacactacgctcgattctgtgtcggcgagcgccgtcctcagtgtggtcgctcccaccccaacccctgcgcctgtgtacgacgtccctaatcctccatttgatcttgaacttacagaccaacttgacaagtctgtccagctgtcttggactcccggagacgacaataatagccctatcacaaagtttataattgaatacgaggacgccatgcataagcccggtttatggcaccaccaaactgaagtttcaggcacccagaccacagctcagctaaagctcagtccctacgtgaactatagctttcgggttatggccgtcaactccattggcaagagcctgccttcagaagcgtccgaacaatacctgacaaaagcttccgagcctgataaaaaccccaccgccgtggaaggtctgggctcagaacccgacaacctagtgattacctggaagcctctgaacggattcgagtccaatggcccaggccttcaatataaggtgagttggagacaaaaagatggcgatgacgaatggacgtccgtagtggtcgctaacgtttctaagtatatagtttccggaacacctacgttcgtcccttacctcataaaggtgcaggctctgaatgatatgggattcgcacctgaacccgctgttgtgatgggccattctggcgaggacctgccgatggtggccccaggcaacgtgcgagtgaacgtggtgaactctacacttgcagaggtccactgggaccctgttccactgaagagcataagaggccacctacagggttatagaatctattattggaaaacacaaagttcatcaaaaagaaatcgcagacatatcgagaaaaagatcttaacctttcaaggttctaagacgcacgggatgctgcccggtttggaacctttttcacactatactctaaacgttcgggtggtaaacggtaagggtgaggggccagctagtcctgatagggtcttcaacacacccgagggagtaccatctgccccatcatctctaaaaattgttaaccccaccttggatagtctcacgctcgaatgggacccaccaagccacccgaatggcatcctcaccgaatacacgcttaagtatcaacctattaatagcacccatgaactaggacccctggtggacctcaagattccagctaacaagactagatggacactgaagaatctgaacttctccactcgttacaagttctacttttacgctcaaacatccgcaggctccgggagtcagattacggaagaggcggtgaccacagtagatgaggccggaatcctccccccagatgtgggagccggtaaagttcaggccgttaaccccaggattagtaatctgactgctgctgccgcagagacatacgctaacatctcatgggagtatgaaggccctgaacacgtcaatttttacgtggagtacggagtggctgggagtaaagaagaatggcgaaaggaaatagttaatgggagtcgatccttttttggactcaaaggcctcatgccaggcactgcgtataaagtcagagtgggcgctgtgggcgactcgggcttcgtgtcctcagaagacgtattcgaaactggccctgccatggcgagcaggcaggtcgacatagctacgcaaggatggttcataggtctcatgtgcgctgtcgccctgctgattcttatactcctgattgtctgcttcatcagacgaaataaggggggtaagtatcctgtgaaagagaaagaagatgcgcatgctgatcccgagatccagcctatgaaggaggacgatggcactttcggcgaatactctgacgccgaggatcacaagcctctcaagaaaggcagccgaacaccatccgaccgcacagtgaagaaggaagattccgacgatagcctggtagattacggagaaggcgtaaacggccagttcaatgaagatggctcgttcattgggcaatatagcggtaagaaggagaaggaacctgcagaggggaatgaatccagcgaggcaccaagcccagtaaacgctatgaatagctttgtctag

SEQ ID NO: 232498 - DNA, 447 bp, Artificial Sequence
  Description of Artificial Sequence: Synthetic coding sequence
atggccagcaggcaggtggacattgccactcaaggctggttcattggcctgatgtgcgctgtggcgctgttgatcctaatcctccttatcgtctgcttcatcagacggaataaggggggaaaatatcctgtgaaggagaaggaagatgcccacgcagatcccgaaattcagccaatgaaagaggatgatggcactttcggcgagtattctgatgccgaggaccacaaacccctgaaaaaaggatcgagaacgcctagtgaccgcaccgtgaagaaagaggactccgacgatagtctggtggactacggagaaggtgtgaatggccagtttaatgaggacgggtcattcattggccaatactccggaaagaaggagaaagagcccgctgagggcaacgagtccagcgaagcaccttcccctgttaacgcaatgaattcgttcgtctag

SEQ ID NO: 232499 - DNA, 357 bp, Artificial Sequence
  Description of Artificial Sequence: Synthetic coding sequence
atgcaacttaagatcatgcccaaaaaaaagcgcctgtcagccggtcgcgttcctctgattctctttctttgtcaaatgatatctgctctggaagtgcccctggatcccaagctgctcgaagacctggttcagcctcctacaattacacagcaaagcccaaaagactatatcattgacccaagagaaaatatcgtaatccagtgcgaagccaaagggaagccgccacccagctttagttggacaagaaacggaacccacttcgacatcgacaaagacccactagttactatgaagcccggaaccggaaccctgatcattaacatcatgtccgagggtaaagcagagacgtacgaatag

SEQ ID NO: 232500 - DNA, 2316 bp, Artificial Sequence
  Description of Artificial Sequence: Synthetic coding sequence
atgcagctcaaaatcatgccgaaaaaaaaaaggctaagcgctggcagggtacctctcatcctgttcctctgtcagatgatttccgcccttgaagttccattggatctggttcaaccgccaaccataacgcagcagagccccaaggactatattattgatccccgagaaaacatcgtcatccagtgcgaagccaaggggaagccccctccctccttctcatggacacggaacggtacccattttgatatcgataaagatccactcgtgactatgaaaccgggaaccggcacattaattatcaatatcatgtctgagggcaaggctgagacttacgaaggcgtgtatcagtgcacagcgagaaacgagcgcggtgcggctgtctccaataatattgtggtgcgtccatcccggtcccctctctggacaaaggaaaagctggaaccaattacattacagagtgggcagagcctggttctgccatgcagaccccctataggtctgccgcctccaatcatattctggatggacaattcctttcaaaggctccctcagagcgaacgggtgtcacagggactgaacggggacctgtatttctctaatgttctgcctgaggacacgagagaggactatatctgttatgctcgatttaatcacactcagactattcagcagaagcagcccatttccgttaaagtgatctcggtggacgagctgaacgacaccatcgctgccaatctgtccgataccgaattctacggtgccaagtcctcccgcgaacgtccccctacctttctcactcccgagggaaatgcgtccaacaaagaggagcttcgcggaaacgtgctgagcctggagtgcatcgcagaaggcctgcccaccccaatcatatattgggccaaggaggacggaatgcttccaaagaatcgtaccgtgtacaaaaacttcgaaaagaccctacagatcatacacgtgagcgaggcggacagtggcaattatcagtgcatagccaagaatgcactgggtgccatccaccataccataagtgtcagagtcaaagcagcaccatactggattacggcccctcagaatctggtactgagtcccggagaggatggaacccttatctgtagagccaatgggaacccaaagcccagaatctcgtggttaaccaacggggtgcctatagagatcgccccagacgacccgagcaggaaaattgatggagacactataatatttagcaatgtgcaggagcgctcctccgccgtttatcagtgcaacgccagcaatgaatatggctatctgctggccaatgcctttgtgaatgtccttgctgaacctccaagaattctgactcccgcaaacacactgtaccaagtgatcgcaaataggccagcactgttggactgcgctttctttgggtctcctttacctactatcgaatggtttaagggggctaaggggagcgccctccacgaagacatctatgttctgcacgagaatggaactctggagatccccgtcgctcaaaaagacagcaccggcacatacacttgcgttgcaaggaataagctgggaatggctaagaatgaggtccatctggagatcaaggaccccacctggatagtgaaacagccagaatatgctgttgtgcagcggggttctatggtgtccttcgaatgcaaggtaaaacatgaccatacactaagcctgaccgttctgtggctgaaggacaaccgcgagcttcctagtgacgagcgttttacagtggataaggatcatctggtagttgccgacgtaagtgatgatgattctggaacttatacttgtgttgctaacacaaccctggactcggtgagtgcctcagctgtgctttcagtggttgatgtccctaatcccccattcgatctggagctgacggaccagctggacaaatccgtgcagctaagctggactcccggtgacgataacaattctccaattacgaaattcataatcgaatacgaagacgctatgcacaagccagggctatggcaccaccagaccgaggtgagcggtactcaaacaaccgctcagctgaagctctctccctacgtcaactatagcttcagggttatggccgtgaactctattgggaaatctctgccctccgaagcctcagagcagtacctgactaaggcaagcgaaccggataaaaatcctacagccgttgagggcttaggcagtgaacccgacaacttagttattacctggaaacctttaaatgggtttgagtcaaacggaccgggactgcagacttcaactgcgtcattctag

SEQ ID NO: 232501 - DNA, 321 bp, Artificial Sequence
  Description of Artificial Sequence: Synthetic coding sequence
atgcagcttaagattatgccgaaaaagaagcgacttagcgcgggacgggtgccactgattctcttcttgtgtcagatgatatccgcgctcgaggtcccgctagacttggtacagccccctaccatcacccagcagagccctaaagactatataattgatccaagggaaaacatcgtcatccagtgcgaagccaaaggcaaacctccgcctagcttcagttggacccgtaacggaacgcattttgatattgacaaggatcccctggtcaccatgaagcccggaaccggcacccttatcatcaatatcatgtcagaggggtag

SEQ ID NO: 232502 - DNA, 3462 bp, Artificial Sequence
  Description of Artificial Sequence: Synthetic coding sequence
atgcagctcaagattatgccaaaaaaaaagaggctgtccgccggtcgcgtacctctgatcttattcctgtgccaaatgataagcgccctggaggtaccactggaccagaaatccaccgaggttatggtccagcctccaaccattactcagcagtcacccaaggattacatcattgatcccagagaaaacattgtgattcagtgtgaggctaagggcaagccccctccttctttctcctggacgaggaatggaacccactttgacattgataaggatcctctcgtgactatgaaaccaggtaccgggaccctgatcataaacatcatgtctgaaggaaaggcagagacctacgagggtgtgtaccagtgtaccgcccgaaatgagaggggtgccgcagtgagcaataacattgtcgttcggccttctagaagtcctttatggactaaggagaaactggagcctattacgctgcaatctggccagtctctggttttgccctgccgccctcccattggcctgccgccaccgatcatattttggatggacaactcctttcagcgccttcctcagagcgagcgggtgtcccagggtctaaatggggacctttacttctccaacgtgctgcccgaggatactcgtgaggattacatctgctacgcacggtttaaccatacccaaaccattcagcaaaaacagcccattagcgtgaaagttatttcggtggacgagcttaacgacacaatcgctgccaatttgtcagacacagagttttatggcgcaaagagctcgcgcgagagacctcctactttcttgactcccgaaggcaatgcgtctaataaagaagagttgcgtgggaatgtcctgtcactcgagtgcatcgccgaggggctgccgacccctattatctactgggcaaaggaggatgggatgctgcctaagaaccgaacggtctacaaaaacttcgaaaagactctgcagatcatacatgtgtccgaggctgattctggcaattatcagtgcatcgcaaagaacgcactcggcgctattcaccatacaatttcggttagggtgaaagccgctccgtactggataaccgctccgcagaatctggttctctctcctggagaagatgggaccctaatctgtcgcgctaatgggaacccaaagcccaggatcagctggctgaccaatggggttcccattgagatcgccccagatgacccatctaggaagattgacggcgatacgattattttttctaatgtccaggaacggtcttctgcagtctaccagtgtaacgcgtctaatgagtacggatatctgttagcgaatgccttcgttaacgtgttggctgagccaccaagaattcttacccccgcaaatacgctctatcaggtgatcgcaaaccgtcctgccctgctagactgcgcatttttcggatctcccctccccacgattgagtggtttaagggtgccaaaggctccgccttgcatgaggatatctatgtgctccacgagaatggaactttggaaattcccgtggcgcagaaagacagcacaggcacatacacttgcgtagctaggaacaagctgggcatggctaaaaacgaggtacacctggaaattaaggacccgacatggatcgtcaagcagccggaatatgcagtcgtgcagcgaggcagtatggtctcattcgagtgtaaagtgaaacacgatcataccctcagcctgacagtcctgtggcttaaagataaccgggaactaccgtccgatgaacgttttactgtcgataaggaccatctcgttgtcgctgatgtgagcgatgacgactcaggcacatatacttgtgtcgccaacaccacactcgacagtgtgtccgcttctgccgtcctgtctgtggtagctcccacccccactcccgcacccgtgtatgacgtgcccaatcctcccttcgaccttgagctaacggatcagctagacaagagtgtccagctttcctggacacctggggacgacaacaattccccaatcacgaagttcattatcgagtacgaggatgccatgcacaaaccagggctgtggcatcatcagactgaggtgtccgggacccagaccaccgctcagctgaaactgtcaccttacgtcaattactccttcagagtgatggcagtgaatagtatcggaaaatccttgccgtcggaggcctcggaacaatacctgactaaagccagcgagccagataaaaacccaaccgctgtcgaggggctaggtagtgagcccgataatctggtaatcacatggaagcccctgaacggatttgagtctaatggacctggcctgcaatacaaggtttcttggcggcaaaaagatggggatgatgaatggacatcagtggtcgtagcgaatgtgtccaaatacattgtgtccggcactcccacattcgtgccctatctgattaaggtccaggcactcaacgatatgggatttgctccagaacctgcagtcgtgatgggccacagcggggaggacctgccaatggttgctcccggtaatgtgagggtcaacgtggtcaactcaaccctcgcagaggtccattgggatccagtacccctcaagtcgatcagggggcatctgcaagggtacaggatttactactggaaaacccagagtagctcgaagaggaatcgacgacacattgaaaagaagatcctgacatttcaaggatctaaaacccacggcatgttgcccggtctggagccattctctcactacaccttaaacgtgcgagttgtaaacgggaaaggcgaggggcctgcaagtcctgatagagtgttcaatacccctgagggggtaccaagtgctcctagctccttgaaaatcgtcaatccaaccttggactctctgaccctggaatgggatcctcctagccatcccaatggcattttaaccgagtacactcttaagtaccaaccaataaattccacccacgaacttggaccccttgtcgacctgaagatacccgctaataaaactagatggacactcaagaacttaaatttctccacccgctataagttctatttttacgctcagacgagtgctggcagcggcagtcagatcacagaggaagccgttaccactgtcgatgaggcgggaatcttacccccagatgttggcgctgggaaagcaatggcgagtaggcaggtggacattgcaacacaggggtggtttatagggttgatgtgcgccgtggcgctgctaatactgatcctcctgatcgtatgcttcattcgtcgcaataaaggaggtaaatatcctgttaaagagaaagaggacgctcacgcagacccagaaattcagcccatgaaggaagacgatggcacgttcggtgaatacagcgacgcggaagatcacaaaccgctcaagaagggaagtcgcaccccaagcgaccgaaccgtgtag

SEQ ID NO: 232503 - DNA, 681 bp, Artificial Sequence
  Description of Artificial Sequence: Synthetic coding sequence
atgcaggtgcatctcacagtacaggttcctccaaagatctatgacatatcaaacgatatgacagtcaacgaaggaacaaatgtgactctcacctgtctggcaaccgggaaaccagagccctccattagctggaggcatatttccccgtcagcgaaaccgttcgaaaacggtcaatacttggacatttatgggatcactagggatcaagctggcgaatacgagtgtagtgctgaaaacgatgtttcattccccgatgtgagaaaggttaaagtggtggtcaattttgccccaactattcaggagatcaagtcgggcactgtgacacctggaagatccggcttaattcgttgcgagggagcaggcgtgcctccccctgcattcgagtggtataagggcgaaaaaaagctgttcaacgggcaacagggtattatcattcagaacttctcaacccgatccatccttaccgttaccaatgtgacccaggaacactttgggaattatacctgcgtggccgcaaataaacttggaaccacaaacgcaagcctgcctctgaacccgccttcaacagcccagtacggaataacaggttccgcggacgtcttgttctcatgctggtacctcgtgctgactctctctagtttcacgtccatcttttacctgaagaacgccatcctccagtag

SEQ ID NO: 232504 - DNA, 1065 bp, Artificial Sequence
  Description of Artificial Sequence: Synthetic coding sequence
atggatatgatgctgcttgtccagggcgcttgctgctccaaccagtggcttgctgcagttttgctatccctgtgctgcctgttacccagctgtctgcctgcaggacagtctgttgactttccctgggccgctgtggacaacatgatggttaggaagggagacacagccgtgttacgatgctatcttgaagatggtgcttctaaaggggcttggctgaaccgctcatctatcattttcgctggtggggataagtggtctgtggatccccgtgtctctatctcgaccctgaacaaaagggattactcactgcaaatccaaaacgttgatgtgactgatgacggaccttacacctgttccgtgcagacccagcacacacccagaaccatgcaggtgcacctgaccgtgcaggtcccccctaagatttatgacatcagcaatgacatgaccgtaaacgagggtacaaacgtaactttgacttgccttgccacagggaaacctgaaccttcgatttcatggcgccatatcagcccatccgcgaaacctttcgagaacggccagtacctcgatatatacggcatcacccgagatcaggccggtgaatacgaatgctccgccgaaaacgatgtctcgttcccggacgttcggaaggtgaaggtagtcgtgaacttcgccccaacaatccaggaaattaaaagtggcactgtgacacccggacggtctggcctgattcggtgtgaaggggcaggagtgccccctcccgctttcgagtggtataaaggggagaagaaactgtttaatgggcaacaaggaataattattcagaatttcagtactagatctattctgaccgtgaccaacgtaacccaggagcacttcggcaattacacctgcgtcgccgcaaacaagctgggaactactaatgccagcctgccccttaacccacccagcaccgctcagtacggcattaccgggtcggctgatgttctattttcgtgttggtatctggttctcaccttgagcagctttaccagtattttttacctgaaaaacgctattctccagtag

SEQ ID NO: 232505 - DNA, 927 bp, Artificial Sequence
  Description of Artificial Sequence: Synthetic coding sequence
atgatgttgctggttcagggggcttgttgttctaatcagtggttggcagccgttttgctgtctctgtgctgtctgctgccctcttgcttacccgcagggcagtcagtcgacttcccttgggccgctgtggataacatgatggttcgaaaaggcgacacggctgtgctgaggtgttaccttgaggatggtgctagtaaaggcgcatggctgaacagatctagcatcatcttcgctggaggcgataaatggtccgtggaccctcgcgtgagcatcagcaccttaaataagagggactatagcctccaaatacaaaacgtggatgtcaccgacgatggaccatacacctgctctgtgcagacgcagcacactcccagaaccatgcaggttcatttgacggtgcaggtccctccaaagatctatgatattagtaatgatatgaccgtcaacgagggcacaaatgtgaccctgacatgtctcgccaccgggaaacctgaacctagcataagctggaggcacatttctccatcagtggccccaaccatccaggagatcaagtccgggaccgtgaccccaggtagatcaggcctgatccgatgtgaaggcgcaggagtgccccctccggcttttgagtggtacaagggcgagaagaaactttttaatgggcaacagggaattattattcaaaacttttcaactcgaagtatacttaccgtaacaaatgtgacacaggagcacttcgggaactacacgtgtgtggccgcaaacaagctggggaccactaatgcttccctgcccttgaaccccccatccaccgcgcagtacggtatcaccggcagcgccgacgttttgttttcttgttggtacctggtgctaaccttaagctccttcacctccattttttatctcaaaaacgccatcctgcagtag

SEQ ID NO: 232506 - DNA, 2133 bp, Artificial Sequence
  Description of Artificial Sequence: Synthetic coding sequence
atggagactagggagtcagaagacctcgagaagacaagaagaaaatctgcttctgaccagtggaacaccgacaacgagccagctaaagtaaagcccgagttactcccagaaaaggaggagacaagtcaggcggatcaggatatacaagataaggaacctcactgtcatattccaattaaacgcaatagtatttttaatcggtcaatcaggagaaaatctaaggcaaaagccagagacaatccagagagaaacgcctcttgtttggccgactcacaggataatggtaagagtgtgaatgagcctctgacccttaacattccatggagccgcatgcccccatgtcgcactgccatgcagaccgatcctggagcgcaggagatgtccgaatccagcagtactcccggaaatggagccactcctgaggagtggcccgcactcgccgatagccctaccaccctaacagaggcactgagaatgatccatcctattcccgctgattcatggcgtaatctgattgagcagattggcttgctatatcaagaataccgggacaaatcaacccttcaggagatcgagacacggagacagcaggacgctgaaattgaggacaacacaaacggaagccccgcatcagaggacacccctgaagaggaagaagaggaagaggaggaagaggagcctgcatctcccccagaacgaaaaaccctaccccagatctgtcttctcagcaatccacatagccggttcaacctttggcaggacctacctgaaatcagatcatccggtgtccttgagatcttgcagccggaagaaatcaagcttcaggaggcgatgttcgaattagtgacttccgaggcgtcctactataaatctttgaacctattagtatcacacttcatggaaaacgagaggattcgaaagattctgcacccgtctgaggcacacatacttttcagtaatgttctcgatgtgttagcggtgagtgaaagattcttacttgagctagaacaccgcatggaggagaatatcgtgatttcagacgtgtgcgatattgtctatcgctacgctgcggatcacttctcagtgtacattacatatgtgagtaatcagacatatcaagagcgaacctacaagcagttactccaggaaaaggccgcttttagagagctcatcgcacagctcgagctggaccctaagtgcaggggtttacctttctcctcattcttgatcctgcccttccaacgcataactcggctgaagctgctcgtgcagaacatcctgaaaagagtggaagagagatcagagcgagagtgtaccgcccttgacgcccacaaagagctcgagatggtggttaaagcttgcaacgaaggagttagaaaaatgagcagaacagagcagatgatctcgatacagaaaaaaatggaatttaaaattaagtccgtgcctattattagccactctcggtggttattaaaacagggcgagctgcaacaaatgtcagggcctaaaacctctaggacactccggaccaagaaactgtttcatgaaatatatctgttcctctttaatgacttgctggtgatctgtagacagatcccaggagataagtatcaggtgtttgatagcgccccaagaggcctgcttcgggtggaagaactggaagatcagggtcagaccctggccaacgtttttatcctgaggctgcttgagaacgccgatgacagagaggctacctacatgctaaaggcctcaagtcaatcggaaatgaagagatggatgacgtctcttgctccgaacaggaggacaaaatttgtcagcttcactagcaggttgctggactgtccgcaggtgcagtgcgtgcatccttatgtggcacagcagcctgatgagttaacgttagaactggcagacatactgaacattctggataagaccgatgatgggtggatctttggggagcggctgcatgaccaggaaaggggctggtttccttcaagcatgacagaggagatactgaatccaaagattcggagccagaatctgaaggaatgttttagagtgcacaagatggacgacccacagaggagccagaataaagacaggagaaaactcggttcgagaaacagacaatag

SEQ ID NO: 232507 - DNA, 1857 bp, Artificial Sequence
  Description of Artificial Sequence: Synthetic coding sequence
atggagctgctggctgcagccttttctgcggcttgcgcggtcgatcacgacagcagtacctctgaatcagacgccagagacagcgccgcaggtcacttgcccggatcggaatctagcagcacgccaggaaatggggcaacccctgaagagtggccggcactggccgattcacccactacattgaccgaggctctccggatgatccatcctatccccgcagattcgtggcgtaatcttatcgaacagatcggccttctgtaccaggagtatcgagacaagtcaacattacaagagatcgaaacccgcagacagcaggacgctgagatagaggacaacaccaatgggtctccggctagtgaagacaccccagaggaggaagaagaggaggaagaggaagaggaacccgcaagcccccctgagcggaagacactgccccaaatctgcctcctcagtaacccccactcgagattcaacctttggcaagacctgcccgaaattagaagtagcggagtgctggaaatactgcagcccgaagagatcaaactgcaggaagcgatgtttgagctggtgactagcgaagcaagttactacaaatcccttaacctcttggtgtctcatttcatggaaaacgagagaattagaaagattttacatccctcggaggcccacatcctattctccaacgtgctagacgtcctggccgtgagcgagcggtttcttctggagctggaacacaggatggaagaaaatatagtaatttcagatgtgtgtgacatagtttaccgctacgcagccgatcatttctctgtttatataacctacgtctcaaaccagacataccaggagcggacctacaagcagctgctccaagaaaaggccgcttttcgtgaactcatcgctcagctggaactcgaccccaaatgtaggggtttgccatttagcagtttcctgattctacctttccaacgcataactagactgaaactcctggtgcaaaacattttaaagcgggtcgaggagcggtccgagagagagtgtacggctttagacgcgcacaaggagctcgaaatggtcgttaaggcctgtaacgaaggagtccggaagatgtctaggaccgaacaaatgatctcaatccagaagaagatggagtttaaaatcaagagcgtgcctattattagtcactctcggtggctgctaaagcagggggagctccaacaaatgtctggccctaagacctctcggactctgcggaccaaaaagctgtttcacgagatttacttattcttgtttaacgatctgctcgttatctgtagacagatacctggggacaaatatcaggtgttcgactcagcccctcgcggtctgttgcgggtcgaggagctggaagatcaagggcagaccctggccaacgtgttcatcctgagactgctcgaaaatgccgatgaccgagaggccacgtatatgcttaaagcctcctcccagtccgagatgaaaagatggatgacgagcctcgcacccaatagacgtactaaattcgtcagtttcacaagcaggctattggattgcccacaggtgcagtgtgtacacccttacgtggcacagcaacctgacgagctgaccttggagttagccgatattctcaacattcttgacaaaaccgacgatggctggatatttggcgagagactgcacgaccaggaaaggggatggttcccaagctccatgacggaggagatactgaatcctaagatccgctctcagaacctgaaggagtgctttagggttcacaaaatggacgacccccagagatcacagaataaggacagaagaaagctaggatccaggaacaggcagtag

SEQ ID NO: 232508 - DNA, 717 bp, Artificial Sequence
  Description of Artificial Sequence: Synthetic coding sequence
atggagctgctggccgcagcattctcagcagcctgcgcggttgatcatgattcatctacttccgagtctgatgcaagggattcggctgctggacatctccctgggagtgaaagctctagcactcccggaaatggggcaactcctgaggaatggcccgctctggctgattctcctactaccctgaccgaggccttgcgcatgatccaccccatacccgcagatagttggcgcaatctgatagagcagatagggctgttgtatcaagaataccgagataaatccacgctgcaggagattgagacaaggaggcagcaggacgccgagatagaggataataccaacggatctcctgcatccgaggacactcctgaggaggaagaagaagaagaagaagaggaggaacctgcttcacctcccgaacgcaagacattaccccagatttgtcttctgagcaacccacacagtaggttcaacctgtggcaggatcttcccgagatccgatcatcaggggtgctcgagatcttgcagccagaagaaattaaactccaggaagcaatgttcgaactggtcacttcagaagcctcatattataagtccctgaacctattggttagtcattttatggagaacgaacgtataaggaaaattctacacccatcagaggctcatatactcttttccaatgtgttagacgttttggctgtgagcgagcgctag

SEQ ID NO: 232509 - DNA, 1302 bp, Artificial Sequence
  Description of Artificial Sequence: Synthetic coding sequence
atgttcgaactggtgacctccgaagcatcatactataaaagcctaaacttgttagtgtcccactttatggaaaatgagcggattcggaaaattctgcaccctagcgaggctcacatcctgttttctaatgtgttagatgtgctggcggtgtctgagaggttcctgttggagctagaacacaggatggaggagaacattgtgatttccgacgtgtgcgatattgtataccgttatgctgccgaccacttctcagtgtacatcacatacgtgtctaaccagacctatcaagagcggacgtataagcagttgttgcaagaaaaggcagctttcagggaacttatagcccaactggagttggatcctaaatgtcgaggactgccgttcagctccttcctgatcctccctttccagcggatcacaagattgaagctgctcgtgcagaacatactcaaacgggttgaagaaagaagcgagcgggagtgcactgctctggatgcccacaaagagcttgaaatggtcgtgaaagcctgcaacgagggggtgaggaaaatgagtagaacagagcagatgatttcaatccagaagaaaatggaattcaagatcaagtctgtcccgatcatctctcacagtagatggctgttgaagcagggggaactccagcaaatgagcgggccaaaaacatccagaacactgcggacaaagaagctctttcacgaaatctatctctttctcttcaatgacctcttagtgatttgtaggcagattcctggagacaaatatcaagtgtttgattccgctcctagaggactgctgcgcgtggaggagcttgaagatcagggccagacgttagctaatgtgtttatcctgcgccttctggagaatgccgacgatagagaagcgacatatatgctgaaggcctcatcacagagcgaaatgaagcgatggatgactagtctggccccaaaccggagaactaaattcgtctctttcacatcaaggctgctcgactgtcctcaggttcagtgcgtgcacccctacgtggcccagcaaccagatgagctcacccttgaacttgcagacatcctcaacattctggataagactgacgatggttggattttcggtgaacggctgcatgatcaagagcggggatggttcccttcctcaatgaccgaagaaatattgaatccaaaaatcagaagccagaaccttaaggagtgcttccgggtgcataaaatggacgacccccagcgatctcagaataaggatcggaggaagttgggctcgcgaaatagacaatag

SEQ ID NO: 232510 - DNA, 1803 bp, Artificial Sequence
  Description of Artificial Sequence: Synthetic coding sequence
atgccaccctgccggaccgcaatgcagacagatcctggggctcaggaaatgagcgaatcttccagtacacccggaaacggcgcaactcctgaggagtggcccgctctggccgattccccaaccacccttaccgaggccctcagaatgattcatcccataccggcagatagctggcgtaatctaatagaacagatcggtctgctctaccaggaataccgagataagtccacgcttcaggagattgagacaagaaggcaacaggacgcagagatcgaggataatacaaatgggagccccgcttccgaggatacccctgaggaggaggaagaggaggaggaggaggaggaacccgctagcccaccggagaggaagacactgcctcagatctgcctgctcagtaacccacactctaggttcaacctgtggcaggacctccctgagatccgctcctccggcgtcctggaaatcttgcaaccagaagagatcaagcttcaagaagctatgtttgagctcgtaactagtgaagcttcctattacaagtctctgaacctcctggtctctcatttcatggagaacgagcgcattaggaagatcctgcaccccagcgaggcacatatcctgttctccaatgttcttgacgtgctcgcagtgtccgaacggttcctgcttgaattagagcatcgtatggaggagaatatcgtgatcagtgatgtgtgtgacattgtataccggtatgctgcagaccacttctccgtgtatatcacttatgtgagtaaccaaacctaccaggagaggacttacaagcagctcctgcaggagaaagcggcatttcgtgagcttatcgcgcaattggagctggatcctaagtgtcgcggtctgcctttttcatcctttctaatcttgccatttcagaggattacacggctgaagctcctcgtgcagaacattctgaagcgcgtggaggaaaggtcagagcgtgagtgtacagccctggacgctcacaaagagctggagatggttgtaaaagcctgcaacgagggagtgcgtaaaatgtccagaaccgagcaaatgatttccattcagaaaaagatggaatttaagatcaagtctgtgccaatcattagccattcccgctggctgctgaaacagggcgaacttcagcagatgtctggacctaaaacaagtcgcacgctacggactaaaaagctgtttcatgagatctacttattcttgtttaacgaccttctagttatctgtagacagattcccggagacaaataccaagtgttcgatagcgccccaaggggcctcttgagagtggaagaactcgaggaccagggccagacactggcaaacgtcttcatccttcgcctcctcgagaacgcggacgacagagaagcaacttacatgcttaaggcctctagccaaagcgaaatgaagcgttggatgacttccctggcaccaaaccggaggactaagttcgtgagctttacctctcgactcttggattgtccccaggttcagtgcgtgcacccttacgtagcacagcagcccgatgagttgaccctggagctggccgacatacttaatattcttgataaaacagatgatggctggattttcggggagagacttcatgaccaagaaagaggctggttcccaagctcaatgactgaggagatactgaatccaaagatacgaagtcagaacctgaaagagtgcttcagggttcataagatggatgatccacaaagatctcagaataaggataggcgtaagttgggatccagaaaccgacagtag

SEQ ID NO: 232511 - DNA, 705 bp, Artificial Sequence
  Description of Artificial Sequence: Synthetic coding sequence
atgactggcagtagtgtgttcgactacatccatcccggtgaccatagtgaagttctcgagcagcttggactgcgtacaccaacccccggaccaccgaccccccctagtgtgtcttcctcatcatcctccagctctagtttagccgacacaccagaaattgaggcaagcctgactaaagtgcctccaagctctttggtgcaagaacggtcctttttcgttaggatgaagtccacactaacaaaacggggattacacgtcaaagccagtgggtacaaagtgattcatgtcacgggcagactgcgggcacatgccctcggcctcgtggcgctgggtcatacactgccacctgccccactcgctgagttaccactgcacggccatatgattgtattcaggctctcgcttggactgactattctggcctgcgaatctcgggtgagcgatcatatggacctaggcccaagcgaactcgtggggcgatcctgctatcagttcgtacatggtcaggatgcaacaagaatccgtcagagccacgtggactcctgtcggggtctccgggttgcagccgtgtgtgggcacagcggatgggaacgggaggaaccacgaggagccccatgtgccctggggcagccacgtgcccagcctagtcggggatggccaaacagcttcggatgcctccccgcttcctcgcagaggggcctgtag

SEQ ID NO: 232512 - DNA, 1773 bp, Artificial Sequence
  Description of Artificial Sequence: Synthetic coding sequence
atggctgctccttacccaggaagtggagggggaagtgaggttaagtgcgtggggggtagaggcgctagcgtgccatgggacttcctgcctgggctgatggttaaagctccctcaggaccatgcctgcaggcccagcggaaggaaaagtctcgtaatgctgctcgcagtcgcagagggaaagaaaaccttgagttctttgagcttgctaagttgctccctctgcctggcgcaatctccagtcaacttgataaagcaagtattgtccgactgagtgtgacctatttgcgactccgacgtttcgccgctctgggggcacctccgtggggcctcagagctgcgggtccaccggctggcctcgcaccaggcaggcgaggacccgcagccctcgtctccgaggtgtttgaacagcatttgggtggccatatacttcagtcactcgacggctttgttttcgctttaaatcaagagggaaagttcctttacatcagcgagacagtctctatctatctcgggctcagccaggttgagatgacaggaagctctgtattcgattacattcatcctggcgatcacagcgaggtactggagcaactcggattgaggacccctacacctggcccaccaactccaccctccgtctccagcagcagctcatcctccagcagcctggcagacactcccgagatcgaggccagccttaccaaggttccgccttcaagccttgtgcaggaacgatccttctttgtgcgtatgaagtccacccttactaaaagaggcctgcacgtaaaagcgtcaggatacaaagtaatccacgtgactggacggctgagggcccacgccttgggactggtcgctctgggccacaccctgccgccagcaccccttgccgaacttcccctgcatggacatatgattgtcttcaggctgtcactaggattaaccattctggcgtgtgaatctcgagttagtgaccacatggatttgggaccctctgaactggtaggtaggtcatgttatcaattcgtccacggacaggatgctactcgcatcagacaatcgcatgtggatttgctggataagggccaggtgatgacgggatattaccggtggttgcagagggctggcggattcgtgtggctccagtccgtggccaccgttgccggtagtgggaagagccccggagagcatcatgtgttgtgggtgtcccacgtcctcagccaggccgaaggaggtcagacaccactcgacgctttccagttacccgcatccgtcgcttgtgaggaagcctctagccctggccctgagccaacggaacccgaaccaccaacagaaggcaagcaggccgcacctgccgaaaatgaggccccacagacccagggcaagcggatcaaggtggaaccaggcccaagggaaacgaagggctccgaggactctggagacgaggacccgagcagtcaccctgcaaccccacgacctgagttcacctctgttattcgcgcaggggtgctgaaacaagatccagtgagaccatggggactggcccctcctggagatcccccacctaccctgctgcacgcaggttttttgccgcctgtcgttaggggcctctgcacgccgggaactatccggtatgggccagcagaattaggtcttgtgtatccgcacttgcaacggcttggccctgggccagctctgcctgaggcattctaccctcccctgggtctgccctatccgggtccggctgggacacgacttcccaggaagggggattag

SEQ ID NO: 232513 - DNA, 2475 bp, Artificial Sequence
  Description of Artificial Sequence: Synthetic coding sequence
atggatgaggatgaaaaggatcgcgcaaaacgtgccagtcgcaacaaatctgagaagaagcggagagatcaatttaacgttttaataaaagagctctccagcatgctccccggaaatacccggaagatggacaagaccaccgttctggaaaaggtgattggtttcctgcagaagcataatgaggtctccgcacagactgagatttgcgatattcagcaggattggaaacctagcttcttgagcaacgaggagtttacccagctaatgttggaggccttggatgggttcataatcgcagttaccaccgacggtagcataatctacgtcagcgattctatcacaccactgctggggcacctgcccagtgacgtgatggaccagaatctcctgaactttctgcctgagcaagagcacagcgaagtgtataagatattgagttcccatatgcttgtgacagattctccgtcgccagaatacctgaaatccgactcagaccttgagttttattgccatttactgagagggagcctgaacccaaaggaattcccgacttatgaatacataaagttcgtgggcaacttcagatcctataataacgtaccaagtcctagctgcaatggtttcgacaataccctgtcaagaccctgcagggtgcctctcgggaaggaagtgtgcttcatcgccaccgtccggctcgctactccgcagtttttgaaggagatgtgtattgtagatgagcctctcgaggagtttacctcgagacattccttagagtggaaattcctgttcctcgatcaccgcgctcctccaatcatcggctatttgcccttcgaagtgctggggacatccggttacgactactaccacattgacgacctggagctgctggctcggtgtcaccagcacctcatgcagttcgggaagggcaagtcttgctgttacaggtttcttaccaagggacagcagtggatttggctgcaaacccactactatatcacgtaccatcagtggaacagtaaaccagagtttatcgtatgcactcatagtgtagtctcctatgctgatgtgcgagtggaacgcagacaggaacttgctctggaggaccctccttcggaggctctgcactccagcgccctgaaggataaagggtctagccttgagcctagacaacattttaacacactcgacgtaggcgcaagcggcctgaacacttctcactcccccagcgccagttccaggtctagtcacaagagttcccataccgctatgtccgaacccacttcgacgcccacgaagttgatggcagaggcaagcacaccggcattaccaagaagcgctacgctacctcaggagttgcctgtgcccggtttgagtcaggcagccacaatgcctgccccactgcccagtccctccagctgtgatctaacgcagcagcttctgccccagacagttctccagagcacccctgcaccaatggcccagttttccgcacaattctccatgttccagacaatcaaagatcagctggaacagcggacccgtattctgcaggccaatattcgttggcagcaggaggaactccacaaaatccaagaacagttatgcctggtgcaggatagtaatgtgcagatgttcttgcagcagcctgcagtctctttatccttttcatctacacagaggccagaggctcagcagcaactacagcagagatccgctgccgtgacacagccgcagctgggtgcgggacctcagctgccgggacagatcagtagcgctcaggtgacaagccaacatttattgcgagaaagctcagtcatcagcactcaaggcccaaaacccatgaggagctcccaattaatgcagtctagtggacgctccggctcctccctggtctcaccattttcctcagcaacggccgcactccccccatctctgaatttgactactccagcatcaacaagtcaagatgccagtcagtgtcagcctagccccgatttctctcacgaccggcagctgaggctgctgctcagccagcccatccagccgatgatgcctgggtcctgtgacgcccgacagcccagcgaggtttcacgcaccggcaggcaggttaaatatgcccagagtcaaaccgtatttcagaatccagacgctcatccagccaacagtagttcagcgccaatgcccgtgctgctaatgggccaggcagtcctgcacccttcttttccggcaagccaacccagtccactgcagcctgctcaggcccgacagcagccaccacagcactacctccaagtacaagcgccaacgagcctgcactcagagcagcaagacagccttctgctgagcacctatagccagcagcctggaacacttggctacccacagccccctccagctcaaccccaacccctgagaccaccaagacgtgtatcatcactgagtgagagttcaggcctccagcagccgccaaggtag

SEQ ID NO: 232514 - DNA, 2670 bp, Artificial Sequence
  Description of Artificial Sequence: Synthetic coding sequence
atgtacgcatacgggttcgtgggtagatgcgcacccttcccagccgaagaaggcaggaccttcgatttatccgaggaattaggcagatcagtgacacgggagggtacaggtaccacccggcttaactctgagcctgtgcctctgctttgtctcccacttcttaactgttctcgtaaaaactgcatagagaacctgatggatgaagatgagaaagatcgcgcaaagcgggcttcccgcaacaagtctgagaagaagcggcgtgatcagttcaacgtgcttatcaaggaacttagtagcatgttaccaggtaacacccggaagatggacaaaacaacggtgctcgagaaagttattggctttctgcagaagcataacgaggtgtccgctcagaccgagatctgtgatattcagcaggactggaaaccctctttcctgagtaacgaggagttcacccagctgatgttagaggcgttagacggattcattattgctgtcactactgacggtagcatcatctacgtcagcgattcaattactccgttgcttggccacttaccttccgatgtgatggaccagaaccttttaaacttcctgccagaacaagagcatagtgaggtttacaagatcttgtcctctcacatgcttgtcaccgattccccgagcccagaatatctaaagtctgactccgacctagagttctactgtcacctgctccgtggcagcctgaacccaaaggagtttccaacttacgaatacataaaattcgttggtaatttcaggtcttataataacgtgccgtccccctcctgcaacggctttgataatactctttccaggccgtgtagggtcccactgggcaaggaagtttgcttcatcgctacagtgcggctggccaccccccagtttctgaaagagatgtgcattgtggatgagccgctggaagaattcacctcccgacactccctggaatggaagtttcttttcctagatcatagggcaccaccgattattggctacctgccctttgaagtcctgggaacatctggctatgactattatcatattgatgatctcgagctgctagctcgttgccaccagcatctaatgcagttcgggaaaggtaaatcttgttgttataggtttctgaccaagggccaacagtggatttggctgcagactcactattatattacctatcaccagtggaattccaagccagagtttatcgtctgtacccattccgtggtgtcttacgctgacgtgagagtggagaggagacaggagctggctttagaagacccgccaagcgaggctctgcactcctctgctcttaaggacaaggggtcctccctggagcctcggcaacacttcaacaccctcgacgtcggtgctagtggactaaacacttcgcattcccccagtgctagtagtcgctcatctcataaaagtagccacacggcaatgtccgaaccaacgtccacacccaccaagctgatggccgaggccagtactccggctctgccccgaagcgccacgctcccacaggagctaccagtccctggcctaagccaggccgctactatgcctgccccattacccagtcctagctcctgtgatctcacgcagcaactgctgccgcagacagtcctccaaagtactccggcaccgatggctcagtttagtgcacagttctccatgtttcagaccataaaggatcagctggaacagaggactcggatacttcaagccaatattcggtggcagcaggaagaactccacaaaatacaggaacagctttgcctcgtgcaagatagcaacgttcagatgtttctgcagcagcccgctgtctcgctgagcttcagtagtacccagcgcccagaggcccaacagcagctacagcagcgtagcgcagccgtcacacagcctcagctcggtgccggaccccagcttcccggtcagatcagttctgctcaggtgaccagtcaacatctcctgcgagaaagctcagtgatctccacgcagggtcccaagcctatgaggtcctctcaactgatgcagtcatccggacgaagcgggtcaagtctggtcagcccatttagttccgctactgcagccctcccgcctagcttgaatttgaccacacctgcgagcacaagccaagatgcatcccagtgccagccgagcccagatttttcacatgacagacagctgagacttttgctttctcaacccattcagccgatgatgcccggatcttgtgacgcaagacaaccgagcgaggttagtaggactggcagacaagtcaagtacgcccagtctcagacagtcttccagaatccggacgcccatcctgccaacagtagctccgctcctatgcctgtgctactaatgggccaagcagtcctccacccgtccttccctgctagccaaccctcgcctctgcaacccgcacaggccaggcagcagccaccccagcactatcttcaggtgcaggccccaaccagcctgcactcggaacagcaggactccttattgctaagtacctattctcagcaacccggaacactcgggtacccacagcccccacctgctcagccccagcccctccgacccccacgtagagtgtctagcttaagcgaaagctccggactacagcagccacctagatag

SEQ ID NO: 232515 - DNA, 774 bp, Artificial Sequence
  Description of Artificial Sequence: Synthetic coding sequence
atggcgcctacaaagccctcttttcaacaggaccctagcagacgggaaagaattacagcacagcaccctcttcccaatcagagcgaatgcagaaagatttaccgctacgatggaatctactgcgaatctacctatcaaaacctgcaggctctgcggaaagagaagagtcgtgacgctgcaaggagccgcagagggaaggaaaatttcgaattttacgaactggccaagctgctccctctgccagccgctattactagtcagctagataaggcaagtatcatccgcttaactatatcctaccttaaaatgagagatttcgccaatcagggcgaccctccttggaatttgcggatggaagggcctccacccaacacttcggtgaaggtcataggcgcacagaggagacgctccccttctgccttggctattgaggtgttcgaggctcaccttggtagtcacatcctgcagagtctggatggtttcgtgtttgccctcaatcaggaggggaagtttctgtacatctccgagaccgtttccatttatctgggactttcccaagtcgagctcaccggtagttccgtttttgattacgtgcatccaggggatcatgttgaaatggctgaacagctcggcatgaaactccctcctggtaggggcctcttgagtcaaggcacagctgaagacggggcttcatcagcaagctcctcctcccagtccgagaccccagaacccgttgtctgcttccctcccgcttctgaccagttcttactgtag

SEQ ID NO: 232516 - DNA, 2706 bp, Artificial Sequence
  Description of Artificial Sequence: Synthetic coding sequence
atggcccctaccaagcccagctttcagcaagatcctagtcggagagagcgcctacaagccctgcgcaaagaaaagagcagagacgccgctcggagtcggcgtgggaaggagaacttcgagttctatgaactcgctaagctgctgcccctgcccgctgcaattacctcccaactcgacaaggcgtctatcattaggctgactattagttatctcaagatgcgggattttgcaaatcagggagatcccccatggaatttgcggatggaggggcctccacccaacacatctgtcaagggagcccagagacggcgaagtccctccgccctcgcaatagaggtcttcgaagcacacctgggctcccatattcttcaatctctagacggctttgtattcgcgttgaaccaggaaggcaaatttctgtacatcagtgaaactgtgagtatctaccttggactgagtcaagtagaactcaccgggtcaagtgtattcgactacgtccacccaggcgaccatgtggaaatggcagagcagctaggtatgaaactgcccccaggcaggggactgctgtcacaggggaccgccgaggatggcgcaagttctgcctcttcctccagccaaagcgaaaccccggagcccgtagagtctacctcccccagcctgcttacaacagacaatacactggagagatcattctttattcgaatgaaatctacactgaccaagcgcggagtgcacattaaatcctctgggtacaaagtcattcacattacgggaagactccggctgcgggttagcctgtcccacggacggaccgtcccttcgcagataatgggactcgtggtggttgcacatgcgttgcctccgccaacgatcaacgaagtccgcatagactgtcatatgttcgtcacaagagtgaacatggacctcaacattatctattgcgaaaaccgcatcagtgactacatggacctgacccctgtggatatagtgggtaaacgatgttatcatttcatccatgctgaagacgtcgaggggatcaggcactcacacttggacctgctgaataagggacagtgcgtcacaaaatactatcgttggatgcaaaagaacggcggatatatctggattcagtcttcagccacaatcgctatcaacgctaaaaacgccaacgaaaagaacatcatatgggtgaactaccttttatcaaacccagagtacaaggacacaccgatggatatcgctcagcttccgcatctgcccgagaagacaagcgagtcctctgagacctctgattcagaatcagattctaaggacacctcaggaattactgaagataatgaaaattccaagtcagatgaaaaaggcaatcagagcgagaatagcgaggaccccgagccagatagaaaaaagtccggtaatgcctgcgacaacgatatgaactgtaatgatgacggccactcaagttcaaaccctgattccagggactcagatgattcttttgagcattcagatttcgagaatcctaaagctggggaggacggcttcggggcactcggcgctatgcagataaaagtcgagaggtatgtggagtccgagagtgatcttaggctgcaaaattgtgaatctctaacttccgacagcgcgaaggattcagactcagcaggcgaagcgggtgcacaggcaagctccaaacatcagaaaagaaagaaacgacgcaaacgacagaaaggcggttccgccagcagacgtcggctgagctccgccagtagtccgggagggctcgacgcaggcctggtggagccgccaaggttgttgtcttcacccaattcggcgtcagtactcaagattaaaactgaaatttctgagcccattaatttcgacaatgacagtagtatctggaactatcccccaaatcgagaaatcagccgcaacgaaagcccttattcgatgacaaaaccacccagcagcgagcactttcctagcccgcagggaggcggagggggagggggtggtggaggcggactgcacgtagccatccccgacagcgtattgactccgcctggggctgatggggcagcggctcggaagacccagtttggtgctagcgcgacggccgcactggcaccagtcgcctctgatccgctgtcaccccctctcagtgcctcccctagggacaaacatcctggcaatggaggagggggtggcggtgggggtggcggtgctggaggcggaggaccatctgcctccaatagcctgctgtacaccggcgacttagaggctctgcaacgactacaggctggaaacgtcgtgttacccttggtgcatcgcgtaacaggcactctggccgcaacatcaacagctgctcagcgggtttacacaacaggcacaataagatatgctccagccgaggtcactctagccatgcagtcaaatctgctgcccaacgctcacgctgtgaactttgtggatgtaaactctcccggatttggactggacccaaaaactcctatggagatgctttatcatcacgtgcaccggctcaatatgtccggcccatttggcggtgctgtatcagcggcttctcttacacagatgcctgccggtaacgttttcaccaccgcagagggcctgttctccactctccccttccccgtgtatagcaatggcatacatgcggcacagacactggagcggaaggaggactag

SEQ ID NO: 232517 - DNA, 2802 bp, Artificial Sequence
  Description of Artificial Sequence: Synthetic coding sequence
atggcccctactaagcctagctttcaacaggatccatcacgaagagagcggatcacagcccaacatcccctgcctaatcagtcagaatgcaggaagatttatcgttacgatggcatctattgcgaatccacataccagaatctgcaggctctaaggaaagaaaaatctcgggacgcggcaaggtccagacgcggaaaggagaatttcgaattttatgaattggccaaactcctccctcttcccgctgcaatcactagccagttggacaaggccagcataatacgcttgacaatttcttacctgaaaatgcgcgattttgccaaccaaggcgacccaccatggaatctgcggatggagggccctcctcctaacacttcggtaaaagtgatcggagcacaacggaggaggtctccctcagcgctcgcaatagaggtattcgaggcacacctggggtctcacatcttacagagtctggacggctttgtctttgcccttaatcaggaaggtaaattcctatacatatcggaaacggtcagtatatatctagggctgtctcaggtggagctaaccggatcttccgttttcgactacgtacatccaggcgatcatgtcgaaatggctgaacaactcggtatgaagcttcctcctggcagagggctgctgagccagggaacagcggaggacggagcaagctctgcatcgagctccagccagtccgaaaccccagagccagtagaaagcactagtccttcactgctcacaactgacaatacgctcgagagatcttttttcatccgcatgaaatcaacacttacaaaaagaggcgttcatatcaagtcatccggctacaaggtgattcacatcactggcaggctacgactgcgggtctcactaagtcatggcagaactgtgccttctcaaatcatgggtttggtcgtggttgcccatgctcttccccctcctaccattaatgaggtacggatagattgccatatgtttgtcaccagggtcaacatggacctgaatattatatactgcgagaataggatttccgactatatggatcttacaccagttgacatagtcgggaaacgctgctaccactttatccacgccgaggacgttgaggggatacgacattcccaccttgaccttctcaacaaaggccagtgtgtcaccaagtactaccgctggatgcagaagaacggaggctacatctggatccaatctagcgcaactattgccattaacgctaaaaatgccaacgagaagaatatcatttgggtaaactatctgttgtccaatccagagtataaggacacacccatggatattgcccagctaccacatctgcccgaaaagactagtgagagtagcgaaacctctgattccgagagcgacagcaaggacacttccgggatcacggaagacaacgagaacagtaaatctgatgagaagggaaaccaatctgagaactccgaagatcctgaaccggataggaagaagagtggtaatgcttgcgacaacgatatgaactgcaatgacgacggccactctagctccaacccggacagtcgggactctgatgacagctttgagcacagcgacttcgaaaatccaaaggccggtgaggacggatttggcgcattgggcgctatgcagatcaaagtcgaacgatacgttgagtccgagagcgatcttcgtcttcagaactgcgagtcacttacatccgactccgctaaagactcagacagcgcaggagaagcaggggctcaggcctccagcaagcaccagaaacgaaagaaaagacgcaaacgccagaaaggagggtccgccagtaggcgtaggctatcctcagcttcttcacctggcggactggatgccggacttgtagaaccgccaaggcttctgagctccccaaattctgcgtccgttctcaaaatcaagaccgaaatcagcgaaccaatcaatttcgacaatgactcctcaatatggaactatccccctaacagggagatttctcgcaatgaaagtccctactctatgactaagcctcccagtagcgaacacttcccatcaccacaaggaggtggtgggggaggcggaggtgggggtggtctgcatgtggcaatccctgactcagttctgacgcctcctggggctgatggtgcagcagccagaaagacacaatttggcgcatctgcaacagctgccctggcacctgtggcttctgacccattgtcgccccctttgagtgcctcaccccgtgacaaacacccaggcaatgggggaggcggagggggaggcggaggcggagcaggtggaggcggaccttcagctagcaactccttgctctacaccggggaccttgaagctcttcagcggctgcaggctggtaacgtggttctaccactggtgcaccgcgtaactggcacattggctgctacctcaaccgctgctcaacgggtatacacgaccgggacgatcaggtatgcccctgcggaggtgactctggccatgcagtccaatctgctgccaaacgcccacgccgtgaacttcgtggacgtcaatagtccagggtttgggctcgatcctaaaactcctatggaaatgctctatcaccatgtgcatagactgaatatgtctgggccattcggaggcgctgtgtcagctgcatccttaactcagatgcccgctggaaacgtcttcacaacggctgaagggctcttcagcactctgccttttcccgtatacagtaacggaatccatgccgcacaaacgctggagcgaaaagaggattag

SEQ ID NO: 232518 - DNA, 2763 bp, Artificial Sequence
  Description of Artificial Sequence: Synthetic coding sequence
atggcacccaccaagccaagtttccagcaggatccctcaaggagggagcgccttcaagctttgcgaaaggaaaagagtcgggatgcagctagatctcggcgtggaaaagagaactttgagttttacgaactcgcgaaactcctgcctcttcccgcagccattacaagccagctggacaaggctagcattattcgtcttaccatatcttatctgaaaatgcgtgactttgccaaccagggcgaccccccttggaacttgcgcatggagggtccaccgccaaataccagcgtaaaaggcattcaaatgtggaaatctgagttatgcatgcgcaaaaccccatgcgaggtcatcggcgcacagagaagaagatccccaagcgccctggctatcgaggtgttcgaagcacatcttggatcccatatccttcagagtttggatggcttcgtctttgccctcaaccaggagggcaaatttctttacatttcagaaacagtttccatctatctgggcctctcccaggtggagctgactggcagcagcgtattcgattatgtgcaccccggagaccatgtggagatggcagagcagctaggcatgaaactgccaccaggaaggggtctgctgtctcagggcactgccgaggacggagcgtcatccgcctctagctcaagtcaatccgagactcccgaacccgtggagtctacgagcccaagcctgctgactacggataatacccttgagaggagtttcttcattcggatgaagtctacactaacaaaaaggggggtacacatcaagtcaagtggatataaggtgatccatatcacggggaggctccgcctgagagtatctctaagtcacggcaggacagtgccgtcgcagatcatgggtttggtagtggtggcacatgctttacctcctccaaccataaatgaagtgcgcatagattgccacatgttcgtgacacgggtaaatatggacctgaacattatctactgtgaaaacaggatctcggactatatggaccttacccccgtcgatatcgtggggaaacgctgttaccactttatccacgcagaggacgtggaagggattcggcactcacatctcgacctgttgaataaaggtcagtgtgtgaccaaatactacaggtggatgcagaagaacggcggatatatctggatccagagttcggccactatcgcaatcaacgccaagaatgcgaacgaaaaaaatatcatttgggtgaactacctgctttcaaatccagagtacaaggacacacctatggatatcgcacagctgccacatctgccagaaaaaaccagtgagagctctgaaacctccgattctgagtccgattccaaagacacaagtggtataaccgaagataatgaaaacagcaagtctgacgagaaagggaatcagtcagagaacagtgaggaccctgaaccggatcggaaaaagagcggtaatgcttgtgataacgacatgaattgtaacgatgatggccactctagttccaacccggacagccgggatagcgatgactcctttgaacattccgactttgaaaaccctaaagccggtgaggatggttttggtgctcttggcgcaatgcaaatcaaggtagaaagatacgtggaatccgagtcagatctacgcctacagaactgtgaaagtcttacctcagacagcgccaaagatagtgattcagcaggcgaggctggggcacaggcctcaagtaaacatcagaagcgtaagaaaaggagaaagcgtcagaaaggcggaagtgcttcccgccgtcggctgagctcagctagcagcccaggtgggctcgatgccggactggtcgaacccccaaggctgctgtcgagcccaaatagcgcttctgtcctcaaaattaagactgaaatctccgagccaatcaattttgataacgattctagtatttggaactacccacccaatcgagagatttcaaggaacgagtctccctacagtatgaccaaaccacccagcagtgagcacttcccctcgccgcagggtggcggagggggaggcggtgggggagggggtttacacgtggctatacccgattctgtgctgacgccaccgggtgcggatggagcagctgctcggaagactcagttcggagcctctgccacagcagccctggcccctgtggctagcgatcctttgtctccaccactgtcggccagcccccgtgataaacaccctggcaatggaggaggcggtggaggaggagggggaggggcagggggaggtggaccctcagcttcgaatagtcttctgtatactggagatctcgaagctcttcagaggctgcaggccggaaatgtggtgctgccactggttcaccgtgtcacagggacactagccgcaaccagcacagcagcccagcgcgtctacaccaccgggacaattagatatgcccctgcggaggtgacattagcaatgcagtccaatttgcttcccaatgcccacgccgttaactttgtcgacgtcaatagccccggtttcggcttagaccccaagactcccatggagatgctgtaccaccatgtacaccggctcaatatgtctgggcctttcggcggagcagtttcagcagcaagccttacccagatgccggcagggaacgtttttaccaccgctgagggcctattctcgaccttaccttttcctgtctatagtaacgggattcatgctgctcagactctggagagaaaagaggattag

SEQ ID NO: 232519 - DNA, 462 bp, Artificial Sequence
  Description of Artificial Sequence: Synthetic coding sequence
atgagagacttcgccaaccagggcgacccaccttggaacttgcggatggagggtcccccaccaaatacctctgtcaaaggagcccagcggaggaggagcccctcggcactggccattgaagtgttcgaagcccacctcgggtcccacattctgcagtctctggatggctttgtgtttgccttgaaccaggagggaaagttcttgtacatttcagaaaccgtgagtatttatctgggactaagtcaggtggagctgaccggaagctcagtgttcgactacgttcaccccggagaccatgtcgagatggccgaacaacttggtatgaagctcccccctgggaggggtctgctgtcccagggaacggctgaagatggggcatcctcagcctcaagttcatcacaaagtgagacaccagaacctgtggtgtgttttcccccagccagcgaccaattcctcctgtag

SEQ ID NO: 232520 - DNA, 2712 bp, Artificial Sequence
  Description of Artificial Sequence: Synthetic coding sequence
atggccccaaccaagccttccttccagcaggatccttcccggagggaacgtctgcaggcactgaggaaggagaagtctagagacgctgcccgttctcgccgaggaaaggagaatttcgagttttacgagctggctaagctgctgcccctccccgcagccatcacgagtcagctggacaaggctagtattatcaggcttacaattagctatcttaaaatgcgtgactttgccaatcagggtgaccctccatggaatctgaggatggaaggaccgcctcccaatacgtcagtgaaggtcattggagcacagaggcggcgatccccgtctgctctggccatcgaagtttttgaggcgcacctaggctcacacatcttacagagtttggacggctttgtattcgccctgaaccaggagggcaagtttctctatatctcagaaacagtgtcaatctacctgggactctctcaggtggaacttacaggctcctccgtgttcgactacgtccaccctggcgaccatgtcgagatggcagagcaacttggcatgaaactgccacctggcagagggctgcttagtcaaggaacagctgaagacggtgcgtcgtctgcctccagtagtagccagagtgaaacaccagagcctgtcgaaagcaccagtccatccctcctgacaacagacaataccctggagagaagcttttttatacgcatgaagagcaccctgaccaagagaggagtccacattaagtcctctggctataaagtgatccacatcacagggcgtctacgccttcgagtttccctgtcccatggaaggaccgtgccaagccagattatgggcctcgtagtggtggcacatgcacttcctcccccaacgatcaatgaggtcaggattgattgccacatgttcgtcacccgagtaaatatggacctaaacataatctactgcgagaatagaatatctgactacatggatctgaccccggtggacattgtgggtaagaggtgctaccacttcatccacgccgaggacgttgaaggaattaggcattctcatctcgacttattgaacaagggacagtgtgtgactaaatattatcggtggatgcaaaagaacgggggttacatttggatccagagcagcgctaccatcgctatcaatgccaagaacgccaacgagaaaaatatcatctgggttaactacttactttctaatccagagtacaaggacacgcccatggacatagcccagttgcctcatctgcccgagaagactagcgagagcagcgaaacgtccgactccgagtccgatagcaaggatacaagcgggatcaccgaagataacgagaactctaaaagtgatgaaaaaggcaaccagtccgaaaactccgaggatccggagccagaccgcaagaagtcaggaaacgcttgcgacaatgacatgaactgtaacgacgatggccacagttcttcaaaccctgattctcgcgactctgatgatagctttgaacattcggacttcgagaacccaaaggccggagaggatggcttcggtgcccttggagctatgcagatcaaagtggaaagatacgttgaaagcgagagcgatctccgccttcaaaactgcgagtcgctcacttctgattccgccaaagactccgattctgctggagaagcgggtgcgcaggcgtcctctaaacaccaaaaaaggaagaaacgcaggaagcgtcagaagggcggttcggctagccggagaaggctgtcatctgcctctagccctggcggtctcgatgccggactagtggaaccaccgagactgctctccagtcctaactcggcgtctgttctcaaaataaagacggagatctccgaaccaatcaactttgataacgactcatccatttggaattaccccccaaaccgggagatctcccgcaacgagtccccatactccatgacaaaacctcccagcagcgagcacttcccatctccacagggcggtggcggaggaggaggcggtggtggagggctccacgtggctatccctgacagcgtcctgacaccgccaggagcagatggggcagccgcaagaaaaacacagtttggggcttccgccacagcggctctcgctcccgtggcaagtgatcctttaagccccccattgagcgcgagcccaagggacaaacatccaggaaatgggggtggcggaggcggaggcggaggtggagctggaggaggcggacctagtgcatccaactctttgctctatactggagaccttgaagccctgcagcgactgcaggccggtaatgtagtgctgccactggtgcaccgtgtaacgggcacacttgccgcaacatccaccgcggcacagcgggtgtacactacaggaaccatcagatatgccccagctgaagtaactctggccatgcagtcgaatttgctcccaaacgcccatgccgttaatttcgtagacgtgaacagccctggcttcggcctggatcctaaaacacccatggagatgttgtatcaccatgtgcacaggctgaatatgtccggaccgtttgggggtgctgtgtcggcagccagcctgacgcagatgccagccggtaacgtgttcacaactgctgagggtctttttagtacactgcctttcccagtctattctaacggtatccacgccgcacagaccttggagcgtaaggaggattag

SEQ ID NO: 232521 - DNA, 2409 bp, Artificial Sequence
  Description of Artificial Sequence: Synthetic coding sequence
atgtaccgcagcaccaagggggctagtaaagctcggagggatcagatcaatgcagagattagaaatctcaaggaactactgcctctcgccgaagcagataaggtgaggctctcatacctgcacattatgagcctcgcgtgcatttacacgaggaaaggagtgttcttcgcagggggaacgcctctggccggacccactggcctcctgtccgcccaggagctcgaggacatcgtcgctgcgctgccaggctttcttctcgtgtttactgcagagggcaagctgctttacctgagcgaaagcgtcagtgaacacctcggtcacagtatggtggatttggtggctcagggagactcaatatacgatattatcgatccagccgatcacttgacagtgcgacagcagttgactcttccatctgcattggataccgatagactcttccggtgtaggttcaatacctctaagtccctaaggcgacagagcgccggtaataagctggtgcttattcggggacggttccatgcgcacccgccaggtgcgtattgggccggtaatcctgtgttcactgctttttgcgcgcctctcgaacctcgtccacggccaggccctggcccagggccaggaccagcctcgctgttccttgcaatgttccagagcaggcatgcaaaggacttagctttactggacatttcagaaagcgtcttgatctacctggggttcgagagaagcgagttactctgcaaatcatggtatggcctgcttcaccctgaggatctggcccacgcttccgcacagcattacaggctattagcagagtccggcgatatacaggcagagatggttgtgcgcctgcaggccaaaactggcggttgggcctggatatattgtttgttgtactcagagggccctgaaggacccattaccgccaacaattacccaatatccgatatggaagcttggtccctcaggcaacagctcaactcagaggacacacaggcagcatatgtgctcggcaccccaacaatgttgccctcgtttcccgaaaatatactatcgcaggaggagtgctcatcaacaaatccgctattcaccgccgcactgggggctccgagatcgactagcttcccctccgcgcctgagttaagcgtggtgagtgccagcgaggaactaccacgacccagtaaggaactggatttctcctatctaaccttcccatccggaccagagccctcacttcaagctgagctgagcaaggacctggtgtgtacacccccttacaccccacaccagcctggtggatgcgcctttcttttcagtctgcatgagcccttccagacacatcttcccacaccaagttccacactgcaggaacagcttaccccttctactgctacattctccgaccagctgactccctccagcgctactttcccagatccgctgaccagccccctgcagggccagctcaccgaaaccagtgtgcgctcctacgaagaccagctgactccctgtaccagcacttttcccgaccagctcctaccatctactgctacctttcctgaacctctgggttctcccgctcatgaacagctgacacctccatctacggctttccaggcacatcttgactcccctagccagacatttccggaacagctgtctcctaaccccactaagacatatttcgcacaagaggggtgctcttttctgtacgagaaactgccgcctagcccatcttcacccggaaatggcgactgcacactattagctttagctcagctgaggggtcctctctcagtcgacgttcctctggtgcctgaggggctgcttacgcctgaggcttcccctgtgaagcagtcctttttccactacagcgagaaagagcagaatgaaattgacagactcattcagcagatctcacagctggcacaagggatggacaggcctttctccgcagaggcaggcactggaggcctagagcccctcgggggactggaaccgctggattccaacttatctctgagcggggcagggccacccgtgctatctctggacctgaagccgtggaaatgtcaggagctggatttcctggccgatcccgataacatgtttttggaagaaactccagtggaagacattttcatggatctgagcacacccgatccttccgaagaatggggcagcggggaccccgaggctgagggtcctggcggtgccccatcaccctgcaataacttgtcaccagaagaccactcattcctcgaggatcttgcgacatatgaaactgcctttgagacgggcgtgtctgccttcccgtacgacggcttcacagatgagctgcatcagctccagagccaggttcaagactccttccatgaggacggctcaggaggtgagcccaccttttag

SEQ ID NO: 232522 - DNA, 705 bp, Artificial Sequence
  Description of Artificial Sequence: Synthetic coding sequence
atgtaccgtagcactaaaggcgctagtaaagcgaggcgggaccagattaatgccgagataaggaacttgaaggagctgctcccactggccgaggcagacaaggtaagactcagctatctccacataatgtctctggcctgtatttacacccgcaaaggcgttttctttgcgggaggtacccccctcgcaggtccgactggactcctgtctgcccaggagctagaagatattgtggctgcgttgcctggctttctgcttgtatttacagcagaaggcaagctgttgtacctctcagagtccgtgtctgagcacctgggacattcaatggtggacttggtggcccagggagacagcatttatgacatcattgaccccgcagaccatctgactgtacgccagcagttaactctgccttctgctctcgacaccgaccgcctgttccggtgccggtttaatacaagcaaatcccttcgcagacaatccgccggaaataagctggtactcattcgagggcgttttcacgctcatccgccaggcgcatactgggccggaaacccagtgtttacggcattctgcgccccacttgaacctagaccacggccaggtccgggacccggacccggaccagcatctctgttcctggcgatgttccagagcaggcacgcaaaagacctcgccttgctggacatcagcgagagcggatag

SEQ ID NO: 232523 - DNA, 1299 bp, Artificial Sequence
  Description of Artificial Sequence: Synthetic coding sequence
atgcccgctggcagggccgctcgtacctgcgctttgctcgcactgtgcctcttgggagcgggtgcgcaagacttcgggccaacgaggtttatctgtactagcgtgcctgtggatgccgatatgtgcgccgcatcagttgccgctggtggcgcagaagagctacgcagctctgtgctccaacttcgggagaccgtcctgcaacaaaaggaaaccattctgtcccagaaagaaaccatcagggagttaacagctaaattaggaagatgtgagtcacagtcaaccctggaccctggcgctggagaggccagagccggagggggtcgaaaacaaccaggtagtggtaaaaatacgatgggggacttatcccgcactcccgcagcagaaactttatctcagttgggacagaccctgcagtcattaaaaacaaggctggagaacttagaacagtattcccgcttgaacagttccagccaaaccaactccttgaaagacctcttacagtctaagattgatgagctggaacgccaagtgctgagccgggtcaatacattggaagagggcaaaggtgggcctcggaacgatacagaagagagagtcaagatcgaaactgccctcacttcactgcatcaaagaatctccgagctggaaaaagggcaaaaggataacaggccaggggacaaattccagcttactttccccctgaggaccaactacatgtatgctaaggtcaaaaaatcactgcctgagatgtatgcgttcaccgtgtgcatgtggcttaaaagttccgccacgcctggcgtcggcacccccttcagctacgctgtgcccggacaagcgaacgagctggtgcttatcgaatggggaaataatccaatggagatactgattaacgacaaggtcgctaaacttccctttgtgatcaatgatggcaagtggcaccacatttgcgtcacctggactacacgggacggggtttgggaagcctatcaggatggtacgcaggggggaagtggcgagaacctcgccccttatcacccaatcaagccccagggagtgttagtcctcggacaggagcaagacacactaggagggggtttcgacgccacacaagccttcgtcggggaactggcccattttaatatctgggacagaaaattaacaccgggagaagtgtacaatctggcaacttgctctacaaaagctctgagtgggaacgtgatagcatgggctgaaagtcacatcgaaatctatggtggcgctactaagtggactttcgaagcctgccgccaaatcaactag

SEQ ID NO: 232524 - DNA, 585 bp, Artificial Sequence
  Description of Artificial Sequence: Synthetic coding sequence
atgtacgccaaggtaaaaaagtccctgcccgaaatgtacgcatttactgtatgtatgtggcttaaatccagcgcaactccaggggtcggcactccgttctcatacgccgtgcccggacaggcgaacgaattagtattgattgagtggggaaacaatcccatggaaattctgatcaatgacaaggtcgcaaagttaccatttgtaataaacgatggcaagtggcatcatatctgcgtcacctggaccacccgcgacggtgtttgggaagcctaccaggacggtacccaggggggatcaggtgaaaatttggcaccgtatcaccctataaagccacagggcgtcttggtgttgggccaagaacaagacacccttggagggggttttgatgccacacaggcatttgtgggcgaactcgctcatttcaacatttgggataggaagctcactccaggggaagtttataacttggccacttgctcaacaaaggccctgagcggcaatgttatcgcgtgggctgagtcccatattgagatctatggtggtgctacgaaatggacgttcgaggcttgtaggcagatcaattag

SEQ ID NO: 232525 - DNA, 1296 bp, Artificial Sequence
  Description of Artificial Sequence: Synthetic coding sequence
atgctcgctctccttgcagcctctgtggctttggctgtggctgcaggcgctcaggactcacctgctcctgggtctagattcgtctgtacggccttaccacctgaggcggtgcacgctggctgtccgttacccgctatgcctatgcagggcggtgcacaaagtccagaagaagaacttcgagccgctgtgctacagctaagggaaactgtcgtccagcagaaggaaacactgggggcacagcgcgaagccattagagagcttaccggaaaactggcaagatgcgagggcctagcaggtggcaaggcaagaggcgctggggctactggaaaggataccatgggagacctcccccgtgacccaggacacgtggtcgaacagttgtctaggagcctgcaaacattgaaagataggttggaatccctcgagcatcagctcagggcaaacgtgagtaacgccggtctcccaggcgattttagggaggtgctgcagcagaggttgggagagttggaaagacagctgttaaggaaggttgccgagctggaggacgagaagtcattgctccataatgagaccagtgctcaccggcagaagactgaatctactctcaacgctctgttacagcgtgttaccgagctggaaagaggcaattccgcctttaagtcccccgatgcgtttaaagtgagcttacctctcagaaccaactacctctatgggaaaattaaaaagacacttccagagctgtacgcattcaccatttgtctctggttgagatcaagtgccagtccaggaattggtacgccattcagttatgctgtacccggtcaggccaacgagattgtactaattgaatggggaaataatcctatcgagttgctaatcaatgataaagttgctcagctgcccctctttgtttctgatggtaagtggcatcacatatgcgttacttggaccactagggatggtatgtgggaagcgtttcaggatggagaaaaactggggaccggtgaaaatttggcgccttggcaccccataaagcccggtggcgtgcttattctggggcaggagcaagacactgtcggaggcagatttgacgctacacaggcttttgtgggagagctgtcccaattcaacatttgggatcgagttctgagagcacaagagattgtgaacattgcaaattgttccactaatatgcccggaaatattatcccatgggtggacaataacgtggacgtcttcggcggagcttctaaatggcccgttgagacttgcgaggagaggctcctcgatctgtag

SEQ ID NO: 232526 - DNA, 246 bp, Artificial Sequence
  Description of Artificial Sequence: Synthetic coding sequence
atggcagccgtagcagctgcctccgccgagctgttaattattgggtggtacattttcagagtgctcttgcaggtcttcttggaatgttgtatttattgggtgggtttcgcatttcgaaatcctcctggtacccaacccattgcccgttccgaggtttttaggtatagcctgcagaagctggcctacacagtaagtcgcaccggacgccaagtgctgggcgagcggcgacagcgcgcacctaactag

SEQ ID NO: 232527 - DNA, 165 bp, Artificial Sequence
  Description of Artificial Sequence: Synthetic coding sequence
atggccgctgtggctgctgcgtccgcggagttgctgattattggctggtatatctttcgcgtcttattgcaagtgtttcgctattccttacagaagctggcttacactgtttccaggacagggaggcaggtcctgggagagcgcagacagcgggcacctaattag

SEQ ID NO: 232528 - DNA, 270 bp, Artificial Sequence
  Description of Artificial Sequence: Synthetic coding sequence
atgattagctcggtgaagctaaacctgatactggtgctcagtcttagcactatgcacgtgttttggtgctacccggtcccgagtagcaaggtcagtggtaaatccgactacttcttaattctcctcaatagttgtcccaccagactcgaccgatcaaaggaactcgcctttctcaagcccatattggagaagatgtttgttaagcgctcgttccgaaacggagtcggaacagggatgaagaaaacaagctttcaacgggctaaaagttag

SEQ ID NO: 232529 - DNA, 525 bp, Artificial Sequence
  Description of Artificial Sequence: Synthetic coding sequence
gtggtcctcctctacgctagcacttatgtgctggtgtcactgtccattgatagataccacgccattgtctatcctatgaaagttctcattgtgatcgcatggtcgcttagttttcttttttctatacccactcttattatctttgggaagcggacattgtctaacggtgaggtgcagtgttgggccctctggcctgacgactcttactggacaccttatatgactattgtggcgttcctcggatctctaatcacttttatctgctgctggtccccatatttcctgttcgacatcctggataattttaaccttctccctgacacacaggagcgcttctacgctagcgtgattatccagaacctgcccgcattgaactcagcgattaatccactgatctactgcgtcttctcaagttcaatcagttttccatgtagagagcaaaggagtcaggactctcggatgacctttagagaacgaactgaacggcatgaaatgcagatcctaagtaagccagagttcatctag

SEQ ID NO: 232530 - DNA, 1134 bp, Artificial Sequence
  Description of Artificial Sequence: Synthetic coding sequence
atgcccgctaattttactgagggcagtttcgattcctctgggaccggtcagacgcttgattccagtccggttgcctgcaccgagactgtcacatttaccgaggtggtggaaggaaaggaatgggggagcttctattactccttcaagacggaacagttgataacactgtgggtgctgttcgtgtttactatcgtgggcaactcagtggtcctgttctctacctggcgccgaaagaaaaagtcccggatgactttctttgttactcagctcgctattactgatagctttacggggcttgtgaacattcttactgacatcaactggcgattcacaggagattttactgctcctgacctagtctgccgggtggtgcgatatctccaggtggtgctcctgtacgccagcacttacgtattggtgtcactgtcaatagacagataccacgctatagtataccctatgaagttcctgcagggggagaagcaggccagggttctcatcgttattgcttggtccctttccttcctgttctctatcccgacactgatcatttttgggaagcgaaccctgagcaatggggaggtgcagtgctgggccctgtggccggatgactcttactggacaccttacatgacgatcgtcgcattcctcgtgtactttatcccattgacaatcatctctatcatgtacggcattgttatccgcaccatatggattaagtctaaaacctatgagaccgtcatttccaattgctccgatggcaaactatgctcttcgtacaataggggactgatttctaaggcgaagatcaaggccatcaaatactctattattattatcctggctttcatctgctgttggtccccttatttcctgttcgatatcctggacaactttaaccttctacctgacacccaggaacgcttttatgcgtctgtgattatccagaatttgccggctctcaatagcgctattaatccgttgatctattgtgtgttcagttccagcatcagctttccatgtcgggtgattagactgaggcagcttcaggaggccgcactgatgctatgtccacagcgggaaaactggaagggcacatggcccggtgtcccgagttgggcactgcctaggtag

SEQ ID NO: 232531 - DNA, 1116 bp, Artificial Sequence
  Description of Artificial Sequence: Synthetic coding sequence
atgcccgctaatttcacagaaggttctttcgactctagcgggaccggccagacactcgactcctcgcctgtagcatgtacggagaccgtcacttttactgaggttgtagaaggcaaggagtggggatccttctattactcattcaaaacggaacaactcatcaccctgtgggtgctcttcgtgttcactatagtggggaatagcgtggtcttgttttccacctggaggagaaagaaaaagtctagaatgaccttcttcgtgacccagctggctattaccgattcgtttaccgggctcgttaacatcctgactgacatcaattggagattcaccggagactttaccgccccagacctcgtctgccgcgtcgtgcgctatctgcaggtcgtcctcctgtatgcttccacctatgtcctggtttccttgtctattgataggtaccacgccattgtataccccatgaaatttctgcaaggagaaaagcaggccagggttctgatcgttattgcctggtctctctctttccttttctctatacccacacttataatattcggaaaacgtactctttcaaacggtgaagttcagtgttgggccttatggcccgacgactcttactggacaccctacatgactattgtggcttttctggtgtacttcatccccctcaccattatttctatcatgtacgggattgtgatcagaacaatttggatcaaatcaaaaacatatgaaactgtaatctcgaactgcagcgacggaaaactgtgtagctcatacaataggggccttatttccaaggctaagatcaaggctattaaatactctatcatcataatcttggcattcatctgttgttggtctccttacttcttgttcgatatcctggacaactttaaccttttacctgacacccaagagcggttttatgctagcgtgattattcagaaccttccagccctcaattctgccatcaatcccctgatttactgtgtgttttcctcttccatctccttcccgtgtcgtgagcaacgaagccaggattctaggatgacttttcgagaaagaactgagcgccacgagatgcagattctgagcaagcccgagttcatttag

SEQ ID NO: 232532 - DNA, 1173 bp, Artificial Sequence
  Description of Artificial Sequence: Synthetic coding sequence
atgcctgcaaacttcactgagggctctttcgatagtagtggaacaggccagacactcgactcctctccagtggcctgcacagagaccgttacgtttactgaggtcgtcgagggcaaggagtggggtagcttttattatagttttaaaactgagcagctcattacactctgggtcctgtttgtatttactatcgtgggaaacagtgtggtgctgttctccacttggagacgtaagaagaaatcccgaatgacattttttgttacccagttggccattactgatagttttactgggctcgtcaatattctcactgatatcaattggcggttcacaggagatttcacagctccagacctggtgtgtcgcgttgtcagataccttcaggtggtcctgctatacgcgtcaacctacgtgctcgtttccctaagcatagaccgataccacgcaatcgtctatcccatgaaatttctccagggcgaaaaacaagcaagggtactcattgtcattgcatggagtttatccttcctattttccattccaacgctgatcatattcgggaagcggactctgagtaatggtgaagtccagtgttgggctctgtggcccgatgactcttactggacgccatatatgacaatcgtagcctttctcgtgtacttcattccacttaccattatcagcatcatgtacggcatcgtgattcggacaatctggatcaaatccaagacttatgaaaccgtgatcagcaactgctctgacggaaagctctgcagcagctacaatcgcggactgattagtaaggcaaaaatcaaggccattaagtattccattatcatcatcctagcgttcatatgttgctggagcccttactttctcttcgacatattagataactttaatctcctgccagacacgcaggagaggttctatgcgagcgtgatcatccaaaacctgcccgcattgaatagcgctatcaatcctcttatatactgcgtgttcagcagttctatttcctttccctgcagggcgaattcctctgtatatcttctggcatgtgatgttagcgtgctgtgggctctcgtccttacctctgaaaaggaaagttgtgagagctggcgacgcaagggtgccaagatcaccggattccaaaatgacgttcctggtgaaaactag

SEQ ID NO: 232533 - DNA, 918 bp, Artificial Sequence
  Description of Artificial Sequence: Synthetic coding sequence
atgcctgctaattttacagaaggctcttttgattccagtggaacggggcagactcttgacagcagtccagttgcttgtactgaaacggtgacttttaccgaggttgtggagggaaaagagtggggatccttctattactcttttaagactgaacagctgattacactctgggtacttttcgtatttacaatcgtgggtaacagtgtggttctgttctccacctggagacggaagaagaagtctcgcatgacgttttttgtgacacaactggctatcaccgagaaacaggctagggtcttaattgtgatcgcctggtctctctcttttctgttttcaattcccacgttaattatatttggcaagagaacactttctaacggcgaggtgcagtgttgggccctctggcccgacgacagctattggacaccctacatgacgattgtcgcttttctcgtctatttcatccctctcacaattattagcatcatgtacggaattgtaattcgaactatttggatcaagtctaaaacatacgaaactgtgattagtaattgcagcgacggaaaactttgctccagctataataggggattaatctctaaggctaaaattaaggctatcaagtactctatcatcatcatcctggcatttatctgctgttggagcccatacttcttgttcgatatcttggataatttcaacctcttgccagacacacaggaacgattttatgctagtgtcattattcaaaatctacccgcactgaactctgccatcaaccctctgatttattgcgttttcagtagcagtatcagctttccctgccgggagcagagaagtcaggactcgcggatgacattcagggagaggacggagagacatgaaatgcagatcctctcaaagcctgagttcatctag

SEQ ID NO: 232534 - DNA, 432 bp, Artificial Sequence
  Description of Artificial Sequence: Synthetic coding sequence
atgcccgcaaattttaccgaaggaagctttgactcgtctggtacaggtcagacacttgactcttcgccagtcgcttgcactgagacagtaacgttcaccgaggtcgtggagggcaaagaatggggtagtttctattattcttttaaaactgagcagctgatcacgctgtgggtgctcttcgttttcactatcgtgggaaattccgtggtgctgttttctacttggcgcaggaaaaagaaaagtagaatgacatttttcgtgactcagctcgccatcacggacagctttactggcctggtgaacatccttacagatattaactggcgttttactggagactttaccgcccctgatctggtgtgtagagtagttcgttacctgcaggtgatggttatgaagctgttccacatccaaaagatgaacatggagtag

SEQ ID NO: 232535 - DNA, 285 bp, Artificial Sequence
  Description of Artificial Sequence: Synthetic coding sequence
atgcctgcaaactttacagaaggctcatttgacagttcaggaactggccagacattagattcatcccccgtggcatgtacagagacagtcacatttacagaagtagtcgaagggaaggaatggggctccttttactattcattcaagaccgaacaattgatcaccctttgggtcttgtttgtttttactatagtgggaaactctgtcgtgctgttcagtacttggcgaaggaagaagaagtccagaatgaccttctttgtgacccaactcgccatcacagtctag

SEQ ID NO: 232536 - DNA, 294 bp, Artificial Sequence
  Description of Artificial Sequence: Synthetic coding sequence
atgttggggaacaagcggttgggactgagtggacttactctggccttaagccttttagtgtgccttggcgctttggctgaggcatacccgtcaaagcccgataacccgggagaagatgccccagcagaggacatggccaggtattacagcgcacttcgacactacatcaatctgatcaccagacagcggtacggcaagcgatccagtccagagaccctgatctcagaccttttgatgagagaaagcaccgaaaacgttccccgtactcggctggaggaccccgcaatgtggtag

SEQ ID NO: 232537 - DNA, 294 bp, Artificial Sequence
  Description of Artificial Sequence: Synthetic coding sequence
atgctcgggaataagcgcctagggctgagcggcctgactttggcccttagtctcctggtgtgcctgggcgcactcgcggaagcttacccctcaaaacctgataatcccggtgaggacgctcccgctgaagacatggcacggtactatagcgcactccgccactacatcaatctgattactaggcagagatatggaaagaggagcagcccagaaacgttgattagtgacctgctgatgagggagtcaacagagaatgtgcctaggacaagactagaggatcctgcaatgtggtag

SEQ ID NO: 232538 - DNA, 294 bp, Artificial Sequence
  Description of Artificial Sequence: Synthetic coding sequence
atgctaggtaataagcgtctgggcctctcaggcctcactctcgccctgtctctgctcgtctgtctgggcgcactggccgaagcctaccccagtaagcccgataatccaggagaggacgccccagcggaggacatggctaggtattatagcgcgctgaggcattacatcaacctgataaccaggcagagatatggtaaacgaagctcccctgagacgcttattagcgaccttctcatgcgggagtccaccgaaaacgtcccgaggacacggctggaggatccagctatgtggtag

SEQ ID NO: 232539 - DNA, 1155 bp, Artificial Sequence
  Description of Artificial Sequence: Synthetic coding sequence
atgaactccaccctcttctcacaagtggagaaccatagtgttcattctaattttagtgaaaaaaatgcccaactgcttgcgttcgagaacgacgactgtcatcttcctcttgccatgattttcacgctggctctggcttacggcgctgtgatcatccttggcgtttcaggaaatctggccctcattattattatacttaaacagaaagagatgcgaaatgtcacaaatattctcatagtcaacctgtcattctccgacctcctggtggccatcatgtgtttaccttttacgttcgtttacactctgatggaccattgggtgttcggggaggctatgtgcaagttgaatcctttcgtacagtgtgtgagcatcactgtgtctatctttagcctcgtcctcatagctgttgaacggcatcagctcataattaaccccaggggctggaggcccaacaaccggcacgcttatgtcggaatcgccgtgatatgggttctggcggtggcaagctccctcccttttctcatctaccaagtcatgaccgacgagccttttcagaatgttactctcgatgcttataaagataagtatgtttgtttcgaccaattcccaagtgattcacacagattgagctatactactcttttgttggtcctgcaatattttggccctctttgctttatcttcatctgttattttaagatctatattaggctaaagaggcgcaataacatgatggataaaatgcgagacaataagtaccgaagctcagagactaagaggatcaatataatgctgctgtcaatcgtcgtcgcatttgctgtgtgctggctgcctctgacaatattcaataccgtgtttgattggaatcatcagatcattgctacatgcaaccataacctgctgttcttactctgtcacctaactgcgatgattagtacctgtgtgaaccctatcttctacggatttctgaataagaatttccaacgggatttacagtttttctttaatttttgtgatttcagaagccgcgacgatgactatgagaccatagccatgagtacaatgcatactgacgtatccaaaacaagtctgaaacaagcatcacctgtagcttttaagaaaatcaataataacgacgacaatgaaaaaatctag

SEQ ID NO: 232540 - DNA, 186 bp, Artificial Sequence
  Description of Artificial Sequence: Synthetic coding sequence
atgaactccacacttttctcccaggtggaaaaccatagcgtccacagcaatttctcagagaaaaacgcccagctcctggccttcgagaacgacgattgccatctgcccttggcaatgatctttacattagccctggcctacggggctgttatcatactaggcgttagtggcaacctggctctatag

SEQ ID NO: 232541 - DNA, 426 bp, Artificial Sequence
  Description of Artificial Sequence: Synthetic coding sequence
atgatggacaaaatgcgagacaacaaataccggtccagcgaaaccaagcgcattaatatcatgctgctaagcattgtggtcgcctttgctgtctgctggttacccctgaccatcttcaacactgtgtttgattggaaccaccagattattgctacctgtaaccacaacttgctgttcctcctgtgccacctcaccgccatgatatctacttgtgtcaatcctatcttttatgggttcctaaacaaaaatttccagcgggatttgcaatttttcttcaacttttgcgactttcggtccagagacgatgactacgaaacaatagctatgtccacgatgcacacagacgtgagtaaaacatcattgaagcaggcctcccccgtcgcgttcaagaaaatcaacaacaacgacgataatgagaaaatctag

SEQ ID NO: 232542 - DNA, 78 bp, Artificial Sequence
  Description of Artificial Sequence: Synthetic coding sequence
atgaattcgactctgttctcgcaggtggaaaatcacagcgtgcactccaacttttccgaaaagaacgctcagttgtag

SEQ ID NO: 232543 - DNA, 183 bp, Artificial Sequence
  Description of Artificial Sequence: Synthetic coding sequence
atgaactcaaccttgttctctcaggtcgaaaaccatagtgtgcactcaaatttttccgaaaaaaatgcacagctgctggccttcgaaaacgacgattgccatctgcctttggctatgatctttacactcgctctggcctacggcgcagtgattatcctgggtgtgagcggcaacctggcctag

SEQ ID NO: 232544 - DNA, 1146 bp, Artificial Sequence
  Description of Artificial Sequence: Synthetic coding sequence
atgggcccaattggcgctgaagccgacgaaaatcagactgtggaggaaatgaaagtggagcaatatggaccgcagacgacaccaagaggcgagcttgtaccagatcccgaaccagagctcatcgatagtacaaagctgatcgaggtgcaggtggtattaatcctggcatattgtagtatcatcctgctcggagtcattgggaacagtttagtaattcacgttgtcatcaagtttaaatccatgaggaccgtgactaatttcttcatcgcgaatctggctgtggctgatctgcttgtaaatacactctgcctgccctttacactgacatatacactgatgggagagtggaagatgggaccggttttgtgtcatttagtgccttacgcacagggattagccgttcaggtgagcacgatcactctgacagtgattgccctcgacagacacagatgcatcgtgtaccatttagagagcaagatttcaaagagaatatccttcctgatcatcggcttagcatggggaatatcagccctccttgcatcacctttggccatcttcagggaatattctttaattgagatcatccctgactttgaaatcgtggcctgcactgaaaaatggccaggcgaggaaaagagtatctacgggactgtctacagtcttagctcattgctcatcctatacgtcttgcccctcgggattatcagtttttcatatactcggatctggtccaagctgaaaaaccacgtgtcaccaggagccgctaacgaccactatcaccaaagaagacagaagaccaccaaaatgttggtgtgcgtggtagtggtcttcgcggtgagttggttaccattgcacgccttccagcttgcagtcgacattgatagccaggtccttgacttgaaggagtataagctgatttttactgtgttccatataattgcaatgtgcagcacgtttgccaatccactgttgtatggatggatgaactctaactaccgcaaggcattcctctcggccttccgctgtgagcaaaggctcgatgctattcactcagaggtgtccgtcactttcaaggcgaaaaaaaatctggaagtgcggaaaaatagcggaccaaacgacagtttcacagaagccaccaacgtgtag

SEQ ID NO: 232545 - DNA, 1146 bp, Artificial Sequence
  Description of Artificial Sequence: Synthetic coding sequence
atgggtccaattggagccgaagctgacgaaaatcagacggttgaggaaatgaaagtagagcagtatgggccacagacaacgccccgaggggaactggtgccagaccctgagccagagttaatcgattccacaaagcttatcgaagtgcaagttgtcctgatcctggcgtattgcagcattatactcctgggggtaatcggtaatagccttgtgattcacgttgtcataaagttcaaatcaatgcgtacggtcaccaacttcttcatcgccaatctggcggtggcagaccttctggtaaacacactctgtctaccgtttaccctgacttacactctgatgggcgagtggaaaatgggtcctgtgctgtgccatctggtgccatatgctcagggcctcgcggtgcaggtatccaccattactttgactgtgattgcgctggaccgacaccgatgcattgtgtaccatctagagtctaaaatctcgaaacgtatttcatttctgattattggactggcgtgggggatttcggcattgctagccagtcctctggctatcttcagggaatactccttgatcgaaatcatacccgacttcgaaatagtggcctgtaccgaaaagtggccaggagaggagaagagtatctacggcaccgtatacagcctgtcatcactgctgattctctacgtactccccctgggcattatttcattctcatacacccgtatctggtctaagcttaagaaccacgtctcgcctggggctgccaacgatcattatcatcaacggagacagaagactaccaagatgctggtttgcgttgtcgtcgtattcgcggtgtcctggctccctctgcatgcctttcagctggctgttgatatcgattcgcaggttctggatcttaaagagtacaagctgattttcacagtttttcacattatcgctatgtgcagcacctttgcgaaccccctcttgtatggctggatgaattctaattaccggaaggcttttctgtctgcattcagatgtgagcagcgtctggacgcaattcacagcgaggtctcagtcacctttaaggctaaaaagaatctggaggtccgaaaaaactccggcccaaatgatagttttactgaagccaccaatgtttag

SEQ ID NO: 232546 - DNA, 1338 bp, Artificial Sequence
  Description of Artificial Sequence: Synthetic coding sequence
atggacttggaactggatgaatattacaacaagacactggctacggaaaataacactgcagcgactagaaatagcgactttcctgtttgggatgactacaagagctctgtcgatgacctgcagtatttcctgatcggtctttatacattcgtgtccttacttgggtttatgggcaaccttttaatcttgatggccttgatgaagaagcgaaaccagaagactaccgtgaattttctgatagggaacctggccttctcagacatcctggttgtgttattctgcagtcccttcactctgacaagtgttttgctcgaccagtggatgttcggaaaggtaatgtgccacattatgccatttctgcagtgcgtttccgtcctggtttccaccctgattttgatcagcatagccattgtgaggtatcacatgatcaagcacccgattagcaataaccttacagcaaaccatgggtactttctcattgccacagtgtggaccctaggctttgccatctgctcccccttgcccgtgttccattcactcgtggaactgcaagaaactttcggctctgcactcttgtcttcgagatatttatgtgtcgagtcttggcccagtgattcataccgtattgcctttaccatttcactgcttttggtccagtacatcctgcccctggtgtgcctgacagtgtcgcacacctctgtgtgcagaagtatcagttgtggcttgagtaataaggaaaatagactggaggagaacgagatgattaacctgaccctccaccctagtaaaaaatctgggcctcaagtgaagctgtcgggaagtcacaaatggtcttattctttcatcaagaaacaccggcgtcgctactctaagaaaaccgcttgtgtgctaccagccccagaacggccatcccaggaaaaccactccagaatactccctgagaactttggatctgtccgcagccaactgagctcttcttccaagttcattcctggcgtgcccacctgcttcgaaattaaacccgaggaaaactccgatgtgcatgaactccgcgttaagagaagcgttacccgcattaagaagaggagtagatctgtgttctacagactgactatactgatcttggttttcgccgtgtcgtggatgcccctgcatctttttcatgtagttactgacttcaatgataacctaatcagtaacagacattttaagttggtctactgcatctgccacctcctggggatgatgtcctgctgcctaaaccccattctgtacggcttccttaacaatggcatcaaggccgaccttgtgtccctgatccattgtttgcatatgtag

SEQ ID NO: 232547 - DNA, 1338 bp, Artificial Sequence
  Description of Artificial Sequence: Synthetic coding sequence
atggatctggagctggacgagtactacaacaagactttggccactgagaacaacacagctgctactaggaacagcgacttccctgtttgggacgattataagagttctgttgatgaccttcagtacttcctgattggactgtatacgttcgtctcactgttgggctttatggggaaccttctgatcctgatggctctgatgaagaagagaaatcaaaagacaaccgtgaacttcctcattggcaatcttgccttctccgacatcctggttgtccttttttgctcaccatttaccctgacttctgtactcctggatcaatggatgtttgggaaagtgatgtgtcatatcatgccctttttgcaatgcgtatcggtgctagttagcactctcatactcatttctatagccatcgtgcggtaccatatgatcaaacaccctatctcaaacaaccttacagccaaccacggctacttccttatcgctactgtgtggacacttggctttgcgatctgctctccattgccggtgtttcacagtctggttgaactccaggaaacttttggctcagccctgctctctagccgatatctgtgtgtggaatcatggccttctgatagctatcgcatcgcctttaccatctcattactccttgtgcagtacatccttcctcttgtatgtctgaccgtctctcatactagcgtgtgcagaagtatttcttgtggactgtccaacaaagaaaacaggttagaggagaacgaaatgattaatcttacactgcacccgtcaaaaaagtccgggcctcaggttaagttgtcgggctcccacaagtggagttactcattcatcaagaagcaccgacgaaggtactctaaaaagaccgcatgtgtgttacctgcccctgagaggcccagtcaggaaaatcactctaggattttacctgaaaactttggcagtgtgcggtcccagctcagctccagctccaaattcatccccggtgtgccaacgtgtttcgaaattaagcccgaggaaaactctgacgttcatgagttgcgcgtcaaacgatcagtgacaaggatcaagaagcggagcaggagcgttttttaccgcttaaccatcctgatcctcgtgttcgccgtgtcgtggatgccactgcacctcttccatgtcgtgactgactttaatgacaacctgatctctaacaggcactttaagcttgtctattgcatttgtcacctcctcgggatgatgtcgtgttgtctgaacccaatcctgtacggcttccttaacaatggtatcaaggcagatttggtgtccttgatacattgtctacacatgtag

SEQ ID NO: 232548 - DNA, 1338 bp, Artificial Sequence
  Description of Artificial Sequence: Synthetic coding sequence
atggacctagaattggacgaatattataacaaaactctcgccacagagaacaataccgccgcaacacgcaattccgattttccggtctgggatgattataagagctcagtcgacgaccttcagtactttctgattggcctctatacatttgtgtcactgttgggtttcatggggaatctcttaatcctaatggccttaatgaagaaacgcaatcagaaaacgaccgtgaacttcctcatcggtaacctcgcattctccgatattctcgttgtgttattctgctcaccctttacacttactagcgtcctactggaccagtggatgtttggcaaggtgatgtgccatatcatgccatttctgcagtgcgtcagcgtgctggtgtcgacactgatactcattagtatcgccattgtgaggtaccatatgatcaagcatcccatctcgaacaacctcaccgccaatcacgggtacttcctgatagcgaccgtgtggacactgggattcgcaatctgcagccctctgcccgtgttccattcgcttgtggagcttcaggagaccttcggttcggccctgcttagctctagatatctctgtgttgaatcttggccctctgacagttataggatcgcatttaccattagtctgcttctggtccagtatattctcccactggtttgtctgacagtgagtcacaccagcgtttgccgctcaatttcttgtggactttctaataaggagaacaggttggaggagaacgagatgatcaatctgaccctgcatccatccaaaaagtccggcccacaggtgaaactgtccggctcccataagtggtcgtattccttcatcaaaaagcacaggcggaggtattccaaaaaaacagcgtgcgttctgcccgcacccgagcgaccttcgcaggagaatcactcaagaatcctgccggagaactttggatcggtgcgttctcagctgtcttcaagcagtaagtttattcctggcgtcccgacttgtttcgagattaagcctgaagaaaactccgatgtgcacgagctgcgcgtgaagcgcagcgtgaccagaattaagaagagaagccgatctgtgttttataggcttacaatactgatcttagtattcgctgtgtcctggatgccactgcatttattccacgttgtgacagactttaatgataatctgatctccaatcggcattttaaactggtgtattgcatttgtcacctactcggcatgatgagttgctgccttaatcccatcctctacggatttctaaataacggcatcaaggcagatctcgtgtccctcattcactgcctccatatgtag

SEQ ID NO: 232549 - DNA, 987 bp, Artificial Sequence
  Description of Artificial Sequence: Synthetic coding sequence
atggataatgccagtttttcagagccctggcccgctaacgcatctggccctgacccagccctcagttgttccaatgccagcaccctggcccctttgccagcaccactggccgtagccgtgccagtggtgtatgccgtgatctgcgccgtcggcctcgccggaaattcagcagttctctacgtcctgctgagagccccaaggatgaagacagtcactaacctgtttattttgaatctcgcgatagcggatgagctcttcacactggtactccccattaacatcgcggattttctgctgcggcagtggcccttcggggagcttatgtgcaagctcattgtcgctattgatcagtacaatacattcagtagcctgtattttttgactgtcatgtcagccgaccgatacctggtcgtactggctactgcggagtcaaggagagtggcaggaagaacgtactccgcagctcgcgctgtctccttagcagtgtgggggatagtcaccttggtggttttgccttttgccgtgtttgctaggctcgatgacgaacagggaaggaggcagtgcgtactggtgttcccccaaccagaagcattttggtggagagcaagcagactgtatactctggttctcggatttgccatccctgtatctaccatatgcgtgctgtataccactctactctgccgactgcatgccatgcggttagattctcatgctaaggccctggagagagccaagaaaagggtcacctttctggtggtcgcgattctggctgtgtgcctgctgtgttggactccgtaccaccttagcactgttgtcgcactaacgaccgacttgcctcagaccccgttagtgatcgcgatcagctatttcatcacttccctgtcttacgccaacagttgccttaacccattcctttatgcattcctggacgccagctttcggaggaatctgcggcagctgatcacctgccgggcagcagcatag

SEQ ID NO: 232550 - DNA, 1599 bp, Artificial Sequence
  Description of Artificial Sequence: Synthetic coding sequence
atgttagcggagcctttccctaaggttgtggcgtcattaatcatcttgcacctgtcaggcgcaaccaaaaagggaacagaaaaacagacgacatccgaaacacagaaatccgtccagtgcgggacatggaccaaacatgccgagggtggtatattcacgtctcccaattatccatccaagtacccccctgatagagagtgtatctatatcatcgaagctgcccctcgacagtgcatagagctgtattttgacgagaaatacagtatcgagcccagttgggagtgtaaatttgatcacatcgaggttagagacgggccattcggattctcaccgattattggcaggttttgtggtcagcagaatccacctgttatcaagtcgtctggtagattcttatggatcaaattctttgccgatggagaattggagagcatgggcttctccgccaggtacaactttactccagaccccgattttaaggacttgggcgctctgaagcccctcccagcatgcgagtttgaaatgggcggtagcgagggcatcgtagaaagcatacagataatgaaggaggggaaggccacggccagcgaggctgtcgactgcaagtggtatattagggcgccaccacggtcaaaaatttatctgcgcttcctggactacgagatgcagaactctaatgagtgcaaacggaactttgttgccgtttacgatgggagtagctcagtcgaggacttaaaggccaagttttgcagcaccgtggccaacgacgtgatgttacgcaccgggctgggcgttattcgaatgtgggccgatgaaggatccaggaacagcagatttcagatgttatttacatctttccaggaaccgccatgtgagggaaatactttcttctgccattcaaacatgtgcatcaacaacactctcgtttgcaacggtctgcagaactgcgtatacccttgggacgagaaccactgcaaggagaaaagaaagactagcttgttggatcagctcaccaatacatcaggcaccgtgatcggagtcaccagctgcatcgtgattatactcattattatctccgtgattgtgcaaatcaagcaacctcggaaaaaatatgtgcagcggaagagcgattttgatcagaccgtgttccaggaagtgtttgagccccctcactatgagctgtgcacgttgagaggcacaggcgctaccgcagattttgccgatgtggctgatgactttgagaactaccacaaattgcggagaagttccagtaagtgcattcacgaccaccactgcgggagtcaattgagctcaacaaagggaagccgatctaatctttctacgagggacgccagcatactgacagaaatgcctactcagcccggaaagcccctgataccccctatgaacagacgaaatatcctggtcatgaagcattcctacagccaggacgcagcagatgcctgcgacatcgacgagatcgaagaagtccccactacttcccataggctgagccggcatgacaaagcggttcagcggttttgtctcataggatcgcttagcaagcacgaaagcgaatataacacaaccagggtgtag

SEQ ID NO: 232551 - DNA, 1602 bp, Artificial Sequence
  Description of Artificial Sequence: Synthetic coding sequence
atgatacatggtcgttcagtcttacacatcgtggcgtctctgatcatcttgcacctcagcggcgctaccaaaaaggggacggagaaacagacaactagcgaaactcagaagtcagtccaatgcgggacctggaccaaacacgcggagggaggtatttttactagccctaattacccatctaagtacccccctgatcgtgaatgtatctatataattgaagccgcacctagacagtgtattgaactgtattttgacgaaaagtatagcatcgagccttcgtgggaatgcaagttcgatcacattgaagttcgcgacggaccgtttgggttcagcccaattattggaagattctgcggacagcagaatccacctgtgatcaaaagctccgggcgtttcctttggatcaaattctttgctgacggcgagctcgaatccatgggcttttccgctagatataatttcacgcccgatcctgacttcaaggaccttggagctttaaagccacttcctgcttgtgagtttgagatgggtgggagtgagggcatcgtggagagcatccagattatgaaggagggaaaagcaaccgccagtgaggcagtcgattgcaagtggtacatacgcgctcctccgagatcaaagatttacttgcgatttctggactacgagatgcagaattccaacgagtgcaaacggaattttgtggccgtgtatgatggttcctctagtgtggaagacctcaaggcgaaattctgctcaacagtagcgaacgacgtgatgctccgcacgggattgggggttatccgcatgtgggctgacgagggaagccggaacagccggtttcagatgctctttacttccttccaggagcccccatgtgaggggaacacattcttttgtcactccaatatgtgtattaataacacattagtgtgtaatggcctgcagaactgtgtgtatccttgggacgagaaccattgtaaagaaaagcgcaagacttcattactggaccagctcactaatacttcgggaacagtgatcggcgtgacctcatgcattgtgatcatcctaataataattagcgttattgtgcagatcaagcagccccgaaaaaagtatgtccagaggaaatctgattttgatcagacggtatttcaagaggtctttgaacctccccattacgagctctgtacgctgcgcggaacgggcgcaactgccgatttcgcggatgtggctgatgacttcgagaactaccataagctgagaaggtcctcaagcaagtgcattcatgaccaccattgtggcagccaactctcttccactaagggctcaaggtccaacctgagtacccgagacgcatcaatcctcacagagatgcccacccaaccaggcaagccccttatcccacccatgaatcgaagaaacatattggtgatgaagcatagttatagccaggacgccgctgatgcctgtgatattgacgagatcgaagaggtgccaaccacttctcacagactgagtcgccacgacaaggcagtgcagaggttctgtctcatcggctccttgagtaagcatgaaagcgagtacaacacaactcgtgtgtag

SEQ ID NO: 232552 - DNA, 471 bp, Artificial Sequence
  Description of Artificial Sequence: Synthetic coding sequence
atgctggccgagccctttcccaaggtggtggcttccctgatcatcttgcacctgagcggggcaacaaagaagggaactgaaaaacagaccacgagcgagacgcagaaatcagttcagtgtggtacctggaccaaacacgccgaaggaggcattttcaccagccccaactatccctcaaaatatcccccagatcgggagtgtatatacataatcgaagccgctccaagacagtgtattgaactatacttcgatgaaaagtattccatcgaaccgagctgggaatgtaaatttgaccacatagaggtgcgggacggccctttcgggtttagtcccatcatcggcaggttctgtggccaacaaaatccacccgtcatcaaaagctccggtagattcctgtggatcaaatttttcgcggacggggagctggagagtatgggcttcagtgcaagatataactttacacccgagtag

SEQ ID NO: 232553 - DNA, 1602 bp, Artificial Sequence
  Description of Artificial Sequence: Synthetic coding sequence
atgattcacggaagaagcgtactccacattgtcgcgtctttgataatcctgcacctgtcgggggctactaaaaaaggcacggagaaacagaccacaagtgagacccaaaaaagtgtacagtgtggcacttggacaaagcatgccgaagggggtatttttacctcaccgaactaccctagcaaatacccccctgatagggagtgcatctacattattgaagctgccccacggcagtgcattgagctgtatttcgacgaaaaatatagcattgagcccagctgggaatgtaagtttgaccatatagaggtcagggatggcccttttggatttagccctatcattggtaggttctgcggccaacagaatcctccagtgatcaagtcctccggccgatttttgtggatcaaatttttcgctgacggggagctagagagtatggggttttcagcccgatacaatttcactccggatcctgacttcaaagatctcggagcacttaagcctcttccagcatgcgaattcgaaatgggcggatccgaggggattgttgaatcgatccagattatgaaggagggcaaagccaccgcttctgaggctgttgattgtaaatggtacattagggctccacccagatcaaagatttaccttcgcttcctagactacgaaatgcagaatagcaatgagtgtaaacggaattttgtggccgtatacgacggatcatcctctgtggaggacctgaaagccaaattctgctctacggtggccaacgacgtcatgcttcggacggggctgggcgtcataaggatgtgggcagatgagggaagtcgcaattcacggtttcagatgctgttcacatcgtttcaagagcccccatgcgagggcaacacgtttttttgtcacagcaacatgtgcatcaacaatacactagtttgtaacggcctgcaaaactgcgtatatccttgggacgaaaaccattgtaaggagaagagaaagacatccctgctcgaccagctaacaaatactagcggtaccgttatcggggtaacctcatgtattgtcatcattcttatcattatttccgtaatcgtacaaatcaagcagccccgaaaaaagtacgtgcagagaaaatccgatttcgatcagacagtgttccaagaagtgtttgaaccaccgcactatgaactgtgtaccctaagaggaaccggagcgaccgcggacttcgcagacgtggctgatgacttcgaaaattaccataaattgaggcggagtagcagcaaatgcattcatgatcaccattgcggcagccagctgtcctccacgaaggggagccgatccaacctgagtacccgagatgcgtccatcctaacggagatgcccacccagccaggcaagccactaatcccgccaatgaataggcggaatattcttgtgatgaagcattcatatagccaagacgccgcagacgcttgtgatatcgatgaaatcgaggaggtgcctactacctcccaccgattgtcccggcacgataaagccgtgcaaaggttctgtctcattgggagcctgtctaagcacgagtcagagtacaacaccacgcgtgtgtag

SEQ ID NO: 232554 - DNA, 1017 bp, Artificial Sequence
  Description of Artificial Sequence: Synthetic coding sequence
atgtcgggtagcagtctcccaagtgcccttgctttaagcctgctcctcgtaagcggatccttgttgcccggtccaggggcagcacaaaatgccggatttgtgaaatccccaatgtctgagacaaagctgactggagacgcattcgagctttattgtgatgtggtgggctccccgactcccgaaatccaatggtggtatgctgaggtgaaccgggcagagtctttccgacagctttgggacggcgcacgaaagaggagggtgacggtgaatactgcatatggctcaaacggagtctctgtgctgcgcatcacccgcctcactcttgaggactctggcacatatgaatgcagagcgtcaaatgaccctaagcggaacgatctgcggcagaaccccagtatcacttggatccgagcgcaggctacaatcagcgttctgcagaaacctagaatcgtgacctccgaggaagtcatcatccgggactcgccagtcctacccgtgaccttgcaatgcaacctaacctcatcttctcacacactaacctatagttattggaccaaaaacggagtggagttgtctgccaccaggaagaatgctagcaacatggagtacagaatcaacaagcccagagcagaggattccggagagtatcactgcgtctatcactttgtctctgcccctaaggctaacgctacaattgaggtgaaggctgcacctgatataactggacataaaagaagcgagaacaagaacgaggggcaggatgccacaatgtactgcaagagtgtggggtaccctcatccagactggatctggcggaagaaagaaaatggcatgccaatggacatagtaaatacttcaggcagattctttattattaataaggaaaactacacggaattaaacatcgttaacctgcagatcaccgaagaccctggtgaatatgagtggtgcggggctacctggccacattctggattatcttgggagttttggcttaagctctccagcctgtggtag

SEQ ID NO: 232555 - DNA, 1197 bp, Artificial Sequence
  Description of Artificial Sequence: Synthetic coding sequence
atgtcaggttcttccctacctagtgcactggctctcagcttgctccttgtctctggaagcctgctcccaggccctggggctgcccagaacgcaggctttgtaaagtctcctatgtctgaaactaagttgaccggggatgccttcgagttatactgcgacgtcgtgggcagtcccacccctgagatccagtggtggtatgccgaggtcaacagggcagagagctttcgccaactctgggatggtgccagaaagcgtcgggtgaccgtgaacacggcttatggttctaatggtgtttctgtgctgagaattacccggctgacccttgaggacagcggaacgtatgagtgtcgggctagcaatgaccccaaaagaaacgacttacggcagaatccctcaattacatggatcagagctcaggcgacaatctcagtgctgcagaaaccacgaatcgtgaccagcgaggaggttattattagggattcgcccgttcttccggtaactctccagtgtaacctgacgagtagctctcacacactgacgtatagttattggacaaagaatggcgtggaactgagcgcaactcggaagaacgcttccaacatggaatacaggatcaacaaaccacgggcagaagatagcggggagtatcactgcgtgtaccattttgtgtctgctcccaaagctaacgctacaattgaagtgaaagctgcccctgacatcactgggcacaagcgctccgagaataagaacgagggacaggacgctactatgtactgtaaatcagttgggtatccccatccggactggatttggagaaagaaggagaatggtatgccaatggatatagtgaacacctcaggacgtttcttcattatcaacaaggagaattacacagagctgaatatagtgaatttgcagattacggaagacccgggagaatatgagtgtaatgccacaaacgccattggatcagccagtgtggtaacagtcttaagagtaaggagccacctcgcccctctgtggcccttccttgggatactcgcagaaattatcatcctggtggtaataatcgtcgtgtatgaaaagcgtaaaagacccgacgaggtgcctgatgacgacgagcccgctgggccaatgaaaaccaactcaaccaacaatcacaaagacaagaatttacgccagagaaacacaaattag

SEQ ID NO: 232556 - DNA, 849 bp, Artificial Sequence
  Description of Artificial Sequence: Synthetic coding sequence
atgagcggctcctctctcccaagcgctctagcactgtcattgctccttgtctcaggctcactgctccctggccctggcgcagcgcagaacgagccacgcattgtgacctctgaggaggtcataattagggatagccccgtactgccagtcacactccagtgtaacctcacttcttcaagtcatacacttacttacagctactggacgaaaaacggcgtggagctctctgccaccagaaaaaacgcctcaaacatggaataccgtatcaataagcctcgggctgaggactcaggcgaatatcactgtgtgtatcactttgtcagcgcacccaaggctaacgccactattgaggtgaaagcagcgccagacatcactggtcacaaacggagcgaaaataagaatgagggccaggatgctaccatgtactgtaaaagcgttggttacccccatcctgactggatctggcgcaaaaaggagaacgggatgcctatggatatcgtgaacacctctggtaggttttttattattaacaaggaaaactataccgagttaaacatcgtgaacctacagataactgaggacccaggtgagtatgagtgtaatgctactaatgccattggaagcgctagcgtagtaactgtgcttagggtaagaagtcaccttgctccattatggccatttttgggcattctggccgagataatcatcctggtggtgatcatagtagtgtatgagaaacgcaagaggccggatgaggtgcccgatgacgacgagcccgctggaccgatgaagactaactccactaacaaccacaaggacaagaacctgcggcaaagaaatacaaactag

SEQ ID NO: 232557 - DNA, 582 bp, Artificial Sequence
  Description of Artificial Sequence: Synthetic coding sequence
atgtccgggtcctctctgccctcggccctggccctcagtctgctgcttgtgagcggatctctgcttcctgggccaggggcagcccagaatgccgctccggacattacaggccacaagcggagcgagaacaagaacgagggtcaggatgctacgatgtactgtaagtctgtgggataccctcatccagactggatctggagaaagaaagagaatgggatgccaatggacattgtgaacacgagtggaagattttttatcatcaataaagaaaattatactgagctgaatatagtgaatctccagatcacagaagatccgggagaatacgaatgtaacgctacaaatgcaattggcagtgcatccgtagtaactgtgctgagagtgcgatcacatttagcccctttgtggcctttcttgggcatactggccgagatcattattctggtggtgatcatcgttgtctacgagaagagaaaaagacctgatgaagtgccagatgacgatgagcccgcaggaccgatgaagaccaattctactaataatcacaaagataaaaatctgagacagcgaaataccaattag

SEQ ID NO: 232558 - DNA, 1185 bp, Artificial Sequence
  Description of Artificial Sequence: Synthetic coding sequence
atgagtggtagtagcttaccttctgctctcgcactgtcactgcttctcgtgagtggaagtctgctgcctggcccaggagctgcacaaaacgctggcttcgtgaaaagtccgatgtcagagacaaaacttacaggtgatgcttttgagttatattgcgacgtggtgggatcacccaccccggaaatacagtggtggtacgccgaggtgaacagagccgagagcttcaggcaactgtgggatggtgcaagaaaacgccgagtgaccgtaaacacggcctacggctcaaacggggtgtctgtgcttagaataactcggttaacactggaggattctgggacatatgagtgtcgagccagtaacgatcctaagcgaaacgacctacgccaaaatcctagcataacatggatccgtgcccaggcaaccatttctgtgctgcagaagccacgcatcgttacctcagaggaggtgataatacgggactccccagtcctgccggtgacactacagtgcaatctaactagcagcagccatacgttaacctacagctactggaccaagaatggcgtggagctgagtgccacaagaaagaatgcgtccaatatggaataccggataaacaaaccacgcgctgaggacagcggcgagtatcactgtgtgtaccattttgtcagtgcacccaaggcgaacgcaacaatcgaggtgaaagcggcacccgacattactgggcataagcggagtgagaataagaacgaaggacaggatgccaccatgtattgcaaaagtgtgggctatccgcatccagactggatttggagaaaaaaggagaatgggatgccaatggatatagtgaatacaagcggtcggtttttcattataaacaaggagaactacacagaattgaatatcgtgaatctgcagataactgaggacccaggcgaatatgaatgtaatgccacaaacgctattggctctgcctcagtcgtgacagtgctaagggtgaggagccatctcgcgccactgtggccctttctgggcatattggccgagatcattatactggtggtaatcatcgtggtgtacgaaaaacgcaagcgaccggatgaggtccctgatgtgccgcctagaaaaacaaactccacaaataaccacaaggacaaaaacttgagacagcggaatactaattag

SEQ ID NO: 232559 - DNA, 513 bp, Artificial Sequence
  Description of Artificial Sequence: Synthetic coding sequence
atgatggcaggtatgaagatccagttggtgtgcatgctgctcttagccttcagcagctggtccttatgctcagattcggaggaagaaatgaaggctctcgaagcggacttcctgacaaatatgcacacatcaaaaatctcaaaggctcatgttcccagctggaagatgaccctcttaaatgtgtgctccttggtaaacaatttgaactcaccggcagaagagactggagaggttcacgaggaggaactcgtggcaaggcgtaagctgcctaccgcgttagacggcttctccctggaggccatgctgacgatttaccaactgcataagatttgccacagtcgagccttccagcattgggagctgatccaggaggatattcttgacacgggaaacgacaagaatggaaaagaggaggtaataaagcgcaaaatcccttacatcctaaagcggcaactctacgagaacaagcctaggcggccatatatcctgaagcgagacagctattattattag

SEQ ID NO: 232560 - DNA, 348 bp, Artificial Sequence
  Description of Artificial Sequence: Synthetic coding sequence
atgactctgcttaacgtgtgcagccttgtaaacaacctgaattcccccgcagaggaaacaggcgaggtgcacgaggaagagttggtagcaagacggaaactgcccaccgctctcgacggcttctctctcgaggccatgctaaccatttaccagttacataagatttgccattcacgtgctttccagcattgggaattgatccaggaagatatcctcgacaccggaaacgacaaaaacggaaaagaggaagtgattaagagaaagataccctacatcctgaagagacagctatacgaaaataagccacgacgcccttatattctgaaacgcgatagctactactactag

SEQ ID NO: 232561 - DNA, 288 bp, Artificial Sequence
  Description of Artificial Sequence: Synthetic coding sequence
atgatggcaggaatgaagattcagcttgtctgtatgctgttattagcgttctcttcctggagcctctgcagtgacagtgaagaagagatgaaagcccttgaggccgatttcctgaccaacatgcacacgagtaagcttattcaagaagatatcctcgatacaggtaatgacaaaaacggcaaggaggaggtgataaaaaggaagattccctacatcctgaaaagacagctctacgaaaacaaaccaagacggccttatatcctgaaaagagacagctattattactag

SEQ ID NO: 232562 - DNA, 1257 bp, Artificial Sequence
  Description of Artificial Sequence: Synthetic coding sequence
atgcggctgaattcgagcgctccaggtaccccagggactccagctgcagacccattccagcgcgctcaagccggactggaggaggcactcctggcaccaggcttcggaaacgcatccggcaatgcctccgagagggttctggccgcaccaagtagtgagctagatgtaaacaccgatatttactcaaaggtcttggtcaccgcagtctacctggctttattcgtggtgggtaccgtgggcaatactgttacggcattcaccctagctcgcaagaagtcactacagagccttcaatctaccgtgcactatcatctaggctccctcgccctgagcgatttgctgactctacttctagccatgccagtcgagttatataattttatctgggtgcaccatccctgggcattcggtgatgcgggatgcagaggatactactttctgagagacgcctgtacctatgccacagccctgaatgtcgcatcgctgtccgtggagcggtatctcgccatctgccacccttttaaagctaagactctgatgagccgttctagaactaagaaatttatttcagccatctggctggcctcggcactgctcgctgtaccgatgctctttaccatgggcgaacagaaccggagcgctgatggacagcacgctggcggtctggtgtgcacccccacgattcacactgccactgtcaaggtggtgatacaggtcaatacatttatgtccttcatcttccctatggtggttatatccgttcttaataccatcatcgctaataagcttactgtgatggttaggcaggctgcagagcagggccaggtgtgcactgtgggaggcgagcattccacgttttcaatggccatagaacctgggagggttcaagctcttagacatggcgtgagagtcctgagggctgtggtgatcgctttcgtggtatgttggctcccataccatgtgcgccgactgatgttttgctacatatcagacgagcaatggacaccctttctgtatgatttttaccattatttctacatggttacaaacgcccttttctacgtgtcttcgactattaatcctatattatataatctggtctcggcaaattttaggcacattttccttgccacccttgcctgtctttgcccagtgtggcgaaggcggcgaaagcgtcccgcttttagtcgtaaggcggatagcgtcagcagcaatcacaccttatccagtaatgcaactagggagactctgtattag

SEQ ID NO: 232563 - DNA, 951 bp, Artificial Sequence
  Description of Artificial Sequence: Synthetic coding sequence
atgggggtttgtgggtatttgttcctgccgtggaagtgccttgtcgtcgtgagcctgagactgcttttcctggttcccacaggggtcccagtgaggagcggagacgctacattcccaaaggccatggataacgtgacagttcgccaaggagagtccgccaccctgcgctgcaccatcgataatagggtgactagggtcgcatggctgaacagatcaacgatactgtacgctggcaatgataagtggtgtctggaccctcgtgtggttcttctttcaaatacacaaacacagtactcgatcgaaattcagaacgtggacgtctacgacgaaggcccttacacctgctctgtgcagactgataatcaccccaaaacatcacgcgtccacctgatcgtgcaagtcagccccaagatcgtagagatcagtagcgatatttccatcaatgaggggaataatatttctttgacttgcatagctaccggcaggcccgagccgaccgtgacttggagacacatcagccctaaggctgtgggatttgtgtctgaagacgagtatttagagatccaaggcatcactcgcgaacagtcaggagattatgaatgctcagctagcaatgacgtggctgctcctgtggtcaggcgagtcaaggtaactgttaactacccgccttacatcagcgaggcgaaaggcacgggagtgcctgttggacaaaaaggcaccctccagtgcgaggccagcgcggtcccctctgcagaatttcaatggtacaaagatgacaagcgtctcatcgagggtaagaagggcgtcaaagtggagaatcggcctttcctgtcaaaactaatctttttcaatgtcagcgagcatgattacggtaattacacatgtgtcgcatcgaataagctgggccacactaacgcatcgatcatgctgtttggtgagactgtcctttag

SEQ ID NO: 232564 - DNA, 1035 bp, Artificial Sequence
  Description of Artificial Sequence: Synthetic coding sequence
atgggagtgtgtggatatctgttcctgccatggaaatgcctggtggtcgtgtccctgaggctgctgttcctggtgccgactggagtgcccgtccgaagcggtgacgccacattcccaaaggcaatggataacgtaactgtgagacagggcgaaagcgctaccctgcggtgtaccatagacaatcgggttacacgcgtggcctggttgaatagatccaccattctctacgccggtaatgacaaatggtgtctcgatccccgtgtagtcctgttaagcaacacgcagacgcagtacagcatcgaaatacagaacgtggacgtctacgacgagggaccgtatacctgttccgttcaaacagacaatcaccctaagactagccgtgttcacctgatagtgcaagtgtcgccaaagatcgttgaaatttcgtctgacatctctattaacgagggaaacaacatatctctaacctgtattgcaactggcagacctgagccaacggtaacttggcgccacatctccccaaaagcagtcggattcgtgagtgaagacgagtacctagagattcaaggcattacccgggagcaaagcggcgattacgaatgctccgcctcaaacgacgtagccgctcctgtcgtgaggcgtgtcaaggttaccgtgaactaccctccctacatatccgaagccaagggtaccggggtgcccgtgggccagaaagggaccttacagtgcgaggctagcgcagtaccatcagcagagtttcaatggtacaaggatgacaagagattgatcgagggaaaaaagggcgtgaaagtcgagaataggccttttctgagtaaactgattttcttcaatgtctctgaacacgattatggaaattacacctgcgtcgcttctaataagctggggcataccaatgcttcgatcatgctctttggacctggcgcagtgagtgaagtgagtaacggaacgagtagacgagctggatgtgtgtggctgttaccgctcctcgtgctccacctgttgctcaagttctag

SEQ ID NO: 232565 - DNA, 1035 bp, Artificial Sequence
  Description of Artificial Sequence: Synthetic coding sequence
atgaaaaccatccaacctaagatgcataactccatcagttgggccatctttaccggcctagcagcactctgcctgttccaaggagtacccgtccgatcaggggacgctacgtttcctaaggccatggataacgtaacagtccgacagggggagtctgctacattgcggtgcaccattgacaaccgcgtgacacgggttgcgtggttaaacaggtcaaccatcctgtacgcaggtaacgataagtggtgcctcgacccgagagtggtattactaagtaatacgcagacacagtattcaattgagattcagaatgtcgacgtctacgacgaaggaccctatacatgttctgttcagacagataatcaccctaagaccagccgcgtgcaccttatcgtccaggtctcaccgaagattgttgagatcagcagcgacatctcaatcaatgaggggaacaacatctcgctgacatgtattgccaccggacgccctgaaccgacagtgacttggcggcatatctcgcccaaggcggtcggctttgtctctgaggatgaatacctagaaatacaagggataacacgggagcagagcggcgactacgagtgttccgcgtccaatgatgtggctgcccctgtcgtcagacgagtgaaagtcacggtaaactacccgccttacatttctgaagctaaaggtaccggggtacctgtcggtcagaaagggaccctccagtgcgaagcctcggcagtccctagcgcggaattccagtggtataaagacgacaaacggctgatcgagggaaagaagggggttaaagtggagaacaggccttttttatccaagctgatctttttcaacgtatcggagcacgactacgggaattacacttgcgttgcctccaataagctgggccacaccaacgcctctatcatgttatttgggccaggcgcagtctcagaagtgagtaatggtacttcccgacgagccggttgtgtttggctgctgcctctgcttgtcctacacctgctgttgaaattttag

SEQ ID NO: 232566 - DNA, 1041 bp, Artificial Sequence
  Description of Artificial Sequence: Synthetic coding sequence
atgaacggaaaacggaacggtgaaggcggaaagcgatggaagtggaaaggcaccggagtgcccgtgcgctccggggacgccacatttccaaaagctatggacaacgtcactgtgcggcaaggggagtctgccaccctgagatgtacaatcgataatagagtgacacgggttgcctggctcaacagaagtaccattttgtacgcaggaaacgataagtggtgtctggatcccagagtagtgctgttgtcaaacacccagacccagtatagcatagaaattcagaacgtggacgtttatgatgagggaccttacacctgtagtgtgcaaaccgacaaccacccaaaaacttcaagagtgcacctgatcgtgcaggtctcacccaagatcgtagagatctcaagtgacatcagcataaacgaggggaacaatatcagcttgacatgtatcgccactggaagacctgaacctaccgtaacctggcggcacatatctcccaaagcagttggattcgtatctgaagatgagtacctggagatccagggcatcacaagggagcaatctggggattatgaatgttccgctagtaacgacgtcgctgcccctgtggtcagaagggtcaaggtgactgtgaactaccccccttatatctctgaggcaaagggtacaggcgtgcctgttgggcagaagggaaccctgcagtgtgaagcctccgcggtgcctagtgccgagttccagtggtataaggacgacaagagactaattgaaggaaagaaaggagtgaaggtggaaaatcgaccctttctttccaaactcatatttttcaacgtcagcgaacacgattacgggaactatacctgtgtcgcctcaaacaagttaggacacacaaatgcctccataatgctttttgaggtgaagaccacagcactgacaccttggaaaggaccaggagccgtctcagaagtgtctaacggcacaagcagaagagcaggatgtgtgtggcttctgccgcttctggtcctacatctcctgctgaaattttag

SEQ ID NO: 232567 - DNA, 1068 bp, Artificial Sequence
  Description of Artificial Sequence: Synthetic coding sequence
atgaaaacaattcaacctaaaatgcataacagtatcagctgggcaatctttacagggctggccgcactctgtttgttccagggcgtacctgtgagatcgggtgacgccaccttcccaaaggctatggacaacgtgaccgtgcggcagggcgagtcagccactcttaggtgtacgatcgataaccgtgtcactcgggttgcctggctgaacaggagcacaattctttacgccggtaacgataagtggtgcctggacccacgtgtggtgctcttatcaaatacccagacacagtactccatcgagatacagaatgtagatgtctacgacgagggcccatatacctgttctgtgcagactgacaaccatcctaagactagtcgcgttcacctcatagtgcaggtgtcccctaaaatcgtggaaatttcatcagacatatcaatcaatgagggcaataatattagtctgacttgtatcgccactgggagaccagaacctaccgtgacctggcgccacattagcccaaaagccgtgggctttgtatctgaggacgaatatctggagatacaaggcatcacccgagaacagtcgggtgattatgagtgctcagcttccaacgacgtagcagcacccgtggtacgtcgggtgaaggttactgtcaactatcccccttatatttcagaggccaaaggaaccggcgttcccgtcggccagaaaggcaccctgcaatgtgaggccagcgccgtcccatccgctgagtttcaatggtataaagacgacaagaggttaattgagggaaagaagggggtgaaagtagaaaaccggccattcctgtctaagctgatcttctttaatgtctctgagcatgactacgggaactacacctgtgtggcttcaaataagctgggacacacaaatgcttcaattatgctgtttgaagtgaagaccacggccctgacaccttggaaaggtcctggggcagtgagcgaagtaagcaatgggactagtaggcgcgctggttgtgtatggctgctgccgctgctggtgctacatctgctcttgaaattctag

SEQ ID NO: 232568 - DNA, 1068 bp, Artificial Sequence
  Description of Artificial Sequence: Synthetic coding sequence
atgggagtgtgcgggtacctgttcctcccctggaaatgcctagtggtagtctcactgcggctcctgtttctggtgcctactggagtccctgttagatctggcgatgcgactttcccaaaagcaatggataacgtgacagtgcgtcagggagagagtgctacccttcgctgcacaatcgataaccgcgtaactagggtcgcttggttaaacaggagtacaatactgtacgcaggtaacgataagtggtgtctagacccacgtgttgttctcctttccaacacccagacgcaatatagcatagagatacagaatgtggacgtctacgacgaagggccttacacgtgttcagtccagactgataaccaccccaaaacttcacgcgtacatctcatcgtgcaggtgtcgcctaagatcgtggaaatttcctcagatatatccattaatgagggcaacaacataagcctgacttgcatagccaccggcagacccgaacctaccgtgacatggagacacatctctcccaaagcagtggggtttgtctccgaagatgaatacctggaaatacaagggattactcgcgaacagagtggagactatgaatgctcagcctctaatgacgtggccgcaccagttgtaagaagagtcaaggtgacagtgaactatccgccttatatcagtgaagctaaaggaacgggtgtgcctgtcggccagaaaggtaccctgcaatgtgaagcatccgctgtgccatctgcggaatttcagtggtataaggatgataagcgcctgattgagggcaaaaaaggggttaaggtcgagaatcggcctttcctctcaaagcttatattctttaatgtgtcggagcacgattacggaaactacacctgcgtggcctctaataagttaggccacaccaatgcctcaatcatgttgttcgaggtgaaaaccacagccttgactccctggaaagggcctggcgcagtgagtgaagtttctaacggtacctcccgccgagcaggatgcgtgtggctgctccctctgctggtgctacacctgttgctcaagttctag

SEQ ID NO: 232569 - DNA, 2373 bp, Artificial Sequence
  Description of Artificial Sequence: Synthetic coding sequence
atgctaagaggtggacggagaggccaattggggtggcactcttgggccgcaggccctggatctcttttggcatggcttatcctggcatcagccggagccgcaccatgtccagatgcctgctgtcctcacggctccagtggattgcggtgtaccagggacggggctctagacagtctgcatcacttgcctggagccgagaacctcacagaactctacattgagaaccagcagcatttacagcatttagaactcagggatctgcgcggtctcggtgagctccgtaacctcactattgtcaaaagtggcctcaggtttgtggcccctgacgccttccacttcacgccacggttgtcaagactaaacctgtccttcaatgccctggagtcacttagctggaaaaccgtccaggggctctcactgcaggaattagtgctgtctggcaatccattgcattgcagctgtgctcttcgatggcttcagcggtgggaagaggaggggctagggggtgttcccgagcagaaacttcagtgccacggccagggacctctcgctcacatgcctaacgcttcgtgcggcgtgcccactctgaaagtgcaggtcccgaacgctagtgtcgatgtcggagacgacgtgctgctgaggtgtcaggtagaaggcagaggactggagcaggctggatggatcctgaccgaattggaacagagcgccactgtgatgaagagcggcggactgcccagcctcggactgacgttagcaaacgtgacctcagacctcaatcgcaagaacgtgacctgctgggctgaaaacgatgtggggagggcagaagtgagtgttcaggtgaatgtctccttccccgcaagtgtgcagctccacacagcagtcgagatgcatcattggtgcattcccttctccgtcgacggccaacctgcccctagcctcagatggctgtttaatggttctgtactgaatgagacttctttcattttcactgagttcctggaaccggctgcgaacgaaactgttaggcatggctgtttaaggcttaaccagccaactcacgtgaataatggaaactacaccttgttagccgctaacccttttggacaggccagtgcatccattatggccgctttcatggataacccctttgagttcaatcccgaggatcccattccagacactaattcgactagcggagacccagtagagaaaaaggatgagacacccttcggggtgtctgtcgcagttggactagctgtgtttgcatgcctcttcctcagtaccctcttgctggtgcttaacaaatgcggaagacgcaataagttcggcatcaaccggccagccgtcttggctccagaggatggacttgccatgagtctgcattttatgacactaggcggttcatccctgtcccctaccgagggcaagggctccgggctccaaggccacattatagagaatccgcagtatttttcagatgcttgcgtccaccacatcaaacgtcgggacattgtcctcaagtgggagctcggtgagggggctttcggcaaggtattcctggccgagtgccataacctgttacccgagcaggacaaaatgctggtggcagtaaaggccctgaaagaggctagtgaaagtgcgcgtcaggacttccaacgcgaagccgagctcctgactatgctccagcaccagcatatcgtcagatttttcggtgtatgcaccgagggacgcccacttctgatggtgttcgaatacatgagacatggagatcttaaccggttcctgagatcacacggccctgacgctaagttgctagccggaggggaagatgtagctcctggtccccttggactgggtcaactgctggcagtagcgagccaagtggctgcgggaatggtctacctggcgggactgcatttcgtccatcgcgatctcgcaacaagaaattgtctggtggggcaggggctggtggtgaaaataggcgactttggaatgagccgcgatatctattccacagactactaccgcgttggtggcaggacgatgctgcctatcagatggatgcctccggagtctatcttgtataggaaattcacaaccgaaagcgacgtctggtcattcggggtggttctctgggaaatctttacttatggcaagcagccatggtaccagctcagtaacaccgaagctatagactgtatcactcaaggccgtgagctagagcgacctagagcttgtcctcccgaggtctacgccataatgaggggatgctggcagagggagcctcaacagcgtcacagcatcaaagatgtacatgcccgtttgcaagcactggcgcaggcccctcctgtgtatttggacgtcctagggtag

SEQ ID NO: 232570 - DNA, 2283 bp, Artificial Sequence
  Description of Artificial Sequence: Synthetic coding sequence
atgaaggaggctgctctcatatgccttgccccaagcgtgcctcctatcttgactgttaagtcgtgggacaccatgcagctacgtgcagcacgcagtagatgcacaaacttactggcggcttcatatatcgaaaaccaacagcatctgcaacacttggagctaagggacttgagggggctgggtgagctccgcaatcttactattgtcaaatcgggtctgcgcttcgtggccccagatgctttccatttcacccccaggctgagtaggttgaacctttcattcaatgctctcgagagcctgagttggaagaccgttcagggcctctccctgcaagaacttgttttgtcaggtaacccccttcactgctcttgcgctctccggtggctgcagcggtgggaagaagaaggtctaggaggagtgcccgaacagaagttgcagtgccatgggcaaggaccccttgcccacatgcccaatgcttcttgcggcgtgccgactctaaaagtgcaggtaccgaacgcctccgtagacgtgggcgacgacgttctgcttaggtgccaggtagaggggcgtgggcttgaacaagccggatggattctgactgagctggagcaatcagcgactgttatgaaaagcggcggtctcccaagcttaggcctcacactggccaatgtaactagcgatctgaaccgtaaaaacgtgacttgctgggccgaaaatgatgtgggaagagccgaagtgtctgttcaggtgaatgtgtctttccctgcgagcgttcagctgcatactgcagtagaaatgcatcattggtgcatccccttctctgttgacggacaaccagccccatcccttcgctggttgtttaatggatccgtgttaaatgagacaagttttatattcacagaattcctggagcctgctgcgaacgagacagttcggcacggctgcctccggctgaatcagcccacccacgtgaacaacggcaattacacattgctggcagcgaatcctttcggtcaggcatcggcttccattatggcagcgtttatggacaatccctttgaatttaatccagaggacccaatacctgatactaactctacgtcaggcgatcctgtcgagaagaaggatgaaacgcctttcggcgttagcgtggcggtgggtctggcggtgtttgcctgtctgtttctttccaccctcctgctggtgttgaacaagtgtggtagacggaataagtttggtattaacagaccggcagtccttgcgccagaggacggacttgctatgtcattgcactttatgactttgggtgggtcttcgctctccccaacggagggaaagggcagcgggctgcaaggtcatattatcgaaaaccctcagtacttctccgacgcctgtgtgcatcacattaagcggagggacattgtgctgaaatgggagctcggagaaggggctttcggaaaggtgttcctggccgaatgccacaatctactgccggaacaggataaaatgttggttgcggtcaaggccctaaaagaagcctcggagtctgcacgccaggattttcaacgggaggcagagctgcttacaatgttgcaacatcagcatatcgtgaggttctttggcgtatgcacagagggtcggccattactgatggtgtttgagtatatgagacacggagacctgaaccgcttcctacgttcccatggacctgacgccaagctcctggctgggggtgaagacgtggcccctggcccattggggttggggcagctgcttgcagtagcttctcaggttgccgctggtatggtgtatcttgcgggactgcatttcgtgcaccgcgatctggcaacaagaaattgtcttgtcggtcaaggtctcgtcgtgaagataggcgacttcggaatgtcacgcgatatctattctaccgattactacagggtagggggtagaaccatgctaccgatccgatggatgccaccagagtcaattctctatcggaaattcactactgagtccgacgtttggagctttggtgtggtgctatgggagatattcacatatggtaaacagccctggtatcagctttcaaacacggaggcaattgattgtattacccagggcagggagttggaacgccctcgcgcatgcccacctgaggtgtacgcaattatgaggggatgctggcaaagagagccccagcagaggcacagtattaaggacgttcatgccaggctgcaagctttggctcaggcaccaccagtgtaccttgatgtcctcggttag

SEQ ID NO: 232571 - DNA, 2391 bp, Artificial Sequence
  Description of Artificial Sequence: Synthetic coding sequence
atgctgcgaggaggacggaggggacagttggggtggcatagctgggcggcaggccctgggtcactgctagcatggctcatcctagcttctgctggcgctgctccgtgccctgatgcttgctgcccccacgggtcctccggactccgctgtacacgtgacggtgccttggacagcctgcaccacctcccaggggcagagaatctcacggagctgtacatagagaatcagcagcaccttcagcaccttgaactgcgcgacctccgaggcttgggcgaattaaggaacctgactatagtgaagtccggactgcgctttgtggccccagatgcatttcatttcacaccaagactttctagattgaatctgtctttcaatgctctcgagtcactgagctggaagacggtgcaaggactttcgttgcaggaactggtgctgtctggcaacccactccattgcagctgcgcccttcgctggctgcagcggtgggaggaagaaggccttggaggggtcccagaacagaagctgcagtgccatgggcagggacccctcgcgcatatgcccaacgctagctgcggcgttcccacattgaaagtgcaagttcccaatgccagtgtggatgttggcgatgacgtgctgttgcgatgtcaggtagagggccgtggcctggaacaggctggttggatcttgactgagctcgaacagagtgcaacagtgatgaaatccgggggattgccctctcttggtcttacgttagccaatgtgacatccgatctcaacaggaagaacgtcacgtgttgggccgaaaacgacgtggggagggcagaagtgtccgtacaggtcaatgtgtcattccccgcatcagtgcagctgcataccgctgtagagatgcaccactggtgtatccctttctctgtggatggacagcctgccccttccctgcggtggctatttaatggatctgtactaaacgagacgtccttcatttttacggagttcctggagccggctgccaacgaaaccgtaaggcacgggtgtctgcgacttaatcagcctacacacgtaaacaatggcaattatacactgctggcagctaacccattcggtcaggcatcggccagcattatggctgcctttatggataacccattcgagttcaatcccgaggatcctatcccagtgtcgttctctcccgtcgataccaactcaacttccggggaccccgttgagaagaaagatgaaacccccttcggagtaagcgttgcagtcggacttgctgtgttcgcctgtctattcctttctactctactactcgttttgaataaatgcggcaggaggaataagttcggcattaatcggccagccgtgctggccccagaggatgggctcgcaatgtcccttcactttatgactctgggtgggtcaagcttatcccccacagaagggaagggcagtgggctgcagggccatatcatcgaaaatcctcagtacttcagcgacgcgtgcgtccaccacatcaagcgccgtgacatcgtgctcaaatgggaactcggtgagggggctttcgggaaggtatttctggctgagtgtcataatctgctgcccgagcaagataaaatgctggtggcagtgaaagctctaaaggaggcttctgaatctgctaggcaagattttcaaagggaagcagagctgttgacaatgctgcagcatcagcacatagtgcgatttttcggggtttgcaccgaggggcgacctctccttatggtatttgagtacatgcgtcacggagacctgaatcgctttctgaggtcgcacggaccagatgccaaactgcttgccggaggggaagatgtggctcctggcccactagggttgggccagctccttgcagtcgcaagccaggtcgctgctggaatggtgtacctggcgggtttacactttgtacatcgcgacctcgcaactaggaattgtctggtggggcagggtttagtggtgaagatcggagactttggcatgtcccgagatatttacagtaccgactactaccgggtcggaggacggaccatgctgccaatccggtggatgcctcccgagtctatcctgtacaggaaattcactaccgagtcagacgtgtggagctttggcgtggtgctgtgggaaatctttacatatggcaagcagccttggtatcagctctcaaatactgaagcaattgattgtattacccaggggagggaactggagcggccacgggcttgtcctccagaggtttatgctatcatgcggggatgctggcagagagaacctcagcaacgccactccattaaggatgttcatgccagacttcaggccttggcccaggcccctccagtgtacctggacgtgctggggtag

SEQ ID NO: 232572 - DNA, 2517 bp, Artificial Sequence
  Description of Artificial Sequence: Synthetic coding sequence
atgtcaagttggatccgttggcacgggcctgccatggcacgactttggggcttctgctggctcgttgtgggattctggcgcgcagcattcgcgtgccctactagctgcaagtgctccgcgagtcgtatttggtgtagtgatccttcacccggaattgtggcattcccaagactcgagcctaactccgtggaccccgaaaatatcacagagatattcatcgccaaccagaaacgtctagaaatcattaatgaggatgatgtggaagcttacgtcgggctccgtaacctgacaatcgtggatagtggactgaaattcgtggcccataaggcttttctaaaaaactcaaatctccagcacattaattttacacggaataaactcacaagcctttcacgcaagcactttcgccacctggacttgtccgagctgatcctggtggggaacccgttcacttgctcctgcgatattatgtggatcaaaaccctacaagaggcgaaatctagtcccgacacccaggatttatattgcttgaatgagtcaagcaaaaacataccactcgcgaatttgcagatcccgaactgtggcctcccaagcgccaatctcgcagctcccaacctcacagttgaagagggtaagagcatcaccctctcctgttccgtggccggagatccagtccctaacatgtattgggacgtgggcaacctggtaagtaaacacatgaacgaaacctcacatactcaggggtctttgagaattaccaacatctcatctgacgattcaggcaaacaaatctcttgtgtagcagaaaatcttgtcggagaagaccaagattccgtaaatctcacggtacattttgcccctacaattactttcctggagagcccaacctcagatcaccattggtgtatcccattcacagttaaaggaaaccctaagccagcactgcagtggttttataacggcgcaatactgaacgagagcaagtacatttgtacgaaaatccacgtaacgaatcacacagaatatcacggatgcctccaactggataatcctacccacatgaataacggagattatacgctgatagctaaaaacgaatacggcaaagacgaaaagcaaatttctgcccactttatgggatggcccggaatcgacgacggggctaatcccaattatcctgacgtcatatatgaggactatggcacggcggcaaatgatatcggcgacaccaccaatcgcagtaacgaaatcccatctacggacgtgacagataagacaggcagagaacacctgagcgtgtacgctgtggtcgtcattgcctcagttgtaggattctgtttgctagtcatgttgttccttctcaagcttgctagacactccaagttcggtatgaaggacttttcctggttcggattcgggaaagtgaaatcaagacagggagtgggacccgcttccgtgattagcaacgacgatgattctgcatctccactgcatcacataagcaacggatctaacactccttctagctccgaaggcggacccgacgcggtcataatcgggatgactaagattcctgtcatcgagaacccccagtactttggaattacaaattcacagctcaagcctgataccttcgtccagcacattaagcgccacaacatcgtgctcaagcgcgagctgggcgagggtgcctttgggaaggtctttctggccgaatgttacaacttgtgcccagagcaggacaagattctggtggccgtcaagacgctcaaggacgcttctgataatgcccgaaaagacttccaccgcgaggccgaactgctgactaatctccagcatgaacatatagtgaagttctatggcgtttgtgttgagggcgatcccctgataatggtatttgagtatatgaaacatggggatctcaataaattcctccgcgctcacgggcctgatgcggttctgatggccgaggggaacccccctacagagctcacccaatctcagatgctccacattgcccagcaaattgcagcaggtatggtgtacctggcctctcagcatttcgtgcatcgagatttggccactcgaaactgcctggtgggagagaatctcctggtgaaaatcggggacttcggcatgtctagggacgtttattctactgactattatcgggtgggcggacacaccatgctgccgattcgttggatgcccccagagtcaattatgtatcgcaaatttaccaccgaatcagacgtgtggtcgttaggcgtggtcctatgggagatcttcacgtacggaaaacagccttggtatcagttatcaaataatgaggttattgaatgcatcacccaaggcagggtgcttcagcgcccaagaacctgtccccaggaggtgtatgaacttatgctaggttgttggcaaagggagccacatatgaggaagaacattaaaggaattcacacacttctgcagaatctggcgaaggcctcaccagtctacttggatatcctgggatag

SEQ ID NO: 232573 - DNA, 1662 bp, Artificial Sequence
  Description of Artificial Sequence: Synthetic coding sequence
atgtcctcatggattcgctggcacgggccagccatggctagactgtggggcttttgttggctggtcgtgggattttggcgcgcagccttcgcctgccccacttcttgtaagtgctctgctagcagaatatggtgcagcgacccatccccgggtatagttgcatttcctcggcttgaacccaacagcgtcgacccagaaaacatcacagagatattcatcgctaatcagaagcgccttgagatcattaacgaagacgacgtggaagcttacgtgggactgagaaacctgactatcgtcgatagcggactgaaatttgtggcccacaaagctttcctcaagaattccaatttacagcacatcaatttcacaaggaacaagctcacatctctgagcaggaaacatttccggcatctcgatctcagcgaactgatactggttggtaatccatttacctgctcgtgtgacatcatgtggatcaagactttacaggaggcaaagtcctcccccgatacgcaggacctgtactgtttgaatgagagtagcaaaaatatccctctagctaacctgcagatccccaattgcggactcccatcagccaacctggcagctccgaatttaacagtagaggaaggtaagagtattactctgtcctgttcagtggccggagatcccgtgcccaatatgtactgggacgttggcaacctagtgagcaaacacatgaacgagaccagccacacccagggcagtttaaggattacgaacatcagctctgacgatagcgggaaacagatcagctgcgtcgccgaaaacctggtgggcgaggaccaggatagtgttaatctgaccgttcattttgccccaaccattacttttctggaaagcccaacaagcgaccatcactggtgtatacccttcaccgtgaaagggaatccaaagcctgcactgcagtggttctataacggagctatactgaatgagtccaaatacatttgtacgaagatccacgtgaccaatcacactgagtatcatggatgcctacagctggataatccaacccatatgaataatggagattatacgctgatcgctaaaaatgaatacggaaaggatgagaaacaaattagcgcccattttatgggttggcccggaattgatgacggcgcaaatccaaattaccctgacgttatctacgaggattatgggacggccgcaaatgatattggggacactaccaatcgaagcaatgaaatcccctcaactgatgtgaccgataagaccgggagggagcatttgagtgtgtacgccgtcgtggtgatcgcatcagtagtgggattctgcctgctggtcatgctattcttgctaaaactggccagacacagtaagttcggcatgaaggacttctcctggttcggatttgggaaagtcaaatcccgccagggggttggcccagccagcgtgatcagcaacgatgacgatagcgcttcccctctgcaccatatctctaacggaagtaacaccccatcgtcctcagagggaggccctgatgcggtgatcataggtatgaccaaaattcccgtcatcgagaacccgcaatacttcggtataaccaatagtcagttaaagccagatacttggccgagaggttctcccaaaacggcatag

SEQ ID NO: 232574 - DNA, 2469 bp, Artificial Sequence
  Description of Artificial Sequence: Synthetic coding sequence
atgagctcatggatccgatggcatggaccagccatggctcgattgtggggcttttgctggctggtcgtcggcttctggcgcgctgcttttgcttgtcccacctcgtgtaagtgctccgccagccgcatctggtgctccgatccgtcacccggaattgtagcgttcccaagacttgaaccaaactcagtcgatcctgagaacatcactgagattttcattgccaaccagaagcgcctggaaatcatcaacgaagatgatgtcgaggcatatgtgggcctgcgcaatctgactattgttgacagtggactgaaattcgtcgctcacaaggcctttctgaaaaactctaacctgcagcatatcaatttcactcggaacaagctgacaagtctaagccggaaacacttccgacatctcgatctgagtgagctgattctggtgggaaacccgttcacctgcagctgtgatattatgtggattaaaacactccaggaggcgaagagctcccctgatacacaggatctgtactgtctgaatgaatctagcaaaaatatcccgttagccaatctgcagattcccaactgtggcctgccatctgccaatctcgcggctcctaacttgaccgtcgaggagggaaaatcaattaccctctcatgtagcgtggcaggagaccccgtgccgaacatgtactgggacgttggcaatctggtcagtaagcacatgaacgaaaccagtcatactcagggatctcttcgcatcactaacatctcttcagacgattccggtaaacagatatcctgcgtggccgaaaaccttgtgggcgaagatcaggactcagtcaacctgacagttcactttgctcctacgatcacttttctggaaagccctacctctgatcaccattggtgcattcccttcacagtcaagggcaatccaaagcctgctcttcagtggttctataatggcgctatcctcaatgaaagcaaatatatatgtaccaagattcacgttacaaaccatacggagtaccacggctgcctgcagttggataaccccacacacatgaataacggggactacaccttaatcgcgaagaatgagtatggtaaggatgagaaacaaattagcgcccatttcatggggtggccgggaattgatgacggtgcaaatccaaactacccagacgttatttacgaggactacgggacagccgctaatgacatcggtgataccaccaaccggtccaatgagatacctagtactgacgtcaccgataaaactggccgagagcatctgtctgtgtatgccgtcgtagtaattgccagcgtcgtgggattctgccttctcgtaatgctgtttttgctgaaactggccagacactcaaagttcggcatgaagggaccagcctccgtgatatcaaatgatgacgacagtgcatcccctttgcatcatatatctaacggctctaacacccctagttcatccgaaggcggtcctgatgcagtgatcattggcatgacgaaaattcccgtgatagagaacccacaatactttggcattactaacagtcagcttaagccagatacatttgtgcagcacataaagcggcacaatattgtgctgaagagagaactcggcgagggcgctttcggaaaagttttcctggcggagtgttacaacttatgccctgagcaagataaaatactcgtggctgtcaagactctgaaggatgccagcgacaacgctaggaaggacttccaccgagaggctgaattgcttactaacctgcagcacgagcacattgtgaagttctacggtgtctgtgtagagggagaccctctgattatggtattcgaatacatgaagcatggagatctcaataaatttttgagggcacatggccctgatgcagtcttaatggccgaaggtaatcctcccacagagcttacccaatcccagatgctacatatagcccaacagatagccgcaggcatggtgtatctcgcatctcagcacttcgtgcacagggaccttgccaccaggaactgtcttgtaggagaaaatctgttggttaaaatcggagactttggaatgtccagagacgtctatagtacggattattatcgtgttggtggccacaccatgcttccaattcgctggatgccgccagagtcaataatgtatagaaaatttaccaccgagagtgatgtgtggagcctgggggttgtgctgtgggagatatttacttatggtaaacagccttggtaccaactgtcaaacaacgaggtcatagagtgcattacccagggccgagtgctgcagagacctcgcacgtgccctcaggaagtctacgagttaatgctgggctgttggcaacgtgagccccacatgcgaaagaatattaaaggcatccacaccctcttacagaatctcgctaaggcctcacccgtgtatcttgacatcttgggctag

SEQ ID NO: 232575 - DNA, 1434 bp, Artificial Sequence
  Description of Artificial Sequence: Synthetic coding sequence
atgagctcatggattcgatggcatggccctgctatggctagactatggggtttctgctggcttgttgtcggattctggagagccgcttttgcgtgtccaacatcgtgcaagtgttcagcatctcgtatttggtgtagtgatccttcccccggtatcgtggccttccctcgccttgagcccaatagcgtcgaccccgagaacatcacggagatctttatagccaatcagaagagactcgaaatcattaatgaagatgacgtcgaggcctacgtgggtcttagaaatctgacaatcgttgattcaggcctcaaattcgttgcccacaaggcgttcctaaaaaattccaacctacagcacatcaactttactagaaataaattaacttctctttcaagaaagcattttcgccatctggatctttctgagctcattctggtgggaaacccgttcacatgctcatgtgatatcatgtggatcaaaacactgcaggaggccaagagctccccagacactcaagacctatactgtctgaacgagagttcaaagaacattcctttagccaacctacagattcctaactgcggtctgccatcagcaaacctcgcggcacctaatcttacggtagaggagggcaagtccatcacactgagttgcagcgtcgcaggagatcccgtgccaaatatgtattgggacgtcggcaatctggtgtcaaaacacatgaatgaaacatcccatacgcagggatctctccgcattaccaatatctctagtgacgactctggcaagcaaatttcatgcgtggcagaaaatctggttggcgaggaccaggatagcgtcaacctgactgttcattttgctcccacaattacgtttctggagtctcctaccagtgatcaccactggtgtatacccttcacagtgaagggtaatcccaagccggcactacagtggttttacaatggcgcaattctgaatgaatccaaatacatctgcacaaagatccacgtcacaaaccacaccgaataccacggctgtttacagctagacaaccccacacacatgaataacggagattatactcttattgctaaaaatgaatatggtaaggacgagaagcaaatttccgcacacttcatggggtggcctgggatcgatgacggcgctaacccaaactaccccgacgtcatatacgaggactatgggacagccgcaaatgatataggtgataccacaaacaggtcaaacgaaattccctccaccgacgtgaccgacaagacaggccgtgagcacttgtctgtttatgcagtggttgtcattgcctcagtggtcggcttttgtctgctggtaatgctgtttttgcttaaactggcacgtcattccaagttcggtatgaaagggtttgttcttttccataaaatacctctagatggatag

SEQ ID NO: 232576 - DNA, 1614 bp, Artificial Sequence
  Description of Artificial Sequence: Synthetic coding sequence
atgtcatcctggatcaggtggcacggccctgcaatggccagactctggggcttctgctggctggtcgtggggttctggcgagctgcgttcgcgtgccctacatcgtgtaagtgctccgcttcccggatctggtgttccgaccccagccccggaatcgttgccttccctcgactggaacccaatagcgtcgatcccgaaaatattacagagatcttcattgcaaatcagaagcggctggagatcataaacgaggacgatgtggaggcctatgtgggcctccggaacctgaccattgtggactccggactgaagttcgtcgctcacaaagcctttttgaagaacagcaacctccagcatataaatttcacgcgcaacaagctgaccagtttaagcagaaagcatttcaggcatttggatctgtccgaattgatacttgttggtaatccatttacatgcagctgcgatatcatgtggataaagactctgcaggaggcaaagagctcacccgatacacaagacctgtattgccttaacgagagctctaagaatatcccactcgccaacctgcagatccctaattgcggattgccttccgcaaacctggctgcccctaatctaaccgttgaagaaggtaagagtattacgctgagttgtagcgtagccggagaccctgtgcctaacatgtattgggatgtaggcaacctcgtgtcaaagcatatgaatgagacgagccatacgcagggctctctccgaatcacaaacatcagctccgacgatagtgggaaacagataagttgcgtcgctgagaatctcgtgggcgaagatcaggactctgttaacctaaccgtgcatttcgcccctacaattacctttttggaatcccctactagcgaccatcactggtgcatccccttcacagtgaaaggaaatcctaaacccgctctccaatggttctacaatggtgcaatcctgaacgagagtaagtatatttgtacaaagatccatgtgactaatcataccgagtaccacgggtgtctacagcttgataaccccacccacatgaacaacggtgactacactcttatagcgaagaacgagtacggaaaggatgagaaacaaatttccgcccacttcatgggatggcctggcatcgatgacggtgctaacccgaattatccagatgtgatttatgaggactatggaaccgcagcaaacgacataggtgataccacaaacagatcaaacgagatcccatctacagacgtcacagataagacagggcgagaacaccttagcgtgtacgcagtcgtcgtgatcgcatccgtcgtgggcttttgtttacttgtaatgctctttcttctgaaactcgccagacattccaaatttggcatgaagggaccagcaagcgtcatctccaacgacgacgacagcgccagtccactgcatcacatatcaaatggatctaacactccatcgagtagcgaagggggtccagacgcagtgatcattggtatgacaaagatcccagtcatcgagaatccccagtatttcgggatcaccaacagtcagctcaaacctgacacttggcccaggggcagtccaaagaccgcttag

SEQ ID NO: 232577 - DNA, 2469 bp, Artificial Sequence
  Description of Artificial Sequence: Synthetic coding sequence
atgagcagttggatacggtggcatggtcccgctatggccagactatggggcttctgctggctggtggtcggtttttggagagcagccttcgcgtgcccaacttcgtgcaagtgttccgcaagccgtatttggtgttcagacccatcccccggaattgtagctttccccaggctggagccaaatagtgtcgatcctgaaaacatcactgagatctttattgctaatcagaagaggctggagatcattaacgaggacgatgtggaagcctacgtgggactgaggaatctcacgatcgtcgacagtggattgaaattcgtagcacataaggcgttcctcaagaattccaatttacaacatatcaattttacaagaaataagctcacatctctctcccggaagcatttccgtcatttagatctctcagagctcattctagtgggcaacccattcacatgcagctgcgacattatgtggatcaaaaccctacaagaggccaagtcatcccctgacacccaggacctctattgtttgaacgagagctcaaagaacattccgctggcaaatttgcagattcccaattgtgggctgccttccgccaacctggccgctcccaacttgaccgttgaggaaggcaaatcgatcacgctgtcatgttcagtggccggtgatccagtcccgaatatgtactgggatgttgggaacctagttagtaagcatatgaacgagacctctcacacccaggggagcctacggataacaaacatctcctcagatgactccgggaaacagatctcatgtgtggccgagaatctggtgggggaggaccaagattccgtgaatctaacagtgcactttgctcccacgataacctttctggaaagtcctaccagtgaccatcactggtgtatccctttcactgttaaaggtaaccctaagcccgctctacagtggttttacaatggggctattctgaatgagtccaagtatatatgtaccaagattcatgttactaatcacactgagtatcacggatgtctgcaattagataatccaacacatatgaataacggtgattacactcttatagctaaaaacgaatacggcaaggacgagaagcagatcagcgctcacttcatgggctggcctggtatcgacgacggggcaaacccaaattaccccgacgtgatctatgaggactatggcacagcagctaacgatattggtgatactacaaaccggagcaacgagataccctctacagatgtcacagacaagaccgggagggagcacctgtccgtgtatgcagtcgtcgtgatagcctcagttgttggtttctgtctgctcgtgatgttgtttctcctgaagctcgctaggcactcgaaattcggcatgaagggcccagcatcagttatttccaatgatgatgattcagcatcacccttgcaccacatatccaatggaagcaacaccccttcatcaagcgagggaggtccagatgccgtaatcataggtatgacaaagatcccagtgatcgaaaacccccagtacttcgggattactaacagccaattgaagcccgacacattcgtgcagcatatcaaacggcacaacatcgtgctgaagagggaactcggggagggagcgtttggtaaggtcttcctcgccgagtgttataacttgtgtcctgagcaagacaagatcctagtcgctgtgaagacgctaaaagatgccagcgataatgctagaaaagacttccaccgagaggctgagctgttgaccaacctgcagcatgaacatatcgtgaaattctacggcgtgtgtgtcgaaggggatcccctaattatggtcttcgagtatatgaaacatggcgatctgaataaattccttcgggctcacggacctgatgccgtgcttatggcagaaggaaacccacccacagagttgacccaaagtcagatgctgcacatcgcacaacaaattgctgcaggcatggtctacctggcgtcccaacacttcgtgcacagggatctcgccacccggaactgcttggtaggcgagaacctgctggtgaaaatcggtgactttggtatgagtcgagacgtatacagtacagactactacagagtgggaggccacactatgcttcccattagatggatgcctccagaatccatcatgtaccgcaaatttaccacagaatcagatgtatggagtctgggcgtggtcctgtgggagatttttacctacggaaagcagccctggtatcagctcagcaacaatgaggtgattgagtgcatcactcaggggcgagtcttgcaacggccacgtacatgtccccaggaagtgtatgaactgatgcttggctgctggcagcgtgagccacacatgaggaaaaacatcaaagggatacacacgctgcttcagaatttagccaaggccagcccagtctacctagacatactggggtag

SEQ ID NO: 232578 - DNA, 2517 bp, Artificial Sequence
  Description of Artificial Sequence: Synthetic coding sequence
atgtcgtcgtggattcgctggcatggtcccgctatggctcgcctctggggcttctgctggcttgtggtgggattttggcgagccgcatttgcatgtccaacatcctgtaaatgcagcgcttcgcgtatatggtgttccgacccgtcgcctggaatcgtggcattcccaagactggagccgaactcagtagaccctgagaacataacagagattttcatcgcaaatcagaaaaggctcgaaattatcaatgaagatgacgtcgaagcttatgttgggctcaggaacctgacgatagtggattcaggtctcaagttcgtggcccacaaggcattcctcaagaactcaaacctgcagcatatcaatttcactagaaataaactgacctcattgagtagaaaacacttcagacatctggatctcagtgaattgatcctcgtggggaaccccttcacttgctcctgcgatatcatgtggataaaaacactccaagaggctaagagttcaccagatacccaggatctgtattgtcttaatgagagtagcaaaaacatccccttggctaatctccaaatccctaactgcggattaccttccgccaacctagctgcccctaatctgactgtggaagaggggaagtcaattactttaagttgttctgtggcaggtgaccctgtgccaaacatgtattgggatgttggcaacctggtcagtaaacacatgaacgagacctctcacactcaaggttctctccgaatcactaacatctccagcgatgactcgggtaagcaaatttcctgtgttgctgaaaaccttgtcggcgaagaccaggacagcgtcaatctcacggtacactttgctccaacaatcacattcctggaatcccctacttcagaccatcactggtgtattccatttactgtgaagggaaaccccaaaccagcacttcagtggttctataacggcgcaattctgaacgaatccaagtatatctgcaccaagattcacgtgaccaaccatacggagtaccacggctgtctgcagttggacaatccaacgcatatgaataacggcgattacacactgatcgcaaaaaatgagtatgggaaggatgagaaacagatcagtgcccacttcatgggatggcccggaatcgacgacggcgctaatccaaattacccagacgttatctacgaggactatggaaccgcggctaacgatatcggtgataccaccaatcggagtaacgagatcccgtctactgacgtgaccgataaaaccgggcgtgagcacttgagtgtgtacgctgtggtcgtgatcgcatcggtggttggcttttgtttgctggttatgttattcctgctgaaactagcaagacattcaaaatttggcatgaaagatttttcctggtttgggttcggcaaggttaaatcacggcagggggtggggcctgcaagcgtgatctccaacgatgacgatagtgcttctccactgcaccacatttcaaacggatccaacaccccctcgtctagtgaaggcggacccgatgcggttatcatcggaatgaccaagatccccgtgatcgaaaatccacagtactttggaatcaccaattctcaattaaaacctgacacatttgtgcagcatattaagcggcacaatatcgtacttaaaagagaactgggcgagggcgctttcggcaaagtgttcctggcggagtgttacaacctgtgccctgagcaagacaagatactcgtagctgtgaaaaccctgaaagatgcatcagacaacgcccgaaaagattttcaccgcgaggctgagcttttgactaatctacagcacgagcacatcgtcaagttctatggagtgtgtgtcgagggggatcctctaattatggtgtttgaatatatgaagcatggggacttgaataaattcttacgggcacacggaccagacgccgttctgatggcagagggtaatccacctactgaactgactcagagtcagatgctgcatatcgcccaacagattgcggctggcatggtgtacctggcaagccaacactttgtgcaccgagatctcgcaaccaggaattgtcttgtgggagagaatctgctggtcaagatcggcgacttcggtatgagccgcgacgtttattccacagactactatcgagttgggggacacacgatgctgcccatcaggtggatgcctccagagtccatcatgtatcggaagtttacgacagaaagtgacgtgtggtcactgggcgtggtgctatgggaaattttcacatatggaaaacagccctggtaccagctcagtaataatgaggtgattgagtgtatcactcaggggagagtcttgcagagaccacgcacctgcccacaggaagtgtacgagttaatgttaggttgctggcagagggagccacatatgcgaaaaaatatcaaaggaatccacacattattgcagaacctcgccaaggcttctccagtttatctggacatcctgggctag

SEQ ID NO: 232579 - DNA, 966 bp, Artificial Sequence
  Description of Artificial Sequence: Synthetic coding sequence
atgtggataaaaactctccaagaggctaaatcctccccagatacccaggacctgtactgtctgaatgagtctagtaagaacatccccttggccaatttgcaaattcccaattgtggtctgccatcagccaatctggctgccccaaatttgaccgtcgaagagggcaagtcgataaccttatcgtgctcagtggccggtgatcctgtcccaaatatgtattgggatgtgggcaacctggtgtctaagcacatgaatgagacgagccacactcagggatccctgagaatcactaacatcagctcagatgattcaggaaaacaaattagctgcgtggctgagaacctggtgggcgaggaccaagatagcgttaacctgactgtccacttcgctccaacaatcacatttttggaatcccctacttctgatcatcactggtgcatccccttcaccgtgaaaggcaaccctaagcctgctctgcaatggttctataatggggctattctgaacgaatcaaaatatatttgcactaagattcacgtgacaaaccacaccgagtaccacggatgtctgcagctagataatccaacccatatgaacaatggtgattataccctcatcgcaaagaatgaatatggaaaggacgagaagcagatcagtgcccacttcatgggctggcccggtatcgatgacggtgctaacccgaactatccagatgtcatttatgaagattatggtacagccgctaacgacattggggatactactaatcgctccaacgagatcccatctacagacgtaacagacaagaccgggagagaacaccttagtgtgtacgctgtagtggtgatcgccagcgtcgttggcttttgcctgctagtgatgttattcctcctgaagctagctaggcattccaaattcggcatgaaaggtttcgtcctgtttcacaaaattcctctagacggctag

SEQ ID NO: 232580 - DNA, 1434 bp, Artificial Sequence
  Description of Artificial Sequence: Synthetic coding sequence
atgagttcatggatcaggtggcatggtccagcaatggccagactgtggggtttttgctggctcgtggtagggttctggagagcagccttcgcgtgccccacatcttgcaaatgcagtgctagtcgcatctggtgtagcgacccatcacccggaatcgtagcattcccacgcttagagcccaattcggttgatccggaaaacatcaccgaaatttttattgctaatcagaaaagactggagattatcaacgaggatgatgtggaggcctacgttggtttgcggaacctgactatcgtagattcaggcctgaagtttgttgcacataaggcctttctcaagaattcaaacctgcagcatatcaacttcacaaggaataagcttacatcactctctaggaaacactttcgccatcttgatctgtctgaactcatcctggtgggcaaccctttcacttgtagctgcgacatcatgtggattaagactttgcaagaggcaaagagcagtcctgatacccaagacctgtactgtctgaacgagtcaagcaagaatatccctctagctaatcttcagattccaaactgtggcttgccttcagcaaacctggctgctcctaatcttacagtggaggaagggaagtctatcactctgagctgctctgtggctggggaccctgtgccaaacatgtactgggacgttggcaacctggtgagcaaacacatgaacgaaactagccacacgcaagggtctttgagaatcaccaacatttctagcgatgactctggcaaacagatctcatgcgtagcagaaaatcttgtgggcgaggaccaagactctgttaatctgaccgtgcatttcgcacccacgattacatttctggagagtcctacttcagatcaccattggtgtattccgttcaccgttaagggcaatccaaagccagcactccagtggttttacaatggagccatcctgaacgagtccaagtacatatgtacgaagattcacgtcacaaatcacaccgaataccatgggtgtcttcaactcgataatcctactcatatgaacaacggcgactatacactgattgctaaaaacgaatacggtaaggacgagaagcagatatccgctcatttcatgggatggcctggaatagacgatggcgctaatcctaattatccagacgttatctatgaagactacggaacagccgctaacgacatcggggacaccactaaccgttctaacgaaatcccctcaactgatgttactgacaagaccggtagagagcacctgagcgtgtacgcagttgtcgtgattgcgagcgttgtgggcttttgccttctggtgatgctgttcttgttgaaacttgccaggcacagcaaatttgggatgaagggatttgttctgtttcataaaatcccactagatgggtag

SEQ ID NO: 232581 - DNA, 1839 bp, Artificial Sequence
  Description of Artificial Sequence: Synthetic coding sequence
atggatgtatcactttgcccggctaagtgtagcttctggcgcatcttcctcctcggtagcgtgtggctcgattacgtggggagcgtcctagcctgcccagctaattgcgtctgctctaagactgagatcaactgtagaagaccggatgacggtaatctgttccccctcctggaggggcaggacagtggtaactctaatggaaacgcatctattaacattacagatataagcagaaacataactagtatccacatcgaaaattggagaagcctgcatactcttaacgccgtcgatatggagctctacaccggcctccaaaagctcaccataaagaattccgggttgagaagcatccagcctcgggcattcgctaagaatcctcaccttcgctacatcaatttgtcgagcaatcgcctgacaaccctgagctggcagctgttccagacccttagcttgagagaattgcagcttgaacaaaattttttcaactgctcatgcgatatccgctggatgcagttatggcaggaacaaggagaagccaaactgaactcacagaacttgtactgtatcaacgcagacggctcccagctaccattgtttcggatgaacatcagtcagtgtgatctccccgaaatctccgtctcccacgtgaatctgacagtcagggagggcgacaacgctgtgatcacatgcaatggctctggatccccactgcccgatgtggattggatcgttaccggtctgcagtccattaacacgcaccagacaaacctcaactggaccaacgtgcatgcaataaacctcacactggtgaatgttacctctgaggacaatggctttaccctgacttgcatcgcagaaaacgttgtagggatgtctaacgcttcagtggctcttaccgtctactacccgccacgcgtggtttccctggaggaacctgagctaagactggaacactgtatagaatttgtagtgcgagggaatcccccacccactttgcattggttgcacaatggccagcctctcagagagtcgaaaataatccatgtcgaatactaccaggaaggagaaatttccgaaggatgtctgctgttcaataaacccacccactataacaacggtaattacacactgatcgccaaaaatccgctgggcactgccaaccaaacaatcaatggccacttcttaaaggagccgttccctgaaagcactgacaattttattctgttcgacgaggtgagtcccacccccccaataaccgtcacacataagcccgaagaggatacgttcggagtaagtatcgcagtgggcctcgccgcttttgcctgcgtactgttagtggtgctgtttgtgatgattaacaagtacgggagaagatccaaattcggcatgaaaggtccagtagccgtgattagcggggaagaggactcggcctctccactgcaccacattaaccatgggataaccacccctagctcactcgatgcaggacctgatacagttgtgatcggcatgacaagaataccggtcatcgagaatcctcagtactttcgacaagggcataactgtcataaacccgacacctgggtcttcagtaacatcgacaaccacggcattctgaatcttaaagacaacagagaccaccttgttccatccacacattacatatacgaagagcctgaagttcagtcaggtgaagtctcctaccctcgctcccacggatttagagagataatgttgaatcccataagcctgcccggacattccaagcccttgaaccatggcatctatgttgaagacgttaacgtgtattttagcaagggcagacacggattttag

SEQ ID NO: 232582 - DNA, 414 bp, Artificial Sequence
  Description of Artificial Sequence: Synthetic coding sequence
atgacaaggattccggtgattgagaatccgcagtactttcggcaagggcacaactgtcataagccagatacttacgtgcagcatataaaacgaagagatatcgtgcttaaaagggagcttggcgagggggcattcgggaaggtgttcttggcagagtgctacaacttgagtcccacaaaggacaagatgctggtggccgtaaaggccctgaaagatccgaccttggctgccaggaaggatttccagagggaagccgaactcctcaccaacttgcaacacgaacacatcgtcaaattctatggggtctgcggcgatggtgacccccttatcatggtttttgagtacatgaaacatggtgacctcaacaagttccttagctcgattagttctcctaaatcccatcagcaggggtag

SEQ ID NO: 232583 - DNA, 2478 bp, Artificial Sequence
  Description of Artificial Sequence: Synthetic coding sequence
atggatgtatcgctctgtcctgcaaagtgcagcttttggaggattttcctgttgggctcggtgtggctggattatgtaggctccgttctggcttgccccgcaaattgcgtatgctccaagaccgaaattaattgtcggaggccagacgacggcaacttgttccccctcctggaaggccaggacagcgggaatagtaatgggaatgcttccatcaacattacagatatctctagaaacataacctcaatccacattgaaaactggagaagcttgcacacactgaatgcggtcgatatggaactgtatactggtcttcagaagttaacaataaagaattccggtctccgctccatccagcccagggcatttgcaaaaaaccctcaccttcgctatataaatctgtcatccaacaggctgactaccctaagctggcagctgtttcagacactgtccctacgagagctgcagctggagcagaattttttcaactgttcttgtgatatccggtggatgcaactctggcaagagcaaggagaagccaagttgaacagtcagaacctgtactgtataaatgccgacggctcccaattacccctttttcgtatgaacatttcccagtgtgatcttcccgagatttcggtgtctcatgttaacctgaccgttcgggaaggcgataacgcagtcattacctgcaatggcagcggctccccactgcccgatgttgactggatcgtgacaggtctgcaatcaatcaatacgcaccaaacaaatttgaattggactaacgtgcacgctatcaatctgaccttggtcaatgtgacatctgaggacaacggttttacccttacctgcatagccgagaatgttgtggggatgagcaacgcaagcgtggcattgaccgtgtactacccccctcgcgtcgtcagcctcgaggaacccgagctgcggttggagcactgcattgaattcgtggtcaggggtaatccccctccaacattgcactggctgcacaacggccagcccctgcgggagagcaaaataattcatgtcgaatactaccaagaaggagagatctcagaaggatgtctgctgttcaataagcctacccactacaataacggaaactacaccctcatcgcaaagaatccattgggcacagccaaccagactatcaatggccatttcctaaaagagccgtttcccgagagtactgataatttcattctctttgacgaggtgtcccctactcctccaattaccgtgacacataagcccgaggaagataccttcggcgtttccatcgccgtaggtctggctgcctttgcctgtgtgcttctggttgttctctttgtgatgatcaacaagtacggcagaaggtctaagttcggaatgaaaggtccagtggcagtaattagtggagaggaggacagcgctagccctttgcatcacatcaatcatggcatcaccaccccgagctcacttgacgccggacctgatacagttgtgattggaatgacccgcattcctgtgattgagaacccccagtattttagacagggacacaattgtcacaaaccagacacctacgtgcagcacataaagcggcgtgacattgtgctgaagagagaactgggtgaaggcgcattcggcaaggtgttcttggcagagtgctacaatctgagccctacaaaggataaaatgttggtagcagttaaagcgttgaaggatcccacgttagctgctagaaaggactttcagcgggaagcagagcttctcactaatctgcagcacgagcacatagtcaaattttatggggtttgtggagatggggacccattaattatggtgttcgagtatatgaaacatggcgacctgaataaattcttgcgggcacatggacccgatgccatgatactggtggatgggcagcctaggcaggccaagggcgagctggggctgagccagatgctgcacatcgcatcccagatcgctagtgggatggtttaccttgcgagccagcatttcgtgcatagagacctggctacaagaaattgtctcgtaggagcaaatctgctggtgaagatcggggatttcggaatgagcagggacgtgtatagcacagactattaccgggttggcggacacaccatgcttcctatccgatggatgcctccggaatctatcatgtacaggaagtttactacggaatccgatgtatggtcttttggggtgatcttatgggaaatcttcacctatggcaagcagccctggttccagctttcaaacactgaagtcatcgagtgtatcacacagggacgggtcctcgaaagacccagggtctgccccaaggaagtttatgacgttatgctcgggtgctggcagcgcgaaccgcagcagcgcctcaatattaaggagatatacaaaattcttcacgccctgggaaaggctaccccaatctacctggatatcctgggctag

SEQ ID NO: 232584 - DNA, 2496 bp, Artificial Sequence
  Description of Artificial Sequence: Synthetic coding sequence
atggatgtgtctctatgccccgctaagtgctctttttggaggatttttctcctgggaagcgtctggctcgactatgtggggagcgtcctggcatgtcctgccaattgtgtgtgttccaagaccgagatcaactgtcgacgacccgacgacggaaatctcttccccttgctggaggggcaggacagcggtaactcaaacggtaacgctagcatcaacataactgacatttcgaggaatatcactagtatccatatcgaaaactggcgatccctgcacacgctgaatgctgtggatatggaactatatactggcctccagaagctcacaatcaagaattcaggcctgagatccatccagcctcgggcattcgctaagaatccacacctgcgttacatcaatcttagtagtaaccggttaactacactttcttggcagctgttccagaccctgtccctccgagaactgcaactggaacagaactttttcaactgttcttgtgatattagatggatgcagctgtggcaggaacaaggggaagccaaattgaacagccagaacctatattgtataaacgccgacggctcgcagctgcccttatttcgaatgaatatcagccaatgcgacttgcctgagataagtgtgagtcacgtaaatctgaccgtccgcgagggcgataacgcagtcataacctgcaacggctccggttcccctctgccagatgtcgattggatcgtgaccggcctgcaatctatcaatacacaccagactaatctcaactggacaaatgttcacgcaatcaatctgacgctcgtgaatgtgacaagcgaggataatgggtttacgctgacctgcattgccgaaaacgtcgttggcatgtccaatgcgtccgtcgccctgacggtgtactacccaccaagggtggtgagtctggaggaacccgagctcagattagaacattgcatcgagttcgtggtccgaggcaaccccccaccaactctgcactggttgcacaatggccagcccctgcgggagtctaagattatacatgtggagtattaccaggagggcgagatttctgaaggatgcttactctttaacaagcccacccattacaataatgggaactacaccttgatcgcaaaaaatcccctgggtaccgcgaatcagaccattaacggccattttctaaaggagccatttccagtcgacgaagttagccccactcccccaattaccgtcacccataagcctgaagaggatactttcggggtgtcaatagcggtgggactcgctgccttcgcttgcgttctgctcgtggtgctgttcgtgatgatcaataagtacgggagacggtccaagtttggcatgaaaggaccagtcgcggtcatctccggcgaggaagacagcgcctcaccgctgcaccacattaaccacgggattactactccaagttccttagatgcaggccctgatacagtcgtgattggaatgacccggatacctgttatcgaaaatcctcagtattttcgacagggccacaattgccacaaacctgacacatacgtgcagcacatcaagcggagggacatagtgctgaagagagaactgggggagggcgcattcggaaaggtgttccttgctgagtgttataacctgagcccaacgaaagataaaatgctcgtagcggtaaaggcacttaaggaccccactctggcagctcgcaaggatttccagcgagaggccgagcttctaacgaatctgcagcacgaacacatcgtgaagttttacggtgtgtgcggcgatggcgacccacttatcatggtgttcgagtatatgaaacatggtgatctaaacaaatttctgcgagcccacgggccagacgccatgatcctggtggacggccagccacgacaggctaaaggagagctgggattgagccagatgctacacatagctagtcaaatcgcaagtggcatggtctacttggcttcacagcactttgttcatagggatttggccactaggaactgcctggtcggtgcgaacctgctggtcaaaattggcgattttggcatgtcaagagacgtctatagtactgactactacaggctgtttaacccttctgggaacgatttctgtatctggtgtgaagtgggcggacatactatgctaccaatcagatggatgcccccagagagtatcatgtaccgcaagttcactactgagagtgacgtctggagtttcggggtgatcctctgggagatttttacttatgggaagcagccctggtttcagctttccaatacggaggtgattgagtgcattacacaaggccgtgtcctggagaggcccagggtgtgccctaaagaggtgtacgacgtgatgctgggttgctggcaaagggagccacagcagcgactgaatatcaaggagatatataagatcctccacgctctgggcaaagccacccctatctacctcgacatcctggggtag

SEQ ID NO: 232585 - DNA, 2520 bp, Artificial Sequence
  Description of Artificial Sequence: Synthetic coding sequence
atggacgtgagcttgtgtcccgctaaatgttctttttggcggatctttttgctggggtccgtgtggctcgattatgtcggatccgtgctggcttgccccgcaaattgtgtgtgcagcaaaaccgaaatcaattgtaggcgccctgatgacggcaacctgttcccccttctagaggggcaagacagtggtaattctaacggtaacgcatcgataaatatcactgacatatccaggaatattacgtcaattcatatcgagaactggaggagcctgcatacacttaacgccgttgatatggagctgtacactggcctacagaaattgacaattaagaacagcggactgcggtccattcaacccagagcctttgccaagaatccccatctccggtatatcaatctctctagcaaccggctgactactctatcgtggcagctcttccaaactctgagcctaagggagctgcagctcgaacagaatttctttaactgttcgtgtgatattcggtggatgcaactttggcaagaacagggagaggctaagcttaattctcaaaatctctattgtatcaatgccgatggcagtcaactgcccctctttcggatgaatatctctcagtgcgacctgcctgagattagcgtgagccacgtgaatctgactgtacgagaaggagacaacgctgtcatcacttgtaacggatccgggagccctctacccgatgtggactggatcgttaccggactgcagagtatcaatacccaccagaccaacctcaattggaccaatgttcacgccatcaatcttaccttagtgaatgtgacaagtgaggataacgggtttaccttaacctgcatcgccgaaaatgtcgtcggaatgtccaatgcatctgtggcactgacggtctactaccccccaagagtggtgtcccttgaggagcctgagttgcggctggagcactgtattgaattcgtggtgagggggaaccctccacctacactgcattggctgcacaatggacagcccctgagggagagtaaaattatccacgtggaatactaccaggaaggggaaattagcgaaggatgcctacttttcaataagccgactcattacaataacgggaactacacactcattgcgaagaatccattagggactgctaatcaaaccatcaatggccacttcttgaaggagcctttccctgagtccaccgacaattttattctgttcgacgaggtgtctccaacaccccctattacagtgacacataagcccgaagaagacaccttcggagtgtccatcgctgtcggcctggcagcgttcgcttgtgttctgttagttgtgctgttcgtgatgatcaataaatatggacggcgatccaaatttgggatgaagggccctgtggccgtgataagcggcgaagaagactcagcctctccgctgcaccatatcaaccacgggattactacgccgagcagcttggatgccggtcccgacacggtcgtgatcggtatgacccggatacctgtgattgagaacccccagtatttccgccagggtcacaactgtcacaagcccgatacatacgtgcagcacattaaacgacgggacattgtgctaaagcgcgagcttggggagggcgcatttggcaaggtcttcttggccgaatgttacaacttgagcccgactaaagataaaatgctggttgctgttaaggctctgaaggatcccacacttgccgctaggaaagactttcagcgcgaggcagagctgctcacaaatctgcagcacgagcacatcgtgaagttttatggtgtctgcggggacggagatcctctgataatggtgtttgaatacatgaagcacggcgatttaaataagtttttgcgagctcacggccctgatgccatgatcctggtggacggccagcccagacaggcaaagggcgagttgggcctctcgcaaatgttgcatatcgcttcacagatcgcctctgggatggtttatctggcttctcaacacttcgtccatcgagacctcgcaacccggaattgcctcgtaggcgctaacctgttggtaaaaattggtgattttgggatgagtcgtgatgtgtactctaccgattactaccggctgtttaacccttccggcaacgacttctgtatctggtgtgaggtggggggtcacacaatgttaccaataaggtggatgcctcctgagtctatcatgtacagaaagttcacgaccgagtctgatgtatggagtttcggagttatcttgtgggagatattcacttatggcaaacagccttggttccaactgtccaacactgaggtcatagaatgcatcacacagggcagagttctagagagacctcgggtgtgcccaaaagaggtgtacgatgttatgctaggctgctggcagagagagccacaacagcggttgaatattaaagaaatctacaaaatcctgcacgctttgggaaaagctacccctatctatctggatatactgggctag

SEQ ID NO: 232586 - DNA, 2477 bp, Artificial Sequence
  Description of Artificial Sequence: Synthetic coding sequence
atggatgtttccctctgcccagccaagtgcagtttctggaggatcttcctgctgggatcagtatggttggattacgtggggagcgtcctggcatgtcctgcaaactgtgtttgctccaagacggaaatcaactgcaggcgacctgatgacggtaatctctttcctcttcttgaggggcaagacagcggcaatagtaatggaaacgcctccataaatattaccgacatttccaggaatatcacttccatccatattgagaattggagatccttgcatacactgaatgcagtggatatggaactgtatactggcctacagaaattgacgattaaaaattccgggcttcggtccatccagccgagagcttttgccaagaatccacacctgcgatatatcaacctttctagcaaccgtctaaccacactgtcttggcagctgttccagaccctctccctgcgcgaattgcagctggagcagaatttctttaactgcagctgtgatatccgctggatgcagctgtggcaggagcaaggcgaggcaaagctgaatagtcaaaacctgtactgcataaacgcggatggtagtcagctgcccttgtttcgaatgaatattagtcagtgtgaccttccggaaatcagcgtgagccatgtcaacctaaccgtgcgtgagggcgacaacgctgtaattacgtgcaatggcagtggaagcccgctccccgatgttgactggatcgtaactggcctccagtctattaacacgcatcagactaacctcaactggaccaatgtgcatgcgatcaatttaactctggtgaacgtcacgtctgaagacaacgggtttacattaacgtgcatagcagagaacgttgtcgggatgtctaacgcgtccgtcgcgctgacagtgtattatcctccccgtgtggtgtctctggaggaaccagagctacggttggagcactgtattgagttcgtggtgcggggaaacccccctccaacactccattggctgcataatggtcaaccccttagagaaagcaaaataatccacgttgaatactaccaggagggcgaaatctctgaggggtgcttgttgttcaacaaacccacacactacaataatggcaactacacgctgatcgctaagaacccactcgggaccgctaatcagactataaatggacatttccttaaggaacccttcccggagtctactgataacttcatcctattcgacgaggtgagtcccacccccccaatcaccgtgactcacaagccagaggaggatacctttggggtttcaatcgcagtgggcctggcggctttcgcatgtgttctgctggttgttctgttcgtcatgatcaacaagtatggaagacgcagcaagttcgggatgaagggtcccgtcgcggtgatcagcggtgaagaggactccgcttcccctttgcatcatatcaatcacggaattacgacaccaagcagtctcgacgctggtcccgacaccgtcgtgataggcatgacccgaattcctgtgatagaaaacccacagtatttccgccagggtcacaattgtcacaagcccgacacttacgtgcagcatataaaacgcagagacatcgtgttgaaaagagagttaggtgagggcgcattcggaaaagtcttcctggccgagtgctataatctctctccaacaaaagacaagatgcttgtcgctgtgaaagcccttaaggaccctactctggccgcacgcaaggattttcaacgtgaggccgaactcctgactaacctgcagcacgaacacatagtcaaattctatggggtttgcggagatggggatcctcttataatggtgttcgagtatatgaaacatggtgatttaaataagttcctgcgggcacatggacccgatgccatgattctcgttgacgggcagccccgacaggctaagggcgagttgggtcttagccagatgttgcacattgcctcccagatcgcctcgggaatggtttatcttgcctcacagcacttcgtgcatagggatctggcaactcgtaactgcttggtcggtgcaaatctccttgtaaagataggcgactttgggatgagtcgggatgtctattccactgactattaccgggtggggggacacactatgctccccatcagatggatgcctccagaatccatcatgtaccgaaagtttacaaccgagagcgacgtgtggtcctttggcgtcatcctttgggaaatattcacttacgggaagcagccctggttccagctgtcgaataccgaggtgatcgagtgtatcacgcagggacgcgtactggaacggccaagagtgtgtcccaaagaggtttacgacgtgatgctcggatgctggcagcgcgaacctcagcaacgcctgaacatcaaagaaatttataagatcctccatgccctggggaaagctacgccaatttatctcgacattttaggata

SEQ ID NO: 232587 - DNA, 1839 bp, Artificial Sequence
  Description of Artificial Sequence: Synthetic coding sequence
atggacgtctccttgtgtcctgcaaagtgctcgttctggcgaatctttctactcgggtcagtgtggctggactacgtaggctctgtgctggcgtgccctgctaactgcgtgtgcagcaagacagagatcaattgccgccgacccgacgacgggaatctgttccccctgctcgagggtcaggattctggtaatagcaatggtaacgcatctatcaacattacagacattagtcggaatattacgagcattcatatcgagaattggagatccttacatactctcaacgcggtggacatggagctgtacaccgggctgcagaaattgacaatcaaaaatagcggcctgagaagtattcagcctagagcctttgctaagaaccctcacctcagatacataaacctttcctccaaccgtctgaccacattgagctggcagctgtttcagactctcagccttagagaattacaactggaacagaatttcttcaactgctcctgcgatattcggtggatgcagctctggcaggagcaaggcgaagctaaactgaacagccaaaacctatattgtatcaatgctgacgggagccagttgcctctttttcgcatgaatatttctcagtgtgaccttcccgaaatcagcgtctctcatgttaacctgaccgtcagggagggagataacgctgtaattacatgtaatgggtctgggagcccactgcctgacgtagactggatcgttaccgggctccagtccatcaatactcatcaaactaacctgaattggaccaacgttcatgcgatcaatttaacattggtcaacgtcacttcggaggataatggttttaccctcacatgcatcgccgagaatgtggtcggtatgagcaacgccagcgtagctctgactgtctactacccacctagagttgtttctctcgaggagcctgagctaagattggaacattgcatcgagttcgtcgtgcggggtaacccacctcccactttgcattggctgcacaatgggcagcccttgcgggaatcaaagattattcacgtggaatattaccaggagggagagattagcgaggggtgtctgctttttaataagccaacacattataataacggcaactacacactgatagctaaaaacccattggggactgccaatcagactatcaacggacattttttaaaggagccgttccccgagtcaactgacaactttatcctctttgatgaagtaagccccacaccccctatcacagtgacacataaacctgaggaagatacgttcggggtcagcattgccgttggactcgcggctttcgcctgcgtgctgttagtggtgttgtttgttatgatcaataagtacggtcgaagaagtaagtttggcatgaaggggcctgtagcagtcatttctggcgaggaagacagtgcctctcctttgcatcacatcaaccacggaataacaacgccaagctccctggatgcaggtcctgacacagtggttatcgggatgacccgcattcctgtaatagaaaacccacagtactttcgtcaaggtcacaattgtcacaagccagatacatgggtgttttccaacattgataaccatggcatccttaatcttaaagacaatcgggatcaccttgttccttcaacccattacatttatgaggagccagaagtgcagtccggagaggtcagctaccccagatctcatggctttagggagataatgcttaaccccatttcacttccagggcacagtaagcccctgaaccacggaatctacgtcgaagatgttaatgtgtacttcagcaaaggccgtcacggcttttag

SEQ ID NO: 232588 - DNA, 1854 bp, Artificial Sequence
  Description of Artificial Sequence: Synthetic coding sequence
atggaactgtacacaggtctgcagaaactcacgataaagaactccgggctgcgatcgatccagccgagagctttcgcaaagaacccacatctgaggtatatcaacctatcctccaatcgccttaccacactttcatggcagctcttccagacactgagtctgagagagctacaattagagcagaattttttcaattgttcatgtgacatccgctggatgcaactctggcaagagcagggggaagccaagctcaactcgcaaaatctttactgtatcaatgctgacggcagccagctgcctctcttcagaatgaacatcagccagtgtgaccttcccgagatttcggtctcacacgttaacttaacagttcgggaaggcgataatgcagtcataacctgtaacgggtctggctctcccctgcccgatgtggactggatcgtcacgggcctccagagtatcaatacacaccagaccaacctcaattggacaaatgtgcacgccattaatcttacgttagtcaacgttacaagtgaagacaatggttttaccctgacctgtatcgctgaaaacgtggtgggaatgtccaatgcctcggtggctctgaccgtttattaccctcctagggtggttagtctggaagagccagagctgcgcctcgagcactgtattgagtttgtcgttcgaggcaaccctcctccaacactgcactggttgcacaacggccaacctctgcgagaaagcaagatcatccacgttgaatattatcaagagggggagatctccgaaggatgtctgctttttaacaagcccactcactataataatggcaactataccctcatcgccaaaaaccctctgggaaccgccaaccagacaatcaatggccactttctaaaggaaccttttccagagtctactgacaacttcattttattcgatgaggtttctccgactccaccgattaccgtgacccacaaaccggaggaagatacttttggagtcagcatcgcagtgggcctagcggctttcgcttgtgtcctgctggttgtgctgttcgtcatgattaacaaatatgggagaaggagtaagtttggaatgaaggggcctgtggccgtgatctctggggaagaagattccgctagcccgcttcatcatattaatcacggcataactacacctagctccctggatgctggccctgacactgtcgtaattggaatgactagaatccccgttattgaaaacccacagtatttccgccaggggcataactgtcataagcccgatacctatgtgcagcatatcaagagaagggacatcgtccttaaacgggagctgggagagggggcttttggcaaagtgtttcttgctgagtgctataatctgagcccaaccaaagataagatgctggttgcagtgaaagcgttgaaggaccctacgctggcagctcggaaagacttccagcgcgaggctgagcttcttactaatctgcagcatgaacacattgtgaagttttatggcgtgtgcggcgacggagaccctcttattatggttttcgagtacatgaagcatggcgaccttaacaagttcctgcgggcacacggaccagacgccatgattctggtagatgggcagccgcgtcaggctaagggagagcttggcttgagccaaatgcttcacatcgcctctcagattgctagcggaatggtataccttgcttcacaacactttgtacacagggatctcgccactcgtaactgcctggtaggggctaatttgttagttaagatcggcgattttggcatgtcccgagacgtgtattccactgactattacagagtcgttcaagcctag

SEQ ID NO: 232589 - DNA, 774 bp, Artificial Sequence
  Description of Artificial Sequence: Synthetic coding sequence
atgagcattctcttctacgtgattttcctggcctacttgcggggaatacaaggcaataacatggaccagcggagtctcccggaggattccctgaatagccttattatcaagcttatccaggctgatattctaaagaataaactttcaaagcagatggtggacgtcaaagaaaactaccaatccactctgcccaaagctgaagcaccacgcgaacccgaaagggggggaccggcaaagagtgcattccagccggtgattgcaatggataccgagctgcttcgccagcaacgcaggtacaactcacccagggtgctcctgagcgattcaactcctctggagccaccaccgctctatctgatggaagactacgttggatctccagtagtggccaacaggacttcaaggcggaagaggtacgccgaacataaatcacataggggggagtacagcgtgtgtgactccgagtcattgtgggttaccgacaaaagcagcgccatcgacataagaggacatcaggtgactgtgttaggggaaattaagactggcaattccccagtaaagcaatacttctatgagaccaggtgcaaagaggccaggccggtgaagaatggttgtagaggtatcgatgacaaacactggaattcccaatgcaagacatcccagacatacgttagggccctgacctcggagaacaataagctggtaggctggcgctggatacgtatcgatacgtcctgcgtgtgtgctctgagccgtaaaattgggagaacttag

SEQ ID NO: 232590 - DNA, 813 bp, Artificial Sequence
  Description of Artificial Sequence: Synthetic coding sequence
atggttacatttgcgaccatcctacaggtcaacaaggtgatgtctatcctgttttatgtcatctttctggcctacttgcgcggaatacaggggaacaatatggaccagaggagtctgccagaagactccttaaattctctcataatcaaactgatacaggccgatattcttaaaaacaagctgagtaagcagatggtcgacgtcaaagagaactatcagtccaccttgccaaaggcggaggcacccagagaaccagagagaggagggcctgcaaaatctgccttccagcctgtgatcgcaatggacacagaattgttgaggcaacagagaagatataatagtcccagggtgctcctgtccgatagcaccccactcgagccccctccactctatttaatggaggactacgtgggctcgcctgtggtagctaatcgaacttcaaggaggaagcggtatgccgaacacaagtctcatcggggagagtattccgtctgtgacagtgagtccctgtgggtgaccgataagagtagtgctattgacattcggggtcaccaggtgaccgtactgggagaaattaagaccggcaactcccccgtcaagcaatacttttatgaaacccggtgtaaagaggcgcgtccagtgaaaaacggatgccggggtatcgacgataagcattggaatagccagtgcaaaacatcacaaacatacgttcgcgcactcacctccgagaacaacaagctagtcgggtggaggtggatcagaatagacaccagttgtgtctgcgctctgtcccgaaaaattggcagaacttag

SEQ ID NO: 232591 - DNA, 633 bp, Artificial Sequence
  Description of Artificial Sequence: Synthetic coding sequence
atgttaccattgcccagttgttcacttcccattctcctgctctttctgctgccatcggtaccgatcgaaagccagcctcccccttcaactctccccccatttctcgccccagagtgggatctcctgagcccacgggtggtcctttcgaggggggcaccagccggtccaccattgctcttcctactagaagctggagcctttcgggagagcgccggagcccctgctaacagatccaggaggggtgtctcagaaacagcacctgcgagcaggcgcggtgaattggccgtgtgcgacgccgtgtctgggtgggtgactgataggcgaaccgctgtggacctgagaggcagagaggtagaggtgctgggagaggtgcccgctgctggaggcagtcctctgaggcagtacttctttgagacaagatgcaaagccgacaatgcagaggaaggaggtcctggcgctggaggcggaggctgtcgaggggtagatagacggcactgggtctcagagtgcaaggccaaacaatcttacgtgagagccttaacagccgacgcacagggtagggtggggtggcgttggatccgcattgacactgcgtgcgtgtgcacgctgctctcacgtactggtcgtgcctag

SEQ ID NO: 232592 - DNA, 594 bp, Artificial Sequence
  Description of Artificial Sequence: Synthetic coding sequence
atgcaacgttggaaggccgcagccctggcatccgtgttatgctcttctgtgttaagtatatggatgtgtagagaggggctcttgctctctcaccgcctcggccctgccttggttccactacaccgacttccacggactcttgatgctaggattgcccgactggcacagtacagggcacttctccagggcgcacccgatgccatggagctacgtgaacttaccccctgggccggaagacctcccggacctcggaggcgggctgggccacggcgtaggagagcaagggcccgtctgggggctcgaccctgtgggctgcgcgagctggaagtgagagtgagcgagttgggcctgggttatgccagcgacgagaccgtgctctttagatattgtgccggagcttgcgaggccgcagctcgggtgtacgatctggggctgaggcgcctacggcagcgaagacggttacgccgagagcgggttagagcccagccatgctgtaggcccaccgcatatgaggacgaagtgagtttcctggatgcccattccagataccacacggtgcacgaactcagcgctcgagagtgcgcctgtgtctag

SEQ ID NO: 232593 - DNA, 1323 bp, Artificial Sequence
  Description of Artificial Sequence: Synthetic coding sequence
atgtcctcttgccggggacagaaggtggcgggtggactgcgcgtcgtgagccctttccccctctgtcagcctgccggtgaaccctctcagggcaagatgcggtctagctgcgtgctgctgaccgcactagtcgcgctggccgcttactatgtgtacatccctttgccagggagtgtgtcagacccctggaagctgatgctcctggatgccacctttcgcggagcccagcaggtgtccaacctcatccattacctggggctcagtcatcacctcctggccctgaattttattatcgtatccttcggcaagaaaagcgcatggtcttcagcccaggtgaaggttaccgatacggatttcgacggcgttgaagtcagggtgtttgaaggacctccaaagcctgaagaacctcttaaacggtcggtcgtttacatacacggcggtggttgggcactcgcctccgctaagatccgctactatgacgagctgtgtactgccatggctgaagagctgaacgctgtcatcgtaagcattgaataccggctcgtgccaaaagtatactttccagaacagattcacgatgtggtacgtgccactaaatactttctgaagcccgaggtcctgcagaagtacatggtggacccgggaaggatttgtatcagtggcgactccgcaggagggaacttagcagccgctcttggacaacagtttacgcaggatgcgagtctcaagaacaagctgaagttgcaggccctcatctaccccgtcctgcaggctctggatttcaacaccccatcctatcagcagaacgtgaacacacctatcctccccagatacgtgatggtgaaatattgggtggactacttcaagggcaattacgactttgttcaggccatgatcgttaataaccataccagcctggacgtggaggaagctgctgccgtgcgtgcccgactgaattggacatccctgttgccagcaagtttcactaaaaactacaaacctgtggtacagaccacggggaatgccagaatagtgcaggagcttccacagttattggacgcaagatctgctccactgattgctgaccaagcggttttacaattattgcccaagacatatatcttaacatgcgagcatgacgtacttcgagacgatggcataatgtacgccaagcggctggaatctgcaggcgtggaagttacgctggaccattttgaggacggcttccatggttgtatgattttcacttcctggcccacaaacttttcagtgggcataagaactcggaattcctatattaagtggctcgatcagaatctctag

SEQ ID NO: 232594 - DNA, 1227 bp, Artificial Sequence
  Description of Artificial Sequence: Synthetic coding sequence
atgcggagcagctgcgtgctactcaccgccctcgttgcgctcgccgcatactacgtgtacattccattacccggttccgtgtctgacccctggaaactgatgcttttagacgcaacctttcgtggggctcagcaggtgtccaacttgatccactatctgggcctatcgcatcacttgctcgctttgaattttattattgtcagctttggcaaaaagtccgcctggagctcagcccaagtcaaggttactgacacagactttgacggtgtcgaagtgcgcgttttcgagggtccgccaaagcctgaagagccactgaaacgctccgttgtgtatattcatggtggcggatgggcgttagcaagcgccaaaatcaggtattatgatgagctgtgcaccgccatggcggaggagctcaacgcagtgatcgtcagtatcgagtatagactggtcccaaaggtgtactttcccgagcagatacatgacgttgtacgtgcaaccaagtatttcctgaagccagaagtcctccagaaatacatggtggatcctggcaggatttgcatctcaggggatagcgcgggagggaacctggccgcagccctcgggcaacagttcacacaggacgcttccctcaagaacaagctcaaactgcaggcacttatctacccagtgctgcaagctcttgactttaatacccctagctaccaacagaatgtgaacactcctatcttgcccagatatgtgatggtgaaatattgggtagattactttaagggcaactatgacttcgtccaagccatgatagtaaacaaccacacatccctggatgtagaggaggcagccgcagtccgcgcacggctgaattggacctctctgctgccagcatcattcaccaagaactataagcccgtggtgcagacaacagggaatgccaggattgtgcaggagttgccgcaactgttggacgccaggtccgcgccattaatcgcagaccaagccgtcctccagttattgccgaaaacgtacattcttacttgtgagcacgacgtgttgagggacgacggtatcatgtacgccaaacgactggaatcggccggtgtcgaggtgacactcgatcatttcgaggatggctttcacggttgcatgattttcacatcttggcccactaattttagtgtgggcattagaactagaaatagttatattaagtggcttgaccagaacctgtag

SEQ ID NO: 232595 - DNA, 1347 bp, Artificial Sequence
  Description of Artificial Sequence: Synthetic coding sequence
atgtcctcgtgtagagggcaaaaggtggcgggtggtctgcgggtggtgagtccttttccgttgtgccagcctgccggagagccttcacagggtaaaatgagatcttcttgcgtcctcctaacggcgcttgtcgctttggcagcatactatgtatacattcctctccctggctcagtctccgatccctggaagttgatgctcctggacgcaacctttcgcggtgcacagcaggtgtctaacctcatacattacctcggcttatctcaccacctcctggcgttgaacttcattatcgtgtctttcggcaagaagtctgcatggtctagcgcccaggttaaagtcaccgacacagacttcgatggcgttgaggttagggtctttgaaggcccaccaaagcctgaggaaccactaaaacgttccgtggtctacattcatggcggaggatgggccctcgcttccgcctccgcaagttggtcacctagcgatgaaattcgctattacgacgaactgtgcaccgctatggccgaagagctgaatgcagtcatagtgtctattgagtaccgactggtgccaaaagtctattttcccgagcagatacatgacgtagttagagcaacaaagtatttcctaaagccagaggtgctccagaagtacatggtcgatcccggaagaatttgcatctctggtgatagtgctggaggcaatctcgccgcagccttaggacaacagttcacgcaggatgccagtctgaaaaacaaactcaagctgcaagcactcatctatccggttcttcaagcccttgactttaacacaccaagttaccaacaaaacgtcaacactccaatcctgccaaggtacgtgatggtgaagtactgggttgattacttcaagggaaactacgatttcgtgcaagcaatgatcgtcaataatcacacaagtttggacgtggaagaagcagcagccgtgcgggctcgcctgaattggacttcgctgctcccagcgagttttacgaaaaactacaagccagtagtgcaaaccaccggtaacgccaggatcgtccaggagcttccacagttgctggacgccagaagtgcaccacttatcgccgaccaggctgttttgcagttactgccaaagacctatatcctcacatgtgaacacgacgtgttgcgagacgacggcatcatgtatgcgaagaggcttgagagtgcgggtgtagaggtgaccctcgatcacttcgaagatggatttcatggctgtatgatctttacatcatggccaacgaatttcagcgtcggcatcagaaccagaaactcttacatcaaatggctggaccagaacctgtag

SEQ ID NO: 232596 - DNA, 828 bp, Artificial Sequence
  Description of Artificial Sequence: Synthetic coding sequence
atggccgaagaactgaacgcggtgatcgtcagcatcgagtaccgcctggtccctaaggtctacttccctgaacagatacatgatgttgttagggccaccaagtatttcctgaagcccgaggtgttacagaaatatatggtggatccgggaaggatttgcataagcggcgatagcgccggaggaaatcttgccgcagcactgggccagcagtttacgcaagatgcatctctaaaaaataagctcaaactgcaagcgctgatttaccccgtgctacaggcactggacttcaataccccatcgtaccagcaaaacgtgaacactcccatcctgcctcgctatgtgatggtgaaatactgggtggattatttcaaaggcaattatgattttgtccaggccatgatcgtcaacaaccatacctcactcgatgtcgaggaagcagctgcagtgcgcgcacggctcaattggacaagtctgttgccagcatcttttaccaagaattataaacctgtagtgcagacaactggaaatgcccgaatagtgcaggaactgcctcaactgctggatgctagatccgccccactaattgctgaccaggcagtgcttcagctactaccaaagacctatatacttacctgcgaacacgatgtgctgcgggatgatgggattatgtacgcaaaaaggctggaatctgctggtgtggaggtaaccctggatcattttgaggacggcttccacggctgcatgatcttcacctcatggccaacaaacttttctgtaggcataagaacacggaactcctacataaaatggctagatcagaacctgtag

SEQ ID NO: 232597 - DNA, 2754 bp, Artificial Sequence
  Description of Artificial Sequence: Synthetic coding sequence
atggcttttatcaggaaaaagcagcaggaacagcaattgcaactgtattcgaaggagcggttttcccttctactattgaacttggaggaatattatttcgagcagcaccgggctaatcatatcctgcacaaggggtcccaccacgaacggaaaatccgaggttccctcaaaatttgtagcaaatccgtgattttcgagcccgacagcatctcccagcctatcattaagatcccacttagagattgtatcaagattgggaaacacggcgagaatggggcaaatcgccactttaccaaggctaaatctggcggtatctcactgatctttagccaggtctactttattaaagagcacaacgtggtagctccttacaaaattgagagaggcaagatggaatacgtgttcgagttggacgtgcctggaaaggtagaagacgtggtcgagactcttctacagttgcaccgtgccagttgtctcgataagctgggggatcagacagctatgattacagccatactccagtccaggctagccagaacttcattcgacaaaaatcgattccagaatatatcggaaaaattgcatatggagtgtaaagcggagatggtcacacctctagtgaccaatcccggtcacgtatgcattaccgacactaatctgtacttccagccccttaatggctaccccaagcctgtggtccaaatcaccttacaagatgttcgcaggatttacaaaaggcggcacggcctcatgccgttagggctcgaagtcttctgcactgaagacgatctgtgctcggacatctatcttaaattctacgaacctcaggaccgcgatgatttgtacttttacatcgcgacctaccttgagcaccacgtcgcagagcacactgctgagtcctatatgttgcaatggcaacggggacacctgtcaaactatcagtacctgctgcaccttaataacctggctgaccgctcctgtaacgatctgtcccagtaccctgtgtttccctggatcatccatgactactcatcttctgaactcgacctttccaacccaggtacgtttcgtgacctgtccaaacccgttggcgcactcaacaaagaaaggttagagcgcctactgacccgttaccaggagatgcctgaaccaaagttcatgtacgggtcacactacagctctccaggatacgttcttttctacctggttcgaatcgcaccagagtacatgctttgtctgcagaacggacgattcgacaatgccgatcggatgttcaactccatagccgaaacgtggaagaactgcctggatggcgcaacggacttcaaggagctgattcccgagttctacggcgacgacgtcagctttctcgtgaactctctaaagttggatttgggaaaacgtcaagggggacagatggtggatgatgtggagttgcccccatgggcaagcagcccagaggattttctgcagaagtccaaggacgcactggaaagtaattacgtctctgagcacttgcacgagtggatcgacctcatctttggatacaaacagaaaggctcagatgccgtgggtgctcacaatgtgttccatcctttgacatatgagggcggtgtggatctcaactccattcaggatcctgacgaaaaggtggccatgttgactcagatactcgagttcggtcagactccgaagcagttgttcgtgactcctcaccccagacgaatcactcccaagttcaagtctctatctcagaccagcagttataacgcctcaatggcagactcccccggtgaagagagttttgaggacttgaccgaggagtctaagaccctagcttggaacaacatcacaaagttgcagttacacgagcactacaagatccacaaagaagcagtgacagggatcaccgtgtccaggaatggctccagcgttttcactactagccaggactccacccttaagatgttcagcaaagagtctaaaatgctgcaacgctctatttccttttctaacatggccttgagttcctgtctcttgttgcccggagacgcaaccgtaattacaagcagctgggacaataatgtgtatttttacagcatcgccttcggtcggaggcaagatacgctcatgggccacgatgatgctgtctctaagatatgttggcacgataataggctctacagtgcaagttgggactccaccgttaaggtatggagcggagtccccgctgagatgcccggaaccaagaggcatcactttgaccttttagccgagctggagcacgatgtaagcgtcgatactatctccctcaacgccgcatccaccctactggtgagcggaaccaaggaggggactgtaaacatctgggacctgaccacggcaactctgatgcaccagatcccatgccacagcggtattgtttgtgacactgcattctccccagattccaggcacgttctttctaccggtacggacggctgcctgaacgtcattgatgtacagactggcatgctgatttcctctatgactagtgatgaaccacagcgctgtttcgtatgggacgggaactccgtcttatctggaagtcagtcaggcgagttactggtgtgggatctgctcggcgctaagatttctgaacggattcagggtcacacgggcgcagtaacttgtatttggatgaacgaacagtgctcctccattatcacaggaggtgaagatcgccagattatcttttggaaactgcagtactag

SEQ ID NO: 232598 - DNA, 2847 bp, Artificial Sequence
  Description of Artificial Sequence: Synthetic coding sequence
atgacaggccaagcacgcttccatcgaggagccgaagcttgccgtgccatccgccagtgtaggtcccgacgccctcgggctgcacaccctgaagggcgagcgggaagcgggagagggagccggcacgcatcgcccggagtgcgacggggaggattttctctcctccttctcaacctcgaagagtattatttcgaacagcaccgcgctaaccacatcctccataaagggagccatcacgaaaggaaaatcaggggctccttaaagatatgttcaaagtcggtgatcttcgagccagacagcatcagccagcctatcatcaagataccgctccgggattgcatcaagatcgggaaacatggcgaaaatggtgcgaatagacactttacaaaggccaaatccggcggaatctcacttattttctcacaggtttattttatcaaagagcataacgtagtggcgccatacaagatcgagagaggcaagatggagtatgtgttcgagctggacgttccagggaaggttgaggacgtggtggagaccctgttacaattacaccgggcttcctgcctggacaagttgggagatcagacagcgatgatcacagctattctgcagagcaggctggccagaacaagcttcgacaagaatcgctttcagaacatcagtgagaaactgcacatggagtgcaaggcagagatggtgaccccactggtaaccaaccctggccatgtttgtatcaccgacactaatttgtattttcagcctctaaatggctacccaaaacctgtcgtgcaaattacgttacaggatgtgcggaggatctataaacgaaggcatggactgatgcctcttggtctggaggtgttttgcaccgaagacgacctctgttcggacatctacctgaaattctacgaaccacaggaccgggatgacctttatttttatatagctacttatcttgaacaccatgtagccgagcatacagccgagtcctatatgctgcagtggcagcggggtcacctgtccaattaccagtacctcctccacctgaacaaccttgccgatcgttcttgcaatgatttgtcccagtaccccgtatttccatggatcattcatgactacagctcttctgaattagatctgtctaatccgggaacgtttcgtgatctgtctaaaccagtcggagcattgaataaagagcgcctggagaggttgctgacacgctaccaggaaatgcccgaacccaagtttatgtacgggtctcactacagttcaccaggttacgtcctgttctatctggttagaatagctccagaatatatgctgtgtcttcagaacggtaggtttgataatgccgatagaatgttcaacagcatcgctgagacatggaagaattgtctggatggagctactgatttcaaggagctgatcccagagttctacggcgacgacgtgagcttcctcgtgaactcgcttaaactggacttggggaaacgccaaggaggtcagatggtcgatgatgtggagttgccaccatgggcgtctagccccgaggacttcttgcagaaatcaaaagatgcccttgaatccaactacgtgtctgagcacctgcacgaatggatcgatcttatcttcgggtacaaacaaaaggggagtgacgccgtgggagcccacaatgtctttcatccactgacctacgaaggaggcgtagacctgaattctattcaggatcccgatgagaaagtggcgatgctaactcagatcctggaattcgggcaaacccccaagcagctatttgtgaccccccatccacggaggataacccctaaatttaaaagtctttcccagacgagcagttacaatgcaagcatggccgattccccaggcgaggagtctttcgaagacctgactgaagaatctaagacactcgcttggaacaatattacgaagctccagctccacgagcactacaagattcataaggaagctgtaactgggattactgtgtcacggaatggctcctctgttttcacgacatcccaggattcaaccctgaaaatgtttagtaaggaaagtaagatgcttcagaggtcaatcagtttcagtaatatggccttgagtagctgcttgttgctacctggagatgccaccgtcatcacctcgtcctgggataacaatgtatatttttacagtattgccttcgggcgacggcaggacaccctgatggggcacgacgacgcggtctcaaaaatatgttggcatgataatcgcctgtactccgcctcttgggactctacggtcaaagtgtggtctggcgtgcccgcagagatgccgggaacaaagcgtcaccacttcgatctcctggctgagttagagcacgatgtttccgtggacaccatatccttaaacgccgcttcaacactgcttgtatccgggacaaaggaggggactgtgaatatctgggatctgacaacggccacactcatgcatcaaatcccttgccacagtggtattgtctgtgacactgcattctcccctgattctcgccatgtcctttccaccggaacagatggatgcctcaatgtaatcgacgtgcagaccggtatgcttatctctagtatgacatcagacgaaccgcagcggtgctttgtttgggacggaaactcagtgctctccgggagccagtccggcgagcttctagtgtgggatctactaggagcaaaaatttcagagaggattcaaggccatactggcgctgtcacgtgtatttggatgaatgaacagtgctccagcatcattacaggcggagaagataggcagatcatcttctggaagctgcagtactag

SEQ ID NO: 232599 - DNA, 1173 bp, Artificial Sequence
  Description of Artificial Sequence: Synthetic coding sequence
atgggagatacctttatacgacacatcgcactattaggcttcgagaagcggtttgttccatcgcaacattacgtctatatgtttctggtgaagtggcaggacctcagcgagaaagtagtgtaccggcgatttactgagatttacgagtttcacaaaacgctgaaagagatgttccccattgaagctggtgcgattaacccagagaacagaatcatcccgcacctcccagcccctaagtggtttgatggccagcgcgctgctgaaaacaggcaggggacactgaccgaatattgcggaacattaatgtccctgcctactaagatctcccgctgtcctcacttgttagatttctttaaggtaagaccagacgacttaaagcttccaaccgacaatcagactaagaaacccgagacatatctcatgccaaaagatggcaaatccacggccactgatatcaccgggcctattattttacagacatatcgagccattgctaattacgagaagacttccgggtcagagatggcgctctctaccggagatgtggtggaggtggtggagaagagtgaaagcggctggtggttttgtcagatgaaggccaagcgtggctggatacccgcatccttcctggagcccctggacagtccagacgagaccgaggaccccgaacccaactacgccggagaaccctatgttgctattaaggcatacaccgctgtggagggcgacgaagtgagtttgctggagggcgaagccgttgaagtgatacacaaactacttgatggatggtgggtgatcaggaaagatgatgtgaccggatacttcccctccatgtacctccaaaagtcaggccaggatgtgagtcaagctcaaaggcagattaagcgtggcgcaccccctcgacggtctagcattcgaaacgctcattcgattcatcagagaagtaggaagcgccttagccaggacgcttatagaaggaactcagtccggttcctgcaacaacgacgcagacaagctcgccctgggccacagtctcccggatcccctctggaagaggaacgccagacccagcgctccaaaccccaaccagcagtgcccccacggccatccgctgatctgattcttaaccggtgcagcgagagcacaaaacgaaaacttgcctcagccgtgtag

SEQ ID NO: 232600 - DNA, 444 bp, Artificial Sequence
  Description of Artificial Sequence: Synthetic coding sequence
atgaccaagaaacccgaaacctacttgatgccaaaagatggcaaaagtaccgccactgatatcaccggaccgatcattctgcagacgtatcgagcgatagcaaattatgagaaaacttccggcagcgagatggcactgtctaccggtgatgtggtagaggtggtggagaaatctgaaagcggacagacgtcacatttaacagggcttttgccccttgttcttcggaatccccagccccaagcgccatgtcaaggttctggctccttggcacctggccgaacccccgcactgcttggcgctctaaatgtcttgccaaccctttgggtggcattctgcctcagcgtgcaccctgtggtcgccgtgggtatatgcgcttggcaggctggcgctggtcatgtctgtgtgttttgtctcgacggctacggcactgtctgttctctctag

SEQ ID NO: 232601 - DNA, 759 bp, Artificial Sequence
  Description of Artificial Sequence: Synthetic coding sequence
atgggggatacttttataagacacattgcgcttctaggctttgagaagcggttcgtgcccagccagcactacgttcatgtccccggagaaatggccggtcctgtgggcgaaggcggactgccggcactccaccgggatcttagagtcccgtcaccaaagtggttcgacgggcagcgcgctgccgagaatcgccaggggacgctgaccgaatactgtggcaccctgatgtccctccccactaagattagcaggtgccctcacctgctcgactttttcaaagtgaggccagacgacctgaaactgcctactgataaccagacaaagaagcctgaaacctacctgatgccaaaggatggtaaaagcacagccacagatattacagggcctattatcctgcagacctatcgcgctatcgcaaattacgagaagacttccggttcagagatggccttgtccaccggcgacgtggttgaagtggttgagaaaagcgagagcggacagacctcccatttgaccggactgttgcctcttgtgctccgtaatccccagccccaggcaccctgccaggggtctgggtctctcgccccaggacggactcccgctcttctgggcgctctgaatgtgttgcccaccctgtgggtcgccttttgcctgtctgttcatccggtcgtcgcggtcgggatatgcgcatggcaggctggagccggtcacgtatgtgtgttctgcctagatgggtacggtaccgtgtgtagcctgtag

SEQ ID NO: 232602 - DNA, 1581 bp, Artificial Sequence
  Description of Artificial Sequence: Synthetic coding sequence
atgagccttgttgaagccatctctttatggaatgagggagtgctcgctgcagataaaaaggattggaaaggcgctctcgacgccttcagtgcagtgcaggatccccactctcggatttgcttcaatatcgggtgtatgtacacaatcctaaagaacatgactgaggcagaaaaagcattcacacggtccatcaaccgggataagcacctagctgtagcctactttcagaggggcatgctttattaccagaccgaaaaatatgacctcgcgattaaggatctgaaggaggcattgatacagctgaggggtaatcagctaattgactacaaaatcctgggccttcagttcaaactgttcgcctgcgaagtgctgtacaatatcgcctttatgtatgctaagaaggaggaatggaagaaagctgaggaacagttggcactggcgacgagcatgaaaagcgagcctcgacattccaaaatcgataaggcaatggaatgtgtctggaaacagaaactctacgagccagtggtaatacctgtgggtaaactcttccgcccaaacgagcgtcaggtggcgcaactcgctaagaaggactacctgggaaaggccacggtcgtcgcaagtgtggtcgatcaggactccttcagcggctttgccccattacagccccaggcagccgaacccccacctaggcctaaaaccccagagatatttcgagcgctcgagggcgaggcacaccgcgtcttgtttgggttcgtgccggagacaaaggaggaactgcaagtcatgcccggtaatatagtgttcgtgctgaaaaaggggaacgataattgggcaacagtcatgtttaacggccagaaagggctagtcccctgtaattacctggagcctgtggaacttaggattcacccacaacaacagccccaagaggagtcgtctccacagtccgatattccagcccctcccagtagcaaagccccaggacggcctcagctatcaccgggacagaagcagaaggaggagcctaaggaggttaagttatcggtgccaatgccatacacgctgaaggtgcactataagtacaccgtggtaatgaaaacacagccgggactgccttattcacaagtgcgggacatggtgagcaagaagcttgagttgcgccttgaacacacaaaactgtcttacagacctcgtgattcaaacgagttagttccactgagcgaggactctatgaaagatgcctggggacaggtgaagaactattgtcttacactttggtgcgagaatactgtgggggatcagggattccccgatgagcctaaggagtctgaaaaggctgacgcgaataatcagacaacagagccgcagttgaaaaagggaagtcaggttgaagcgctgttctcatacgaagccacccagcctgaagacctggagtttcaggagggggatatcattctggtcttatccaaggtgaacgaggaatggctggaaggcgagtgtaaagggaaggtcggcatcttcccgaaagtatttgtagaggactgcgcaaccaccgacctagagagcacccgccgtgaagtgtag

SEQ ID NO: 232603 - DNA, 1581 bp, Artificial Sequence
  Description of Artificial Sequence: Synthetic coding sequence
atgagcctggtggaggccatcagcttgtggaacgagggagttcttgcggctgataagaaagattggaagggagccctggacgccttcagcgcagtgcaggacccacattcaaggatttgtttcaacattggctgtatgtacacgatcctaaagaacatgaccgaggctgagaaggcttttacacgttcaattaatcgtgataagcacctggctgtggcatatttccagcgcggtatgctttattaccagacagaaaaatacgatcttgctattaaggacctgaaagaagcgctgatccaattgcggggtaatcagctcatcgattataagattctcgggctacagtttaaactgtttgcttgcgaggtcctttataatatcgccttcatgtatgcaaagaaggaagagtggaagaaggcggaagagcaactggcactcgctacgtccatgaagtccgagccgaggcactcaaagattgataaagccatggaatgtgtgtggaaacaaaaactctatgaaccagtcgtgatccctgttggaaaattatttagacccaatgagcgtcaggtcgcgcagctggcaaagaaggactacctcggcaaagcaacagtcgtggcgagcgtcgtggatcaggattctttctcagggtttgcccctctacagccgcaagctgctgagccacctccaagacctaaaacccccgaaatatttagggccttggagggggaggctcatcgggtgctctttggatttgttccagagacgaaggaggaactccaagtaatgccaggaaatattgtgtttgtgctcaaaaagggtaatgacaattgggccaccgtgatgtttaatggccagaaaggtctcgtgccatgcaactatctcgaacctgttgaactccggatccacccccagcagcagcctcaggaggagagtagtccgcagagcgacattcccgctcctccgtcgtccaaagcccctggcaggccccagcttagtcccggacaaaagcagaaggaagaaccaaaggaggtaaagctgtcagtgcccatgccctataccctcaaagtgcattacaagtacaccgtggtgatgaagactcaacccggactgccttacagtcaagtgagggatatggtctctaagaagctcgagttacggctggaacacacgaaattgtcgtaccgcccaagggattcaaacgagcttgtccctctctctgaggactcaatgaaggatgcgtggggacaggtgaaaaactactgccttaccttatggtgtgaaaatacggtgggcgatcagggttttccagacgagcctaaggaaagcgaaaaagctgatgcaaataatcagacaacggagccacagcttaagaagggatcccaggttgaggccctgtttagttatgaggctactcagcctgaggatctggagtttcaggaaggcgacattatattagttttatctaaggtgaatgaggaatggctggaaggcgagtgtaaaggcaaagtaggcatattcccaaaggtttttgtcgaggattgtgccaccaccgatctggagtctacaaggagggaggtctag

SEQ ID NO: 232604 - DNA, 1797 bp, Artificial Sequence
  Description of Artificial Sequence: Synthetic coding sequence
ggatcccctgctcgaggggatgcccctacgtgcctcctgagtgtatcctggcagttgagctggccaccatcattttaccttatcatgtctttggtggaggcgatcagcctatggaatgagggagtcctggcagctgataagaaggattggaagggggcactggatgctttctcagccgtgcaggacccccactcccggatctgtttcaatattggttgcatgtacactattttgaagaatatgacggaggctgagaaggcctttacaagatcaatcaacagagacaaacatctcgcagtggcctatttccagaggggcatgctgtattaccagaccgaaaaatatgacttagcaattaaggacctcaaggaggccttgatacagctgcgaggaaaccagctcattgactacaagattctgggactgcagtttaagctgttcgcctgcgaggtgctgtacaacatcgcttttatgtatgctaaaaaggaagaatggaaaaaagccgaggagcaacttgctctcgctacaagcatgaagagtgagcctcggcattctaagatcgacaaggctatggaatgtgtttggaaacagaagctctatgagccagtggtgatcccagtcggcaagctgttcagacctaacgaaagacaggtcgcacagttagctaaaaaagactatctggggaaggccaccgttgtcgcttctgtggtcgaccaggacagttttagcggattcgccccactacaaccccaggtaagacagtccgatctcctgggggcacaggccggtagcgtgagttccagacaattgcagttggacgtcgagttagagcctggctggtctcaagtaccagggagtaagttttcagtattcgcaccctggcatcacgtcagaggctggggcttggacctggtctcaatcctgtgtcgggctctggagggggaagcccacagggtcctcttcggttttgtgccagagaccaaggaggagctgcaggtgatgcccggaaacatagtgttcgtgttgaaaaaaggcaacgataactgggccactgtgatgtttaatggccagaaagggttggtgccatgtaactaccttgaacccgtggagctcagaattcaccctcagcagcagcctcaggaagagtcctccccccagtcagatatcccggcaccgccatcttctaaagctcctggccgaccacagctgtcacccggtcagaaacagaaagaggaacccaaagaggtgaagttgtcagtgccaatgccttacacgctcaaggtgcattataaatataccgtggtcatgaaaacacagcccggtctgccatattcacaggtgagagacatggtgagtaaaaaactagaactcaggctggagcacactaagctaagctaccgcccacgcgatagtaatgagcttgtgcccctgtctgaggactccatgaaagacgcgtggggccaagtgaaaaattattgtcttactctctggtgtgaaaacaccgtgggggatcagggattccctgacgaacctaaagagtctgaaaaggccgatgcgaataaccaaactaccgagcctcagctgaagaagggcagccaggtggaggctctcttcagttacgaggccacccagcccgaggatttggagtttcaagagggcgacatcatcctcgtgctgagcaaagtgaacgaagaatggctggaaggcgagtgcaaaggaaaggtcgggattttccctaaggtcttcgtggaagactgtgctacgacggatttggaaagtacaagaagggaggtttag

SEQ ID NO: 232605 - DNA, 1446 bp, Artificial Sequence
  Description of Artificial Sequence: Synthetic coding sequence
atgtcactagtggaagccatctctctctggaacgaaggtgtattggcggctgataaaaaagactggaagggagccttggatgcctttagcgccgtgcaggacccacattccagaatctgcttcaacatcggctgcatgtataccatcctgaagaatatgaccgaggccgagaaagcctttacccgcagcattaatagggacaagcacctggccgtagcttacttccagcgtggtatgctgtactaccagacggaaaaatacgatctcgcgattaaggacctgaaggaggcactgatccagttaaggggcaaccagctgatagattataaaatacttggcttgcaattcaagttatttgcctgtgaaaagcagaaactgtacgagcccgttgtcatccccgtcggcaaactctttagaccaaacgagcggcaggtagcgcagcttgcaaagaaggactacttgggaaaggcgaccgtggttgcctccgtggtggatcaggacagcttttccggattcgccccactccaaccacaggctgcagagcccccaccaagacccaagacaccagagattttccgggcactggaaggagaggcccacagggtgctcttcggatttgtccctgaaaccaaagaagagctccaggtgatgcccggaaacattgtatttgttctcaaaaaaggaaatgacaactgggccacggtgatgttcaatgggcaaaaaggactggtgccctgcaactatctggagcccgtggaacttcgcattcatccccagcaacagccacaggaagagtcttcaccccaatctgacatccccgctccaccttcctctaaagcccctggaagaccgcagctgtcccctggtcagaagcagaaggaagaacctaaggaggtgaagctgtcggtccctatgccttacacactcaaggtgcactataaatatactgtggttatgaagactcaacctggcttgccttatagccaagtgcgggatatggtatccaaaaagctagagttacggttagagcatacaaaactatcttaccgcccaagagattcaaatgagctcgtccccttgtccgaagactccatgaaggatgcctggggacaggttaaaaattattgtctgactctgtggtgcgagaatactgtgggggaccagggctttcctgacgaacccaaggagtctgaaaaagcagatgcaaacaatcagacaaccgagccacagctcaagaagggatcacaggtggaggcgctattttcttatgaggccactcagccagaggacctggaattccaggagggcgacatcatactcgtattgagtaaagtaaacgaagagtggctggaaggggaatgcaaaggaaaagtcgggatatttccaaaggttttcgttgaggattgtgctactacggacctggaatccacgcgcagggaagtgtag

SEQ ID NO: 232606 - DNA, 1338 bp, Artificial Sequence
  Description of Artificial Sequence: Synthetic coding sequence
atgtctcttgtcgaagcaatctcactttggaatgaaggagttctggctgcagataagaaagattggaaaggcgcactcgacgctttctcagcggtgcaggacccccactcccgaatatgctttaatatcggatgtatgtacaccatactcaagaatatgacagaagctgagaaagcctttacaaggtccatcaatagagataaacatcttgctgtggcctactttcagcggggtatgctttattatcaaacggaaaaatacgaccttgctatcaaggacctcaaagaagcactcatacaactgcggggaaatcaacttattgattataagattctggggctgcagttcaagctattcgcatgtgaggtagtggccagtgtggttgatcaggactcattctcgggttttgctcctctccaacctcaagctgcagaaccacccccacggcctaaaacccccgaaatctttagagcattagaaggggaggcccaccgggtgctttttggattcgtgcctgaaaccaaggaggaactgcaggtgatgccagggaatattgtattcgttctgaagaaggggaacgataattgggctactgtgatgtttaatgggcagaaggggctagtgccctgtaattacctggagccagtggaactgaggattcaccctcaacaacagccccaggaagagtcatcaccgcaatctgatattccggcaccgccaagctctaaggccccagggcgtcctcagctatcaccaggccagaagcagaaggaggagccgaaggaggtgaaattgagcgtcccaatgccctacactctgaaggtgcactataagtatacagttgtgatgaagacccaaccaggcttgccgtattcccaagtcagggatatggtgtcgaagaaactcgagctacgcctcgaacatactaaactgtcatatcgacccagggattcaaacgagctcgtaccactgagcgaggactcaatgaaagacgcatggggccaggtaaagaattactgcctgacactgtggtgtgagaataccgtgggcgatcaagggttccctgatgaacccaaagagtctgagaaagcagacgcaaacaaccagactaccgagccacagttgaagaaaggttcccaagtggaggcactgttctcatacgaagcgacccagcctgaggatttggaatttcaagaaggcgatattatcctggtgctcagcaaggtcaacgaagaatggttggaaggcgagtgtaaaggcaaggtcggtatctttccgaaggtgtttgttgaggactgtgctaccaccgatctggagtcgacaaggagagaggtgtag

SEQ ID NO: 232607 - DNA, 432 bp, Artificial Sequence
  Description of Artificial Sequence: Synthetic coding sequence
atgcccggaaatattgttttcgtgcttaaaaaagggaatgataattgggcaacagttatgtttaatggtcagaagggcctagtgccatgtaactacctcgagcccgtagagcttcgcatacacccacagcaacagccacaggaggaaagtagtccccagtccgacattccagctcctcctagcagcaaagcccctgggcgaccacaactaagccccggacagaagcaaaaagaagaaccgaaagaagtgaaactctccgtcccaatgccttatacattgaaggtccactacaaatacacagttgttatgaagacacagcctggcttaccttactcacaggtgcgcgacatggtcagcaaaaaattggaactccgccttgagcacacgaaattatcataccgtccgcgagactcaaacgagttagtgccctag

SEQ ID NO: 232608 - DNA, 171 bp, Artificial Sequence
  Description of Artificial Sequence: Synthetic coding sequence
atgccatatacattgaaggtgcactataagtataccgtagtcatgaagacccaacccggacttccatattcgcaggtgcgcgacatggtgtcaaaaaagttggagctgcggcttgagcatacaaaactgtcatatcgccctcgagacagcaatgagctggtgcccctgtag

SEQ ID NO: 232609 - DNA, 1020 bp, Artificial Sequence
  Description of Artificial Sequence: Synthetic coding sequence
atggccgtggctcaacagctgagggccgagagcgactttgaacagctgcctgatgatgtagccatctccgccaatattgctgacattgaggaaaaaagaggcttcacatcccacttcgttttcgtgattgaggtcaagaccaaaggcggatctaagtatcttatctaccgtaggtacagacaattccacgccctgcagtctaagttggaggagcgcttcggccctgattctaagtcaagcgccctcgcttgtactctgccaactcttccagccaaggtttacgtgggcgtgaaacaggagatcgccgagatgaggataccagccctgaatgcatacatgaaaagcctgcttagcctccctgtctgggtgcttatggacgaggacgtgcggatcttcttttaccagtcgccttacgactcggagcaggtcccccaggccttgagacggctgcgcccacggacgaggaaagtgaaatctgtttcgcctcagggcaattccgtggacagaatggccgcaccacgcgctgaggcactctttgacttcacgggaaatagcaagctggaattgaatttcaaggccggagatgtgatttttctgctgagtaggattaacaaggactggctggagggcaccgtgagaggggcaacaggcattttccctctctcctttgttaagattttgaaagattttcctgaggaagatgatccaaccaattggctgcgatgttactactacgaagacaccatctctacaataaaagatatagctgtggaagaagatttaagtagtacacctttgctgaaggaccttctcgagctgacacggagagaattccagagagaagacatcgccctcaactacagggacgcagaaggagacctcgtccggctgctctctgacgaggacgtggctctgatggttcgccaggccagagggcttccctctcagaaacgtttgtttccatggaagctccacatcacgcagaaagataactaccgcgtctacaatactatgccctag

SEQ ID NO: 232610 - DNA, 1047 bp, Artificial Sequence
  Description of Artificial Sequence: Synthetic coding sequence
atggccgtggcgcagcagttgcgggctgagtcagactttgagcaactgccggacgacgtcgccatatctgcaaatatagccgatattgaagaaaaaagggggtttacgtcacattttgtctttgtgattgaagtaaaaaccaaggggggtagcaaatacctgatatacaggcgttataggcaattccacgccctgcagagcaagttggaggagcgatttggtccagatagcaagtccagtgctttagcttgcacccttccaactctcccagccaaggtctacgtgggagtgaagcaggagatcgcagagatgaggataccggctcttaacgcttatatgaagagtctcctgagcctgccagtctgggtgctgatggatgaagatgtgaggatattcttttatcaaagcccctatgattcagaacaagtgccacaggccctgaggcgcctgcgccctcgcactaggaaggtgaagtccgtatcaccccaggggaacagtgtggacaggatggccgctcctagagcagaagccctgtttgacttcacagggaacagcaagcttgaactcaattttaaggctggcgacgtaatatttttactttcgcggatcaataaggactggctggaggggacagtccgcggtgccacaggcatcttcccattgtcatttgtgaagattctcaaagatttccctgaggaggacgacccaacaaattggctgcggtgttactactatgaagacacgatatccacaataaaatccgtggcctgggaaggcggagcttgccctgcttttttgccttctctccgacccctgccattgactagtccttcccatggatccctgagccattccaaagcccctagtggaagccagatgtctcacaacgctgtcactagtcatcaaaggcctggctggcccggtcagccacactctccctttccacatccgacaccccatttccagcccgacgcctcacttctccagcctgtaacacctttgggcacctcgcgttggcggaagatttcagcagccctgccctactag

SEQ ID NO: 232611 - DNA, 501 bp, Artificial Sequence
  Description of Artificial Sequence: Synthetic coding sequence
atgcgaataccggctctcaacgcctacatgaagtctctcttatcgcttcccgtgtgggtcctaatggatgaggatgtgcggatcttcttctaccagtcgccgtatgactccgagcaagtgcctcaggctcttaggcgactccgacccaggacacgtaaggtgaagagcgtgtctcctcagggcaatagcgtggacaggatggcagctccacgggctgaggctcttttcgacttcaccggaaattctaagctcgaattgaactttaaggcaggggacgtgatcttcttgctgtcacgcatcaataaagactggctggagggcaccgtcagaggtgctacaggcatctttcctctcagtttcgtgaagatcttgaaagactttcccgaggaagatgaccccaccaactggctaagatgctattattacgaagatacaataagcacaattaagagcgtggcttgggaaggcggagcttgtccagctttcctgcctagtctttag

SEQ ID NO: 232612 - DNA, 480 bp, Artificial Sequence
  Description of Artificial Sequence: Synthetic coding sequence
atgaatgatataagtcagaaagctgagatcctccttagctctagtaagccagttccaaagacgtacgtgcctaagctgggaaagggagatgtaaaggacaaattcgaagctatgcaacgcgctagagaagagcgcaatcagcgcagatcccgcgatgaaaaacagcggaggaaggaacagtacattcgagagagggaatggaatagaaggaagcaagagattaaagaaatgcttgcatctgatgatgaagaagacgtaagctctaaggtcgagaaagcttacgtgccaaagctgacagggactgtgaaaggaaggttcgccgagatggagaaacagagacaggaagaacagcgaaaaagaacagaggaggagcggaagcgaagaattgaacaagacatgctagagaagcggaaaattcagcgggaattggccaagagggcagagcaaaaattagctcgcagagatggtgcccacctgtag

SEQ ID NO: 232613 - DNA, 1836 bp, Artificial Sequence
  Description of Artificial Sequence: Synthetic coding sequence
atgaacgatatatctcaaaaggctgagatcaaagaaatgctggcgagtgatgatgaagaagatgtgagcagtaaggttgaaaaggcatatgttcccaaactcactggcacggtgaaagggcgattcgctgagatggagaaacagaggcaggaggagcaaagaaaaagaacggaggaagagcgcaagcggaggatcgagcaagatatgctcgaaaagcgcaagatccaaagagagttggctaagcgagctgagcagatagaagacatcaacaacactgggaccgagtctgcttccgaggaaggtgatgattcccttcttatcacagtagttccagtgaaaagctataagaccagcgggaaaatgaagaaaaactttgaggacctcgaaaaggagcgggaggagaaggagcgaattaagtacgaggaagataagcgcatccgctacgaggagcaacggccatcactaaaggaggctaaatgccttagcctggtgatggacgatgaaatcgagtctgaggccaaaaaggagtcattgtcccctggaaagctcaaactgacctttgaagaactagagagacagcgccaagaaaacagaaagaaacaggctgaagaagaggcacgcaagagactcgaagaagagaagcgcgctttcgaagaagcgaggaggcaaatggtgaatgaagatgaagaaaatcaggacacagctaagatatttaaaggttacagaccaggcaagctgaagctcagttttgaggaaatggagcgccagagacgagaggacgaaaaacgtaaggccgaagaagaagcacgcaggagaatcgaggaggaaaagaaagcattcgctgaggcgagacggaatatggtagttgacgacgacagccccgaaatgtataaaaccatcagtcaggaattcctcaccccaggcaagctcgaaatcaatttcgaagaattgctgaagcagaaaatggaggaagaaaaacgtcggacggaggaagagaggaaacataagctggagatggaaaagcaagagtttgaacagctccggcaggaaatgggcgaggaggaagaggagaacgagacatttggcctctcccgcgaatacgaggagctgatcaagctgaaacgctcaggctctattcaagcaaagaacctgaaatccaagttcgagaagatcgggcagctttctgagaaggagatccagaaaaaaatcgaggaggagcgggctcgcaggcgggctatagatctggagataaaggagcgagaggcagagaacttccatgaggaagacgacgtggatgtgcgacccgcaaggaagagtgaggcgccattcacccacaaggtgaatatgaaggcccgattcgaacagatggccaaagcccgtgaggaagaagaacagcgccgtattgaggaacagaaactgttacgcatgcagttcgagcagcgggagattgatgcggctttacagaagaaaagggaggaagaggaggaagaggagggaagcattatgaatggatcaacagctgaggacgaggagcagacccggtccggcgcaccttggttcaaaaagcccctcaaaaatacatccgtcgtagacagtgagccggtccgctttacagtcaaggtcacaggagagcccaaaccagagatcacctggtggtttgagggggaaattctgcaggacggtgaagattatcagtacatcgaaagaggcgagacctactgtctgtatttgccagagactttccctgaagacgggggtgagtacatgtgtaaggccgtcaacaataagggaagcgctgcatcaacttgcatcctcacgatcgagtccaagaattag

SEQ ID NO: 232614 - DNA, 2028 bp, Artificial Sequence
  Description of Artificial Sequence: Synthetic coding sequence
atgaatgatatctcccaaaaggcagagattttgttgagcagtagtaagccagtacccaagacgtatgtcccaaaactcggcaagggcgatgtaaaagataagttcgaggccatgcagagggccagggaagagcgcaatcagcgcagatcacgggatgaaaagcagcggagaaaagagcaatatattagggaacgcgaatggaatagaaggaaacaggagatcaaagaaatgctcgcttcggacgacgaggaggacgttagcagcaaggtggagaaggcatacgtccccaaactgaccggcactgtaaagggcaggtttgccgaaatggagaagcagcgccaggaggaacagcggaaaaggaccgaggaggaacgaaaaagaaggatcgagcaggatatgctagagaaaagaaagattcaaagggaacttgctaaacgcgctgagcaaattgaggacattaacaacacaggcacagaatctgcaagcgaggagggtgacgattccctgctgattaccgtagtgcccgtaaagtcgtataaaacctctggaaaaatgaagaaaaactttgaagatctggaaaaggagcgcgaagagaaggagaggatcaaatacgaagaggataaaaggattagatacgaggaacaacgcccttccctgaaggaagccaagtgcctttctctggtgatggatgacgagattgaaagcgaggcaaaaaaggaaagtctctctccaggaaaactcaagctgacgttcgaagagctggagcgtcagcgccaggagaatagaaagaaacaagccgaggaggaagcgaggaagcgcctcgaggaggagaaaagggccttcgaggaagccaggcgtcagatggtcaacgaggacgaggaaaaccaggacactgccaagatctttaagggctatcgacctggcaaattaaaactatcgtttgaagagatggagcgtcaacggagagaagacgaaaaacggaaagccgaggaagaagccagacgtcggatagaagaggagaagaaggcctttgcggaagcacgacggaatatggtggtggacgacgatagcccagagatgtacaagacaatcagtcaggaattcttaacacccggtaagctagaaatcaattttgaggagctcctgaaacagaaaatggaagaggaaaaacggaggaccgaggaggaacgaaaacataaattggaaatggaaaaacaagaatttgaacaactgaggcaggagatgggcgaagaggaagaggaaaatgaaaccttcggactgagccgggaatacgaggaactcattaagctgaagaggtctggcagtatccaagctaaaaatcttaaatcaaagtttgaaaagataggccagctgtccgaaaaagagattcaaaagaagattgaggaggagcgcgctcgtagaagggcaatagaccttgagatcaaagagcgcgaagctgagaacttccacgaggaggacgacgtcgatgtcagacctgcaagaaagagcgaggcacctttcacacataaggtaaacatgaaggctcgatttgagcagatggccaaagcacgcgaagaggaagagcagcgtcgcattgaagagcagaaattgctgcgcatgcagttcgaacagcgcgaaattgacgccgcattgcagaaaaagagggaagaggaggaagaagaggaggggtccatcatgaacggatccactgccgaggacgaggaacagacccgcagcggggcaccatggtttaagaaacccttgaagaacacatcagtagtagactctgagccagtccggtttacagttaaagtgactggggagcccaaaccggagataacctggtggtttgaaggggaaatcctgcaggatggcgaggactaccagtatattgagcgaggggagacatattgtctatacttacccgagacattccctgaggatggcggagagtatatgtgcaaggcagttaataacaaaggctccgcggcttctacatgcatattgaccatagagtcaaagaattag

SEQ ID NO: 232615 - DNA, 1731 bp, Artificial Sequence
  Description of Artificial Sequence: Synthetic coding sequence
taagtgaaggggcgatttgccgaaatggaaaagcaacgccaggaagaacagcgcaagcgcaccgaggaagagcgaaaacgacgcattgagcaagacatgctggaaaaacggaaaattcagcgtgagttggccaagcgggcagaacagatcgaggacataaacaatactggaaccgagagcgcttccgaggagggcgacgatagccttcttattacggtggtaccagtgaaatcttacaaaacatcgggcaaaatgaaaaagaattttgaagacctggagaaagagcgcgaagagaaagagagaatcaagtacgaagaagacaaacgcattcggtacgaggagcagcgaccatctctgaaggaagcgaaatgcctttcactggtgatggatgacgaaatcgaaagcgaggcaaagaaggaatctctgagccccggaaaacttaagctgaccttcgaggagctagagagacagcgccaggaaaatcgtaagaagcaggctgaggaggaagcccgtaaaaggctggaagaggaaaagcgcgctttcgaggaggctcgcagacagatggtgaatgaagacgaggagaaccaggacacagccaaaatcttcaaaggctatagacccggaaaactgaaactgtcttttgaagaaatggagcgccaaaggagagaagatgaaaaaaggaaagccgaggaagaagccaggaggaggatcgaagaggaaaagaaagcgttcgctgaagctaggcgaaatatggtggtcgacgacgactctcccgaaatgtacaagactatatcccaagagttcctcacccccggtaagctggagatcaatttcgaagagctgctcaagcagaaaatggaggaggagaaacggaggaccgaggaggagcgcaagcataagctggaaatggagaaacaggaatttgagcagttacgtcaggaaatgggcgaggaagaggaggaaaacgagacattcggtttgtcccgggagtatgaagagctcatcaaactgaagcgcagcgggagcatacaggccaagaacctgaagtctaagttcgagaagattggccaactgtctgaaaaggagatccagaaaaagatcgaggaggaacgggctcggagacgtgcaatcgacctcgagatcaaggagcgtgaggctgagaactttcacgaggaggatgacgttgatgtgcggccagccagaaagtctgaggctccatttacccataaagtgaatatgaaggccaggttcgaacagatggccaaagccagagaagaggaagagcagcgcagaatcgaagagcaaaagcttctccgaatgcaattcgagcagagggagatcgacgccgcactccagaagaaacgtgaagaagaggaggaagaggaggggagcatcatgaacgggtccacagcagaagacgaggagcaaacaagatctggggctccctggtttaaaaagcctttaaaaaataccagcgtggtggatagtgaaccagtcaggtttaccgtcaaggtgaccggagagccaaagccggagattacctggtggtttgaaggcgaaatcctgcaggacggggaggactaccaatacatcgaaaggggggagacttattgcctatatctgcctgaaacattcccggaggacggcggagaatacatgtgtaaagcagtaaacaacaaaggcagcgccgcatctacttgcatactgaccattgaaactgacgattattag

SEQ ID NO: 232616 - DNA, 966 bp, Artificial Sequence
  Description of Artificial Sequence: Synthetic coding sequence
atgaacgacatatcccaaaaagccgaaatcaaagagatgctggctagtgatgacgaagaagacgtatccagcaaagtggagaaagcatatgtgcctaaattgaccggtactgtcaagggacgattcgctgagatggaaaaacaacgccaggaagaacagaggaagcggacagaagaagagcgtaagcgtaggatagagcaggatatgctcgaaaaacgaaaaatccagcgcgaactagccaaacgagctgagcagatagaggacattaacaacactggcaccgaatctgcctctgaggagggggacgatagtttgctcatcacggtcgtgcccgtgaaaagctacaagaccagcggaaaaatgaagaagaactttgaagacctcgaaaaggaacgagaggagaaggaaagaattaaatacgaagaggacaagagaatcagatacgaagaacagcggccaagcctgaaagaggccaagtgcctttccctagtgatggatgatgaaatcgagtccgaagccaaaaaagagtctctatcaccaggcaagctcaagcttacctttgaagagctggagaggcaaaggcaggaaaaccggaagaagcaggcagaagaggaggcaagaaaacggttggaagaagaaaaaagagccttcgaagaagcccgtcgccagatggtgaacgaagacgaggagaaccaagatacagccaagattttcaaggggtatagacccggtaaattgaagctcagtttcgaggagatggagcgacagaggcgggaggatgagaaacgtaaggctgaagaggaggctaggaggaggatagaagaggaaaaaaaagcattcgccgaggcccgacgaaacatggtcgttgatgacgactctcccgagatgtataagacaatttcacaggaatttctgaccccgggaaagctggaaattaacttcgaggagctgctgaaacagaagtag

SEQ ID NO: 232617 - DNA, 1308 bp, Artificial Sequence
  Description of Artificial Sequence: Synthetic coding sequence
atgaatgatatctctcaaaaggctgaaatcctattgtcaagcagtaagcctgtccctaaaacctacgtgcccaagctcggcaaaggggacgttaaggataagtttgaagctatgcagagagcccgtgaagaacgaaaccagagaagatctcgcgatgagaaacagaggaggaaggaacagtatatccgggagcgcgaatggaacaggagaaagcaggagatcaaggagatgttggcctccgacgacgaggaggacgtcagtagcaaggtggaaaaggcgtatgtgcccaagttaaccggcactgtcaaggggaggttcgctgaaatggagaagcagcgacaggaggaacagagaaaaaggaccgaagaagaacgcaagagacggattgaacaggatatgcttgaaaagcgtaaaatccaacgagaacttgctaagcgtgctgaacaagagggagacgattctctgctgatcactgtggtcccagtgaaaagctataaaacctctgggaagatgaagaagaactttgaagacttggagaaggagcgagaagagaaggaacggatcaagtatgaagaagacaaacgaatccgctatgaagaacagcgcccatccttgaaagaggccaagtgtctctcactggtgatggacgatgaaattgaatcagaagcgaagaaggaatccctgtcccctggcaagctcaaactgacgttcgaggagctggaaaggcagcggcaggagaaccgtaaaaaacaggctgaggaagaagcgcgtaaaaggcttgaagaagagaaaagggcgtttgaggaagcacgacgtcagatggtaaatgaagacgaagagaatcaggacaccgccaagatctttaagggatacagaccaggcaaactgaagctaagtttcgaagagatggagaggcaacggagggaggatgagaagaggaaagcggaagaagaggctcgcaggaggatcgaagaggaaaaaaaagcctttgccgaggctaggaggaatatggttgttgacgacgactctcccgagatgtacaaaacaatcagccaagagttccttacccctggcaaactcgagattaactttgaggaactgctgaagcagaagatggaggaagagaaacggcgtaccgaggaggagcggaaacacaaacttgagatggagaagcaggagttcgagcaacttaggcaggaaatgggggaggaggaagaggagaatgaaacattcgggttgtctcgcgagtatgaggaactgatcaaacttaaaagatcaggctccattcaagcgaaaaaccttaagtag

SEQ ID NO: 232618 - DNA, 1989 bp, Artificial Sequence
  Description of Artificial Sequence: Synthetic coding sequence
atgaacgatatctcgcagaaggcagaaatcctcctgtcgtccagcaagccagtgcctaagacttacgtccctaagctggggaaaggagatgtgaaggacaagttcgaagcgatgcaaagagctagagaagagcggaatcaacgccgttccagagacgaaaaacagcggagaaaagagcaatacatacgcgagagggagtggaatcggcgaaaacaagaaataaaagagatgctggccagcgacgatgaggaagacgtttctagtaaagttgagaaagcctatgtgccgaagttgaccgggacagtaaagggcagattcgccgaaatggagaagcagcgccaggaagagcagcgaaaaaggaccgaagaggagagaaaaaggaggatagaacaggatatgcttgagaagaggaagatacagagagaactggcaaagagagccgagcaggagggcgatgactcgcttctcataacggtggtccccgtaaaatcttataagacatctgggaagatgaagaaaaacttcgaggatcttgaaaaagaaagagaggagaaggagagaataaagtacgaagaggataaaaggattaggtatgaggaacagaggccctcactgaaagaagccaagtgcctcagcctggtgatggatgatgagattgagtccgaggcaaagaaggaaagcctgagccctggcaagttgaaactgactttcgaggagcttgagcgacagcggcaggagaaccggaagaagcaagctgaggaagaggctagaaaacgactggaagaagagaagagggcgttcgaggaggctcggagacaaatggtcaatgaggacgaggaaaaccaggacaccgctaagatcttcaagggctaccgccctggaaaactcaaattgtcctttgaagagatggaacgtcagaggagggaagacgagaaaagaaaggctgaagaagaagccaggcgcagaatcgaggaggaaaaaaaggcatttgcagaggctcgcaggaacatggtggttgatgatgattcgcctgaaatgtataagaccatatcgcaggagtttctaactccaggtaagcttgagatcaattttgaggagctgcttaaacaaaagatggaggaagaaaaaaggcgtaccgaagaagagaggaaacataagcttgagatggagaaacaggagtttgaacagcttagacaagagatgggcgaggaggaggaagaaaatgagacatttggattgtctcgggaatacgaggagctcattaagctgaagagaagcggttcaattcaggccaagaacttaaaatcaaaattcgaaaaaatcggccagttatccgagaaagaaatccagaaaaagatagaggaggagagagctagacgcagggcaattgacctggagattaaggaacgcgaggcagagaacttccacgaggaggatgacgtggacgtccggcctgccaggaaatcagaggcccctttcacgcacaaggtgaatatgaaagctagatttgaacagatggccaaagctagggaggaagaagaacagaggaggatagaagagcagaagttactcagaatgcagttcgagcagcgggagatagacgctgcgctgcagaaaaagcgagaggaggaagaggaagaggaagggtccattatgaatgggtctacagcggaagatgaagagcagacccgatcgggagctccctggttcaaaaagccgttaaaaaatacttccgtggtggactccgagccagtaaggtttaccgtcaaagtcaccggagagcccaagcctgagattacctggtggttcgaaggcgaaatcttgcaagacggagaagactatcagtacatcgagagaggtgaaacttactgtttgtatctcccagagacatttcccgaggatggcggtgaatatatgtgtaaagccgtgaataacaaagggagcgctgccagcacctgtattttaaccattgaaaccgacgactactag

SEQ ID NO: 232619 - DNA, 813 bp, Artificial Sequence
  Description of Artificial Sequence: Synthetic coding sequence
atggaaaatcagccagttagatggagggctctacctggcctgccacgccctcctgggcttcccgcagcaccatggctgcttctgggtgtgttgttattgcccggaaccctgaggctggccggtggacagtccgtcactcacactggcctacccattatggccagtttagcaaatacggcaatcagcttttcatgtcgcataacttatccgtatactccccagttcaaggtgtttactgtgtcctatttccacgaggatttgcagggacagcgttccccgaagaagcccactaattgccacccagggctcgggaccgagaatcagagccacacactggattgccaggttacactggtgctgcccggtgcatctgccaccggaacctactattgttcggttcactggccacatagcacagtacggggtagtggcacctttattcttgtacgcgacgccggttaccgggaaccgcctcagagcccacagaagctgctgctctttgggttcacaggtctcctgagtgttttatctgtcgtgggcaccgccctgctcctatggaataagaaacgcatgcgcggacctggcaaggaccctacgcgaaaatgcccagatccgcgttctgcctcttccccaaagcagcacccttcagaaagcgtctataccgcactgcagcgtcgcgaaacagaggtttatgcctgtatcgaaaatgaggatggcagcagtcccacagcaaagcagtcaccactaagccaggagaggccccacagattcgaggatgacggagaactgaacctcgtgtatgaaaacctgtag

SEQ ID NO: 232620 - DNA, 1248 bp, Artificial Sequence
  Description of Artificial Sequence: Synthetic coding sequence
atggcccctgtttccggctcccgatctccagatagggaagcttctggtagtggaggaagacgacggtcctcctctaaatccccaaaaccctcaaagtcagctagatctcctagggggcgtagatcaaggtcacattcttgttctagaagcggggaccgcaacggtctcacccatcagctgggtgggctttctcagggaagccggaaccagagctaccggtcccgctcccgctccaggagtcgagaaagacctagcgcaccaagagggatccccttcgcctctgctagcagttcggtctattatggcagctacagccggccttacggctccgataaaccctggccctcgctcttggacaaagagagagaggagtccctgagacaaaaaaggctgagcgagcgtgagaggatcggtgagctcggggcacccgaggtttggggccttagccctaagaaccctgagccagatagcgatgagcacacccctgtggaagacgaagagccgaagaagagcacaacatccgcatctacgtccgaagaagaaaaaaaaaaaaagtctagtcggtccaaagagcggagcaagaaacggagaaaaaagaaaagtagtaagcgaaagcataagaaatactcggaggacagcgacagcgactcggacagcgaaaccgactcctccgatgaggacaataaacggagggctaaaaaggcaaagaagaaggagaaaaagaaaaaacataggagcaaaaagtataagaagaagcggtcaaagaaatcccgcaaggaatcctctgatagctcttcaaaggagagccaggaggagtttctggaaaatccttggaaagatcgtaccaaggcagaggagccatctgatctgattggccctgaggctccaaaaaccctgaccagtcaggatgacaagccactaaattatgggcacgcactcttgcctggcgaaggggctgccatggctgaatatgttaaggccggtaagagaatccccagacgaggagagatcggactgacgtccgaagaaattgcgtcttttgaatgtagtggttatgtgatgagcgggagcaggcacaggcgtatggaagccgtgcgcctcaggaaggagaatcaaatctattccgccgacgagaagcgcgctctcgccagtttcaaccaagaagaaagaagaaagagagaaaacaagatccttgcatccttccgcgaaatggtgtacaggaagacgaagggcaaagatgataaatag

SEQ ID NO: 232621 - DNA, 2073 bp, Artificial Sequence
  Description of Artificial Sequence: Synthetic coding sequence
atggagaagatattacaaatggcggagggtatagatataggggagatgccctcttacgatcttgtgttgtctaaaccatctaagggtcagaagagacacctttctacatgcgatggccagaacccacccaaaaaacaagccggaagcaagtttcatgcgcgtccccgattcgaacccgtccactttgtagcaagttcctccaaagacgagaggcaagaagacccttacgggcctcaaactaaagaagtaaacgagcagacacacttcgcttccatgcctcgcgatatctaccaagattacacacaggacagtttctctattcaggatgggaacagccaatattgcgatagctcaggatttatactgaccaaagaccaacctgtgactgccaatatgtatttcgattcgggtaatccagcccctagtacgacctcccagcaggccaactctcagtctactcctgagccaagccctagtcagacctttccggagagtgttgtggcagagaaacaatatttcatagaaaagctaacagctaccatatggaaaaatctatcaaatccagaaatgacctccgggtccgacaagattaactacacttatatgctcacgcgatgtattcaggcttgtaagacgaacccagaatacatctacgcccctctaaaggaaatacctcccgcagatattcccaagaacaagaagctactcacggatggatatgcttgtgaagtgagatgccaaaacatttacctgacaacagggtacgcgggtagtaagaatggctcgagggatcgcgcaacagaactcgctgtgaagttattgcagaaacgcatcgaggtcagggttgtgaggagaaagtttaaacatacattcggggaagatctagtggtctgtcagataggcatgagcagctatgagtttcctcccgcactgaaaccaccggaggatctcgttgtgcttgggaaggatgcttccggccagcccattttcaatgcgtctgcaaagcattggactaacttcgtgatcactgagaacgccaatgacgctattggaattctgaataatagcgcctccttcaataagatgtccatcgaatataagtatgaaatgatgcctaatcgcacatggagatgccgcgtgtttctccaggaccattgtctggccgaaggctatggcactaagaagacaagcaagcatgccgcagccgatgaagccctcaagatactgcagaaaacccagcccacttatccttctgttaaatcatctcagtgccatactggctcatcccctcgcggaagtggaaaaaagaaagatatcaaggacctcgttgtgtacgagaattcctcaaatcccgtctgtacactgaatgacactgcccaatttaaccgtatgaccgtggaatacgtctatgagagaatgacaggcctgaggtggaaatgtaaggttatcttggagagcgaggtcatcgccgaggccgtgggagtgaaaaaaacagtgaagtacgaagctgccggagaagctgtcaagactctgaagaagacacaacccactgtgattaataatctgaaaaaaggcgctgtggaagacgtgatctctcgaaacgaaatccaaggtcgctcagcagaggaggcttacaaacaacagattaaggaagataatatcggtaatcagcttcttcgcaaaatggggtggacgggagggggtctgggcaagtctggggaaggcatccgcgaaccgatatccgtcaaagagcagcataagcgtgagggcctcggacttgacgttgaacgcgtcaataagatcgcaaagcgcgatattgagcagattatcagaaattatgcgagatcagaaagtcacacggatcttactttttccagggaactgacgaatgacgagcgcaagcagattcaccagatagctcagaaatacggcctgaaatccaaaagccacggcgtaggtcatgacaggtatctggttgtagggagaaagcgtcggaaagaagacctgttggatcagctgaagcaggaggggcaggtgggccactatgagttagtgatgcctcaggctaattag

SEQ ID NO: 232622 - DNA, 2073 bp, Artificial Sequence
  Description of Artificial Sequence: Synthetic coding sequence
atggagaagattctccagatggctgaaggaatcgacattggtgagatgccatcatatgacttagtcctttctaagcccagcaaaggacagaaaaggcatctgagtacttgcgacggccagaacccccctaagaagcaagcaggctcgaagttccacgcaagaccccgattcgagccggttcatttcgtggcgtctagctccaaagatgagcggcaagaggatccatacggaccccagacaaaagaagtcaatgagcagactcatttcgccagcatgcctagagacatctatcaggattacacccaggacagcttctctattcaggacggtaacagtcagtattgtgacagctccggatttatcctcactaaagaccagcccgtaaccgcaaacatgtacttcgatagcggcaaccccgctccaagcaccacgtctcagcaagctaattcccagtccactcccgagcctagtccttcccagactttccccgaatccgtcgtcgccgaaaaacaatacttcattgaaaagctgacagctacaatctggaaaaacctctccaaccctgaaatgacatcgggttcagacaagattaattacacgtatatgctcacaaggtgcatccaggcttgcaagacgaacccggaatacatctacgcccctctgaaagaaatcccaccagccgatattccaaaaaacaagaaattactcacggatggctacgcctgcgaggtgaggtgtcagaacatttaccttacgacaggctacgcaggatcaaagaacggttccagagacagggccaccgagcttgctgtgaagctgctacagaagcgcattgaagttagagtcgtgaggcggaaatttaaacatacctttggggaggatctggtcgtgtgccagatcggcatgagtagctacgagtttccccctgcccttaagcccccagaggacctggtggtgctgggcaaggacgcgtcaggacagcccattttcaatgcctctgctaaacattggaccaatttcgtaatcacagaaaacgcgaacgatgccatcggaatcctgaataacagcgcatctttcaacaagatgtcaatagaatacaaatacgagatgatgcccaacaggacatggcgttgtagggtgttcctccaggaccactgtctggccgagggatacgggacaaagaagactagcaagcatgctgcggctgacgaggcgctcaagattctccagaaaacccagcctacttatccttcagtcaaatctagtcagtgccacaccggctcctcgcctcggggtagtgggaagaagaaggacatcaaggatttggtggtttacgaaaacagtagcaatccagtgtgcaccttaaatgacaccgcccagttcaaccgcatgacagtcgagtacgtgtacgagcgaatgactgggctgcgttggaaatgcaaggtgatcctggagagcgaggtgatagccgaggctgtcggggttaaaaaaacagtgaaatacgaggctgccggtgaggccgtcaaaacgctgaagaagacgcagcctaccgtgattaacaacctcaaaaagggcgcagttgaagacgtgatcagcaggaatgaaattcagggccgttctgccgaagaagcatataaacagcagataaaggaagataacataggcaatcagctgctaagaaaaatgggatggaccggcggaggactcggtaagtcaggcgaggggatccgtgagcccattagtgtcaaagaacaacataagcgcgaaggcttgggcctcgatgtcgaaagagtgaataaaatcgccaaacgcgacattgagcaaataatacgcaattacgcacggtcagagtctcatacagatctcaccttcagtagagagctgacaaacgacgagcggaagcagatccaccagatcgcccagaagtacggtctcaagagcaaaagccatggcgtgggccatgaccggtatctggtggtcggtcgaaaaagacggaaggaggacctgctggaccagctgaagcaggagggccaggtcggacactacgaactcgtgatgccgcaggcaaattag

SEQ ID NO: 232623 - DNA, 2118 bp, Artificial Sequence
  Description of Artificial Sequence: Synthetic coding sequence
atgggctttatgctgcccttgatcttccgatattctcccaggcttatggaaaagatcctgcagatggcagaaggcattgatatcggagaaatgccttcatatgacctggtgttatcaaagccctcaaaggggcagaagcgccacctctccacctgcgatgggcagaatcctcctaagaagcaggcagggtccaagtttcatgccagaccaagatttgagcccgtgcactttgtagccagctctagtaaggacgaaaggcaggaagacccatacgggccacagacgaaggaagtcaatgagcagactcatttcgcatcaatgccccgtgatatttatcaagactatactcaggactccttttctattcaggatgggaacagccaatactgtgactctagtggcttcatattgaccaaagaccaacccgtgaccgccaacatgtacttcgacagcggaaaccctgcccctagcacgacatcccagcaagcaaactcacaaagcacaccagaacctagtccatctcaaacgtttcctgaaagcgttgtggccgaaaagcagtattttattgaaaaactgacagccacaatttggaaaaacctttctaaccctgaaatgacgtctggttctgacaagattaattatacctatatgctgacaagatgcatccaggcttgcaagaccaaccctgagtacatatacgcccctctaaaggaaattcctccggctgacatccctaagaacaaaaaactcctgaccgacgggtatgcatgcgaggtgcggtgccagaatatttaccttaccaccggatacgccggtagtaagaatggatccagggatcgcgcaaccgaactggccgtgaagctgctgcagaagcgcatcgaagtgagggtggtgcgtcggaagttcaaacatacattcggcgaagacctcgtggtttgtcaaatcgggatgagtagttatgagttccctcctgcattaaagcctccagaggacttggtggtgctggggaaagacgcatcgggacaacctatctttaatgcatcagccaagcattggactaattttgtgattactgagaatgctaacgacgctatcggtattctaaataactcagcctccttcaacaaaatgtccatcgaatataagtacgaaatgatgcccaatcggacatggagatgcagggttttcctccaggatcactgcctggcagagggctatgggacaaagaagacgtcgaaacatgctgctgccgacgaggcgctcaaaattttacagaagactcaaccaacttatcccagcgtaaagagtagtcagtgtcatacaggaagctcacccaggggatccgggaaaaagaaagacattaaggatttggtggtgtatgagaattcctccaaccccgtctgtactttgaacgacacagcccaattcaatcgaatgaccgtggaatacgtgtacgagaggatgacagggctgcgctggaaatgcaaagttatcttggaatccgaagtgattgccgaggctgtgggcgtcaaaaagaccgtcaagtacgaggccgcaggcgaggccgtgaagactctaaagaagacccagcccacagtgatcaacaatctcaagaagggcgcagtcgaggatgtgatttcccggaatgaaatccaggggcgatctgccgaggaggcatacaagcaacaaatcaaagaagacaatatcggcaatcagctactgagaaagatgggatggaccgggggaggcctggggaagtctggcgaaggcattagagagcccatctccgtgaaggagcagcacaagagagagggactcgggttggacgttgagcgcgtcaataagattgctaagagggacatagaacagatcatcagaaactacgccagatctgagagccacacagatctcactttcagccgcgagttgacaaacgatgaacggaagcagatccatcagatcgcccagaaatatggcctgaagtctaaaagccacggggtgggccacgacagatatctcgtggtggggcgaaagagacgtaaagaggatctgctggaccagttgaaacaggaagggcaagtgggccactatgagctagtcatgccgcaagccaattag

SEQ ID NO: 232624 - DNA, 570 bp, Artificial Sequence
  Description of Artificial Sequence: Synthetic coding sequence
atgttattaagagccgcatggcggcgtgctgctgtggcagtgactgcggctcctggcccaaagccagccgctccgacccggggtctgcgcttgagggttggcgatcgagccccacaatcagctgtgccagcagataccgccgcagcccctgaggtcggcccagtcctgaggccactctatatggacgtgcaggctacaactcccctggatcccagagtgcttgatgccatgctcccctacttgatcaactactacggaaacccccatagccggacgcatgcatatggatgggaatcagaggctgccatggagcgagcccgtcagcaagtcgcatccctgattggtgctgaccctcgtgaaataatttttaccagcggcgcaactgagagtaataacattgccattaagactgagtcccacagcgttatacaagccggtgtgcagtggcacgatcttgatagcctacaggcccctccacctgggtttacaccatttagctgtctgagtttactgagtagctgggattaccggaggccgccacctcatcctgccaactttctttacttttag

SEQ ID NO: 232625 - DNA, 1374 bp, Artificial Sequence
  Description of Artificial Sequence: Synthetic coding sequence
atgctgctgcgtgctgcttggaggcgggctgctgtggccgttacagccgcaccaggcccaaagccggctgccccaacccggggactgaggcttcgggttggtgacagagccccacaaagcgcagtacccgctgataccgcagccgctcccgaggtgggtcccgttctgaggcccctgtacatggacgtccaggccactacaccactagaccctagagtcctggatgcaatgttgccctatctcatcaattattacggaaatccacactcaagaacacatgcctacggctgggaatctgaggctgcgatggaacgagccagacaacaagtggcttccctgataggcgcagatcctagggagattatatttactagcggagccactgagtccaacaacatcgccatcaagggcgtggccaggttctaccgaagccggaaaaagcacctcataacaactcaaacggaacataaatgtgtgctggattcttgccgatccctggaagctgagggatttcaagtgacttatcttcctgtgcagaagtcgggcataatcgaccttaaggagctggaggcagccatccagccagataccagcctcgtgagtgtgatgacagtaaacaatgagataggtgtcaaacagccgattgccgagatcggacgaatctgttcatcgcggaaagtttattttcatacggacgccgctcaggccgtgggaaagattccactggatgtgaatgacatgaagatcgacctgatgagcatctccggacataagatctacggccctaagggcgtgggagcgatatatataaggcgtcgtcctagggtcagagttgaagccttgcaaagtggcggagggcaggaaaggggtatgaggagcggaaccgtaccaactcctcttgtcgttggacttggagcagcgtgcgaggttgcccaacaggaaatggaatatgatcacaagagaatttcaaagctgtcagagaggctgatccaaaatataatgaaatctctcccagatgtagtaatgaacggggacccaaagcaccactatccgggatgcatcaatctcagttttgcctatgtcgagggcgagtcactgctgatggcacttaaagacgtggcactgtcttccggcagtgcgtgtacctcagcttctctcgaaccttcatatgtcctgcgcgcaattgggactgacgaagacctggctcactcatcaattagattcggaattggacgctttaccaccgaggaagaggtcgattatacggtagagaaatgcatacagcacgtaaagagactgcgggaaatgagtcccctttgggaaatggtgcaagatggcatagatctgaagtctattaagtggactcaacattag

SEQ ID NO: 232626 - DNA, 486 bp, Artificial Sequence
  Description of Artificial Sequence: Synthetic coding sequence
atgctcctgagagccgcttggaggagggcggctgttgcagtgaccgctgcacctggcccaaagccggctgccccaacaaggggattgaggctgcgggtgggagatcgggcaccccaatctgctgtcccagctgacacagctgctgcccctgaggttggaccagtgctacggcctttgtacatggatgtgcaggcgacgactcctcttgaccctcgggttctggacgcaatgctgccttatctaatcaactattatgggaacccccattcgaggacacatgcgtatggttgggagagtgaggccgctatggaaagagcgcgacagcaggttgcatccctgattggggcagatccacgagagattatatttacatcaggagcgacagaaagtaacaacatcgccattaagggggtggctcgcttctacaggagccgcaagaaacatctcattactaccctgtctggtggtgccggtggttgcgtgtag

SEQ ID NO: 232627 - DNA, 768 bp, Artificial Sequence
  Description of Artificial Sequence: Synthetic coding sequence
atgacagtgaataacgagatcggggtcaaacagccaattgctgaaatcgggagaatttgctcctcccggaaggtttatttccacacggacgccgcacaggccgtcgggaaaattcctctggatgtaaacgacatgaagatagaccttatgtctatcagcggtcacaaaatctacggcccaaagggcgtcggcgctatctacattagaaggcgaccccgagtgcgcgtggaggccctgcagtctggagggggacaggagaggggaatgaggtccggaaccgtgccaactcctctcgtcgtgggactaggagctgcttgtgaggtagcacaacaggagatggagtatgatcacaagagaatttcgaagctgtcagagaggctgatccagaacataatgaaaagtctgcccgatgtagtgatgaatggggaccctaaacatcactaccccggttgtattaatcttagcttcgcatatgttgagggtgagtcactcctcatggccctcaaagatgtggcacttagcagtggatccgcatgcacctccgcctcactggagccatcatacgtgctgagggctatcgggaccgacgaggatcttgcacactcatctattcggttcgggattgggcgattcacaacagaggaagaggtggactatacggtggagaagtgcattcagcacgtaaagcgtttgagagagatgagtccactctgggagatggtccaggacggaatcgatctaaagagcattaaatggacgcagcactag

SEQ ID NO: 232628 - DNA, 1221 bp, Artificial Sequence
  Description of Artificial Sequence: Synthetic coding sequence
atgctacttcgcgctgcctggaggagggccgcagtggctgtgaccgcagcacccggtcccaaacccgctgcaccgactagaggacttcggctgagagtgggcgaccgggctccacagagtgccgtgcccgcagacactgcagctgctcctgaggtagggccagtgctgagaccactgtatatggacgtacaggccactacccccttagacccccgagtcctcgatgccatgcttccatacttgatcaattattatggaaacccacatagtcggactcacgcctacggctgggaaagcgaagcggctatggaaagagcccgacagcaagtcgcatccctcattggcgctgaccccagggagattatttttacaagcggggcaactgagagtaacaatattgcgatcaaagaacttgaagccgcaattcagccggatacttcattggtctctgtgatgacagtgaataacgaaatcggggtgaagcagcccattgctgagataggacgcatatgtagctcgcgtaaggtgtattttcatacagatgcggctcaggccgtgggcaagattccacttgacgtgaacgacatgaagattgatttaatgtctatttctggacataaaatctatgggccaaagggcgtgggcgcaatttatatcagacggagaccgagagtcagagttgaagcattgcaaagcggagggggtcaggaaaggggaatgcgaagtgggaccgttccaacccccctggttgttgggctgggcgctgcctgtgaggtcgcccagcaggagatggagtacgaccacaagaggatttcgaagctctcagaaagacttatacagaacattatgaaaagcctccccgatgtagtgatgaacggggatcctaaacaccattaccccggatgcatcaaccttagctttgcctacgtcgagggcgagtctttactgatggctctgaaagacgtggccctttcgagtggtagcgcctgtacatcggcttccctggagccttcctatgttctgagagccattggaaccgatgaagacctggcccattcttccattagattcggaattggtcgcttcacgacagaagaggaagtcgattatactgtggaaaaatgcattcaacacgtgaagaggcttcgcgagatgtcccctttatgggagatggtgcaggatggcatcgatttgaagtcgatcaagtggacgcagcattag

SEQ ID NO: 232629 - DNA, 693 bp, Artificial Sequence
  Description of Artificial Sequence: Synthetic coding sequence
atgcttaagaacccatacaccatcaaaaaacagcctctccaccagtttgttcagcggccactgttccctctgcctgccgcattttaccatccggtgaggtatatgttcatccagacacaggatacccccaacccaaacagccttaagtttatacctggaaagcctgtgctagagactagaacgatggactttcccacccctgcggctgcgttcagaagccccctggcgcgtcagctcttccgaatagagggcgtgaaaagcgtgttttttggtcctgacttcataactgtaactaaagagaacgaagaacttgactggaatttgctcaagcccgatatctacgcaaccatcatggacttctttgcctccggactgccgttagttaccgaggagacgccaagcggtgaggcaggatcagaggaggacgatgaagtcgtggccatgatcaaagagcttctcgatacccggatccgcccaacagtgcaagaggatggtggcgacgtgatttacaaaggcttcgaagatggcattgtgcaactcaaactgcaaggctcttgcaccagctgtccaagctccatcataaccttgaaaaatgggattcagaatatgctgcagttctacattccagaagtggagggggtggaacaggtaatggacgatgagtctgatgaaaaggaggccaatagcccctag

SEQ ID NO: 232630 - DNA, 342 bp, Artificial Sequence
  Description of Artificial Sequence: Synthetic coding sequence
atggactttttcgcaagcgggctgccattagttaccgaagagaccccctcaggcgaggccggttcggaagaagatgatgaagttgtggcaatgattaaggagttgctggatacccggatccggcctacggtgcaggaagatgggggtgacgtgatctacaaaggctttgaggacggaattgttcaacttaagctgcagggatcgtgcactagctgtccatcatccatcatcacacttaagaatggcatacagaatatgctccaattttatattcccgaggtggagggcgtcgagcaagtgatggatgacgagtcagacgagaaggaggcaaactccccctag

SEQ ID NO: 232631 - DNA, 765 bp, Artificial Sequence
  Description of Artificial Sequence: Synthetic coding sequence
atggccgctaccgcacgacgagggtggggcgcagccgctgtcgccgcaggattaagacgccgtttctgccacatgctgaagaacccctacaccatcaagaagcagccactgcaccagttcgtgcagcgccctctgttcccgctgccagccgctttttaccaccccgtaaggtacatgttcattcaaactcaggacacgcccaaccccaattctctcaaatttattcccggaaaacctgtgcttgaaactagaacaatggacttcccaacccccgcagccgcattccgcagtccactggcccgtcagctcttcaggatcgaaggggttaagagcgtttttttcggtcccgacttcataaccgtaaccaaagaaaatgaggagttagactggaacctgcttaagcccgatatttacgcgacgattatggacttcttcgccagtggtctcccgctcgtcaccgaggagacccctagtggagaggccggatccgaggaggacgacgaggtcgtcgccatgataaaggaactcctggacacacgcattcggcctaccgttcaagaagacgggggagacgtgatctataagggctttgaggatggtatcgtgcagctcaaactgcaaggttcatgtacaagctgcccttcctctatcattacactcaagaacggaattcagaacatgctgcagttttacattccagaggttgagggcgtggaacaggtcatggatgacgagagtgatgagaaggaagctaacagcccatag

SEQ ID NO: 232632 - DNA, 300 bp, Artificial Sequence
  Description of Artificial Sequence: Synthetic coding sequence
atggacttctttgcttcagggctgcccctggtaacagaggagacccctagtggcgaagctggcagcgaggaagatgatgaagtggtagccatgattaaggagctgctggatacgcgtatcagaccaactgtccaagaggacggcggtgacgtgatttacaagggttttgaagacgggatcgttcagctcaaactgcagggctcctgcacttcctgtccatcatcaattattaccctcaagaacggcatccaaaacatgttacagttctacattcccgaggtcgaaggggtagaacagtag

SEQ ID NO: 232633 - DNA, 342 bp, Artificial Sequence
  Description of Artificial Sequence: Synthetic coding sequence
atggatttctttgcctccggcctcccactggtcaccgaggagaccccctccggcgaggccggtagcgaggaggacgatgaggttgtcgccatgatcaaggaactcctggacacgagaattaggcctactgtccaagaggatggaggagatgtgatctataaaggattcgaggatggaatagtgcaactgaaacttcagggcagctgcacttcgtgtcccagctccatcatcacgcttaagaatgggattcagaatatgctgcagttttacattcccgaagtcgagggcgtggaacaggtcatggacgacgaaagtgacgaaaaggaggctaattccccctag

SEQ ID NO: 232634 - DNA, 291 bp, Artificial Sequence
  Description of Artificial Sequence: Synthetic coding sequence
atggatttcttcgccagcggcttgcccttagtgactgaggagactccttctggggaggcaggcagtgaggaggacgatgaggtggtggcaatgatcaaagaactcctggatacaagaattagacctaccgtccaagaagacggtggagatgtaatctacaaaggcttcgaagacggcatcgtgcagcttaagctgcagggaagctgcacttcgtgtccctctagtattattaccctgaaaaacgggattcaaaacatgttgcagttttacatccctgaagtagaggggtag

SEQ ID NO: 232635 - DNA, 1464 bp, Artificial Sequence
  Description of Artificial Sequence: Synthetic coding sequence
atggctgccgcactgccaaggactttgggcgagttgcagctgtatcgcatcctgcaaaaagctaacctcctaagctatttcgacgccttcatccagcagggcggtgatgacgtgcagcaactctgtgaggccggtgaagaggaatttctcgagattatggcgcttgtggggatggcctctaagcccctgcacgtgcggcgtctgcaaaaggccctgcgcgactgggtgaccaatcccggactgtttaatcagcccctaacatccctaccagtctcttctatcccgatctataagctgcctgaaggctctcccacttggctgggaatttcttgctcctcctacgagcgctcctcaaatgcacgcgaaccacatctcaaaattcccaaatgtgctgctactacgtgcgtgcagtctctggggcaaggcaagagtgatgttgtggggagtctcgcactacagtcagtgggggaaagccgactgtggcagggtcaccatgcaacagagtcagagcatagcctctcccccgcagatttgggatctccagcatcacctaaagaatcctcagaggctttggacgcagccgcagccctctccgttgccgaatgtgtggaaagaatggctccaaccctccctaagtcggatctgaacgaggtgaaagagctgcttaagactaacaagaagctcgcgaagatgatcggccatatcttcgagatgaacgacgacgatccacataaggaagaggaaattcggaagtactccgctatctacggcagattcgactctaagcggaaggacgggaagcacttgaccctgcatgagttgacggtgaacgaggccgcagcgcagttgtgcgtgaaggataatgcgcttctgacgagacgtgacgagttgtttgcccttgctaggcagatctcaagggaggttacctacaaatacacatacagaactacgaagtcgaagtgcggggagagggacgagctgtcgcccaaacgcattaaagtggaggacgggttcccagatttccaggacagtgtgcagactcttttccaacaggctagagcaaaatccgaagagctcgctgcactaagcagccagcaaccggagaaagtgatggccaaacagatggaattcttgtgcaaccaagcaggatatgagcgcttacagcacgctgagcgaagactgagtgctgggctctaccgacagtcttctgaggaacatagcccaaatggactgacctcagataatagcgatggtcagggcgagaggcctctaaacctgcggatgcctaacctccagaaccggcagcctcaccatttcgtcgtcgatggtgaactgagcagactataccctagcgaagccaaaagtcattctagcgagagtttgggaattctgaaggactacccacacagcgcttttacgttagaaaaaaaggttattaaaaccgaaccggaggactcaaggtag

SEQ ID NO: 232636 - DNA, 1377 bp, Artificial Sequence
  Description of Artificial Sequence: Synthetic coding sequence
atggctgccgcactgccgagaacccttggagagctccaactttataggatcctgcagaaggcgaacctgttatcctacttcgatgcctttatccaacagggcggagacgatgtgcaacagctttgcgaggctggcgaagaagaattcctggagatcatggcattagtaggcatggcaagcaagccactgcatgtgcggaggttgcagaaagccctgcgcgattgggttacgaatcctggcctattcaaccagccacttacaagtctacccgtatcctccattcctatttacaagctgcctgaagggagccccacttggcttggcatctcttgttcatcttatgaaagatcttcaaacgctcgagagccacacctaaagatcccgaagtgtgcagctaccacttgcgtgcagtcactggggcagggtaagagcgacgtggtgggctcccttgcgctgcagtctgtcggggagagcagattatggcagggacatcacgccactgagagcgagcatagtctgagtcctgccgacctcggctcacccgcatcccccaaggagagttccgaagctctggacgccgcagcagcgctgtcagtggctgagtgcgttgaacggatggccccaaccctgccaaagtccgatttgaatgaggtaaaagaactccttaaaacgaacaagaagctggcgaaaatgatcggacatatctttgagatgaatgatgacgaccctcataaggaagaggaaattagaaaatatagtgcaatctatggtaggttcgatagcaaacgcaaggacggcaagcacctgacactgcacgagcttaccgtcaatgaggccgcagcccagctttgcgttaaggacaacgcgctgttgacccgccgtgatgagctttttgctctggcaaggcagatttctcgggaggtgacatacaaatacacttaccgcacaaccaagagtaagtgtggcgagcgtgatgaactaagtcccaagcgtatcaaagttgaggatcagccggagaaggtcatggccaaacaaatggagtttctgtgtaatcaggcaggctacgagagactgcagcatgcagaacgtaggctaagcgccggtttgtatagacagtcatcagaggaacactctcctaacggcctgacaagtgataatagcgacggccagggagaaagaccattgaacttacgcatgcccaacctccaaaacagacagccccaccacttcgtagttgatggggagttgtcacggctgtacccaagcgaggccaagtcccatagtagcgaaagtctgggcatacttaaggactaccctcatagtgccttcacacttgagaagaaggtgattaagacagagcccgaagattccagatag

SEQ ID NO: 232637 - DNA, 1464 bp, Artificial Sequence
  Description of Artificial Sequence: Synthetic coding sequence
atggctgccgcattacctcgaacactgggcgagctacaactgtacagaattctccagaaggccaacctgctatcctatttcgatgccttcatccagcagggcggagacgacgtgcaacagctttgcgaggccggagaagaagaattcttggagatcatggctctggtcggcatggcatcaaagccacttcacgtacggcgactccagaaggccctgagggattgggtcaccaacccaggactatttaaccagcctcttacctccctgccagtgagttctattccgatctacaaacttccagaaggctctcccacctggctcggaatcagctgtagttcctatgagaggagttccaacgccagagaaccgcatttaaagatccccaagtgcgccgctaccacgtgcgtccaaagcctgggtcagggcaagagcgacgtcgtgggctctctggcattgcagagcgtcggcgaaagtagactctggcaagggcaccacgctactgaaagtgaacacagtctctcgccggctgacttgggcagtcccgcttctcctaaagaatcgtctgaggcattagacgccgctgccgcactaagtgttgcggaatgcgttgagagaatggcgccaactttacccaaatctgatctcaacgaagttaaggaacttcttaagactaacaaaaagttagccaaaatgattggccatatctttgagatgaatgatgacgacccacacaaggaggaagagatcaggaagtactcagcaatttatggcagatttgatagcaagaggaaggacggtaagcacctcaccctacacgaacttaccgtgaatgaagccgctgcccagctgtgcgtgaaggacaatgcccttttaactcgcagggacgaactgttcgcactagcgcgacaaatttcccgcgaagtgacgtacaaatatacctaccgaactacgaagagcaaatgcggcgagagggatgagctctcccctaagcgcatcaaggtcgaagatggttttcctgatttccaggacagcgtgcagaccctgtttcagcaggcgcgtgcgaagtcagaagagctggcagccctgagctcacagcagccagaaaaagtgatggccaaacaaatggaatttctctgcaatcaggccggatacgagaggttgcaacacgccgagcggaggctgtccgcgggactgtaccggcagtccagtgaggagcacagtccaaatgggctgacatcagacaattcggacggccaaggggaaagacctctgaacctgcgcatgcccaacctgcagaatagacaaccgcatcacttcgtggtcgatggagaactgtccagactttatccttccgaagccaagagtcattcctctgaaagtttgggaattctgaaggattatccacacagcgccttcacacttgagaaaaaggtgatcaagacagagccagaagatagcaggtag

SEQ ID NO: 232638 - DNA, 1461 bp, Artificial Sequence
  Description of Artificial Sequence: Synthetic coding sequence
atggccgcagctttaccaagaacactgggtgagctgcagttgtaccgcatcctgcagaaagcaaatcttctgtcctacttcgatgcatttattcagcagggtggagatgacgtccaacagctttgtgaggcaggagaggaagagttcttagagattatggccctagtgggcatggcaagtaagcctcttcatgtcaggcgcctccaaaaagctctcagggattgggttacaaatcccggactgttcaaccaaccactgacctcattgccagtcagttcaattcctatttacaaactgcccgagggtagcccgacgtggctcgggatcagctgtagtagctacgagcgtagttcaaatgccagagagccacacctgaagattccaaagtgcgcggctactacatgcgtacagtctctcggccagggcaagtctgatgtggttgggagtttagccttacaaagcgtgggagagagtcgtctgtggcagggccatcatgccacggagtccgagcatagtctgagccctgctgacttgggttctcctgcatcgcccaaagagtcttcagaagccttagacgcagctgcagccctctctgttgctgaatgcgtcgagaggatggcccctacactcccaaaatctgacttaaacgaagtgaaagagcttttgaagactaacaagaagcttgccaagatgattggtcatatattcgagatgaatgatgacgatccgcataaagaggaagaaatccggaagtatagtgccatctacgggagattcgactctaagcgaaaagatggaaaacatttaacactgcatgagttgactgtcaatgaggccgcagcccagctgtgcgtgaaagacaacgctttgctcaccaggcgcgacgaacttttcgcattagctcgacagatctccagggaagtcacctacaagtacacctacagaacaactaaaagtaagtgcggcgaacgggatgagttatctccgaagagaatcaaggttgaggacggattcccagattttcaggatagcgtgcagaccctgtttcagcaggctcgcgcaaagtccgaagagctggcagctctgagctcccagccggaaaaggttatggcaaaacagatggaattcctgtgcaaccaggccggatatgaacggctgcagcatgccgagcggcgtctgagcgcgggtctctatcgccaatccagcgaggagcactcacccaatggtttaactagcgataactccgacggtcagggtgagcgccctctcaatctgaggatgcccaacctccagaatagacagccccaccactttgttgtggatggggagctatcaagactttacccctcagaggctaagtcgcactcctccgagtccctggggatcttgaaggactatccccactcagcatttaccctggaaaaaaaagtgataaaaacagagcccgaagactcccggtag

SEQ ID NO: 232639 - DNA, 474 bp, Artificial Sequence
  Description of Artificial Sequence: Synthetic coding sequence
atggccgcagcactgcctcggaccttaggcgaactccagctgtaccgtattcttcaaaaggcaaacttgctgtcctattttgatgcgtttatacagcaagggggagacgacgtccagcagctctgcgaggccggagaggaggaatttcttgagattatggcccttgtaggaatggccagcaaacctctgcacgtgcgcaggctccaaaaagctctgcgcgactgggtcactaatcccggtttatttaatcaaccgctaaccagccttcctgtgtcgtccattccaatttataagttgccagaggggagcccaacctggctgggcatttcctgctcaagctatgagcgttcttcgaatgctcgtgaaccccatttgaagataccaaaatgtgccgctaccacatgtgtgcagagcttaggacagggtaaatcagacgtggtgggctccctggcattacaatcagtcggcgaatag

SEQ ID NO: 232640 - DNA, 189 bp, Artificial Sequence
  Description of Artificial Sequence: Synthetic coding sequence
atggccgctgcactaccacggacactgggtgaactgcaactctaccggatcctgcaaaaagccaatttacttagctactttgacgcgttcattcagcaaggaggggacgacgtgcagcagctctgtgaggccggtgaagaagagttcttggagataatggcactcgtgggaatggcatctaagccctag

SEQ ID NO: 232641 - DNA, 303 bp, Artificial Sequence
  Description of Artificial Sequence: Synthetic coding sequence
atggctgctgccttgcctagaaccttgggggagctgcagctgtatagaatcctgcagaaagccaacctactatcctatttcgatgctttcatccaacagggtggcgatgatgtacagcagttgtgtgaggccggagaagaggagtttttggagatcatggcgctggtgggcatggccagcaagccgctgcatgtgagaaggctccaaaaggccctgcgggattgggtaaccaaccctggactgtttaatcagccccttacctctctccctgtcagctccatacctatctacaaactaccatag

SEQ ID NO: 232642 - DNA, 723 bp, Artificial Sequence
  Description of Artificial Sequence: Synthetic coding sequence
tgaaaggaactgttgaaaactaataagaaactggcaaagatgatcgggcacatcttcgaaatgaacgacgatgatcctcacaaggaagaagaaatcaggaaatactctgccatttatggtaggtttgacagcaagaggaaggatggtaaacatctcacactccatgaactaaccgtgaacgaagccgcagcacagctgtgcgtgaaagacaacgctctcctcacacggcgagacgaactgtttgccctggcgcgacagatttcaagagaggtgacatacaaatacacttaccggaccacaaagtcaaaatgcggcgaaagagacgagctatctcccaaaaggatcaaagtggagcaacctgagaaggtgatggccaagcagatggaatttctatgcaatcaggcagggtacgaacgccttcagcatgctgagaggcgcctctcagctggactgtaccgccagagcagtgaggagcactcgccgaacggtctaactagtgacaatagcgatggacagggagagcgcccactgaatctcagaatgcctaatcttcaaaatcgacaaccccaccatttcgtggttgacggcgagctatcccgtctttatcccagtgaggcgaagagccatagtagcgagagtctcggcatactgaaggactacccgcatagcgctttcaccctggagaagaaggtgatcaagactgaaccagaggacagtcgttag

SEQ ID NO: 232643 - DNA, 459 bp, Artificial Sequence
  Description of Artificial Sequence: Synthetic coding sequence
atggctgccgcattgcccagaacactgggcgagttacaactctatagaattctccagaaggccaatctgctgtcttacttcgatgcgtttatccagcaagggggagatgatgtgcagcaactgtgcgaggccggagaagaagaatttctagagatcatggcccttgtcggtatggcttccaagcccctgcatgtgcggagactgcagaaagccctccgcgactgggtgactaacccgggtttgttcaatcagcctctaacgtcattgccagtctcctctattcctatttacaaactgccggaggggtcgcctacttggctggggatcagctgcagcagttacgaacgatctagcaatgccagagagccccacttgaaaatccccaagtgtgcagcaactacatgcgttcaatcccttggacagggaaagagtgatgttgtgggctccctggctctgtag

SEQ ID NO: 232644 - DNA, 684 bp, Artificial Sequence
  Description of Artificial Sequence: Synthetic coding sequence
atgataggacacatattcgaaatgaacgatgatgatccccataaggaggaagagataaggaagtattcagcgatatatggacggttcgactcgaagagaaaggatggcaagcaccttaccctgcatgagttgactgttaacgaagctgcggcacaactttgcgtgaaagataatgccctgctcacgcgcagggacgaactcttcgcactggcacgacagatttcccgagaggtgacatacaaatacacttacaggacaaccaagtctaagtgtggagaacgagatgaactttctcccaagcgaattaaggtggagcaacccgagaaagtgatggccaaacagatggagtttctgtgcaaccaagctggatacgagaggctacagcatgctgagcgccgtctatctgccggactataccgtcagtccagtgaagaacacagtccaaacggactaacttcggacaacagcgatggacagggcgagcgtcctctgaacctccgcatgccgaatttgcagaataggcaaccacaccacttcgttgtagacggtgaactgtctcgcctctatcccagtgaggccaaaagtcacagtagcgagtctctcggtattttgaaagattatccccattccgcgtttaccttagagaaaaaagtgatcaagacagagcctgaagacagccgctag

SEQ ID NO: 232645 - DNA, 1578 bp, Artificial Sequence
  Description of Artificial Sequence: Synthetic coding sequence
atgcaccgggctcctagtcccaccgccgaacagccgccaggtggtggagacagcgctcggaggacgctgcagccacgactgaaacctagcgctcgagccatggccctgcctagaactctcggagaactgcaactgtaccgcgtacttcagcgggctaatctgctttcctactacgaaacttttatccaacagggtggagatgacgtccaacagctctgtgaagcaggagaggaggaatttttggagattatggcattggttggcatggccacgaaacccttacatgtgagacggctgcagaaggcacttagggaatgggccacaaatcctgggctgttttctcagcctgttcccgcagtcccagtgtcatccataccactgttcaaaatttctgagaccgccggtaccaggaagggtagtatgagcaacggacacggtagtccaggcgaaaaggctggcagcgcacggtcttttagccctaaatccccccttgagctgggcgagaaactgagccctttacctgggggtccaggcgctggggaccccagaatctggcctggacggtcaacccccgaatctgacgtaggtgctgggggagaggaagaagcgggaagtccacccttttctccacctgccggaggaggagtgcctgaagggacgggagcaggagggctcgccgctggcggtacgggaggcggaccagaccgtcttgagcctgaaatggtccgaatggtggtggagagcgtagagcgcatcttcaggtcctttcccaggggcgacgctggggaggtcacctctctgctaaaactgaacaagaaactggcaagatctgtgggccatatattcgagatggatgataacgatagtcaaaaggaagaggagatccggaaatattcaatcatatacggcagattcgattctaaaaggagggaaggcaagcaattgagccttcacgaactgacaatcaacgaggctgccgctcagttctgcatgcgcgacaatacactcttattgaggcgcgttgagttgttcagcctgtcaagacaagtggccagggagtctacttacctgtcctctcttaagggatcccgcctgcaccctgaggagttgggcggtccccctctaaagaagcttaagcaagaagtcggggagcaaagtcaccctgagattcagcaacctcccccaggtcctgagtcctacgtacccccttatcgcccttcactggaggaggattccgcctctctgtcaggagagtccttagatggacacctccaggcagttggctcatgcccaagactcaccccgccaccagcagatctgcccctcgcgttacctgcgcacggtctgtggtcacggcatatcctccagcagactctcatggatgaggggttgcgacttgcacgtctggtatctcatgaccgggtgggcagattgtccccctgcgttcccgctaagcctccactggcagagtttgaggagggcctgttggaccgctgtcccgcacccggaccacatcccgctctcgtcgaaggcagacgctcctctgttaaggtggaggctgaggcctcacggcaatag

SEQ ID NO: 232646 - DNA, 1386 bp, Artificial Sequence
  Description of Artificial Sequence: Synthetic coding sequence
atgcacagggccccttcaccaaccgccgaacagcccccaggtggcggagactcagctcggcgaacactgcagcccagacttaagcccagcgcgcgagcaatggccctgcctagaactctaggcgagcttcagctgtaccgtgtgctgcagcgggcaaatctactgagctattacgaaacttttattcaacaaggaggcgatgacgtgcagcagctctgtgaggccggagaggaggagtttctggaaatcatggctctggtaggtatggcaacaaagccgttgcatgtgcgcagactgcagaaggcgctacgagagtgggcgacaaatccgggtttgttttcccaacccgtgcccgctgttcctgtttcttcaatacctcttttcaaaatcagtgaaacggccggtacccgcaagggttccatgtctaatggtcacggaagtcccggagaaaaagctggcagcgctcgcagtttcagccccaagagcccactggaactgggggaaaagctttccccccttcctgggggacccggagccggtgatccacggatctggcctggccgatctacccctgaaagcgatgttggcgctggcggtgaggaggaggccggatccccccctttttctccccctgcgggaggcggtgtccccgaagggactggcgcagggggactagcagctggcggaaccggaggtggtcccgatcggcttgagccagagatggtcagaatggttgtggagagtgtcgaaaggatcttccgaagcttcccgaggggagacgctggtgaggttacgtctttactgaagctgaacaaaaagctggcacggtcagtaggacatatctttgaaatggacgacaatgacagccaaaaggaggaggaaatccggaagtatagtattatttacggcagattcgactccaagagacgtgaagggaaacagctgagcttgcatgagctgaccatcaatgaggcggctgctcaattttgcatgcgggacaacaccttactgctcagacgcgtagaactgttcagtctctctagacaggtggcacgagagtctacatatctgagcagcctaaaaggctcccgattgcaccccgaggaactgggaggccctccactcaagaaactgaagcaggaggtgggggaacagtcccatcccgagatccagcagccaccaccaggtcctgagagctacgttcccccttacagacctagtctggaggaagacagcgcaagcctcagcggtgagagtctggacggtcaccttcaggagttcgaagaagggctccttgatcgctgccccgctcctggcccacacccggcactagtggagggccgtagaagctcagttaaggtggaggctgaagcttctcggcagtag

SEQ ID NO: 232647 - DNA, 969 bp, Artificial Sequence
  Description of Artificial Sequence: Synthetic coding sequence
atgcacagggccccttctcccacagccgaacagcctccaggtggcggagatagtgcccgaaggactcttcagcctaggctaaagccaagcgctagggcaatggccctgcccaggactctgggagaactacagctctatcgggtgttgcaacgagctaatctcctctcatattacgagacgttcatccagcagggaggggacgacgtgcagcagttatgtgaggctggcgaggaagaattcctagaaataatggccctagtgggtatggcaactaagccacttcatgttcgccgacttcagaaagcgctgagggagtgggccaccaaccccggtttgttctcccaacctgttccagcggttcccgtgagttcgatacctctattcaaaatatctgagacagccggaaccagaaagggctcaatgagtaacgggcacggaagccccggagagaaggcgggttctgcacggagctttagccccaagtctccactggagctgggggaaaagctttcaccacttccaggtgggcctggggcaggggacccaagaatttggcccggacgctctacacccgaaagcgatgtcggcgctgggggtgaggaggaagccggatccccacccttttcaccccctgccggtggcggtgtgcctgagggaaccggggcagggggtttagcggctggcggtacaggcggtgggccagaccgcctggagcccgaaatggtgcgcatggttgtcgagagtgtggaacgaatttttcgctccttcccgaggggagacgctggcgaagtgacaagtttgttgaagctcaataaaaagcttgcacggagtgtcggacacattttcgagatggatgataacgacagtcagaaggaggaagaaatccgaaagtatagcatcatatacggcaggtttgatagtaaaaggagagaaggtaaacagctctcactgcatgaggcctctccctag

SEQ ID NO: 232648 - DNA, 723 bp, Artificial Sequence
  Description of Artificial Sequence: Synthetic coding sequence
tagagtgggtcagcctcgcccgcagtggccgaactgtgtcagaacacacctgaaacattcctggaagcaagtaaactcctcctcacctatgctgacaacatccttaggaatcctaacgacgaaaaatacagatctatccggataggtaatacggctttttccaccagactactaccagtgagaggggcagtggagtgcctatttgagatggggtttgaagagggggagactcatttaatctttcctaaaaaggcctctgtggagcaactccaaaagatccgagatctgatcgcaattgagcggtcctctcgcctggacggttccaacaaatcacacaaagtgaagtccagtcagcaacccgcagcatctacacagctcccaacaacaccctccagcaacccaagcggcctcaaccaacatacccgtaacagacaggggcaaagcagcgacccgccatcagcaagtacagtcgccgctgattccgccattcttgaagtgcttcagtctaacatacaacacgttttggtgtacgaaaaccccgcactgcaggagaaggctcttgcctgcataccagtccaggagctgaaacgcaagagccaggaaaagctatcccgagcgagaaagctggacaaagatatcattacgctccggaatttctggaaacaagacgtagacggagtcgcgtccggcccaatcgttctgcactgcgccgcagaactatag

SEQ ID NO: 232649 - DNA, 1965 bp, Artificial Sequence
  Description of Artificial Sequence: Synthetic coding sequence
atggccgctgccgcattgggtagttcctcaggctccgcctcgcccgcagttgctgaactgtgtcagaataccccagagacctttttggaggcgagtaaattgttgttgacttacgcagacaatattctgagaaaccctaacgatgaaaaatatcggagcatacgcattgggaatacagcattttcaacacgcctactgcccgtgagaggggctgtcgaatgcctgtttgagatgggtttcgaggagggtgagactcatctgattttccccaagaaagcatccgtggaacagttgcagaaaatcagagatctcatcgcaatagagcggagttctcgactcgacggatccaataaatcccacaaggttaaatcaagtcagcagccagccgcaagtacccaattgcctacgactcctagttccaacccatcaggactgaaccaacacacccgcaacagacaagggcagagctccgacccgccttctgcaagcaccgtggccgcagattcggccatattggaggtcctccaaagcaatatccagcatgtcctggtatatgagaaccccgctctccaagagaaggccttagcatgcattcccgtccaggagctcaaacgcaagtctcaggaaaagctttcacgagcaagaaaactcgataagggcatcaacatcagcgatgaagactttctcctcctggagctgcttcattggtttaaggaggagtttttccactgggtaaataacgtgctttgttccaaatgtggtggtcaaacccgcagtcgcgaccgctccctcctgccatctgatgatgagctgaagtggggtgccaaggaggtagaagatcactactgcgacgcctgccagttctccaataggtttccacggtacaataatcccgaaaagctgctggaaacaaggtgcgggaggtgtggtgaatgggcgaactgctttacactgtgttgtcgcgctgtaggcttcgaggctagatatgtctgggactacaccgatcacgtctggaccgaggtctactcaccgtcccagcagcgctggttgcactgcgatgcttgcgaggatgtgtgcgacaaaccccttctttatgaaattggatgggggaagaaattatcatacgtgatcgcattctccaaagacgaggtagttgacgtgacctggcgctatagctgcaagcatgaggaggtgatcgcccgtcgtaccaaggtgaaggaggcactgttaagagacactatcaatgggttgaataagcagcgacagctttttctgtcagaaaatagacgaaaagagcttcttcaaagaattatcgtggaattagtggagttcatctctcctaagacccctaagcccggtgaacttggcggtcgaatcagtggcagtgtggcgtggagagttgcccgaggcgagatggggctacaacggaaggagacactgtttataccttgtgaaaatgaaaaaattagcaagcagctgcacctgtgctataacatcgttaaagaccgctacgttcgagtcagtaacaataaccagacgatttccgggtgggagaacggggtgtggaagatggagagcatctttaggaaagttgagactgactggcacatggtctatctggccagaaaggaaggtagctccttcgcctacatttcctggaagttcgagtgtggttcagtgggcctgaaggtggattctatatccattcggactagctcccaaaccttccagacaggtaccgtggaatggaaacttcggtcagatacagcccaggtggaactcactggagacaattctcttcactcctatgccgactttagcggagccactgaagttattctcgaggccgagctgagccgaggcgatggcgatgtggcttggcagcatactcaactgttcagacagagtctgaatgatcacgaggagaattgcctcgagattatcattaaatttagcgatctttag

SEQ ID NO: 232650 - DNA, 1902 bp, Artificial Sequence
  Description of Artificial Sequence: Synthetic coding sequence
gccgctcttggttcctcatccggtagtgccagccctgctgtggccgagttgtgtcagaacaccccagaaaccttcctcgaagcctctaaactgctgttgacatatgccgacaacatcctgcggaatcccaatgacgaaaagtaccgctccatccggataggtaatactgccttttctacaaggcttctgccggtccgcggtgcggtggaatgcttatttgagatggggtttgaggagggggaaacacatcttatttttcctaaaaaagcaagcgtggagcagttgcagaagattcgagacctcatcgcaatcgagaggtccagtcgactggatggcagtaacaagtcgcacaaggttaaaagcagccagcagccagccgctagtacgcaattgcctaccactccaagttctaaccctagtggcttaaatcagcatactaggaaccgacaggggcagagcagtgatccgccaagcgcaagtactgttgccgctgacagcgctattctggaggtcctgcagagcaacattcaacatgtgctggtctacgagaatccagcactacaagagaaggcgctggcctgcattcccgtgcaggaactgaagaggaaatcccaggaaaagctgtcaagagctcggaaactcgacaagggtatcaacattagcgacgaggactttttgctcctggagctgttgcactggtttaaggaggaattcttccattgggtcaacaatgtgttgtgttcaaagtgtggaggacagacccgcagcagggataggtcgctgctgccaagcgacgacgaactcaaatggggcgctaaggaggttgaagatcactattgtgacgcatgtcagttttctaaccggttcccccgttataataaccccgagaagctccttgagacacgatgcggtcgctgtggcgaatgggcgaactgcttcactctctgctgcagagcggttggcttcgaagcaaggtatgtctgggattatactgaactgcagaggaccctttctctgaagcttactacccttaaggaaatcggtaaaaccttcctgaggatctccaagcggcagaagctgatacaggtggtggacgtgacgtggcggtactcatgtaagcatgaggaagtcatcgcccgtcgcacaaaagttaaagaagctctcttgcgggacactattaacggcctaaacaagcagagacagctgttcctgtcagaaaatagacgcaaggagctactgcagaggatcattgtcgaactggtggaattcatcagcccgaaaacccctaagcctggagagctgggtggaaggatctccggcagcgtggcctggagagtggctaggggcgagatgggtctgcaacgcaaggaaacactctttatcccgtgcgagaacgaaaagatttctaagcagctgcacctatgttataatatagtcaaggatcggtatgtgcgggtgtccaataataatcagaccatttccgggtgggagaatggggtctggaagatggagagtatctttcgcaaggtagagacagactggcacatggtttaccttgcaaggaaagaggggtcttcattcgcctacatttcatggaagtttgagtgcggtagtgtagggttgaaggtagatagcatcagtatccggacgagttcccaaacgttccagacaggcaccgttgaatggaagctcaggtcagacaccgctcaggttgagctgacaggtgataattctcttcattcttatgctgatttcagtggggcaaccgaggtcattctggaggccgagctgagcaggggcgacggcgatgtcgcatggcagcatactcagctgtttcgccagtctctgaatgatcacgaagaaaactgcctggagataatcattaaattttcagacttgtag

SEQ ID NO: 232651 - DNA, 1677 bp, Artificial Sequence
  Description of Artificial Sequence: Synthetic coding sequence
atggcagctgctgcccttggatcctcttcaggttcagcctctccagctgtggccgaattatgtcagaatacaccggagacttttctcgaagcctctaaattgcttctgacgtacgccgataacattctgcgcaaccctaacgatgagaagtatcgaagcattcggatcgggaacaccgcatttagcaccaggctcctcccggtccggggtgccgtagagtgtcttttcgaaatgggtttcgaagagggcgagacacacctgatcttcccaaaaaaggcatccgttgaacaactgcagaaaattagagacctcatcgctattgaacgctcctcacggctggacggatctaataaatcccataaagtgaaatctagccaacagccggcagcttcaacacagttgcccacaactccctcttcaaatccgtctgggctgaaccagcacacaaggaaccgacagggccagtcatccgatcctccttccgccagcactgtcgccgctgatagcgccatcttagaggtgctgcagagtaacatccagcacgtgctggtctatgaaaatcctgctttgcaggagaaggcattagcttgcatacccgtccaggaattgaagcgcaagagtcaggaaaagctgtcaagggccaggaagctggacaaggggattaacatcagtgatgaggattttctcttgctcgaactactgcactggtttaaagaagagtttttccattgggtgaacaacgtactctgtagtaagtgtgggggtcagacgcgtagcagagatcggtcgctcctcccatcggacgacgaattgaaatggggagccaaggaggttgaggaccactactgcgacgcctgtcagttctccaatagattccctagatacaataatccagagaaacttctggagacccgatgtggcaggtgcggagagtgggccaattgctttacactgtgttgccgggcagttgggtttgaggcacgatatgtttgggattacacagaccacgtttggacagaggtgtattccccaagtcaacagagatggctgcactgtgacgcctgtgaggacgtctgtgataagccactgctgtatgagattgggtggggcaaaaagctgtcatatgtgatcgctttctccaaggatgaagtggtggatgtgacatggagatattcgtgtaaacacgaggaagtgatcgccaggcgaaccaaggtgaaggaggccctactccgagatactatcaacggattaaataagcagaggcagctttttctctcagagaatcgcagaaaagagttactacagaggataatcgttgaactcgttgagtttatttcccctaaaactccaaaaccaggggaactcgggggtcgcatctccggctctgtagcttggagagtggccaggggagagatgggccttcagaggaaggaaaccctctttatcccatgtgaaaacgaaaaaatcagcaagcagctgcatctctgttataatatcgtcaaagacaggtatgtgagagtttcaaacaacaatcagaccattagcggttgggagaatggtgtctggaaaatggaaagcatcttcagaaaggttgagacagattggcatatgattacggttttcacccccatgctaatttttctggtcccccttaaacttttctggaaacagaattag

SEQ ID NO: 232652 - DNA, 1839 bp, Artificial Sequence
  Description of Artificial Sequence: Synthetic coding sequence
atgcggaatccaaacgacgagaagtaccgctctattcgaatcggaaatactgcgttcagtactagactgctgcccgttcgaggggctgtggaatgtctgtttgaaatgggatttgaagagggagagacacatctaatttttcccaagaaagcctcggtggaacagcttcagaagatccgtgatctgatcgcaattgagcgaagctcacgattggatggatccaacaagagccacaaggtgaagtcctcccagcagcctgcagcgtccacacaattgcctactactccttcttccaatccaagcgggctaaatcagcatacccgaaaccgtcaggggcagtcgtcagacccgccttccgcttccacagtggcagctgatagtgcaatattagaggtgctccagtctaacatccagcatgtcttggtatacgagaatccggctttgcaggagaaagctctggcctgcattccagtgcaggaacttaagcgaaaaagccaggaaaaactgtcacgtgccagaaagctggataagggaattaacatctccgacgaggactttttgttgctggagctcctccattggttcaaagaagagttttttcattgggtgaataacgtgctctgttcgaagtgcggaggacagacccggagcagagatcgcagtcttttgcctagcgatgatgagctgaaatggggagccaaagaggttgaggatcactactgtgacgcttgtcagttctccaacaggtttccccgatacaataatcctgaaaagctgctggagacgagatgcggcaggtgtggcgagtgggcaaactgctttaccctgtgctgcagggcagtcggattcgaggcacggtatgtatgggactacactgaccacgtttggacagaggtctattctccatcgcaacagcgttggttgcattgcgatgcctgcgaggatgtatgcgataagccattgctctatgagattggctggggaaagaagctgtcctacgttattgccttttctaaagatgaggtcgtggacgtgacctggcgatattcctgtaagcatgaagaagtaatcgccagacgaacgaaagtcaaagaggcacttctgagggacactattaacgggctcaataaacagcgacagctatttcttagcgagaatcgcagaaaagagctcctgcagagaatcatagtggaactggtcgagttcatctcacctaagacaccaaaacctggagagctcggaggaagaattagcgggtccgttgcctggcgtgtggcgagaggggagatgggactgcagcgaaaagagactctgtttattccttgtgagaacgaaaagatatcgaagcagctccatttatgttacaatattgtgaaggatcggtatgtgcgcgtgtccaacaataaccagaccatttccggctgggagaatggggtgtggaagatggagagcattttccgcaaagtcgaaactgattggcacatggtatacctggcacgaaaggagggaagtagcttcgcctacatctcctggaagtttgagtgtgggagtgttggactaaaggtagattccatttcaattcgcacctctagccagactttccagacaggcacagtcgagtggaaattgcgcagcgatacagcccaggttgagctgacgggggataacagcttgcactcctacgctgatttctctggggcaacagaggtgatccttgaagctgagctgagccggggtgacggagatgttgcctggcaacatacacaactattccgccaaagcctcaatgatcacgaggaaaactgcctggagattatcattaaattctcagatctctag

SEQ ID NO: 232653 - DNA, 516 bp, Artificial Sequence
  Description of Artificial Sequence: Synthetic coding sequence
atgggcttcgaggagggtgagacccacttgatatttcccaagaaggcctcagtggagcagcttcagaagatccgggacttaatcgctattgagcggagtagccgccttgatggcagcaacaagagccacaaggtgaagtctagccagcagccggcagctagcacccagttgcctactactccctcctccaatccatccggacttaatcagcatacacgaaacagacaggggcagtctagcgaccctccatccgcatctactgttgcagctgacagcgcaatcttggaagttctccagtccaacatccaacacgtgctagtgtatgagaatccagccctccaagagaaagcactggcgtgtattcccgtccaggaattaaagcgaaaaagccaagaaaaactttcacgcgctagaaagctcgataaagacattatcactctccggaatttttggaaacaggatgttgatggagtggcctccggaccaatcgtgttgcactgtgcagctgaactgtag

SEQ ID NO: 232654 - DNA, 1911 bp, Artificial Sequence
  Description of Artificial Sequence: Synthetic coding sequence
atggctgcggcagctctgggctcctcaagtggaagcgcgtcacctgccgtggctgagctctgtcaaaacacccctgaaacctttctggaagcaagcaaactgctgttgacgtatgcagataatatactgaggaatccgaatgacgaaaagtatagatccatacgcatcggcaataccgctttcagcacccgcctgcttcctgtgagaggggctgtcgagtgtctcttcgaaatgggatttgaagaaggggaaacccatctcatttttccgaagaaagctagtgtcgaacagcttcagaaaattagagacctgattgcaattgagcggagttcaagactcgacgggagcaataaaagtcacaaagtgaagagcagccaacagcctgctgcaagtacacagctcccaacaaccccatcctctaatccctccggactgaatcagcataccaggaataggcagggacaatcttctgatcccccttccgcgagcactgtggcagccgactccgcaatactcgaggtcttacagagcaacattcagcacgttctggtctacgagaacccagccctgcaggagaaagctctagcctgcataccagtgcaggaattgaagaggaaaagccaggagaaactcagcagagccagaaagctggataaggggataaacatttccgatgaggattttctccttctggaactgttgcattggtttaaggaggaatttttccattgggtgaacaatgtcctatgttccaagtgtgggggacaaacccggagtcgcgacaggagcctgctgccatctgatgacgagcttaaatggggggcaaaagaggtggaggaccactactgtgacgcatgccaattcagcaataggttccccaggtacaacaatccagaaaaactactcgagacaagatgtgggagatgcggggagtgggccaattgttttactctgtgctgccgggcagttggcttcgaagccaggtatgtgtgggactatactgagctgcagagaactctgagcctcaaacttactactctcaaggagattggtaagacgttcttacgcatctccaaaaggcagaaattgatccaggtggtcgacgtgacgtggagatatagttgcaaacacgaagaggtgatcgctagaagaaccaaagtgaaagaagcgctgcttagagatacgataaatggcctgaataagcagcgccagctgtttttgagcgaaaataggagaaaggagcttctccagcgaattatagtcgagctagtcgagtttatctccccgaagacgccaaagcccggagagttgggcggtcggattagcggaagtgtagcttggcgggtggcgaggggagagatgggactgcagaggaaggaaacgcttttcatcccatgcgaaaacgagaagatcagcaagcagctgcacctgtgttacaatatcgttaaggatcggtacgtaagggtctctaacaacaaccagactatcagtggatgggaaaacggcgtctggaagatggagtcaatatttcggaaggtggagaccgattggcacatggtctatctcgccaggaaggaagggtcatccttcgcctatatcagctggaagttcgaatgtggttctgtcggactgaaagtggactcaatttccatcagaacctccagccagacctttcaaaccggcacagtggagtggaaactaagaagcgatacagcgcaggtagaacttaccggcgacaatagtctgcattcttacgctgatttctccggcgcaacagaggtcatcctggaggctgaactcagccggggtgatggagacgtggcctggcagcacacccagctcttcagacaatcattaaatgatcacgaggagaattgcttagagattataataaaattcagtgacctttag

SEQ ID NO: 232655 - DNA, 1188 bp, Artificial Sequence
  Description of Artificial Sequence: Synthetic coding sequence
atggcagccgaggcttccgagagcggaccagcattgcatgaattgatgcgggaggccgagatcagcctgttagaatgcaaagtctgctttgagaaattcgggcaccgccaacaacgtcgtccccgaaacttgagctgtggacacgtcgtctgcctcgcctgtgtcgccgcactggcacatccccgaaccttggccctggagtgtcccttttgtagacgggcatgtagagggtgtgacacatccgattgcctccctgttcttcatcttattgaactgctggggtcagctctaagacagtcccctgccgctcatagggcagccccaagcgccccaggggctcttacctgccatcacacctttggaggctgggggacccttgttaatcctactggccttgccttatgccctaagaccggcagggtcgtggtagttcacgatgggcgtaggcgcgtgaaaatcttcgattcagggggaggctgcgcccaccagttcggtgagaaaggcgacgccgctcaagacatcaggtatcccgtggatgtcacaattacgaacgattgtcacgtcgtggtgactgacgctggggataggagtatcaaagtttttgactttttcggccagatcaaactggttatcggtggccagttctctttaccttggggagttgagaccacccctcagaatggaatcgtggtgaccgatgctgaagctgggagtctgcacctgctggatgtggacttcgccgagggggttctcaggcggactgaacggctgcaggcccatctgtgtaatcccaggggggtcgccgttagctggctgacaggagctattgcagttctcgaacatcctctggccctggggaccggagtctgcagtacccgtgtaaaggtatttagctccagcatgcagttagttgggcaagtggacactttcgggctcagcctgtattttccaagtaagattaccgccagtgccgtgacttttgatcatcagggcaacgtgattgttgctgatacgagcggcccagctatcctgtgcttggggaaaccggaggagtttcccgtgccgaaaccaatggtcacccatggattatctcatccagttgccctcactttcacaaaagaaaactccctcctggtccttgacaccgcttctcattcgatcaaggtgtacaaggtggactggggctag

SEQ ID NO: 232656 - DNA, 903 bp, Artificial Sequence
  Description of Artificial Sequence: Synthetic coding sequence
atggctgctgccgcaggcgacgctgacgatgaacccaggtccggccacagttcttcagaaggagaatgtgccgttgcacctgagcccctcactgatgcagagggtctattctccttcgcagatttcggtagtgcactcggaggcggtggcgctgggctctccggcagggcatctggtggcgctcagtcccctttgcgttatctgcacgtcttgtggcagcaggatgctgaacccagagatgagctgagatgtaagatccctgctggtaggttgcggagggcggcaagaccccatcgcagactgggtcctaccggcaaggaggtgcatgcgctgaaaagactgcgcgacagtgccaacgctaatgatgttgaaaccgtccaacagctcctcgaagacggagccgacccatgtgcagctgacgataaaggacgtacagcgctgcactttgcatcttgcaacggcaatgaccagatcgttcagctcctactagaccatggtgctgaccccaaccaacgggacggactcgggaataccccgttgcaccttgccgcatgcaccaatcacgtcccagtgatcactacactgctaagggggggagccagggttgacgctctcgacagagccggtcgaacccctctgcacctagccaagtccaaactaaacatcctccaggaaggacatgcccaatgcctggaagcagtgagacttgaggtgaagcagataatccacatgctcagagagtatttggaaagactgggccagcacgagcagcgtgagagactggatgacctatgcactcggctacaaatgactagcacaaaggaacaggtggatgaggtgacagacctgctggcctccttcacaagcctgtcactccagatgcagtctatggaaaagaggtag

SEQ ID NO: 232657 - DNA, 387 bp, Artificial Sequence
  Description of Artificial Sequence: Synthetic coding sequence
atgacagaggccgatgtaaaccccaaggcatatcctctcgccgatgcacacttgaccaagaaactcttggatctggtccaacagagttgcaattacaagcagcttaggaagggcgcaaacgaagcaacaaaaactctcaatagaggtatttctgagtttatcgtcatggcagccgatgccgaaccactagaaataattctacatctcccgttattgtgcgaagacaagaacgtaccctatgtatttgtaaggtcgaagcaggctctgggtcgtgcttgcggtgtttcgagacctgttattgcatgctccgttacaatcaaagagggctctcagctgaaacagcagattcaatccatacagcagtcaatcgagcgcttgttagtgtag

SEQ ID NO: 232658 - DNA, 387 bp, Artificial Sequence
  Description of Artificial Sequence: Synthetic coding sequence
atgactgaggccgacgtaaatcccaaagcgtacccactcgctgatgctcacctgaccaagaaattgttggatcttgtccagcaaagctgtaactataaacagttgagaaaaggcgctaatgaagccaccaagacactgaaccgcggaatttccgaattcattgtgatggccgctgacgctgagccgctagaaattatccttcacctacccctcctgtgtgaggacaagaacgtgccctatgtcttcgtacggtccaagcaagccctgggtcgggcttgtggtgtgtcgcgtccagtcatcgcgtgctcagtcactatcaaggaaggctcccagctgaagcagcagatacagtctattcaacagtcaatcgagagattgcttgtttag

SEQ ID NO: 232659 - DNA, 399 bp, Artificial Sequence
  Description of Artificial Sequence: Synthetic coding sequence
atgctcctggttcaaactgaagctgacgttaaccccaaggcctatcccctcgctgacgcccaccttacgaagaagctccttgacctcgtgcaacagtcttgcaactacaagcagttaaggaagggtgccaatgaggctacaaagactctgaacagaggcatctctgaattcatcgtaatggccgctgatgccgaaccattggaaatcattttgcatctccctctgctgtgcgaggataagaacgtcccgtatgtctttgttcggtcgaagcaggcattaggcagagcttgtggggtctctcgtccagtgatcgcctgttcagttacaataaaggagggcagccagctcaagcaacaaatccagtccatccagcaatccatagaacgattgcttgtgtag

SEQ ID NO: 232660 - DNA, 2130 bp, Artificial Sequence
  Description of Artificial Sequence: Synthetic coding sequence
atggcaaccgcaggtgggggatccggggctgaccctgggtctaggggtctgctgcgcttgttaagtttttgtgtcttgctggccggactgtgtcgaggcaattccgtggaacggaaaatttacatccccctcaataagaccgcaccgtgtgttcggctgctaaacgcaacccatcagatcggttgccagagcagcatctcaggagataccggcgtcattcacgtcgttgaaaaagaggaggacctgcaatgggtgttgaccgatggacccaacccaccctacatggtgctgctcgagagcaaacattttacaagagatctgatggaaaaattaaaaggacgaacctctcggatagccggactggctgtctctcttactaaaccctctccggcaagtgggttttccccatctgtacaatgccccaacgatggcttcggtgtctatagcaattcatacgggcctgagttcgctcattgtcgggagatacagtggaatagtttgggcaatgggctcgcctatgaagatttctctttcccaattttcctgctcgaagatgagaacgagacaaaggtgatcaagcagtgctaccaagaccataatctgtcccagaacggttcagctccaacctttcccctttgtgccatgcagctcttctcgcacatgcatgctgtgatatctactgctacatgtatgagaaggagctccatccagagcaccttctccattaatcccgagatcgtgtgcgatcctctttccgactacaacgtgtggtctatgctgaagcccatcaataccacgggcacactcaaacccgatgatcgcgtcgttgtggctgccactaggttggattctcggtctttcttctggaatgtagcccctggtgccgaatcagctgtggcctctttcgtgacccagctggctgcggcagaggccctgcagaaagctccagatgtgaccactttgcccaggaacgttatgtttgttttcttccagggggagacgttcgattatatcggcagctcaaggatggtttacgacatggagaagggaaagtttccagtgcagttggaaaacgtggattcattcgtggaattagggcaggtcgctctaaggacgtcgctggaactctggatgcataccgatcctgtgagtcaaaagaacgaatcagtgaggaatcaagttgaggatttgctagccactttagaaaagtcgggggcaggcgttcctgccgtgatcctgcgccgtcctaaccagtctcagcctctgcctcctagctccttgcaaagattcctgagagcaaggaatatttccggcgtggtcctcgccgatcattcaggggcatttcacaacaagtattatcaatcaatctacgacacagccgaaaatatcaatgtgtcctaccctgagtggctgtctcctgaggaggatctgaattttgtaactgataccgccaaggccctggcagatgtcgccacagtcttgggacgcgcactgtacgaacttgcgggaggcaccaacttctccgataccgttcaagctgaccctcagaccgtgacccgactgctttatggattccttatcaaggcaaataatagctggttccaatctattctccggcaggatcttaggtcctatctgggggacggccctttgcagcattacatcgctgtcagcagtccgaccaacacaacgtacgttgtgcagtacgcactggcaaatctgacggggaccgtcgtcaatttgacccgcgaacagtgccaagatccctcaaaagtgccctcggagaacaaggacctgtatgagtactcatgggtgcagggcccactccatagcaatgaaaccgatcgtttgcctcgatgtgtaaggagcacagcccgactggccagagcactcagccccgctttcgagctgagccagtggtcaagtactgaatacagcacctggaccgagagccggtggaaagatattcgggctagaatcttcctgattgccagcaaagaattagagctcatcacccttacagttggctttggtatacttatattttctctgatcgtcacttattgtataaatgccaaggccgacgtgctgtttattgccccacgggagccaggcgcagtttcctactag

SEQ ID NO: 232661 - DNA, 2070 bp, Artificial Sequence
  Description of Artificial Sequence: Synthetic coding sequence
atggatttcaatctgattctggagtccctctgcaggggcaactcagtggaacggaagatatatatcccactgaataaaaccgccccttgcgttaggttgcttaatgccacgcatcagattggctgccaatccagcatcagtggggatactggagtgatacacgtggtcgagaaggaggaagatttgcagtgggtgctgacagacggtcccaacccaccttacatggtgctactggaatcaaagcactttacacgcgatctgatggagaagttaaaggggaggacttcgcgaatcgctggtctggcagtctctctgacaaagccttcaccggcaagtggatttagcccatccgttcagtgccccaatgatggcttcggcgtgtatagcaattcctatggaccagagttcgcccattgccgagaaatccagtggaactctctggggaacggactggcatacgaggatttttcctttcctatctttctgctcgaagatgaaaacgaaacaaaggtaattaagcaatgctaccaggaccataacctctcacaaaacggcagcgctccaaccttccccctttgtgccatgcagttatttagccatatgcatgcagtaattagcactgctacttgtatgaggagatcctctatacagtccactttcagcatcaacccggaaatcgtgtgcgaccccttatctgactacaatgtgtggtcgatgttgaaacctattaacaccaccgggaccttgaaaccagatgaccgagtggtcgtagccgctacccgactggacagtcgtagcttcttctggaacgtggcacccggagccgagagtgccgtagccagcttcgtcacccagctagcagccgctgaggctcttcagaaggctccagacgtaaccaccttacccagaaatgtcatgtttgtgttttttcaaggggagacgtttgactacatcggctcctctcggatggtctatgacatggagaagggtaagtttcctgttcagctggaaaatgtggacagttttgtcgagcttggacaggtagctctgcgcacatcactagagctgtggatgcacacggaccctgtgagccagaaaaatgaatcggtaagaaatcaggttgaggatctactggcaaccctcgaaaaaagtggagcaggcgtgcccgcagtcattctgcggaggccgaatcagtcgcagccattaccgccatcctctttgcaacgcttcctccgcgcacgtaatattagcggtgtggtgctcgcagaccattcaggcgcttttcacaacaaatattatcagtcaatttatgacactgctgagaatattaacgtgagctatcctgagtggctgagtcccgaagaggatcttaatttcgtaacagatacagcaaaggcactggctgacgtggccactgtgctgggacgcgcattatacgagttggctggaggtaccaactttagtgacacagtccaggcagatccacagactgtgactaggctcctttatggatttctcattaaagcgaacaattcctggtttcagtctattctgaggcaggatcttaggtcatacctgggagacgggccactacagcattacattgccgtgtcttccccaaccaacactacgtacgtggttcagtacgcactcgcgaacctgactggcactgtagtgaatttaactagagaacaatgtcaggaccccagcaaagtgccttcggagaataaggacctctatgaatatagttgggttcaagggccacttcacagcaacgagaccgacaggctgccccgttgtgtgaggtctacagcaaggcttgccagagctctgagccccgcattcgaactgtcccaatggtcttcaacagagtacagcacatggactgaaagccgctggaaggacattagagcacggatcttcttaattgccagcaaggagttggagcttattacactcaccgtgggcttcggaatcctcatcttctctttgatcgtgacttactgcattaatgccaaggccgacgttctgttcatcgcccctagggagccaggcgctgtgagttactag

SEQ ID NO: 232662 - DNA, 1356 bp, Artificial Sequence
  Description of Artificial Sequence: Synthetic coding sequence
atgcttaaaccaataaataccactggcactctgaaacctgacgatagagtagttgtcgcagctacccggcttgatagcaggagcttcttttggaacgtggccccaggcgctgaatctgccgtggccagcttcgtgacacaactcgccgcagccgaggcgctgcaaaaggctcccgacgtgactacactccctagaaatgttatgtttgtgttcttccagggggaaactttcgattatatcggatctagtcggatggtatatgacatggaaaagggcaagtttcctgtacagctcgagaacgtcgatagctttgttgagctggggcaggtcgctctgagaacctccctagaactgtggatgcatacggatccagtttctcagaagaacgagtcagtacgcaatcaggtagaggacttgcttgccactctggaaaagtccggcgctggggttcctgctgtgattctgcgcaggcctaaccagtctcagccactgcccccttcctctctacagcgctttctaagagctcggaacatatccggtgttgtgctcgctgaccactccggcgctttccacaacaagtattatcagtccatttacgacactgccgaaaatatcaatgtgagctaccctgaatggctgtcacctgaggaggacctcaattttgtgaccgatactgctaaagccctggccgacgttgctaccgttctcggtagggccctgtacgaattagccggtgggacgaacttttctgacaccgtacaggctgatccccagacagtcacgcgactgctgtatggctttctgattaaggctaataatagttggttccagagcatccttagacaggacctgcgtagttatctgggcgacggacctctgcagcactacatcgctgtgagctctcccactaacacaacttacgtagtgcaatacgcactggccaacctcaccggaacggtggtaaatctgacgcgggagcagtgccaggacccctcgaaggttcccagcgagaacaaggacctctacgagtatagctgggtgcaggggccactccacagtaatgagactgatagattaccaaggtgtgtcagatccacggctcgcctggccagagctctgtcgcccgcttttgagctgtcccagtggtctagtacagaatactccacttggactgagagccgatggaaagatatccgcgcaaggattttcctgatagcatctaaagaacttgagctgataaccctgacagtgggattcggaatcctgatttttagtcttattgtcacgtactgtatcaacgctaaggctgatgtcctgttcatagcaccaagggaacctggcgctgtgtcatattag

SEQ ID NO: 232663 - DNA, 918 bp, Artificial Sequence
  Description of Artificial Sequence: Synthetic coding sequence
atgctcaagcccattaacaccaccggtacccttaaaccggacgacagagtggtggtggcagcaactcgcctcgattccaggtcgtttttttggaacgtggctccaggagccgaatctgcagtcgcttccttcgtgacccaactggcagcagctgaggctctgcagaaggccccagatgttacaactttgcccaggaacgtcatgtttgttttctttcagggagttgctctgagaacgtctctcgaactgtggatgcacactgaccccgtgtctcagaaaaatgaatctgtgagaaaccaggtggaagacctgttggccacccttgaaaaatccggcgctggggttcccgctgtgatcctgcggagaccgaaccaaagccagcctctgcctccaagttccctgcagaggtttttgagggctcggaacatctctggggtcgtgttagctgatcattccggagcgtttcacaacaaatattatcagtcaatctatgacacagcggagaatataaacgtctcttatcccgagtggctaagcccggaggaggatctgaattttgtcaccgacacagccaaggccctcgctgacgtggccaccgttcttggcagagccctctatgagcttgcagggggaactaatttctctgataccgtgcaggccgatcctcaaaccgttacaagactgttatacgggttcctcatcaaggccaacaactcttggttccagagtattctccggcaggatctgagatcctacctcggtgacgggcctctccaacactacattgctgtttcttcacccactaatactacctatgtcgtccagtacgctctggccaatcttacaggaaccgtggtgaatctcacgagagaacagtgtcaggacccgtcaaaagttcctagtgagaacaaggactag

SEQ ID NO: 232664 - DNA, 2070 bp, Artificial Sequence
  Description of Artificial Sequence: Synthetic coding sequence
atggactttaaccttattcttgagagcctgtgtcgtggtaacagtgttgagagaaaaatttatattcctctgaacaagaccgcaccttgcgttcggctgctaaacgcgactcaccagatagggtgtcagtcctccatcagcggtgatacgggcgtgatccacgttgtggagaaagaggaggatctgcagtgggtccttacagacggcccaaatccaccatacatggtgctcctcgagagcaagcatttcacccgggatttaatggaaaagctcaagggccgtacctcaaggatcgcgggtctggctgtgagcttgacaaaaccttctcccgcttccgggttcagcccatccgttcagtgtcctaatgatggcttcggcgtgtattccaactcctacggaccagaatttgcacactgtagagaaattcagtggaattcgttaggtaatggactggcatatgaggactttagcttccccatcttcttgctcgaggatgaaaatgagactaaggtgatcaagcagtgttatcaggaccacaacttaagtcaaaacggttcagcccctacatttccactgtgtgcaatgcagctgttttcacacatgcatgccgttatttccacggcaacatgcatgcggaggtctagcatccaatctaccttttcaattaacccagagattgtgtgcgatccacttagcgactataacgtctggtcaatgctcaagcctattaacaccacaggaacactaaagcccgacgaccgggtggtggtggctgccacccgactggacagtagatcttttttctggaacgtcgcaccaggggctgagagtgccgtcgcaagctttgtaactcaactggcagcggcagaggccctgcagaaggctcccgacgttacaaccctgccgcgaaacgtgatgtttgttttctttcaaggagagacatttgactacatcggaagttctaggatggtgtacgatatggaaaaagggaaattccctgtgcagttagaaaacgtggactcgttcgtggaacttggacaggtagctcttaggacctcactggagctgtggatgcacactgatccagtcagtcagaagaatgagtctgtgcgcaaccaggtggaagatctccttgccacactagagaaaagcggagccggagtgcccgcagtgattctgagaagacccaatcaaagccagcccttacccccaagctccctgcagagattcttgcgagccaggaatatttccggcgtcgtgctcgcagaccactcaggcgcatttcacaacaagtactaccagagcatttatgacactgctgaaaatattaacgtctcatatccagagtggctgtccccagaggaggatcttaactttgttaccgacaccgccaaagcattagccgacgtggccacagtcttgggcagagcactctacgaactagcaggcggaaccaacttctctgacacagtccaggccgacccccaaacagttaccaggctgttgtacggctttctgatcaaagctaacaacagctggttccagagtatcctgcggcaagacctgcgctcttatttaggagacggacccctgcaacactacatcgcagtgtccagtcccactaacaccacctacgtggtccagtacgcgctcgcaaatctgactgggaccgtcgtgaatctgacacgcgagcagtgccaggatccctccaaggtcccaagcgagaacaaggacctgtatgaatattcctgggtgcaaggccctctgcacagtaacgaaactgatcggcttcccagatgtgtaaggtcaacggctcggctcgcgagggcactttccccagccttcgaactttcccagtggtcctctaccgaatactctacgtggactgaaagccggtggaaggacatccgagctcgcatctttctcattgcgtccaaagaactggagctgatcactctgactgtaggatttggcatcttaatcttttctcttattgtgacatactgcatcaatgccaaggcagacgtgctgtttatcgcccctcgggaacctggggcagtttcatactag

SEQ ID NO: 232665 - DNA, 768 bp, Artificial Sequence
  Description of Artificial Sequence: Synthetic coding sequence
atggccactgccggaggcggatccggcgctgatcctggctcacgtgggctgctgcgactgctgtctttctgcgtcctcttggctggcctctgccggggtaattccgtggaaagaaagatttacattccactaaacaaaaccgcaccatgtgtcagactgttgaacgccacacaccagattggatgtcagtccagcatatctggagacacaggagtcatccacgtggtcgagaaagaggaagaccttcagtgggttctcaccgatggccctaacccaccttacatggtactcctcgaatccaagcatttcacccgcgacctgatggagaagttaaaggggagaacttctagaattgcaggcctggcagtcagcctgaccaagcccagccccgcaagcggtttttctccctccgtgcagtgccccaacgacgggttcggtgtttatagcaattcatacggccctgagttcgcgcactgccgggagattcagtggaactctttaggtaacggcctggcttacgaagacttttcttttcccatctttctgctggaagacgagaatgaaaccaaggtaattaagcaggagacttttgactatatcggcagtagtagaatggtctacgacatggaaaaggggaaattccccgtacaactggagaatgtcgatagtttcgtggagctaggccaagttgctctgcgtacctccctggaattatggatgcacacagaccccgtgtctcagaagaatgaatctgttaggaaccagtag

SEQ ID NO: 232666 - DNA, 963 bp, Artificial Sequence
  Description of Artificial Sequence: Synthetic coding sequence
tagggcttcggcgtgtatagcaactcctacgggcctgagttcgcgcactgcagagagatccagtggaatagcctgggaaacggcctggcttacgaagactttagtttcccaatcttcctgctggaggacgaaaatgagactaaggttatcaaacagttattttcccacatgcacgctgtcatctccacagccacatgtatgcgtcgcagttctatccagagtaccttcagcataaatccggaaatcgtgtgcgatcccctgagcgactataacgtgtggtccatgttgaagccaattaataccactggcaccctcaagcccgatgatcgtgttgtggtggctgcaactcggctggattcccggagctttttctggaacgtggccccaggagccgagtctgcggtcgccagcttcgtgacccaactggccgcagcggaagcactccagaaggcacctgacgtgaccacattacctcggaatgtgatgtttgtgtttttccagggagaaacctttgactatattggctctagccgcatggtgtatgatatggaaaagggcaagttccctgttcagcttgagaacgttgattcctttgtcgagctgggacaagtggctttgcgcacttccctggagctgtggatgcacacagatcccgtgtcgcagaagaatgaaagtgtgcgcaatcaagtggaggatctgctggctactctggagaaatccggagcaggcgtgcctgccgttatactcaggagaccgaatcagagtcagccccttccacccagctcgctgcagcgctttctgagggccaggaacattagcggagtcgtgctagctgaccattcaggcgctttccataacaagtattatcaaagcatttacgatacagccgaaaatatcaatgtctcgtacccggagtggctgtctcctgaagaagacctgaattttgtcaccgataccgcctag

SEQ ID NO: 232667 - DNA, 660 bp, Artificial Sequence
  Description of Artificial Sequence: Synthetic coding sequence
cgatcatccattcagagtactttctcaattaacccagagatcgtgtgcgaccccctgtccgactacaacgtatggtcaatgctcaagcccataaacaccactgggactctgaagccagacgatagagtcgtggtggccgcaacccgccttgccgcagccgaggcgcttcagaaggccccagatgtgacgacactgccccgtaatgttatgttcgttttttttcaaggtgagacatttgattatatcggttccagcaggatggtgtacgacatggaaaaaggcaaattcccagtgcaactggagaacgtggactcttttgtggagctggggcaggtcgcccttaggacctcactggaactatggatgcacacagacccagtgagccaaaagaacgagagtgtgcggaatcaggtggaagacctactcgcgaccctggagaaatcaggggctggcgtaccagccgttattctccggaggcctaaccagtcccagcctctccctccctcttcattacaacgcttcctcagggcacgcaatatatcaggggtagtgctcgccgatcactcaggagcctttcacaacaaatattaccaatccatctacgacacagcagagaacataaacgtatcttaccctgagtggctttctcctgaggaatag

SEQ ID NO: 232668 - DNA, 828 bp, Artificial Sequence
  Description of Artificial Sequence: Synthetic coding sequence
tagaacgttgcacctggggcagaatccgccgtggcctcttttgtgacccagctggctgccgctgaagctctgcaaaaggcccctgacgtgacgactctgccacgtaacgtcatgtttgtgtttttccaaggtgtggcactcagaacctcactggagctttggatgcatactgatcccgtatcccagaagaatgaatctgttcggaatcaggtcgaggatcttctcgccaccctggaaaagtcaggcgctggagtacccgctgtgattctcagacggcctaaccagagccagcctctcccgccaagctcgctgcagagattcctcagagcccgtaatatttcaggagtggttttggccgaccactccggagcctttcacaacaagtactaccagtctatctacgacacagccgagaatataaatgtcagctacccagagtggttgtccccggaggaagacctaaactttgtgacagacaccgctaaagctcttgccgacgttgctacagtgctcggaagagccctgtatgaactagcgggtggaactaacttttcagacacagtgcaagccgaccctcagacagtgacacgcctgctgtatggattcttgatcaaagccaacaatagctggtttcaatccatactccgtcaggatcttcggtcatatctaggagacggaccactgcagcactatatcgccgttagctccccgacaaataccacatatgtcgtgcagtatgcccttgccaacctgacgggtacggttgtaaaccttactagagagcagtgccaggacccatccaaggtgccatctgagaacaaagattag

SEQ ID NO: 232669 - DNA, 405 bp, Artificial Sequence
  Description of Artificial Sequence: Synthetic coding sequence
atggccactgctggcggtggctctggcgcagatcccggttccagaggtctgctgcgtctcttatccttttgcgtgctcctggctggcctgtgcaggggcaactcggttgagcgtaagatttacattccactaaacaagactgccccatgtgtgcgattgctcaacgccacacatcagattggctgccagtcctcaatctctggcgataccggtgtgattcacgtggtcgagaaggaggaggacttacagtgggtgttgaccgatggcccaaatccgccttatatggtactcctcgagtccaaacattttactcggcagaatgtgcgtctttccgatactttcttgtgctcttttatggaatttctgtcttactctagggacttaatggaaaaactgaagggatag

SEQ ID NO: 232670 - DNA, 699 bp, Artificial Sequence
  Description of Artificial Sequence: Synthetic coding sequence
atggctacggctggaggtgggtctggagccgatcccggaagcaggggactgctgcgcctgctaagcttctgtgtattgttggcaggcctattcctggactttgaacctgatccacttcctctgtgcccagacgtgtcctttttcccacaacctcagcccccaacccctcagtcaaaagggacaggactgtgtagggggaattcagtggaaaggaagatttacattccactgaataaaacggcaccttgtgtgcggctcctgaatgcaacccaccagattggatgccagtcctctatctctggcgatacgggagtaatccacgtggtggagaaggaggaggatttacagtgggttctgactgacggacctaatcccccatacatggtgctgctggagtctaaacactttacacgcgatctgatggagaagctgaagggtcggaccagcaggatagctggtctggcagtctctctgaccaaaccgtccccggcttccggattttcacctagcgtgcagtgcccaaacgacggtttcggagtgtatagtaactcttacgggccagagtttgcacattgtagagagatccaatggaatagcctgggcaatgggctcgcctatgaagacttctcgtttcctatctttttgctggaagacgaaaatgagaccaaggtaatcaaacaatgctatcaggaccactag

SEQ ID NO: 232671 - DNA, 1716 bp, Artificial Sequence
  Description of Artificial Sequence: Synthetic coding sequence
atggccaccgcaggcggaggatcgggtgccgaccccggtagccgagggctgctcagattgttgtctttctgtgtgctccttgccggtctatgccgtggcaactccgtcgaacgaaagatctacatcccgctcaataaaactgccccttgcgtgcgcctgcttaatgcaacacaccaaatcggctgccagagttcaatctccggggacacaggggtcatccacgttgtggagaaggaagaagatctgcagtgggttctcacggacggcccaaatccaccttacatggtcctgcttgaatctaaacattttaccagagacctgatggagaagttaaagggccgtacctccagaatcgcgggtctggcggtcagccttaccaagccatcccctgccagcggcttttcgccttctgttcaatgccccaacgatgggttcggagtgtattctaattcctacggcccagaatttgcccattgcagagagattcagtggaatagcctgggaaatggtcttgcctacgaggacttctcctttcctatttttcttctggaggacgaaaatgagactaaagtgattaaacaggagacgttcgattacattggctcatccagaatggtctacgatatggagaaaggcaagttccccgtgcagctggagaatgttgatagtttcgttgagcttggacaagtcgccctcagaacgagccttgaactgtggatgcatactgatccagttagtcagaagaacgagtccgtccgaaatcaggtggaggaccttctggcgacgctggagaaatcaggggcaggtgtgcctgcagtgattctcagaaggccaaaccagtctcagcccctgcctccctcatctctgcagcggtttttgagagcccgtaacatcagcggtgtggtgctcgccgatcattccggggcattccacaacaagtattaccagtccatctacgatactgcagagaatatcaacgtctcttacccggagtggttaagtcctgaagaggacttgaacttcgttactgacactgcaaaagctcttgcagatgtcgccaccgtgctgggacgcgctttgtatgaattagctgggggaacaaacttctctgatacagttcaggccgacccacagacagtgacacggttgctctacgggttcctgattaaagcaaacaattcctggttccagtctatcctgcgccaagatctacggtcgtacttgggggacgggccactgcagcactacatcgccgttagtagtcctactaatactacttacgtagtccaatacgccctcgctaacctcactggcactgtggtgaacctcacccgggaacagtgccaagatccaagtaaggttccgagtgagaacaaagatctttacgaatactcctgggtgcagggacctctgcattctaatgagaccgatcgcctcccacgatgtgtgaggtcaacagcaagactggctcgggctttgtcgccagctttcgagctttcgcagtggagctctactgaatacagcacttggacagagagccgatggaaggacattagagcccgtatctttctgatcgcgagtaaagaactcgagcttattacacttacagtcggctttggcattttgatttttagcctgattgtcacctactgtatcaatgccaaggcagatgtcctcttcattgcacccagggaacctggcgctgtatcttactag

SEQ ID NO: 232672 - DNA, 642 bp, Artificial Sequence
  Description of Artificial Sequence: Synthetic coding sequence
atgtctcgggtcctcgtaccgtgtcacgttaagggttctgttgctctgcaggtgggtgacgtgcggacctcacaagggcgtcctggtgtcctggtaatagacgtcacattcccatctgtggccccattcgagctgcaggaaatcacattcaaaaactactatacagctttcctgtcgattcgggttaggcagtataccagcgcgcacactcccgcaaaatgggtcacatgcttaagggattattgccttatgcccgacccacatagcgaggaaggcgctcaggagtacgtgtctctgttcaagcatcagatgctgtgcgatatggccagaatatctgaacttcgcctgatactgcgacagccttcccctctttggctgtcattcactgtggaggagcttcagatttaccaacaggggcctaaatcaccttccgtaacatttcctaagtggctctctcatcccgtgccctgtgagcagcctgccctgctccgcgagggattgccggacccaagcagggtcagttccgaagtccagcaaatgtgggcactgactgagatgatacgtgcctcacacacctccgctaggataggccgttttgatgtggacggttgttacgacctgaatctcctgtcctatacgtag

SEQ ID NO: 232673 - DNA, 642 bp, Artificial Sequence
  Description of Artificial Sequence: Synthetic coding sequence
atgagtcgtgtgctggtgccatgccacgttaagggtagcgtggccttgcaggttggagacgtgagaaccagccagggtaggcccggagtgttagtgatcgatgtaacatttcctagtgttgctccgtttgagctgcaagagatcacattcaagaattactacacagccttcctgtccattcgcgtgagacagtatacctcagctcacacaccggcaaaatgggtcacatgcctcagagattactgcctgatgcccgacccccacagtgaggagggagcccaggagtacgtttcattattcaaacatcagatgctgtgcgatatggcacggatcagcgaacttaggctgattctcaggcaacctagccctctctggttgtctttcacagtggaagagttgcagatataccagcagggccctaaaagtccgtcggttacatttcccaaatggctcagccatcccgtgccatgcgaacagcccgctctgctgcgggagggactacccgacccgtctcgggtaagcagcgaagtacagcagatgtgggccctaacagagatgattagagcctctcacacatcagctagaattggccgatttgatgtggacgggtgttatgacctcaatcttctgagttatacgtag

SEQ ID NO: 232674 - DNA, 528 bp, Artificial Sequence
  Description of Artificial Sequence: Synthetic coding sequence
atgagcagggtgcttgtgccttgtcatgtgaagggcagtgtggcactgcaggtgggcgacgtccgcacttcacaaggccgacccggagtgctcgttatcgacgttacgtttccctccgtagctcctttcgagctgcaggaaatcaccttcaagaactattacacagcgttcctgagcatccgcgtgcgacagtatacatccgctcataccccggctaaatgggttacctgcctgagagattactgcctcatgcctgacccccatagcgaggaaggcgcacaggaatatgtcagcctgtttaagcatcagtcaccctccgttaccttccccaagtggctgtcccatcccgtgccatgtgaacagcctgcccttttgcgcgaggggctgccagacccctccagggtaagctccgaagtgcagcaaatgtgggccctgacagagatgatacgcgcatcacacacctctgctcgaattggaagatttgatgtggacggttgttatgacctgaacttactcagttacacctag

SEQ ID NO: 232675 - DNA, 795 bp, Artificial Sequence
  Description of Artificial Sequence: Synthetic coding sequence
atggaaagcggcttcacgtctaaagatacgtatctgtcccattttaatcccagagattatttggaaaaatattataaatttggatctcggcactccgcggagagccagattctgaaacacttgttgaaaaacttattcaaaatcttctgtctggatggagtcaagggagacctgcttatcgatattgggtcaggaccgacaatttaccaattgctctccgcctgcgagagtttcaaagaaatcgtcgtgacagactatagcgatcaaaatctacaggagctggaaaaatggctgaagaaagagcccgaagcattcgactggagccctgtcgttacgtatgtctgtgacctcgaggggaatcgcgtgaagggcccagagaaagaggaaaagctccgacaggcggttaaacaggtattgaagtgcgatgttacccagagtcagccattaggggctgttcccctgccaccagcagattgcgttttgtccaccctttgcctggacgctgcctgccccgacctgcctacctactgccgcgctctgaggaatctgggctcactactaaagcctggaggttttctggtaatcatggatgcactcaagtcttcgtactatatgattggtgagcagaaattctcatcgctgccgcttggtcgtgaagccgtcgaggcagcagttaaagaggcgggttacacaatcgagtggttcgaggtgatttctcagtcgtattcatccaccatggctaataatgagggcctatttagtctggtggcaaggaaacttagtaggcctctgtag

SEQ ID NO: 232676 - DNA, 795 bp, Artificial Sequence
  Description of Artificial Sequence: Synthetic coding sequence
atggagagtgggttcacatctaaggatacatatctgtcccattttaatccgagagactacctggagaagtactacaagtttgggtcacgacactcagcagaaagtcaaatcttgaagcatctactcaaaaatctgttcaaaattttttgtctcgacggcgtcaagggcgaccttctcatcgacatcggttcaggccctactatttaccagctcctctccgcctgcgaaagtttcaaagagatagtagtgacagactatagcgaccagaacttgcaagagttggaaaagtggctgaagaaggaacccgaagcttttgactggtctccggtggtcacttacgtctgtgatcttgagggaaacagggtcaaggggccagagaaggaagagaagctgcggcaagctgtgaagcaggtcctcaaatgcgacgtcacacagtcacagccgttgggtgccgtgccactccccccagccgactgcgtcctgtctacactgtgccttgatgccgcttgccccgatcttcccacctattgtagagcgttacgtaacctcggatccctcttgaaaccaggcggttttctcgttattatggacgcattgaagagtagctattacatgatcggggaacagaaattctccagcctccccctaggtagagaggctgtcgaggccgcagtcaaagaggccggttataccattgagtggttcgaggtgatatctcagagttatagctctacaatggccaataacgaaggcttatttagtttggtcgcccgaaaactcagcagaccactctag

SEQ ID NO: 232677 - DNA, 759 bp, Artificial Sequence
  Description of Artificial Sequence: Synthetic coding sequence
atgaagtctagaatccccgttgtgttgctggcgtgcggttcatttaacccgatcacaaatatgcacttgcggatgttcgaagtggcacgggaccacctgcatcaaacaggaatgtatcaagtgatccagggaatcatctccccagtcaacgacacatatggaaaaaaagacctggccgcatctcaccaccgagtcgctatggcccgactcgctctccaaacgtccgattggatccgagtagatccatgggaatctgagcaggctcagtggatggagaccgtgaaagtgttgcgccatcaccattctaagcttctaaggagcccaccacagatggaagggcctgatcacggcaaggccctgttttctacccccgcagcggtaccggaactgaaacttttatgcggtgccgatgttctcaaaacattccaaacccctaacctgtggaaagacgcacatatccaggagattgtggagaagtttggtcttgtgtgcgtaggccgtgtcgggcatgacccaaagggctacatcgctgaatctcccattcttaggatgcatcagcacaatattcacctggcaaaggagcctgtccaaaacgagattagcgcgacttacatcagacgcgcattgggacagggccagtctgtgaagtacctcattccagatgccgtcataacttatattaaggaccacggtctgtatacaaagggaagcacatggaaagggaagagcacccagtccacggagggaaaaacgtcctag

SEQ ID NO: 232678 - DNA, 648 bp, Artificial Sequence
  Description of Artificial Sequence: Synthetic coding sequence
atgtatcaggtaatccagggcattattagccccgttaacgacacctatggaaaaaaggatttagccgcatctcaccatcgcgtagctatggctcggttagccttgcagacatccgattggatccgggtggatccatgggagtcagaacaggctcagtggatggaaaccgtaaaggtgctgagacatcatcactctaaactgcttcgcagtccaccccagatggagggaccagaccatggcaaagctctgtttagtactcccgcagccgtcccggaactgaaattgctctgcggggcagacgtactgaaaacctttcagactccaaatctctggaaggatgcacacatccaggagatagtggagaagtttggcctggtgtgtgtgggtagagtgggacacgaccctaagggatacatcgctgagtctcctattctgaggatgcaccaacataatatccacttggccaaagagccagtgcagaatgaaatctctgcaacatatattaggcgggctttgggacagggccagtccgtgaagtacctcatccctgatgcagttatcacttatataaaagatcatggcctatacacaaaaggctcaacatggaaggggaaatcaacacaaagtacagaaggcaaaacatcttag

SEQ ID NO: 232679 - DNA, 648 bp, Artificial Sequence
  Description of Artificial Sequence: Synthetic coding sequence
atgtaccaagttattcagggcatcatcagcccagtaaacgatacatacgggaagaaggacctggccgctagtcaccatcgggtggccatggcgaggttagccttgcagacctctgattggataagggtcgacccatgggagtctgaacaggcacagtggatggaaacagtgaaagtgctgagacatcaccattcgaagcttcttcgatctccccctcagatggaaggacccgaccatggcaaagcgctcttctctacacctgcagctgtgcccgaactcaagctcctgtgtggcgctgatgtgctgaaaacctttcagaccccgaacctctggaaggacgctcacatacaggagatagtcgagaagttcgggctcgtgtgcgtgggcagggtgggacacgatcccaagggctacatagctgagtcccccattcttagaatgcaccagcacaacattcatctggctaaggagcctgttcaaaacgagatttcagctacatacattcggcgtgccttagggcagggacagagcgtaaaatacttgatccctgacgcggttattacatacattaaagatcacggactgtataccaaggggtctacttggaagggcaagtctacgcagtccaccgaggggaaaactagctag

SEQ ID NO: 232680 - DNA, 429 bp, Artificial Sequence
  Description of Artificial Sequence: Synthetic coding sequence
atggagggcccagatcacggcaaggccctgttcagtacccccgctgccgtaccagagcttaaactgctgtgcggggctgatgtgctcaagaccttccagactcctaatctttggaaggatgcacacatccaggagattgtggagaagtttggccttgtgtgcgtggggagagtaggacacgaccctaagggctatatcgcagagtccccaatcctcaggatgcaccagcataatatccatcttgcaaaagagccggttcagaacgaaatctccgccacctatatcaggagagccttgggtcaaggtcagtccgttaaatacctgattcccgatgcagtcattacttacatcaaggaccacggcctgtacactaagggaagcacctggaaaggcaagagtacccaaagtactgagggcaaaacctcgtag

SEQ ID NO: 232681 - DNA, 345 bp, Artificial Sequence
  Description of Artificial Sequence: Synthetic coding sequence
atgaagtcacgaattccagtcgtgctccttgcttgtgggtctttcaaccctatcaccaatatgcaccttcgcatgtttgaagtggctagagaccacctccatcagacaggcatgtaccaggtgattcaaggcataatctctcctgtcaacgacacctatggcaaaaaggacttagctgctagtcatcacagagtagccatggccagactggcactccagacatccgattggattagggtggatccctgggaatcagagcaggcgcaatggatggaaaccgtaaaggtgctccgccaccaccacagtaagctgctcaggagtcctcctcagatggaggggccttag

SEQ ID NO: 232682 - DNA, 492 bp, Artificial Sequence
  Description of Artificial Sequence: Synthetic coding sequence
atgaagagtaggatcccagtcgttctcctggcctgcggttccttcaatcctattaccaacatgcacctgagaatgtttgaggtcgcaagggaccatcttcatcaaacagcagtgccagagttaaagctgctgtgcggagccgacgtgctgaaaacctttcaaacccccaacctctggaaagatgcacacatccaggaaatagtggagaaatttgggctcgtctgtgtgggacgagttggtcatgatcccaagggatatatcgccgagtcaccaatcctgcggatgcatcaacataatattcacttggctaaagaaccagtgcagaacgagattagtgcaacctacattcgacgcgcactgggccagggtcagtccgtgaagtaccttatcccggatgcagtgatcacatacataaaggaccacggcttgtacacaaaaggatccacctggaaagggaagagcactcagtcgactgagggcaaaacgtcatag

SEQ ID NO: 232683 - DNA, 3261 bp, Artificial Sequence
  Description of Artificial Sequence: Synthetic coding sequence
atggctaacctcctgaagactgtggttaccggctgttcttgtcctttgctctctaatctcggatcatgtaaagggctgcgtgtcaagaaggatttcctgcgcactttttatactcatcaggagctgtggtgtaaggcccctgttaagccaggcatcccctacaagcagttgaccgtgggcgtgcccaaagaaatcttccagaacgagaagagagtcgcattaagtccagctggagtccagaaccttgtaaagcaggggtttaatgttgtggtcgagtcgggtgccggagaggccagcaagttcagcgacgaccattaccgcgtggcaggtgcccaaatacagggagcaaaagaagtgctggcctccgacttagtggtgaaggtgcgcgcacccatggtcaaccccaccctgggggttcatgaagcagacttgctgaagacgagtggcactctcatatcattcatataccctgcccagaatccggagctgctcaacaaacttagccagcgcaagaccaccgtgcttgccatggatcaggttccaagagtgacaatcgcacaagggtatgacgcattgtctagtatggccaatatcgccggatacaaggctgtggtactggccgctaaccattttggaaggttctttactgggcagatcacagctgccggaaaggtgccgcctgccaaaatactgatcgtcgggggtggggttgccggtcttgccagcgccggtgccgctaaatccatgggggcaatcgtcaggggttttgatacacgggctgcagccctagagcaattcaaatccctcggtgccgaaccgcttgaagtcgacctgaaggaatccggagaaggacagggtggttatgccaaagaaatgagtaaagaatttatcgaagctgagatgaagttattcgctcaacagtgcaaggaagtcgatatcctcataagcacagctttgattccagggaagaaagctcctgtgttgttcaacaaagaaatgatagaaagtatgaaagaggggagcgtggtggtggacctagctgccgaggcaggtgggaatttcgaaacgacaaagccaggtgaattgtatattcacaagggcatcacacatataggctacaccgatctacctagtcgtatggcgacacaggccagtacattatactccaataacattaccaaactactgaaagcaatcagcccagacaaagacaacttttacttcgatgttaaagatgacttcgactttggtacaatgggccatgtgatccgaggtaccgttgtgatgaaggatgggaaagtgatatttcccgctccaacaccaaagaatatccctcaaggtgctcctgtgaagcaaaagaccgtggccgagctggaagccgagaaggcagcaacaatcacccctttccgcaaaaccatgtctaccgccagcgcctataccgcagggctgaccggaatccttggactgggcatagcggcaccaaatcttgcattctcccagatggtgacgacctttggactggccggtatcgttggctaccatactgtatggggtgtgactccagctctgcacagccctctcatgtctgtgactaatgctatctctggactcactgccgtcggtggtttggctctgatgggcggtcacctgtatcctagcacgacttcacagggactggctgccctggctgcttttatcagttctgtgaacatcgcgggtgggtttctcgtgacacagcggatgcttgatatgtttaagcggccaacggatcccccagagtacaactacttgtacctgttacccgcaggcacatttgtcggagggtaccttgccgcattgtatagtggatacaatatcgagcaaataatgtatttaggcagcggactttgctgcgtaggcgctctggcgggtctatcgacacagggtactgctcgcctgggaaacgctctgggcatgattggtgtcgcgggtgggctggccgcaacccttggagtgctgaaaccgggtccggagttgctcgctcaaatgagcggggcaatggcactcgggggtactattggcctcaccatagctaagcgcatccagatcagcgacctgccccagttggtggccgcattccattctctggtggggctggccgctgtgctgacttgcatcgcggaatatattatcgagtatcctcatttcgcaactgacgccgctgctaacctgaccaaaattgtcgcttacctagggacttacattggtggcgttacgtttagcggatccctgatcgcctacggaaagttgcaggggctgttgaaaagcgcgccattgctactgcccggtcgccacttactaaatgccggactgcttgccgcttccgttggaggaatcataccattcatggtagacccgtcatttacgactgggatcacctgcttgggatccgtgagtgctctgtccgcagttatgggcgtgaccctgaccgccgctatcgggggtgcagacatgcccgtcgtaattaccgtacttaacagttacagcgggtgggctctgtgcgcagaagggtttcttctcaacaataatctgctcaccattgtcggcgctctgataggatcgtctggtgcgattcttagttatattatgtgtgtggccatgaacagatctctggcaaatgtgattcttggcggatatgggacgacctctacagcaggcggaaaaccaatggagatctctgggacccatacggagataaatctggataatgctatcgatatgatcagagaagccaactccattattatcacccccggttatggattatgtgccgctaaggctcagtaccctattgcagatctcgttaaaatgctcaccgagcaaggaaagaaggtaaggtttgggatccaccctgtggcgggacgtatgcccggacagctgaacgttctgctcgccgaggccggtgtaccatacgatatcgtgctggagatggatgaaattaatcacgacttcccagacacagacttggtcctggttataggagccaacgatacagtgaattctgccgctcaagaagatcctaatagtataatcgcaggaatgcccgtcctggaggtgtggaagagcaaacaggtcatagtgatgaagagaagcttgggcgtgggatatgctgctgtggataatccaatcttttataagcctaataccgctatgctgcttggcgacgcaaagaagacctgcgacgctcttcaggcaaaagtccgggaatcttaccagaaatag

SEQ ID NO: 232684 - DNA, 3261 bp, Artificial Sequence
  Description of Artificial Sequence: Synthetic coding sequence
atggccaacttacttaagactgtcgtaaccggctgctcctgtcccctcctgagtaacctgggctcttgcaagggcttgagggtcaagaaggacttcttaagaaccttttatactcatcaggagctgtggtgtaaagccccagtaaaacctgggattccttacaaacagcttactgttggggtaccaaaggagatcttccaaaatgagaaaagagtcgcactcagtccagccggagtgcaaaacctggtgaaacagggtttcaacgtggtcgtggagagcggagcaggagaagctagcaaatttagtgatgaccactatagggtggctggagcgcagatccagggtgctaaggaggtgctggccagcgatctggtggttaaagtgagggctcctatggtcaatcctacactgggggtgcacgaggctgacctgctcaaaacgtccggaacactcatttctttcatataccctgcccagaatccagagttactcaacaaactttcgcagcgcaagaccaccgtgttagccatggatcaagtccctcgggttactatcgcacagggatatgatgcccttagctctatggccaacatcgcaggttataaagcagtggttcttgctgctaatcactttgggaggttttttacaggacagattacagcagccggaaaagtccccccagccaaaatcttaatagtgggcggaggagtggcaggcctagcctcagcaggcgcagccaagagcatgggtgctattgtgagaggattcgacacacgggctgcggctctagagcagtttaagagtttaggcgcagagcccttagaggtggatctgaaggaaagtggggaaggccagggcggatacgccaaagagatgtccaaagagtttatcgaggccgagatgaaacttttcgcccagcaatgcaaggaagtcgacattctgatttcaaccgctctgatccccggaaagaaagctcctgttctgtttaacaaggaaatgattgagtcgatgaaggagggttctgtcgtggtggacctcgctgcagaagcgggtggtaattttgagactacgaagccgggagaactgtacatacacaaaggaatcacacacattggatatacagacttaccctctcgcatggcaacccaggcatccaccctgtactctaataacatcactaaactactcaaagccatctcaccggacaaggataacttctatttcgacgtgaaggacgactttgatttcggaacaatggggcacgtcattagagggaccgtggtcatgaaagatggcaaagtgatctttccagcacctacacccaagaatatcccccagggagccccagtgaaacaaaagaccgtggcagagctggaagccgagaaagctgccaccatcaccccgtttcggaagactatgagcaccgcgagcgcttatacagccggattaactggaatcctgggcttaggcatagcagctccaaacctggccttttctcagatggttacaacttttggactagccggaattgtcgggtaccataccgtatggggtgtcacgccagcccttcatagccccctcatgagtgtaaccaatgccatctcgggcctgaccgctgtgggaggcttggcgctgatgggtggacatctgtatccgagcacaacaagtcagggtctagctgcgctggctgccttcattagtagcgtcaatattgccggtggattcctcgtaactcagcggatgcttgatatgtttaagaggccgacggaccctcccgagtacaattacttgtacctcctgcctgctggcacgtttgtaggcggttatcttgccgctctgtactccggatacaatatcgagcaaatcatgtacctaggatcaggcctgtgttgtgtgggcgctcttgccggtttaagcacccagggaactgcgaggttagggaacgccctggggatgattggcgttgcaggcggtttagctgccacgttgggcgtccttaagcccggtccagagttacttgcacagatgagcggcgctatggcactgggcggaaccatcgggcttaccattgccaagcgtatccaaatctcagatcttcctcagctggtggctgcttttcattccctcgtaggtctcgccgctgtgctgacatgtattgctgagtacatcatagagtaccctcattttgctacagacgctgcagctaacctcaccaagatcgtcgcatatcttgggacttacattggaggggtcaccttttccggcagcctgattgcttatggaaagctgcagggcctgctgaaatcagctcccctgctgttgccagggagacacctactgaatgcaggactactagccgctagtgtgggtggtataatcccttttatggtcgatccgagcttcaccactggcatcacttgcttgggctccgtgagcgctctgtctgcagtcatgggtgtgacactcaccgccgcaatcggcggagcagatatgcccgttgtgatcacagtgctgaatagctacagcggatgggcactgtgcgcagaggggtttcttctcaacaacaatctgcttaccattgtcggtgcactgattggaagttcaggggctatcctgtcttatattatgtgcgtcgccatgaataggtcactagctaacgtaattctgggagggtacgggaccacctcaactgctggcggaaagccaatggagatcagcgggacccacaccgagatcaaccttgacaacgcgatcgatatgatccgtgaggctaattccatcatcatcacccctgggtatggcctctgtgccgctaaagctcagtatcccattgcggatttggtaaagatgctcacggagcagggaaagaaggtacggttcggtattcacccagtcgccggaagaatgccaggacagttgaatgtgctcctcgccgaagcaggagtcccgtacgatattgtgttggagatggacgagattaaccacgacttcccggatacagacctggtactcgtcatcggggctaacgatacagtcaactcggccgctcaggaggatccaaattccatcatcgccggaatgccggtcctcgaggtgtggaagagcaagcaggtaatagttatgaagaggagcttaggggttggatacgccgcagtggacaaccctatattttataaacccaacaccgccatgcttctgggagatgccaagaagacctgcgatgccctccaggccaaggttcgtgaatcttatcaaaaatag

SEQ ID NO: 232685 - DNA, 600 bp, Artificial Sequence
  Description of Artificial Sequence: Synthetic coding sequence
atggccaatctgctcaagacagtagttacaggttgtagttgccctctcctctcgaacctggggtcttgtaaaggcctccgggtgaaaaaagatttcctaaggactttctatacccaccaggaactctggtgcaaggctccagtgaagcccggaatcccttataagcagttaactgtgggggtgcccaaggagatcttccaaaacgaaaagagggtggcgctcagtcctgctggcgtacagaacctggtcaaacaggggttcaacgtggtcgtcgagtcgggggctggagaagcttcaaagttctccgacgaccactaccgggtggccggagctcagatacagggcgcaaaggaagtattggctagtgacctcgtagtgaaagtacgcgctccaatggttaatccgacattgggagtgcatgaggccgacctccttaagacttcaggcactctaataagttttatctatcccgctcaaaatcctgagcttctgaacaagctgtcacagcgtaagacaacagtgcttgctatggaccaggtcccacgagttacaattgctcaggggtatgacgctctgagttctatggcaaatatagcttag

SEQ ID NO: 232686 - DNA, 654 bp, Artificial Sequence
  Description of Artificial Sequence: Synthetic coding sequence
atggccaacttgctgaaaactgtcgttacagggtgctcttgtccactgctgagtaacctcggctcttgtaagggactgcgagtgaaaaaggattttctgcgaaccttttatactcaccaggagctttggtgtaaagcaccggtgaagcccggtatcccctataagcagctgaccgttggagtgcctaaggaaattttccagaatgagaagcgcgtcgcattgtcccctgcaggcgtgcaaaatttagtgaaacagggctttaatgttgtggtggaatctggggctggagaggcctctaagttttccgacgaccactaccgcgtcgctggcgcacagatacaaggagctaaagaagtccttgcctcagacttggttgtaaaggtcagggccccaatggtcaaccccactctcggagtgcatgaagccgatttgctgaaaaccagtgggacactgataagtttcatttatcccgctcagaaccctgagctgttaaataaactgagtcagagaaagacgacagttctggccatggaccaagtaccaagggtgactattgcccaagggtacgatgctctgtctagtatggccaatattgcagggtataaggctgtcgtcctggccgcaaaccacttcggcaggttctttactggttag

SEQ ID NO: 232687 - DNA, 1806 bp, Artificial Sequence
  Description of Artificial Sequence: Synthetic coding sequence
atgctgtcttggaaccgtgtgcgagcaaaacttccgtcatcacaaatggtcacgacatttggtctggcgggaattgtggggtaccatacagtgtggggtgtcacccccgctcttcattctcctctgatgagtgtcacaaacgccatatccggcctcacagctgtcggcggactcgcgctcatgggcggacatctgtacccttccaccacttctcaagggttggccgctctggcagcatttatatctagtgttaatatagccggagggtttctggtaactcaaaggatgcttgacatgttcaagcgtcctacagaccctcccgagtacaattatctatatttgctgcccgcaggcacgtttgtaggtggctacctggccgcattatactcgggatacaacattgagcagattatgtacctcggttctggcctatgctgcgtcggagcgctggctgggctgtccacgcagggtacagccaggctcggtaacgcactcggaatgatcggcgtcgccggaggcttggccgctacccttggggtattaaaaccaggtcctgaattgttagcccaaatgtccggcgcaatggcacttggcggtacaataggcctgaccatcgcaaagcgtatccaaatttccgatctcccacaactcgtcgccgctttccactctcttgtgggactagccgctgtcctaacatgtatagctgaatacatcatcgaatatcctcatttcgctacggatgcagcagcgaatctaactaagattgttgcttacctcggtacctacattggcggtgtaacattctcaggctctttgatcgcatacggcaagctacagggcctgctgaagtctgcacccctcctgctccccggacgccacctactgaacgcagggctgcttgccgcttccgtgggcggaattatccccttcatggtggacccctccttcacaacgggcatcacctgtctggggtccgtgagcgcactcagcgccgtcatgggggtcaccttaaccgcggctatcggaggagccgacatgccagtggttatcaccgtgctcaatagttactcaggttgggctctctgcgccgagggctttcttctgaacaacaacttgttaactatcgtgggggcactgataggaagctccggggctatcctgtcatatattatgtgcgttgccatgaataggtccctggcaaatgtcattctaggcggttacggcacaacttccaccgcagggggtaaacctatggagataagcggaactcataccgagatcaacctggacaatgctattgatatgatccgtgaagccaatagcattatcataacacccggatatggactctgtgctgcaaaggcacagtatccgatagccgacttggttaaaatgctcactgagcaaggcaaaaaggtgcggttcggaattcaccctgtggcgggacgtatgcccggtcagttgaacgttctgctagctgaggccggtgtcccttacgatatcgtactggagatggacgagattaatcacgacttccccgataccgatctcgttctagtcatcggtgccaatgacacagttaactccgccgcacaggaggatcccaacagcattattgctggcatgccggttctagaggtgtggaagagcaagcaggttattgtgatgaagagaagtctgggtgttggttatgctgctgtagataaccctatcttctacaagcccaacacagctatgctcttgggggacgccaaaaaaacttgcgatgccttgcaggctaaagtgcgagaaagctatcagaagtag

SEQ ID NO: 232688 - DNA, 357 bp, Artificial Sequence
  Description of Artificial Sequence: Synthetic coding sequence
atgcggcgagcaggccttggagagggcgtcccaccgggtaattatggcaattatggatatgcaaatagtgggtacagcgcttgtgaggaagaaaatgagcgactgacggagtcattgcgaagtaaagtgactgcaattaaatctctgagtattgagataggccatgaagtgaagacacagaacaaactgctggccgaaatggactcacagtttgacagcaccacaggattcctgggcaagaccatgggcaaattaaagattctaagtcgaggctcgcagactaagctgttatgctatatgatgctattttccttattcgtgttcttcataatttactggattattaagctgagatag

SEQ ID NO: 232689 - DNA, 1107 bp, Artificial Sequence
  Description of Artificial Sequence: Synthetic coding sequence
atgaatccggcagccgaagccgaattcaatatactgctggcgactgacagctacaaggtcacgcactataagcaatatccacccaataccagcaaagtttatagctacttcgaatgcagagagaaaaagacagagaatagtaagctgcgcaaggtgaaatacgaagagaccgtgttttatggcttgcagtatatcttaaacaaatatcttaaagggaaggttgtgacgaaagaaaaaatccaagaagctaaggacgtgtacaaggagcatttccaagacgacgtatttaatgaaaagggctggaactacatactggagaaatatgatgggcacctgcctatcgagatcaaggccgttcctgaagggtttgtgatcccaagaggcaacgtcctgtttacagtggagaacactgatcctgaatgttactggctgaccaactggatagaaactatcttagtacaatcttggtatccaatcactgttgccaccaatagtagggagcagaagaagatactggctaagtatctcttggagacatcaggaaatctggatggacttgagtacaagctgcacgattttgggtaccggggtgtgtccagtcaggaaacggctggtataggggctagcgcacacctcgtcaatttcaagggtaccgatactgtggccggtcttgctctgatcaagaaatattatgggacaaaggaccctgtacctggatactcagtgccagcagctgagcattctacaatcaccgcatggggcaaagatcatgagaaagatgcctttgaacacattgtcactcagttctcttccgtgcctgtctcagtggtctccgactcttatgatatatacaatgcatgtgagaaaatatggggcgaggacttgaggcaccttatcgtgagcaggagtacccaggcgcctctgatcataaggcccgattccggtaacccactagacacagttcttaaggtacttgaaattctgggaaagaagtttcccgtgaccgaaaattccaaagggtataagctattgcccccttacctgagagtaattcaaggggatggagtcgatatcaatacgctacaggaggtgtgcgtcctttattag

SEQ ID NO: 232690 - DNA, 183 bp, Artificial Sequence
  Description of Artificial Sequence: Synthetic coding sequence
atgaatccggctgcggaggccgagttcaacattctgctcgccacggatagctacaaagtgacccactacaagcagtaccctccaaacacttctaaggtgtactcatacttcgagtgtagagagaagaaaactgagaactcaaagttgcgtaaagtcaagtacgaggagactgttttttattag

SEQ ID NO: 232691 - DNA, 267 bp, Artificial Sequence
  Description of Artificial Sequence: Synthetic coding sequence
atgaacccagcagcagaagccgagttcaacattttactggcaaccgatagctacaaggttactcactataaacagtatccgccaaacacttccaaagtgtattcttatttcgaatgcagggaaaaaaaaacagaaaatagcaagctgcgaaaagttaagtacgaagaaaccgtgttttacgggcttcagtatatccttaacaaatatctgaagggtaaggtggtgacgaaagagaagattcaggaagccaaggacgtatacaagtag

SEQ ID NO: 232692 - DNA, 1701 bp, Artificial Sequence
  Description of Artificial Sequence: Synthetic coding sequence
atggcagctgagcaggaccccgaagctcgggctgcggctcggccactgttaacagatttgtatcaagcaaccatggcccttggatactggcgggcaggcagagccagagacgctgccgagtttgagctcttcttccgtagatgtccctttggcggagccttcgctctggctgccggactcagagattgcgtgcgcttcctgcgagcctttaggctccgggatgcggacgtccagttccttgcatcggtcctgcccccagacacggatcccgcattcttcgagcatctgcgagcgctagattgctctgaggttaccgtcagggctctgcctgagggatctttggcctttcccggagtgcctctgttgcaggtttccggacccctgcttgtagtgcaactcctggagacccccctgctgtgcctagtcagttacgcttctctggtagctactaatgccgctcgtctccgcctgattgcaggcccagagaagcggctgctggagatgggcttacggagggcccagggacccgatggaggcctgacggcctccacttactcgtacctcggcggattcgacagctcctctaatgtgctggccggtcaattgcgaggcgtccccgtggccggaaccctggcccattcttttgttacatcattctctgggtcagaggttccccctgaccccatgctggcacccgcagcgggagagggtcccggtgtagatctagctgcgaaagcccaggtttggctggaacaggtctgcgcacacttaggcctcggcgtgcaggaaccacaccccggagaaagggctgccttcgtcgcttacgctctcgcttttcctagagctttccagggtctgctcgacacttactccgtctggcgtagtggcctaccaaattttctggctgtcgccctggccctgggtgaactcggataccgggctgtcggtgttcgattagacagcggggacctcttgcaacaggcgcaggagatccgcaaagttttcagagcagccgctgcacagttccaggttccttggctggaatcagtgctgatcgtcgttagtaacaacatcgatgaagaagccttggccagactggcccaggaagggtctgaagtcaatgtgataggtatagggacttctgttgtgacttgcccacaacagccaagcctgggaggggtttacaagctagttgctgtgggcggtcagccgagaatgaaacttacagaagacccggaaaagcagacactgccgggatccaaggccgctttcaggctcctaggttcagatggaagccccttgatggatatgttgcaattagcagaggagcctgtcccacaagccggacaggagttgagagtatggcctccaggcgcacaagagccctgtacggtccggcctgcacaggtagaaccccttctgcgcctctgcctccagcagggccagttgtgcgaacccctgccgagccttgctgaatcaagagcacttgcccagttgtccctgtctagactttctccagagcaccgcaggctgagatcccctgcccagtaccaggtgggcggtggaccgccttgtcactctgctctttgcgctcccgctctgacgctcccgactgcaccggtcctctgttccctgcaggtcgtgctttctgagcggctgcaggccctggttaatagcctctgcgctggccagagcccatag

SEQ ID NO: 232693 - DNA, 1578 bp, Artificial Sequence
  Description of Artificial Sequence: Synthetic coding sequence
atggctgcagagcaagaccccgaggctcgcgcagctgcacggccacttttaacggacctctatcaggccaccatggctctgggctactggcgggctgggcgtgcgagggacgcagccgaatttgaactgtttttcaggaggtgcccatttgggggagcctttgcactcgcggcaggattgcgcgattgtgtgcggttcctgcgcgcatttagactgcgcgacgctgatgtgcaattcctggctagcgtcctcccacctgacacagatccggcttttttcgagcaccttagagcgttggactgcagtgaggtgacggtgcgagccctgccggaggggtcactggcattccctggcgtgccactgctacaggtcagcggtcccttgctggtggtacagctcttagaaacgccgcttctctgtctggtttcttacgcaagcttggtggctactaatgcggctcgactcaggctgatagccggtcctgaaaaacggctgcttgagatggggcttcggagagcgcaggggcctgacggagggcttacagcttcaacttatagctatctgggagggttcgattcatctagcaacgtgttagccggacagctccgaggtgttccggtggccggtacgctggcacactcatttgtgactagcttttcaggaagtgaggtgccacccgaccccatgctggccccagctgcaggggaagggcctggtgtggacttggccgcaaaagcccaggtctggctcgaacaggtctgcgcccacctcggactaggggttcaggaaccccaccccggtgagcgggcagcctttgtagcttacgcattggcttttccaagagcattccagggcttactcgacacctattctgtgtggagaagtggtttaccaaacttcctcgccgtagccctcgcgttgggtgaactagggtatcgtgccgtcggcgtaaggctcgactccggggacctcctgcaacaggcccaggaaatccgtaaggtgttccgcgctgccgctgcacaattccaagtgccttggctagaaagcgttttaatcgtggtgtctaataacatagacgaggaggcccttgctcggctggcccaggagggcagcgaggtaaatgtgattggtatcggaactagcgttgtaacatgtcctcaacagccgtcactgggtggcgtgtacaaactcgtagcagtcggcggtcagcctcgtatgaaactaaccgaggacccagaaaagcagacactccctgggagtaaagccgcttttagactcctcggcagcgatgggtctccacttatggatatgttacaacttgcggaggagcccgtgccccaggctggccaggaactgcgtgtctggccaccaggtgcccaggagccctgcaccgtccgtcctgcgcagctctgcgagccactcccctctctggcggagtcaagggccctggcacaactgtccctttctaggttgagccccgaacatcgtagactgagatctccagctcaatatcaagtggtgttgtctgagaggctccaagctctggtgaacagcttgtgcgccggacagagcccttag

SEQ ID NO: 232694 - DNA, 1473 bp, Artificial Sequence
  Description of Artificial Sequence: Synthetic coding sequence
atggcagccgaacaggacccagaggcacgggcagccgcacggccattactcacggatctttaccaagcaaccatggctcttgggtactggcgcgcaggcagggccagggacgctgccgaatttgagctgttctttcggcgttgtccctttggtggagccttcgctctggccgcaggattgcgcgactgtgtcaggttcctcagggccttcagactgcgggacgccgatgttcaatttctcgccagcgttctcccgccagacactgatcctgcttttttcgagcacctccgtgccttagactgttctgaagttactgtgagagcgcttcctgaggggtccttggccttccctggagttcccttgctgcaggtttcaggccctctgctggttgtacagctcttggagacacctctgctgtgcctcgtgtcgtacgcttccctagtggccaccaacgcagcccgtctgaggctgattgcagggcctgaaaagagactgctagagatggggttgcggagagcccagggtccagatgggggattgactgcctcaacatatagttacctggggggttttgacagctcatctaacgtactggccggacagttacgaggcgtcccggtggccggaacgctcgcacactcctttgtgacttcttttagcggttcagaagtccccccagatccaatgctagccccagctgctggcgagggccctggagtcgacctggccgcaaaggcccaagtctggctcgaacaggtgtgtgctcaccttgggctgggggttcaagagccacatccaggcgagcgcgctgcctttgtggcctacgcactggcttttccacgtgctttccaaggattgctagacacctattccgtatggcgcagcggccttcctaactttctggccgtggctttggcacttggcgagctgggttaccgcgctgtgggagtgcggctcgactctggtgacctcctacagcaagcccaggagatcagaaaggtgtttagagccgctgctgcccagttccaggtgccctggctcgagtccgtcttaatcgtggtttctaataacatcgatgaggaagcactcgccaggttggctcaggaaggcagcgaagtgaacgttatcggaatcggaacaagtgtggttacgtgcccgcagcagcccagtctgggaggcgtgtacaagctcgtcgctgttggaggccagccaagaatgaagctgaccgaggaccccgagaaacagacgctgccagggagcaaggctgcatttcggttactggggagtgacgggagtccgttgatggacatgctgcagctggccgaggaaccagtgccccaagctgggcaggagctgcgcgtttggcctcctggagcacaggagccctgcacagtaagacccgctcaagtcgaaccgttgttgagactgtgtttacagcagggccaggtggctgcgccaccgccatccagctag

SEQ ID NO: 232695 - DNA, 1617 bp, Artificial Sequence
  Description of Artificial Sequence: Synthetic coding sequence
atggccgcagagcaggatcctgaggcacgggctgctgccaggcctctattaacggacctgtaccaggcaactatggcactcggatactggcgtgctggacgcgcaagagatgcggctgagttcgaattgtttttccgtagatgtcccttcggcggagctttcgcgctggccgcaggactcagggattgtgtgcggtttcttcgagccttcaggttaagggatgctgacgtgcagttcttggccagcgtgttgccacctgacaccgaccccgctttttttgagcaccttagggccctggattgcagtgaagtgaccgtgagggccctccccgaggggagccttgctttccccggagtccctctgcttcaagtctctggtcccctcctggtggtgcagctgttggagactccgctgctgtgtttagtttcctacgcctcactggtcgccaccaatgcagctcgtctcaggctgatcgcgggacccgaaaaacggcttttggaaatgggtcttcggcgtgctcagggcccagatggcggacttaccgcctccacatactcctacctcggcggtttcgactcctcctccaatgttctagcagggcagcttaggggagtgcctgtggccggaaccctggctcactcctttgtcacttccttctctggcagcgaagtgcctccagaccctatgctggcacccgctgcaggcgaggggcctggggtagatctggcagccaaagcccaggtgtggctggagcaggtgtgtgcccacctaggattgggtgtgcaggagccacatcccggtgagagggcagccttcgttgcatatgcgctggccttccctagagcctttcagggtctactggacacctacagtgtttggcggagtgggctgcctaattttctcgccgtagcccttgccctcggagaactcggctatcgggctgtaggtgttcgtctagactcaggtgatctgctgcaacaagcccaggagatacgcaaggtgttcagagccgctgctgcccagttccaagtcccttggctcgagtccgtgctgattgttgtttcaaataacattgacgaagaggccctggcccgactggcccaggagggtagcgaggtaaatgttatcggcataggaaccagcgttgtgacgtgtccccagcagcccagcctgggtggcgtgtataagctggtagccgtcgggggacagccaagaatgaagcttacagaagacccggaaaagcagacacttcccggtagcaaggccgcttttcggttgctcggttctgacggctccccactcatggatatgctccaattagctgaagagccagtgccacaggctgggcaggaactgcgggtgtggccacctggggctcaggagccttgcaccgtgcgacccgctcaggtcgagccgctccttcgactgtgtctgcagcaaggccagctatgcgagcctctaccatcacttgcggagtcacgcgctctcgcccaattgtccttgagccgtctgagccctgaacataggagactcaggtctcccgcacagtaccaagtggtcctgagtgagaggctgcaggctctggttaattcattgtgcgctggtcaaagcccctag

SEQ ID NO: 232696 - DNA, 2199 bp, Artificial Sequence
  Description of Artificial Sequence: Synthetic coding sequence
atgccggaggaaactcagacacaggaccagcccatggaggaggaggaagttgaaacttttgcttttcaggctgaaatcgcgcagctcatgtcattgatcatcaatactttctattcgaacaaggagatttttctgcgggaactcatttcaaactcttccgatgccctggataagatccggtacgagagtttgacagacccctccaagctggacagtggtaaggaactgcatattaatttgattcccaacaaacaggacagaaccctcacgattgtggatacggggatcggtatgacaaaggccgatctcataaacaatctgggtaccatagccaaatctggcacaaaggcctttatggaagcactccaagcgggagccgacatcagtatgattgggcagtttggagttgggttttacagcgcttatttggtcgctgagaaggtcactgtaatcaccaaacataatgacgatgaacagtacgcttgggagagcagcgctggaggctctttcactgtgaggaccgacaccggggagccgatgggaagaggaacaaaagtcattctgcatctgaaggaggatcagaccgagtatcttgaggaacggaggattaaagaaatagtcaagaagcatagccagtttatagggtaccccattacactcttcgttgagaaggagcgagacaaagaggtgtccgatgatgaagctgaagagaaggaggataaggaagaggaaaaagagaaagaagagaaggaatccgaagataaaccagagatcgaggacgtcgggagtgacgaggaggaagagaaaaaggacggtgacaagaagaaaaaaaagaaaatcaaggaaaagtatatcgaccaggaggaactgaacaaaaccaagcctatttggactagaaaccctgatgacattacaaacgaagaatacggtgaattttataagagtttgaccaatgattgggaagaccatcttgcagttaagcacttttccgtcgaaggtcagctggagtttcgggcactgctctttgttcccagacgtgctccttttgacctgtttgaaaaccgtaaaaagaagaataacatcaagctttatgtgcggagagtgtttatcatggataactgtgaagagctgatccccgagtacttaaatttcatccgaggagtggtggattctgaggatctcccgctgaacattagccgcgagatgcttcaacagagtaaaattctcaaggttatccgaaagaatctggtgaaaaaatgcctggaactctttactgagctagccgaggacaaggagaactataaaaagttctacgagcaattttccaaaaacatcaagctgggaattcacgaagactcccagaaccggaagaaattgtcggagctgctccgctactatactagcgcgagtggggacgaaatggtgagcttaaaagactattgcactagaatgaaagagaatcagaagcacatttactatatcactggcgaaaccaaggatcaggttgctaacagcgctttcgtagagagactgagaaagcacggcttggaagtgatctatatgatcgagcccattgacgagtactgcgtgcagcagctgaaagaatttgaaggaaagacccttgtcagcgtcacaaaagaaggcttagaactccccgaggatgaagaggaaaagaaaaaacaggaggagaaaaaaactaaatttgagaatctgtgcaagattatgaaagatatcctggaaaaaaaggtggagaaggttgtcgtttcaaataggcttgtgaccagtccttgttgtatagtaacctctacatatggatggacagctaatatggagcgaattatgaaagctcaggctctgcgggataattccacaatggggtacatggcggctaagaaacatctggagatcaatcctgatcactctatcattgaaaccctgcgccagaaggccgaggcggataagaatgataaatccgtaaaggacctggttatcctcctgtatgaaacagctcttttgtcttctggttttagcctggaagatcctcagacccatgccaataggatctacagaatgatcaaactgggtcttggcattgatgaagacgatcccacagcagatgatacgtcagcagccgtgactgaagaaatgcctcccctcgagggggatgatgacacatctagaatggaagaagtcgattag

SEQ ID NO: 232697 - DNA, 2910 bp, Artificial Sequence
  Description of Artificial Sequence: Synthetic coding sequence
atggagggagacagggtggcagggagacccgtgctttctagcctccccgtgttgcttctgctacccctgcttatgctgcgagctgctgccctgcaccccgatgagttgttcccccacggagagtcctggggtgaccagctcctgcaggagggggatgacgagtcttcagctgtggtgaagctggccaatcccctgcacttttacgaagctcgattctctaacctctatgtcggaactaatgggatcatttcgacacaggacttcccgcgagagacacaatatgtagactatgattttcctacagattttcctgcaattgctccattcctggccgacatagatacctcccacggacggggaagggtcctgtatagggtcaacggtaaggtgagcggccatctgcacgtggggcatactccggtgcatttcactgatgtcgacctgcacgcttatatcgtcggtaatgacggcagggcttatacagcaatctcacacatccctcaaccagcggctcaggcgctactgcccctgacccccataggaggtctctttggttggctgttcgcccttgagaagcccggatctgaaaacggctttagcttagccggagcagccttcactcacgacatggaggtcacattttatccgggtgaggaaaccgtcagaattacacagacggctgagggacttgatccagaaaattatttgagcatcaaaacgaatatacagggccaggtgccatacgtctcagctaactttaccgctcatatctctccctataaggaactgtaccactatagcgattcaacagtgacaagtacgagctccagagattactcccttacgttcggagcaataaaccagacatggagttacaggatccaccagaacattacttatcaagtctgccggcatgctccgcgacacccttcatttcctactactcagcaactgaacgtggatcgagtgttcgcgctgtataatgatgaagagcgggtgctcaggttcgccgtgactaaccagattggccctgtaaaagaagacagtgacccaactccgggaaatccttgctacgacggcagccatatgtgcgacactaccgcccgttgtcatcccggtacaggcgtggactatacctgcgagtgcgcctctggctaccaaggagatggacggaactgcgtagacgagaatgagtgcgccaccggcttccatcgctgcggccctaactccgtctgcattaacctgcctggttcttaccgctgtgagtgccgcagtggatacgagttcgctgatgacagacacacttgtatcctgataacacctcctgccaacccctgcgaagacggctcccacacctgtgcaccagccggtcaggccagatgcgttcaccacggaggcagcacttttagttgcgcttgtctacccggatatgctggggacggccaccaatgtaccgatgtggacgagtgtagcgaaaataggtgccatccggctgccacgtgttacaatactcccggttcttttagctgtcgatgtcagccaggttattatggagacggttttcaatgcattcccgattccacgtccagccttacaccctgcgagcagcaacagagacacgcccaggctcagtatgcatatccgggtgcccgatttcacattccccagtgtgacgaacaggggaacttcctccccctacagtgtcatggatcaaccggattttgctggtgcgtggacccggacggacatgaggtcccagggacacaaaccccaccaggatccacaccgcctcactgtgggccttcccctgagcccacacagagacctccaaccatttgtgagaggtggagagagaatctgctggagcactacggaggaactcctcgcgatgaccaatatgtgccccagtgcgacgatctcggtcatttcatccctcttcagtgccatggaaagtccgacttctgttggtgtgtggacaaggatggccgtgaagtccaaggaacgagaagtcagcctgggacaactccggcatgtattcctactgttgcccctccgatggtgcggccaacccctagacctgatgtaactccacctagcgtcggcaccttcttgctctatacacaggggcagcaaatagggtaccttccattaaatggtactcgtctgcagaaggacgccgctaagacactgctatctctccacggcagcattatcgttggaatcgactatgactgcagagagagaatggtgtactggaccgacgtcgccggaaggactatctctagagccggactcgaattgggggcagaacctgagacaattgtcaattccgggctgatctctcccgagggccttgccattgaccacatcagaaggactatgtattggaccgacagtgtgcttgacaaaatcgagagcgccctcttagacggatcggagcgcaaagtgttattctacaccgacctcgtaaaccccagagccattgccgtggacccaatccggggtaatctgtactggacggactggaaccgcgaagcacccaagatagaaacttcctccctggacggtgagaacaggagaatattgatcaacactgatattggcttgcccaatggcctcacattcgatccattctccaagcttctgtgttgggctgatgcaggcactaagaaactggaatgtactcttcctgacggaaccggcagaagagtcattcagaacaacttaaaatatcccttttcaatagtgagctacgcagaccacttctaccacaccgattggaggagagacggagtagtgtctgtaaacaaacatagcggtcagttcaccgatgaatacttgccagagcagcgatcgcatctatatggcattacagccgtatatccgtattgtcctaccggacgcaaatag

SEQ ID NO: 232698 - DNA, 3543 bp, Artificial Sequence
  Description of Artificial Sequence: Synthetic coding sequence
actcctcagaccgagcgtatcacccacagtagtatcagttggagttttctgttgcggtttagcagaggcaaattgttgatgcttagagccgctgcattacatcctgacgaactgtttccccacggtgagtcgtggggagaccaactgctccaggaaggcgacgacgaatcttccgcggtggtcaaactcgccaatccattacacttttacgaagctcggttctccaatctctatgtagggaccaacggcatcatctctacacaggatttccctagggagactcaatatgtggattatgactttcccaccgacttccctgccatcgctccttttcttgctgacatcgacacgtctcatgggagggggagagtactgtatagggaggacactagtccagccgtgctcggcctggcagcgcgttatgtccgcgctgggttcccacgcagcgccagatttacgcctacgcatgcgttcttggctacatgggagcaggtaggagcctatgaagaggtcaaacgaggggctctgccatccggggagctgaataccttccaggccgtcctcgcatcagacggaagcgacagctacgctctgtttctctaccccgcaaacggtctgcaatttctgggcacacggcctaaggagagttacaatgtgcagcttcagcttcccgcacgcgtgggattctgtaggggcgaggccgacgatttgaagagcgagggcccttacttttccctgaccagcactgagcagtctgttaagaacctttaccagcttagcaacctcggcatccctggagtttgggccttccacataggctctacaagccccctggacaacgtgcggcctgctgctgtcggcgacctcagtgccgctcattcctctgtgccactgggaaggtcattttctcatgctaccgctttggaaagtgattacaatgaggataacttagactactacgatgtgaacgaagaggaggccgaatatctgcctggggagccagaagaggcactcaacgggcacagcagcatcgacgtatcttttcaaagcaaggtggataccaaacctctcgaggagagcagtaccctggatccccacactaaggaggggacatcgctaggagaagtgggaggacctgatctcaaaggacaggtagagccctgggacgagagggaaactcgcagtccggctccccctgaggtcgatcgcgattccctagcccctagctgggagactcccccaccctaccctgagaacggttcaatacaaccatatcccgatgggggaccagtgccttccgagatggatgttcctccggcacaccctgaagaggagatcgtgctaagaagttaccccgcatcagggcacacaacacctctcagcaggggaacttacgaggttggcctcgaagataatattggatcgaacaccgaggtgttcacatataacgctgccaataaggagacttgtgaacataaccacagacagtgctcaagacatgcgttttgtacagattacgcaacagggttctgctgccattgtcagagtaaattttacggcaatggcaagcactgtctgcctgaaggggcaccccaccgggtcaacgggaaggtcagcggccaccttcacgttgggcacactcctgtgcactttacggatgtagatctgcatgcatacattgtcggcaatgatgggagggcctacacagctatctcacacatccctcagcccgcagcccaagccctgttgcccctaactccgatcggagggcttttcggatggctgtttgcgttggaaaagcctggatctgagaacggcttttccctggctggggctgctttcacacatgacatggaggtgacattctatccgggtgaagaaaccgttaggatcacccagactgctgagggcctcgaccccgagaactacctatccattaagaccaatatccaggggcaggttccttatgtgtctgccaacttcactgctcatatctctccatacaaagaactgtaccactacagtgattccactgtcacaagcactagctccagagactattctctaaccttcggtgccattaaccagacctggtcttaccggatacaccagaatataacatatcaagtgtgccgacatgcaccaaggcatccctctttccctaccacccaacagctcaatgtggacagagtatttgctctgtacaatgacgaagagcgcgtgcttaggttcgctgtgacaaaccagattggaccagtgaaagaggactctgatccaacacctggcaacccgtgctatgatggctcacatatgtgcgacactaccgcaagatgccaccctggaacaggcgttgactatacctgcgagtgcgcttcggggtatcagggggacggacgaaattgcgtggatgagaatgagtgtgccacaggcttccacagatgtggacccaacagcgtgtgcatcaaccttcctgggagttaccgctgtgaatgccgtagcggctacgagttcgcagacgaccggcatacctgcatactcattacccctccagccaacccctgtgaggatggctctcacacttgcgcacccgctgggcaggctcggtgtgtgcaccacggaggctccacattctcctgcgcctgtctccctggctacgctggcgatggacatcagtgcacggacgttgacgaatgtagcgaaaataggtgccaccccgcagcaacatgctacaacacacctgggtcttttagctgccggtgtcaacctggatactatggcgatggcttccagtgcatccccgacagcacgtcttcccttaccccctgtgaacagcagcagagacatgcccaggcccaatacgcttaccctggagcaagattccacatcccacagtgtgatgaacagggcaactttctcccgctgcagtgccacgggtcaacaggattttgctggtgtgtggaccccgacggacatgaagtccctggaacgcaaacaccacccggatccacaccaccacactgtggccctagtccggaacctacacaaagaccacccacgatttgtgagcgttggagagagaatctactggaacattatggtggtactccaagggatgaccagtatgtgccgcaatgtgatgatttaggtcatttcattcccctacaatgccatggaaaatcagacttctgctggtgtgtagacaaggacgggagggaggtacagggcacgagaagccagcccggaacaacgccggcttgcattccaactgtagctccccctatggttcgcccaacaccaagacctgacgtgactccaccttccgtgggaaccttcctgctatatacccaaggccagcagattggatatctgcctctgaatggaaccaggctacagaaggacgcagctaaaaccctgttatctctgcatgttaagtggattagcccagtgggaggcagggctgcttggctcagccaatgggagccccctcatcggccttgctgtagtgaggtcgactggtgtcgcgaggtgctggaaggcttctag

SEQ ID NO: 232699 - DNA, 3825 bp, Artificial Sequence
  Description of Artificial Sequence: Synthetic coding sequence
atggagggagatagggtgaaactcgctaaccctctgcacttctacgaggccaggtttagtaatctttatgtcggcactaatgggatcatatccacccaagatttcccacgagagacccagtatgtcgattatgactttccgacagatttcccagccattgcaccctttttggccgatatcgatacctctcacggacggggtcgtgtcctgtatcgggaagatacctctccagctgtgctgggcttggcagcaagatacgtccgggctggattccctcggtctgctagattcacccccacgcacgcctttctcgcaacctgggaacaggtcggtgcatacgaggaagttaagaggggggctctgcctagcggtgagctgaacacgtttcaggcggtcctcgcatctgatgggagtgattcatacgcactctttctctatccagctaatggattgcagttcttggggacacgacctaaggagtcttacaacgtccagctgcaattgcccgctagagtcggattctgccggggagaggcagacgatctgaagtccgagggcccatatttctcactgacaagcaccgaacagtccgtcaaaaacctctaccagcttagcaacttagggatccccggagtctgggcattccacatcgggtccaccagcccactcgacaatgtgagaccagccgctgttggagacttgagtgccgcacattcatccgtccctctgggcaggtccttttcccatgccactgcactggagagtgattacaacgaagataacttggactactacgatgtgaacgaagaggaggcagaatatttgcccggagagcctgaagaagcgcttaacggtcacagcagcatagacgtgagtttccagtcaaaggtggataccaagccactggaagaatcatccacattagatcctcatactaaggaaggtacatctctgggtgaagttggtggaccagacctgaagggccaagtagagccatgggatgagcgcgagacaagaagtccagcccctcccgaggtggatcgggattccttggcgccaagctgggagacccccccaccttacccagaaaacggctcaatccagccctaccccgatggcggacccgttcccagcgaaatggacgtcccgcctgctcaccccgaagaagaaatagtcctgcgcagctacccagcgtctggtcacactactcccttatctcggggtacctatgaggtaggactggaggataacattggctcaaacacggaggtgtttacctacaatgccgcaaacaaggaaacctgcgagcataaccaccgccagtgttcacgccacgctttttgcacagattacgcgacaggcttctgttgccactgccagagcaagttttatggtaacggcaagcactgtctgcccgagggagccccacacagggttaacggaaaggtttccggccacttgcatgtgggccacacccccgtacacttcactgacgtggacctgcatgcttatatcgtgggcaacgatggacgcgcatatacagccatctctcacatcccccagccggcagctcaggccctcctcccgttgactccaataggtggcttgtttggttggctttttgcccttgaaaagccgggttcagaaaacggcttttcactggccggagcggcatttacgcatgatatggaagtgaccttctaccccggagaggagaccgtccggattacacaaacagctgagggactggatcctgagaattatttgtcaatcaagactaacatccagggccaagtgccttatgtgtccgcgaatttcactgcacacatctccccgtacaaagagttgtatcactactccgatagcacagttacgtcaacctcatctcgagactattccctgacgtttggcgctatcaatcagacctggtcatatcggatccatcagaatattacctatcaggtctgtcgacacgcacccaggcaccctagctttccaacgactcagcaactaaacgtcgaccgggttttcgccctttacaacgacgaggagagggtcctcaggttcgcagtcaccaaccaaatcggccctgtgaaagaagacagtgaccccacacctggaaatccctgttatgatggatcccatatgtgcgacaccaccgctaggtgtcaccccggaacaggcgtggattatacctgcgaatgcgccagtgggtatcagggagacggccgaaactgtgtggacgagaatgaatgtgccacgggcttccataggtgcggtccaaactccgtgtgtattaatctccctggatcatatcgttgcgaatgcaggtccggttacgaatttgctgatgataggcatacctgcatctacgtcgacgaatgttctgagaaccgttgccaccctgctgccacctgctacaacacccccggttctttctcttgtcgatgtcagcctggatactatggtgacgggtttcagtgcatccccgattcaacaagttccctgaccccctgtgagcagcaacaacgacacgcacaggctcagtacgcttaccctggtgctcgtttccatattccacagtgtgatgaacagggaaatttcctgcccctgcagtgccacggttcaaccggattctgttggtgcgtcgatcctgacggccatgaggtgccaggaacacagacccctccagggagcaccccccctcactgcggccctagccccgagcctacacagcgcccacccacgatttgcgagcgctggcgcgagaacttgttagagcactacggtggtacaccaagggatgatcagtatgtcccccaatgcgacgatctcggtcactttatacctctacagtgtcacggtaaaagtgatttctgttggtgtgtggacaaagacggacgcgaagtgcagggcacccgctcacaaccgggaaccacccctgcatgcattccaacagtcgctcccccaatggtacggccaacaccacgccctgacgtcactccaccgtcggtcggaacatttctgctctacacccaaggccagcagatcggatatctgcccctaaacggcacccggcttcagaaagacgctgctaaaaccctgttgagcttgcatggctccataatcgtggggatcgattatgattgtcgggagaggatggtctactggacggatgtcgctggtcggactatttcaagagccggactcgaactaggtgcggagccagagacgatcgttaattccggattgatttctcccgagggtctcgccatcgaccacattaggcggacgatgtattggacggattcggtgcttgacaaaatagagtccgcactcctggatgggtccgagaggaaggttctattctacacagacctcgttaatccaagagccattgccgtggaccctatccgcggtaatttgtactggaccgactggaaccgggaggccccaaagattgaaacctcatctctggatggcgagaaccggagaatcttgattaatacagacattgggctgcccaacggattgaccttcgacccatttagcaaactgttgtgttgggccgatgcaggcaccaagaaattggagtgtacattaccagacgggacgggcaggcgcgtaattcagaataacctgaagtacccattcagtatagtgagctatgctgatcatttttatcatacggattggcggagagacggcgtcgttagtgtgaacaagcactcaggccagttcaccgatgagtacctccctgagcagaggtcgcacctctacgggatcactgccgtttacccctattgccctacagggagaaagtag

SEQ ID NO: 232700 - DNA, 3837 bp, Artificial Sequence
  Description of Artificial Sequence: Synthetic coding sequence
atgaccgcccgtggcctagcgctgggtctattgcttctgctcctatgccctgctcaagtgttctctcagagctgcgtctggtacggtgagtgtgggatcgcctacggcgacaaaaggtacaactgcgagtattccggtcccccaaagcccttacctaaggatggttatgatctcgtgcaggaactttgcccagggtttttttttggaaacgtcagcctgtgttgtgatgtgagacagcttcaaactctgaaggacaatttacagctcccactccagttcctcagccgctgcccaagctgcttctacaatctcctgaacctgttttgcgagctgacgtgtagcccgcgacagagccaatttctgaatgttaccgctacagaggattacgtggatccagttacaaaccagacaaagacaaacgtgaaagaactgcagtattacgtgggtcagtccttcgcgaatgccatgtacaatgcatgcagggatgttgaggccccaagttctaacgacaaagctttaggattactgtgtgggaaggatgctgacgcatgcaacgctaccaactggatagagtatatgttcaataaggataatgggcaggcccctttcacaatcactccggtatttagcgatttccctgtacatgggatggaacccatgaacaatgccaccaaagggtgcgatgaatctgtcgacgaagtgaccgccccatgcagttgtcaagattgtagcattgtctgcggacccaaaccccagcctccccctccgcctgcaccttggaccattttaggtctggatgcgatgtatgtgatcatgtggattacctacatggccttcttgctcgtctttttcggcgcttttttcgctgtctggtgttatagaaaacggtacttcgtatctgagtatacacccatcgatagcaatattgctttctctgttaacgcaagcgataaaggcgaagctagctgttgcgacccagtgtccgcggcattcgagggctgcctgaggagattattcacaagatggggcagcttttgtgtgcgcaaccctggatgcgtgatctttttctcccttgttttcatcaccgcctgcagcagcgggctggtctttgtgcgcgtcacaactaaccccgttgatctttggtcagcgccatcatcgcaggcaagactggaaaaggagtactttgaccagcactttgggcctttcttcaggaccgagcagctgatcatccgggctccgcttactgacaaacatatttaccaaccttacccatctggtgcagatgtgccgtttgggccacctctggacatccagatcctccatcaggttcttgatctccagatcgccatcgagaatattacagcctcctacgataacgaaacagtgaccctgcaggatatttgccttgccccactgtctccctacaacacaaattgtactatcctgagcgtgttgaactatttccagaattcacactctgtgctggaccacaagaaaggtgacgatttttttgtgtacgctgattaccatacgcattttctgtattgcgtgcgggctcccgcttctctgaatgacacctcactgcttcacgatccttgcctgggaacgttcggagggccagtttttccttggctcgttcttgggggatatgatgaccagaattacaataacgctaccgctctggttatcaccttccccgtgaacaattactataacgacaccgaaaaactgcaacgtgcgcaggcgtgggagaaagaattcataaacttcgttaagaactacaaaaaccccaatctgacaatctcattcactgccgaaagaagcattgaagatgaattaaacagagagtctgactctgatgtgttcactgtggtcatttcatatgcaatcatgtttctgtatataagcttagcactgggacacatgaaatcctgtcgaaggttgcttgttgactctaaggtgtcactgggcatcgcaggaatcttgattgtgctctcttcagtggcttgttctttaggcgtgttctcatatatcgggcttccactgacattaatcgtgatcgaagtgatcccgttcctcgtgctggccgtgggcgtcgacaatatattcattctcgtgcaggcctaccagagggatgagcgcctgcaaggagagacactagaccagcaattgggtagggtcctgggcgaagtagcaccttccatgttcctgagttcattttctgagacagtagcctttttcctgggggctcttagtgtgatgcccgctgtgcatacatttagtctctttgctggactggccgtctttatagactttctgctgcaaataacctgttttgtgtccctgctgggcctcgatataaagcggcaggaaaagaataggttagatatcttttgctgcgtgcgcggtgccgaggacggtacctccgtccaggccagtgagtcatgcctgttccggttctttaagaattcgtattctcctctgcttttgaaggactggatgcgccctattgtgattgcgatcttcgtcggcgtgctaagcttttccattgccgtgttgaataaagtggatattgggctggatcaatctctgagcatgccggatgacagctacatggtggattattttaaatccatcagccaatatcttcatgccggtccaccagtgtacttcgtcctggaagaaggccacgactacacctcatctaagggccagaacatggtttgtggagggatgggctgtaataatgactctttagtccagcaaattttcaacgcagcccagcttgataactacaccagaattgggtttgctccttcatcttggatcgacgactacttcgactgggtgaaacctcagtcttcttgctgccgcgtggataacatcacagaccaattctgtaatgcctcggttgtggacccagcgtgtgtgcgttgtcgccctctgacacccgaggggaagcaaagacctcaaggcggagatttcatgcggttcctaccaatgttccttagcgacaaccctaacccaaagtgcggtaagggagggcacgcggcatacagtagcgccgttaacatcctcctgggtcacgggactagggttggcgctacatatttcatgacctaccacaccgtgcttcagacaagcgccgacttcatcgatgctttgaaaaaagctaggctcatagcctcaaatgttacagaaaccatgggcatcaacgggtctgcataccgcgtctttccctactctgttttttacgtattctatgagcaatacctgactattatagacgatactatattcaatcttggcgtgtctcttggggctatctttctcgtcaccatggtgctgctcggttgtgaactgtggagcgcagtcatcatgtgcgcgacgattgcaatggttttggtgaatatgttcggagtgatgtggttgtggggcatcagtcttaacgcagtgtcgttagttaatctggtgatgtcttgcggaatctccgtcgagttctgttcacatataacaagagccttcacggttagtatgaaggggtcccgcgtcgagagggctgaggaagccctggcacatatgggcagctccgttttcagtggtattactttgactaagttcggaggcattgtcgtattagcttttgccaaaagtcaaatttttcagatcttctacttcaggatgtatctcgcgatggtcttgctgggggcaacccatggcctgattttcctgccagtccttttgagttatatcggtccttccgttaataaggccaaatcctgcgcgacggaagagagatataagggaaccgagagagaacgcttgttgaatttctag

SEQ ID NO: 232701 - DNA, 2883 bp, Artificial Sequence
  Description of Artificial Sequence: Synthetic coding sequence
atgtacgtgattatgtggattacatacatggccttcctgttggttttttttggggctttctttgcagtttggtgttatcggaaacggtatttcgtgagcgagtacacaccaattgattcaaatattgccttttctgtgaatgcttccgataaaggtacagcctggctcttaaccagcacattcccctctagtccagtcctcccgggagaggcttcttgctgcgatcccgtgtccgccgcttttgagggttgcctgagaagattgtttactagatgggggtccttctgtgtgcggaacccagggtgtgtcatcttctttagtttggtgttcatcacagcctgttcgtccgggctcgtcttcgtgcgcgtgaccaccaatccagtagacctgtggtcagcccctagctcccaagcacggctagagaaggagtatttcgaccagcactttggtccattctttagaacagaacaacttatcataagagcccctctgaccgataagcacatttaccaaccttatccatccggcgcagatgtgccgtttggccctcctcttgacatccagatcctacaccaagtgctcgacctccaaatagccatcgaaaacataaccgcatcatatgacaatgagaccgttaccttgcaggacatttgtctggcgccactttccccttacaacacgaactgcacaatcctttctgttttgaattacttccaaaactcgcatagcgttctcgaccacaaaaagggagacgacttcttcgtgtatgctgattaccatacccatttcctatactgtgtgagattcatcaattttgtcaaaaattacaaaaacccaaatctgacaatctcctttaccgcagagcgttctattgaagatgaactgaatagagagtcagacagcgatgtgtttactgtcgtgattagttatgcgattatgttcctgtatatcagtctggcgctcggacatatgaagtcttgccgacgactgctggtcgacagcaaagtttccttaggtattgcgggaatcttaatcgttctaagctcagtcgcatgtagtttgggagtcttttcctacattggcctacccctgacactgatcgtgattgaggtgattccctttctcgtgctggccgttggtgtggacaacatcttcatccttgttcaggcctatcagagagatgagagactgcagggcgagactctggaccagcagctcggtcgggtgctcggggaggtagccccttccatgttccttagctcattcagtgaaaccgtggcctttttcctcggggcactctcagttatgcctgcggtgcataccttcagcttatttgcaggactagctgtttttattgactttctgcttcagattacgtgttttgtctctctactgggtcttgatatcaagcggcaggaaaagaatcggctggatattttctgttgtgtgaggggagccgaggatggcacatccgtccaggcttcagagtcgtgcctgttccggttcttcaaaaatagctattctcctctattactaaaagattggatgcgccctatagtcatcgccatcttcgtgggcgtcctgtctttcagtatagcagtattgaacaaggttgacattgggctggatcagagcctgtcaatgccggacgattcctacatggtagactactttaaatccataagccagtatcttcacgctggaccaccggtgtactttgtcctggaagagggccacgactatacaagctcaaaaggccaaaacatggtgtgcgggggaatgggctgcaataacgactccctggttcagcagattttcaacgccgcacagttagacaattacactaggatcggattcgcccctagctcttggatagatgactactttgactgggttaagccccagtctagctgctgtcgggtagacaatatcacagatcaattttgcaatgccagcgtggtcgacccagcttgcgtgaggtgcaggcccctgaccccggagggaaaacaacgaccccaggggggagacttcatgcgctttctgcctatgttcttaagtgacaacccaaatcccaagtgcggcaaggggggtcatgccgcatactcctctgccgtaaacatcctcctggggcatggcacacgggtcggagcaacatactttatgacatatcacaccgtgttacagactagcgcagatttcatcgacgctttgaaaaaggccagacttattgccagtaatgtcaccgaaaccatggggattaacgggagcgcttaccgggttttcccatactctgtgttctacgtgttttatgaacaatatctgactattattgatgacaccattttcaacttgggagtctccctcggagcaattttcctcgtcacaatggtgcttctgggctgcgaactctggagtgccgtgattatgtgcgccactatagccatggtgcttgtcaatatgttcggtgttatgtggctgtggggaatttctcttaatgcagtatcattagtgaacctggttatgtcttgcggtataagtgtggaattttgctctcacataacgagagcatttactgtgagcatgaagggctctcgggtagagcgcgctgaagaagccttagcccatatgggatccagcgtgttcagtggaattactctgactaaatttggtgggattgtggtcctcgcattcgctaagtcccagatcttccagatcttctacttccgaatgtatctggcaatggtcctcctcggggcaacacatggtctgatcttcttacctgttctcctaagctatattgggccaagcgtcaataaggcaaaatcatgcgccaccgaggaacgctataagggcacagagcgcgaacgtctgttaaacttttag

SEQ ID NO: 232702 - DNA, 2331 bp, Artificial Sequence
  Description of Artificial Sequence: Synthetic coding sequence
atgtacaacgcgtgtcgagacgtagaagcacccagctccaatgataaggctcttggcctgctttgtggaaaggatgctgatgcatgcaacgccactaattggatcgaatacatgttcaacaaagataacggccaggcccctttcactatcactcccgtcttttccgactttccggtgcacggtatggaacccatgaacaacgctaccaagggatgcgacgagtccgttgatgaagttaccgcgccttgtagttgccaggactgctcaatcgtctgcggacccaaaccccaaccgcctcccccacctgccccatggaccattctgggacttgatgccatgtatgtcattatgtggatcacctatatggcgttcctgctagtcttcttcggagcctttttcgccgtatggtgttaccgtaagcgctactttgtcagtgaatatacccctatagacagcaacatcgcttttagcgttaatgcttctgataaaggcgaagcatcctgctgtgatccagtatctgctgcctttgagggctgcttacgacgactttttaccaggtgggggtctttctgtgtgcgcaatcccggttgcgttatcttcttctcgctggtgtttatcaccgcatgcagtagtgggctggtcttcgtgagagtgacaactaacccggtggatctgtggtcagcaccctcgtctcaggctcgattggaaaaagagtattttgatcaacattttggaccctttttcagaacagaacagctgatcattagagctcccctcacagacaagcatatctaccaaccatatccttcaggagccgatgtgccattcgggccaccactggatatccagatcctgcaccaggttctggatttgcagatcgcgattgagaatatcactgcctcctacgataacgaaacagtcactctgcaagacatttgcttagcacctttgtccccttacaatactaactgtaccattctgagcgtgttgaactactttcagaacagtcacagcgtgctcgaccataaaaagggcgatgacttctttgtgtacgctgactaccacacccatttcctgtattgcgtcagagcacctgccagcctcaatgacacctcactcctccatgacccctgcctgggtacctttgggggtcctgtattcccatggctcgtactgggcggttacgatgatcagaactacaataacgctaccgccctggtgataaccttcccggtaaacaattactacaacgacaccgaaaagttgcagagggctcaagcttgggagaaagaattcattaacttcgtcaaaaattataaaaatcccaatcttacaatatcattcacagccgaacgatcaatagaggacgagctcaatagagaatccgactcggacgtgttcactgtcgtcatctcttatgccatcatgtttttgtatattagcttggccctggggcacatgaagagttgtagacggcttctggtggattccaaagtctccctaggtatagccggaattctgattgtgctctcaagtgtagcctgtagtctgggagtgtttagctatatcggactgcccctgaccctcatcgttattgaggtgattccttttctcgtgcttgccgtgggcgttgataacatctttattctggtgcaggcataccagcgtgacgagcgcttgcagggcgagacgctcgaccaacagctgggtcgggtcctgggagaggtcgcaccctccatgttcttgtcgtcctttagtgaaacggtagctttctttttgggtgcattgagtgtaatgcccgcagtgcatacattttccctctttgctggactggctgtctttattgattttcttctccagatcacttgcttcgtctcattgctggggctggatataaagagacaggaaaagaaccggctggatatcttctgctgcgttcgtggagctgaagatgggacgtcggtgcaggcttccgaatcctgcttgtttcggttttttaaaaacagctatagcccactcctgctcaaagattggatgcgcccaattgtgattgctatttttgttggcgttctcagcttctcgatcgcggtactgaacaaggtggacattggactggaccaatcactaagtatgccagatgactcttatatggtcgattactttaaatccatctctcagtaccttcacgccggtccacctgtctacttcgtgctggaagaaggacacgactacacaagctccaaaggccagaacatggtctgcggcggtatgggatgtaataatgactctctggtccaacagatattcaacgctgcacagctcgacaactag

SEQ ID NO: 232703 - DNA, 369 bp, Artificial Sequence
  Description of Artificial Sequence: Synthetic coding sequence
atgcggtttcttgccgcaacctttctgctattggctctcagtaccgcagcccaagctgagccggtgcagttcaaagactgcggaagtgttgatggcgttatcaaagaggtcaatgtgagcccatgtccaactcagccttgccaattgagcaaaggacaaagttactctgtaaatgtgacttttacctccaacatacagtcgaagtcctcaaaggcagtagtccatgggatcctcatgggagtgccagtgccattcccaatacccgagcccgatggctgtaaaagtggaatcaattgtcctatccagaaagacaaaacttattcatacctgaacaaattgccagtcaagtccgagtatcccagcgtgtag

SEQ ID NO: 232704 - DNA, 456 bp, Artificial Sequence
  Description of Artificial Sequence: Synthetic coding sequence
atgaggttcttagccgcaacatttctgttgctagctttaagcacagccgctcaggcagagcccgtgcagttcaaagactgtggaagtgtcgatggggtgatcaaggaagttaacgttagcccctgcccgacgcaaccctgtcaactctccaaaggacaaagctattcagtgaatgttacatttacctccaacattcagtccaaatcctcgaaagcagtagtacacggcattctcatgggggtgccagtcccctttccaatccctgaacctgatgggtgcaagtccggcatcaactgtcccatccaaaaggacaaaacatattcctacctcaataagcttcctgttaaaagcgagtacccgtccatcaagctcgtggttgaatggcagctccaggacgacaagaaccaatccctgttctgttgggagatccccgtgcaaatcgtttcacatctttag

SEQ ID NO: 232705 - DNA, 1053 bp, Artificial Sequence
  Description of Artificial Sequence: Synthetic coding sequence
atggacctgaaagcactgctttcatctctgaacgattttgcctcattgtccttcgcggagtcgtgggataacgttggtctgctggttgaaccctccccgccacacaccgtgaatactctgtttttaactaacgatctgacggaggaggtcatggaagaggtgttgcaaaaaaaggcggacctgattctgtcgtaccatccgccaattttccgacccatgaaacgtatcacatggaacacctggaaggaaaggctggtgatcagggccctcgagaatagagttggcatttactctcctcacaccgcttacgatgccgcaccccagggcgtgaataactggttagccaagggcctgggcgcatgcacgtctcggccaattcacccaagcaaggctcctaattatcctaccgagggtaatcaccgggtggaattcaatgtgaattacactcaggatttggacaaagttatgtcagctgtcaagggcatcgacggagtgtctgttacatcgttttctgctaggacaggtaacgaagagcaaacaagaatcaatctgaattgcacacagaaagctctgatgcaagtcgtcgatttcctgtcaagaaataagcagctgtaccagaaaactgaaattttgtcacttgagaaacctctgctcctgcacacggggatgggaagattgtgcacgctcgatgaatcggtgtccctagcgacaatgatagataggataaaacggcacctcaagttgtcccacatccgtctggcccttggcgtcgggaggaccctagagtcccaggtgaaggtcgtcgccctgtgcgccggaagtggttcaagcgttctacagggagtggaggccgatctgtaccttacgggcgagatgagccaccacgatacgctggacgctgcatcccaggggatcaacgtgattctgtgtgaacattccaatacagaacgaggatttctctcagatttacgtgacatgctcgattcccatctggaaaataaaattaacattatattgtcggagacggacagagatcctttgcaggtcgtctag

SEQ ID NO: 232706 - DNA, 759 bp, Artificial Sequence
  Description of Artificial Sequence: Synthetic coding sequence
atgctgagtagctgcgtccgccctgtcccaactaccgtgcgttttgtggactctctgatatgcaatagctctaggagttttatggatctgaaagccttactgtcttcactgaacgactttgctagtctgagttttgccgagagctgggataacgtggggttgctggtggagccgtctcccccacatacagttaatactctgttcctaaccaacgatttaaccgaggaggtaatggaagaggtgctccagaaaaaggctgacctgattctgtcatatcatccaccaatctttcggcctatgaaacgtatcacctggaatacatggaaagagagattggtcatccgtgctctggaaaaccgtgtcggcatctacagcccccacactgcctacgacgccgcaccccaaggtgtgaacaactggctggctaaaggactgggtgcatgcacgagccggcctatccatccctccaaggctccaaactacccaaccgagggaaaccacagagtggagttcaacgtcaattacacccaggacctggataaggtgatgagcgctgtgaagggtatagatggcgtgagcgtgacatccttcagcgctcggaccggaaatgaggaacaaactcgaataaacttaaactgcacacaaaaggccctgatgcaggtggtggacttcttgagccgcaacaagcagctctatcagaagcatcaggataataccttctataagtccgccggatgccagctcaagtttgtaacgtag

SEQ ID NO: 232707 - DNA, 1134 bp, Artificial Sequence
  Description of Artificial Sequence: Synthetic coding sequence
atgctctcgtcatgtgttaggcctgtgcccacaaccgtgcggttcgttgacagcctgatctgcaattcatcccgctctttcatggatttgaaagcgctgctatcttccctgaacgatttcgcatctttatcatttgcagaatcttgggataacgtgggattactggtggagcctagccctcctcacacagttaacaccctcttcctgaccaacgacctgactgaggaggtcatggaagaggttttgcagaaaaaggccgatcttatcctatcttaccatcctcctatctttagacctatgaagagaatcacctggaacacttggaaggagcgacttgtcatccgggctcttgagaatagggtgggcatttactccccacatacagcctacgatgcggcacctcagggggtgaataattggctggccaaagggctgggggcttgtacatcgcggcctattcatccgagcaaggccccaaattatccaaccgagggcaaccaccgtgtggaatttaacgtaaattatacacaggacttggacaaagtgatgtcggccgtgaaggggatcgacggggtaagtgtcacctctttttcggcccgaacggggaatgaggagcaaacaaggatcaacctaaattgtacgcagaaggcactgatgcaggtggtcgactttctgagtcgaaataaacagctctaccagaaaaccgaaattctctccctagaaaaacctctcctactccacactgggatggggcgattatgcactctcgacgagagcgtgtccctggcaaccatgattgatcgcatcaagaggcacctaaaacttagtcatattagactagcactcggcgtgggacgtacgctcgagtcccaagtaaaggtcgttgccctgtgtgccggaagtgggtcttctgtgctccagggcgtcgaagccgacctgtacctgacaggcgagatgtcgcatcatgacacccttgatgcagcatcccaaggcattaatgttatcctctgcgagcattcgaacaccgagcgagggttcttaagcgatctgagggacatgctggactcacatctggagaacaaaatcaacatcatcctctctgagacggaccgggaccctcttcaggtagtgtag

SEQ ID NO: 232708 - DNA, 489 bp, Artificial Sequence
  Description of Artificial Sequence: Synthetic coding sequence
atggatctcaaggcactgctaagttctctgaatgattttgcatccctgagtttcgctgagtcgtgggataacgtaggacttctggtggaaccatctcctcctcacacagtgaatacgctttttctcaccaatgacctcaccgaggaggtgatggaggaggtactccagaagaaggctgatttgatcctgtcctatcaccctcccatctttcggcctatgaagcgcattacttggaatacatggaaagagcgattggtcatccgagctctggaaaatcgcgtgggtatttattcaccccacactgcatacgatgctgccccacaaggggtgaacaactggctcgccaaaggccttggtgcctgcaccagtcgccctattcacccctctaaagctcctaactaccccactgagggcaaccaccgagtcgagttcaacgtgaactacacccaggacctggacaaggttatgtccgctgtgaaaggaatctag

SEQ ID NO: 232709 - DNA, 1134 bp, Artificial Sequence
  Description of Artificial Sequence: Synthetic coding sequence
atgctgtctagttgcgtgcgtcccgtccctaccactgtcaggttcgtggatagtctcatatgtaatagctcgaggtcatttatggatctcaaggccctgctttctagtctgaacgatttcgcctcgcttagcttcgccgagtcctgggacaacgtaggcctgcttgtggaacccagcccgccacatactgtgaacaccctgttcttaacaaatgatttgaccgaagaagttatggaagaagtactgcagaagaaggctgaccttatcctgtcgtaccacccgccaatctttaggccaatgaagcgcattacttggaacacctggaaggagaggcttgtgattcgggctctggagaaccgtgtgggtatttacagcccccacaccgcttatgacgccgcaccccaaggagtgaacaactggctggcaaagggactaggagcctgtacctcccgtcctattcacccatcaaaagctccaaattaccctaccgaaggtaatcaccgagttgaatttaatgtgaattacacacaggatttggacaaggttatgtccgccgtcaagggaatagacggcgtgagcgtaacttccttttcggccaggaccggtaacgaggaacagaccagaattaacctaaattgtacccagaaagctttaatgcaggtggtagacttcctctccagaaataagcagctgtaccagaaaactgagattctctccctggagaaacctttactcctgcacacaggcatgggcaggctttgtaccctggacgagtccgtttccttagccaccatgattgataggatcaagcgccatctgaagctgagtcatataaggctcgctttgggagtgggtcgaactttagaaagtcaggtcaaggtggtggcgctgtgtgctggctccggctcctcggttttacaaggtgtcgaagcagacctgtatctcaccggagaaatgtcacatcacgatacactggatgcagccagtcagggcattaatgtaattctgtgcgagcacagcaatacagaacggggttttctgagcgatctgagagacatgcttgactcacacctggagaacaaaatcaatataatactatctgaaactgacagagacccactccaagtcgtgtag

SEQ ID NO: 232710 - DNA, 858 bp, Artificial Sequence
  Description of Artificial Sequence: Synthetic coding sequence
atgctgtcctcttgtgtccgaccggtgccgacaacagtgagatttgtggattccctgatctgtaattcgtcaagatcatttatggatctcaaggccctgctgagctctttgaacgactttgctagcctatcctttgctgagtcctgggacaatgttggactgctggtcgagccatctccaccacacacagtgaacacactcttcctcaccaacgatctcaccgaggaagtgatggaggaggtcctgcagaaaaaggcagacttaatcttatcctaccacccacccattttccggcctatgaaaagaattacatggaatacctggaaggaaaggctggtgatccgcgcactagagaatcgcgtgggtatatacagtcctcacacggcctatgatgcggcacctcagggggtaaataactggttggcaaagggtctgggagcatgcacctcaagaccaattcacccgtcaaaggcacccaactaccctaccgagggaaatcatcgggttgagttcaacgtgaattacacacaggacctggataaggttatgtccgccgtaaagggaattgatggggtgagcgtgaccagcttttcagcacggaccggcaacgaggagcagacccggatcaacctgaactgtactcagaaggctctgatgcaagtcgtggactttctaagtcgcaacaaacagctctaccagaagaccgagatactgtcccttgagaagtcactcaagtcaaagagctggccatgtgttttggtcttaggggcagctttctgcagggtgctgcgtcttacattcacatcccaggtgcggtgtcctatcatgattttgtggatgctcctgccgaaagagtag

SEQ ID NO: 232711 - DNA, 1134 bp, Artificial Sequence
  Description of Artificial Sequence: Synthetic coding sequence
atgctctcatcatgcgtgaggcctgttcctacaacagttagattcgtcgatagcctcatatgtaattcgtcccgcagcttcatggacctgaaagctctgctgagttccctaaacgattttgcctcactctcattcgctgagtcctgggacaacgtgggcctcctggtcgaaccctccccaccccatacagtgaataccctcttcctgacaaatgatctgaccgaagaggtgatggaagaggtcctgcagaagaaggccgaccttatcctgtcgtatcatcctccaatctttagaccgatgaagaggataacttggaatacctggaaggagagactcgtgattagggccttagaaaatagggttggcatctacagtcctcacaccgcatatgatgcagctccacagggggtaaacaactggctcgccaagggcctgggagcctgtacaagcagacccatccatccatctaaagcaccaaattaccctactgagggcaaccaccgggtggaattcaatgtgaattacacacaggatctggataaggtgatgagcgctgtgaaggggatcgatggcgtgagcgtaacctcattttcggccaggactggtaatgaggagcaaactaggattaatctcaattgtacacaaaaggcccttatgcaagtagtagatttcctaagccgaaacaagcagctatatcagaaaactgagatcctttccttagagaaaccactgttgctgcataccggcatgggcaggttgtgtacgctggatgagtcagtgtctctagctaccatgattgatcgaataaaacgccacctgaaactcagccacatccggctcgctctgggagttggtcggaccctcgagtctcaagttaaggtggtggccctttgtgctgggtctgggtccagcgttctccaaggcgttgaagcagatctgtatctcacaggcgagatgtctcaccacgacactctcgatgccgcatcccagggaatcaatgttatcctctgtgaacactctaacaccgagcggggttttttgagtgaccttcgagatatgctagattcccatctggaaaacaagattaatatcatcctttctgaaaccgaccgtgatcctctccaggtagtgtag

SEQ ID NO: 232712 - DNA, 630 bp, Artificial Sequence
  Description of Artificial Sequence: Synthetic coding sequence
atggatctcaaggccctgctgtcctctctgaatgatttcgcctccttatccttcgccgagagctgggataatgtggggctgttagtggagccatcacctcctcacactgtaaacaccctttttctaactaatgatctgactgaagaagtgatggaggaggtgcttcagaagaaagcagatctgattctgtcataccaccctcccattttcagacctatgaaaaggatcacgtggaacacatggaaagaacggctggtgatccgtgccctcgaaaaccgcgtcggaatctactccccgcacaccgcttatgatgcggcaccgcaaggggtgaacaactggctcgccaagggcctgggtgcttgtacgtcaaggccaattcacccctctaaagcgccaaattatcctacggagggtaaccatcgagttgaatttaatgtcaactacacccaggacctggataaggtcatgagcgccgtgaagggtatcgacggagtgtctgtcacttcattctctgcaagaaccggtaatgaggagcagacccgcatcaatctgaattgtacccaaaaagcactaatgcaggtagtggatttcctatcgcggaataagcagttgtatcagaaaacagaatag

SEQ ID NO: 232713 - DNA, 492 bp, Artificial Sequence
  Description of Artificial Sequence: Synthetic coding sequence
atgctgagcagttgcgttaggcccgttcctaccactgtccgctttgtggactccctgatttgcaacagtagcaggagcttcatggatttaaaagctttgctatcctcactgaacgattttgcatccctgtcgtttgcagaatcctgggataatgtagggctgctggtcgagccttctcccccacacaccgtgaatactctttttttgaccaacgatctaaccgaggaagtgatggaggaggtccttcagaagaaggcagatttgatcctatcataccacccgcctattttcaggcctatgaaacgtattacgtggaacacctggaaggagcgactcgttattagagcgctggaaaacagagtaggaatctactccccccacactgcgtacgacgcagcgccacaaggagtcaacaactggctggcaaaagggctgggtgcttgcaccagccgccctattcatccctctaaagccccaaactacccaacctag

SEQ ID NO: 232714 - DNA, 4749 bp, Artificial Sequence
  Description of Artificial Sequence: Synthetic coding sequence
atggctggcccaggaggctggagagatcgcgaggtaacagacttaggccacctccctgacccaacagggatctttagcctggacaagacgattggcctgggaacttacggcagaatttacctgggattgcacgagaagactggcgcttttacggccgttaaagtcatgaacgccagaaagactcctctgcccgagatcggaagaagggtccgggtcaataaataccagaaaagcgtgggttggagatacagcgacgaagaggaagatctgcgcacagagcttaacctgctccgtaagtattctttccacaaaaacattgttagcttttacggcgcattttttaagctctctcccccaggccagaggcatcagttgtggatggtcatggagctgtgcgccgctggttcggtgacggacgttgtcagaatgacaagcaaccaatccctcaaggaagattggatcgcttatatttgtcgggagatattgcaaggacttgcgcacctgcacgctcacagagtgatccatcgcgacatcaaggggcagaatgttctgctcactcataacgccgaagtcaagttggttgacttcggtgtcagtgcccaggtgtctaggacgaatggacgtaggaactcgtttattggtacgccctattggatggccccagaggtaattgactgtgatgaagacccccgtcggtcgtatgattaccgcagcgacgtgtggtctgttgggatcacggcaatcgaaatggctgaaggcgctccacctctatgtaatctccagcctctggaagcactgttcgtaattttgcgcgagtcagcccctacagtcaagagcagcgggtggtcacgcaaattccataacttcatggaaaagtgtaccataaagaacttcctgttcagacctaccagtgccaatatgttacagcatccatttgtgcgtgacatcaaaaatgaacgccatgtagtggagtctttgactcggcatctaactggcatcattaagaaacggcaaaagaaaggcattccactgatattcgaacgtgaggaagccatcaaagaacagtatactgtacgcagattccgaggtccttcatgtacccacgagctgctgaggttacctacgagctcccggtgtcggccacttcgggtactgcatggcgagcctagccagccgagatggcttccagacagggaagagccacaggtgcaggctttacagcagcttcagggggcagcccgagtcttcatgccacttcaagcgctagattcggcgccaaaacccctgaagggacaggcccaggcccctcagcgtcttcagggagcagccagggtcttcatgcctcttcaggctcaggtaaaggccaaggcctccaagcctctccagatgcagattaaggccccacctcgcctaagacgggctgctagggttctcatgcctctgcaagcccaggtgcgggcacccagacttctccaggttcagagccaggtctccaagaaacagcaggcccaaacgcagacctcggagcctcaagacctcgaccaggtgccagaggagtttcagggtcaggatcaagtacccgaacagcagcggcaggggcaggcccctgagcagcagcagagacacaaccaggtgccagagcaagagcttgagcagaatcaggcacccgagcagccagaggtccaggagcaggccgctgaacctgcgcaagccgagaccgaggccgaggaacctgaaagtttgcgggtcaatgctcaggtcttcctgccactgctgtcacaggaccatcatgtactgttacctctgcatctggatacccaagttctgatccccgtggaaggacagacagagggctccccccaagctcaggcctggaccctggagccacctcaggcaatcgggtcggtgcaggccctaatcgaggggctttctcgcgaccttcttagagccccaaactctaataatagcaaaccactcgggcctctccagactttaatggagaatctgagctctaacagattctatagccagcctgagcaggccagggaaaaaaagtccaaagtgagcacactccgtcaagcgttagccaaaaggttgtctcctaaacggtttcgggctaaaagttcctggcggcctgagaaactcgagctttctgaccttgaagcgagacgtcagcgacgacagcgcaggtgggaggatatctttaaccaacacgaagaagagctcagacaggttgacaaggataaagaagacgagtcctcagacaatgatgaagtattccactccattcaagccgaggtccagattgagccactcaagccttacatttctaaccctaagaagatcgaagtgcaggagcggtcaccctctgtacccaacaaccaagaccacgcacaccacgttaagttttcaagcagcgtcccacagcgttccctgctcgaacaggcccagaagcccattgatattaggcaacggtctagccagaaccgccagaactggttggcagcttccgaatcctcaagcgaggaagagagtccagtcaccggccgtcggagtcaatcttccccaccctattctaccatcgaccagaagttgctagttgatattcacgtccctgacgggttcaaagtgggcaaaataagcccaccagtctatttgaccaacgagtgggtagggtacaatgctttaagcgagatcttccggaacgattggttgacaccagcccctgtgattcagcctcctgaggaggacggagattacgtggagttatacgatgcttctgcagacactgacggggacgatgacgatgagagcaatgacaccttcgaggacacgtatgatcacgctaatggcaatgacgatctggataatcaggttgaccaggctaacgatgtgtgtaaggaccacgacgacgacaataataagttcgtggatgacgtcaacaataactactacgaggctccaagttgtcccagagcttcgtatgggagagatgggtcatgtaaacaggatggatacgatgggtcccgcggtaaggaggaggcctatagaggctatggaagccacacagcaaatcgttcccatgggggttccgctgccagtgaggataatgctgctattggagatcaggaagaacacgcagctaatatcggatcagagagaagaggatctgagggcgacggaggaaagggtgtggttaggacaagcgaagaatcaggtgccctgggccttaacggcgaagaaaattgtagcgagaccgacggtcctggattgaagcgacctgcctctcaagatttcgagtatttacaggaggagcccggtggaggaaacgaggccagtaacgcgattgatagtggagccgctccatccgcacctgatcacgaatccgacaacaaggatatcagcgagagcagcacacagagcgacttttcagctaaccactctagcccctcaaaagggtcgggtatgtccgccgacgcgaacttcgctagtgcaatactgtatgcgggtttcgtggaggtgccagaagaatccccaaagcagccatcagaagttaacgtgaaccccttgtacgtctcccccgcttgcaagaagcccttgatacatatgtatgagaaagagttcactagtgaaatctgctgtgggagcctctggggagttaatttattgcttggtaccagatctaacctctacctgatggacagatctggcaaggctgatataaccaagttgatcaggagacgtccatttcgccagatacaggtgctcgagccattaaacttgctgattactatctctggccacaagaacagattaagggtctatcatctcacatggctaagaaacaaaatccttaacaacgaccccgagtcaaaaagaaggcaggaggaaatgctgaaaactgaagaagcgtgtaaagccatcgataagctgacaggatgcgaacacttttccgtccttcagcacgaagagaccacgtatatagcgattgcattgaagtcctccatacacctgtatgcctgggctcccaaatctttcgatgaatccactgctattaaagtgtgcatcgaccagtccgctgattccgagggcgactacatgtcataccaagcgtacatcaggatattggccaagatccaggccgcagatcccgtaaacaggtttaaacgccctgacgaattgctgcacctgctgaagcttaaagtgtttcccacacttgatcataagccagtgaccgttgacctcgcaattggctctgagaagcggctcaaaattttcttcagcagcgcggatggctatcatttgatcgatgccgagtcagaggtgatgtcagacgtaaccctgccgaaaaatccactagaaattattataccccagaacatcattattctgccagattgcctgggaatcggtatgatgttgacgttcaatgccgaagctcttagtgtagaagccaacgaacagctattcaaaaaaattctagagatgtggaaggatataccatctagcatcgcattcgagtgtacacaacggaccacagggtgggggcagaaggctattgaggttcggtccctgcagagtcgagtcctggagtcggagctaaagaggagatctatcaagaagctgcgcttcctctgcacacgaggggataagctattttttacctccaccttacgaaatcaccacagtagagtgtatttcatgacattgggtaagctcgaggagctgcagtctaattacgatgtctat

SEQ ID NO: 232715 - DNA, 4751 bp, Artificial Sequence
  Description of Artificial Sequence: Synthetic coding sequence
atggcaggtcctggaggatggcgcgatagagaggtgacagacctggggcacctccccgatccaactggcatttttagtcttgacaaaactatcggattgggcacctatggtcgaatctacctcgggctgcatgagaaaacgggagcgtttaccgcggtgaaggtcatgaacgccagaaagacaccactcccggagatcggcagacgcgtccgcgtcaataagtatcagaaaagcgttggatggagatacagcgacgaggaggaagatctacgcaccgagctgaacctcctaagaaagtacagctttcacaagaacattgtaagtttctatggagctttcttcaagctgagccccccaggccagagacatcagctgtggatggtcatggagctgtgtgctgccggtagtgtcacagacgtggtgaggatgacatctaaccaaagcctcaaagaagactggattgcctatatttgtcgcgaaatactacaggggctagcccatttacacgctcatcgcgtaatccacagggatattaaaggccagaacgttcttcttacacacaatgcagaggtaaagcttgtggacttcggggtgtcagcccaagtaagtcgaaccaacgggcgtcgtaattccttcattggaacaccctactggatggccccagaggttattgactgcgacgaggatccacggagatcttatgactaccggagtgacgtctggagtgtggggatcacggccattgagatggctgagggagccccacctctctgcaatctacagccactggaggcactcttcgtcatccttagagagagtgccccaactgtgaaaagctctggatggtctcgaaaatttcacaattttatggagaaatgcacaatcaaaaacttcctatttaggcctacctctgctaatatgttacaacaccctttcgtccgcgacatcaagaacgagaggcacgtagttgagtctctaaccaggcatttgacggggattattaaaaagcgccagaagaagaaggggatcccccttattttcgaaagggaagaagccattaaagaacagtataccgttaggcggttcagggggccttcatgcacacatgaactgctcaggctgccgacatctagtcgctgccgcccactacgcgtgctccatggcgagccctctcagcctaggtggctgcctgacagggaggagccccaagtgcaggcccttcagcaactgcagggagccgcacgggtttttatgccactccaggccctggacagcgccccaaagccacttaaaggccaggcacaggcccctcagcgcctccagggtgcagcccgtgtgttcatgccactgcaagcgcaggtgaaggcaaaagcttcaaaacccctgcaaatgcagatcaaggcaccacctaggcttagacgcgctgctcgcgttttgatgccactgcaagctcaggtgagagctccccgactcctgcaggtgcaatctcaagtttctaagaaacagcaggctcagactcagacctctgagccccaagacctcgatcaggtccctgaagaatttcaaggtcaggaccaggttccggaacaacaacgtcaagggcaagccccagaacagcagcagcgacacaatcaggtgccagaacaggagctggagcagaaccaggcgcctgaacagccagaggtgcaggagcaggctgctgagcctgctcaggcggagaccgaagcggaggagccggagtccttacgagtgaacgcccaggtcttcctgccactgctgtcccaggatcatcacgttctgctgcctctccatcttgacacacaggtgctcattccagttgagggccagacagagggtagtccccaggcccaagcgtggactttggagcctccgcaagctatcgggagcgtgcaggctctcatcgagggcctttctcgggatctcctgcgagctccgaatagcaacaactccaagcccctcggtcctctgcagacattgatggagaacttgtcttcaaacaggttttacagccaacccgaacaggcacgggagaaaaagagcaaggtttcaactttaagacaggccctagcaaagcggttatccccaaagcgctttcgggcaaagagttcctggagaccagaaaaactggaactgtcagacctggaggcacgccgtcaaaggcgtcagcggaggtgggaggatattttcaaccagcacgaggaagaactcaggcaagttgacaaagataaggaggacgaatcttcagacaacgacgaggtgttccactcgattcaagcggaagtacagattgagcctctgaagccttacatttcaaaccccaagaagatagaggtccaagaacggagcccttctgtgccaaacaaccaggaccatgcccatcacgtgaaattttccagctctgttccccagcgcagcttgttggagcaggcacagaaaccaatagacatcaggcagcgcagcagtcagaatagacagaactggctggccgcatcggaatcctccagtgaggaggaatcaccagtgactggtagaaggtcccagtcaagccctccttattccacaattgaccagaagctccttgtcgatatccacgtccccgacgggttcaaggtgggaaaaatcagccctccggtgtatctcaccaacgagtgggtcggctacaacgccttatcagaaatttttagaaacgactggctgacacccgcacccgttattcagcccccagaagaagacggggactatgttgagttgtatgatgcctccgctgacactgacggggatgatgacgacgaatcgaacgacacttttgaggacacatatgatcacgcgaacgggaatgatgacctggacaatcaggtagaccaggcaaacgacgtatgcaaagaccacgacgacgacaacaacaaattcgtcgacgacgttaacaataattattatgaagctcccagttgccctagagcctcttacggtagggatgggtcttgtaagcaggacggatacgacgggtcccgcggtaaggaggaggcctatagggggtacgggtctcacaccgcgaaccgttcccacgggggaagtgccgcatctgaagataacgccgctataggcgaccaagaagagcacgccgcaaatattggatcagagcgccgagggagcgagggggatggcggaaaaggcgtggtgcgaacgagcgaagaatctggcgctctcggccttaacggtgaagaaaactgctctgagacagacggacccggtttaaaacgtcccgctagccaggattttgaatatctccaggaggagcccggagggggaaatgaggcttcaaacgcgatcgacagtggagcagctccctccgcacccgatcacgaatctgataataaggacataagcgaaagttcaactcagtcggatttctcagccaatcactccagtccaagtaagggaagcggcatgagcgccgacgctaatttcgcctctgctatcttgtatgcgggattcgtggaagttccagaggagtccccgaagcaaccttccgaagtcaatgtcaaccccctgtacgtaagtcccgcttgcaagaagcccttaatccacatgtatgaaaaggagttcacctctgagatttgttgtggaagtttgtggggcgttaatctgcttttaggaacacgatccaacctgtacctcatggaccggtcaggaaaagctgatatcaccaagctgattcgaaggagacccttcaggcagatacaagtgctagagccactgaaccttctcattaccatttcagggcacaagaatcgccttagagtgtaccatctgacttggctacgaaataaaatattaaataatgacccagaaagcaagaggcgccaggaagagatgctgaagaccgaggaggcatgcaaggccatagataagctaaccgggtgcgaacattttagcgtgctacagcacgaggaaacgacctatatcgctatcgccctgaaatcttctattcacctgtacgcatgggcacccaaatctttcgacgaatccacagctatcaaagtgtgtatcgaccagagtgctgactccgagggcgactatatgtcctaccaggcttatattcgtatattagccaagattcaagctgcggatcctgtaaacaggttcaaacggccagatgaactcttacatctcttgaagttgaaagtgttccccaccctggaccacaagcctgtcacggtcgatttggctatcggcagcgagaaaagactgaaaatattcttctcctctgccgatggctatcatctcatcgacgccgaatcggaggtgatgagtgacgtgacgctcccaaaaaacccgctggaaatcatcatcccccagaacattattattctcccagactgtctaggaattggaatgatgcttacttttaacgcggaagcattatcagtggaggccaatgagcaactcttcaaaaagatactggagatgtggaaggacatcccttcaagtattgccttcgagtgcacacagaggaccactggttggggacagaaggctatcgaggtgagaagtctgcagtctcgcgtattagagtcagaactcaagcggcgttctatcaagaagctccgtttcctctgcacccgaggcgataagctcttttttacatccacgctccgcaaccaccactcccgagtatacttcatgacgcttgggaagctagaggagcttcagagtaactacgacgtgta

SEQ ID NO: 232716 - DNA, 567 bp, Artificial Sequence
  Description of Artificial Sequence: Synthetic coding sequence
atggctgggccaggagggtggcgggatagggaggtgaccgacctgggtcatctgcccgatcctactggtatatttagcctggataaaaccatcggcctcggaacatatggaagaatatacctggggctgcacgaaaagaccggggcttttaccgccgtgaaagtaatgaatgctcgcaagactcccctccctgaaattggtcgccgtgtgagggtcaataaataccagaagtctgtcggatggaggtattccgatgaggaggaagatcttcggacggagttaaatctgttgcgcaagtactctttccacaagaacatcgtgtctttctatggagcattttttaagctcagtcctccgggacaacgtcaccagttatggatggtgatggagctgtgcgctgccggatccgtcacagatgtcgtgcggatgacgtccaaccagtctctgaaggaggactggattgcatacatctgtcgcgagattctgcagcctaaggtaatatttctaggaacgggttgctctgacagctccctgaaaaaagagctttgcttgaagcaccagaactag

SEQ ID NO: 232717 - DNA, 492 bp, Artificial Sequence
  Description of Artificial Sequence: Synthetic coding sequence
atgcaggtacctcgcgagcggataaaaattgccttccgcctgtggatccctatactcgtgattcggatagtcgtggccggaacatggccccaagccccaggactttcaaccttgggcctgaacattataattttgcctgactgcctcgggatcggaatgatgctgaccttcaacgccgaagctctctccgtggaagccaatgaacagttgttcaaaaagatccttgagatgtggaaagacatcccctcaagtatcgcctttgagtgcacccaacggacaacaggttggggtcagaaagccatcgaggtgcgaagccttcaatctcgcgtcctggagtctgaattaaaacggagatctattaaaaaactccgcttcctgtgtacccggggagacaaactgttcttcacaagtacgctccggaatcaccattctcgagtttatttcatgaccctggggaaactggaggagctccagtcaaattatgatgtgtag

SEQ ID NO: 232718 - DNA, 1449 bp, Artificial Sequence
  Description of Artificial Sequence: Synthetic coding sequence
atgttgaaattccaggaggccgctaagtgtgtgtcagggtccacagccataagtacctaccctaaaaccctgattgccagacggtacgtcctgcaacagaagctggggagtggttcatttggaaccgtgtatctggtgagtgataagaaggctaaacggggagaagagctgaaggttctaaaggaaatctctgtcggggagctcaatcctaacgaaactgtgcaggccaaccttgaagctcagctactgagtaaactcgaccatcctgctatcgtgaagtttcatgccagctttgtcgagcaggacaacttttgtatcatcaccgagtattgtgaagggagagacctcgatgataaaatacaggagtacaagcaggcaggtaagatatttcctgagaatcaaatcatcgaatggtttatccaattgctcctgggcgtggattacatgcatgagaggagaatcctccaccgggacctgaaatccaagaatgtcttcctcaagaataacctactgaagattggggacttcggcgtcagcaggctgctgatgggatcctgcgaccttgccacgacactaaccggcacgccacactatatgtctccagaggctttgaagcatcagggatatgacaccaagtctgacatatggagcctggcctgcattctgtatgagatgtgctgtatgaaccatgcctttgctgggtcaaacttcctcagcattgtgctaaagatcgtggagggggacacgccttctctacctgaacgctacccaaaagagctaaacgctattatggaatcaatgcttaacaagaatcccagcctcaggccctccgctatcgaaatcttgaaaatcccttacctggatgaacaactccagaatcttatgtgccggtacagcgaaatgaccttagaggataagaatctggattgtcagaaggaagccgctcatatcataaatgcgatgcaaaaacggatacatttgcaaacccttagagcgctcagcgaagtgcagaaaatgactccacgagagagaatgcgcctgaggaagctccaggccgctgatgagaaagccagaaagctgaagaagatagtggaggaaaagtacgaagagaactccaagaggatgcaggagctgcgctctagaaactttcagcaactgtctgttgacgtcctgcacgaaaagacccacctgaagggcatggaagaaaaagaagaacagccagaggggagactttcctgctcaccacaggatgaagatgaagaacgatggcaggggagagaagaggaaagcgacgagcccacacttgagaacttgccagagtcccaacccatccccagcatggacctccacgagctggaaagtatcgtcgaggatgcgaccagtgacctggggtatcacggcgactgtaacctgatctctcttgatgagtactggaaaaatgaaaaatag

SEQ ID NO: 232719 - DNA, 1938 bp, Artificial Sequence
  Description of Artificial Sequence: Synthetic coding sequence
atgcttaaattccaggaggccgcaaagtgtgtatccggatcaacagctatttcaacatatcctaagaccctgatcgcccgacgttatgtgttgcagcagaagctcgggtccgggtcattcggtacggtatacctcgtttctgataaaaaggccaaaaggggcgaggagctgaaagtcctcaaagaaattagcgtaggtgagttgaatcccaatgaaaccgtgcaggccaatctcgaggcccagctcctctctaaattggaccatcccgctattgtgaagttccacgccagttttgttgagcaggacaatttctgtataataaccgagtactgcgagggtcgagatctggatgacaaaattcaggagtacaaacaggcgggaaagatctttcctgagaatcagattatcgaatggtttatccagctcttacttggagtggactatatgcacgaaaggagaattctacaccgggacttaaagtccaagaatgtgtttttgaaaaataacctgttgaagattggagatttcggagtgagccggcttctgatgggctcgtgtgatctggctactactctgaccgggacgccacattacatgagtcccgaggccctgaaacatcaggggtacgataccaaaagcgatatatggtctctggcttgtatcctgtatgaaatgtgttgcatgaatcacgcatttgctgggtctaacttcctgtccatagtgctgaagatagtagaaggtgatacaccctccctgcctgaacgatatccaaaggagctcaatgcgattatggaatctatgttgaataaaaacccctcgctgcgaccgtctgcgatcgaaattttgaagatcccgtatctcgacgagcagttgcaaaacctgatgtgcaggtacagtgagatgaccctcgaggacaaaaatctagactgccagaaggaagccgcacatatcatcaacgcaatgcagaagagaatccacctgcagaccctccgcgcactgtccgaagtgcagaaaatgacaccacgggaacggatgaggctgcgcaagctgcaggcggcagacgagaaagcacggaagctgaaaaagatagtggaggagaaatatgaggagaactcgaagcgtatgcaggaactgagaagcaggaattttcaacaactgagcgttgatgtattacacgagaaaacccacctgaagggaatggaggagaaagaagaacagccagaaggtaggctctcttgtagcccccaggacgaagatgaggagagatggcagggcagggaggaagagtcagacgaacccaccctggagaacctgcccgagtcacaaccaataccctcgatggacttgcacgagctagagagcatcgttgaggatgccacttcagatcttggctatcacgagatccccgaggaccccctggtcgcggaagaatactacgccgatgccttcgacagctactgtgaggagtcagacgaggaagaggaggaaatcgccctcgagcggcctgaaaaggaaatacgaaacgagggatcacagcccgcttatagaaccaatcagcaggactccgacattgaagcactcgccagatgtttggaaaatgttctgggatgtacttcacttgacaccaagacaattacaactatggccgaggatatgagtccaggaccccctatcttcaactcagtcatggcccgtaccaagatgaaacggatgagagaatccgcgatgcagaaactgggcaccgaagttttcgaagaagtttataattacttgaaacgggcaagacatcagaacgcaagcgaggcagaaatccgcgagtgtctagaaaaggtagttcctcaagcatcagattgtttcgaagttgaccagctgctctacttcgaggaacagcttctaatcactatgggtaaggagccgactcttcaaaaccacttatag

SEQ ID NO: 232720 - DNA, 1386 bp, Artificial Sequence
  Description of Artificial Sequence: Synthetic coding sequence
atgcatgagcgccgaatcttgcatagagacttaaagtctaagaatgtatttctgaaaaataaccttctcaagattggggactttggagtgagccgcctgctgatgggctcatgcgatctggccacaacattgaccgggactccacactacatgagccccgaggctctgaaacatcagggctatgatacgaaatctgatatctggtcgctggcctgcatcctgtacgaaatgtgttgtatgaatcatgctttcgccggatccaatttcctgtccatcgtgctgaagatcgtggaaggcgatactcccagtttgccggaaaggtatcctaaggagctgaatgccatcatggaatctatgctgaataaaaaccccagcctaagaccctccgcgatcgagatactcaaaatcccgtacctagatgagcaactgcagaacctcatgtgtcgatacagcgaaatgacacttgaagataagaacttggattgccagaaggaagcagctcacatcatcaacgccatgcagaaaaggatccatttgcagactttgagagcgctgagcgaggtgcaaaaaatgactccacgggaacgcatgaggcttaggaaactccaggccgctgatgagaaagccagaaaacttaaaaagatcgtcgaggagaagtatgaagagaactctaagaggatgcaggagctgagatcccgaaacttccagcagctgtccgtggatgtcctccacgagagtgacgagccgactctggaaaaccttcccgaaagtcaacctatacccagcatggatctgcatgaactggagagcattgtggaagacgccacctctgacctaggctatcacgaaattcctgaggacccgctcgttgcagaggagtactacgcggatgcgtttgattcatattgcgaggagagcgacgaagaggaggaggagattgccctggaaaggcccgaaaaagagatccgcaatgaaggtagccaacccgcttatcgcactaaccaacaggattctgacatcgaggcactggccagatgccttgagaatgtactgggatgtaccagtcttgatacgaagaccattacgactatggccgaggacatgagccccggtccgccaatcttcaacagcgtaatggcacgcaccaagatgaagaggatgagagagtccgcaatgcagaaattggggacagaagtgtttgaagaggtctataattatctgaagagggctagacaccaaaatgccagtgaggcagaaatccgggagtgtctcgagaaagtcgttccacaggccagtgactgtttcgaagtagaccagctgctgtattttgaggagcaacttctgattactatgggaaaggaacctaccctccagaaccatctgtag

SEQ ID NO: 232721 - DNA, 1938 bp, Artificial Sequence
  Description of Artificial Sequence: Synthetic coding sequence
atgttaaaatttcaggaagctgctaaatgcgtgagcggatctactgccatctctacatatcctaaaactctcatagcccgtagatacgttttgcagcagaaattggggtccggatcttttggaactgtctacttggttagcgataagaaggctaagcggggagaggagcttaaagtgctgaaggagatcagcgtaggcgagttaaacccgaacgagaccgtgcaggccaacctggaagctcagctgctatcaaaactggatcacccggctattgttaagttccacgcctcctttgttgagcaggataacttttgtatcataaccgagtattgcgaaggacgggatctagacgataaaatccaggagtataagcaggcgggtaaaatctttcctgagaaccagatcatcgagtggtttatacagctattgctgggagttgattatatgcatgaaagaagaattctgcacagggacctgaaatccaagaacgtctttctgaaaaataacctgcttaaaatcggtgacttcggagtcagtaggttgctgatgggtagctgcgacctggccaccacactgaccggtaccccccattatatgtctcccgaagccctcaagcatcaggggtatgacactaaatccgatatctggtctctggcatgcatactatacgaaatgtgctgtatgaaccacgccttcgccggatcaaatttcctatctattgtgctgaagatcgttgaaggagacacccctagtctgccagagaggtaccccaaggagctgaatgccatcatggagagcatgctgaacaaaaacccttccctgcgtccctcagctattgagatcctgaagatcccctacctggacgagcagctccagaacctgatgtgtcggtattctgagatgactcttgaggataagaatttggactgccaaaaagaagctgctcacattatcaacgcgatgcagaagaggattcatcttcagacattgcgtgctctctcagaggttcagaaaatgacacctcgcgagcggatgcggctgcggaaactccaagccgctgacgaaaaagccaggaagctaaagaagattgtcgaagagaaatacgaggaaaactctaaacgcatgcaggagctccgatcccgtaatttccagcagctgtctgtggatgtgcttcatgagaagacacacctgaagggaatggaagagaaggaggaacagcccgagggacggttgtcatgcagcccccaggatgaggatgaggagcggtggcagggcagggaggaggagagcgacgaacctacacttgagaatctgcccgagtcccagcctataccatctatggacctacacgaactcgagtctatcgttgaagacgccacttctgacctgggataccatgagatccctgaggaccctctggtggccgaggaatattatgctgatgccttcgattcttactgcgaagagtccgatgaggaggaagaggagatcgcactcgagcgccctgaaaaggagatcaggaatgaaggctcacagcctgcttatcggacaaatcagcaggattcagacatagaggccctggctaggtgtctggaaaatgtgctgggttgcacatcactggacactaagacgatcactacaatggctgaggatatgtcccccggacctcctattttcaactccgtgatggctcgcactaagatgaagcggatgagagagtcggcaatgcagaagctgggcacagaggtgttcgaggaggtttataattacctcaaaagggcaaggcaccagaacgcaagtgaagcagagatccgagagtgtctggaaaaagtggtgccacaagcgtctgactgcttcgaggtcgaccagctgctctatttcgaggagcagctgctaatcaccatgggcaaggagcctaccctgcagaaccatctttag

SEQ ID NO: 232722 - DNA, 1449 bp, Artificial Sequence
  Description of Artificial Sequence: Synthetic coding sequence
atgttgaagttccaggaagccgctaagtgtgtgtcagggagtacagccatatccacctacccgaaaacactcatcgcgagacgttatgtgctccagcaaaaactgggttccgggtcattcggaacagtgtaccttgtgtctgacaagaaagcaaaacgtggtgaggaacttaaagtgctcaaagaaatatcagtaggcgagctcaatcccaacgaaactgtgcaagccaatttggaagcccagctcctgagcaagctggatcaccctgcgatagtgaaattccatgcgagctttgttgaacaggacaacttctgtatcatcacagaatactgcgaagggagggacctggatgataaaatccaggaatacaaacaagccggaaagatattccccgaaaaccagatcatcgagtggtttatccagcttctcttaggggttgattacatgcatgagagaagaatacttcacagggacctgaagtcaaagaacgtcttcctgaaaaataaccttctgaaaataggcgacttcggggtgagccgtctgctgatgggtagctgcgacctggcaacgaccttaactggaactccccactacatgtctccggaagctcttaaacatcagggatacgacaccaagtcagatatctggagtctggcgtgcatcctttatgagatgtgttgtatgaaccacgccttcgctggctctaacttcctcagcatcgtgctcaagatcgttgaaggcgatactccctcactgcccgagcgctatcccaaggagttgaacgccatcatggagagcatgttaaataaaaaccccagcctgcgaccctctgccatcgaaattctgaaaatcccatacctcgacgagcagctgcaaaacctaatgtgtagatactctgagatgaccctggaggacaaaaatctggactgccaaaaggaagccgcacacatcatcaacgccatgcagaaacgaattcatctccagacactcagggccttgtctgaagtgcaaaagatgacccctcgtgagcgtatgagattaagaaaactgcaagcggctgacgagaaagcgagaaagctcaaaaagatagttgaggagaagtacgaggaaaactctaaacgcatgcaggagttgcgctcccgaaactttcagcagcttagtgtcgacgtgctgcatgagaaaacccacttgaagggaatggaagaaaaagaagaacagcccgaggggagactctcctgctcaccccaggacgaagacgaagagcgctggcagggacgcgaagaggagtctgacgaaccaactctcgagaacctgccagagtctcagccgattccatctatggacttacacgagctcgagtctatagtggaggacgccacatccgatctcgggtatcacggcgattgtaacttgatctccctggacgagtactggaagaacgagaagtag

SEQ ID NO: 232723 - DNA, 1938 bp, Artificial Sequence
  Description of Artificial Sequence: Synthetic coding sequence
atgctcaagtttcaggaggccgcaaagtgtgtgagcggttccaccgcgattagcacgtaccccaagactttaatcgctagaaggtatgtgctgcagcaaaagctcggtagcggaagctttggcacagtctacctcgtgagtgacaaaaaagcaaagcgcggtgaggagctgaaagtgctgaaagaaatctcggtgggcgaactgaatcccaacgagacagtgcaggcaaacctggaggcccagttgttgtcaaagcttgaccatccggctatcgttaagtttcatgcatccttcgtggagcaagataacttttgcatcattactgaatattgcgaaggcagagacctggatgacaagatccaagagtacaaacaagctggaaagatctttccggagaaccagataattgagtggtttattcagctgttgttgggggtagattatatgcatgaaagacgtatcctgcatagggatctcaagtcgaagaatgtgttcctgaaaaataacctcctcaaaattggtgacttcggcgtatcgagactcctgatggggtcatgtgacttggcgactactctgacgggtactccacactacatgagcccggaagcccttaaacaccagggctacgatacaaaatctgatatttggtctctcgcatgtatcctttatgagatgtgttgcatgaatcacgccttcgccggtagcaatttcctcagcattgtgcttaaaatcgtggagggagatacaccctcattgccagagagatatcctaaggagctgaatgcaattatggagagcatgctcaacaaaaatccctccctgcgtcctagcgccatagagatattgaagatcccctacctcgacgagcagcttcagaatctgatgtgtcgctactccgagatgactctggaagataaaaacttggattgccaaaaagaggctgcccacattataaacgcaatgcagaaacgaatccatctgcagacattgcgagcactgtccgaagtacaaaagatgacacccagagaaaggatgcggttgcgaaagctgcaggctgcggacgagaaagcccgtaaactcaagaaaattgtcgaggaaaagtatgaagaaaacagtaaaagaatgcaggagctgcgcagccgaaacttccagcagttatcagtggacgtcctccacgagaagactcacctgaagggtatggaggagaaggaggagcagcccgagggccgattgtcatgctctccccaagacgaggatgaggaaagatggcaaggtagagaagaggaatcagacgagcctacccttgaaaaccttcccgaaagccagcccattccgtcaatggatctgcacgaactggaaagtattgtagaggacgctacttcggatctcggctaccatgaaataccggaggatccactcgtggccgaggagtactatgcagacgctttcgactcctactgtgaggagagcgacgaggaagaggaagaaattgccctcgaacgcccagaaaaggagattcgcaacgagggctcccagcccgcttatagaacaaaccagcaggattcagacatcgaggccctggctcgctgcctcgagaatgtcttaggatgtacttctttggacacaaagacgatcaccacaatggccgaggatatgtcaccaggcccacctatcttcaacagcgtgatggccaggactaaaatgaagagaatgcgggagagcgcaatgcagaaactcggaacggaggtctttgaggaggtgtacaactatctgaaacgggcacgtcatcagaatgcgagtgaggcggagattagggagtgtttggaaaaagtggtgccccaggcctccgactgtttcgaagtggaccaacttctgtacttcgaggagcagctgctgatcaccatgggaaaggaacccacactgcagaatcatttatag

SEQ ID NO: 232724 - DNA, 1413 bp, Artificial Sequence
  Description of Artificial Sequence: Synthetic coding sequence
atgcttaagttccaggaggctgcaaaatgtgtgtccggatctacagctatttcaacgtaccccaagaccctcattgccagacggtatgtcctccagcagaagcttgggagcgggagcttcgggacagtctacctggtgtccgacaagaaggctaagcggggtgaggagctgaaggttctcaaggagatttctgtcggcgagctgaatcccaacgagacagtgcaggccaacctcgaggcacagctgttaagtaagctcgatcaccccgctatcgtcaagttccatgctagctttgtagaacaggataatttctgtatcatcacagagtattgtgagggcagggatctcgatgataaaatccaagagtataaacaagcagggaaaatcttccccgaaaaccagataattgaatggttcattcaattactcttgggagtggattatatgcacgagagacggatcctgcaccgcgaccttaagtctaaaaatgtctttctcaagaataacttgctgaagattggcgactttggggtatcacgcctcttgatgggttcctgcgatcttgcgaccaccctaaccggtacaccccactacatgagcccagaagcccttaaacatcaggggtacgacactaaatccgatatctggtcacttgcttgcatactgtatgaaatgtgctgcatgaatcacgccttcgctgggagtaactttctctctattgtgctgaaaattgtagaaggggacactcccagcctgccagagcgctaccctaaagagttgaatgccatcatggagtccatgctgaataaaaatccttcccttcgcccaagcgctattgagattttgaagattccatatctggacgaacaactgcagaaccttatgtgccgatatagtgaaatgacactggaggacaaaaacttagactgccagaaggaagcagctcatattatcaatgcaatgcagaaacgtattcacctgcagacactgcgcgcactgagcgaagtgcaaaagatgaccccacgggaaagaatgcgcttgagaaagctccaggcagccgatgagaaagctcgaaaacttaagaaaatcgtggaagaaaaatacgaagagaactccaaaaggatgcaggaactgcggagccgcaactttcagcaactatccgtggacgtcctccatgaaaagactcacctcaagggcatggaggaaaaggaggaacagccggaaggacgcctctcatgcagcccccaggacgaagatgaagagcgttggcagggacgagaggaggagtctgacgaacctacattggaaaacctgccagagtcccagcccattcccagtatggacttgcatgagttggaaagtattgtggaggatgctacctccgacttaggttatcacgctactcattcctag

SEQ ID NO: 232725 - DNA, 2079 bp, Artificial Sequence
  Description of Artificial Sequence: Synthetic coding sequence
atggagaagtacgagcgtatcagagtggtggggcgtggggctttcggcattgtacacctctgcttgaggaaggcagatcagaagttggtgattataaagcaaattccagtggaacagatgaccaaggaggaaagacaggcggctcagaacgagtgccaggtgctgaaactcttgaatcatcctaacgtaatcgagtattacgaaaattttttagaagataaagccctcatgatcgcgatggagtacgccccaggcggtactctggccgagttcatacagaaaaggtgtaacagtttacttgaggaggaaaccatccttcatttttttgtgcagatccttctagctctccatcacgtccatacacacttgatcttgcatagagatctgaaaactcagaacatccttctcgacaaacatcgaatggtggtgaagattggggattttgggattagtaagatactgagctctaaatcgaaggcctacacggtggtggggacgccatgctacatttcgccagagttgtgcgaagggaaaccatataatcagaagtctgacatctgggctctgggttgcgttctttatgaacttgctagtctaaagagagccttcgaagccgctaacctcccggcattagtactcaaaattatgagtggcacgttcgccccaatttcagatcggtattcacctgaactgcggcagctcgtgctctccctgctttctctagagccggcacagaggcctcctttgtctcatataatggcacagccgctgtgcatccgagccttgttgaacctgcatactgatgtgggttccgtgcggatgcgcagggcagaaaaatccgtagccccttctaacacaggtagccgtaccaccagcgtacggtgccgtgggatcccacggggacccgtgaggccggcaattcctcctccactctcaagcgtttacgcttggggcggaggcctgggcacaccgctccgactcccaatgttgaacaccgaagtagtgcaagtggctgccggacgcacccaaaaggccggagtaacaagatcaggacgtctgatactctgggaggcacccccactgggcgcaggtggcggttccctgttgcccggtgctgttgagcagccacagccacagtttatttccaggttcctggagggacagtcaggcgtcactatcaaacacgtcgcctgtggtgatttttttacagcatgcctaacagaccgcggaatcataatgactttcggcagcggcagcaatgggtgcctgggccacggttctctgactgatatctcacagcccacaattgtcgaggctctgttagggtatgagatggttcaggtcgcttgtggcgcaagtcacgtgctggccctttccaccgagcgcgagctatttgcctggggaagaggtgactcagggagacttggcttaggcacaagggagtcccattcttgtccgcagcaggtgcccatgcccccagggcaggaagcacagcgggttgtgtgcggaattgacagcagtatgattttaacagtgcctggccaggccctggcatgtggcagtaaccgcttcaataaattgggcctggaccacctgagcctcggcgaggagcccgtgcctcaccagcaagttgaagaagctctgtccttcaccttactcggtagcgcacctctggatcaggaacccctcttgagtatcgatcttgggactgcccactcagccgcagttacggcttctggggactgttatacttttggctctaatcaacatggccagctaggcacgaacaccagaagagggtccagggctccatgcaaggttcagggtctcgaaggaattaagatggctatggtggcttgcggggatgctttcacagtagctatcggtgctgaaagcgaggtctactcctggggtaaaggagccaggggacgtttgggtaggcgtgacgaagacgcaggtcttccccgaccagtgcagctggatgaaactcacccttacactgtcaccagcgtctcctgctgtcatggcaacaccctcctggctgttaggtcagtcacagacgagcccgtcccaccttag

SEQ ID NO: 232726 - DNA, 1383 bp, Artificial Sequence
  Description of Artificial Sequence: Synthetic coding sequence
atggagaagtacgagagaatacgcgtggttgggagaggagcgtttggcatcgtacacctttgccttaggaaagctgatcagaagctggtgatcattaaacagattccggtggagcagatgacgaaggaggaaagacaggcagcacaaaacgaatgccaggtgctaaaactcctgaaccacccaaacgtcattgaatactacgagaattttcttgaggataaggctcttatgatcgccatggaatacgccccaggtggaaccctcgcagaattcatacaaaagagatgtaactctctgttggaggaggaaacaatcctgcacttcttcgtgcagattctattggccctgcatcacgtgcacacacacctaattctgcaccgagacctgaagactcaaaatattctcctcgacaaacaccggatggtggttaaaattggggattttggaataagcaaaatcctttctagtaaatcaaaggcttacacagtcgtggggacgccctgctacattagccctgagctatgcgaggggaagccttataaccaaaaatccgacatatgggccctcggctgcgtgctttatgaattggcttcacttaagcgcgcattcgaggccgcaaacctgccggctcttgtcctgaagataatgagcgggaccttcgctccaatttctgaccggtactcccctgaactccgccagttagtgctgagcctgctgtctttagagcctgcacagcgacctccgcttagtcacattatggcccaacctctgtgtatcagggcactgctgaatctgcacacggatgttggaagcgtcaggatgagacggcctgtacagggccagcgggctgtgttgggcggtagagtgtgggcgccttccgggagtactgggggactgagacaaagggagacatggggcaagagctcactcccagcgtgcagaaacgtgcgaagggtgttcgtactacgtcccccaagcgtcctccaggggcgagaagtgagaggcccacagcaacatagagagcaggaccaccaatgcccactgcaacggtacccaccaggtacttgcgaagcatctcaccccaccaccactgtagttagcgtatgcctgggatggtgggccggtcaccctcctgccgctgccaacgcccaacaccggggagggcctggtggaagctgggcacatgcggaatcccggagacacgccctgtgggctagccatcccgttggaggaccgactccccgatgcagacgccgtcagagtccctcttggggctcaggcgctgcgaccgcccctgttcacctggcctttcccggtggtcctgttggctgcgaccatcaggcgaggggattatggggtttgctccactgcctccccgattag

SEQ ID NO: 232727 - DNA, 2940 bp, Artificial Sequence
  Description of Artificial Sequence: Synthetic coding sequence
atgagcgtgctcggcgagtacgaacgacattgcgatagcattaactctgatttcgggtctgaatcaggaggctgtggcgattcaagcccaggacccagcgcgtcccaaggtccgagggcgggagggggagctgccgagcaagaagaacttcactatatacctatcagggtcttgggcagaggcgctttcggagaggcaacactgtataggagaaccgaggatgattccttagtcgtgtggaaggaagttgatctgactcggctgtccgagaaggaacggcgagacgccctgaacgagattgtcatcttggccttgttgcagcacgataatatcattgcctactacaaccatttcatggacaatacaactttgctcattgaattggagtattgcaacggagggaacttgtacgacaaaatactccgtcagaaggacaagctgtttgaggaggagatggtcgtatggtacctattccagattgtctcagctgttagctgtatccataaagcaggtatactgcatcgtgacatcaaaacactgaatatattcctgaccaaagcaaacctcatcaagctgggcgactacggactagcaaagaagctcaacagcgagtacagcatggcagagacactggtcggtaccccatactacatgtctcctgaattgtgccagggggtgaagtataatttcaagagcgacatctgggccgttggctgtgtgattttcgagttgctgacactgaagcggactttcgacgcaactaacccactgaatttgtgtgtgaaaatcgtgcaggggatccgggcaatggaagtggatagttcccaatacagtctcgagttgattcagatggtgcacagttgtctagaccaggaccctgagcaacggccaactgccgacgagctgctggacagacccctgctgcgcaaacggcgtagggagatggaggaaaaagtgaccctgcttaacgcacccactaaacggcctcggagctctacggttacggaagctccaatcgcggtggtgacatcacggacttctgaagtctacgtgtgggggggaggcaaaagcactccccagaagctcgacgttattaaatctggctgcagcgcacgccaagtctgtgccggaaatacacactttgccgtggtgactgtagagaaggagctttatacgtgggtaaacatgcagggaggaacaaagttgcacggacagcttgggcacggggacaaagcatcctatcggcagcccaagcacgtggagaagctccaaggaaaagctatccgccaggtatcatgcggtgacgactttaccgtctgtgtgacagacgaaggacagctttatgcatttggtagcgactattacggttgcatgggcgtggacaaagtggcgggtcctgaggtgcttgagcccatgcagctgaatttcttcctatctaatcctgtggagcaggtttcctgcggtgataaccatgtagttgtattaaccagaaacaaagaagtgtactcctggggatgtggagagtacgggcgactgggcctggacagtgaagaggattactatactccacagaaagtggatgttccgaaggcgttaataatagtggcggtccaatgtggctgcgatggtaccttcttgcttacgcagtccgggaaagtcctggcttgtgggctcaatgagttcaacaaacttggcttgaatcaatgcatgagtggcataatcaaccatgaagcctaccacgaagtgccttacaccacctctttcacattggctaagcagctgtcattttataagatacgcacaatcgcacctggcaagacccatacagcagccatcgatgaacgcggacggctgctaacttttgggtgtaataagtgtgggcaacttggagttggaaactataagaagagattgggcattaacctgttaggtgggccactgggtggcaaacaggtgatcagggtctcttgcggcgatgagttcaccattgccgcaacagacgataatcatatcttcgcttggggaaatggtggaaatggcaggttagctatgacacccaccgaacgtccacatggctccgacatctgcactagctggccaagacctatcttcggatcgttgcatcatgtgcccgatctttcctgccgcggatggcacacgatactaatcgtcgaaaaggttctgaatagtaagaccataaggtctaactccagcggcctttccattgggactgtgttccagagttcttctccaggcggaggaggcggtggcggtggcggagaggaagaggactcacagcaggaatcagagaccccggatccctctggagggttccgaggcacgatggaggccgacaggggcatggagggcctgatctctccgaccgaggccatgggcaattctaacggagccagcagctcttgtcccggatggttgcggaaggaacttgaaaatgcggaattcatacctatgccggacagcccgagccctttgtctgccgcattctccgagtctgagaaagacacactgccctatgaagagctgcagggacttaaggtggcatccgaggctccactcgagcataaaccccaagtagaagccagctccccacggcttaaccctgccgtgacatgcgccggaaaagggactccactgactcctccagcctgtgcatgctcttcactccaggtggaggtagagagacttcagggactggttctcaaatgtctcgccgaacagcagaaattacagcaggaaaacctccagatctttactcagctccagaaactgaataagaagctcgaaggcggtcagcaggtcggtatgcatagtaaagggacccagaccgctaaagaggagatggagatggaccccaagccagacctggattcagatagctggtgtttactggggacagacagctgtaggccatctctctag

SEQ ID NO: 232728 - DNA, 1545 bp, Artificial Sequence
  Description of Artificial Sequence: Synthetic coding sequence
atgagcgtgctaggcgagtatgaaagacactgcgactctattaacagcgacttcggctccgagtcaggcggatgtggggattcctccccaggaccaagcgccagtcaaggacctagagcgggtgggggtgcatttggggaagctaccctgtacaggcgcaccgaggacgactcccttgtggtgtggaaggaggtggatcttacccgactctcagaaaaggagcgacgcgacgcattgaacgaaattgtgattttggctctacttcagcacgataatattatcgcatattacaatcatttcatggacaatactacgttgctcatcgaactggagtactgcaatgggggtaacctttatgataaaattctgaggcaaaaggacaagttgtttgaggaggagatggtcgtttggtatctgtttcagatagtgtctgctgtctcctgtattcataaggccggaatcctgcaccgagacattaagaccctgaacattttcctcacaaaggccaatctaatcaagcttggcgattatggcttagctaaaaagttgaattcagagtatagcatggctgagacactggtgggcacaccctattacatgagccctgaactgtgtcagggggtgaagtataatttcaaatccgacatttgggccgtcggatgcgttatcttcgaacttctcacgctgaagaggacctttgacgctaccaatcccctcaacctctgtgttaagatcgttcagggtatccgtgccatggaagtcgattccagccaatacagcttggaactcatccagatggtccatagttgtctggaccaagaccctgaacaacggcctacggccgacgaactgcttgataggccattgttacggaaaagacgtcgggagatggaagagaaagtaacccttttaaacgctcctaccaaacgtcccaggagttccactgtcaccgaggcgccaattgcagtcgtgacttcgcgaacttcggaagtgtacgtatggggtggagggaagtctactcctcagaagctcgatgtcatcaaatctggctgctcggcaaggcaggtgtgtgccggaaacacacactttgccgtggtgactgtcgaaaaggaactctacacatgggtgaatatgcagggcggtacaaagctgcacggtcaactgggacatggcgataaggcatcttaccggcaacccaagcacgtagaaaaactgcaggggaaggccatacgtcaagtgtcctgcggggacgattttactgtgtgcgtcacggacgagggtcagttgtatgcatttggatcagattactacggttgtatgggagtagacaaagtcgccggtccagaagtgctggagcctatgcagcttaacttcttcctttcaaaccccgtcgagcaggtttcatgtggtgataaccacgtcgtagtactcactagaaacaaggaagtgtactcttgggggtgcggggagtatggcaggggtagcctggtgagcgtgcacttcttcacgggtattcagcctgacttcaaagtggtgtgcatttag

SEQ ID NO: 232729 - DNA, 3777 bp, Artificial Sequence
  Description of Artificial Sequence: Synthetic coding sequence
atggagaaatacgtcaggctccagaaaatcggggaaggctcattcggtaaagccattctggtgaaaagtacagaagatggtcgtcagtatgtgataaaggaaatcaatatatctcgtatgtcctccaaggagcgcgaggagagccggcgtgaagtcgccgtgctggcgaacatgaagcaccccaacatcgtgcagtaccgcgagtccttcgaggagaacggaagtctttatatcgttatggactattgcgaaggaggagacctgttcaaacggattaatgcgcagaaaggcgtcctctttcaggaagatcaaatcctggactggtttgtacaaatttgtttagcactgaagcatgtccatgacagaaagattctgcacagggacatcaaatctcagaatatctttctgactaaagatggaactgtgcaactgggggactttggcatcgcgagggtgctgaattccacggtagaactggccaggacatgcattggcacgccctactatcttagcccagagatctgcgagaataagccatacaacaacaaaagtgatatttgggcgctcggctgcgtcctctacgagctgtgtactctgaaacatgctttcgaggccggtagcatgaagaatctggtgctcaaaatcatttcaggaagcttccccccagtgtcgttgcattactcatatgatcttcgtagtcttgtgtcacagctgttcaagcgaaacccgagagatcgaccgtccgtgaactcgatacttgaaaaaggtttcatagctaagcgcattgaaaagttccttagccctcagctcattgctgaggagttctgcttaaagacatttagcaagtttggctcccagcctatccctgccaaaaggccagcttccgggcagaactcaatctcagtgatgccagcccaaaagattaccaaaccagctgccaagtacggaattccgcttgcttataaaaaatacggtgacaagaaactccacgaaaaaaaacctttacagaaacacaaacaggcacatcagacacccgaaaagcgggttaacacaggggaagaacgtagaaagatcagtgaggaagcggcaaggaaaagacggctggagtttatcgaaaaagagaaaaaacagaaagatcagatcatctcattaatgaaggcagagcagatgaaacgccaggagaaggagaggttggagagaatcaacagagcccgagaacagggctggagaaatgttttaagtgccggtgggtctggcgaagtgaaggcgcctttccttggctccgggggtaccattgctccgagcagcttttccagccggggtcaatatgagcactatcatgccatcttcgaccagatgcaacagcagagggccgaggacaacgaggccaagtggaaacgggaaatctatggaagagggttgccagagaggggtattctgccgggagtcagaccaggattcccgtacggcgcagcagggcatcaccactttcccgatgctgatgatattcgcaaaacactgaagcgccttaaggcggtctctaagcaggccaatgcaaatagacagaaaggtcagttagccgtcgagcgggctaagcaggtcgaagagtttctgcagaggaaacgcgaagccatgcagaataaagctcgtgccgaaggacatatggtctatctagctcgattgaggcagatacgcctgcagaactttaacgagcggcagcagataaaggcgaaacttcgaggcgagaagaaagaggccaatcactccgaaggccaagaggggtccgaggaggctgacatgagacgcaagaagatagagtctctgaaagcccatgctaatgccagggccgctgtgttgaaggagcagcttgagagaaaaagaaaagaggcttacgaacgtgaaaaaaaagtgtgggaggaacacctggtggccaaaggtgtgaaaagtagcgatgtgtcccctcctctgggacagcatgagactggagggtcaccatctaagcagcagatgcgctccgtcatttctgtgacctcagccctgaaggaggtcggcgtcgatagcagcctgaccgatactcgggagaccagcgaagaaatgcagaaaaccaacaacgcaatcagttccaaacgtgaaatccttcggaggctgaacgagaatctgaaggcacaggaggacgagaaagggaaacagaacctttcggacacatttgagattaatgtgcacgaagatgcaaaagagcacgagaaggagaagagcgtttccagcgatcgcaaaaaatgggaggcaggcggacagcttgtgattcccctggatgagctgacactcgacacatccttcagcacaacagagcgccacaccgtgggagaggtgattaagttgggaccaaatgggtcccccagaagggcatggggcaagtcaccaactgattctgtgctgaagatattgggagaggctgagctacagttgcagaccgagctcctcgaaaatactactatccggagcgagatcagtccagagggtgagaagtacaaaccgctgatcactggggagaaaaaggtgcagtgcattagccatgagattaacccctccgccatcgtggactcgcctgtcgagacaaaaagccccgagttctcagaggcaagtccgcagatgtcgctgaaactggaaggaaaccttgaagaacccgatgatcttgagactgaaattctgcaggaaccatccgggaccaacaaggatgagtcgctcccctgcaccatcactgatgtatggatatctgaggagaaggaaaccaaggagacacaatccgctgacaggatcaccatccaggaaaatgaggtgtccgaggacggtgtaagtagcacagtcgatcagctgtcagacatccatattgagcccggaacaaacgattcacaacattccaaatgcgatgtggacaaaagtgtgcagccagagccctttttccacaaagtcgtacattctgaacacctcaatttagtaccgcaggtccagtccgtgcaatgtagtcctgaagaaagtttcgcgttccgctctcattcgcatttgccgccaaagaataagaacaagaattccttactcatcggactgtccaccggcttgttcgatgctaataaccccaaaatgttgagaacttgcagcctgcccgacctgtctaagctcttccgaactctaatggacgtgccaaccgtgggagatgtgagacaagacaacctggagatagatgaaattgaagacgaaaatatcaaagaagggccaagcgatagtgaggacattgtgttcgaagaaacagatactgatctccaggagttgcaggccagcatggaacagctattgagagaacaacccggtgaggaatacagcgaggaagaggaatcagttctgaagaactctgatgtcgaacccactgccaatgggacagacgtggccgacgaggacgataatccttcctcagagagcgctttaaacgaagagtggcactcagataactcagatggggaaatcgcctccgagtgcgaatgtgacagtgttttcaaccacctggaagagctgaggcttcacctagagcaggaaatggggttcgagaaattttttgaggtgtacgagaaaattaaagcgattcacgaggatgaggatgagaatattgaaatttgtagcaagattgtgcagaacatcctgggaaatgagcaccagcacctttacgccaaaatcctgcacctggtgatggcagatggagcctatcaggaagacaatgatgagtag

SEQ ID NO: 232730 - DNA, 3861 bp, Artificial Sequence
  Description of Artificial Sequence: Synthetic coding sequence
atggaaaagtatgtgcggctgcagaaaatcggggagggtagtttcggaaaagcaatcctggtgaagtctacagaggacggcaggcagtatgtgataaaggagattaacatatctagaatgagttctaaagagcgggaggaatcaaggagagaggtggcggtgttagccaacatgaagcaccctaacatcgtgcagtatagggagagcttcgaagagaatgggtctttgtacatagtgatggactactgcgaaggcggagatttgtttaaaaggattaacgcccagaagggtgtgctctttcaggaagaccagatactagattggttcgtccagatatgtttagcgctaaaacatgttcacgatcggaagattctgcacagagatataaagtcccaaaacatattcctgacaaaagatggcacagtccagctgggggatttcggcatagctcgggtgctgaatagcaccgttgagctggccagaacgtgcattggcaccccatactacctatctcccgaaatttgcgaaaacaaaccctacaataacaagagtgacatctgggctctgggatgtgtcttgtatgagctctgtacattaaagcacgcttttgaggcagggtcaatgaagaacctagttctgaagataatttctggatcctttccacccgttagtctccattactcttacgacctacggtctttagtgtctcagctgttcaagaggaaccctagagacagacctagtgttaattcaatccttgagaagggctttatcgcaaaaagaatcgagaaattcctcagtccacagctcatagctgaagagttttgcctaaagacctttagtaaattcgggagtcagcccatccctgccaaaagaccggcttctggccagaacagtatatccgttatgcctgcacagaagatcactaaacccgcagccaagtatggtattcccttagcttataaaaaatacggtgacaagaagcttcacgagaagaaaccactccagaaacacaaacaggcacatcaaacccccgagaagagagtgaataccggagaggagcgccgaaaaattagcgaagaggcagcccgaaagcggcgactagaattcattgagaaggaaaagaaacaaaaagaccaaataatcagtctaatgaaggcagaacagatgaagcggcaggagaaggaaaggctggaaagaatcaatcgggctcgggagcaaggatggcggaacgtgctgtctgccggtggctcaggtgaggtgaaagctcctttccttggctctggtggtacgatcgccccaagcagctttagttctcggggacagtatgagcactatcacgcaatcttcgaccagatgcagcagcaaagagcagaagacaacgaagcaaagtggaaacgggaaatatatggcagagggctgccggagagaggaattctccccggtgtgcgacccggatttccttatggtgccgctggccaccaccattttccggatgctgatgatatcagaaaaactttaaaacgactcaaagccgttagcaagcaagcaaacgccaatcggcagaagggccagctggccgtagaacgtgcaaagcaggtggaagagttcttgcagcgcaaacgagaggccatgcaaaataaagcacgagctgagggccacatgggcattcttcaaaatctggcggctatgtatggcggtaggcctagctctagccgcggtgggaaaccgcgtaacaaggaagaagaggtgtatttggcccgactgagacagattagacttcagaatttcaacgaaagacagcaaattaaagctaagctgaggggcgaaaaaaaggaggccaaccattccgagggtcaagaggggagtgaggaggcagacatgagaagaaagaagatcgaaagcttgaaggctcacgccaacgctagggccgcagtgctgaaagagcagcttgaacgcaagagaaaagaagcctatgaacgcgagaagaaagtctgggaagaacaccttgtagcaaagggggtgaaatccagcgatgtgtccccaccgctgggccagcatgagaccgggggttccccctcgaaacagcaaatgaggagcgtgataagcgtgacatctgccctgaaggaagtgggcgtagattctagcctaacagacactcgggagacaagcgaagagatgcagaagactaacaatgccatcagcagcaaaagggagattctccggaggctgaatgagaacctcaaggcccaagaggatgagaagggtaagcagaatctctctgatacgttcgaaatcaatgtgcacgaagatgccaaggagcacgagaaagagaagtccgtgagctccgatcgtaaaaaatgggaggccggaggtcaattggtgatccctttggacgagttaaccctggacacctcatttagcactacagagcgtcataccgtgggcgaagtgattaagcttggcccaaatggatccccaaggagggcgtgggggaagtccccaacagatagcgtgctgaagattttaggtgaggcagaactccagctgcagaccgagctgctggagaatacaactatacgatctgaaatcagcccagaaggcgaaaaatataaaccactcattacgggcgagaagaaggtccagtgcataagccatgagatcaacccaagcgccatcgttgacagtcccgtggaaaccaagtcccccgaattttccgaggcgtcaccacagatgtctcttaagttggaaggaaatcttgaagaacctgatgatctagagacagagatcttgcaggaacccagcggcacaaacaaagatgagtctctgccttgcacgattacagacgtttggatatcagaagagaaagagactaaggagacccagtctgctgatcgcattacgattcaggagaacgaggtgagtgaagatggcgtgtcctccaccgttgatcagctttcggacattcacattgaaccagggaccaacgatagccaacatagtaaatgcgacgtggacaagtcagtccagccagaaccattctttcataaggtggtgcatagcgaacatttgaacctggtgcctcaagtgcagagcgtccagtgcagtccagaggaatctttcgcctttaggagtcattctcatctaccacccaagaataagaataaaaattcactgctcataggtctttctacaggactgtttgatgcaaacaaccctaagatgctgcgtacttgcagcttgcccgatttatccaaactgtttaggacgctgatggacgtgccaactgtaggggacgtgagacaagacaatttagagattgatgaaatcgaggatgagaacattaaagaaggcccaagtgattccgaagacatcgtcttcgaagagaccgatactgaccttcaggagctccaagcttccatggaacaactcctccgcgagcaacccggagaggaatactctgaggaggaggagagcgtgctcaaaaactctgatgtggaacccacagctaacggaaccgatgtcgctgacgaggacgacaacccatccagtgagagtgcattgaatgaggagtggcactctgataattcagacggcgaaattgccagtgagtgtgaatgcgacagcgtgtttaatcacctggaggaattgcgcctgcatctggagcaagaaatgggctttgagaaattcttcgaggtgtatgagaagattaaggctatccatgaggacgaagacgagaatatagagatctgcagtaagatcgtgcagaacatactgggaaacgagcaccaacacctgtacgccaaaatcctgcatctagttatggccgacggagcctatcaggaggacaatgatgaatag

SEQ ID NO: 232731 - DNA, 3645 bp, Artificial Sequence
  Description of Artificial Sequence: Synthetic coding sequence
atggaaaagtatgtcagactgcagaaaataggcgagggatccttcgggaaagcaattctggtaaagagtaccgaggatgggaggcaatatgtgattaaggagattaacatttctagaatgtctagtaaggagcgagaggaaagtcggagggaggttgccgtgctggccaacatgaagcatcccaatatcgtccagtacagggaatcgttcgaagaaaacggatctctgtacatagtgatggattactgcgaaggtggcgaccttttcaaaagaatcaacgctcagaagggcgtgctgttccaggaggaccagatacttgattggttcgtccagatttgcctcgcgctgaagcacgtgcacgaccggaaaatactccacagggatattaagagtcagaatatctttctgaccaaagatggaaccgttcagctgggagatttcggcatcgcccgtgtgctgaactcaacggtagagttggccaggacctgtattgggaccccgtactacttgagccctgaaatctgtgagaataagccctataataataagtcggatatttgggcattaggatgcgtcttatacgaactgtgtacccttaaacatgccttcgaggcaggctctatgaaaaatcttgtgttgaaaattatatcggggagcttccctcccgtgtctttacattactcctacgatctgaggagcctggtgtctcagctgtttaaacgaaatcccagagatagaccaagtgtcaattcaattctagagaagggatttattgctaaacgcatcgaaaaattcctctctcctcagctcattgcagaggagttttgcctcaaaacatttagcaagttcggatcacagcctattcctgccaaacgtcctgcctcgggccagaacagtattagtgtgatgccggcacagaagatcaccaagcccgcagcaaagtacgggatcccccttgcttacaaaaagtacggcgacaaaaaactgcatgagaagaaacccctacagaagcataagcaggctcatcaaacccctgaaaaacgggtgaataccggcgaggaaaggcgcaagatttctgaggaggctgccaggaagaggcgcttggagtttattgagaaagagaaaaaacagaaggatcagatcatcagccttatgaaagctgagcaaatgaagagacaagaaaaagaacgcttagagcggatcaaccgggctcgagaacaggggtggcgaaatgtcctaagtgctggtggcagtggcgaagtcaaagcccctttcctcgggtccggcggaaccatcgctccaagttcattttcttctaggggtcaatatgagcattaccacgctatattcgaccagatgcagcagcaacgggcagaagacaacgaggccaagtggaaacgagaaatttacgggagaggtctgccggagcggcaaaagggccagttggccgtggagagagccaagcaggtcgaggaatttctccaaaggaagagagaggcgatgcagaataaagcaagggccgagggtcacatggtgtatttggccagacttcggcagatccgcttgcagaattttaatgaacggcagcagatcaaggccaaattgcggggagaaaagaaagaggccaatcacagcgagggccaggaaggatctgaggaagcagatatgcgcaggaaaaagatcgaatctctgaaggcccatgccaatgccagggcagccgtgttgaaagagcagctggagcgcaagcggaaagaggcctatgaaagggagaagaaagtgtgggaagaacatctcgttgccaagggagtgaagtcctccgacgtttctccacctctaggacagcacgagaccggaggttccccctcaaagcagcagatgagatccgtgattagcgtgacttctgcgctgaaagaggtgggggtcgactctagtctcactgacacacgggagacaagcgaagaaatgcaaaagactaacaacgccatttctagcaagagggagatactacgacgtctgaacgagaacctaaaggcccaggaggatgaaaagggcaagcaaaacctctcagacacatttgagatcaacgtccatgaagatgcaaaggaacatgaaaaagagaaaagtgtgtccagcgaccgtaaaaaatgggaagcaggcggtcagctggtcattcccctagacgagctgacactggacacatccttctccactactgagagacacaccgtaggcgaagtgataaaacttggccctaacggaagtccaaggcgggcttgggggaagagcccgaccgactcagtcctcaaaattctaggggaggccgaacttcagttgcagaccgaactgctggagaataccacgataaggtcagaaatctcccccgagggcgagaagtacaagcctcttatcactggagaaaagaaggtgcagtgcatatcacacgagattaacccctccgcaattgtggactcgccagtggagaccaaatcacctgaattttcagaggcttctcctcaaatgtccctcaaactggaggggaacctggaagaaccagacgacctcgagacggagatacttcaggagcccagcgggaccaacaaggatgagtctctcccctgtaccattaccgacgtgtggatttccgaggagaaggaaacaaaagagactcagtccgctgaccgcatcaccatccaagaaaatgaagttagcgaagatggggtgagcagtacagtggaccagctgagcgacatacatatcgaaccagggaccaacgactcccagcattccaaatgtgacgtcgacaagtctgtgcagcctgagccgtttttccacaaggtggtgcactcagagcatctcaacctggtcccgcaagtccagagcgtacagtgctcgcctgaggaaagcttcgcattccgtagccattctcatctcccacccaagaataaaaataagaatagcctactaattggcctctcaactgggttgttcgatgcaaacaacccgaagatgttgcgtacctgttccctccctgacctatctaagctctttcgaactctcatggatgtacctacggttggtgacgtcaggcaggataacctggagatcgacgaaatagaagatgaaaacataaaggaaggccctagcgacagcgaggatatcgtctttgaggaaacagacactgacctccaagaactacaggcctcaatggagcagctgttgcgggaacagcccggagaggagtactctgaggaggaggagagcgtactgaagaattcagacgtggagccaactgccaatgggaccgatgtggcagatgaggacgacaatcccagctctgaatctgcacttaacgaagagtggcattctgacaattccgacggcgagatagccagcgaatgtgagtgtgattctgtgtttaaccacctggaggagctgaggctgcaccttgaacaggaaatgggttttgaaaaatttttcgaagtgtatgaaaaaatcaaggccatccacgaggacgaagatgagaacatcgaaatctgttcgaagatcgttcagaacatactgggaaacgaacaccagcacctttatgccaagattctgcatttagtgatggccgacggtgcataccaggaggataatgatgaatag

SEQ ID NO: 232732 - DNA, 3570 bp, Artificial Sequence
  Description of Artificial Sequence: Synthetic coding sequence
atggagaagtacgtgaggctgcaaaagatcggcgaggggtcattcggtaaggcaattctcgttaagtccactgaggacggaaggcagtacgtgatcaaagagatcaatatttctagaatgtctagcaaagagcgggaggagtccagacgggaagtggccgtattagctaacatgaaacaccctaacatagtccaataccgcgagtcgttcgaggagaatggaagcttgtacatcgtgatggactactgtgaaggcggtgacctgttcaaacgcattaatgcgcagaagggagtactgttccaagaggaccagatactggattggttcgtacagatctgtctagcccttaaacacgtgcacgataggaagatcctccaccgtgacattaagtcgcagaacatattcctgacaaaggacggaactgttcagttgggcgacttcggcatagcccgtgttttaaacagtaccgtagaattggcacgaacttgtataggaaccccttattacttgtcaccagaaatatgcgagaacaaaccctacaacaataagagtgatatctgggcgctgggctgtgtgctttatgaactgtgcactttaaagcacgccttcgaggctggctcaatgaagaacctggtgctaaagattatctctgggtccttcccccctgtgtctcttcattactcatacgatctgcgctctctcgtgagccagctgttcaaacggaatcccagagataggccatcagtgaatagcatactcgagaaaggctttatcgccaagaggatcgaaaaattcctgtccccccagctcatcgctgaggaattctgcctgaagacattttctaaattcggctcacagcctatccctgccaaacgacctgcttccgggcaaaattcaatatccgtgatgcccgcacagaagatcaccaagccagctgctaagtatggaatcccactggcgtataagaagtacggcgacaaaaagctgcacgagaagaaacccctgcagaaacacaaacaagcccaccaaactcctgagaagagagtgaatactggggaagaacggagaaagatatccgaagaggccgcacggaagcgacgtctagagtttatcgagaaggagaaaaaacagaaagaccaaatcatttcccttatgaaggcagagcaaatgaaaaggcaagagaaggagagagctcctttcctgggtagtgggggaactatagccccttccagcttttcatctcgtggtcagtacgaacattatcatgccatattcgaccaaatgcagcagcagagagctgaagacaacgaggctaagtggaagcgcgaaatctatgggaggggactcccagagcggcaaaagggacaactggccgtggagcgtgccaagcaagtcgaagaatttttgcaaagaaagcgggaagctatgcaaaataaggctcgtgcagaggggcacatggtctacctggctaggctgcgccaaatccggctccagaatttcaacgagcggcagcagatcaaagccaagctgcgaggcgaaaaaaaggaggctaaccacagcgagggccaggagggcagcgaggaggccgacatgaggaggaaaaagatcgaatcactgaaggctcacgcgaatgcccgagccgctgtacttaaagagcagctggagagaaagagaaaggaagcatacgaacgtgagaaaaaggtctgggaggagcatctggtcgcgaagggagtgaaaagtagcgatgttagccctccgttagggcagcacgagacagggggatcgccatccaaacagcagatgcgttccgttatatccgttacttcagccctgaaagaggtgggagtcgacagcagtcttacagacacaagggaaacctcagaagagatgcagaagacaaacaatgccatttcctcaaagcgcgagatcctgcgacgccttaatgagaacctgaaagctcaggaagacgagaaaggaaagcaaaatctctcagatacattcgagattaacgtacacgaggatgccaaggaacacgagaaggagaaatcggtcagctcagataggaagaagtgggaggccggaggccagctggtgatcccactcgatgaattgaccctcgacacctcatttagtaccacggagaggcacacagtcggggaggtcattaagctggggccaaacggcagtccccgtagagcctggggtaaatcccctactgactctgtcttaaagattctcggtgaggccgaactccagttgcagaccgagctgctggagaacacaactattagatcagagatctcccccgaaggagagaagtacaagcccctgatcactggcgagaagaaagttcagtgtataagccacgaaataaatccttccgctattgtagattctcctgtggagacaaagtctcccgagttcagtgaggcttcaccccagatgagcctaaagctcgagggcaacctggaggagcccgacgacctggaaaccgagattctgcaggagccttcggggacgaacaaagatgagtccctgccctgtacgatcaccgacgtgtggatcagcgaagagaaagaaacaaaggaaacccagtccgccgaccgaatcaccatccaggaaaacgaggtttcagaggatggagtgagttctacagtcgatcagctgagtgacattcacatagaaccaggaacaaatgatagccagcacagcaagtgcgacgtggacaaatctgttcagcccgagcccttcttccacaaagtggttcacagcgaacacttaaacctggtaccgcaggtccagtccgttcaatgttccccagaagagagctttgctttccggagccattcccacctcccccctaaaaacaagaacaagaactctttactcatcggattatcaactgggcttttcgatgccaacaatcccaagatgctgaggacctgctccctacctgacctgtctaagctcttccggactttgatggatgttcccacagtcggggatgtgcgccaggataacctggagatagatgagatcgaagatgagaacattaaagaaggaccttccgatagcgaggacatcgtgttcgaagagaccgacactgacctgcaggagctgcaggcctctatggaacagctccttcgggaacaacctggtgaggagtatagtgaggaggaagagagcgttctcaaaaacagtgacgtggagcccacagcaaacgggactgacgtggcggatgaggacgataacccctcatccgagtctgcactgaatgaagagtggcactccgacaactcagatggtgagatcgcctccgagtgtgagtgcgattccgtctttaaccacctggaggagctgaggttacatctggaacaggaaatgggctttgagaaattctttgaggtgtacgagaagattaaggcaatccacgaagatgaagatgaaaatatcgagatttgtagtaagatcgtgcaaaatatccttggcaacgagcatcagcacctttatgcaaaaatcctgcacctagtgatggcagatggagcataccaggaggacaacgacgagtag

SEQ ID NO: 232733 - DNA, 1155 bp, Artificial Sequence
  Description of Artificial Sequence: Synthetic coding sequence
atgcctagcagagccgaggactacgaggtcctctatactataggaacaggaagctacgggagatgtcaaaagatcaggcgcaagtctgacggaaagatcctggtgtggaaagagctggattatggtagcatgacggaagccgaaaaacagatgctagtttcggaggtcaacttgctccgggaacttaaacatcctaacattgtgcggtattacgacaggattatagacaggacaaacaccacactgtatatcgttatggaatattgcgagggcggagacctggcttccgtgataactaaaggcaccaaagagaggcaatacttggacgaggagttcgtgctgcgagtgatgactcagctaacccttgctcttaaagagtgccaccgaagaagcgacggaggtcatacagtgctacaccgggacctcaagcctgcgaatgtgttcctggacggcaaacagaacgtcaagctaggagactttggccttgcccgaatactcaatcatgatacatcctttgctaagacgttcgtcgggaccccgtattatatgtcacccgaacagatgaacaggatgtcctataacgaaaagtccgatatttggagtctggggtgtctcctctatgagctctgcgcactcatgcccccattcaccgcgttctcgcagaaagagttggccggtaagattcgggaaggcaagttcagacgcatcccctacagatatagcgacgaactgaatgagattattactagaatgctgaatctgaaggattaccaccggccttctgtggaggagattctggaaaaccccctcattgcagacctcgtggctgacgaacaacgaagaaacctggaacggcgaggcagacagttaggtgaacccgaaaagtctcaggactcttccccagtgctcagtgaactgaaacttaaggagatacagctccaagagcgggaacgtgcactgaaggccagggaagagcggctggagcagaaggagcaggaactatgcgtccgtgaaaggctagccgaggacaagctggcccgagctgaaaaccttctgaagaattactctctgttgaaagagaggaaattcttgtcacttgcgagcaacccaggcatgagaatcaaccttgtgaacaggagctggtgttataagtag

SEQ ID NO: 232734 - DNA, 1338 bp, Artificial Sequence
  Description of Artificial Sequence: Synthetic coding sequence
atgccaagtagggcagaagactacgaggtgctttacacaatcggaacgggtagctacggaagatgccagaaaattcggaggaaatcagacggaaagattctggtgtggaaagaactcgactacggctcgatgacggaggctgagaaacaaatgctcgtgtcagaggtaaatctactgagagagttaaaacaccccaatatcgttcgttactacgaccggatcatcgatcgcaccaacactaccctctacatcgtgatggagtactgcgaaggcggtgatctggcaagtgtgattacgaaaggcacaaaggagcggcaatatctcgacgaggagttcgtgctgcgtgtcatgactcagctaacgctggccctgaaggaatgccatagaagaagcgacgggggacataccgtcctccaccgggaccttaagccagcaaacgtgtttttggacggcaagcaaaatgtcaaacttggtgatttcggactggctaggattctgaaccacgacacaagctttgctaaaaccttcgtgggtacaccttactatatgtctcctgaacagatgaacagaatgagctacaatgagaaatccgatatctggtccctcgggtgtttgctctatgaattgtgcgcgctcatgccacccttcacagcattcagccagaaagagttagcgggtaagatacgggaaggaaaattcagacgcataccgtacagatatagcgatgagctcaacgaaattatcacccgaatgctgaatctcaaggattaccacaggccctctgttgaggagatacttgagaaccctttgatcgcagatttggttgccgacgagcagcgcaggaatctggaacgtagaggtaggcaacttggcgagccagagaaaagtcaagatagctccccagtgctgtctgaattgaagctcaaggagattcagctgcaggaacgcgaaagagctttgaaagccagggaggagcgtttggaacaaaaggaacaggagctttgtgtgagggagagattggcggaggacaagttagccagggctgaaaacttgctgaaaaactatagcctactgaaggagaggaaatttctctccttggcctccaatcctgagctgctgaacctgcctagttccgtgatcaagaagaaggtgcacttttcaggcgagtcaaaagagaatattatgagatccgagaacagcgaatctcagcttacaagcaaatccaagtgtaaagaccttaaaaaacggcttcacgctgcacagctcagggcacaagcactgtcggatatcgaaaagaactaccagttgaaaagcaggcaaatcttaggaatgcgctag

SEQ ID NO: 232735 - DNA, 1209 bp, Artificial Sequence
  Description of Artificial Sequence: Synthetic coding sequence
atgacagaggctgagaaacaaatgctggttagcgaagtcaacctcttgcgggaactgaaacacccaaatatcgtccgctactacgatcggataattgataggactaacactaccttgtacatcgttatggaatattgcgaaggaggcgatcttgcatcagtgatcaccaagggaactaaggaacgacagtatctggatgaggagttcgtgttacgcgtcatgactcaactaacactggcactgaaggagtgtcaccgcaggtctgacggcggacacactgtcctccacagagacctgaaacctgccaatgttttcctggatggaaagcagaacgtcaagctgggtgactttggactggcccgaattctcaatcacgacacaagtttcgccaagactttcgttggcaccccctattacatgtctcctgagcagatgaataggatgagctacaatgaaaagagcgatatctggtccctgggctgtctgctatatgagctctgcgccttaatgccacctttcacggcgttttcacagaaggagctggccggaaagatcagggagggaaagttcagacgaatcccgtacagatattccgatgaacttaacgaaatcatcactcgaatgctgaatttaaaagactatcatcggccttctgtagaggagatcctggaaaacccgctcattgccgatctggtcgctgatgagcagcggagaaacctggagaggaggggccgtcagcttggcgagccagaaaagagccaggactcgtctccagtcctgtccgagctgaagttgaaggagattcagctgcaagagcgggaaagggccctaaaagcaagggaggagagactggagcagaaggaacaggaactctgcgtaagagagcgcctggctgaggacaaactagctcgagccgagaacctgttgaaaaattacagcctgctaaaggagcggaagtttttgtccctagcttccaaccccgaacttttgaatcttccatcgtcggtgattaagaagaaagtgcacttttcgggcgagtccaaggaaaacatcatgaggagcgaaaactcagaatctcagctgacatccaagagtaagtgcaaagatctcaaaaagcgcctccatgccgcacagctaagagctcaggctctttcagatatcgagaaaaactatcagctcaagagcagacagatcttgggaatgaggtag

SEQ ID NO: 232736 - DNA, 1521 bp, Artificial Sequence
  Description of Artificial Sequence: Synthetic coding sequence
atggacgactatatggtcctgcgcatgattggcgagggctccttcgggcgagccctgttggtgcagcacgaaagcagcaatcaaatgtttgccatgaaggaaatcagattacctaagtcattttctaatacccaaaacagtcgcaaggaggctgtgctgttggccaagatgaagcaccccaacatcgtcgcctttaaggaatcctttgaagccgaaggccatctgtacatcgtgatggagtattgcgacggcggagacttgatgcagaagattaaacagcaaaagggcaaactgttcccagaggatatgatcctcaattggtttacacagatgtgtttgggggtcaaccatattcataaaaagcgcgtgcttcacagagacattaagtccaagaacattttccttactcagaatgggaaagtaaaactcggtgacttcggttcggccaggctgctcagcaatccaatggcgtttgcctgcacgtatgtggggactccgtactacgtcccgcctgaaatttgggaaaacctcccctataataataaatccgatatttggtctttagggtgtattctgtacgagctttgcaccctaaaacaccctttccaggcaaatagttggaagaatctcatcctgaaggtgtgtcagggatgtatcagtccactgccctcccattacagttatgaattacagttccttgttaagcaaatgtttaagaggaatcctagccacaggcctagtgccaccaccctgctcagtcggggtatagtggccagactcgtgcagaagtgccttcctcctgaaattatcatggaatacggcgaagaagtgttagaagagattaaaaacagcaaacacaatactcctaggaaaaaggcaaacccatctaggatccgaattgctttaggcaacgaagcatctaccgtgcaggaggaggaacaggatcggaaagggtcccatactgacctggaaagcatcaatgaaaacctggtggagtcagctttacgtagagtgaaccgggaggagaaaggcaacaagtccgtgcacttgcggaaagcaagttcacccaatctgcaccgacgacagtgggaaaagaatgtcccaaataccgcgttaacggccctggaaaatgcttctatccttacatcttccctaaccgccgaagacgatcgcggaggcagcgtaatcaaatactctaaaaatactactcggaagcagtggctcaaagaaaccccagatacccttttaaacattttgaagaatgccgacctttcccttgcattccaaacatatacaatttacagaccaggttctgaggggtttctcaaggggcctctgagcgaggagacggaagcgagtgacagcgtggatgggggtcacgatagtgtgattttagaccctgagaggctggaacctggcctagatgaagaggatactgattttgaggaggaggacgataatcctgactgggtttctgaactgaagaagcgagcaggctggcaaggactatgtgatcgatag

SEQ ID NO: 232737 - DNA, 1521 bp, Artificial Sequence
  Description of Artificial Sequence: Synthetic coding sequence
atggacgactacatggtgctacggatgatcggcgaaggctcctttggcagagctttacttgtacagcacgagtcatcgaaccagatgttcgcaatgaaagaaatccgactacctaagagctttagtaatactcaaaactcccggaaggaggccgtgctgttggcaaaaatgaagcacccaaacatcgtggcattcaaagagtccttcgaagcagaaggccatttgtacatcgtgatggagtactgtgatggaggagacctcatgcagaagattaagcaacagaaggggaaattattccccgaagatatgatcctgaactggttcacacaaatgtgcttgggagttaaccacatccacaaaaaacgcgtgcttcaccgcgatatcaagtccaagaacatcttcctcactcaaaatggcaaggtaaagctgggagactttggcagcgccagactgctgtccaacccaatggcgttcgcatgtacttatgtgggtaccccttattatgtgcctccagaaatttgggagaatttgccttataataacaagtcagatatttggtcactgggttgtattttatacgagttatgtacactgaagcacccattccaggccaatagctggaagaatctgattttgaaggtgtgtcagggatgtatcagccccttgcctagtcactacagttatgagctgcagttcctggtgaagcaaatgtttaaacgaaatcccagccatcggccttcagcgaccaccctgctgagtagaggtattgtggccaggctcgtgcagaaatgtctgcctccagagatcatcatggaatatggagaggaggtgctggaggagataaagaacagcaagcataacactccccgtaagaaagccaacccttcccgaatcaggatagcactcggcaacgaggcatctacagtgcaagaggaagaacaggaccgtaaaggatctcacaccgacttggagtccattaatgagaacctggtcgagtcggccctcagaagggttaatagagaggagaagggcaacaagtccgtgcatttaagaaaagctagctctcccaacttacaccgtaggcagtgggagaaaaatgttccaaataccgcattaacagccctggagaacgccagcattctgaccagttctctaactgctgaggatgatcgcggagggagcgtgattaagtatagtaagaatacgacacggaaacagtggctgaaagaaacccccgacaccctattgaacattttgaaaaacgcggatctgtctctagcatttcagacatacacaatctatagacctggcagcgaagggtttctcaagggcccattatccgaagaaacggaagcaagtgactccgtcgatggcggacacgattccgtgatcctggatcctgagagacttgaaccgggactggatgaggaagatacagattttgaagaagaagatgataatcccgactgggtttccgaattgaaaaagagggcaggatggcaaggtctttgtgatcgctag

SEQ ID NO: 232738 - DNA, 1470 bp, Artificial Sequence
  Description of Artificial Sequence: Synthetic coding sequence
atggatgactacatggtcctgaggatgataggagagggctcattcgggagggcactgctggttcaacacgagagcagcaaccagatgttcgctatgaaggaaatacgacttcctaagtccttttctaatacccagaactcccgaaaagaggccgtgttactcgcgaagatgaaacatcctaatatagtggccttcaaggagagcttcgaggccgaaggccatctttacatcgttatggagtactgtgacggtggggacctgatgcaaaaaattaagcagcagaaagggaagctgtttccggaggatatgatacttaactggttcacacagatgtgtctgggcgtgaatcacattcacaaaaaacgggtactacacagagatatcaagtcgaagaacattttccttacccagaatggcaaagttaagctgggagatttcggcagtgctaggctcctgtctaacccaatggcttttgcctgcacctacgttggaacgccttactacgtcccccctgagatatgggaaaatctcccttacaacaacaaaagtgacatttggtcactgggctgcatcttgtacgagctgtgtaccctcaaacaccctttccaggcaaactcttggaagaaccttatactgaaagtctgtcaaggctgcatcagccctctcccctctcactactcgtacgagcttcagttcctcgtgaagcaaatgtttaagcgcaaccctagccacaggccctctgcgacaaccctgttgagtcgtggaatagtagccagactggtacagaaatgccttcccccagaaattattatggaatatggagaggaggtgctggaagagattaaaaactctaaacacaacacaccacgtaagaagcaagaggaggaacaagacaggaaggggagccacacagacctcgagtcaatcaacgagaacctcgtagagtccgcattgcgcagggtgaatagggaggagaagggcaataaaagcgtccacttgcgcaaagctagctctccgaacttgcacagacgccagtgggaaaaaaacgttcctaatactgcattaactgccttggagaatgctagtattcttacctcatctctgaccgctgaggacgatcggggtggctccgtgattaagtactctaagaacaccactcgcaaacagtggctgaaggaaacaccagacactttgctgaatatccttaaaaatgcagacctctcactcgcatttcagacgtacacgatctatcgacctggaagcgagggctttctcaaggggcctcttagtgaagaaacggaagcctctgactctgtagatggtggtcacgattccgttatcctggacccggagagattagagcctggcctggacgaagaagatacagattttgaggaagaagacgacaaccctgactgggtaagcgaactgaaaaagcgagccggttggcaaggcctgtgtgatcgctag

SEQ ID NO: 232739 - DNA, 1533 bp, Artificial Sequence
  Description of Artificial Sequence: Synthetic coding sequence
atgcagttcgggagggctcacggcgattgtgtttctggcgcacagctgtgcgggtgcccctccatggacgactatatggtgcttcggatgatcggcgagggcagttttggccgagccctgttggttcagcatgaaagcagcaaccagatgtttgctatgaaagaaatacgccttcctaaaagtttttctaatacacagaattcccggaaagaagcagtactactcgccaagatgaaacatcccaacatcgtcgcattcaaagaatctttcgaagctgaagggcacctttacatagtgatggagtattgtgatgggggagatctgatgcagaaaatcaagcagcagaaaggcaaactgtttccagaagacatgatactcaactggtttacacagatgtgcttaggagtaaatcacatccacaagaaacgcgtgctgcatcgggacatcaagagtaagaatatcttcctaacccagaacggcaaagtcaagctgggggacttcggtagcgccagactcctgagtaatccgatggcctttgcttgtacctacgtgggtacaccttactacgtgcccccagagatttgggaaaatcttccctacaataataaatcagacatatggtctcttggatgtattctgtatgagctgtgcaccctcaagcatcccttccaggctaactcttggaagaatctgatactaaaggtttgccaggggtgcatcagtccgctgccgtcacattactcgtacgaactgcagtttttagtgaagcagatgtttaagcgcaatcctagccaccgcccttctgcgacgaccctcctttctcgtgggattgtggcacggctggtccagaagtgcttgcctcctgaaatcatcatggagtacggcgaggaagtattagaagagatcaagaattcgaagcataacacacccagaaagaagcaggaggaggaacaggatcgcaaggggagtcatacagacttagagagtattaacgagaatctcgtggagagtgcccttcgccgagttaatagagaagagaagggcaacaaatccgtccacctgcgaaaagcctcttctccaaatttgcacagacgtcagtgggagaaaaatgtacctaatactgcactgacagcgctcgaaaatgcctccatcctaaccagctcactgactgcggaggacgatagaggcggatcagtcatcaaatattctaaaaacacaactagaaagcaatggctgaaagaaacgcctgatacacttctcaatatactgaaaaacgcagacctttctctagcttttcagacctacaccatctaccgcccaggctcagaaggttttctgaaaggccctctctcagaagaaacagaagcctccgattctgttgacggtggacacgatagtgtgatcttagaccctgagcgactcgaaccgggtctcgatgaggaagataccgatttcgaggaggaggacgataaccctgattgggtctccgagttaaagaaacgagcaggctggcaggggttgtgtgacaggtag

SEQ ID NO: 232740 - DNA, 177 bp, Artificial Sequence
  Description of Artificial Sequence: Synthetic coding sequence
atggacgactacatggtgctacgcatgataggagagggatcctttggacgcgcactgctggtccagcacgaatcttcaaaccagatgttcgctatgaaagaaatcagactgcctaagtcttttagtaacacccaaaatagccgcaaggaagctgtgttattggccaaaatgaaatag

SEQ ID NO: 232741 - DNA, 510 bp, Artificial Sequence
  Description of Artificial Sequence: Synthetic coding sequence
atggcacgcggaggcgacaccgggtgcacaggtccttcagagacatctgcttccggagccgcagccatagctttgcctgggttagaagggccagctacagacgcacagtgtcagactctgccccttacagtcctgaagagcagatctccctcaccacggtccctgccgcctgctctttcatgtcctcctccccaaccagcaatgttggaacacctgtcttctcttcccactcagatggattacaagggacaaaagctcgcggagcagatgttccaggggattattctgttctctgccatcgtcgggttcatctatggttacgttgcggaacagtttggctggactgtatatatcgttatggctggcttcgcctttagctgcctactaactctgccaccttggcctatttacaggcggcaccctttaaaatggctaccggtacaggaatcctccacggatgataaaaaacctggggagcgaaaaattaaaagacacgccaagaataactag

SEQ ID NO: 232742 - DNA, 2259 bp, Artificial Sequence
  Description of Artificial Sequence: Synthetic coding sequence
atgccactggccgcatactgttacttgcgggtggttggcaaaggatcatacggggaggtgactcttgtaaagcaccggagggacggcaagcaatacttgcatgaaaagcacattcttcatcgggatctgaagacacagaacgtctttcttaccaggaccaacatcataaaggttggtgaccttggcattgcacgggtcctggagaatcattgcgatatggcatcaacccttattggtaccccatactatatgtcccccgagctgttcagcaataagccatacaactataaatctgacgtctgggcgttgggatgttgcgtgtacgaaatggcaacattgaagcacgcttttaatgccaaagatatgaattccttagtctaccgaataattgaaggcaagttgccaccaatgcctagggattatagtcctgagctagctgaactcattaggactatgttatcaaagagacccgaggagcgcccatccgtccgaagcatcctgcgacagccttatattaagcggcagatatctttcttcttggaggcaaccaaaatcaaaacatctaaaaacaatatcaagaacggtgattcgcagagcaagccctttgctacggtggtgagcggggaagccgaaagcaatcatgaggttatacacccgcagcctctgtcaagcgaaggaagccagacatatatcatgggagaggggaagtgtctgagtcaggagaagcccagagcttccggactcctcaaatccccagcttctcttaaagcccatacttgtaaacaagacctgtctaacacgaccgagctggctacgatttcaagcgtcaacatcgacattctgccggctaagggcagggacagcgtttctgatggcttcgtgcaggagaatcagcctagataccttgatgcttcaaatgaattgggtggcatttgcagcattagccaggtcgaggaggagatgctccaagataacacaaagtccagtgcacagcccgaaaatttgattcccatgtggagctcagatatagtcaccggtgaaaaaaatgaacctgtaaagccattgcagcccctgattaaggagcagaagcctaaggaccagagtctggccttatcccctaagctggaatgctcagggacgatactcgcccatagcaacctgaggctgctgggtagctccgacagccccgcatcagctagccgcgtcgcaggcataacaggcgtgtgtcaccatgcccaagaccaagtggccggtgaatgcatcatcgagaaacaaggaaggattcaccctgacctgcagccccataactcgggaagtgaaccctccctgtcccgccagcgccgacagaaaagaagagagcaaaccgagcatcggggagaaaaacgacaggtccgcagagatctctttgcctttcaagaatctcccccaagatttttaccctctcaccctattgtcggcaaggttgacgtgacgtctacacagaaggaagccgagaaccagcgccgagtcgtgaccggttcagtgtccagttctcgcagtagtgaaatgagctcaagcaaagaccggcctctctctgccagagagcggcgacgactgaagcagagccaggaagagatgagctcctctgggccatcagtgcggaaggccagtctctccgtcgccggaccgggaaagccacaagaggaggatcaacctctgcctgcccgtcgcctgagttccgattgtagtgtgacccaggaacggaagcaaatacactgcctgagcgaggacgagttgagctcctccaccagcagtacggacaagagcgatggcgattacggtgagggtaagggccagacgaatgagattaatgccctagtgcagctgatgacccagaccttgaaactcgattcaaaggaatcctgtgaggacgtgcccgtcgccaatccagtcagcgaatttaagctccatagaaaatacagggataccctcattttgcacggcaaggtggcagaggaagctgaagaaattcattttaaggaacttccatctgccatcatgcctggctccgaaaaaattaggcggctcgtggaggtgctgcgaaccgacgtaatccggggacttggagtccagcttctggagcaggtgtacgatctgttagaggaagaagatgaatttgatagagaagttagactgcgtgaacatatgggcgaaaagtataccacatacagcgtgaaggctcggcagctgaagtttttcgaggaaaacatgaacttttag

SEQ ID NO: 232743 - DNA, 942 bp, Artificial Sequence
  Description of Artificial Sequence: Synthetic coding sequence
atggcgggacaaccgggacatatgcctcacgggggaagctcgaacaacctgtgccacaccctgggtccagtgcatccaccggacccccagaggcacccaaacaccctgagctttagatgcagtttggcggactttcagatagagaaaaaaattggccgagggcaatttagcgaagtctataaggccacctgcctacttgatcgaaagactgttgccctgaagaaggtacagatattcgagatgatggatgctaaggcgagacaggattgcgtgaaggagatcggcctgctgaaacagctcaaccatccgaacattatcaagtacctcgatagctttatagaagacaatgagctgaatattgtcctggagctagcagacgcaggcgatctgagtcaaatgatcaagtacttcaaaaagcagaaaaggctgatcccagaacggactgtctggaagtacttcgtgcagttatgctctgctgtcgaacacatgcactctcggagggtgatgcatcgggacatcaaacctgccaatgtattcataacagccacaggggtagtgaagttgggcgatcttggactgggaaggttcttctcatccgaaacgacagccgcacactcactggtgggcacaccctactatatgtcacccgagaggatccacgaaaatggctataacttcaagtccgatatatggagtcttggatgtcttctttacgagatggccgctttgcaatcccccttctatggtgacaagatgaacctcttctccctatgccagaagatagagcagtgtgactaccctcctctgcctggggaacactactccgaaaagttaagggagctggtgagtatgtgcatttgccccgacccccaccaacgtcctgatatcggctatgttcatcaagtcgctaagcaaatgcacatatggatgagttccacttag

SEQ ID NO: 232744 - DNA, 624 bp, Artificial Sequence
  Description of Artificial Sequence: Synthetic coding sequence
atggctggtcagccaggacatatgccccacggaggatcctctaacaatctttgccatactctcggcccagtacacccacccgatccacaaagacaccctaataccttgagcttccgttgctctttagccgatttccaaatagagaagaagatcgggcgaggtcagttctccgaagtgtataaagcaacctgtctgctcgatcggaaaactgtcgctttgaagaaggttcagatctttgaaatgatggatgccaaagcacgacaagactgtgttaaggaaattggactactgaaacagcttaaccatccaaacatcatcaagtatctcgattcatttatcgaggataacgagctcaacatagtcctcgagttggccgacgctggtgacctgagtcagatgatcaaatacttcaagaagcagaagcgtcttattcccgaacgaaccgtgtggaaatacttcgtccagctttgctcagctgtggaacacatgcactcccggcgagtaatgcaccgcgatatcaaacccgcaaacgtcttcataactgctactggtgttgtgaaactgggggacctgggtctcggtaggttctttagcagtgaaactaccgccgcacatagcctgtag

SEQ ID NO: 232745 - DNA, 1044 bp, Artificial Sequence
  Description of Artificial Sequence: Synthetic coding sequence
atgcctcgcagagaggtctgctgggaagccgcacatttcagacaagaggagcagtcgctgcctcggccaagggttagggctttagtgcggctcgcttgtaggatggcgggtcagcccggacacatgcctcacgggggttcttcaaataacctctgccatacactcggcccagtacacccacctgacccacagcgccatcccaacacattatcctttcggtgcagtctggcagattttcagattgaaaaaaaaatcggtcggggacagttctctgaagtatataaagccacatgtctacttgaccgtaagacggtcgccctcaaaaaagtccaaatcttcgaaatgatggacgccaaagcgcgacaagattgtgttaaagaaatcggactgctgaaacagctaaaccatccgaatatcatcaaatacctcgactcatttatcgaagacaatgagctaaatatagtcttagagctcgcagatgccggtgacctgagccagatgattaaatattttaagaagcagaagcggctgataccggagcgcacagtgtggaagtattttgttcagctctgttccgcagtggagcacatgcacagtcggagggtgatgcaccgggacattaaacccgcaaacgtgttcattacggctacaggcgtcgtgaaactcggtgacctgggcctcggcaggttcttctctagcgaaaccactgctgcccattctttagttgggacaccgtattatatgtctcccgagagaatccacgaaaatggatacaactttaagtcagacatctggtctctgggctgtctgctctatgaaatggctgccctgcagagccccttttatggggataaaatgaacttatttagtttatgccagaagatagaacagtgcgactaccccccacttcctggtgagcattattcagaaaagttgcgcgaactggtaagcatgtgtatctgtcccgatccgcaccagcgccctgatattgggtacgtccaccaagtggccaaacagatgcacatctggatgtcatctacgtag

SEQ ID NO: 232746 - DNA, 738 bp, Artificial Sequence
  Description of Artificial Sequence: Synthetic coding sequence
atggctggccagcccggacacatgccgcacggcggtagctcaaataacttgtgccacacactgggaccggtccatcccccagatccgcaacaactaaatcacccaaacatcatcaaatatctggatagttttattgaggacaacgagctcaacatagtgctggagctagcggacgcgggtgatctgtctcagatgattaagtatttcaagaagcaaaaacgtcttatccccgagcgcacagtgtggaaatattttgtgcagctgtgctctgctgtggagcacatgcatagcagaagggtgatgcacagggatattaaaccagcaaacgtctttattactgccacaggcgtcgttaaactcggagatctgggcctaggtagattcttttcttccgaaaccacagccgcacactccctggtgggcaccccatactacatgagtccggaaaggatccacgagaacggctacaatttcaagagcgacatttggagtctagggtgcctcctctatgagatggcggctttgcaaagcccattttatggcgacaaaatgaatttattttcactgtgccagaagatcgaacaatgtgattatcctccgttgcctggggaacactacagcgagaaactgcgggagttagtgagtatgtgtatctgcccagacccccatcaacgcccagacatagggtacgtgcatcaagtggccaaacaaatgcatatctggatgtcttccacctag

SEQ ID NO: 232747 - DNA, 942 bp, Artificial Sequence
  Description of Artificial Sequence: Synthetic coding sequence
atggcaggacagcccggtcacatgcctcacggcggtagctccaacaatctgtgccatactttaggccctgtgcatccccctgacccccagcgtcatccgaacacacttagtttccggtgtagcttagcagactttcaaatcgagaaaaaaattggtagaggccagtttagcgaggtgtacaaggccacctgtctgctcgacagaaagactgtcgccctgaagaaggtgcagatattcgagatgatggacgcgaaggccagacaggactgcgttaaggaaatagggctgttgaagcagctgaatcacccaaatataatcaagtatcttgatagctttatagaagataatgagttgaacatcgtcttagagctagccgacgctggtgacctttcacagatgatcaaatatttcaaaaaacagaagagactcattcctgagagaactgtctggaagtattttgtgcaactatgcagcgcagtggagcacatgcattcccggagggttatgcacagggacattaagcctgccaatgtgtttatcacggcaacaggcgtggtaaagcttggagacctcggactaggacggttcttctcatccgagactacagcagcacattctctggtggggacaccatattacatgtctcctgagagaatccatgagaacggctacaactttaaatccgacatctggtctctgggttgccttctgtatgagatggcggcattgcagtcccccttctatggtgacaagatgaatttattttcgctatgtcaaaaaattgagcaatgtgactaccctcctttgcccggagagcactatagcgaaaaactgcgcgaactggtctctatgtgtatctgccccgacccacatcagcgtcctgacatcggctatgttcatcaggtggctaaacagatgcacatttggatgtctagcacatag

SEQ ID NO: 232748 - DNA, 1044 bp, Artificial Sequence
  Description of Artificial Sequence: Synthetic coding sequence
atgcctcgtcgcgaagtatgctgggaggctgcccattttcgacaggaggagcaaagtttgccccgaccgagggtgcgggctctggtgaggctggcttgccgtatggctgggcagcccggacacatgccccatggaggctcctccaacaacctgtgtcacacacttggtcccgtccaccccccagacccacaaaggcaccccaacacactgtcctttcggtgcagtctcgccgacttccagatagagaagaagatcggacgcggacaatttagcgaggtgtataaagcgacctgcctgctggatagaaagactgtggcactgaagaaggtccaaatcttcgagatgatggatgcaaaggcgagacaggattgcgtgaaggagattgggctgctgaagcagctgaaccatcccaatattatcaaatatctggactctttcatagaggataatgaattgaatattgtcctagagctggccgatgcaggggacctgtcccagatgatcaagtattttaaaaaacaaaagcgactgatccccgagagaaccgtctggaaatactttgtgcagttgtgttccgccgttgaacacatgcattctagacgagtgatgcatagggatatcaagcctgctaacgtgtttatcaccgctacaggtgttgtgaaactgggtgatctgggcttgggtagatttttctcctctgaaaccacggctgctcacagtctagtaggcacaccatactacatgtccccagagaggatccatgaaaacgggtataactttaagtcggacatttggagcctggggtgtttgttgtacgaaatggcagcactgcaatctccattctacggagacaagatgaatctcttctcgctgtgccagaagatcgaacagtgcgattatccccctttacctggagaacattacagtgagaagctgagagagctggtttctatgtgcatttgccccgaccctcaccagcgacccgacatcggctatgtacatcaggtggcaaagcagatgcatatctggatgtcctccacatag

SEQ ID NO: 232749 - DNA, 663 bp, Artificial Sequence
  Description of Artificial Sequence: Synthetic coding sequence
atggccggtcagcccggacatatgccacacgggggatcatcgaataacctgtgtcatacactggggccagtccatccccctgacccacagagacatcccaacaccctgtcattccgctgctccctcgccgactttcagatcgagaaaaagatcggccgaggacagttcagcgaggtgtacaaagcgacctgtcttctggaccgcaagactgttgcactgaagaaagtccagattttcgaaatgatggacgctaaggccaggcaggactgcgttaaggaaatagggctgctcaagcagctgaaccacccaaacatcatcaagtacctagactctttcatagaggataacgaacttaatattgtcttggagctggcggatgcgggagacctgagtcagatgatcaagtatttcaagaaacagaaaagattgataccagagaggaccgtgtggaaatattttgtccagctatgttcagccgttgagcacatgcatagccgtagagtaatgcatcgcgatattaagccggctaatgtgttcatcactgccactggtgttgtgaagctaggagaccttggtctgggtcggtttttttccagtgagaccaccgctgcacactccctcgtagggaccccctattacatgtctcccgagagaatacactag

SEQ ID NO: 232750 - DNA, 585 bp, Artificial Sequence
  Description of Artificial Sequence: Synthetic coding sequence
atgccaaggagagaggtttgttgggaggccgcacatttccgacaggaagaacagagtttgcctcgccctcgggttcgggctctagtgaggttagcctgcaggatggccggtcagcctggccatatgccccacggcggatcatctaacaatttatgccacacattgggccctgtgcatccccctgacccacaacgccatccaaacactctttcgtttcgctgctctctggcagacttccagatcgaaaagaaaatcggccgtggccaattctccgaagtgtacaaggccacctgcctcctggacaggaagaccgtggctttgaagaaggtgcagatctttgagatgatggatgcaaaggcgaggcaggactgcgtgaaagagatcggactattaaagcaattgaaccacccaaacattatcaagtacttggattcattcatagaggacaacgaattaaatatcgtgctagagttagcagacgcaggcgatctctctcagatgattaaatatttcaaaaaacagaagcggctgatcccagaacgcactgtgtggaaatatttcgtgcagctgtgtagtgcggtgtag

SEQ ID NO: 232751 - DNA, 669 bp, Artificial Sequence
  Description of Artificial Sequence: Synthetic coding sequence
atggcaggacagccaggtcatatgccacacggcggttcatccaataatctgtgccacaccctggggccagtgcatcccccagatccacaacgccatcccaatacattgagtttccggtgctctttggccgacttccagattgagaaaaaaatcggaagaggccagttctcagaagtgtataaggctacttgcctcctcgacagaaagacagtagccctgaagaaagtgcaaatcttcgagatgatggacgccaaggccagacaggattgtgtgaaggagatcggactactgaagcagttgaaccatcccaatatcattaagtacctggattctttcatcgaggacaatgagctgaacattgtacttgagctggcggatgccggagatcttagccagatgataaagtactttaaaaagcagaagcgactgatcccagagcggaccgtgtggaaatattttgtgcaactttgttctgccgtcgagcatatgcacagccgacgagttatgcacagagatattaaaccagccaatgtattcatcactgccacgggagtggtgaaactaggcgatttagggctggggaggtttttttctagtgagacaacagccgcacacagccttgtaggcaccccctactatatgagccctgaacggatccatgagaactag

SEQ ID NO: 232752 - DNA, 660 bp, Artificial Sequence
  Description of Artificial Sequence: Synthetic coding sequence
atggcaggccagcctgggcatatgccccatgggggtagttccaataatttatgtcatacgctggggcctgtccaccccccagacccccagcggcaccctaataccctgagttttagatgtagtctggctgacttccagatcgaaaaaaaaattggtcgcggacagttttccgaagtttataaagcgacatgccttctggaccggaagacggtggcgctgaaaaaggttcaaatctttgagatgatggacgcaaaagcccgacaggactgcgtgaaggagatcggactgttgaaacagttaaaccacccaaacatcatcaagtatttggatagttttatagaagacaacgagctgaacattgtgctggaactcgctgatgcaggcgacctgagccagatgatcaaatatttcaagaaacagaagcgactgatacctgaaaggactgtttggaaatacttcgtccagctttgtagcgctgtggagcacatgcacagccgtagggtgatgcatagggatatcaagcccgctaatgtattcattacggccactggtgtcgtgaagcttggcgacctcggacttggaaggtttttctcaagcgagacgacggcagcccattccttggtcggcaccccgtactacatgagcccagagaggatttag

SEQ ID NO: 232753 - DNA, 516 bp, Artificial Sequence
  Description of Artificial Sequence: Synthetic coding sequence
atggccggacagcctggtcacatgcctcacggcggatccagtaataatttatgccacaccttagggccagttcaccccccagatcctcagcggcatccgaacaccctctcatttcggtgctctttagctgacttccagatcgaaaaaaagatcggccgagggcaattcagtgaggtatacaaagcaacctgtttgctggaccgcaaaaccgtagctttgaagaaagtgcagatttttgagatgatggatgccaaggcaagacaagattgcgtgaaggaaatcgggctcctcaagcagctcaaccaccctaacattatcaagtacctcgattctttcatcgaagataatgagctgaatattgtgctcgagctggcagatgcaggtgatctttctcagatgatcaaatatttcaagaagcaaaaacgtctgattcctgagcgcaccgtatggaagtactttgtgcagttgtgtagcgctgtcgaacatatgcacagccgtagggtgatgcaccgctag

SEQ ID NO: 232754 - DNA, 606 bp, Artificial Sequence
  Description of Artificial Sequence: Synthetic coding sequence
atggccggtcaacccggacacatgccccacggcggatcttccaacaatctttgccataccctcggacccgtacatccacctgatccacagcagctgaatcatccaaatattatcaagtatctggattcatttatcgaagataatgagctgaacatcgtgctggagctcgcagacgctggggatctatctcagatgattaagtactttaagaagcaaaagcgcctcataccagagaggacggtgtggaaatactttgtgcagctctgttcggctgtggagcatatgcatagccgtcgggtgatgcatcgggacatcaagccagcgaatgtgtttattacagccactggggtggttaagcttggagatctgggactgggcaggttcttttcctcagagacgacagccgcacattcactggtgggaaccccctattacatgtcccctgaacggatccacgagaatggttataatttcaaatccgacatttggtctttggggtgcttattgtacgaaatggccgcacttcagtctccgttttatggcgacaaaatgaacctattcagcctctgtcagaagatagagcaatgcgattaccctccactgtag

SEQ ID NO: 232755 - DNA, 1017 bp, Artificial Sequence
  Description of Artificial Sequence: Synthetic coding sequence
atggaggctaccgggtgggacagcagatgttcccccggtacccaagtccgcgctctggtgaggttagcatgcagaatggccggtcagcccggacacatgccccacggcggtagctcaaacaacctgtgccataccctgggcccagtacaccccccagacccacagcgtcacccaaataccctgtccttcaggtgctctctggccgattttcagatcgaaaagaagattggcaggggtcagttttctgaagtttataaagcaacctgcctgctcgatagaaaaactgtagccctaaaaaaggtccagattttcgaaatgatggatgccaaagcgaggcaggactgtgtcaaagagatcggcttgctcaaacagctgaaccaccccaacataataaaatacctggattcctttatcgaggacaacgaactgaacatagtgctagagctggcggatgccggagatttatcccaaatgatcaagtactttaagaagcagaaacggcttatcccggaaagaaccgtttggaagtacttcgtgcaattatgctctgccgtggaacatatgcacagcagacgagttatgcaccgagatatcaagccagccaatgtcttcattaccgccaccggcgtcgttaaactgggcgatttgggcctcggcagatttttcagttccgagacaacagccgctcactcattggttgggaccccgtactatatgtcccctgaacggatccacgagaacggctataacttcaagtcagacatttggtccttgggttgcctgctgtatgaaatggctgctctacagtctcccttctacggggataaaatgaatctttttagcctctgccagaagatcgagcagtgtgactaccctccactgccaggcgaacattacagtgaaaagctcagggagctggtaagtatgtgcatctgcccggacccccaccagcggcctgatattgggtacgtgcatcaggtcgccaaacagatgcacatttggatgtctagtacctag

SEQ ID NO: 232756 - DNA, 996 bp, Artificial Sequence
  Description of Artificial Sequence: Synthetic coding sequence
atgggaagacggaggccagctccattcagagccttggtccggctggcctgtcgcatggcagggcaaccaggtcacatgccccacgggggaagttctaataacctctgtcatacccttggtcctgtgcaccctcccgacccccagcgacacccaaatacactgagctttaggtgctccctcgcagacttccagatcgagaaaaagattggccgtggacagttttcagaggtttacaaagctacatgcctgctcgaccgaaaaacagtcgcccttaagaaggtccagatttttgagatgatggacgcaaaggccagacaggattgtgttaaagaaattgggctgttaaagcagctaaaccacccaaatattattaagtacctcgactcatttattgaggacaacgagttgaatattgtgctcgaattggccgatgctggcgacctcagccagatgatcaagtattttaaaaagcagaagaggctcatacctgagcgtacagtatggaaatactttgtacagctgtgttccgctgtggaacatatgcactccagaagggtgatgcaccgggacattaagcctgcaaacgtatttatcacggccacaggagtggtgaagctgggcgatctaggcctgggacgttttttttcaagcgaaacgactgcagcccatagcctcgtggggactccttactacatgtctccggagcgaatccatgagaatggatacaactttaaaagcgacatttggagcctgggctgcctgctgtacgaaatggctgcgctacaatcgccattttacggcgataagatgaacctattcagcctgtgccagaagattgagcagtgcgattacccacctctccctggcgagcactattcagagaaactgcgggagcttgtttcaatgtgtatatgccctgaccctcaccagaggcctgatattggctacgtgcatcaggtcgccaaacagatgcacatttggatgtcatccacctag

SEQ ID NO: 232757 - DNA, 942 bp, Artificial Sequence
  Description of Artificial Sequence: Synthetic coding sequence
atggcaggtcaacctggacacatgccccatggcggatccagtaacaacctctgtcacaccctgggcccagtacacccccctgatcctcagcgtcaccctaatacgttgtcttttaggtgcagtctcgccgacttccaaatcgaaaagaagattggcagggggcagttctctgaggtatacaaagcaacatgtttactcgatcgcaagacagtcgccctgaagaaggtgcagatttttgagatgatggacgccaaggctaggcaagactgcgttaaagagatcgggctgctgaagcagctcaaccatcccaatatcattaagtatctagacagctttatcgaagacaacgagttaaacatcgtcctggaattagctgacgctggggatctgtcccagatgattaaatacttcaagaaacagaagagactcatccccgagcgtacggtgtggaagtacttcgtacaactctgctccgcagtcgagcacatgcactcaaggcgggtgatgcatcgggatatcaagccggctaacgtcttcataaccgctaccggcgtcgtcaaactgggggacctgggcctcggcaggttctttagctccgagaccacagccgctcattccttggtaggaactccctactatatgtcccccgagcgcattcatgagaacgggtacaacttcaagtcagatatatggtcactggggtgtctgctgtatgaaatggctgctttgcagtccccattctatggagataaaatgaacctcttctccctttgtcagaagatcgagcagtgtgattatcccccactaccgggagaacattattctgagaaacttagagagctggtgtcaatgtgcatttgtcccgacccccaccagcgacctgacatcggatatgttcatcaggtcgcaaagcaaatgcatatttggatgtccagtacatag

SEQ ID NO: 232758 - DNA, 942 bp, Artificial Sequence
  Description of Artificial Sequence: Synthetic coding sequence
atggccggacagcccggacatatgccccatggcggttctagcaacaacctgtgccacacgctggggcctgtgcacccaccggatccccagcgacaccctaacaccctctccttcaggtgtagtctcgctgatttccaaatcgagaaaaagattggcaggggacagttttccgaggtctacaaagcaacctgcctcttagacaggaagactgtggccttgaagaaagtgcagatcttcgagatgatggacgccaaggcaaggcaggactgtgtcaaagagattggcctccttaagcaactgaaccacccgaatattatcaagtatttagattcgttcatcgaggacaatgagctcaatatagtgctcgagttagccgacgctggagatctgagtcaaatgatcaaatacttcaaaaaacagaagagacttataccagaacgaacggtgtggaagtatttcgtacaactgtgctccgctgtggaacatatgcattccagacgcgttatgcatagagatatcaagcctgcgaacgtgtttataaccgccacgggggtcgtgaaactgggagacctgggtctgggacgattcttttcatccgagacgaccgccgcacactctctggtggggactccctactatatgtcccccgagaggatccacgaaaatggctacaacttcaagtccgacatttggtccctaggttgtctgctttatgagatggccgctctgcaatctccattctacggagataagatgaacctattcagcttgtgccagaagatcgagcagtgcgactacccccctctgcctggcgagcactattccgagaaactgagggagttggtatctatgtgtatttgcccagaccctcaccagcggcctgacattggatatgtgcatcaggtggccaaacaaatgcatatttggatgtcttcaacatag

SEQ ID NO: 232759 - DNA, 909 bp, Artificial Sequence
  Description of Artificial Sequence: Synthetic coding sequence
atggatgaacagagtcagggaatgcagggtcctccagtgcctcagttccagccccagaaagcccttcggcctgacatgggctacaacactctggcgaacttccgtatagaaaaaaaaatcgggcgtggacagttttccgaagtgtaccgggctgcttgtctgcttgatggagttccagttgccctgaagaaagtgcaaatctttgatctgatggacgcaaaggctagagccgactgcattaaagagattgatctgctcaagcagctgaaccatcccaacgtcattaaatactacgctagcttcatcgaagacaacgagctgaacatagtgcttgaactggcagacgctggggatctgtccagaatgattaagcacttcaaaaagcagaagcggttgatcccggagagaaccgtgtggaaatattttgtccagctatgttcagccctggaacatatgcactctaggcgggtgatgcaccgagatatcaagcccgctaatgtgttcataactgccacaggggtcgttaagttaggggatctcgggctgggcagattctttagctccaagactaccgctgcccactctctcgtcggcaccccttactacatgtctcctgaacgcattcacgaaaacggctataactttaagagcgatatctggtccttagggtgtctgctgtatgaaatggctgccctccaaagcccattttatggggacaaaatgaacctatatagcctctgtaagaagatcgagcagtgcgactacccacctctgcctagtgaccactacagcgaagaacttcggcaactggttaacatgtgcattaacccagaccccgaaaagcggccagacgtcacttatgtgtatgatgtcgccaaaagaatgcatgcatgtactgcctcttcttag

SEQ ID NO: 232760 - DNA, 249 bp, Artificial Sequence
  Description of Artificial Sequence: Synthetic coding sequence
atggacgaacagtcccagggcatgcagggacccccagtaccacagttccaacctcagaaggcactgcgacccgatatggggtataacactctagcaaactttcgcattgaaaaaaagattggacggggacagttcagtgaagtataccgagcagcatgtctgctagacggcgtgcctgtggctctgaaaaaggtccagatctttgatttaatggatgccaaagcgcgagccgactgtataaaggagtag

SEQ ID NO: 232761 - DNA, 99 bp, Artificial Sequence
  Description of Artificial Sequence: Synthetic coding sequence
atggacgagcagagccagggcatgcagggccctccagtgccccaattccagccccagaaagcactgcggcctgatatgggatacaacactctggcttag

SEQ ID NO: 232762 - DNA, 909 bp, Artificial Sequence
  Description of Artificial Sequence: Synthetic coding sequence
atggatgagcagagccagggtatgcagggcccaccggtcccacagttccagccccaaaaggcactgcgaccggacatgggttataacacacttgccaattttcgcatagaaaaaaagattgggcgaggccaattctcagaagtctatcgcgctgcctgcctgcttgacggcgttcccgtagccctcaagaaagtgcagatcttcgacttgatggatgcgaaggcaagagccgactgcattaaggaaattgacttgctgaagcagttaaatcatcctaacgtgattaaatattacgcttccttcattgaagataatgagctgaacattgtccttgaattagcagacgccggtgatctatccagaatgattaaacacttcaagaagcagaaaagactgattcctgaaagaacagtgtggaaatacttcgtgcagctgtgcagtgcactcgaacacatgcacagccgcagagtcatgcatcgagatatcaagccggcaaatgtgtttattacggctactggagtggtgaaactcggagacctgggcctagggaggttcttcagctctaaaaccactgcagctcactcgctggtcggcactccctactacatgtctcctgagcgaatccatgagaacggatacaacttcaaatcagacatatggagtcttggttgcctcttatacgagatggccgcactgcaatcccctttctacggcgataagatgaatttgtattccctctgcaaaaaaattgaacagtgcgattaccctcctctgccatccgatcattacagcgaagagctgcggcagctggtcaacatgtgcatcaatccagatccagaaaagaggcctgatgtaacatacgtgtacgatgttgccaaaagaatgcatgcctgtaccgcctccagttag

SEQ ID NO: 232763 - DNA, 189 bp, Artificial Sequence
  Description of Artificial Sequence: Synthetic coding sequence
atggatgagcagagtcagggcatgcaggggcctcccgtgccccagtttcagccccaaaaggctctccggccagatatggggtacaacacactggcaaattttcggatcgagaagaagatcggaaggggacagttctccgaggtgtatcgcgcagcatgcttactagacggcgtgcctgtggccttgtag

SEQ ID NO: 232764 - DNA, 3729 bp, Artificial Sequence
  Description of Artificial Sequence: Synthetic coding sequence
atggaaaagtacgtgcgtctacaaaagattggagagggaagtttcggtaaagccattctggtgaagtctactgaagacggcaggcagtacgtaattaaggagattaacattagtcgaatgtcaagcaaggagcgggaagaatcccggagggaggtggcagtcctcgccaacatgaagcatcccaatatcgtccagtatcgtgaatcgttcgaagagaacggttcactctatatagtgatggattactgcgaaggcggagacctgtttaagagaattaatgcacaaaagggagtgctgtttcaggaagaccagatcctcgattggttcgtgcagatatgcttggcactgaagcacgtccacgaccgtaaaattctgcaccgagacattaagtcccagaacatttttcttacgaaagacggcactgtgcagttgggcgactttggaattgccagggtgctgaattcaacagtcgagctggcacggacctgtattggtacaccctattacttaagccccgagatttgcgaaaacaagccttacaacaacaagagtgatatatgggcgcttggctgcgtcctatacgagttgtgcacattgaagcatgcttttgaggctggcagtatgaagaacctggtgctcaagataatatcagggagttttccccctgttagcctgcactattcatacgatttgcgttcactggtcagtcagctgttcaagcgaaatccccgtgatcgcccatcagtgaatagcatcctggagaagggattcatcgccaaacgcattgaaaagtttctcagtccccaactcattgccgaggaattctgcctcaaaaccttttcaaagttcggttcccagccaatcccagccaaacgccctgcatccggccagaactctatttctgtgatgcccgcacaaaaaataacaaagccagccgctaaatacggcattcctctcgcctacaagaagtatggtgacaagaagctgcacgagaaaaagcccctccaaaagcataaacaagctcaccagaccccagaaaagagggtgaacaccggtgaagaacggcgtaaaatctctgaggaagctgcacggaagaggaggctggagtttatcgagaaggagaagaagcagaaggatcagatcattagtctaatgaaggccgagcagatgaaacgacaggaaaaagaacgacttgagcgcatcaatcgagcgagagagcagggctggcgcaatgtcttatcagctgggggatcaggcgaggtcaaggccccattcttggggtctggaggaactatcgctccttcaagttttagctcgagaggacagtatgagcattaccatgccatatttgatcaaatgcagcagcagcgggcagaagataatgaagctaagtggaagagagaaatatacggccgaggtttgccggagcggcaaaaagggcagctggcagtcgagcgggctaaacaagtcgaggaatttctgcagcgaaaaagggaagccatgcagaataaagcgagggccgagggacatatgggcatcctgcagaacttagcagcaatgtacggtgggagacctagcagttccagaggagggaaaccccgtaacaaggaggaggaggtttatctcgcccgtctgaggcagatcagactgcagaacttcaacgagcggcaacagattaaggccaaactccggggtgagaaaaaagaggcgaaccattccgagggccaagagggcagcgaagaagccgacatgagaagaaaaaaaattgaatcactcaaagcacacgccaatgctcgtgccgctgtattaaaggaacagctggagagaaaacgcaaggaggcctatgaacgcgagaaaaaggtatgggaggagcatctggtcgccaaaggtgttaagtcttctgatgtgtcgccacccttaggacaacatgaaactggtggctccccctctaagcagcaaatgcgatcagttatctcagtcacgagcgccctcaaggaggttggggttgactcttccttgaccgatacgagagaaacgagtgaagagatgcagaaaactaacaatgctatttccagcaaacgtgaaattctacgtaggttaaatgagaatctcaaagcacaggaagatgaaaaaggcaaacagaacctgtccgatactttcgagattaatgtgcatgaagacgccaaggagcatgaaaaggaaaagagcgtcagcagcgaccgcaaaaaatgggaagccggaggtcagctagtgatcccgttggacgagctgaccttggacacctctttttctaccaccgagaggcacacagtcggtgaggtgattaagctgggacctaacggcagccctagacgcgcatgggggaaaagccctactgattctgtgctcaaaatccttggcgaagctgagctgcagcttcagactgagctgctagaaaacacaacaattaggtccgagatatcgcctgaaggcgaaaaatacaagcccttaatcactggcgagaagaaggtgcaatgtatttcacacgaaattaaccccagtgccattgttgacagtcccgtagaaactaagtccccagagttttcagaggccagtccccagatgtcacttaaactggaaggcaacctagaggagcccgatgatctcgaaaccgaaattctgcaggagcctagtggaaccaacaaggatgagtcactgccttgtacaatcactgatgtatggatatcagaggaaaaagagactaaagaaacccagtcagctgatcgtatcacgatccaggaaaatgaggtgtctgaagacggagtgtcatctaccgtcgatcagctgtcagatattcacatagaaccaggtactaacgactcacagcatagcaaatgcgacgttgacaaaagtgtccagcccgaacctttttttcataaagtggtgcactcagagcaccttaacctggtgcctcaggtgcaaagcgttcagtgctcgcccgaggaaagtttcgcatttagaagccatagccacctccctcccaaaaataagaataaaaatagccttttaatagggttatctaccgggctgttcgatgcaaataatcccaaaatgctccggacttgctcccttcctgatctgagcaaattattcagaaccctgatggatgtgccgacagtgggagacgtgcggcaggacaacctcgagatcgacgagattgaggatgagaacattaaagaagggccttcggacagtgaggatatagtgttcgaggaaactgacaccgatctgcaggagctgcaagcttcaatggagcagttgctgcgtgagcagcctggtgaggagtactcagaggaggaggaaagtgttctgaaaaactccgatgttgaacccactgccaacgggactgacgtggctgatgaggatgataaccccagctctgagtccgctctcaatgaggaatggcattccgataacagcgatggtgaaatagccagcgaatgcgagtgtgatagcgtgttcaaccatctggaggagctgagacttcacttggagcaggagatgggttttgagaagtttttcgaggtgtatgagaaaattaaagctattcacgaggatgaggacgagaacatagaaatttgttccaagatcgttcagaacatcctggggaacgagcatcagcacctgtacgcgaagatcctccatctcgtgatggccgatggcgcataccaggaagacaacgatgaatag

SEQ ID NO: 232765 - DNA, 1800 bp, Artificial Sequence
  Description of Artificial Sequence: Synthetic coding sequence
atgttgaagttccaggaggctgcaaagtgtgtgtcaggatctaccgccatcagtacatatcccaaaacactgatcgcaaggcgatatgtcctgcagcagaagttaggatctggctcattcggaaccgtttatcttgtttccgacaaaaaagcaaaaaggggagaggagctaaaagtgcttaaagaaatcagtgtgggagagctgaatcccaatgagaccgtgcaggctaatctcgaagcacaactgttgagtaagcttgaccacccggcaatcgttaagtttcacgcgtcatttgtcgaacaagataacttttgcattataaccgagtactgtgagggcagagacctggatgataagatccaggagtataaacaggcgggaaagatcttcccagagaaccagatcatcgaatggttcatccagctgctcctaggagtggactacatgcatgagagacgaattttgcaccgtgacttgaaaagtaaaaacgtgtttctgaagaataaccttttaaagatcggagacttcggcgtctcccggcttttgatgggttcctgcgatctggcaacaaccctgacagggactccccattacatgtcccctgaagcattgaagcaccagggctacgatactaagagtgacatatggtcactggcatgcattctgtatgagatgtgctgtatgaatcacgcatttgccggttccaatttcctgtccattgtgctgaagatcgtggagggagacaccccctctctgcctgaacgctatcccaaggagctgaacgctatcatggagtccatgctcaataagaatccctcgctacgccctagcgcaattgagatactgaaaatcccatacctggacgaacagctccagaacttaatgtgcagatactctgaaatgacactagaggacaagaaccttgactgccagaaggaagctgctcatataatcaatgcaatgcagaagaggattcatcttcagaccctgcgtgccctaagcgaggtgcaaaagatgacccctagggagcggatgagattgcggaaattacaggccgctgatgagaaggctcgcaaactgaaaaaaatagtagaggagaagtacgaagaaaattctaagcgcatgcaggaactgagaagtcggaatttccagcagctctctgttgatgtgttgcacgaaaaaacacacctaaaaggaatggaggagaaagaggaacagccggaaggcagactcagttgcagcccacaagatgaggatgaggagcggtggcagggtagggaagaggaatcagacgaacctaccctggaaaatttacctgagagtcagccaatccctagcatggacctccacgaattggaaagcatcgtcgaggatgccaccagtgatctggggtaccatgagatccccgaggatcccctcgtcgctgaagaatactacgccgacgctttcgattcctactgtgaggagagtgacgaggaggaggaggagattgcgctcgaaaggcccgagaaggaaatccgcaacgagggctctcaaccagcctacagaaccaaccaacaggacagtgatattgaagccttagcaaggtgtctcgaaaacgtgcttggctgcacgagtctagaccaaccttgtcgaagttgggggcagaaatacttgaaaaggagcatcattacaagccgggaacagggaatcaggatgcttgccaaacagcgcagcgctagtgtgtggaagaagtggtgcttaaaaccagcaaccgtcctaaaatggacctcatcttgtaccctgaaatcttcttgctag

SEQ ID NO: 232766 - DNA, 459 bp, Artificial Sequence
  Description of Artificial Sequence: Synthetic coding sequence
atggacagcggaacggaagaatatgaacttaatggcggactcccgccagggacccccggatcccctgacgcaagcccggctcgatggggctggagacacggccctattaacgttaatcactacgcatccaaaaagagcgcggcagagtcaatgctggatatcgctctgctgatggccaatgcatcacagctgaaggctgttgtggaacagggtcctagtttcgccttctacgtgccacttgtcgtgttaatcagcatctccttggtactgcagatcggggtgggagtacttctgatcttcctggtaaaatatgatctaaacaaccccgcaaagcacgcaaagctcgactttctgaataacttagctacaggcctcgtgttcattatcgtggtggtgaacattttcatcactgccttcggagtgcagaagccccttatggacatggccccacagcagtag

SEQ ID NO: 232767 - DNA, 567 bp, Artificial Sequence
  Description of Artificial Sequence: Synthetic coding sequence
atggctggtctatctagacaattgtgcgccctgtctcacccgaagaaagcggcagaaactcagacagccgaacccggaggggctcatgccgtgtgctctcggcaccccgtaagagtgaagggactggagggctccgagatggagagtgccagggaaaatatagatttacagcccggatcttctgatccacggagccaaccaattaatctaaatcactacgcaacaaagaagtctgtggcagaatccatgctcgacgtggcgctgttcatgagtaacgcgatgcggttgaaagcggtgctggaacaagggccaagctcccactactatacaacattagtgaccctcatttccctaagcctactgctccaggttgttatcggtgtgctgctagtggtcatagccagattgaatcttaacgaggtagaaaagcagtggcgccttaatcaactcaataacgctgccacgatcttagtgttcttcaccgtggtgatcaacgtgtttatcacggcgttcggagcacacaagaccggctttctcgccgctcgtgcatcgaggaaccccctctag

SEQ ID NO: 232768 - DNA, 273 bp, Artificial Sequence
  Description of Artificial Sequence: Synthetic coding sequence
atgcttgacgtcgcgttgttcatgtctaacgctatgcgtttaaaagctgtgcttgagcagggaccaagtagccattactataccactctcgtgacactcattagtttatctttgctgctccaggtcgtcatcggggttctcctcgtggtgattggagaggaaccaagtcttcagagtgacttgctccctcgccatccctggctggcagaacgccctcacgtgagcccgggacctccatgcatcggaaccggatcctttgcaaccacccggtag

SEQ ID NO: 232769 - DNA, 1401 bp, Artificial Sequence
  Description of Artificial Sequence: Synthetic coding sequence
atgccaggcgacagctctcccggtacacttccgctatgggacgcttccctgagtcccccactgggcccagatcccggaggattttcacgggcaagtcatgccggtgataaaagtcgaccccctgccccagagttgggctctcccggtgccgtccggccaagagttggttcgtgcgcacccggtccaatggagttaagagtttccaacacatcatgtgaaaatggttcactgctgcacctatattgctctagtcaggaggtgctgtgccagattgtgaatgatctcagtcccgaagtgccttccaacgccacttttcattcctggcaggaaaggatacgacagaattacggtttttacattggactaggactggcatttttgtcttcttttcttatcgggagctccgtaatcctgaaaaagaaggggctactgcgcttagttgccactggcgcaacgcgggctgtggacggtggcttcgggtatctgaaagacgcgatgtggtgggcgggattcctaacaatggccgctggtgaggttgccaattttggtgcgtacgccttcgctcccgctactgttgtcacgcccctgggagcattgagcgtcctaatcagtgccattctgtccagttatttcttgcgagaatccctgaatcttctggggaaactgggatgtgtcatttgcgtggcgggatcaactgtgatggtaatacatgccccagaggaggagaaagtcaccactattatggagatggccagcaagatgaaggacacgggcttcattgtgttcgcagttctgttgctcgtcagctgtctgatccttatcttcgtgatcgcccctaggtacgggcagcgcaacatccttatttacatcattatctgttccgtgatcggcgcattctccgtggccgctgttaagggcctcgggattaccataaagaatttttttcagggccttcctgtagtgcgacaccccttgccgtatattctgtctcttattttggcgctgtctttgagtactcaggtgaattttttaaatcgggctctcgacattttcaatacatccctagtgtttcccatttactatgtttttttcaccacagtggttgtgacaagctctatcattctgttcaaagaatggtattccatgagcgccgtggacatcgcaggcacactctccggcttcgtcacaattattctgggggtctttatgctgcatgcctttaaagatctggacatctcatgcgcctcactgccccacatgcataagaaccctcccccaagccctgctcccgaaccgactgtgatccgtctggaggacaagaatgtcttagtggataacatcgagctcgcctccacctcaagtcctgaagagaagcctaaggtttttattattcactcctag

SEQ ID NO: 232770 - DNA, 1344 bp, Artificial Sequence
  Description of Artificial Sequence: Synthetic coding sequence
atgcccggagacagttctcctggaactctcccactctgggacgcaagtttatctcccccacttggtcccgatccaggcggattctcacgcgctagccacgcaggcgacaagtcccggcctccagccccagagctggggtccccgggtgcagtcaggcccagggtcggcagctgtgcaccgggtccgatggagctccgggtgagcaacacctcatgtgaaaatggctccctgctgcatctttactgttcctcccaggaggtgctttgccagattgttaatgatttatcaccagaagtaccaagcaacgccaccttccatagttggcaagagcgtatccgccagaactacggcttctatatcgggctgggcctggcatttttaagctccttcctgataggcagttccgtgattcttaagaagaaaggcctgcttagacttgtggccaccggcgcaacccgggcagtggcagcaggggaagtcgcgaactttggcgcttacgccttcgcccctgccaccgtggtgaccccgcttggcgcattgtcagtcttgatttcagcaattcttagctcctattttttgcgagagtcactgaatctattggggaagttgggctgtgttatttgcgtagcagggagcaccgtgatggtaatccatgctcctgaggaggagaaggtgacaacaatcatggaaatggccagcaaaatgaaggacactggatttattgttttcgccgtcctgctactcgtaagctgccttatcctcatatttgtgatcgcaccccgatatgggcagcggaatatcttaatttacattatcatctgctcagtcataggcgctttcagtgttgccgctgtgaaagggcttggcattacaataaagaatttctttcagggcctccctgtggtcaggcaccccctgccctacatcctgagtttaatcctggctctatctctgtccactcaagtcaatttccttaatcgggcattggacatttttaatacttcccttgtcttcccaatttactacgtctttttcaccactgtggtggtgaccagctcaattatcctgtttaaagagtggtattccatgtctgctgttgatattgccggaactctaagcggtttcgttacgatcattctcggtgtgttcatgctgcacgcattcaaagatctcgatatctcctgtgcatcactccctcatatgcataagaacccaccaccttcccccgctccagagcccacggtgatccgccttgaggacaagaatgtgctcgttgacaatattgaactcgcctccacttctagccctgaagaaaaacccaaggtgtttataattcactcctag

SEQ ID NO: 232771 - DNA, 8415 bp, Artificial Sequence
  Description of Artificial Sequence: Synthetic coding sequence
atgaatggggacatgcctcacgtcccaattacgacacttgccggtatcgccagtctgaccgatctgctgaaccagcttcccttgccctccccccttccagccacgaccacaaaaagcctccttttcaatgctaggatcgccgaggaggtgaactgtctgttggcttgtcgcgatgacaacctagtgagtcaactcgttcacagtctgaaccaggttagtaccgaccacatcgaactgaaggataatttaggttctgatgatccggaaggtgacatccccgtgctgctccaggcggtgctcgccaggtcacctaacgtctttcgggaaaaatccatgcagaaccgatatgtccagtcaggtatgatgatgagtcagtacaaattgagccagaattcaatgcattcctcgccagctagttccaactaccaacagacgacaatcagccattctccttcatctcgcttcgtccctccacagacttcctccggtaaccgtttcatgccacagcagaactctcccgtacctagcccatatgcccctcaaagcccagctggatatatgccgtattcgcaccctagctcctacaccactcatccacaaatgcagcaggcctcggtgtcatcccccattgtggcgggaggcttacggaatatccacgacaataaggtgtccggacccctctcaggtaactcggcaaaccaccacgcagataaccctcgtcacggaagttcggaggattatctccacatggtgcacagactgtccagcgatgatggggactcctccactatgcgcaatgctgcctcatttccacttcgaagccctcagccggtctgttctccagcaggaagcgagggcacacccaaaggcagtcgacctccactgattttgcagtcacagtccttgccctgttcctcacccagagacgttccccctgacatcctgttggattctcccgaacggaaacaaaagaaacaaaagaagatgaaattaggaaaggacgaaaaggagcagagtgagaaagcggcaatgtacgatattatttcaagtcctagtaaggatagtacgaaactcaccctcaggctgagcagggtgaggtcctcggacatggatcagcaggaggatatgatttccggggtggaaaatagtaacgtgagtgaaaacgacattccgttcaacgttcagtatcccggacagacatccaaaaccccgattacccctcaggatatcaatcggcctctgaacgccgcacaatgtctgtcgcagcaggagcagaccgccttcctccccgcaaaccaggttccggttttgcagcagaatacttccgtggcggcaaaacagccacagaccagcgtggtccagaatcagcagcagatctcacagcagggtccaatatatgatgaagtggagctcgatgcccttgcggagatagaacgaatcgaacgagagtcggctatcgagcgtgaaagatttagtaaagaagtacaggataaagataaacccctgaaaaagagaaagcaggattcctaccctcaagaggctggcggagctacaggcggaaataggccagcctcccaagaaaccgggtctacgggtaacggttcacggcctgccctgatggtgagcatagacctgcatcaggctggtcgcgtggattcacaagccagcattacacaagattcagactctatcaaaaaacctgaggaaatcaagcaatgtaatgacgccccagtcagcgtcctgcaagaagatattgtcgggagtcttaaatccacccctgaaaatcaccccgagaccccgaagaaaaagtcggatcccgagctgtcaaaatcagagatgaagcagtctgagagtcgccttgctgaatccaaacctaatgaaaaccggctcgttgagactaagtcctccgagaataagctcgagaccaaggtcgagacacaaacggaagagctgaagcagaatgaatccagaacgaccgagtgcaagcaaaacgaatccaccattgttgaacccaaacagaatgagaataggttatctgacacaaagccaaacgataacaagcagaacaatggccgatccgagactacaaagtcccgtccagaaactccaaaacaaaagggggaaagccgcccagaaactccaaagcagaaatctgacggtcaccctgaaacaccaaagcaaaaaggagacggaagacctgagacgcctaaacaaaagggagaaagccgcccagaaacaccaaaacagaagaacgagggccgtcctgaaacgcctaaacaccggcacgataacagacgcgactcaggaaaaccctcaactgagaagaaaccagaggtgtccaagcataagcaggacaccaaaagcgattcccctaggttaaagtccgagagggcggaggcgttaaagcaacgccctgacgggagatctgtgtctgagtccttgcgccgtgatcacgataataaacagaaaagcgacgaccgcggagaaagtgagcggcacagaggcgaccagtcccgagtgaggcgccctgaaaccctcagaagcagttcccgcaatgagcacggcatcaaaagcgattcatcaaagacagacaaactggaacggaagcaccggcacgagagcggagactcgagagaacggccttcatctggcgagcagaagagtagacctgattcgcccagggttaagcagggagatagcaacaagtctaggagcgacaagctggggttcaaatcgcccacttctaaggatgataagcgtacagagggcaataagagcaaggtggacactaacaaagcacatcctgacaacaaagcagagtttccttcataccttcttggcggtcgcagcggagccctaaagaactttgtgatccccaaaattaaaagggataaggacggcaatgtgacacaagaaactaaaaaaatggagatgaagggtgagccgaaggacaaagtggagaagattggacttgtggaagatctcaacaagggcgctaaaccggtggtggtgttgcaaaagctgtcactggacgatgtgcagaagcttattaaagatcgtgaggacaaaagtcggtcttcccttaagccaatcaagaataaaccatccaagtcgaacaagggcagtatcgatcagtcggttctaaaggaactgccgccagagctgctggctgaaatcgagtcaacgatgccactatgcgagcgagtgaaaatgaacaagcgcaagcggtcaacagttaacgagaaacctaaatatgctgaaatttcatctgatgaggacaatgattccgatgaggcctttgagtcaagcaggaagcgccataaaaaggatgacgataaggcctgggagtacgaggaacgagaccgaagatccagtggcgaccacagacgatccgggcattcacacgaaggcaggaggagcagtggcggtggacgatacagaaaccggagtccatctgatagcgacatggaggactacagtcctcctcccagcttatcagaggttgcaaggaaaatgaaaaaaaaggaaaaacagaaaaaaaggaaagcttatgaaccgaagctcacacccgaagaaatgatggattcaagtactttcaagagatttactgcctctattgagaacattttggacaatttggaggacatggattttacagctttcggcgatgatgatgagattccccaggagttacttctgggaaaacatcagctcaatgaactgggctcagagtccgctaagattaaagcgatgggaatcatggataaactgagcacagacaagactgtgaaggtactgaacatactggaaaaaaacattcaggatggaagtaaactgtccaccctcttgaatcacaataatgacaccgaggaagaggaacggctctggagagatctcattatggaaagggtgactaagtctgccgatgcttgtctgacaaccatcaacatcatgacctcccctaacatgcctaaggctgtgtatattgaggatgtaatcgaaagagtgattcagtacactaagttccacctacagaatacattatacccccagtatgaccccgtttacaggctagatccccacggagggggtctcctgagttctaaagccaagcgagcaaaatgcagtacccataaacagagagtgatagtcatgttgtataacaaagtatgcgatatcgtctcaagtctcagcgaactgctcgagattcaattactcaccgacacgaccatcctgcaggtgtcttctatgggcattactcccttttttgttgaaaacgtgagcgagctgcaactgtgcgccattaagctggtcacagccgtcttctcccggtatgaaaaacatcgccagctgattctcgaggagattttcacctcactcgctagactacccaccagcaaaagatcactgaggaattttagattgaacagttctgacatggacggcgagccaatgtatatacagatggttaccgccctcgtgctgcagctgattcaatgcgtcgtccacctcccatcttctgaaaaggattccaatgcagaagaggattccaataaaaaaatagaccaggatgttgtgatcaccaacagttacgagacagcgatgaggactgcgcagaactttctaagtatcttcctgaaaaaatgcggcagcaaacaaggggaagaagactacagaccgctgttcgaaaactttgtccaagatctcctctcaactgtgaacaagccagagtggcctgcagctgaattgctgctttcccttctgggacggctgcttgtacaccagtttagcaacaaaagtactgaaatggccctgcgtgtggcctccttggattacctcgggactgtggctgcccgtctgagaaaggacgcagtgacttccaaaatggaccaggggtccatagaacgaatcctgaagcaagtttcaggaggggaggatgagatccaacagctgcagaaagcattactggattatctagatgaaaacaccgagaccgatcctagcctcgtgttctcccggaagttttatatagcacagtggttcagggacacaaccctcgagacagagaaagctatgaaatcccagaaggacgaggagtcttcagagggaacccaccacgcaaaggaaatcgaaactacaggacagattatgcatagagcggagaacaggaagaagtttctcaggtccattataaagaccaccccaagccagtttagcacactcaaaatgaactccgacaccgtggattatgacgacgcttgcctcattgttagatacctggcctctatgcgcccttttgcccagtcctttgatatctatcttacccagattctgagggttctcggcgagaatgctattgctgtccggaccaaggccatgaaatgcttgtctgaagtggtggccgttgacccttcaatcctggctcgcctggacatgcagcggggagtgcatggacgactcatggacaacagcacttccgtgagggaagcagccgtggaattgctgggacgattcgtgttgtgtcgacctcagttagcagaacagtactacgatatgttaatagagcgcatactcgataccgggatttccgtgcggaagagagtgattaagattcttagagatatttgcattgaacagcccacattcccaaaaattactgaaatgtgtgtcaagatgatccggagggtcaatgatgaagagggaataaagaaacttgtgaacgagaccttccagaagctctggttcactcccaccccacataatgataaagaagccatgactcgcaaaatcttgaatatcaccgatgttgtggccgcttgcagggacaccgggtacgactggttcgagcagctcctccagaatctgctcaagtcagaagaggacagctcctataaacccgtaaagaaggcctgtacccagctggtagacaatctcgtggagcacatcttgaagtatgaagaaagcctcgctgactcggacaataaaggggtgaattcgggaagattggtggcctgtataaccactctctttttgttcagtaaaattagacctcagctgatggtcaaacacgccatgacaatgcagccttacctgacaactaaatgcagtactcagaatgacttcatggtaatctgtaacgtggcaaagatcttagagctcgttgtgcctctgatggaacatccaagcgagacattcctagcgaccattgaggaggaccttatgaaacttattataaaatacggcatgacagtggttcaacactgtgtgagctgtctcggagccgtcgtaaacaaagtgacacagaatttcaaattcgtctgggcatgcttcaatcgctactacggcgcaatttccaagctgaaatctcagcatcaggaggatccgaataatactagtctactgacaaacaagcctgccttactcaggtcactcttcactgtcggtgccttatgccggcatttcgactttgatctcgaggatttcaagggaaacagcaaggtgaacatcaaggataaagtgctggagttactcatgtactttactaaacactccgacgaggaagtgcaaactaaggccatcatagggctgggattcgcattcatacagcatccatccttaatgttcgagcaagaggtcaaaaacctgtacaacaacattctgagcgataagaattcatccgtaaatctgaagatccaggtgctgaaaaaccttcagacttatttacaggaggaagacaccagaatgcagcaggcagatcgggattggaagaaagtggcaaagcaggaggacctaaaggagatgggggacgtgtcttctggcatgtctagcagcatcatgcagctgtacttaaaacaagtactcgaggccttctttcatacgcagagtagtgttcgtcattttgccctcaatgtcatcgccctgacgctgaaccagggcctgatccacccagtgcagtgtgtgccttacctgattgccatggggactgatcccgagcccgcaatgagaaataaggcagaccaacaattggtagagattgataagaagtacgccggtttcatccatatgaaagctgttgccggaatgaaaatgagttatcaggtacaacaggcgatcaacacttgtctgaaggaccctgtccgcggattccggcaggacgaatcttcgtcagcactgtgttcccatttgtacagtatgatcagaggtaacaggcagcataggagagccttcctcataagcctcctgaacctctttgatgatactgctaaaaccgatgtgaccatgctgctgtatattgcagataacctcgcgtgttttccctatcagacgcaggaggagcctctgttcataatgcaccacatagatatcacattgtctgtctccggttccaatcttctgcaaagctttaaagaatctatggttaaggataaacgcaaagagcgcaagtcctcacccagcaaggaaaacgaaagttcagactctgaggaagaggttagtagaccacgcaaaagccggaagagggtagatagtgattcggattccgatagcgaggatgacatcaatagcgtaatgaaatgccttcccgaaaattctgcgcctctgatcgagtttgcgaacgtgtctcagggcatcttgcttcttctgatgctcaagcagcacttgaaaaatctttgcgggttttcggattctaagattcaaaaatactcaccatccgaaagtgctaaagtgtatgacaaggccattaaccggaagacaggagttcacttccaccctaagcaaactcttgactttcttcgctcagatatggccaattctaagatcaccgaggaagtgaaaaggtccattgttaagcagtacttggattttaaattacttatggagcatttggaccctgatgaggaggaagaagaaggagaggtatcagctagtactaatgctagaaacaaggccatcactagcctcctcggcggtggctcacccaagaacaatacagcagccgagacagaggacgacgagtcagacggagaggatagaggtggtggcacatccggatcactgcgcaggtccaagaggaacagcgatagtaccgaactagcagcccaaatgaacgagtctgtagacgtcatggatgtaatcgccatctgctgcccaaaatataaggaccggcctcagattgccagagtggtacaaaagacatcctctgggttttctgtccagtggatggcaggatcttatagtgggagctggacagaagccaagcgcagggatggtcggaagctggtgccttgggttgatacaatcaaggagagcgacataatctacaaaaaaatcgcgctcactagcgctaataaactgactaacaaggtggtgcagactctgcgatccttgtacgccgcaaaagacgggactagctcgtar

SEQ ID NO: 232772 - DNA, 8093 bp, Artificial Sequence
  Description of Artificial Sequence: Synthetic coding sequence
atgaacggcgatatgccccacgtgccaatcaccaccctggccggtatagcctcactgacagacctcctgaatcaactgccactccctagtcctcttccggctacgaccaccaaatccttgttatttaacgcgagaatagcggaggaggttaactgtctcctcgcctgtagagacgacaacctggtgagccagttggtgcattccctgaatcaggtgtcaacagaccatatcgagctgaaggacaatttgggtagcgacgaccccgagggcgatattccagttctgctgcaggccgtgttggcccgatctccaaatgtgttccgggaaaagtcaatgcagaatcggtacgttcagagtggcatgatgatgtcccagtataaactgagtcagaattcaatgcatagcagccccgcttcttctaattaccagcaaaccactatttctcactcaccatccagtcgtttcgttcctcctcagaccagcagcggcaacaggttcatgcctcaacaaaattctcctgtcccaagtccctacgcacctcagagtccagccggatacatgccttactcacatccctcctcttataccactcacccacagatgcaacaggcctccgtctcaagccccatcgttgccggtggactgcgcaacattcacgataacaaagtgagtgggcctttatcaggtaattcggctaaccatcacgctgacaatccaagacacggctctagcgaagattatctgcatatggtgcatcgcttgagctctgacgacggcgactcaagcaccatgcgtaacgccgcatcctttcctctgcgttcgccccagcccgtctgttctcccgctggctcggaaggtacacctaagggatctagaccccctctgattctgcagagccagtccttgccgtgttccagtcccagagacgtccccccagacatcctcttggattctccagagcggaagcaaaagaagcaaaagaagatgaaactcgggaaggatgagaaggagcagagtgagaaagctgccatgtacgatatcattagctcgccatctaaggacagcaccaagctcacccttcggctctccagggtgaggagttcagacatggaccaacaggaggacatgatttctggcgtggaaaactctaacgtgtccgagaatgatatcccgttcaacgtacagtacccaggacaaacgagcaagacccctattacaccccaagatattaatcgcccactcaacgctgcccaatgcctaagccagcaggagcagaccgcgtttctgccagctaatcaggtaccagtattgcaacagaacacatcggtagcagcgaagcagccacaaacatcagtcgtgcaaaatcaacagcagatttctcagcaaggccctatctacgatgaggttgagctggatgcactggccgagatcgagagaatcgaaagggagtccgctatcgagcgcgagaggttttctaaagaggtgcaagataaagacaagcccctgaagaaaagaaaacaggactcatatccccaggaagctggcggagcaacaggaggaaaccgcccagcctcccaagagacggggagtaccggcaatggtagtaggcccgctctgatggtgtccattgacttgcaccaggccggacgggtcgattcacaggccagtatcacacaagactcagacagcataaaaaagcccgaggaaattaagcagtgtaatgatgctcccgtgagcgtgctgcaggaggacatagttgggtctctgaaatctacccccgagaatcatcccgagacacctaagaaaaagtcagatcctgaattatctaagtctgagatgaaacagagcgaaagccgactggccgagtctaagcctaacgagaacaggttagttgaaacaaaatcatccgagaataagctggagactaaagtcgagacacagacagaggaattaaagcagaatgagtcccgcaccaccgaatgtaagcagaatgaatcgacgattgtcgaacccaagcagaatgagaataggctgtccgatacaaagcctaacgataacaaacagaacaatggcagatcggagactactaaatcccgccctgagactccaaaacagaagggcgagtctagaccggagacgcccaagcaaaagagcgacggccatcctgagaccccaaagcagaaaggagatgggaggcctgagactcctaagcaaaagggtgaatcgcgtcccgagacgcccaagcagaagaacgaggggaggcccgagaccccaaaacaccgtcatgataatcgtcgcgactccggcaagccaagcaccgaaaagaaaccagaggtatctaagcacaagcaggacacaaaatctgacagtcctagacttaaaagcgaaagagccgaggcccttaagcagcgaccagacggacggagtgtaagcgagagcctgagacgggaccacgacaataagcagaaaagcgacgaccggggtgaaagcgaacggcacagaggagatcagagtagggttcgacggccagaaacattgcgaagcagctccaggaacgagcacggcataaagtctgacagctctaagactgacaaactggagagaaaacacaggcatgaaagcggcgactcaagggaaagaccctcttccggagagcagaaaagtcgcccagactcccccagggtcaagcagggcgactcaaataagagccgatctgacaagctcggtttcaagtcccctaccagcaaagacgataagcgcaccgaggggaacaagtctaaggtagatacgaacaaagcacacccagataacaaggccgagttccctagctatttgctggggggtagaagcggcgctctaaagaacttcgtcatccccaagattaaaagggacaaggatggaaatgtcacacaggagaccaagaagatggagatgaaaggagaaccgaaagataaggtcgaaaagattgggctcgttgaggaccttaacaagggagccaaacctgtggttgtcctacaaaaactgagcctggatgacgttcagaaactgattaaagaccgggaagacaagtcgcggtcaagtcttaagcccatcaaaaacaaaccatccaagagtaataaagggagtatagaccagtcagtcctgaaagaactcccacctgagctcctggcagagatcgaaagcacaatgccactgtgtgaaagggtgaagatgaacaaacggaagcgcagcaccgtgaacgagaaaccaaaatatgcggagatatccagcgacgaggataacgattcagacgaagctttcgagagctccagaaagcgacataaaaaagatgatgacaaagcttgggaatacgaagagcgggacaggagatcctccggcgatcatcgcaggagtggtcactcacatgaagggagacgcagcagcggaggtggaagatatagaaaccgaagtccatccgatagcgacatggaggactattctcctccgccttctctctctgaggttgcaagaaagatgaagaaaaaagaaaagcaaaagaagcgaaaagcatacgagcccaaacttacccctgaagagatgatggactcctctactttcaaacggtttacggcctcaattgaaaacatcctggacaacctggaggacatggactttacagcttttggcgacgatgatgaaattccacaggagctcttgctgggaaagcatcaacttaatgagctgggttctgagtccgcaaagataaaagccatggggatcatggacaaattgtcaaccgataagactgtaaaggtcctgaacattctggagaagaacatccaggatggtagcaaactgtctacattgctgaatcacaataacgacaccgaggaggaggaacgactctggcgggatctaatcatggagagggtcaccaaaagcgccgacgcctgcctgacaacaattaacatcatgactagtcctaatatgccgaaggcagtttacatcgaggacgtcatcgagagagttatccagtacaccaagtttcatctacagaacaccctgtacccgcaatatgatccagtgtaccggttggaccctcacggaggaggcctgctgtcttctaaagctaaacgcgcaaaatgctcaacacataagcagagagtaattgtaatgctttataataaagtctgcgacatagtgagcagtctaagcgaactgttggaaatacagctgctgacggatacaaccatcctgcaggtgagttcaatgggcatcacacccttctttgtcgaaaacgtaagcgaattacagttatgtgctattaagcttgtcacagcggtgttctccagatacgagaagcacagacaactgatcttggaagagatctttacctccctcgctcggcttcccactagtaagcgctcgcttaggaatttcagactgaactcatccgacatggatggggagcccatgtacattcagatggtcaccgcattggtcttgcagttgattcagtgtgtggtccacttgccgtcaagtgaaaaagactccaatgctgaggaagactcaaataagaaaatcgatcaagacgttgtgattactaactcatacgagacagcaatgcggacagcccagaattttctgtctattttcctaaaaaaatgtggctccaaacaaggcgaggaggactatagacccctctttgagaactttgttcaagacctgctgagcactgtgaataagcccgaatggccggctgcagaactgctgctgtccttactgggcaggctgctggtgcaccagttttctaataagtcgactgagatggccttgcgcgttgcgtcactggactacctgggaactgttgccgctcgcctgaggaaggacgcagtgacctcaaaaatggaccaagggtccatagagcgcatcttgaagcaggtgagtgggggagaagacgagatacagcagctccagaaagcactgctggattaccttgacgagaatacggaaacagatccgagcctggttttcagtaggaaattctacatagcccagtggtttagggatacaacactggagaccgagaaggccatgaaatcccagaaggatgaggagtcatcagaaggcacacaccacgcaaaagaaatcgaaacaaccggtcagatcatgcatcgcgcagagaaccgtaagaaattcctgaggtctatcatcaaaaccaccccttcccaattctccaccctgaaaatgaactctgacacagtcgactacgatgatgcttgcctcattgtaagatacctggctagtatgagaccatttgctcagtccttcgatatctacctgacccagattctgagagtgctgggcgaaaatgcaattgccgtacggaccaaagccatgaaatgtctgtccgaggttgtggccgtggatccctctattttggcccgactggatatgcaacggggtgttcatggaaggcttatggataactcgacttctgttagagaggccgctgtcgagttacttggcaggtttgtactctgccgcccacagctggccgagcagtattacgatatgctgatagagcggatcctagatactggaatcagcgtgcgaaaacgtgtgattaagattctccgcgatatttgtatcgagcagcccacatttccaaaaatcacagaaatgtgtgtgaaaatgatccgacgggtaaatgacgaggagggcattaagaagttggtgaacgagacttttcagaaactctggttcacaccgactccccacaacgacaaggaagctatgacccgcaaaatactgaacatcacggatgttgtggccgcatgccgggataccggctatgactggtttgagcagcttttgcagaaccttctcaaaagcgaggaggactcttcttacaagcccgtaaaaaaagcttgcactcagctggtcgacaatctggttgagcacattctcaagtacgaagagagcctagccgactcggataataaaggggtgaattctggaagactggtcgcctgtatcacaacgctctttctgtttagtaagatccgaccccaattgatggtgaagcatgcgatgaccatgcagccctatctcacgactaagtgttccacccaaaatgactttatggtgatttgcaacgtggctaaaatcctagagctagtggtgccactgatggagcacccctcagaaaccttcctcgctaccatagaggaggacctgatgaagttgattattaaatatgggatgaccgttgtgcagcactgcgtgagctgtctgggggcagtggtcaacaaggtgacccaaaatttcaaattcgtctgggcttgcttcaatcgctattacggtgctatcagcaaactgaagagccagcatcaggaggaccctaacaacacctcgctgctcacaaataaacctgcactgctcaggtcactcttcactgtcggggcactgtgccggcatttcgacttcgatttagaggactttaaaggtaatagtaaagtcaacattaaggataaagtgctggaattgctgatgtacttcacaaaacatagtgacgaagaagtgcagactaaggccattatcgggttggggtttgctttcatccaacaccctagtctgatgttcgagcaagaggtcaaaaacttatataacaatatactgagtgacaaaaatagcagcgtgaatctcaagatccaggtgctgaaaaacttgcaaacatacctacaggaggaggatacacgcatgcagcaagccgatagggattggaaaaaggtggccaagcaggaggacctcaaggaaatgggggacgtgtcttccgggatgtcctccagcatcatgcagctgtacttgaagcaggtgctggaggcgttttttcatacccaatcttccgtaaggcatttcgctctgaacgtgatagctttgaccttgaaccaggggctcatacaccctgtccagtgtgtgccgtacctcattgcaatgggtaccgaccctgaacctgcaatgcgcaataaggccgaccaacagctggtggagatcgacaagaagtatgcgggtttcatccacatgaaggctgtggctggaatgaaaatgagttaccaagtgcagcaagccattaacacctgtttgaaggatcctgttcgcggatttcggcaggacgaaagttcttccgccctctgctcgcatctgtatagcatgattagaggcaacagacaacatcgcagagcattcctgatcagcttgcttaatcttttcgacgacacagcaaaaaccgatgtgactatgctgctttatattgcagataatcttgcttgcttcccctaccagactcaggaggaacctttgtttatcatgcatcacatcgatataactctgagcgtgtccggctccaatttactgcaatcctttaaggagagtatggtcaaagataagaggaaggaaagaaaaagtagcccaagtaaagagaacgagtcatcggactccgaagaggaagtctcccggccacggaagtccaggaagcgcgttgacagcgactctgattctgattctgaagacgatatcaactcagtgatgaagtgtctgcccgaaaattccgcacccctcatcgagtttgccaatgtgagtcagggcattctgcttttgctgatgctcaagcagcacctgaaaaacttgtgcggcttttccgattctaaaatccagaagtatagcccttccgaatcagccaaggtctacgataaagccatcaatagaaagacaggtgtgcactttcaccccaagcagacattggactttttaagaagtgacatggccaattcaaaaatcaccgaagaagtgaagcgatctatcgtcaagcagtatctcgactttaagctgctaatggagcatctggacccagacgaggaagaagaggaaggggaagtttctgcaagcacaaatgctcggaataaggcgattaccagcttactcgggggtggctcacccaagaataacacggccgctgagactgaggacgatgaatctgacggcgaggatcgcggtggaggcactagtggcgtaagacgtcggagaagccagagaatatctcagcgaatcacata

SEQ ID NO: 232773 - DNA, 867 bp, Artificial Sequence
  Description of Artificial Sequence: Synthetic coding sequence
atggagcgccctcagccggatagtatgcctcaggatttgtctgaagccctgaaggaggctaccaaagaggtacacacacaagctgagaatgctgagtttatgcggaattttcaaaagggacaggtgacacgggacggcttcaaacttgtaatggcatctctttaccatatctacgtggctctcgaagaggaaatcgaaagaaacaaagagtcccccgtattcgcccctgtgtactttcccgaagagctgcataggaaggcagccttggaacaggatctcgctttctggtacggcccacgctggcaagaggttatcccttacaccccagccatgcagcgatacgtgaagaggctgcacgaggttggcaggaccgaacctgaactgctcgtcgcacacgcctatactagatacctgggcgacctaagtggtggtcaggtgctgaagaagatcgcacaaaaggccctcgacctcccctcgtcaggtgaaggcctcgctttcttcacattccctaatatcgccagcgccaccaaattcaagcagctctacaggagtagaatgaacagccttgaaatgaccccggctgttcgccagagggtgatcgaggaggcgaagaccgcttttctgctcaatattcaattgtttgaggagctgcaggagctgctgacccatgacacaaaagaccagagcccttcaagggcacccggtctccggcagcgggcaagtaataaagtgcaggacagtgctccagttgagactcctcggggaaagccaccactgaatacaagaagccaggcaccactgttgaggtgggtgctgactttgagctttttggtggctactgtcgccgtcggactgtatgccatgtag

SEQ ID NO: 232774 - DNA, 4304 bp, Artificial Sequence
  Description of Artificial Sequence: Synthetic coding sequence
atggaagaccacatgttcggagtccagcaaattcaacccaacgtgatatcggttcgtctgttcaagcggaaagttgggggacttggattccttgtgaaggagcgagtgtctaagccgcctgtgattattagcgacctgattagggggggagccgctgagcagagcggcctgatccaggctggggacatcatcctcgcagtgaatggccgacctctggtggacctgtcatatgattcagctcttgaggtattacgtggtatcgctagcgagacgcacgtagtgcttatccttaggggaccagagggattcacaactcacctggagaccaccttcaccggcgacggtactccaaagaccatacgcgtgacacagccacttgggcctcctactaaggccgttgacctatcacatcagccacccgcagggaaggagcagccactggctgtggatggagcatctggccctggaaatggtcctcaacacgcctatgatgatgggcaggaggcgggatccctgccacatgcgaacggcctggccccacgccctcccggacaggatccagcgaaaaaagctacccgagtttccttacagggcagaggtgaaaataacgaactcctaaaggagatcgagcccgtgctctctctgctgacttcggggagccgtggggttaaggggggagcccctgcaaaggccgaaatgaaggacatgggtatacaggtggaccgggatctggatggtaagtctcacaagccattgccactcggagtcgaaaatgacagggtgttcaacgacctctggggaaagggcaacgtcccagttgttttaaacaacccatactccgaaaaagaacagccacctacctctggcaaacagagccccactaagaatggaagtccaagcaaatgccccagattcctgaaagtgaaaaattgggaaacggaggtggtgttaactgacacactgcacctgaagtctactttggagactggctgcacagagtatatatgtatgggatccatcatgcacccgagccagcatgccaggagacccgaggatgttcgaactaaaggccagctgttcccattagctaaggagttcattgatcaatactactccagcatcaagaggttcggtagcaaggcccatatggaacgtctcgaggaagtgaataaagaaatcgacaccactagcacctaccaactgaaagataccgagctcatttacggagcgaaacacgcttggagaaatgccagcaggtgcgtcggccgaatacagtggtcaaaactccaggtcttcgacgcaagagattgtacaactgcacatggcatgttcaactacatctgcaatcatgtgaagtacgctacaaataagggcaatcttcggtcagcgattaccatatttcctcagcgcactgatggaaagcatgattttagggtgtggaattctcagctgattcgttatgcaggctataagcagccagatggaagcacactaggagatcctgccaacgtacaatttaccgagatttgcatccagcagggctggaagccgccaagaggtcgattcgacgttttgcccttacttcttcaggccaacgggaatgacccagaacttttccagatccccccagaactggtcctggaggtacctatcagacaccctaagttcgagtggttcaaagatttggggctgaagtggtatggtctgcccgctgtttccaacatgcttcttgagattggaggcttagaattctccgcctgtccttttagtgggtggtacatggggaccgaaattggggttcgcgattactgcgataattcacgatacaatattctggaggaggttgcaaaaaaaatgaacttggatatgcgtaagacatcttcattatggaaggatcaggcactggtggagatcaacatagccgtgctgtatagctttcagtctgacaaagttaccatcgtagatcatcactccgcgactgaaagctttattaagcacatggagaatgagtaccggtgtcggggaggttgtcctgcagattgggtttggatcgtacctcccatgtctgggtcaatcacacccgtgtttcatcaggagatgctgaactatcgactgactccatcattcgaatatcaacccgacccctggaacacacacgtgtggaaggggactaatggaactcccactaaacggagagcaataggatttaagaagctcgccgaggccgtcaagtttagtgcgaagctgatgggccaggcgatggcaaaacgggtgaaggcgaccatcctgtatgctacagagacagggaagtcccaggcgtatgccaagacactgtgtgagatatttaagcatgcatttgatgctaaggtcatgagcatggaagagtacgacatagttcatctcgaacatgaaacccttgtgttggttgtgacaagcacatttggcaatggcgatccccctgaaaatggggagaaattcggctgcgccttgatggaaatgcggcatccaaattccgtgcaggaggagcggaagtcatataaggtccgctttaactccgtgagctcctatagcgatagccagaagagtagcggagatggaccagacttacgggacaatttcgagagcgctggtcccctcgccaacgtcaggttttcagtcttcgggcttggttctcgggcttacccccacttctgtgctttcggacacgccgtggacactctgctggaggaactgggaggcgagaggattcttaagatgagagagggggacgagctgtgcggccaggaggaggcgtttcggacatgggcgaagaaggtttttaaagcagcctgtgatgtgttttgcgtgggggacgacgtgaacatcgagaaagcaaacaattctctgatcagtaacgacagaagctggaagcgcaacaaattccgactcacctttgtagcagaagcccctgagttgactcaggggttgtcgaacgtacataagaagagagtgtcggctgcgaggttattgtctcgccagaacttacaaagccctaagagctcaagaagtaccatatttgttcggttgcacaccaacggctcccaggagctgcagtaccagcccggagaccacttaggagtttttcctggcaaccacgaagacctcgtgaacgcattaattgagcgcctggaggacgcccctcctgttaaccaaatggtcaaggtggaattgcttgaggagagaaatacagcgctgggcgtgattagtaactggacagatgaactgagactgccgccatgtacgatcttccaggctttcaagtactatctggacattactaccccgcctactccacttcaattacaacagttcgccagccttgctacctcagagaaagaaaaacaacgattgctggttctgtctaagggattacaggaatacgaggagtggaagtggggtaagaatcccaccatcgtggaggtcctggaggagttccctagtattcaaatgccagcaaccctccttcttactcagttaagcctgcttcagccccgttactactcaattagtagttcaccggatatgtatcctgacgaagtccatctgacagtggctatcgtatcttatagaactcgggacggcgagggaccaattcaccacggggtctgttcctcttggctcaaccgcatccaggcggatgagcttgttccatgttttgtgaggggagccccatcttttcatctccctcgcaacccccaggtgccctgcatcctggtgggaccagggacaggcatcgcaccgtttcgcagcttttggcagcagaggcagttcgacattcagcacaagggaatgaacccatgtcctatggtgttggtgtttgggtgtagacaatcaaagatcgaccacatataccgagaggagacacttcaggccaagaacaagggcgtgttccgagaactgtacacagcttatagtagggagcccgataagcctaagaaatacgtgcaggacatcctgcaggaacagttagctgaatctgtttatagggccttaaaggagcagggaggccacatctatgtgtgtggtgacgtgaccatggccgctgacgtcctgaaggccatccagcgcattatgacacagcaggggaagctgagtgcggaggatgccggagtcttcatctctcggatgagagacgacaacagataccacgaggacatcttcggtgtcacccttaggacctatgaggtcaccaaccgactgcggtccgaatctattgcttttattgaggagagcaagaaggataccgacgaggtcttcagcagtta

SEQ ID NO: 232775 - DNA, 4407 bp, Artificial Sequence
  Description of Artificial Sequence: Synthetic coding sequence
atggaagaccacatgtttggggtgcagcaaatacagcccaatgttatatcagtcaggttgttcaagaggaaagtgggagggcttggatttctcgtaaaggaaagggtttctaagcctcccgtcattatatccgacctaatcagaggcggagcagccgagcagtctggccttattcaggctggcgatattatactggcagtgaacggaaggcctctcgtcgacctgtcatatgactccgcccttgaagtgctacgcggaatcgcgagcgaaactcacgtggtcctgatcctcaggggccctgagggctttaccactcatctcgagacaactttcaccggagacgggactccaaagaccattagagtgacacagcctcttggcccacccaccaaggcggtggacctgtcacaccaaccccctgcagggaaggagcagccactggccgtcgacggtgcttccgggcctggcaatgggccacagcatgcatacgatgacggccaagaagccggatcactccctcacgctaatggactggcccctagaccgccaggccaggatcccgcaaaaaaggctactcgggtcagtctgcagggacggggagaaaacaacgaattgctcaaagagattgaacccgttttgtctttgctgacgtcaggatcccgcggtgtaaaaggcggtgcacctgcaaaagccgaaatgaaagatatggggatccaggtagatcgcgacctggacggaaaatcacacaaacctcttcctctaggcgttgagaacgacagggtatttaatgatctttggggaaaaggaaatgtcccagttgttctgaataatccttacagtgaaaaggagcagcccccaaccagcggaaaacaaagccctaccaaaaacggaagccctagcaagtgcccgaggtttctgaaggttaaaaattgggaaaccgaggtggtgctgaccgatacacttcatctgaagagtaccctggagaccgggtgcacggagtacatttgtatgggaagcatcatgcatccctctcagcatgccagaaggccagaggacgtgcgcaccaaaggtcagctgttccccctggcaaaagaatttatcgatcagtattactccagcatcaaacgtttcggttcgaaagcgcatatggagagattagaagaagtgaacaaggaaattgatactacctcaacctatcagctgaaagacacagagctaatttacggggctaagcacgcatggcgcaacgcctcccgttgtgtgggtcggattcagtggtctaagctccaggtcttcgatgcccgtgactgcactacagctcatggaatgtttaactacatttgcaaccacgtgaagtacgccacaaataaaggaaatctacgctccgctatcaccattttcccgcaacgtaccgatgggaagcacgattttagggtgtggaactcccagctgattaggtacgccggatacaaacaacccgacgggtcaactctcggagacccggctaatgtccagtttaccgagatatgtatacagcaggggtggaaaccccctcggggacggttcgacgtgctgccgctactactgcaggccaacggtaacgacccagaactgtttcagatcccgcctgaactggtgttggaggtgcctatcagacacccaaagttcgagtggtttaaggatctgggcctgaaatggtatggattgcctgccgtctccaatatgctgttagagatcgggggactggagtttagcgcttgtccgttctccggctggtatatggggacggagatcggcgtgagagactactgcgacaactcccgctataatatcttggaggaggtcgcgaaaaagatgaatctggacatgagaaaaacttccagcctgtggaaagaccaggctctggttgaaatcaacattgcggtgttatacagcttccagagcgacaaggtgacaatcgtcgatcaccattctgccactgagtccttcattaaacacatggaaaacgagtatcgatgtaggggagggtgtcctgccgattgggtctggatcgtccctcctatgagtggcagcatcacccccgtgttccaccaagagatgctgaattatcggctaacacccagtttcgaatatcagccagatccctggaacacccacgtttggaagggcaccaacggcacaccaactaagagacgggcaatcggatttaaaaaactagccgaggccgtgaagtttagcgctaaactcatgggccaggccatggctaagcgcgtaaaggcgacgatcctttacgcaacagagaccgggaagagtcaagcctatgcaaagaccctgtgcgaaatcttcaaacacgcattcgacgcaaaagtgatgtccatggaggagtacgatatcgtccatttagagcacgaaaccctggttctggtggtcacaagcaccttcgggaacggtgaccctcctgagaatggtgaaaagttcggctgtgcactgatggagatgcgccaccctaattcggtgcaggaggagcggaaataccctgaacccctccggttcttccctcgcaagggtccacccctccctaatggcgataccgaggtgcatggcctggccgctgccagggatagccagcatcggtcatataaagtacgctttaacagcgtgtctagttactcagattcccagaagtcaagtggagatggccctgacctgagggataattttgagtctgccggacctctggcgaatgtcagattctcggtgttcggcctcggttcaagagcatatccccacttctgcgcctttggtcacgctgtggacaccctcctcgaggagctaggcggagaacgtattctaaagatgcgtgagggggatgaactgtgtgggcaagaggaagcatttcgcacctgggctaaaaaagtgttcaaggctgcctgcgatgtgttctgcgtgggagacgacgtgaacattgagaaggcgaacaatagccttataagcaacgaccgctcttggaagagaaataagttcaggctgacattcgttgctgaggcacctgagctgacccagggacttagcaacgtacataagaagcgagtaagtgcggcaaggctcctttccaggcaaaaccttcagagtccaaagagttcaaggagcaccatcttcgttagactgcacaccaacggctcccaggaactccagtatcagcctggggaccacctgggagtgttccctgggaaccacgaggacctagtcaacgctctcattgagcggcttgaggacgcgcctcccgttaatcaaatggtgaaagttgaattgctcgaggaacggaatactgcgctgggggtgatctccaattggactgacgaattacggctgccaccctgtactatattccaggcctttaaatactatctcgacataacaactccgcctacccccctgcagcttcagcaattcgccagccttgctacctccgagaaagagaagcagcggctgcttgttctgtccaagggactgcaggagtacgaagagtggaagtggggaaagaatcccacaatagtcgaggtgctggaagagtttccttcaattcagatgccagcaaccctcctgctgactcagctgtcgttgttgcagccacggtattacagcatctcttcctctcccgatatgtatcccgacgaagtgcacctcacagtggcaatcgtgtcttacaggacaagggatggtgagggcccaatccaccacggagtgtgcagctcgtggctcaaccgcatccaggccgatgagctagttccttgttttgtgcgcggtgccccatccttccatttacccaggaacccacaggtgccctgtatattggtcggacctggaacagggatagcaccctttcgtagcttttggcagcagcgccagtttgacatccaacataagggaatgaacccttgcccaatggttttagtcttcggctgtcggcagagcaaaatcgatcacatctacagggaagagacccttcaggcaaagaataaaggagtgttcagggaattatacactgcttattctcgcgaaccagataaaccgaaaaagtatgtacaggatatcctgcaggaacagctggctgagagtgtctaccgtgcgctaaaggaacagggaggacacatctacgtctgtggggatgtcactatggccgctgatgtactgaaagcaatccaaaggattatgacccagcagggtaaattaagtgcagaagatgcaggtgtgtttatttctagaatgcgcgacgacaatcgataccatgaggatatcttcggggtgaccctcaggacttatgaagtcacaaatcgtctgagaagtgaaagcattgcatttatcgaggagtctaaaaaggataccgatgaagtgttttccagttag

SEQ ID NO: 232776 - DNA, 1224 bp, Artificial Sequence
  Description of Artificial Sequence: Synthetic coding sequence
atggaagaccacatgtttggggtccagcagatccagcctaacgttatcagtgttcgcctttttaaacggaaggtcggcggacttgggttcttggtgaaggagagagtgtccaaaccgccagtgattatcagtgatttgattaggggcggagccgcagagcagtccggtttgatccaggccggagacattatcctcgcggttaacggtcgccctttggtggacctttcttatgacagtgcgttagaggtgttgcgcggtatcgcatctgagacacatgttgtactgatcctgcggggacccgaggggttcaccacccaccttgagactacattcaccggtgatgggacacccaaaacaataagagtgactcaaccacttggccctcccaccaaggcagttgatttgtcacaccagccccctgctgggaaagaacagcccctagctgttgatggcgcatctggccctggaaatggcccacaacacgcgtatgacgatggccaagaagcaggaagcctgccccacgctaacggcctggctcctcgtccccctgggcaagaccctgccaaaaaggcaaccagagtgtctctgcaaggcaggggcgagaataatgagttgcttaaggaaatagaacccgtactatcactgctgacaagtggatcgaggggagtgaaagggggagcccctgcgaaggccgagatgaaggatatgggcatccaggtggacagggaccttgatgggaagtcacataaacccctccctctcggtgtggagaatgatagggtgttcaacgacctctggggaaaaggcaatgtgccagtagttcttaataacccctactctgagaaagaacagatgaggaaactgcgcattaccgaggggtttggagcccagcggggtagccacaaccatcctccaccccaggagaactcccctccccagaggatggccgcacccccttccgtccatgctagttctcggtctagaactggccgtctacgatggtttagcctaaccccatcaaccttgagagctcactggaaaagagatgcactttctacctccgcatgggcaccatcatgtatcctgttgagcatgcaggggggattgaagacgtccgcccagaaagactccagctccctttcgccaaagagcctcttaattaataccatccatcagttaaaggatctagccccaaaacctacctggaagggatggaaacggtag

SEQ ID NO: 232777 - DNA, 3993 bp, Artificial Sequence
  Description of Artificial Sequence: Synthetic coding sequence
atggaagaccacatgttcggagtccaacagatccagccgaacgtgatatccgttcggcttttcaagaggaaagtgggaggtctggggtttttagtgaaggaacgagtgagtaaaccccctgtgatcatcagcgatttgatccggggaggcgcagccgaacagtcgggattaatccaggctggggatataatcctggctgtaaatgggagacccttagttgatctgtcctatgacagtgcccttgaagtactacgcggtattgcttccgagacgcatgtagttctgatccttcgaggtcctgagggctttaccactcacttagaaacaacatttactggagatggtacccccaaaaccatacgcgtgactcagccactgggaccccctaccaaggccgtggatctttcacatcagccgccagcgggtaaggagcagccgctggctgtcgacggcgcttccggcccaggtaatggacctcagcacgcttatgatgatggccaggaggccggatcactcccacatgccaatggcttagctccccgtcctccaggacaggatcccgcaaaaaaagccacccgagtgtccctgcaggggcgaggagaaaataatgaactgttgaaagaaatcgagccagtcctgtcactgctgacctcaggttcgcgcggagtcaaaggcggtgcgcctgcgaaagcggaaatgaaggacatgggaatacaagtggaccgagatctggatggaaaaagccacaaacctctgccactgggggtcgaaaacgatagggtgttcaacgacctctggggcaaaggcaacgtgcctgtcgtactgaataacccatattctgaaaaggagcagcctccaaccagtggaaaacaaagccctaccaagaacgggtctcctagcaaatgccccagatttctcaaagttaaaaattgggaaacagaggtggtgttgacggacacactgcatctaaagtctacactcgaaactggctgtaccgaatatatttgtatgggtagcatcatgcacccttcccaacacgctcgcagacccgaagatgttagaactaagggacagctattcccactggccaaggaatttatcgatcagtactatagtagtatcaagcgattcggctctaaggcccacatggaacgcttagaggaggtgaacaaagagatcgataccactagtacttaccagctgaaggacacagagctgatatacggagctaagcacgcttggaggaatgctagtcgctgtgtcggaaggatccagtggagcaagctccaggtctttgacgctcgcgattgcacaaccgcgcatggcatgtttaattacatttgcaatcacgttaagtatgcaactaacaaaggcaacctcagatccgccatcacaatcttcccgcagcggaccgatggaaaacatgatttccgggtctggaactcccagttaatccgttatgctggttacaaacaaccagacgggtctacgctgggcgatcctgccaacgtgcaattcactgaagaagtggccaagaagatgaatttggacatgaggaagacgtctagcttgtggaaagaccaggcgttagtcgagatcaacattgcagtgttatattcttttcaatccgataaggtcaccatcgtggatcaccactccgccacagagagtttcataaagcatatggagaacgaatacagatgtcggggagggtgccccgcagactgggtgtggatagtgcccccaatgtctggctccattactccagtgttccaccaggagatgctcaactaccgattaaccccatctttcgaatatcagccagatccgtggaacactcatgtgtggaagggaactaacggcactcctacgaagaggagagcgataggatttaaaaagcttgctgaggctgttaaattcagcgccaaactgatgggccaggcgatggccaagagagtcaaggcaacaatcctttatgcgacagaaacaggtaaaagccaagcgtatgccaaaacactgtgtgagatatttaagcacgcatttgatgctaaagtgatgtctatggaagagtacgacattgtccaccttgagcacgagacgcttgtcctggttgtgacttcaacctttgggaacggagaccccccagaaaatggtgagaagtttggatgcgctctcatggaaatgagacatccgaacagtgtgcaggaagagcgcaaatcctacaaagtcaggttcaattccgtttcatcatatagtgattctcagaaatcttctggcgacgggccagacctgcgcgacaattttgagtctgcagggcctcttgccaacgtgagattcagtgtgtttggattgggcagccgggcttacccccacttctgcgccttcggccatgctgtcgatacattgctggaggagctgggtggggaaaggatcctgaagatgagggagggagatgagctctgcggccaggaggaagccttccgcacatgggcaaagaaagtgttcaaagccgcatgcgatgttttctgcgtgggcgacgacgtgaacatcgagaaagcaaacaacagtcttatctcaaacgataggtcctggaagcgtaataaatttcggttgacctttgtcgctgaggcaccagagctgactcagggactgtcgaatgtgcataagaagcgggtaagcgctgctaggcttctgtccaggcaaaacctccagtccccaaagtcctcacgctctacaatatttgttagattgcatacaaatggttcacaagagctccagtatcagcccggagaccaccttggcgtgtttcccggaaaccatgaagacctggttaatgccctcattgagcgcctggaggatgcacccccagtgaaccagatggtcaaagtggagcttttggaggagcgtaacacagcactgggcgtcatatccaactggaccgacgagctgagactgcctccttgtacaatctttcaggcatttaaatattacctcgatatcacaacgccgccaacacctctgcagctccaacagtttgcgtcactagccacaagcgagaaggagaagcagagactgctcgtgctctctaaaggcctgcaggaatatgaggaatggaagtgggggaaaaatccaactattgtagaagtactggaggagttcccatctattcagatgccagccacactcctgctgactcaactgtcgttgctccagccaaggtactactccattagttcttcacctgacatgtatcctgatgaggttcatctcaccgtcgccatcgtctcatacagaacaagagatggggagggaccaatccaccatggtgtgtgcagttcctggcttaatcggatccaggctgacgaactggtaccctgttttgtcagaggtgcaccttctttccatctacccagaaacccacaagtcccatgcatcctggtcggaccagggacagggattgctccctttagatctttctggcagcagcggcagtttgacattcagcataaaggcatgaacccctgcccgatggtgcttgtctttggatgccggcaaagcaaaatagatcacatataccgggaggaaacattacaagcaaagaataagggggtttttcgggagctgtacaccgcttacagtagggagccggacaaacccaaaaaatatgtgcaggatatactccaggaacagctggcagagagcgtctatcgggcactaaaagaacaaggcggtcatatttatgtgtgtggagacgttactatggctgcagatgttctgaaggccatacagaggattatgacccaacagggcaaattgtctgcggaagacgccggagtcttcatttctcgcatgagagatgataacagataccacgaggacatcttcggagtgacactgcggacttatgaagtaactaatagactaaggtcagaatctatcgctttcatcgaagaatctaagaaggacacagatgatcaggtatttaagacgtag

SEQ ID NO: 232778 - DNA, 3621 bp, Artificial Sequence
  Description of Artificial Sequence: Synthetic coding sequence
atggaagatcacatgttcggggttcagcagattcaacccaatgttatttccgtgagacttttcaagcggaaggtggggggtcttgggttccttgtgaaggagagagtttctaagccccctgtgattatcagcgacctgattcgagggggagccgctgagcaatccgggctcatccaggcaggagacataatcttggcggtcaacggccgacccctcgttgatctgtcctatgactctgccctggaagtactgcgcggaatcgcctccgagacccatgtggtccttatactcaggggaccagaagggttcactactcacctcgaaacgacctttacaggggacggtacccctaagactatacgagtgacacagccattgggcccacctaccaaggctgtggacctgtcacatcagccaccggcaggcaaggagcagcccttagcggtggatggagcatctggacccggtaacgggcctcaacatgcttacgacgacggacaagaggccggttctttgccccacgccaacggccttgcccctcggccacctgggcaagatccggcaaagaaggcaacaagggtgtctctgcagggaaggggggagaacaatgaactgctgaaagagattgaacctgtgctaagtctgctgaccagtggttccaggggcgtcaaaggtggcgctccagctaaggcagagatgaaagatatgggcatacaggtggatcgggacttagacggaaaatcccacaagcccctgcctctgggcgtagaaaacgaccgagtgtttaatgacctttggggcaagggcaacgtgccggtagttcttaacaacccatactcggagaaggagcagccacccacatctggtaagcagtctccaactaaaaacggctcaccgtctaagtgcccaaggtttctgaaggtgaagaattgggaaaccgaggtcgtgctgaccgatacattgcacctcaagtctacactggagactggctgcacagagtatatttgcatgggctcaatcatgcacccatcacaacacgcccgacgacccgaggatgtgagaaccaagggacagctcttcccactggccaaggagttcattgatcaatactattcctctataaaacggttcgggtcgaaagcacatatggaaaggcttgaggaggtcaacaaagagatagacaccacaagcacctaccagctgaaagacacagagctgatctatggtgcaaaacatgcatggcgcaacgccagccgctgcgttgggaggatccagtggtcaaaactgcaggtgttcgacgctcgtgactgtaccacagcccacgggatgtttaattacatatgcaaccacgtcaagtacgccactaataagggtaacctgaggtctgccatcaccatcttcccacagcgcactgacggtaaacatgatttcagggtgtggaatagccagctgattagatatgccggatacaagcagcccgatggatccacccttggggaccccgcaaacgttcagttcaccgaaatatgtatccaacaggggtggaaaccacctcgcggacgttttgatgttttgcccttgcttctccaggctaacggtaatgaccccgagctttttcagatcccacccgagctcgtactggaggtccccattcgccaccccaaattcgaatggtttaaggacttgggtctgaaatggtacggacttcccgcagtatccaacatgctgctggaaatcggcggactcgagttctcagcgtgtcccttttccggatggtacatgggcactgaaatcggggtgagagattattgcgataatagccgctacaacatactggaggaggtcgccaaaaaaatgaatctagacatgaggaagacttcgagtctttggaaagatcaagcattggtggagatcaatatagcagtgctttatagtttccagagtgataaagtgacgatcgtagaccatcattcagccacagagtccttcatcaagcatatggagaacgagtaccggtgtcggggaggctgcccagcggattgggtgtggattgttccaccaatgtctggttcaatcacacctgttttccaccaggagatgctcaattaccgcctcactccatcgttcgaataccagccagatccttggaacacacatgtctggaagggtaccaacggaactcctacaaagaggagagccattggattcaagaagctggctgaggctgttaagttttcagccaagctcatgggccaagcaatggcaaagagggtgaaagcaacgatactttatgctactgagaccggaaaatcccaagcttacgcaaagactctgtgcgaaatcttcaagcatgccttcgacgcaaaggtcatgtctatggaggagtacgatattgttcacctggagcatgaaaccctcgtgcttgtcgttacttccacatttgggaacggcgatcctcctgagaatggtgaaaaatttggctgcgcccttatggagatgaggcacccaaattcagtccaggaagaaagaaagtcttataaggtacgcttcaattctgtgtcatcttactcagatagtcaaaaaagctccggggatggacccgatctcagggacaattttgagtccgctggtccgctggccaacgttcgcttcagtgtctttgggctgggatctcgggcatatcctcacttctgcgccttcggtcatgcggtcgataccctactggaggagctgggtggggaacgcatcctcaaaatgcgcgagggggacgagctctgcgggcaggaggaggcctttcgcacatgggctaagaaggtgtttaaggccgcttgcgacgtgttctgtgttggtgatgatgtcaatattgagaaggccaataactcgctcatctctaacgatcgatcttggaagcggaataagttccggctcaccttcgtggcagaagctccagagctgactcaaggtctctccaatgttcacaagaaacgggtgtccgccgcaagattgttatcgaggcaaaacctacaaagtcctaaatcctctaggtctactatatttgtgagactgcacacaaatggttcccaggagcttcagtaccaacccggtgatcatctcggcgtgttccctggcaaccacgaggatctggtgaacgccttaatcgagcgcctggaggatgcccctcctgtcaatcagatggtcaaagttgagctgcttgaagagagaaatacagccctcggtgtgataagtaattggaccgacgagcttaggctgcctccctgcacaattttccaggctttcaaatactatctcgacatcactacaccacccacccctcttcagctgcagcagttcgcgagcctggccaccagcgaaaaagagaagcagaggttgctggtgctctccaaaggccttcaagaatatgaggaatggaaatggggcaaaaatccgacaatcgtcgaagtgcttgaggaatttccctccatccagatgcctgcaactctgctgctgacccagttgtcgctactccagcctagatactattccatttctagcagcccccacacccacaccttatccgagacacgcccatcacccttgccactgtcatcgcagtgctgttag

SEQ ID NO: 232779 - DNA, 204 bp, Artificial Sequence
  Description of Artificial Sequence: Synthetic coding sequence
catcctaatagcgtacaagaggaacgtaaatacccagaacctctgcggttttttccccgtaaggggccacccctgcctaatggcgatacagaagtccacggactggctgccgcacgggacagtcaacaccgcagctacaaggtcagattcaactcagtgtcctcgtactccgattctcagaagagctccggtgatggaccctag

SEQ ID NO: 232780 - DNA, 1521 bp, Artificial Sequence
  Description of Artificial Sequence: Synthetic coding sequence
atgcccagtaagaccaagtacaatctggtggatgacgggcacgatcttcgaatcccactccacaatgaggacgcctttcaacacggaatatgctttgaggccaagtacgttgggagcttagatgtgcctcgcccaaacagtagggtggagattgtggccgctatgcgcagaatcagatatgaatttaaagccaagaatatcaaaaaaaagaaagtgtccatcatggtttccgtggacggagtgaaggtaatcctgaagaagaagaagaaattgcttctcctgcagaaaaaagaatggacttgggacgaaagcaaaatgcttgtgatgcaggatcccatttaccgtatcttttatgtctcacacgactctcaggacctgaagatttttagctacattgctcgggatggcgctagcaacatttttaggtgtaacgtgttcaagtccaagaagaaatcccaggcaatgagaatcgtgcggactgtgggccaggcttttgaggtatgccacaaattgtctttgcaacatacacaacagaacgcagacgggcaggaagacggcgaaagtgaacgcaactccaattcctccggtgatccgggaagacagttgacgggcgctgagagagcctcgacggcgacggcagaagaaactgatatcgatgctgttgaggtcccactgcccggtaatgatgttctggaattctcacgtggggtaactgaccttgatgccgtaggtaaggaggggggaagccacaccggcagcaaggttagccatcctcaagagcccatgctcaccgcgtccccaagaatgctactacctagtagcagcagcaagccacctgggttgggtacggagactcctctatccacccaccatcagatgcagctgcttcaacagcttttgcaacaacagcagcaacagacccaggtggcagtggctcaggtgcatcttctgaaagaccagcttgccgctgaggcagctgccaggcttgaggcacaggctagggtccatcagctgctgttacagaataaggacatgcttcaacatatttcccttctggtgaagcaggttcaggagctagagctgaagttgagtggccaaaatgctatgggctctcaggacagcctgctcgaaataacattccgatccggagcgctgcccgtgctgtgtgacccgactactccaaaaccagaagatctgcactccccgccactgggagcaggtctggccgatttcgctcacccggcaggctctcctctgggtagaagagattgcctggtcaaactagagtgttttaggtttctccctccagaagataccccgccacccgcacaaggtgaggctctactggggggactggagttaattaagtttcgtgagtccgggatcgcgtccgagtacgaatccaacacagacgaatcggaggagcgggactcttggagccaggaagagctcccgagactgctcaacgtattgcaaaggcaggagcttggtgatggtctggatgacgagattgctgtatag

SEQ ID NO: 232781 - DNA, 636 bp, Artificial Sequence
  Description of Artificial Sequence: Synthetic coding sequence
atgtccctgtcaagtctgtgccccgtctttagcgcagccgcttcatcactgcaggtgcacttgctgaaagatcaactggccgctgaagcggctgcgcgactggaggcacaggcaagggtacatcaattattgttacagaacaaagatatgctgcagcatatctctctactggtcaaacaggttcaggaattagaactcaagctctcagggcagaacgcgatggggagccaggattccctgcttgagattacatttcgcagcggtgctctgcccgtcctgtgtgacccaactacccctaagcccgaagacctgcacagtccacctctcggcgctggacttgccgacttcgcccaccctgcaggctcacctttgggcaggagagattgtctcgtgaaactggaatgttttaggtttctacctccagaggataccccaccaccagcccaaggagaggccttgctggggggtctggaactcatcaaatttcgggaatctggcatcgcatctgagtacgaaagcaataccgacgagtccgaagaaagggactcttggtcccaagaagaactgcctagacttctgaacgtcctgcagaggcaggaactcggcgatggactcgatgacgaaatagctgtttag

SEQ ID NO: 232782 - DNA, 1506 bp, Artificial Sequence
  Description of Artificial Sequence: Synthetic coding sequence
atgccctccaaaaccaagtataaccttgtagatgatggccacgatttacggattcctctccacaatgaagatgcctttcagcacggcatttgcttcgaagccaagtacgtgggcagcctggacgtgccgaggcctaactctcgcgtggaaatcgtcgctgcaatgagacgcattcgttatgagtttaaggcgaagaacatcaagaaaaagaaagtttctattatggtttcggtggacggagtgaaagtgattcttaaaaaaaagaagaagaagaaggaatggacttgggacgaatctaagatgctggttatgcaggacccaatctataggatattttatgtcagtcacgatagtcaagatttgaagatattttcctacatcgctcgtgatggcgcttcaaacatcttccgttgcaacgttttcaaaagtaagaagaagtcccaggcaatgcggatcgtgcgaactgtggggcaggcattcgaggtgtgccataaacttagccttcaacatactcaacagaatgctgacggacaggaggacggggagtccgagcgtaacagtaattccagcggtgaccccggtcgtcagctcacgggcgcagaaagggcctcaaccgctaccgcagaagagactgacatcgatgcagtggaagtcccgcttcctgggaacgacgtccttgaattctcgagaggtgtgactgatctcgatgccgtgggcaaggaaggcggtagccacaccggatctaaggtcagccatccccaggagcctatgttgaccgcatccccacgcatgcttctgccaagcagcagctcaaaaccccctgggttaggtacagaaacccccctgtccacacatcatcagatgcagttgctgcagcagctgcttcaacagcagcagcagcagacgcaggtggccgtcgcccaggtccaccttctgaaggatcagttggcagctgaggcagcggcacggttagaagcccaggcgagggttcaccaacttctgctgcagaacaaagacatgctacagcacatttcgctgctggtgaaacaggtgcaggagctggagctgaaactgtccggccagaacgcgatgggtagccaggattccctcctggaaattacctttaggtcaggggctctgccagtgctctgcgatcctacaacccctaaacctgaagatctgcacagtccaccactcggcgctgggttggcagatttcgctcaccctgccggaagccctctggggagaagggattgcctggtgaagttagaatgttttcggtttcttcctccagaggacacaccacctccggctcagggcgaagccctgctgggaggcctcgagctcattaagttcagagaaagtgggatagccagtgaatatgagagtaacactgacgaaagcgaggagcgcgatagctggagccaggaagagctcccacggctgttgaacgttctccagaggcaggagcttggcgacgggctcgacgacgaaatcgccgtgtag

SEQ ID NO: 232783 - DNA, 2190 bp, Artificial Sequence
  Description of Artificial Sequence: Synthetic coding sequence
atggcctgcccctggaagttcttgttcaagaccaagttccaccagtacgcaatgaatggcgagaaggatatcaataataacgtggagaaggcgccatgcgccaccagttcacctgtgacgcaggatgatctacagtaccacaacctgagtaagcagcaaaacgagagtccccaacctctcgtggagacaggaaaaaaaagccccgagtctctcgtgaaactcgacgctacccctctctccagtcctcgccacgttcgcattaaaaactgggggtcagggatgacattccaagacactctccaccataaagcaaaaggtattctgacttgccgtagtaagtcttgtctggggagcatcatgactcccaagagcttgacacgcggacccagggacaagcccacacctcccgatgaactgctccctcaggccatcgaatttgtaaaccagtactacggctctttcaaagaagccaaaatcgaggagcatctggctagggtagaagccgtgacaaaggaaattgagacaactggcacgtaccagctgacgggggacgaactgatttttgccacaaagcaagcatggcgcaacgctccccgatgcatcggccgaattcagtggagcaacctacaggtattcgatgctcggtcttgtagcacagctagagagatgtttgagcacatttgccgacacgtgaggtactccactaacaacggaaatattcgtagcgctatcaccgtattcccacagcgaagcgatggaaagcatgactttagagtttggaatgcacagttgattcggtatgcgggatatcagatgcccgatggctctattagaggagatccagctaacgtagagttcacccaactctgtatcgatttgggttggaaacccaagtatggcaggttcgatgtggttccactcgtcctccaggccaacggccgtgatccagagctgttcgagattccacctgaccttgtgttagaggtggctatggagcacccaaaatatgagtggttcagggaactcgaacttaaatggtatgcactgcctgctgtggcgaatatgctattagaagtcggcggattggaatttcccggatgccccttcaatggttggtacatgggtactgagattggcgttcgcgacttttgtgatgtccagagatacaacattttggaggaagtgggcaggcgaatgggactcgagacccacaaactggcctccctctggaaggatcaggcagtcgtggagattaatatcgcagtcctccacagtttccagaaacagaatgtgactattatggaccaccacagcgcagccgaatcattcatgaaatatatgcagaatgagtacaggtctcgcggaggttgccccgctgattggatctggctcgttccccctatgagcggaagtataactccggtgttccaccaggagatgctgaactatgttctcagccctttttattactatcaggtagaggcttggaaaacgcacgtgtggcaggacgaaaagcgacgaccaaaaaggagggagatccctctgaaggtccttgttaaggccgtcctgtttgcctgcatgctaatgaggaagactatggcctctcgtgtgcgcgtgacgattctgtttgctacagagacgggcaagtcagaggccctggcatgggatctgggtgcactgtttagctgtgctttcaatccaaaaaagctgaaaaaatctctttttatgcttaaagagttgaataataagttccggtatgctgtcttcggtttaggctcatctatgtatccgaggttctgtgcattcgcacatgacattgatcaaaagctttcacatcttggcgcatcccagctgacacctatgggggaaggagacgagctaagtgggcaggaagatgcatttcgatcctgggctgtgcagaccttcaaggccgcttgtgagacatttgatgtgcgtggtaaacaacacatccagatacccaagttgtacacctcaaacgtgacatgggaccctcaccactaccggctagtgcaagatagtcagccattgcctgcagcatctactagtcccagaatccccccaatactggcatcttctagcggtctcgcacaggcttccaggcccagtgctgtctctggctcgaatgggagcatgactccgtccacacgggaatgtggtgaagccgcttag

SEQ ID NO: 232784 - DNA, 3462 bp, Artificial Sequence
  Description of Artificial Sequence: Synthetic coding sequence
atggcgtgtccttggaagtttttattcaagacaaaatttcatcagtatgcgatgaacggggagaaggacatcaacaataacgttgaaaaggccccttgcgcaacaagcagcccagtcacccaggatgatctccagtatcacaacctgagcaagcagcagaacgaatcccctcagcccctcgtcgaaactggcaagaagagccccgaatccctcgtcaaactggacgccactccactcagctcacctcgccacgtgagaatcaagaactggggctccggtatgacttttcaggacaccctgcatcataaagcaaagggtatcttaacttgtcgctcgaagagttgtctggggtcaatcatgactcctaaatccctcacacgcggtcctcgggataaaccaacccccccagatgagctccttccccaggcaatcgaattcgtgaatcaatactatgggagtttcaaagaggccaagattgaagaacaccttgctagagtggaagctgttactaaggagatcgagaccaccgggacctaccaactgacaggcgatgaacttatattcgcgaccaaacaagcttggcggaatgccccacgctgcatcggcagaatacagtggagcaacttacaagtgttcgatgcgaggagctgttctacagccagggaaatgtttgagcacatctgccgtcacgttcgctacagtactaacaacggcaatatccgcagcgcaatcaccgtatttccacagcgcagcgatggtaagcatgattttcgagtttggaatgcccagttgattagatacgccggatatcaaatgcccgacggtagcattcgaggagatccagcaaacgtggaatttacacagttatgcatcgatttgggctggaaaccgaaatacggacggtttgacgtggtgcctttggtgctgcaagccaacggcagggatcctgagctcttcgaaatcccaccggatctggtgctcgaagtcgctatggagcaccctaaatatgagtggtttcgggaactggagctgaagtggtacgctcttcctgctgtcgcaaatatgctgctcgaagtgggcggattggaattcccaggctgccccttcaacggctggtacatggggacagaaatcggtgttagggatttttgcgatgtgcagcggtacaacatcttggaggaggtgggaagacgaatgggcttagaaacgcacaaactggcttcactgtggaaggaccaggcagtggtagaaattaacattgcagttctgcattcgtttcaaaaacaaaatgtgacgatcatggaccatcactctgctgccgagtccttcatgaaatacatgcaaaatgaatatcgcagtaggggaggatgcccagccgattggatctggttggttcctcccatgtcaggttccattaccccggtcttccatcaggaaatgctcaattatgttctaagtccgttctactactatcaggtggaggcatggaagacacatgtctggcaagacgaaaaacggcgtccgaagaggcgcgaaatcccgcttaaagttctggtgaaggccgtcctgtttgcttgtatgctgatgcgcaaaacaatggctagccgggtgagggtgaccattctgtttgccaccgagactgggaaaagcgaagccctcgcatgggatctgggagctttgttctcctgtgcgtttaaccctaaagtggtctgtatggacaaataccgcctgtcctgcctcgaagaagagaggttactgctggtggtgacgtcaactttcggcaacggcgactgccctgggaatggcgagaaactgaaaaaaagcctctttatgctgaaggaactaaacaacaagtttcgatacgccgtgttcgggctgggttcttcaatgtaccccaggttttgtgcctttgcccacgacatcgatcagaagttgtcccatctgggcgcttcacagctcaccccaatgggcgaaggcgacgagctgagcgggcaggaggacgcgtttcggtcctgggcagttcagaccttcaaggctgcctgtgaaacatttgatgtgcgagggaagcaacacatccagatcccaaaattgtacacaagcaatgtgacttgggatccgcaccactacagacttgtccaagactctcagcccctcgacttatcaaaggcactgtcatcaatgcatgcaaaaaatgttttcactatgcgcctaaagtcccgacagaatctgcagagtcctacatctagtcgagcaacaatcctcgttgaactgagttgcgaggatggccaggggcttaactatcttcctggagagcatctcggagtgtgcccaggaaaccagcctgcccttgttcaaggcatcctcgagcgggtcgttgacgggccaacaccacaccaaacggttagactggaggcacttgacgagtccggaagctactgggtgagcgataagcgcctgcctccatgctctctgtcccaagcactcacgtactttttggatatcacaacccctcctacccaactgctgctccaaaagctggctcaggttgccaccgaagagcctgagcgtcagaggctggaggccttgtgtcagcccagcgagtacagcaagtggaaatttacaaatagccctactttccttgaagtccttgaggagtttcctagcctgcgagtttcggccggttttcttctctcacaacttccgatacttaagccgagattttacagcatctctagctcccgcgaccacactccaaccgaaattcacctcaccgtcgccgtggtaacctaccacacaagggacgggcaaggtcccctgcatcacggcgtgtgttctacttggttgaactcactgaagccccaggatccagtcccctgttttgtgagaaacgcctctgggtttcatctgcctgaagatccttctcacccatgtatcttgattggtcccggtacaggcatcgcacccttccggagcttttggcaacagcgtctacatgactctcagcataaaggggtcagaggagggcgtatgaccctggtttttggatgcagacgacccgacgaggatcacatttaccaggaggaaatgctcgagatggctcagaagggcgttctccatgccgtccatacagcttacagcagacttcccggaaagccaaaggtctatgtgcaggatattttgcggcagcagctcgcctccgaagtgctccgggtgctccacaaggagcctggtcacctctacgtctgtggagatgtccgaatggccagagacgtggctcataccctaaaacagctggttgctgctaagttaaagctgaatgaggaacaagtcgaagactatttctttcagctgaaatcacagaaacgctaccatgaggatattttcggagcagtgtttccctacgaagctaagaaggatcgagtggcggtgcaaccctcttcgctggagatgtccgccctgtag

SEQ ID NO: 232785 - DNA, 3345 bp, Artificial Sequence
  Description of Artificial Sequence: Synthetic coding sequence
atggcatgtccctggaagttccttttcaaaacgaagttccatcagtatgccatgaacggtgagaaagatattaacaataacgtcgaaaaagctccatgtgccacgtccagcccggtgacccaggacgacctgcagtatcacaaccttagtaagcagcagaatgaaagcccccagccccttgtggagacagggaagaaatcccccgagtccctggtcaagctggacgccacgcctctgtcctcaccaagacacgtcaggataaaaaactggggttcaggaatgacctttcaagacacgctacaccacaaggccaaagggatattgacctgccggtctaaatcctgcctgggcagcatcatgacacccaagagcttgactagaggcccacgcgacaaacctactcctcccgatgagctgctgccccaggctattgagtttgttaatcaatattacggcagctttaaggaggccaagatcgaggagcatttggcccgagttgaggcagtgaccaaagaaattgagaccaccggaacataccagctcaccggtgatgagctgatatttgccactaagcaggcatggcgaaacgctcccaggtgtatcggcaggattcagtggagcaatctacaagtgtttgacgcccgaagctgcagcaccgcgcgtgaaatgtttgagcatatttgtcgccacgtccggtacagtacaaacaacggaaacatccgttcagccatcaccgtgtttccccaacggagtgacggtaagcacgactttcgagtgtggaacgcacaactgtgcatagatttggggtggaagcccaatgggagagaccccgagctgttcgaaatccctccggatctggttctggaggtcgcgatggagcacccaaagtacgaatggtttcgggagttggaacttaaatggtacgctctgcctgccgtggcaaatatgctgttggaagtgggcggactggagtttccgggatgcccatttaatggatggtatatgggcacagagatcggagtgcgagacttttgcgacgttcagagatacaatattttggaggaggtcggtaggcggatgggcttggaaactcataaactcgcgtcactttggaaggatcaggccgtagtggaaattaacattgccgtcctgcactctttccaaaagcaaaacgtcaccataatggaccaccattccgctgccgagagcttcatgaaatacatgcagaatgagtatcgatcccgtggcggatgtcccgcagactggatttggctggtacctccaatgtctggatccatcacccctgtcttccatcaggaaatgcttaattatgtcctttcccctttctactattatcaggtcgaggcatggaagacccacgtctggcaggacgagaaacgcaggccgaagcggcgagaaatccctctcaaggtcctagttaaggctgtgctgtttgcctgtatgttaatgcgcaagacgatggcatcccgggtgagggtgactatactctttgctactgaaactgggaagtctgaagcccttgcatgggatttaggggcactattttcatgtgcgttcaaccctaaagtcgtgtgcatggacaagtaccgactttcctgcctggaggaggagcggctgctactcgtcgtcacatcgacatttgggaacggggactgtccgggaaatggagaaaagctcaagaagagtctgtttatgctaaaagagctgaataataagtttcgttatgcagtgttcggacttggctcttctatgtatccgagattttgtgctttcgcccatgatatcgaccagaaactttctcacttgggtgcctcacaactcaccccaatgggggaaggagacgagctaagcggccaggaggacgcttttaggagctgggccgtgcaaacctttaaagcggcatgtgaaacctttgacgtacgagggaagcagcacattcaaattccgaagttatacactagtaatgttacttgggatccacaccactacagactcgttcaggatagtcagcctttagatctctcgaaggccctaagctccatgcacgcgaaaaacgtctttaccatgcgcctcaaatcccggcagaacctgcaatctcctacgagttctagagcaactatacttgtggaactgagttgtgaggatgggcagggtctgaactacttgcctggagagcatctcggcgtatgtcccggaaaccagcctgcactggttcagggtattctagaacgcgtggttgacggccctaccccccatcagactgtaaggctggaggcgttggacgagtccgggagttactgggtgtccgacaaacgactcccaccttgtagcctttcgcaggcgttaacttatttcctggacataaccacccctcccacccagctgcttttgcagaagttggctcaggtggcaaccgaggaacccgagcgacagagactggaggctctgtgtcaaccgtctgaatatagtaagtggaagttcacaaattctcctacgtttctggaggttttggaagagttccccagtctgagagtcagcgctggtttcttgctgagccagctgcctatcctcaagccccgattctactcaatctcttcttcccgagaccacacgccaaccgaaatccatctgaccgtcgccgtagtgacataccacacgagagatggccaaggccctttgcaccacggagtctgtagtacatggctgaacagccttaaaccccaggaccccgttccttgtttcgtccgcaacgcttcagggtttcatctgccggaagatccctcccacccctgcatcttgattggccctgggaccggtattgccccattccgctctttttggcagcaacggctccatgactcccagcacaagggcgtgcggggtggcaggatgacattggtgttcggctgtagaaggcctgatgaggatcacatctatcaagaggagatgttggagatggcacaaaagggggtgctgcatgccgttcatactgcttacagtagactgccgggtaaaccgaaggtgtacgtccaggacatacttcgccagcagctggcttcagaggtgctccgcgtgttacacaaggagcctgggcacttgtacgtctgcggggacgtgcgcatggcccgtgatgtagcacataccctaaagcagttggtagccgctaaacttaaactcaacgaagaacaagtggaggactatttttttcagctcaagagccagaagagataccatgaggatatttttggcgctgtgtttccttacgaggcaaaaaaggacagagtggcggtacagccaagttcgctggagatgtcagctctttag

SEQ ID NO: 232786 - DNA, 3612 bp, Artificial Sequence
  Description of Artificial Sequence: Synthetic coding sequence
atgggaaatctgaaatccgtagctcaggagccaggtcctccctgcgggctgggcctgggactcggtttaggattgtgtggaaagcaaggcccagccactccggctccagagccctcccgcgctcctgcttctctgttaccaccagcgccagaacactcgccgcctagttccccactcactcagcctcccgaggggccaaaattcccccgagtgaaaaactgggaagtgggaagcatcacgtacgacacgctcagtgcacaggcccagcaagacgggccttgtacacctagacggtgcttgggaagtctggttttccctaggaagcttcaagggaggcctagccccggaccccctgctcctgagcagctcctcagtcaggcgagagacttcatcaatcagtactactcttcgatcaaacgtagcggttcacaggcgcatgaacagagactacaggaggtcgaagcggaagttgccgctacagggacatatcaactgagggaatcagagctggtgttcggggctaaacaagcatggcgaaacgccccaagatgcgtcggcaggatccaatggggcaagctccaggtgtttgatgctagagactgcaggagtgcccaggaaatgttcacatatatttgtaatcatatcaagtatgcaactaatcgtggaaaccttcggtctgcaattaccgtgtttcctcagcgctgccccggtcgcggtgatttccgcatatggaattctcagctggttaggtacgctggatataggcagcaggatgggtcagtgcgtggtgacccagccaatgtcgaaatcacagaattgtgcatccaacatggctggactcctgggaatgggcgttttgatgtgttgcccctgctgttgcaggccccagacgatccacccgaactgtttctgctgccccctgaactggtactcgaggttcccctggagcatcccacacttgaatggttcgccgctctggggctgaggtggtacgccctgccggcagtgagtaacatgcttcttgagattgggggtctggaattccctgccgctccattctctggatggtatatgtcaacagagatagggacaaggaacctgtgcgatccccacagatataacatcctggaggatgtggctgtgtgtatggacctggatacacgcactacctcaagcctctggaaagacaaggctgccgtggaaataaatgtggctgtcctccactcctatcagctcgcaaaggtgacaattgtggaccatcacgccgctaccgcctcttttatgaagcacctcgaaaatgagcaaaaagcacgtggaggctgccccgctgactgggcatggatcgtgcccccaatatccgggtctctcactcctgttttccaccaggagatggtgaattatttcttgagcccggcattcaggtaccagcccgacccctggaaaggatccgctgccaaaggcacgggcatcacccgcaagaaaactttcaaggaagtggcaaacgccgtgaagatctccgcctcattaatgggtaccgtgatggccaagcgggtaaaggctaccatcctgtatggctcagaaacaggccgtgcccagtcttatgctcagcagttgggcaggttgtttaggaaagcatttgatcccagagtcctgtgcatggacgagtacgacgtagtaagcctggagcatgaaactctggtattggtagtgacatctacattcggaaacggtgacccccctgagaatggagagtccttcgctgctgcccttatggagatgtccgggccttataactcatcccctagaccagagcagcacaaatcctataagatccgtttcaatagcattagctgctcggatccattggtaagcagttggcgcaggaaacgcaaagaaagctccaatacagactctgccggagccctggggacattgcggttctgtgtatttggcctgggatctcgtgcttatcctcacttttgcgctttcgcgagggcagtcgatacacgccttgaggagctaggaggcgagcgcctgctgcagcttggccagggagacgaactatgtggacaggaggaagcgtttcggggatgggctcaggccgcattccaagcagcctgtgagaccttctgtgtgggcgaagatgctaaagccgctgctcgggacatattctcccccaagagatcttggaagagacaaaggtaccgactctccgcacaggctgaaggtctgcagctccttccgggactgatccatgtacaccgcaggaagatgttccaagccaccatccgatcggtggaaaatctgcagagcagtaagtcaacgagggctaccattctggttagattagacacgggcggtcaggagggcctacaataccagccaggggatcatattggagtttgtcctcccaatagaccaggcttagtggaagccttactgtctcgggttgaggatccacccgcacctacagaaccggtcgcagtagagcagctggaaaagggtagtcctggcggaccacctccaggatgggtgcgagacccacgactgccgccatgcactctgcgccaggctcttacgttttttctggacatcacatccccaccatcacctcagctccttcggttactgtcaacactcgctgaggaaccacgtgagcagcaggaactggaggccttaagccaggaccccaggagatatgaagaatggaaatggtttcggtgccccaccctcttggaagtgttggagcagtttcccagtgtggccctacccgctcccctgctattgacacagctgccgcttctccagccacggtactattctgtgtcctccgccccttccactcatcccggagagattcatctcactgtggccgttttggcctacaggacccaggacggtctaggcccactgcattacggtgtttgttccacctggctctcccaattaaaacccggtgatcccgtgccatgttttattcgaggcgcaccctcctttaggttaccgcctgatccgtcgctcccctgcatcctggtgggcccagggaccgggatcgccccatttcgcggattttggcaggaacgcctccatgatatcgagtctaagggccttcagccaacgcctatgacattagttttcgggtgtagatgctcccaactcgatcatctgtaccgcgatgaagttcagaacgcacaacagaggggtgttttcgggagggttctgacagcatttagtcgcgaaccagataacccgaagacatacgtgcaagatatcttaagaaccgaactggccgcagaagttcatagagtcctgtgtcttgagcgtgggcacatgtttgtgtgcggtgatgtcacaatggccacaaacgtgctgcaaacggtgcagcgcattcttgccactgaaggggatatggaactcgatgaggccggtgatgtcataggcgtgctgcgagatcagcaacgctaccacgaagacattttcggcctgacattacgcactcaggaggtgacctcccgtattaggacacaatctttttccctgcaggaacgccagctgcgtggggctgtcccgtgggccttcgacccccctgggagtgacaccaatagcccttag

SEQ ID NO: 232787 - DNA, 2994 bp, Artificial Sequence
  Description of Artificial Sequence: Synthetic coding sequence
atgtttacatatatctgtaatcacatcaaatatgccacgaaccggggaaatctccgcagtgcaataacggtgtttccccagcggtgtcccggaagaggtgacttccgtatctggaacagtcagctggtgcgctatgcaggctacagacaacaggacggatccgtgcgaggggacccagcgaatgtagagataaccgagctgtgcatccagcatggctggactcccggtaatgggaggtttgatgttctcccattactgttacaagcccctgatgacccccctgagctcttcctccttcccccagaactggtccttgaggttccacttgaacaccccacgctggaatggtttgcagccctgggattgagatggtacgctcttcccgctgtgtctaatatgctcctggagataggagggctggagtttccagccgctccgtttagtggctggtacatgtcaaccgaaattggtacaagaaatctgtgcgatccccaccggtataacattctcgaagacgtggccgtgtgcatggacctggatactaggacgacaagctcattatggaaggataaggcagcggttgagattaatgtggctgtactgcactcctatcagctggcaaaagttactatcgtggaccatcacgcagctacagcatcttttatgaagcacctggaaaatgaacaaaaagccaggggcggatgtccagctgattgggcatggatcgtgccccctatcagcggatctctaaccccagtgtttcatcaggaaatggtgaactacttcctgtcccctgcatttagataccagccagatccgtggaagggctccgccgcaaaggggactggtataacccgcaagaaaacgttcaaagaagttgcaaacgccgtgaaaatatctgcttcccttatgggcacagtgatggctaagcgtgtgaaggccaccattttgtacggttccgagacaggacgcgcacaaagctacgctcagcagctgggaaggctcttccgaaaagccttcgatcctagagttctttgtatggatgagtacgatgtggtctctttggagcacgaaacccttgtgctcgttgtcaccagcactttcggtaacggagacccacctgagaacggcgaatccttcgcagccgctcttatggaaatgagcggcccttacaattcttccccaagacctgaacagcataagtcatataaaattcgcttcaatagcatcagctgttctgacccgctggtgtcctcatggaggaggaaaaggaaggagagtagcaataccgactcagcaggggctctggggaccttgagattctgcgtgttcggcctcggctctcgggcatacccacatttttgcgccttcgcacgtgcagtggacactcgactcgaagaactcgggggagagcgcttactccagctggggcaaggagatgagctgtgcggccaagaggaggcatttagggggtgggcacaagctgccttccaggcggcttgcgaaaccttctgcgtcggggaggacgctaaagccgcagcacgggatattttctccccaaaacgctcttggaaacgccagcggtacagattgagcgctcaggccgagggtctgcagctgctgcccggattgatccatgtgcatcggcgaaagatgttccaggcgacaatcagatccgtcgaaaacctacaaagcagcaaaagtacccgcgcaacaattctcgtcagactggatactgggggacaggagggcctgcagtaccagccaggcgaccatattggcgtgtgccctcctaataggccaggccttgtcgaggcgcttctctcccgagtggaggacccaccagccccaaccgagcccgtcgccgtggagcagctcgagaaaggcagccccggtggtcctcccccaggatgggtgcgggaccctaggctgcccccttgcactttgagacaggcgttgacattttttcttgatataacaagtcccccatcgccacagcttctgcgcttactgtcaaccttggcggaggaaccaagagagcagcaggagttggaagctctttcccaggatccgcgtaggtacgaagaatggaaatggtttcgatgccctacactgctggaagttctcgaacagttcccctcagtggcgctgcccgcacccttattgcttactcagctccctttactgcagccccgttactactccgtatcatcagccccatcaacccatccaggtgagatccacctgaccgtggctgtgctggcctatcggactcaggatggtttgggcccacttcattacggagtatgtagtacgtggctgtcacagttgaagccaggtgaccccgttccctgtttcatcaggggcgctccatccttcagactgccacctgaccctagtctcccgtgcattctggtcggaccaggtacaggcatcgcccctttccggggattttggcaggagagattgcacgatattgagtcaaagggcctgcagcccacgcctatgactttagtgtttggatgtcgctgtagtcagctggaccacctgtatagggatgaagttcaaaacgcacagcagagaggtgtcttcggtcgggtgcttaccgctttctctagagaaccagacaacccgaagacatatgtgcaggatattctgcggactgagctggctgctgaggtgcaccgggtgctttgtttagaacgcggacacatgtttgtatgtggggacgtcacaatggctactaacgtcctgcagactgtccagcgcatactagccaccgaaggtgacatggagctggatgaggcaggagatgtgattggcgttctgcgtgaccaacagcgttatcacgaggacattttcggcctgacactcaggactcaggaagtgacgagcaggatccggactcaaagcttttccctccaggaacgccagctgagaggcgctgtcccctgggcttttgatcctcctggttctgatacgaattccccctag

SEQ ID NO: 232788 - DNA, 1521 bp, Artificial Sequence
  Description of Artificial Sequence: Synthetic coding sequence
atgcgagaccccctgacggactgtccgtacaacaaggtgtataaaaacttgaaggagttttcacagaatggcgagaatttttgtaaacaagtgactagtgtccttcaacagagggcaaaccttgagatctcttatgcaaaagggctacagaagcttgcaagtaaactctctaaggcattgcagaacacaaggaaatcgtgcgtctcttcagcttgggcctgggcatctgaaggcatgaagtccacagcggacctgcaccagaagctgggcaaagcaattgaactggaggcaattaagcccacatatcaggtgctgaatgtccaggagaagaagcgcaagtcactggataatgaagtggaaaagaccgcaaatctcgtgatttcaaactggaaccagcagatcaaagctaaaaaaaagcttatggtctctactaagaagcatgaggctctgtttcaactcgttgaaagctcaaagcaaagcatgacagagaaggagaagagaaaactgcttaataagctgactaaatctacagagaagctggagaaggaggatgagaattactaccagaagaacatggccggatattcaaccagactgaaatgggagaataccctagaaaactgttaccagagcattctggaacttgagaaggagcggatccagctgttatgtaataatctaaatcaatacagccagcacatcagcctgtttggacagaccctgactacctgccacacgcaaatacattgcgcaatatcaaagattgatatagagaaagatatccaagctgttatggaagagacagcaattctaagtactgaaaataagtccgaattccttcttaccgattattttgaggaagacccaaattctgctatggacaaagagaggcgcaagtccttgttaaagcctaaactccttcgtctgcagcgggacatcgagaaggcttcgaaggataaggaaggtctggaacggatgttgaaaacatactcttctaccagctctttttctgatgctaaatcacagaaggacaccgcagctttaatggacgagaacaaccttaagctcgatctgctggaagcaaattcctacaaactgtctagcatgctggctgagctcgaacagcgaccccagcccagccacccctgcagtaatagcatctttcgatggcgagaaaaagagcacactcactcatacgtgaaaattagccgaccttttctcatgaagcgtctggaaaacatcgtgtctaaagcatcctccggcggacagagcaacccaggaagcagtactcccgctcccggagccgctcagctgagctccaggctgtgtaaggccctgtactccttccaggcccgacaggatgatgaattgaatctagaaaagggggatattgtgattatccatgaaaagaaggagggcggatggtggtttggaagtctaaatggaaaaaaagggcactttcccgctgcctacgtggaagaactcccttccaacgcaggcaatacagccaccaaagcctag

SEQ ID NO: 232789 - DNA, 1287 bp, Artificial Sequence
  Description of Artificial Sequence: Synthetic coding sequence
atgaaaagtactgcagatctgcatcagaaactgggaaaggccatcgaactggaggccatcaaaccaacctatcaggtgttaaacgtccaggagaagaaacgcaagtctctcgataacgaggtggaaaagaccgcaaacctggttatttcgaattggaatcagcaaatcaaggctaagaaaaaactcatggtttcaaccaagaagcacgaagcactgtttcagcttgttgagagctctaaacaatccatgaccgagaaggagaagcggaagctgctgaacaaactgacaaaaagcaccgaaaaactcgagaaggaagacgagaactactatcaaaagaatatggctggttattctacgcgcttaaagtgggagaacaccttggagaactgctaccagtcaatacttgagctggagaaggaaaggattcagctgctttgtaataacctgaatcagtattcccagcatatctctctctttggacagacactgactacatgtcatactcagatccattgcgccattagcaagattgatattgagaaggacatccaggcggtcatggaagagaccgccatccttagcacagaaaataaaagcgagtttctgcttacggactacttcgaggaggatcccaacagcgccatggacaaggagcggaggaaatccctattgaagccaaaacttctccgactccagagggatattgaaaaagcttcgaaagacaaggagggccttgaaaggatgcttaaaacctatagctccacctcgtcgtttagcgatgccaagtcccaaaaggacactgccgcactcatggacgagaataaccttaaactggacctgctggaggccaatagttacaagctctcctcgatgctggccgaactcgaacaacgtccacaacctagccacccctgtagtaacagtatattccgctggcgtgagaaagagcacacccactcatacgtcaagatctcacgtccttttctcatgaagaggcttgagaacatcgtgtcaaaggctagctccggcggacagtctaaccctggatcatctacacccgcacctggagcagcgcagctgtccagtcgactctgtaaagccctgtacagtttccaggcaaggcaagatgacgagctgaacctcgagaagggtgacattgtaattatccatgaaaaaaaagagggtggctggtggtttggctccctcaatgggaagaaaggccactttccagcagcttacgtggaggaactcccaagcaatgccggtaacactgccactaaagcctag

SEQ ID NO: 232790 - DNA, 1692 bp, Artificial Sequence
  Description of Artificial Sequence: Synthetic coding sequence
atgcgcgaccctctgacggattgcccctataataaggtttacaaaaacctgaaggaattttcacagaatggcgaaaatttttgcaaacaggtgaccagtgttctgcagcaaagggccaacctcgagattagttatgcgaagggactgcagaaattggccagcaagctgagtaaggcactgcagaatacccggaaatcctgcgtgagtagcgcttgggcttgggcctctgagggcatgaaaagcactgccgatctgcaccaaaagctgggtaaagcaattgagctggaagcaatcaaacctacttatcaggtgctgaacgtgcaggaaaagaaacggaaatcgctcgacaacgaggtcgagaaaaccgccaatttggtaattagcaactggaaccagcagattaaggccaaaaaaaagctgatggtctccactaagaagcacgaggccctttttcagctggtcgaaagctccaagcagagcatgaccgaaaaggagaagcggaagctgttaaataagctcactaagtcaacggagaagctcgagaaggaggatgagaattactaccagaagaatatggcgggatactccacacgtctgaagtgggagaataccctggaaaattgttatcaggtgacccacagtatttgtctgtatgccttctgggtaaagcgcgcttggggcaagtgtgtcagtgatttgcgatatcaagatacctttctccccggaaacctcccacccctgtggtttggctacgacattgttaaaagattaattatgaggttgtgttccgtgtgcctacagagtatcttggaacttgaaaaagaacgtatacagctcttgtgtaacaatctcaaccaatatagccagcacattagcctgttcggtcagacattgacaacatgtcatactcaaatacactgcgcgatcagtaagatcgatatcgaaaaagacatccaggcggttatggaggaaactgccatcctgtctaccgagaacaaatcggagttcctgttgacagactactttgaggaagatccaaactctgccatggacaaagagcgacgcaagtccctgctgaaaccaaagttgctgcggcttcaaagagatatcgagaaagcctccaaagacaaagagggcttggagaggatgttgaaaacatattcttccaccagctccttcagcgacgcgaagtctcaaaaagacactgcggcactcatggatgagaacaaccttaagctcgatctgcttgaagctaactcatacaagttaagcagcatgctggccgaactggagcaacgcccacagccctcccacccatgtagcaactccatctttagatggcgcgagaaggaacatacacacagttatgtgaagattagccggccattccttatgaaaagactcgagaatatcgtaagcaaagcgtctagcggcggtcagagcaaccccggtagcagcacaccagcgcctggagcagcacagttatcttctcgactttgcaaggcactgtactccttccaagcaagacaggacgatgaattaaacctcgagaagggagacattgtgattatccatgagaaaaaagagggtggttggtggttcggcagcctcaatggcaagaaagggcatttccccgctgcatatgtagaagaactgccctccaacgcaggaaatactgctactaaggcctag

SEQ ID NO: 232791 - DNA, 1692 bp, Artificial Sequence
  Description of Artificial Sequence: Synthetic coding sequence
atgagagaccccctgacggactgcccatataataaagtttacaaaaatttgaaggaattttcgcagaatggggaaaacttttgcaagcaggtgaccagcgtgcttcagcaaagagccaacctggagatatcctatgccaaaggacttcagaagcttgcctctaaactctccaaggctctgcagaatactcgcaaaagctgtgtctcatctgcatgggcctgggcctctgagggaatgaaatcaaccgcagatctgcatcagaagctggggaaggccatcgagctggaagctatcaagccaacttaccaggtcctcaatgttcaggagaagaagcgcaagtccctcgataacgaggtcgaaaagactgctaacttagttattagtaactggaatcagcagatcaaggccaagaagaagctaatggtatccacaaaaaaacatgaggcactgttccaactggttgaaagctctaagcaatcaatgacagaaaaagaaaagagaaaattacttaataagttaacgaagagcactgagaagctggaaaaggaggatgagaactattaccagaagaatatggcgggatactccacccgacttaagtgggagaatacgctagaaaattgctaccaggttacccacagcatatgcttatatgccttttgggtcaaaagggcatggggtaaatgtgtaagcgatctgcgataccaggacaccttcttgcccggaaatttgcctcccctctggttcggatacgatatagtcaagagactcatcatgaggctgtgttccgtctgcttgcagagtatcctggaactggaaaaggagaggatccagctgctctgtaataacctcaaccagtacagtcagcacatttccctatttggccagaccctgacgacatgccacacccagatacactgcgcgattagcaaaatcgacatcgaaaaggatattcaagctgtgatggaagagaccgcgatcttatcaacagagaacaagtctgagttcctgctgactgattacttcgaagaagatcccaacagtgccatggacaaagaacggagaaaatccctgctgaagccaaagctgctccgactgcagagggacattgagaaagcctccaaagataaagagggcctggaacgtatgctgaaaacctactcaagcacaagtagcttctctgatgccaaatcccaaaaggatactgccgcacttatggacgaaaacaacctcaagctcgatctcctggaggccaattcctacaaattgagttccatgctggcagagcttgaacaaagacctcaaccatcccacccctgtagcaactctatatttcgatggcgggaaaaggaacatacccacagctacgtcaaaatctcacgccctttcctgatgaagagattagagaatatcgtgtctaaagcctcaagcgggggtcagtcgaaccccggtagcagtacccctgctcccggagccgcacagcttagcagcaggctatgcaaagccctttattctttccaggcaagacaggacgacgagctaaacctggagaagggcgacatcgtgattatccacgagaaaaaggaagggggatggtggttcggtagtctaaacgggaaaaagggtcattttccggcagcatatgtggaagaactgcctagcaacgctggcaacacagcaactaaggcttag

SEQ ID NO: 232792 - DNA, 939 bp, Artificial Sequence
  Description of Artificial Sequence: Synthetic coding sequence
atgacatttggcctgcgcaagcgtctcagcgaggagcgcggtttcagcctcatgccaagagccatggcaatcagctcatcatcatgcgaactccccctggtcgccgtatgtcaggtgaccagtacaccggacaagcaacagaactttaagacttgtgccgagctggtgcgcgaggccgcaagattgggagcttgcctcgccttcctgccggaggccttcgacttcatcgcgagagaccctgctgagacacttcatctgtccgagcccctcggtggaaagctgctggaagagtacactcagctggccagagagtgcggcctgtggctcagtttagggggatttcacgagcgaggccaggactgggaacagacacagaagatatataactgtcatgtcctgctgaacagcaaaggcgctgtcgtcgccacataccgaaaaacacatctgtgcgatgtggagattcccggtcagggtcctatgtgcgagagcaacagcaccatgcccggacctagcctcgaatcaccagtgtccactcccgctgggaaaataggactggctgtgtgttacgacatgcggtttcccgagctcagccttgcccttgcacaagccggtgcagagatacttacatatccatccgctttcggaagtattaccgggccagcacactgggaagtcctgctgcgagcacgggcaatagagacccagtgttatgtagtcgccgcagctcagtgtggcaggcaccatgagaaacgcgcatcatacggacattctatggttgtggatccatgggggacagtcgtggcaagatgttccgagggtccgggtttatgcctcgccaggatcgacctgaattatctgcgacagttgcggaggcacctcccagtgtttcaacatcgcaggccggacctgtacggcaatttgggtcaccctctcagctag

SEQ ID NO: 232793 - DNA, 732 bp, Artificial Sequence
  Description of Artificial Sequence: Synthetic coding sequence
atgctcgggttcataacacgaccccctcatagattcctgagtttactctgtccaggcctcagaataccgcaactatccgtgctgtgtgcacagcccaggcctagagccatggcgatctcctccagctcctgcgagttgcccctcgtggctgtgtgccaagtcacttccacccctgacaaacagcagaacttcaagacctgcgcagagctggttcgcgaagccgctcggcttggagcgtgcctggcctttttgcccgaagcattcgactttattgctcgagatccagccgagactttgcatttgtccgaaccactgggaggaaaactacttgaagaatacacccaactagctcgggagtgcggactctggctgtccctaggaggtttccacgaaagggggcaggattgggaacaaacccagaagatttacaattgccacgttttactaaactcaaagggtgctgtcgtggctacttatcgaaagacacatctctgtgacgtcgagattccaggacagggaccaatgtgtgaatccaattctactatgccgggtccatcactcgagtccccagtgtcaactccagctggtaagatcggcctggctgtatgttacgacatgcggttccctgagctcagtttagcactggcccaggccggagctgagatcctgacctatccctccgctttcggctccataacgggaccagcccactgggaaccagtatcttcttag

SEQ ID NO: 232794 - DNA, 984 bp, Artificial Sequence
  Description of Artificial Sequence: Synthetic coding sequence
atgctcggcttcatcacgaggccgccacaccggtttctgtctcttttgtgcccgggattacgcattccccagctcagtgtgctctgtgcacaacctaggcctcgcgctatggccatatcctcaagttcctgtgaactgccactggttgcggtatgtcaggtcacatcgacgcctgataagcagcagaactttaagacctgcgcagagttggtgcgggaagccgcacgcttgggagcatgtctggcgtttctgccagaggctttcgactttatagcccgagatccagccgaaaccctgcatctctctgagcccctggggggtaagctgcttgaggaatatactcaactagcacgcgagtgtgggttgtggctatcgctgggcggatttcatgagagggggcaggactgggagcagacacagaagatttataactgtcatgtgctgttgaacagtaaaggtgccgtggtggcaacctacaggaagactcatttgtgcgatgtggagattccgggtcaaggcccaatgtgtgagagcaattcaacaatgccgggtccaagtcttgaaagccctgtgtctacccccgctggcaagattggtctggccgtgtgctacgacatgaggttcccggagttgtccctggccttggctcaggccggagccgaaatactcacatacccatccgccttcggtagcataacaggacctgcccactgggaagtcctcttgcgcgctcgggctatcgagacccagtgctacgtcgtggccgctgcgcagtgcgggagacaccacgagaagcgtgcctcctatgggcacagcatggtggtcgatccatggggaacggttgtggcccgttgcagcgagggacctggcctgtgtctcgctcggatagatctgaactatctccgacagcttaggagacacctccccgtgttccagcacagaaggcccgatctgtatgggaatctgggtcaccctctctcatag

SEQ ID NO: 232795 - DNA, 876 bp, Artificial Sequence
  Description of Artificial Sequence: Synthetic coding sequence
atggccattagtagcagttcatgcgagctgcctttagtggccgtatgtcaagtgaccagtaccccagataagcagcagaattttaaaacctgcgccgagttggtcagagaagcagcccgactgggcgcatgcctcgcgtttctgcccgaggcgtttgacttcatcgcgagagacccagcggagacactgcatctcagcgagccactggggggtaaattactggaggaatacacacagttggcccgagagtgcggactgtggctatcactgggcggttttcacgagcgtgggcaggactgggagcagacgcagaaaatctacaactgccacgtgctcctcaactccaaaggggcagtcgtggcaacctacagaaagacgcatctgtgtgatgtggagatccccggacaaggcccaatgtgcgaatctaacagcactatgccgggaccatcactggagagccccgtctctacccctgctggcaagattggtttagctgtctgctacgatatgaggtttcccgagctatctcttgccctggcccaggcaggcgcagagattctcacttacccaagcgctttcgggtcgattacaggacccgctcactgggaagtgctcctcagagctagggctatcgaaacacagtgctatgtagtcgccgctgctcagtgtggaagacaccacgagaagagggcttcctacgggcattccatggtcgtggatccttgggggaccgtcgtcgcccgttgtagcgagggaccagggctgtgtctggccaggattgatctcaattatctgcgacagctgaggcggcacttgcctgtatttcagcaccgcagacctgacctctatgggaacctggggcatcctttatcatag

SEQ ID NO: 232796 - DNA, 822 bp, Artificial Sequence
  Description of Artificial Sequence: Synthetic coding sequence
atgtccctgacaaatacgaaaaccggcttcagtgtaaaggacattctagacttgcccgacaccaatgatgaggaaggaagcgtagctgaaggacccgaagaagaaaacgaaggccctgaacccgcaaaaagggccggaccactgggacagggagctctggacgccgtgcagagtctccctttaaagaacccgttctatgactccagtgataacccatatactagatggttggcctccacagaaggcttgcagtattctttgcatggtctggccgctggcgcaccccctcaggactcatcctcaaagtctcctgagccatcagccgacgaatctcctgataatgacaaggagactcccggagggggaggagatgctgggaaaaagagaaagaggagagtgctattttctaaggctcagacatacgaacttgaacgacgtttcagacagcagaggtatctgtctgcaccggaacgcgagcacctggccagccttatacggctcacacctactcaggtcaagatttggtttcaaaatcaccggtataaaatgaaacgagccagggccgagaaaggaatggaggtgacgccccttccctcacctcggcgagttgcggttccagtgctggttcgcgatggtaaaccctgtcacgctctgaaagcccaggatctcgccgcagccaccttccaggcaggaatccctttttctgcctatagcgcgcaatctctgcagcatatgcagtataacgctcaatatagcagcgcctcaacacctcagtatcccacagcgcatcctctcgtacaggcccaacagtggacatggtag

SEQ ID NO: 232797 - DNA, 1065 bp, Artificial Sequence
  Description of Artificial Sequence: Synthetic coding sequence
atgtcgctgtcacccaagcacaccaccccattcagtgtgtctgacatcttatcccctatcgaggaaacctacaagaagtttagcggtgcaatggacggtgcacctcctggactaggagcgccactcggcgcagccgcagcatatcgagccccacctcccggtcccagctctcaggcagccaccgttgccggtatgcagcctagccacgcaatggcgggacacaatgctgcagccgctgccgctgctgctgcagctgcagctgcagccgctgcgacatatcacatgccacctggagtctcacaatttccgcatggggctatggggtcatattgcaacgggggtctgggcaacatgggagaactccctgcctataccgacgggatgcggggaggagccgcaactgggtggtacggagcgaacccggatcctagatactcttctatctcacgcttcatgggaccatctgccggagtaaatgttgctggaatggggtcactgactggcatcgccgatgcagccaagagtctaggccctttacacgctgccgctgcagcagctgctccccgtcgcaagcgacgggtcttatttagccaggcccaggtctacgagttggaacgccgattcaagcagcagaaatacttgtctgcacctgagagagaacatcttgcgtccatgatacacttgacaccaactcaagtgaaaatttggtttcagaatcatcgctacaagatgaaacgccaagcaaaggataaggcggctcaacagctgcagcaggaagggggtttgggcccaccaccacctccacccccatccccacgcagggtggccgtgcctgtgctggtgaaagatggaaagccttgtcagaacggggcatctactccaacaccagggcaggcaggtccccagcctcccgctcctacacctgcccctgagctggaagaactaagcccatccccccctgccctccatggaccagggggagggcttgccgctctcgatgcggcagctggagagtattcaggtggtgtgctgggggctaacctgctttacggaagaacttggtag

SEQ ID NO: 232798 - DNA, 975 bp, Artificial Sequence
  Description of Artificial Sequence: Synthetic coding sequence
atgtttccttctccagccctcactcctacccctttctccgtaaaagacatcctgaacctggaacagcagcaaagaagcttagccgctgccggagagctatccgccaggctggaggctacactggcaccctccagttgtatgttagctgcttttaaaccagaggcttacgcaggtccagaagccgcagcccctgggttgccagagcttagagctgagctcgggcgagcgccaagtcccgctaaatgcgcaagcgcattcccagcagcccctgccttctatcctagagcttactctgatccagatcctgcgaaagatcctcgcgctgagaaaaaagagttgtgtgccctgcagaaggctgtggagcttgagaaaaccgaggccgacaacgccgagcgccctcgtgctcgtaggcggcgtaagcctagagtactgttctcccaggcccaggtgtacgagttagagaggaggtttaagcagcagaggtacctttctgctccggagagggaccagctggcatctgtgctaaaacttacctctactcaggttaagatttggttccagaatcgccgttataagtgcaaacggcagagacaggatcaaacattggaactcgtgggactgccccctcctcctcctccaccagcacgcagaatagccgttccagtgctggtgagggatggaaagccgtgtttaggtgatagcgcgccttacgcaccagcctacggcgttggcctgaacccttacggttataacgcctaccccgcttatccaggatatggcggagcagcatgcagccccggttacagttgcaccgccgcttatcccgcaggtccttccccagctcagcctgccaccgccgctgctaataataattttgttaattttggagtcggcgatctgaacgccgtccagagccctggtattcctcaatctaattcgggcgtgtccactttacatgggatccgcgcatggtag

SEQ ID NO: 232799 - DNA, 339 bp, Artificial Sequence
  Description of Artificial Sequence: Synthetic coding sequence
atgtttccgagtcccgcactcacacctacacccttttcagtcaaggacatcctgaatctagagcagcagcagaggtccctggcagccgctggagagctcagcgccaggttagaggccaccctcgcacccagcagttgcatgctggctgcctttaagcctgaggcctacgccggacccgaggctgccgctcccggactgcctgaactgcgcgcagaactcggcagagccccaagcccagcaaagtgtgcctccgcctttcccgctgcgcctgcattctacccacgcgcttacagcgatcccgatccagcgaaagatccccgagcagaaaaaaaggcttag

SEQ ID NO: 232800 - DNA, 456 bp, Artificial Sequence
  Description of Artificial Sequence: Synthetic coding sequence
atgtttccgtcgcctgctcttaccccaacccccttcagcgtaaaggacatcctaaatctggagcagcagcagaggagcctggccgctgcaggagagctgtcggcaagattggaagcgactctcgcaccctcctcctgtatgttggccgctttcaaaccggaggcatacgccggtccagaggcagcagccccaggacttcctgagctccgtgcggagctcggcagagcacctagtcccgcaaagtgcgcctccgccttccctgcggctcccgctttttatcctcgggcatattccgacccagatcccgctaaggacccacgtgctgagaagaagggatgtgagctaccaaggggtcaacgacctcccgtcctttttagctccgctctctctcagccggatttccttcagatgctttcagagacatgcagatggctccctgtccacctggcagaatag

SEQ ID NO: 232801 - DNA, 906 bp, Artificial Sequence
  Description of Artificial Sequence: Synthetic coding sequence
atgcttctgtctcctgtgacaagcacaccattttctgtcaaagatatcctcaggcttgaaagggagcggagctgccccgcagcttctccacatccaagggtcagaaaatctcctgagaatttccagtacttgcggatggacgccgaacccagagggtccgaagtgcataacgcagggggaggcggtggcgatcggaagctagacggctcagagcccccaggcggtccttgcgaagccgtgctggagatggatgctgaacgaatgggggagccccagccagggcttaacgccgcatcgcctctgggtgggggaaccagagtgccggaaagaggggtgggtaacagcggcgacagcgtacgcggagggagatcagagcagccgaaagcacggcagaggcggaaacccagagtcctcttctctcaggcccaggtgctggccttggaaagacgttttaagcagcagcgctatctctctgcaccagagcgcgagcatcttgcttcagcactgcaactaacatctactcaggttaaaatttggttccagaatcgtcgctacaagtgtaagaggcagaggcaagacaagtctctggagctggctggacatccactgacgccacgcagggtggccgtgcccgtgctggtgagggatggtaaaccatgtctcggccctggacccggagccccagccttcccaagcccatattctgctgcagtgtcaccctatagctgctatggtggatatagcggcgcaccttacggcgctggctacgggacatgctatgccggagcaccctccggccctgctccacacacaccactggcaagcgctggcttcggccatggaggacagaatgcgaccccccagggccacttggcagcgaccctgcaaggagttagagcgtggtag

SEQ ID NO: 232802 - DNA, 660 bp, Artificial Sequence
  Description of Artificial Sequence: Synthetic coding sequence
atggatgccgagcgcatgggggaaccacagcctggattgaacgctgctagtccactgggcggagggacacgggtacccgagcgtggcgtcggtaacagcggcgattccgtgcggggtgggcgatccgagcagcctaaggcacgccagcgccgaaagcccagagtgttgtttagccaggcccaggtcctggcgcttgagcgacgctttaaacagcagcgatacctgtccgctcctgagcgcgaacacctggccagcgccctgcaactcacaagtactcaggtgaagatctggttccagaatcggaggtataagtgtaagcgacaaagacaagataagtctttggagttggccggtcacccgctaactccacgcagagttgccgtccccgtcttggtgagagacggcaagccttgtctgggccctgggcctggagcaccagccttccccagcccttacagtgcggcagtctccccttattcttgctatggcggatatagtggtgccccttatggcgcaggttacggtacctgttacgcgggagcaccctctggtcccgctcctcacactcctctagcatccgccggtttcggtcatggaggccaaaatgccacccctcagggtcacttggccgctacgctgcaaggggtacgcgcatggtag

SEQ ID NO: 232803 - DNA, 720 bp, Artificial Sequence
  Description of Artificial Sequence: Synthetic coding sequence
atggccacatcagggcgtttgtcttttacagtccgttctctgttggatttgcctgagcaggatgcacaacacctgccacggagggaaccggagccaagagccccacagccagatccatgcgccgcatggctcgacagcgaaagaggccactatcccagctccgacgagtcctcccttgaaacatcccctcccgatagtagtcagcgcccatctgccaggccagcctctccaggaagcgacgccgagaagcgaaaaaagcggagggtgttgttcagcaaagcacagacccttgaactggaacgtcggtttagacaacaacgttacctctcagcgccagaaagggaacagttagccagcctgcttcgtctgaccccaacgcaggtcaagatttggttccagaatcatcgctacaaactgaagagggcgagggccccaggcgctgccgagagtcccgacctggccgcatctgcggagcttcacgcggcaccagggctgcttcgtcgcgtcgtggtccccgtgctggtgcgcgatggccaaccatgtggcggaggaggtggaggagaggttggtactgcagccgcacaagaaaagtgcggagcccctcctgctgccgcatgcccactgcctggctatcccgcattcggaccaggctctgcactgggtctgtttccagcctaccaacatcttgcatcccccgcactcgtgagctggaactggtag

SEQ ID NO: 232804 - DNA, 1002 bp, Artificial Sequence
  Description of Artificial Sequence: Synthetic coding sequence
atggccgtgcggggagccaatacactgacatctttcagcatccaggccattcttaacaaaaaagaggaacgtggcggactggccgctccggagggtcgtcccgctcccggaggaaccgctgcttccgtggcggctgctcctgcagtgtgctgctggaggctattcggggaaagggatgctggagcactcggtggggctgaagactctctgttagctagtcccgctggaactcggacagcagctggccgaaccgccgagagtccggaaggttgggactctgactccgcactttctgaggaaaatgagtcccggagaagatgcgccgatgcgaggggagctagcggagcgggtttggctggcggatcgttgtcgttgggccaacccgtatgcgagctggccgcaagcaaagatctggaggaagaggccgcaggtcgctctgactcggaaatgagcgcttctgtgtccggcgaccggtcacctaggacagaggatgatggagtcggccctagaggcgcacatgtgtctgccctgtgcagcggagctgggggaggcggtggctcaggccctgccggtgtggcagaagaagaggaggagccggctgcccctaaacccaggaaaaagcgatcccgtgccgctttctcccacgcccaggtctttgaattggaaaggcggttcaaccaccagaggtatctgagcggcccagaacgtgcggatctagcagccagtctgaaactgactgagacccaggtgaaaatctggttccagaaccgaaggtataagactaaacggagacagatggctgccgatcttcttgcctcagccccagccgcaaagaaagttgcagtcaaagtgctggtgagagatgaccaaagacagtatctgccgggagaggtgcttcgtcctccaagtctcctgccgctgcagccgtcttactactatccctactattgtctgccaggatgggctctgtccacctgcgccgcagccgctggtacacaatag

SEQ ID NO: 232805 - DNA, 798 bp, Artificial Sequence
  Description of Artificial Sequence: Synthetic coding sequence
atggagtcaaacctacagggaaccttcctgttgaacaacactccactggcacagtttcccgagatgaaggctccagtttgtcagtattcagtccagaactctttttacaagctaagtccccctggccttggaccccagcttgccgcaggcaccccgcatgggataaccgacatcctttcgagaccagttgccgcacctaacaatagcctcctgagtgggtacccgcatgtcgctggcttcgggggacttagttcccaaggggtctactactcacctcaagttggcaattttagcaaggcaggaaacgagtaccctacaagaactcgaaattgttgggctgacacaggccaggattggagaggagggaggcagtgttccaatactcctgatcccctgagcgacagtatccacaagaaaaaacacacccgcccaacattcactggacaccaaatcttcgccctggagaagacctttgagcagactaaatacctggctggtcccgagcgggcacgactcgcttatagtttaggtatgaccgaatctcaagttaaggtatggtttcagaaccgtcggaccaagtggaggaagaagagcgcgttagagcctagctcatcgactccgagggcacctggaggcgcaggcgctggcgctggcggtgatagggcaccatccgagaacgaggacgatgagtataacaagcccctggatcccgattctgacgacgaaaagatccgcttgctactcaggaagcacagggcagcgtttagcgtgctttccctgggggctcactctgtctag

SEQ ID NO: 232806 - DNA, 408 bp, Artificial Sequence
  Description of Artificial Sequence: Synthetic coding sequence
atgcaacaaggtcagctagccccaggctctcgactctgctccggaccttggggtctcccagaactgcagccagcagccccttcctcctccgccgcacagttgccctggggggagtcctggggagaagaggcagacacaccagcatgcctctcagcaagcggcgtttggtttcaaaatcggaggacaaagtggaggaagaaaagcgctctggagccaagctccagcacccctagggctccgggaggtgctggggctggggcaggtggagatagggcaccatccgagaatgaagacgatgagtacaataagccactggacccagactccgatgacgagaaaatcaggttactcttgcggaagcatcgagcggcattctccgtcctttcccttggggcacattctgtctag

SEQ ID NO: 232807 - DNA, 2928 bp, Artificial Sequence
  Description of Artificial Sequence: Synthetic coding sequence
atgaggtggggccaccatctcccccgtgcaagctggggatctgggttccggcgtgccctccagaggccagatgaccgcataccctttctcatccattggagctggccactccaaggtgagcggccattcggcccacccagagcgtttatccggcatcatggatcctctgtcgattctgcaccaccacccggtcgacacggtcggctgttcccgagtgcctctgctacagaggccattcagagacacaggcgcaacctcgcagagtggtttagcaggttgccccgagaggaacgtcaatttggacccacctttgcgctggatactgtgcatgtggacccagttattagggaaagcacacctgatgaactcctgcggcctccagcagagctggcgctggagcaccaaccaccccaagctggactccctccactggccctgagccaattattcaatccagacgcctgcggcaggcgtgttcagacggttgtcttgtacgggacagtcggcaccggcaaatctaccttggtgcggaagatggtgttggattggtgttacgggaggctgccagcattcgagctgctcataccattttcctgcgaggatctttccagtctaggacctgccccagccagcttatgtcagctggtggcacagcggtatactcctctcaaggaggtgctgccccttatggccgcagccggatcccacctgttgttcgttcttcatggtctggagcacctgaacttggacttccgactagccggaactggcctttgctccgatccggaggagccacaagagcccgctgcaatcatagtaaatttattgagaaagtatatgctcccacaagccagtatcttggtcacaacacggccatcagccataggtaggattccttccaagtacgtgggcagatacggggaaatttgtggtttctccgacaccaacctccagaaactctatttccagttacgcctgaatcagccttattgcggttacgcagtgggaggctctggggtgtccgccacccccgctcagagagaccacctggttcaaatgctgagccgcaatctggagggacaccaccaaattgcagcagcgtgcttcttgcccagttactgctggctagtctgcgctacccttcattttctacatgcccctacacccgctggccagactctcacgtctatctacacctcctttctacggctgaatttcagcggggagaccttggattcaactgatccatcaaacctcagtctgatggcatacgctgctcggacaatggggaagctcgcctatgagggagtgtcgagccgcaaaacttacttttctgaagaggatgtatgcggatgcctggaggcgggtattagaacagaggaggagtttcagttactccatatctttaggcgcgacgctttgaggtttttcttggcaccatgtgtcgagccgggtcgggctggcacttttgtgtttacggtgcctgctatgcaagagtacctcgcagcgttgtatatcgtcctgggactgaggaaaactaccctccaaaaagttgggaaggaagtggctgagctggtcgggagagttggtgaagacgtctccctggtgttggggatcatggccaagcttctgccccttagggcacttccactcctttttaacctcatcaaagtcgtgcccagagtctttggccgaatggttggaaaaagccgagaagcagtcgcacaagctatggtcctggagatgtttcgggaggaggattactataacgacgacgtcctggatcaaatgggggctagtatcctgggtgtggaaggtccgcgacgccatcctgatgagccgcctgaggacgaggtattcgaactgttccctatgtttatgggaggcttgctgtctgcgcacaaccgggctgtcctagctcaactgggctgccctattaagaacctcgatgctttagaaaatgcccaagccattaaaaagaagctcggaaagctgggcagacaggtactccccccttccgagctgctggatcatctttttttccactacgagtttcagaatcagcggttttccgcggaggttttgagctctctacggcagcttaatctcgcgggtgtgaggatgacaccagtcaagtgcacagtcgtagctgccgttctggggagcggcagacatgctctggatgaagtgaatctagcttcatgccagctagaccctgcgggacttcgcactcttctgcccgttttccttcgagccaggaaactcggacttcagctcaatagcctcggcccagaggcctgcaaggacctccgcgacctcttactccatgaccaatgccagattaccaccctgcgcctgagcaacaatccactgaccgctgcaggcgtggctgtgctgatggaggggttggcaggcaatacgagcgtgacccatctaagtttactgcatacaggtctgggggatgaggggctggagcttctggccgctcaactcgacaggaatcggcaactacaggagttaaatgtcgcttataatggagcaggcgacacggcggcactcgcgcttgcacgagctgcacgcgagcatcccagccttgagcttttgcacctctatttcaatgagttatcctccgagggaagacaggtactgagagacctaggcggagctgccgagggtggggcaagagtggtggttagcctcacagagggcacagccgtgtcagagtattggtccgtaatcctgagcgaggtgcaacggaacctcaactcttgggaccgggcaagagtgcagaggcacttggagctgctcctgagggatcttgaagattccagaggggcaacattaaacccttggcgcaaggcccagctactgcgagtagagggcgaggttcgtgcattgctcgagcaactcgggtcgagcgggtcttag

SEQ ID NO: 232808 - DNA, 345 bp, Artificial Sequence
  Description of Artificial Sequence: Synthetic coding sequence
ggaatctcaaagctcaaaatggtgaaccagtgttttggtctgggcgacggcacttgcttgctgagtatccaactggagggccctaaacatgtggcattcggctggccggaatgccccgaggcaccactcccaaccctgcctccccctccactcaaggagcctctaacagtgagtccacgtggaagccatttaatgtcggccatgcctggggtttcgccttcaagatgtgtcggctccttcccctcctgtttgatgctaacttgcggacaccgcggttgtcctcacatcggcgcattctcatcttcttcttgccccctgtgccacaacggcatgatggcctggtag

SEQ ID NO: 232809 - DNA, 2928 bp, Artificial Sequence
  Description of Artificial Sequence: Synthetic coding sequence
atgaggtggggccaccacctccccagagcttcatggggatcggggtttagacgagccttgcagaggcccgatgacagaatcccttttctaatccactggtcttggcccctgcagggcgaacgcccatttggccctccccgtgcatttatcagacaccatggttcatcagtggattctgcccctcccccaggccgtcacggcaggttatttccttcagcttcagcaacagaagcaattcagcgccatcgcaggaacctggcagaatggttttcccgactgcccagggaggagcgccaatttgggcctacgtttgccctggatactgtacacgtggatcctgtgattcgcgaaagcactccagatgagctgttacgtccacctgctgaattggctctagagcaccagccaccccaagccggtctcccacccttggccctgtctcaactcttcaaccctgatgcttgtgggagacgggtacaaaccgtcgtgctgtatggcactgtcggcacaggcaagtctactctggtgagaaagatggtgctggactggtgttacgggaggctacccgctttcgagctgctgattcccttcagttgcgaggatctttctagcctggggcctgctcccgctagtctttgtcagctggtcgctcagaggtatacaccgctcaaagaggtgctcccgctgatggccgctgcagggtctcacctgcttttcgtgttgcatggtttggaacacctcaatctcgactttagattagcgggaactggactgtgctccgatcccgaagagccgcaggagcccgcagccattatcgtaaacctgcttcggaagtatatgctgcctcaagcaagcattctcgtaaccactaggccatccgcgattggccgtattcctagtaagtatgtggggcgatatggcgagatttgtgggttcagcgacaccaacctccagaagctgtactttcagctgaggctgaaccagccctattgcgggtacgccgtgggcggatctggggtgtccgcaaccccagcccaacgcgaccacctggtgcagatgctgagcaggaacctcgagggacatcatcagatcgcggctgcctgtttccttccctcctactgttggctggtttgtgccactctccattttcttcatgctccaactcccgctggtcaaactctcacctcaatatacacatcctttctgcggctcaacttctctggagaaacacttgatagtactgatcccagtaacctgtctttgatggcgtatgccgcacgaacaatgggaaaactggcttatgaaggggtgtccagccgcaagacctactttagtgaagaagacgtgtgcggctgcttagaggccggtatccggaccgaggaggagttccagctcctgcacattttccggcgagatgcactcagatttttcctggcgccatgtgtggagccaggacgggcagggactttcgtcttcaccgttcctgccatgcaggagtatctggccgcactttacatcgtcctgggattgaggaaaacaactctgcagaaggttggtaaagaggtggctgagctcgttggcagggtaggcgaagatgtgtccttggtattaggtattatggccaaactcctacctctgcgggcactgccacttctgttcaatcttatcaaagtggtgccaagagtgttcggcagaatggtcgggaagagtcgggaggctgttgctcaggccatggtgttggagatgttccgcgaggaagactactataatgacgacgtgctggatcagatgggagcatctatcctgggagtggaaggccctaggcgccatcccgacgagcctcctgaggacgaagtgttcgagctctttccgatgttcatgggcggtctcctgtcagcccacaatcgggcagttctcgcgcagctggggtgccccatcaaaaacctggacgccctggagaatgcacaggcaattaagaagaagcttggcaagctgggtaggcaagtgttacctccatccgagctcttggatcaccttttcttccactatgagtttcaaaaccaaagattcagtgctgaagttctcagcagtctgcgtcagctgaacctcgcaggcgtccgcatgacacccgtgaaatgcactgtagttgctgctgtcctcggatcagggcgacacgccttggatgaggtgaatctggcctcatgccaacttgatcccgctggcctacggacattgcttcctgttttcctgcgcgctagaaagcttgggctgcagctcaacagcttgggtcccgaggcatgcaaggacctccgtgacctgctgttgcacgaccagtgccagataaccactttgcgtttaagcaataacccactaacagctgcaggggtggccgtcctgatggaggggctggccggtaacacatctgtaacacacttatctctcttgcacactgggttgggcgatgagggcctggagttactcgctgcacagctggatagaaatcggcagctgcaggaacttaatgttgcctacaatggagctggagacacagctgcacttgcactggccagagccgctcgtgagcaccctagtcttgagctgctgcatctctatttcaatgaactgtcctctgaaggacgtcaggtcctgcgcgacctgggaggggcagcagagggcggtgcccgtgtggtggtttccctgacagagggaaccgccgtcagcgaatactggtccgtcattctgtcggaggtccaaaggaacctgaactcctgggaccgcgcaagggttcagagacacttggagctgcttctgagggatctggaagactcccggggagcaaccctaaatccatggcggaaggcgcagctgctcagggtggaaggagaagtgagggccttgttggaacagcttgggtcttcgggatcttag

SEQ ID NO: 232810 - DNA, 2766 bp, Artificial Sequence
  Description of Artificial Sequence: Synthetic coding sequence
atgaggtggggtcatcatttaccacgggcttcttggggcagcggattcaggcgagcgttgcaaagacccgacgaccggatacctttcctgatccactggagttggcccttgcaaggcgaaaggccatttggcccaccacgcgctttcatcagacaccatgggtcttctgtcgactcagctccgcctccagggagacacggcagactattccccagtgcgtcagccactgaggctattcaacgtcatcgcaggaacttggccgaatggttttcccgactaccacgcgaagagaggcagtttggacccacatttgccctggacacggtccatgtggacccagtgattagggaatctacacccgacgagttgctcaggcccccagccgagctcgccctggaacaccagcccccacaagccggactgcccccattggcactctcgcagctgttcaacccagatgcctgtgggaggcgggtgcagactgtggtcctgtatggcaccgtggggactggaaagagcaccttagtgaggaagatggttttagattggtgttacggacggctgccagcctttgagctgctgattccgttttcctgtgaggacctgagctcccttggaccagcacccgctagcctgtgccaactggtggcacagaggtacacccctctgaaggaagtgctgcctctgatggccgcagccggttcacacctcctctttgtgttgcatgggctcgaacaccttaatctcgatttcaggttggccggaaccggtttgtgttctgacccagaggaaccacaggagccggctgccattattgtcaacctacttcggaaatacatgctgcctcaggcctctattctggtgacaacaaggccatcggcaataggaaggatcccctcgaaatacgtgggaaggtacggggagatttgcgggttcagcgatacaaaccttcagaaactctattttcagctgaggctaaaccagccatactgtggttatgcagttggaggtagcggtgtgtctgctaccccggctcagagggaccacctggtccagatgctctcacggaatctcgaggggcaccaccagattgctgcggcttgctttcttcccagttactgttggctcgtatgtgccaccttacactttttgcacgctcctacccccgctggacaaacactgacatcaatctacacctcatttttaagattgaatttttcaggcgagactctggactcgacggacccaagcaacttgtccttaatggcctacgccgcacgtacaatggggaagctagcctacgaaggagtctcatcccgcaagacatatttctccgaggaggacgtgtgtggctgtctcgaagcagggattagaacagaagaagagtttcagttactgcacatttttcgtcgggacgctttgaggttcttcctggctccatgtgtggagcctggcagggccggtactttcgtcttcaccgtgccagccatgcaggaatatctcgcagctctgtacattgttctgggactgcgcaagacaaccctgcaaaaggtcgggaaagaagtggctgaactcgtaggccgagtgggggaagacgtgagcctcgtcttgggcattatggcgaagctgctacccctgagggccctgcctttgttgttcaacctgattaaagtcgttcccagggtgtttgggcgtatggtcggcaagagccgggaggcagtggcccaggccatggtgctggagatgtttagagaggaagactactataacgatgacgtcttggaccagatgggggcaagcatactgggggtcgaagggccacggaggcatcctgacgaacccccagaagatgaggtgttcgaactgttccccatgttcatgggaggcctgctgtccgcacacaatcgcgcagttctggctcagttgggctgtcctattaagaatttggatgccctggagaatgctcaggcaattaaaaagaagttgggtaagctgggtcggcaggtactgccgccatctgaacttctggatcacctgttcttccactacgaatttcagaatcaaaggttttctgccgaggtgctgtccagtttacgccagctgaacctagcaggcgtgcgcatgactcccgtaaagtgcaccgtggtcgcggcagtgcttggatctggccgtcacgcactcgacgaagtcaatctagccagttgccaactggaccccgctggcctccgcaccttgctcccggtgtttctacgggctagaaaacttgggctccagcttaatagcttgggtcctgaagcctgcaaggatctgcgagacctgcttcttcacgatcaatgtcagatcacaactctgcgcctctctaacaatcctctgacggctgccggagtagctgttctcatggagggcctcgcaggcaatacaagcgtgactcatctctctctgttacacacaggactgggagacgagggcttagaactgttagcagcccaactcgataggaatagacagctgcaggagctgaacgtggcctataatggggctggagataccgccgctctcgctttagcacgagctgcacgcgaacacccctccctggaattgctgcagggcgtcgccattcagatgtgctggaagctgccactgctcccatatgcccatctgtggacccctcggatgccctctcattggtgctttctgctgatactaatgcctcctctgccccagtggtatgatgggctggtggccccaagggggcgttgtacgtag

SEQ ID NO: 232811 - DNA, 2928 bp, Artificial Sequence
  Description of Artificial Sequence: Synthetic coding sequence
atgagatggggacaccacctcccgagggcttcctggggtagtggtttccgcagagcactgcagcgccctgacgaccgcatacccttcctcattcactggtcttggccactccagggcgagaggccatttggtcccccaagggccttcattcgccatcacggcagttctgtggattctgctcctcctccagggagacacgggagactatttccctctgcctctgccacagaagcgatccagaggcaccgcagaaacctcgcagagtggttcagcagactgccaagagaggaacggcagtttggccctacatttgcattagataccgtgcacgtggatcctgtgatccgagaatcaacaccagacgagctgctcagaccccctgctgagttggccctggagcaccaaccccctcaggcagggctccctcccctagcactaagccaactgtttaacccagatgcgtgtggccgtagagtacagacagtcgtgctgtacggcacggtcgggactgggaaatccaccctggtgagaaagatggtgttggattggtgctacggccgtttgcccgcatttgagctccttatccctttctcttgtgaggacttgagctctttaggcccagccccagcctctctctgtcagctggtggctcagagatatacaccgctcaaggaggtgctgcctctcatggctgcagctggatctcacctgctgtttgtgctgcatggcctggaacacctcaaccttgactttcggttggcgggtacaggcctctgttccgatcccgaggagccacaggagcccgctgcaattatagtgaatctgctgaggaagtacatgttgccgcaagcatcaatactggttaccacacgcccttctgccattggaaggatcccctcgaagtacgtgggaagatacggcgaaatctgcggcttttctgatactaatctgcaaaaactttatttccaattgcgcttgaatcagccatactgtggatacgctgttggcggtagcggagtgagtgcaaccccagctcaacgggatcacctggtccaaatgctgtccagaaacctggaaggacatcatcaaattgcagctgcatgctttctgccaagctactgctggctggtttgtgcaacacttcactttcttcacgcgccaaccccggctggccagaccctgacctctatttatactagttttctcaggttgaatttttctggcgagactctggattctacagaccctagcaacttgtccctgatggcttacgccgctaggactatggggaaattagcctatgagggcgtgagttcaagaaaaacctattttagtgaagaagacgtatgcggatgcctggaagctggcatacggacagaagaagaattccaattgttacatattttccgaagagatgcactgcgattcttcctcgcgccatgcgtcgaacccggtcgggctggtaccttcgtgttcacagtaccggcaatgcaggagtatctcgccgcactgtacatcgtgttgggccttcgcaagactacgcttcaaaaagtgggaaaggaagtggcggagctcgttgggagggtgggtgaggatgtgtctctggtgctcggaatcatggcaaaactattgccgctgagagccctcccccttcttttcaaccttattaaggttgtgccgagagtctttggtcgcatggttggaaaatctcgggaagccgtcgcgcaagctatggttcttgaaatgtttcgcgaagaggattattataatgacgacgtgctggaccagatgggggcaagtattttgggtgttgagggaccacggaggcaccctgacgaacctcctgaggatgaagtttttgagttgttccccatgtttatgggaggcttgctgtcagcccataatcgggctgtactcgcccagttgggttgcccaatcaaaaacctggacgccctggagaacgcccaagccatcaaaaagaaacttggaaaactggggcgacaagtgctacctccctcggaactgctggaccatctgttcttccattacgagtttcagaaccagagattctccgcagaagtactgagttctttaaggcagctcaacctggctggagttaggatgaccccagttaagtgtaccgtcgttgcagccgttctgggaagcggcagacatgctctggacgaagtcaatctcgccagctgccagctggacccagcaggactaaggactttgctccctgtgttcctgagagctcggaaactgggactccagttgaacagcctcggacctgaggcctgcaaggacctgagggatctcctgctgcacgaccaatgccagatcacgactcttcgattgtcaaataacccattgactgctgcaggcgtggccgtcctcatggaggggttagccggtaacaccagcgtgacccaccttagcctgctgcatacgggcctgggcgacgaaggcttggaattactggctgcccagttagatcgaaacagacagctgcaggagttaaatgtggcctacaatggcgctggtgacacggctgcgctggccttagcgagagccgctagagagcatccatcattagagctgcttcacctctacttcaatgagctatcaagcgaaggcaggcaggtgctgcgggacctgggtggtgcagcagagggcggtgccagggttgtggtgagtctgacggagggaacagccgtttctgaatattggtcggtcatcctgagcgaagtgcagagaaatctgaattcatgggacagagcgcgtgtccaacggcacttagaacttttgttgcgcgacctcgaagactcccgtggagcaaccttgaacccctggcgaaaggcacagctcctgcgcgtggaaggggaagtgcgggctcttctggagcagctgggaagctcggggtcctag

SEQ ID NO: 232812 - DNA, 2766 bp, Artificial Sequence
  Description of Artificial Sequence: Synthetic coding sequence
atgaggtggggacatcacctgcctagggcaagttgggggagcgggttccgaagggccctgcaacgcccagacgaccggatcccattcctgatacactggtcctggccactacagggcgagcggccttttggccctcccagggctttcatccgccaccatggtagctcagtggatagcgccccacccccaggcagacatggtcgccttttccctagcgcaagcgcgactgaagctatccagcgccatcggagaaatttggctgaatggttttccaggctccctcgagaagagcgtcagttcggacctacctttgcgctggatacagttcacgtagatccagtgatacgcgaaagtaccccggatgagttgctgcgcccaccggctgaactagccctggaacaccagcccccacaggccggactgccaccgttggctctctcgcaactgttcaatccagatgcatgcggccgaagagtgcagaccgtggtgctgtatggaaccgtagggacagggaagtccacgttagtccggaagatggtgctggactggtgttatggacgactgcccgcattcgagctgctgattcccttttcttgcgaggacttgtccagccttgggccagctccggctagcctgtgccagcttgttgcccagcgctatacccccctcaaagaagtcctgccactgatggccgctgccggaagccatttactctttgtgttgcatggcctcgagcatctgaatctagacttccgtttggcaggcactggcttgtgcagcgatccagaagagccccaagagcctgctgccatcatcgtcaacctgctcagaaagtacatgctgccacaggcctcaattttggtgacaacccggccttcagctatcggccgtattccctcaaaatatgtgggacggtatggcgaaatctgtggcttctcagacacaaacctgcagaagctgtattttcagttgcgcctgaaccaaccctattgcggttacgccgttggaggcagcggggtcagcgccacgccagcccagagagatcacctagtgcaaatgcttagccgtaacctcgaaggacaccatcagattgcagctgcctgcttccttccctcatactgctggctagtgtgtgcgactcttcatttcctgcatgcgcctacccccgctgggcaaacgctcacttccatctatacctccttcctgaggctaaacttctccggcgagaccttagactctactgacccgtcaaatctgagccttatggcttacgcggcaaggaccatgggtaagttagcgtacgaaggggtgagttcgcgtaaaacctatttttcagaggaggacgtgtgtggctgcctcgaagccggtatacgcacggaggaagagttccagctgcttcatatttttaggcgcgatgctcttcggttctttttggctccatgtgtggaacccggtcgcgcaggcacttttgtctttactgtacccgcaatgcaggagtaccttgccgctttgtatattgtgctgggcttaagaaaaaccacgttgcaaaaagtgggcaaggaggttgccgagctcgtggggagagtcggcgaagacgtgtccctcgtgttgggaatcatggccaagctgctacccctgcgcgctctcccactcttatttaatctgattaaggtcgtgccgcgagtgttcggaagaatggtcggcaagtcgcgcgaagccgtcgcacaggctatggttctggaaatgtttagggaagaagattattataatgatgacgtgctcgatcaaatgggtgcttctattctgggggtagagggcccacggagacacccagatgagccgcctgaggacgaggtttttgagctgtttcccatgtttatgggaggcctactgagcgcacataaccgtgcagtgctggcccaacttggttgcccaatcaagaatttggacgccctcgagaacgcccaagctattaagaagaaattgggaaagctcggcagacaagtgctaccacctagcgagctcctggaccacctgttctttcattacgaattccagaaccaacggttttcagccgaagtgttaagctctctgaggcagttgaacttggcaggagtgaggatgacgcccgtgaagtgtactgtggtggccgctgtgcttgggagtggcagacacgccctggacgaggtgaatttggcttcttgccagcttgaccccgctggactccgtaccctgctgccggtgtttctcagagcacggaagctcgggctccagctgaactctcttggaccagaggcatgcaaagacctgcgggacctgttgctccacgaccagtgccagattacaaccctgcgattatctaataacccgttgacggccgcaggcgtggcagtcttgatggaaggactggcaggaaacacgtccgtgacccatttgtccctgctgcacactggtctgggtgacgagggactggagcttctcgctgcccaacttgacaggaatcggcagctacaggaattgaatgtggcttacaatggcgctggagacactgccgcactggctctggcaagggccgctcgtgaacacccgtccctcgaactccttcagggcgttgccatccaaatgtgttggaagctgcctctgctcccatacgctcacctgtggacccctcgcatgcccagtcactggtgcttcctcctcattttgatgcctcccctcccccagtggtatgatggcctggtggcccctagaggtagatgcacctag

SEQ ID NO: 232813 - DNA, 3111 bp, Artificial Sequence
  Description of Artificial Sequence: Synthetic coding sequence
atgaaaatggccagcacaaggtgtaagctggctcgctacctggaggatctggaggacgtggatctgaagaagtttaaaatgcacctcgaagactatccacctcaaaagggatgcattcctctgcctcgcggacagacagagaaggccgaccacgtcgatctcgcaacactcatgatagatttcaatggagaggagaaggcgtgggctatggcagtctggatctttgctgccattaataggagagatttgtacgagaaggccaagcgggatgagcccaagtggggctctgacaacgctagagtgtctaacccgacagtgatctgtcaagaagacagcattgaggaagagtggatgggcttgttggagtatctttctcgaatatccatatgcaaaatgaaaaaagattatcggaagaagtaccgaaaatatgtccggtccagatttcagtgtattgaggatcgcaacgccaggttgggtgaatccgtgtcactaaataagaggtatacgcggctgcgactgatcaaagaacaccggagccagcaggagcgcgaacaggagctgctcgcaattggaaaaacaaaaacatgtgaatcacctgtcagtccaatcaaaatggagctgctgttcgatccagacgacgaacactcagagcccgtccataccgtcgtgtttcaaggggcagccggaatcggtaaaactatcttagcccgtaaaatgatgctcgattgggccagcggaactctgtaccaggacagattcgattacttattctatattcattgtcgagaagtgtccctcgttacacagagatctctgggtgacctcatcatgtcatgctgcccggaccccaatccccctatccataagatcgtaaggaaaccctccagaattctcttcctaatggacggatttgacgaacttcagggcgcattcgacgagcatatcggtcctctctgtacggactggcagaaggccgagcggggagacattctcctgagctccctgattagaaaaaagctgttacccgaggcttcattacttatcactacccggccagtagcactggagaaactccagcacttattggatcaccccaggcatgtggagatacttggcttcagcgaggcaaagaggaaagagtatttctttaagtatttttccgatgaagcacaggcacgggctgcattttccctgattcaggaaaacgaggtgctctttacaatgtgcttcattcccctcgtgtgctggattgtctgtacgggcctcaagcaacagatggagtccggcaagtccctcgcacagacaagcaaaacaaccactgcagtgtacgtgtttttcctgtccagcctgttacagccaaggggaggatcccaagaacacggtctttgtgcccatctttggggtctgtgttccctcgcggctgatgggatctggaaccaaaaaattctgtttgaggagagtgacctccggaaccacggcctgcagaaggcggatgtatcagcctttctcagaatgaacctattccagaaggaagttgattgtgagaaattttattcgttcattcacatgacattccaggagttctttgcagcgatgtactatttactcgaggaagaaaaagaaggtcggaccaatgtgcccggatctagactgaagctgccttctagagacgttaccgtgctcctggaaaactacgggaaatttgagaagggttacctgatcttcgttgtgaggtttctgtttggtctcgtgaatcaggagcggacaagctacctagagaagaagctgtcctgtaagatctcccaacaaatcaggctggaactgcttaaatggattgaagttaaggccaaggccaaaaagttgcagatccaaccctcacaacttgaactgttctactgtctgtacgagatgcaggaagaagatttcgttcagcgagcaatggactactttcccaaaattgagattaatctgagtacaagaatggaccatatggtgagtagcttttgcatagaaaactgtcatagagtggaaagcctaagcttgggcttcctgcataatatgcccaaggaggaggaggaggaggagaaggagggcaggcacctagatatggtgcaatgtgtactaccctcctctagccacgccgcttgcagtcatggactggtgaatagccacctgacttcatccttttgcagggggctgttctcggtgttatccacgagccagtcgttgactgaactggacttgagcgacaactctcttggcgacccaggcatgcgagtgttgtgcgagactctgcaacacccaggctgcaacattagacggctgtggcttggtcggtgtggactgagccatgagtgctgtttcgacattagtctggtcctgtcttccaatcagaagctggtagagctggatctcagcgacaatgccctgggagacttcggcattcgcctgctctgtgtgggtctgaagcatttgctgtgcaacctgaagaagctgtggttggttagctgctgtctgacatctgcatgctgccaggatctggcctctgtgttgtcaaccagtcactctctgactcggctctatgtgggcgagaacgccctgggggactccggcgtggccattctctgcgaaaaagcaaagaacccacagtgtaatttgcaaaagttgggcctggtcaactctggcctgactagtgtttgctgtagcgcacttagctctgtcctgtcgaccaatcagaatcttacgcatttatatctgcggggaaatacccttggagataagggtataaagttgttgtgcgaaggacttctgcatccagattgtaaattacaagttttggagctggacaattgcaacctaacgtcacactgttgttgggatctaagcaccctgctgactagctcacaaagcctgaggaagctgagcctgggtaataatgatcttggagacctgggggttatgatgttctgcgaggtgctgaagcagcagagctgcctcctccagaacctcggtctttctgagatgtactttaactatgagactaagagtgcactagagactctgcaggaagaaaaacccgagctgactgtggtgttcgagccctcttggtag

SEQ ID NO: 232814 - DNA, 2769 bp, Artificial Sequence
  Description of Artificial Sequence: Synthetic coding sequence
atgaaaatggcctccacaagatgcaagcttgccagatatctggaggacctggaagatgtcgatttaaagaagttcaagatgcacctggaggattacccacctcagaaaggctgcatccctctccctaggggacaaaccgaaaaggccgaccatgttgacctggcaacgttaatgatagactttaacggggaagagaaggcctgggccatggctgtctggatctttgcggcaattaatcgtagggatttgtatgaaaaagctaaaagagacgaaccaaaatggggctcggataacgcacgcgtcagtaaccctactgtaatttgtcaggaagatagtatcgaggaggagtggatgggcctactggaatacctttcacgaatctctatttgcaaaatgaaaaaggactacagaaaaaagtatcggaagtacgtccggagccggttccaatgcatcgaggataggaacgcacggttgggagagtctgtgtccttaaataaacgttatacaaggctgaggctaatcaaggagcataggtcccagcaagaacgcgaacaggaactgctggcaatcggcaagacaaaaacctgcgaaagccccgtgtcccccatcaagatggaactcctgttcgatccagacgacgagcacagtgagccagtgcacactgtggtgtttcaaggagctgctggtatcgggaagaccattttagcacgaaagatgatgcttgactgggcctctggaacgctgtatcaggacaggttcgattacttgttctacatccactgtcgggaggtctctttggtgactcagaggtccctgggagatcttataatgtcttgctgccctgatccaaatcctcccatccacaagatcgttcgtaagccaagcagaatcttgtttctcatggatgggttcgacgaactgcagggcgcttttgatgaacatatcggaccattgtgtacagattggcaaaaagccgagagaggcgatatcctcttgtcgagtctgatacggaagaaactgctgccagaggccagccttctgataacgacacgccctgtcgcattggaaaaactacagcatctcctcgatcaccctagacacgtggagattcttggatttagtgaggccaagagaaaagagtatttttttaagtatttcagcgacgaggctcaggctcgtgcagctttttcactcatccaagagaatgaggtcttgtttacaatgtgtttcatccccctggtgtgctggatcgtctgcacagggttaaaacaacagatggagagcggtaaatccctggcccagacctcaaaaaccacaactgcagtctatgtgttttttcttagctctttacttcagccacggggaggctctcaggagcacggactgtgtgcccatttgtggggtctttgcagcttggccgctgatgggatttggaatcagaaaattctcttcgaggaaagcgatctcaggaatcatggtcttcagaaagccgacgtgtccgcgtttttgaggatgaatctcttccaaaaggaagttgattgtgagaagttttactcttttattcatatgacgttccaagagttcttcgcagctatgtactacctcctggaagaagaaaaggaaggacgtacaaatgtgcctgggtcaaggctgaagctgccgtctagagatgtgacagttctcctggagaattatggaaaatttgagaaaggctatctcatctttgtggttaggttcttgttcggcctcgttaatcaggagagaacctcgtacctggagaagaaactgagctgcaagatcagccaacagatacgattggagctccttaagtggatcgaggtaaaggcaaaggccaaaaagctccagattcaacctagtcagctggaattgttctattgcctgtacgagatgcaggaggaggacttcgtccagagagcaatggattactttcccaaaatcgaaattaacctgtcaacgcggatggaccacatggtatccagcttttgcattgaaaactgtcatcgggttgagtcactgagcctaggtttcctccacaatatgcccaaagaagaagaagaggaggagaaggaaggccgtcacctggacatggtgcagtgtgtgcttcctagtagttctcacgctgcgtgtagtcatggcctggggcgatgtggattatcacacgaatgctgttttgatatctccctggttctctccagtaatcagaaattagtcgaattggacttgtctgataacgcactcggtgatttcggcatcagactcttatgtgtgggcctaaagcacctgttatgtaacctgaagaagctgtggctggtgaatagcggtctcactagcgtgtgttgtagcgccttgtcttccgtgctaagtaccaatcagaatctcacccacctctatctgaggggcaacacactgggggataaaggcatcaaactcctgtgcgaagggctcctgcaccccgattgtaaactgcaggtcctggaattggacaactgcaatctgaccagtcactgctgttgggacctgagcaccctgctgacctcctctcagtccctccggaagttgagtctcgggaacaacgacctcggcgatctgggagtgatgatgttttgtgaagtgctgaagcagcagtcctgtctgttgcagaatctaggactatcagaaatgtatttcaattatgagaccaagagtgctcttgagacgcttcaagaagaaaaaccagagcttaccgtggtgtttgaacctagctggtag

SEQ ID NO: 232815 - DNA, 2940 bp, Artificial Sequence
  Description of Artificial Sequence: Synthetic coding sequence
atgaagatggcaagtacacgatgcaaactcgctagatatctggaagatttagaagatgtggatttaaaaaagttcaaaatgcatttggaagattatccccctcagaagggttgtattccattgccccgtgggcagacagaaaaagctgaccacgtggacttggcaacgctcatgattgattttaatggagaagaaaaggcctgggccatggctgtctggatattcgcagctatcaataggcgggacttgtatgagaaggctaagcgggatgagccaaagtggggatcggacaacgctcgtgtgtctaatccgacagtgatctgccaggaagattccatcgaggaagagtggatggggctccttgaatatctaagtcgcatctccatctgcaagatgaagaaagactatcggaagaaataccggaagtatgtgaggtcaaggtttcagtgcattgaggatagaaacgcccgacttggagagagcgtgtcgctgaacaagcgctacaccaggctgagattgatcaaagaacatcggtctcagcaggagagagaacaggaactgctcgcaattggcaaaactaaaacttgtgagtctccggtgtcccccattaagatggagctgctgtttgacccagatgacgagcacagcgagccggtgcataccgtcgtgttccagggcgctgctggtataggtaagaccattctggcccgaaagatgatgctggactgggcctccggaacgctctatcaggataggttcgactacttattctacatccattgtagggaagtgtctctggtgacgcagagaagcttgggtgatctcatcatgtcctgttgtccagacccaaatccccctatccacaagattgtacggaagccctcccgaattctttttctaatggatggctttgacgagcttcaaggcgctttcgacgagcacatcggcccactctgcacagattggcaaaaggcagagaggggtgatattcttctcagctccttgattcgaaagaaactcctgcctgaggcaagcctgctgatcacgacgaggcctgtcgccctcgagaaactgcagcatctgttggaccatcccagacatgtggaaattctggggttcagcgaagccaagcggaaggagtatttctttaaatatttttccgatgaagcccaggctagagctgccttcagcctcatccaagaaaatgaagtcctctttactatgtgttttatacccctcgtatgctggattgtgtgtacaggcctaaaacagcagatggagtctgggaagtcgctggcacagacatctaagactaccaccgccgtgtatgtgttctttctaagctcactgcttcaacctagagggggatctcaggagcatggcttatgcgcccacctctggggattatgttctttagccgcagacgggatttggaatcagaaaatcctctttgaagagagcgacctgaggaatcacgggctgcagaaggccgatgtgtccgcgtttttgaggatgaacttatttcagaaagaagtagactgcgagaagttttacagctttatacatatgacttttcaagagttctttgccgcaatgtactaccttctcgaagaggagaaagaggggcgtacaaatgtacccggttctcgtttgaaactgccttccagagacgtcactgtactcctggaaaactacggcaagttcgaaaaaggctacctaatcttcgtagtgagatttctgtttgggctcgtcaatcaggaaaggacaagctatttagaaaagaaactcagctgcaaaatcagccagcaaattaggcttgagcttctgaaatggattgaggtgaaagcaaaggctaagaagctgcagatccagccatcccagctggagcttttctactgtctttacgagatgcaggaggaggacttcgtacagagagcaatggattattttcctaaaattgaaataaacttatctactagaatggatcatatggtgagctctttctgcattgagaattgccaccgggttgagtctctgtcgctcggattcttgcataacatgccaaaggaagaggaggaggaagaaaaagagggcagacatctcgacatggtccagtgcgtgcttcccagttcctctcacgccgcttgttcacatgggctggtgaacagtcacctcacatcctctttttgcagaggtctattttccgtattgtcaacatctcaatctctgacagagctcgacctctcggacaacagtctcggtgatcccggtatgcgagtgttatgtgaaaccctgcagcatcctggttgtaatatacgcaggctttggttgggtaggtgtggtctctctcatgagtgctgttttgatatttcccttgtgcttagctccaatcagaagctcgtggaacttgacctcagtgacaacgctctgggggatttcggaatccgccttctttgtgtggggcttaagcatctgctgtgtaacttaaagaagctgtggctggtcaattcgggtttgaccagtgtctgttgtagcgcactctcaagcgtgctgtctacaaatcagaatctgacccatctttatctgagaggtaatacattgggtgacaaaggtatcaagctcctgtgcgaggggctactacacccagattgcaagctgcaagtgttggaactggacaattgtaatctgacttctcattgttgctgggatctgtctacactgctgacgtcttcccagagcctccgtaaactttcactggggaataacgatttgggggacctcggggtcatgatgttctgcgaagttcttaaacagcagagttgccttctgcagaatctaggtctaagtgaaatgtacttcaattacgaaactaaatctgcgttggaaacacttcaagaggagaagccggagcttaccgtggtgtttgaaccttcttggtag

SEQ ID NO: 232816 - DNA, 2940 bp, Artificial Sequence
  Description of Artificial Sequence: Synthetic coding sequence
atgaagatggccagcacaagatgtaagctggccagatacctggaggacctggaggatgtcgatctgaagaaattcaagatgcatttagaggattatcctccccaaaaggggtgcatcccactgcctcgcggtcaaacagagaaggcagatcacgtagacttggccaccctgatgatcgactttaatggcgaggagaaggcttgggccatggcagtgtggatttttgccgcaatcaatcgacgtgacctgtatgagaaggccaaaagggatgagcctaaatgggggtcggataatgcaagagttagtaatccaacggtgatctgtcaggaggactccattgaagaggagtggatgggtctcctggaatacctgtcacgcatctccatctgcaagatgaaaaaagattatcgcaaaaaataccggaagtatgtgcgcagcaggtttcaatgtatagaggacaggaacgcccgtcttggtgaatccgtctctctgaacaaacggtacactcgcttacgactgatcaaggaacaccgttcacagcaagaacgggaacaggaactgctcgccatagggaagaccaagacatgtgagagcccagtgtctccaattaagatggagctcctttttgaccccgacgacgagcactctgagccggttcacacagtcgtctttcaaggggctgctgggattggtaagacgattctggcgaggaagatgatgctagattgggcgagtggcaccctgtaccaggaccgctttgactacttgttttatatacactgcagagaggtgagtttggtcacccagcgctcccttggagatttgattatgtcttgttgtcccgatcccaatccccctatacacaaaatagtccggaagccatcccggatcctgtttctgatggacggctttgacgagctacagggggctttcgatgagcacattgggcctctgtgcaccgactggcagaaggcagaacgcggagatatcctgctgagtagcctgattaggaaaaaattgttacccgaggcttccctcctgatcacgacccgccctgtagccctcgaaaaactgcagcaccttctcgatcaccccaggcacgtcgaaatccttggattctctgaagcaaaacgtaaggagtatttttttaagtatttctccgacgaagcacaggctcgagccgcattctccctcatccaggagaatgaggtcctgttcaccatgtgcttcattcctctggtgtgttggatcgtgtgcactggactcaagcaacagatggaatccggtaaatctttggcgcagacctccaagactaccaccgcggtgtatgtttttttcctgtcgagcctgcttcagcctcgcggtggcagccaagagcatggcctgtgcgcacacctgtgggggctgtgctccctggctgccgatggcatctggaatcaaaagatcctgttcgaggagtccgatctcaggaaccatgggttacagaaagccgacgtatctgcatttctgaggatgaacctgtttcagaaggaggtggactgcgagaagttttattctttcattcacatgacattccaggaatttttcgccgctatgtattacctcctggaggaggaaaaggaggggcgaaccaatgtgccaggctcaagactgaagctgccatctagggatgtaaccgtactgctcgagaactatgggaagttcgagaaaggatatttgatctttgtggtgcgcttcctcttcggtttggttaaccaggagcgcacttcctatctggagaagaagctgtcatgtaaaatttcccagcagatccggctggagctgcttaaatggattgaggtcaaagccaaagcgaaaaagctccaaattcagccatcacagctcgagttattctactgcctgtacgagatgcaagaggaggattttgtgcagagagccatggactactttccgaagattgaaattaatctgagtacacgaatggatcatatggtgagctccttctgcatagaaaattgccatagggtggaaagcctgagtctgggattcctccacaacatgcctaaggaagaagaggaggaagagaaagaaggcaggcatctggatatggttcagtgcgtgttaccatcttcttcccatgccgcttgtagccacggcctggtcaatagtcatctgactagctccttctgcagaggactgttttcagtgctctcgacctcgcagagtctgaccgaacttgatttgtctgacaacagtttaggggatcccggaatgagggttctgtgcgagacgctccagcatcctggttgcaatatccgccgtctctggctcggtagatgtggcttgtctcatgagtgctgcttcgacatctccctggtcttatcgtcaaatcagaagctcgtcgaactagacctgtccgacaacgctctgggcgactttgggatccgactcctctgcgttgggcttaagcacctcctctgtaatctgaaaaagctgtggctggtcaattcgggtctcacatccgtgtgttgcagcgccctgtcatcagttttgtcgacaaaccagaacctgacacacctctatctacgcggtaatactctgggcgataaaggaatcaaactactttgcgaagggctcctgcacccggactgcaagctgcaggtgctcgaactggacaactgcaacctgacgagtcattgctgctgggatctgagtaccctgctgacttctagtcaaagcctgaggaagttgagcttgggaaacaatgacctaggcgacctgggggtgatgatgttctgcgaagtgcttaagcagcagtcctgcctgctgcaaaacttggggctctccgaaatgtactttaactacgagacaaagagcgctctcgagacattgcaggaggagaagcctgagctcaccgtcgtgtttgagccaagttggtag

SEQ ID NO: 232817 - DNA, 2940 bp, Artificial Sequence
  Description of Artificial Sequence: Synthetic coding sequence
atgaagatggctagcacgcgctgcaaactcgcgcgatacctcgaagatctggaagatgtggatctgaagaaattcaaaatgcacttggaagactatccgcctcagaaaggctgtatcccgctgccccgtggccagaccgagaaagcagatcacgtggatctcgctactctgatgattgattttaacggggaggaaaaagcatgggccatggcagtttggatttttgcagcaatcaataggcgcgacttatatgagaaggcgaaacgtgacgaaccgaaatgggggtctgacaatgctcgggttagcaacccaaccgtcatatgccaagaggacagtattgaagaagaatggatggggctcctggagtacctgagcaggatctctatctgcaaaatgaagaaagattatcgcaagaaataccggaaatatgtgcgctcccgctttcagtgcattgaggaccggaatgcacggcttggtgaaagtgtcagtctgaataagcgatacacccgactaagactcattaaggaacataggtcacaacaggagagggaacaggagttattggctattgggaaaacaaaaacgtgtgaaagccccgtgtctcccatcaaaatggagttactgtttgaccccgacgacgaacactccgaaccagtgcacacggtggtcttccagggcgctgctgggatcgggaagaccatcctggcccgtaagatgatgcttgattgggcaagcggcactctgtatcaggatcgctttgattatctgttttacattcattgccgggaggtctccttggtgacccagcgcagcctcggagatctgattatgtcttgttgccccgaccctaaccccccaatccataagattgtgaggaaaccttctcgaatcctatttctgatggatggcttcgacgagctccaaggagctttcgatgaacacatcggcccattgtgcactgattggcaaaaggccgagagaggagatatactgctgtcttccctcatcaggaaaaagctgttgcccgaggcttccttgctgatcacgacaagaccggtcgcactggaaaagctccagcatttgctggatcatccgaggcatgtggagatcctcggcttttctgaggccaagcggaaagagtactttttcaagtacttctccgatgaggctcaagcccgagctgccttctctctcattcaggagaatgaggtgctgtttactatgtgtttcatacccctcgtgtgctggatcgtttgtactggattgaagcaacagatggagtcaggaaaaagcctggcacagactagcaagaccaccacggccgtatacgtctttttcttatctagcttacttcagcccagaggtggcagccaggaacatgggttgtgcgcccatctctggggtttatgctcactggcggcagacgggatctggaatcagaagatccttttcgaagagtccgaccttcggaaccatggcctgcagaaggccgatgtctccgcattcctgcggatgaatctgtttcagaaagaggtcgattgcgaaaagttttattcctttatccatatgacgttccaggagttcttcgctgctatgtactatctactagaagaggagaaggaaggacgaactaacgtacccggatctcgactgaaactcccttcccgtgatgtgactgtgctactcgagaactatgggaagttcgagaaaggctatttgatcttcgtcgtgcgcttcctgtttggtctggtaaaccaggaacgaaccagctatctcgaaaagaagttgtcgtgtaagatctctcagcagatccgacttgagttactgaaatggattgaggtcaaagccaaggccaagaagcttcagattcagccatcccagttggagctcttctactgcctatacgagatgcaggaagaggatttcgtccagcgtgccatggattactttcccaaaatagaaatcaacctgtcgacaagaatggatcatatggtatcaagcttttgcatagagaattgtcacagagtggagtctctatcactgggttttctccataatatgcctaaggaagaggaggaagaagagaaagagggccgtcatttggatatggtgcagtgcgtgctgccctctagcagccacgcggcatgctcacatgggctgggaagatgtgggctgagccacgaatgttgtttcgacatttcactggtgctctcatctaaccagaaactggtcgagctcgacctcagcgacaatgcgctcggcgactttggaattcgccttctgtgcgtgggcctaaaacacttgctgtgtaatttgaagaaactctggttagtgagttgttgtttgacaagtgcatgttgccaggaccttgcttcggtcctcagcacatcgcacagcctaacaaggctgtacgttggagagaacgctcttggggattccggtgtagccatcctgtgcgaaaaagcaaagaatccacagtgtaacctgcaaaagttgggactggttaactctgggctgacctccgtctgctgctcagctctcagttccgtgttgagcactaaccagaatctgacacatttatatctgcggggtaacacactaggagacaagggcattaaactgctatgcgaaggtctgctgcaccccgattgcaagttgcaggtactcgagctggataattgcaatttaacctctcactgttgttgggacctgagtacccttcttacatcatctcaatccctacgcaagcttagcctggggaataatgatctcggcgacctgggcgtgatgatgttttgtgaagttctcaagcagcagagctgccttctacagaaccttggactgagcgagatgtatttcaactatgagaccaagtcagcgttggagactctgcaagaggagaagccagagctcactgtagttttcgaaccctcttggtag

SEQ ID NO: 232818 - DNA, 3111 bp, Artificial Sequence
  Description of Artificial Sequence: Synthetic coding sequence
atgaaaatggcctcaacacggtgtaaacttgcgagataccttgaggacctcgaagatgtcgatttgaaaaagtttaagatgcacctggaggactatccgccacagaagggttgcatcccactcccgagaggtcagacagagaaggcggaccacgtggatttggctacactcatgatagacttcaatggagaggagaaggcgtgggccatggccgtgtggatttttgctgctattaatcggagggatctgtatgaaaaagccaaacgagacgaacctaaatggggctcagataatgccagagtctctaatccgaccgttatctgccaggaagattccatcgaggaagaatggatgggcctgttagagtatttgtctcgaatctcaatttgcaagatgaagaaggactataggaagaagtaccgcaagtacgtgcggtcaaggtttcaatgcattgaggatagaaatgcacggttaggcgaaagcgtatccctcaataaacgatatacaaggttacggctgatcaaggaacataggagccagcaggaacgggagcaggaactcctggccatcgggaagaccaagacctgtgagtctcccgtgtcgcccattaaaatggaactgctgttcgaccccgacgatgaacattccgagccagtgcatactgtcgtgtttcagggggcagcgggaataggaaagaccattctggcgaggaaaatgatgctagattgggcctccggcaccctctatcaggaccgatttgactatttattctacatccattgccgcgaggtgagtctcgttacgcaacgctcgctaggtgatctgattatgtcgtgctgtccagatccaaacccacctatccataagatcgtaaggaaacccagccggattctgtttctcatggacggcttcgatgagctccagggagcattcgatgagcatatcggaccactctgtaccgattggcagaaagccgaacggggagacattttgctgtcatctctcatcagaaaaaaactgttacccgaagcgagcctactaatcaccacacggcctgttgctcttgagaagctgcagcatctccttgaccacccccgtcatgtggaaattctgggatttagcgaagccaagagaaaagaatacttctttaagtatttttctgacgaagcccaggccagggccgctttctccctcatacaggagaatgaggtcctatttacaatgtgcttcatcccactcgtttgctggattgtctgcaccggattgaaacaacagatggagagtgggaagtccctggcccaaacctccaaaaccactactgccgtgtacgtgttcttcttgagctctctgctccagcctaggggcggtagccaggagcatggcctttgcgcccatctgtgggggctatgtagtctggccgctgatggaatctggaatcaaaaaattcttttcgaggaatcagatctgcgaaatcacgggctgcaaaaggctgatgttagcgcattcctccggatgaacttgtttcagaaggaggttgattgcgagaagttttactcattcatccatatgacgtttcaggagttcttcgcggctatgtattaccttctcgaagaagaaaaagaagggcgtacaaacgttcctggatcaaggctaaagctgccgtcaagggacgtgacagtgctgctggaaaattacggtaaatttgaaaaggggtacctgatctttgtagttcgcttcctattcggtctggtgaaccaagaacgtaccagttacctcgaaaagaaacttagttgtaaaatctcacaacagatccggctggagctcttaaaatggatcgaggttaaggccaaagcgaagaaattgcagatacagccatcgcaactcgaacttttctactgcttatatgaaatgcaagaggaggacttcgtccagagggcgatggactatttcccaaagattgagataaatctgtcaacgcgaatggatcacatggtctcatccttttgcatcgagaattgtcaccgggtggaatccctgtctctcggatttctccataatatgcccaaagaagaggaggaagaggaaaaggagggtagacacctcgatatggtccagtgtgtgctgcccagctccagtcatgcggcttgcagccacggcctagtcaatagtcatttaacctcttcattttgccgaggtctgttttccgtgctcagcacctcacagagtctgacagagttggatctgtcagataacagcttgggcgaccctggcatgcgagtcttatgtgaaacgcttcagcacccagggtgtaatatacgtcgtctgtggctgggtagatgcgggctgtcccatgagtgttgcttcgatatctccctggttttatcctccaatcagaaactcgtagaactggatctgagcgacaatgccctgggtgacttcggcattcgtctgttatgcgttggactgaaacacctgctttgtaacttaaagaagctgtggctggtgtcttgttgcctgacaagcgcatgctgtcaagatctcgcttcagtgctgtccacatctcactccctgacacgtctgtacgttggagaaaatgctttgggcgactctggtgtggcaatcctttgcgaaaaagctaagaatccccaatgtaatctgcagaaactggggcttgtcaattcaggcctaaccagcgtgtgctgtagtgctctgagctcagtgctgagcactaaccaaaatctgacgcacctctatctgcgcggaaacacactgggagataagggaatcaagctgctgtgcgaagggctcctacacccggattgcaagctgcaagtgctagaattggacaactgtaacctcaccagtcattgctgctgggatctttctactctactaacaagttcgcagtccttgcgcaagctgtccctgggtaacaacgacctgggggatcttggagtaatgatgttttgtgaagtcctcaaacaacagtcttgcttgctccaaaacctgggtctcagtgagatgtactttaattacgagacaaaatccgccctcgagaccctgcaagaggaaaagcccgaactgactgtggtgtttgaaccctcttggtag

SEQ ID NO: 232819 - DNA, 1512 bp, Artificial Sequence
  Description of Artificial Sequence: Synthetic coding sequence
atggagtatatggccgaatcgacagaccggagcccagggcacatcctctgctgcgagtgcggggtgccaatcagtccgaatccagcaaatatttgtgtggcctgcttgcgttccaaagtcgacatctcccaaggaattcctaagcaagtatcgataagcttctgcaagcagtgccagagatacttccagcctcctggaacctggatccaatgcgctctcgaatccagagagttgctggccctgtgcttgaaaaaaattaaagcccctctgtccaaggtgcggttagtggatgcagggtttgtctggacagaaccacatagcaagagactgaaggtgaagctcaccatccaaaaggaggtgatgaatggcgcaattctccaacaggtctttgtcgtcgactatgttgtccaatcgcaaatgtgtggcgattgccatagagtggaggctaaggatttctggaaggcggttattcaggtaaggcagaagactctacacaagaagaccttctattacctcgaacagctcatcctgaaatatggaatgcatcagaatacactgagaataaaagagatccacgatggtcttgatttttactactcgtctaagcaacacgcgcagaaaatggttgaattcctacagtgcaccgtcccatgcagatataaagcaagccagcgactgatttctcaggatatccatagcaacacttacaattataaatctacattctctgtggaaatcgttcctatctgcaaggataacgttgtgtgcctcagccctaaactggctcagtccttggggaatatgaaccagatttgcgtgtgcattcgcgtcacatccgccatccatctcatagacccaaatacactccaggtcgccgacatcgatggatctactttctggtcccatccattcaatagcctgtgtcatccgaagcagctagaagaattcatcgtgatggaatgtagcatagtccaggatatcaaaagagctgccggagccggtatgataagcaaaaaacatactcttggagaggtgtgggtccaaaagacgtccgagatgaatacagacaaacagtatttttgccggacccacctcggccaccttctcaacccaggagatttagttctggggttcgatctagctaattgcaacctgaatgacgagcacgtaaacaagatgaacagcgatagggtgcctgacgttgtgctaattaagaaatcttatgatcgcacaaaaagacagcgtcgcaggaattggaaactgaaggagctggcaagggagagggaaaacatggataccgacgatgagcgccaataccaggatttcctagaagaccttgaagaggatgaagcgatccgaaaaaatgtcaatatttaccgcgattcagcaatccctgttgagtcggacacagatgatgagggagcccctcggatctccttggctgaaatgctggaagatcttcacatcagtcaggacgcaactggggaggaaggcgcatccatgctgacgtag

SEQ ID NO: 232820 - DNA, 1512 bp, Artificial Sequence
  Description of Artificial Sequence: Synthetic coding sequence
atggaatacatggctgagtctaccgacaggagtccgggtcacatcttatgctgcgagtgtggcgtccctatcagccctaatcccgcaaacatttgcgttgcgtgccttcgcagcaaggtggatatatcccagggaattcccaagcaggtttcgatcagtttctgcaaacagtgccagcgttacttccagcctcctggcacctggatccagtgtgccctggaatcgagagagctgctggccctgtgcctcaagaaaataaaggcccctctctcaaaggtgaggctcgtggatgccggattcgtctggaccgagccccatagcaagcggttgaaagtcaaactcaccatccagaaggaagtgatgaacggggctatactgcagcaggtttttgtggttgattacgtggtgcagtcccagatgtgtggggactgccatcgtgtggaagccaaagatttctggaaagcagtgatccaagttaggcagaaaacgctgcacaaaaaaactttttattacctcgaacaattgattctgaagtatgggatgcaccaaaacaccctgcgcatcaaggagatacacgacggcctcgacttttattattcatccaagcaacacgcccagaagatggtggaatttctgcagtgtacagttccctgccgttataaagcctcacaaagactgatctcccaggacatccatagcaatacgtataactacaagagtacattctccgttgagatagtgcctatctgtaaggacaacgtggtctgcctcagtcccaaactagcgcagtctctcggaaatatgaatcagatctgtgtatgcattcgcgtaacttctgctattcatctgatcgaccctaatacgctgcaggtggccgacattgacggctcaacattctggtcacaccctttcaatagtctgtgtcaccctaagcagttggaggaattcatcgtgatggaatgtagcatcgtgcaagacattaagagggcggctggtgcaggtatgatcagtaagaagcataccctcggcgaagtatgggtccaaaagacgtctgaaatgaacaccgataaacaatacttctgccgcactcacctgggacatctgctcaaccctggcgatctcgtgctgggctttgacctagcaaactgtaatctgaatgacgagcacgttaataaaatgaacagcgacagggtaccagacgtggttttgattaaaaaatcatatgacaggacaaagcggcagcggcgaagaaattggaaactgaaggaacttgcccgtgagagggaaaacatggatacagatgacgaacggcagtaccaggactttttggaggacctcgaggaagatgaggccatccgaaagaacgtgaatatatatcgcgactccgccattccggtggagtccgatacagacgatgaaggcgctccgagaatcagcctggctgagatgctcgaggacttacacatcagtcaagacgcaacgggtgaggagggggcatctatgctgacatag

SEQ ID NO: 232821 - DNA, 471 bp, Artificial Sequence
  Description of Artificial Sequence: Synthetic coding sequence
atggagtacatggctgagtctaccgaccgctcccccggacacattctgtgctgcgagtgtggagtcccgattagtcctaatccagcaaacatttgcgtggcctgcctgagaagcaaagttgatatcagccaaggcatccccaaacaggtttccatcagtttctgcaagcagtgtcagcgatacttccagccaccaggaacatggattcagtgcgccctggaatcccgggaattgttagctctttgtctcaagaaaataaaagctcccctctcgaaagtgcgcttggttgatgccggtttcgtctggaccgagccacatagcaaaagactcaaggtaaaactgaccatccagaaagaggtaatgaacggcgcaattctgcagcaagtgtttgtcgtagattacgttgtgcagagtcagatgtgcggcgactgtcaccgtgtcgaagccaaggacttttggaaggccgtgtag

SEQ ID NO: 232822 - DNA, 657 bp, Artificial Sequence
  Description of Artificial Sequence: Synthetic coding sequence
atggaatacatggcagaaagcactgatcgcagccctgggcacattctatgctgtgagtgtggagttcctatctctcctaatccggctaatatttgtgtggcttgcctccggtccaaggtcgacatttcccagggaatccccaaacaagtgtcaatttcattctgtaagcagtgtcagaggtacttccaacccccaggtacatggatccagtgtgccttggagagtcgagaactcctggcgctttgcctgaagaaaattaaggctcccctatcaaaggtgcggctcgtagatgccggatttgtgtggaccgaaccacatagtaaacgcctcaaggtgaaacttactattcagaaggaagtgatgaatggggctatcctgcaacaggtgttcgtggttgattatgtagtgcagagtcagatgtgcggcgactgccacagggtcgaggctaaggacttctggaaggccgttatccaagtgagacagaagacacttcacaaaaagactttctactatctggaacaactgattctgaagtacggcatgcatcagaacaccctcagaataaaagagattcacgacgggctcgatttctattacagtagtaagcagcatgcccaaaaaatggtggagttcctgcagtgcacggtgccttgctag

SEQ ID NO: 232823 - DNA, 297 bp, Artificial Sequence
  Description of Artificial Sequence: Synthetic coding sequence
atggagtacatggccgagtctaccgacagaagccctggccatattctctgctgcgaatgtggggttcctatcagcccgaaccctgcaaacatctgcgtcgcctgtctgaggagcaaggttgatataagccaggggatcccgaagcaggtttcgataagcttctgtaagcagtgtcagcgctactttcagcctccagggacatggatccagtgcgctctggagtcgagggagctcctcgctttgtgcctaaagaaaataaaagcaccgctgagcaaggtgaggctcgtggacgcatag

SEQ ID NO: 232824 - DNA, 489 bp, Artificial Sequence
  Description of Artificial Sequence: Synthetic coding sequence
atggaatacatggcggagagcaccgaccgcagtcctgggcacatcctttgctgtgaatgcggagtccctatctcccccaacccagccaatatttgcgtggcttgcctgaggagcaaagtcgacatttcccagggaatccccaaacaggttagcatttccttctgcaaacagtgccagaggtatttccagccccctgggacatggatacagtgcgctctggaatccagggaactcctcgctctttgtctgaagaagatcaaggcacccctcagtaaggtccggctggttgacgcaggttttgtctggacagaaccacactcaaaaaggcttaaggtaaagctgactatacagaaagaggtcatgaatggagccatcctgcaacaagtgtttgtagtggactacgtcgttcagtctcaaatgtgtggtgattgccatagagtcgaggcaaaagacttctggaaggccgtgatccaagtcaggcaaaaatag

SEQ ID NO: 232825 - DNA, 657 bp, Artificial Sequence
  Description of Artificial Sequence: Synthetic coding sequence
atggaatatatggcagagtcaacagaccgctcacccggtcacattctgtgttgcgagtgtggtgttcccattagcccaaacccagccaacatctgtgtggcttgtttgagatcaaaagtcgacataagccaagggatacctaaacaggtgtcaattagtttttgtaaacaatgccagcgttacttccagccgcctggcacgtggatccaatgcgctctggagtcccgagagctgctcgccttgtgtctgaaaaaaattaaggcccctctcagcaaagtgagattggtggatgctggtttcgtgtggaccgagcctcattccaaaaggcttaaggttaagttaacaatacagaaggaagtcatgaacggagctatcctacagcaggtgtttgttgtggactatgtagtccagtcccagatgtgcggtgattgccacagggtggaggctaaagacttttggaaggcagttattcaggtgcgacagaagacactccataaaaagacgttttactatctcgagcagcttattctcaagtatgggatgcatcagaacacccttcgcatcaaagaaattcacgatggcctcgacttctactacagctcaaagcagcatgcccagaagatggtcgagtttctccagtgcactgtcccttgttag

SEQ ID NO: 232826 - DNA, 1152 bp, Artificial Sequence
  Description of Artificial Sequence: Synthetic coding sequence
atgaatggtgccatcctccagcaagtattcgtcgtcgactacgtggttcagagtcagatgtgtggagactgtcacagggtggaggccaaggacttttggaaagccgtgatccaggtacggcagaagaccctccataaaaagactttttactatctggaacagctgatcctgaaatatggcatgcatcaaaacacattgagaatcaaggagatacacgatggactggatttctattattcttcgaagcagcacgctcagaagatggttgaattcctgcaatgcacagttccttgcagatataaagcgtctcagaggctgatcagtcaagacatccactctaatacttacaactacaagtcaaccttctccgtggagattgtccccatttgtaaggacaatgtcgtttgcctgtccccaaaactcgctcagtccctgggcaatatgaatcagatctgcgtgtgtatacgtgtgacttcagctatccatttgattgatcctaatactctgcaggtcgccgacattgacggatccaccttctggagccaccctttcaactccttgtgccacccaaaacaattggaggagtttattgtaatggaatgctctatagtccaagacattaagagggccgcaggagcgggaatgatctccaaaaagcacactctgggtgaggtttgggtccagaaaacatccgagatgaatacagacaagcagtatttttgccgtactcacctgggccacctgctcaaccctggggatctggtgctgggatttgacctggccaattgtaatctgaacgacgagcacgtaaacaagatgaattccgatcgtgtgcctgatgtcgtactgatcaagaaatcttatgacagaacgaaaaggcagagaaggaggaattggaaactcaaagaactcgccagggagcgggagaacatggacacagatgacgaacggcagtatcaagattttctagaggacctcgaggaagacgaggctattaggaagaacgtaaacatctatcgggactctgctattcctgtggagtctgacactgacgatgagggtgcccctcgaatctcccttgcagaaatgctggaggatctgcacatttcgcaggatgcaaccggtgaggagggagcaagtatgctgacttag

SEQ ID NO: 232827 - DNA, 2949 bp, Artificial Sequence
  Description of Artificial Sequence: Synthetic coding sequence
atgagcagcaaaatggtaatttcagaacctggcctcaattgggacatctcacccaaaaatgggctaaagaccttcttcagtagggaaaattacaaggaccacagtatggccccttctctcaaagagcttcgggtgctgtccaataggcgcattggcgagaatttaaacgccagtgcaagcagcgtcgaaaacgagccggctgtgtcttcagctacacaggccaaggagaaagttaagacaactattggaatggtactgcttcctaagcccagggtgccttaccccaggttttccagattttctcagcgggaacaacggtcttatgtggatctccttgtgaaatacgctaagattcctgctaacagcaaagccgttggaatcaataagaatgactacctgcagtacctcgatatgaaaaaacatgtgaacgaggaggtcacagaatttctgaagtttctgcagaactctgccaagaaatgcgcacaggattacaatatgttatcagatgatgcaagacttttcactgaaaagatccttcgagcctgtattgagcaggtaaagaaatacagtgaattctacacactccacgaggtgactagtctgatggggtttttcccctttagagttgagatgggcctcaaactggagaagactcttctggcactgggaagcgtcaagtacgtgaagactgtgtttccatctatgccgatcaagctgcaacttagcaaggacgacatcgctactatcgagactagcgagcagactgctgaggccatgcattacgacatttccaaggatccaaatgcggagaagctagtctcgcgttatcaccctcagatcgcacttacgtctcaatcgctattcacactgctcaataatcatgggcctacgtataaggagcaatgggagatacccgtctgcatccaagtaatcccggtggccggatccaaaccagtgaaggtgatctatatcaatagccccctgccccaaaagaagatgactatgagagagcgtaaccagatctttcacgaggtccccttgaaattcatgatgtctaagaacacaagcgtccctgttagtgccgttttcatggacaagcctgaagaatttatctccgagatggacatgtcttgcgaagttaatgagtgccgaaagatagagtctctggagaatctttatctggactttgatgatgacgtcactgagctggagacatttggggtgacaaccactaaagtgagtaagtcaccttctcctgcatccacctccacagtgcctaacatgacagacgctcccactgccccaaaggcgggtacaaccactgtcgctcctagtgctccagacataagcgcaaacagcagatcactgtcacaaatcttgatggaacaattgcagaaggagaagcagctcgtaacaggaatggatggtggtcccgaagagtgcaagaataaggacgatcaaggctttgagtcttgcgaaaaagtcagcaattcagataaacctctaattcaggacagcgacctgaagacctctgacgctcttcagctcgagaattcccaggagatcgagaccagcaacaagaacgatatgacgattgacattctccatgcagacggcgaacgccctaatgttctagagaatctagataatagcaaagaaaagaccgtcggcagcgaagccgcaaagaccgaggatacagtactatgtagttccgacactgatgaggagtgcctgatcatcgatacagagtgcaagaataactcagacggaaaaaccgcagtggtcggctccaacctcagttcgcggcctgcctcacccaatagctcatcgggccaggctagcgtcggcaaccagactaataccgcatgctctcctgaggaatcctgcgtgctgaagaaacccattaaacgggtatacaaaaagttcgacccagtcggcgaaatcctaaagatgcaggacgaactgctcaaacccatcagccgcaaagtcccagagctacctctgatgaacctggagaattcaaagcagccaagcgtgtccgagcagctgagtggtccatcagactcctcttcttggccaaaatctgggtggccgtcagctttccagaaacccaagggccgattgccatacgagctacaagactacgtggaggacacctcagagtacctggcaccacaagaggggaactttgtgtacaagttattcagtctgcaggatttgttgctgctcgtcagatgttcagtgcagcgcatcgaaacccgccctcgaagtaagaaacgcaagaagataagaagacaattccctgtctatgttttgccaaaagtcgagtatcaagcatgctacggtgtcgaggccctgaccgaatccgagctgtgtcgcctttggacggaatctttgctgcactcgaattcctctttttatgtgggacatattgatgcctttacgagtaaactgttccttcttgaggagatcaccagtgaagagctgaaggagaagttgagcgcgctgaagatcagcaatttgtttaacatcttgcaacatattcttaaaaaacttagctcactgcaagaggggagttacctactgtcacacgccgctgaggactcctctttactgatttacaaagcctccgatggaaaggtcaccagaactgcatacaatctgtacaaaacacactgtggacttccgggagtacctagcagtctatcagtcccctgggtgcctctggaccctagtctgttgctaccatatcacatccatcatggacggatcccgtgcaccttcccccctaagtctctggatacgacaacccagcagaaaatcggtggaacaaggatgccgacacggtcccaccggaatcccgtgtctatggagaccaagtcctcatgtctgcccgctcaacaggtagaaacagaaggggtggcaccgcataaaagaaaaattacctag

SEQ ID NO: 232828 - DNA, 2538 bp, Artificial Sequence
  Description of Artificial Sequence: Synthetic coding sequence
atgaaaaaacacgtgaatgaagaggtaaccgagttcttgaaatttctgcagaactccgcaaaaaagtgcgcccaggattacaatatgctgagtgacgacgctcggctgtttaccgaaaaaattttacgtgcgtgcatcgaacaggtaaagaagtactccgagttctatacactgcacgaggtgacctccttgatgggcttctttcccttccgggtggaaatgggacttaagctggaaaaaacccttcttgcgctgggctcggtgaagtatgtcaagaccgtgttcccaagcatgcccattaaacttcagctctccaaagatgacatcgccactattgaaactagcgagcagaccgcggaggccatgcactatgatatctcaaaggatccgaatgccgagaagctcgtttctcggtatcatccacaaatcgcacttactagtcagtctttgttcactttactgaacaaccacggcccaacgtacaaggaacagtgggagatccctgtatgcattcaggtcatacctgttgctggctccaagccggttaaagtcatttacatcaatagccctttgccacaaaaaaaaatgacaatgcgtgagcgaaaccagatcttccacgaggtgcctctcaagttcatgatgtcaaagaacactagtgtaccagtctcggctgtgttcatggataaacccgaggaattcatctctgaaatggacatgtcctgcgaggtgaacgaatgccggaagatcgagtctctggagaatctttacctcgattttgacgatgacgtgacagaactcgagactttcggagtcacaaccaccaaagtgagcaaaagtccctcccccgcatccacatctactgttcccaacatgactgatgcgcctactgcccctaaggctgggaccaccacagtagccccaagcgccccagatatatccgccaactcacgctcactctcccaaatcctgatggagcaactgcagaaggagaagcaactcgtgacaggcatggacggagggccagaggagtgcaaaaacaaggacgaccagggatttgagtcatgtgagaaggttagcaactcggacaagcctctcattcaggactccgatctgaagacaagcgacgccctgcagctcgaaaactcccaggagatcgagacatctaataagaacgatatgaccattgacatcctgcatgcagatggcgaacgtcccaatgtgcttgaaaacttggataacagcaaggagaaaacggtgggcagcgaggctgcaaagactgaggacacagtattgtgttcctctgatactgacgaagaatgcttgattatcgatacagaatgcaaaaataacagtgacggaaagaccgcagtcgttgggagcaatctcagctcgagacccgcttcacccaatagcagttctggtcaagcatccgtgggcaatcagacaaacacagcctgcagtcctgaggaaagctgcgtactgaagaagccaattaaaagggtgtataaaaagttcgatcctgttggagagatcctgaaaatgcaggatgagctgctgaagcctatttctaggaaggtccctgagctgcctcttatgaaccttgaaaacagcaaacaaccctctgtgtcagaacagctgtccgggccatcagattcctcctcatggccaaagtctggttggccaagcgcgttccagaaaccgaaggggaggctgccctacgagctgcaggactacgtggaggatacttcggagtaccttgccccacaagaaggaaattttgtttataaactgtttagcctccaggacttgttgctcctggtgagatgctcggtgcaaaggattgagactaggccaaggtccaagaagcgaaagaagataagacggcagtttcccgtgtatgttctgccaaaggtagagtatcaggcctgttacggagttgaggcactgactgagagtgaactgtgtcgtctctggaccgaatcactcctgcattcaaacagcagcttctacgtaggccatattgatgcgttcacctctaagttgttcctgctcgaggagattacatctgaagagctgaaagaaaagctcagtgcacttaagattagcaacctctttaacatccttcaacatattcttaagaagttaagtagtttacaggagggttcttatttgctctctcacgccgctgaggattcctccctcctcatctacaaagcgtccgacggcaaagtcactcgtacagcttacaatctctataaaacacactgcgggttgcctggggtgccgtcaagcttgagtgtcccgtgggtacctttagacccttcactgctgttgccctaccacattcaccacggcaggattccatgtaccttcccacctaagtcattagacacgacgactcaacagaagatagggggtacccgcatgcccacacgaagccaccgtaatccagtctccatggaaaccaagagtagctgtttaccagctcagcaggtcgagaccgagggtgtggccccacacaaaagaaagataacgtag

SEQ ID NO: 232829 - DNA, 1017 bp, Artificial Sequence
  Description of Artificial Sequence: Synthetic coding sequence
atgtctagtaagatggtgatctctgagccaggacttaattgggatatctctcccaaaaatgggctgaagaccttctttagtagagagaattacaaagatcactccatggcaccctccttgaaggagctacgtgtgctttccaacagacgtattggcgagaatctgaatgctagcgcctccagcgtggagaacgagcctgctgttagcagtgccacacaagctaaggaaaaggtgaaaacaactatagggatggtgctactgccgaaacccagggttccttaccccaggttctctagatttagtcaacgcgagcagcgctcctatgtggacctgctggtgaagtacgctaaaatccccgcaaattctaaggcggttgggattaacaagaacgactacctgcagtatctggacatgaagaaacacgtgaatgaggaggtaacagagttccttaaatttcttcagaactccgccaagaaatgtgcacaagactacaacatgctgagcgacgatgctcgactgttcaccgagaagatattgcgagcctgcattgagcaggttaaaaaatacagcgagttctatacacttcacgaagtgacaagtctcatggggttcttccccttcagagttgaaatgggactgaagttagagaagactttactggcattggggtctgtgaagtatgtgaaaaccgtgttcccttctatgcccatcaaactccagttgtctaaggacgatatcgctaccatcgagaccagcgaacagaccgctgaagccatgcattatgacatctctaaagatccaaacgctgagaaactggtttcgagataccacccacagatcgctctcaccagccagtctctattcaccctcctcaataaccacggcccaacatataaagagcaatgggagatccccgtatgtattcaagtcattcctgtagctgggtccaaacctgtcaaggtgatctacattaattcacctctgccccagaagaaaatgaccatgcgtgagagatag

SEQ ID NO: 232830 - DNA, 438 bp, Artificial Sequence
  Description of Artificial Sequence: Synthetic coding sequence
atgtcatcgaagatggtaattagtgagccgggactgaattgggacatctcccccaagaatggattgaaaacattcttcagcagagagaattataaagaccacagtatggctccgagtctgaaggagcttagagtgctctctaacagacgtattggtgagaatctgaatgcatccgcgagtagcgtcgagaatgagccggcagtatcgtctgccactcaggcaaaagagaaggtgaaaaccactataggtatggtccttctgcctaaaccaagagttccttacccccgattctctcggttctctcagcgtgagcagaggagttacgtcgatcttctggtaaagtacgcaaagatcccagcaaactcaaaagccgtgggaatcaataaaaacgactatcttcagtatctggatatgaaaaagcacgtcaacgaggagtag

SEQ ID NO: 232831 - DNA, 300 bp, Artificial Sequence
  Description of Artificial Sequence: Synthetic coding sequence
atgtcatctaaaatggtgatatccgagccaggtctcaactgggatatatccccaaaaaatggactgaagactttcttctcacgcgaaaattacaaggaccacagcatggccccttcgctcaaggagttacgcgttctgagtaataggcggatcggggaaaatttgaacgcctctgccagcagtgtagagaatgagccagccgtgtcttctgctacccaggcaaaagaaaaggtgaagacaactattggtatggtcctgcttcccaagcctcgggtaccctacccaagattttcccggtag

SEQ ID NO: 232832 - DNA, 285 bp, Artificial Sequence
  Description of Artificial Sequence: Synthetic coding sequence
atgagctctaagatggtcatcagcgagcctggtctcaattgggacatctctcccaagaacgggctgaagaccttttttagccgggagaattacaaagatcacagtatggcaccgagtttgaaggaactgagagttctttccaacaggcgcatcggtgaaaatctgaatgcaagcgccagctccgtagaaaatgagccagccgtatcgagcgccacacaggctaaggagaaagtgaaaacgacaataggcatggtcctcctgccaaaacccagagtaccctactag

SEQ ID NO: 232833 - DNA, 846 bp, Artificial Sequence
  Description of Artificial Sequence: Synthetic coding sequence
atgggccagaagaagcaaaggcccgctcgggcaggccagccccactcatccagcgatgcagctcaggcacctgccgagcagccacattcgtcgagcgacgcagcacaggcgccttgccccagagagcggtgtttgggccctcccaccacccctggcccttatcgatccatctacttcagctcccccaagggacatcttacgcggctcggtctcgaattttttgaccagcctgccgtgcctcttgcacgagcattcttgggacaagttctggtgagaaggctgcctaacggaaccgaactgcgcggacggatagttgaaactgaagcttatttaggaccggaggacgaggcggctcactcaaggggtggtagacaaacccccagaaaccgcggtatgttcatgaagccaggaacgttgtacgtgtacataatctatgggatgtacttctgcatgaatatttcatcgcagggagacggcgcttgtgtacttttgagagccctcgagccacttgaaggcctggagaccatgcgacagctgagatccactcttaggaagggaactgcgtcccgggtattaaaagatagggagctgtgttccggaccgtccaagctgtgccaggccttggccatcaacaaaagctttgatcagagggacttagctcaggacgaagccgtctggctagagagaggtccactggagccctcagagcctgctgtcgtggcagccgcaagggtcggtgtgggccatgccggagaatgggcaagaaaacctctgcgattttatgtccgcggaagtccgtgggtgtctgtggtggacagggttgcggaacaggatactcaggcatag

SEQ ID NO: 232834 - DNA, 924 bp, Artificial Sequence
  Description of Artificial Sequence: Synthetic coding sequence
atggaagccgacaaagacgatacacagcaaatcctgaaagagcattcccccgacgagttcatcaaggacgagcagaacaaagggctgattgatgaaatcacgaaaaaaaacatccagcttaagaaggaaatccagaaattggagactgagctgcaggaagccaccaaagaattccaaattaaagaggatatacctgagaccaagatgaagttcctttcggtcgagacacccgagaacgactcacaactttccaacattagctgcagctttcaagtttcgtctaaagttccatatgagatccaaaagggacaggctctgataacattcgaaaaggaggaagtcgcccagaatgtggtgagcatgtccaagcaccacgtccagatcaaggacgtaaacttagaggtcactgctaagcccgtgccattgaactcgggtgtccgcttccaggtctatgtggaagtctcaaagatgaagatcaatgtgacagaaatccctgacactttgagagaggaccagatgcgggacaaacttgagttgagtttttctaaaagccggaacggaggaggagaagttgaccgtgtggattacgacagacagtctggcagtgcagtcataacttttgtggaaatcggagtggcagataaaatattgaagaagaaggaatatcccttgtatatcaatcaaacctgccacagggttacagtgtcaccgtatacagaaatccacttaaaaaaatatcagatatttagcgggacctctaaaagaaccgtgctcttaaccgggatggaagggattcagatggacgaggaaatcgtggaggacctgatcaacattcatttccagcgggctaaaaacggcggtggtgaggtcgacgtggttaagtgttccttgggacagccacatatcgcttattttgaggaatag

SEQ ID NO: 232835 - DNA, 90 bp, Artificial Sequence
  Description of Artificial Sequence: Synthetic coding sequence
atggaggcagataaagacgacacacaacagatcctgaaggaacattcccccgacgaattcataaaggatgaacagaataagggtctttag

SEQ ID NO: 232836 - DNA, 1185 bp, Artificial Sequence
  Description of Artificial Sequence: Synthetic coding sequence
atgtctagggaaatgcaggatgttgatctggccgaagttaagcctttagttgagaagggagaaacaatcaccgggctcctccaggagttcgatgtgcaagaacaagatatcgagaccctccatggatccgtccacgtgaccttgtgcggtacccccaagggcaataggcccgttatcctgacctatcacgacatcggaatgaatcacaaaacatgctataacccactgtttaactacgaggatatgcaggaaatcacgcaacattttgccgtctgccacgtggatgctcctggtcagcaggacggtgctgcttccttccctgctggttacatgtacccttccatggaccagcttgcggaaatgcttcccggtgtattgcagcaattcggcctgaaatccatcatcggcatgggaaccggcgcaggtgcctacatcctaacccggttcgcactcaataatcccgaaatggtcgagggtctcgtgctgatcaatgtgaacccgtgcgcagagggctggatggattgggcagccagtaagatttccggttggacccaggccctccccgacatggtggtgtctcacctctttggtaaggaagagatgcagtctaatgtggaggttgtccacacctaccgccagcatatcgtcaatgatatgaatcccggaaacctccacctctttattaacgcttacaacagccgccgtgatttggaaattgagagaccaatgccagggacccataccgtcactctgcagtgcccggcactgctggtggtgggtgattccagccccgcagtggatgcagtggtggaatgcaatagcaagctcgaccccacgaagaccaccttgctaaagatggccgactgtggcggtctgccacaaatatcccaacccgctaagctggcagaggcttttaagtactttgtgcaaggtatgggatacatgcccagcgcatccatgactcggcttatgcgatcacgaaccgcctctggctcaagtgtgacaagcttggatgggacacggtcccgctctcatacctctgaggggacccggtccaggtctcatacatcagaaggaacaagatcccggtcgcatacaagtgaaggagcacatctggatatcaccccaaacagtggtgccgctggcaattccgccggacccaagtccatggaggtcagttgttag

SEQ ID NO: 232837 - DNA, 975 bp, Artificial Sequence
  Description of Artificial Sequence: Synthetic coding sequence
atgtcaagggagatgcaggatgtggatctcgccgaggtcaagccactagtggaaaaaggcgaaactattaccggcctcctccaagaattcgacgtgcaggagcaggacattgaaaccctgcacggtagtgttcacgttactttatgtggaacaccgaagggaaatcgccctgttattctcacttatcatgacatcgggatgaaccataagacctgtgcttacatcctcacccggttcgccttgaataatcccgaaatggtggagggactggtgctaattaatgtcaatccttgtgccgagggctggatggactgggccgcatcgaaaatctctgggtggacccaagccttacccgatatggtggtgagccacctgtttggaaaggaggaaatgcagtcaaatgtggaagttgtgcacacctaccgccagcatattgtgaatgatatgaacccaggaaatttacaccttttcataaacgcgtataactcaagaagagatctagaaatcgaacgccctatgccaggtactcacaccgtgactctgcaatgcccagccttgctcgtggttggtgactcgagcccggcagtggatgctgtcgtggagtgcaattccaaacttgatccgacaaaaactaccctgttgaagatggccgactgtgggggtctgcctcagatttctcaaccagccaagctggcggaggccttcaaatactttgtgcaggggatgggctacatgcccagcgcatctatgactaggctgatgcggtctagaaccgctagcggcagctcagttacctcactggatggtacccgttcgcgttctcataccagcgagggcactaggtcacgatctcacacaagcgaaggcaccaggtctcgttcccacaccagcgagggagctcacttagacattaccccaaattccggagccgctggcaactccgcaggaccaaagagtatggaggtcagttgttag

SEQ ID NO: 232838 - DNA, 1185 bp, Artificial Sequence
  Description of Artificial Sequence: Synthetic coding sequence
atgtccagagagatgcaggatgttgatctggccgaggtcaagcctttggtagaaaaaggcgagactattacaggactgcttcaggagttcgatgtgcaggagcaggacattgagacgctccacgggtcggtgcatgtgacgctgtgtggcacgccaaaggggaaccgcccagtcattcttacttatcatgatataggcatgaatcacaagacctgttataacccactgttcaactacgaggatatgcaggaaattacccagcatttcgccgtttgtcacgttgacgccccagggcagcaggacggagctgcaagctttccggctgggtacatgtatccaagtatggaccaattggcagaaatgctaccgggagtgttgcaacagttcggactgaaatctatcatcggaatgggcacgggcgcaggggcatatattttgacacggtttgccctgaacaaccccgagatggtggagggtcttgtcctgatcaacgtaaacccgtgcgccgagggctggatggattgggctgctagtaaaatctctggctggacacaggccctgcccgatatggtggtgagtcacctttttggcaaggaggaaatgcagagcaacgtggaggtggtccacacctaccggcagcacatcgtcaatgatatgaatcctggcaacctacacctgtttatcaacgcgtacaactccaggcgagatctggagatcgagagaccgatgccgggtacacataccgttaccttgcagtgccccgcattgctggtcgtcggcgattccagtccagcggtggatgcagtggtggagtgtaattctaagctggacccaacaaaaaccaccctgctgaaaatggccgactgcgggggtctccctcaaatttcccagcccgcaaagctggccgaggcatttaagtacttcgtgcagggcatgggatacatgccaagcgcctcgatgacaagactcatgcgctcgcgcactgcaagcggctctagcgtgacaagccttgacggcacccgatctcgctcccatacaagcgaggggacacggtcacggagtcacacgtccgaaggtacccgttcccgcagccacacatccgagggggcacacctggatattacgccgaacagtggtgccgctgggaacagcgcagggccaaaatcaatggaagtcagctgttag

SEQ ID NO: 232839 - DNA, 498 bp, Artificial Sequence
  Description of Artificial Sequence: Synthetic coding sequence
atgagcagagagatgcaggatgtggatttggcggaggtcaagcccctggtcgagaagggggaaaccatcaccggcctattacaggagttcgacgtgcaagaacaggacatcgagaccctccacggatcggtacatgttacactgtgcggcacaccaaaaggaaatcgacctgtaatcctcacctatcacgatatcggtatgaaccataaaacctgctacaaccccctgttcaattacgaggatatgcaagaaatcactcagcatttcgctgtgtgtcacgtggatgctcccggacagcaggatggagctgccagctttccagctggctacatgtacccctcaatggatcagctggccgaaatgctacccggagttctacagcagttcggcctgaaatctataatcgggatgggtactggagctggagcatacatcctgacaaggttcgctctcaataaccctgagatggtggaaggcctggtcctgattaacgtgtag

SEQ ID NO: 232840 - DNA, 477 bp, Artificial Sequence
  Description of Artificial Sequence: Synthetic coding sequence
atgtcacgggaaatgcaggacgtcgacttagccgaggtcaagcctctggtggagaaaggagagacaattactggcctgctgcaggagttcgacgttcaggaacaggacattgagaccttgcacggatccgttcatgttacactgtgtggcactcctaagggtaatcggccagttatattgacttatcacgatattgggatgaatcataaaacctgctacaatcccctgttcaattacgaggacatgcaggagataacacaacatttcgccgtgtgccatgtggacgccccaggccagcaggatggagcagctagtttcccagccggatatatgtaccccagcatggaccaacttgcagaaatgcttcctggtgtccttcaacagttcggactgaaatccatcattggcatgggcacgggtgcaggggcttatatcttgacaagatttgcactcaataaccctgaaatggtggaatag

SEQ ID NO: 232841 - DNA, 402 bp, Artificial Sequence
  Description of Artificial Sequence: Synthetic coding sequence
atgtctagggagatgcaagacgtggatctggccgaggtcaaaccccttgtagaaaaaggtgaaaccatcactggcttgctgcaagaatttgatgtacaggaacaggacattgaaacactgcacggaagcgtgcatgtcactttatgtggtacgccgaagggcaacaggccagtgatcctaacttaccacgatatcggaatgaatcataagacctgttacaaccctttgttcaattatgaggatatgcaggaaattactcagcacttcgctgtatgccacgttgacgcaccgggacagcaggatggcgcagctagttttcctgccggttacatgtacccaagtatggaccagctggcagagatgctgcctggagtcctgcagcagtttgggctcaaaagttag

SEQ ID NO: 232842 - DNA, 477 bp, Artificial Sequence
  Description of Artificial Sequence: Synthetic coding sequence
atgagtcgcgagatgcaggatgtagacttggcagaggtgaaacccctcgtggagaagggcgaaaccattacaggacttctacaggagttcgatgtccaggaacaagacatagaaactctgcacggatctgttcacgttaccctctgcggaacccctaagggaaaccggccagtgatcttaacgtatcatgacataggtatgaaccacaagacatgctataatccccttttcaactatgaggacatgcaggaaattacccaacatttcgccgtctgccacgtcgatgctcctggtcagcaggacggagcggcttcttttcctgctggctacatgtacccttccatggatcaactggccgagatgctgccaggtgtgttacaacagttcggactgaaaagtattatcggcatggggactggcgcaggggcatatatcttgacgagatttgcccttaacaaccccgaaatggtggagtag

SEQ ID NO: 232843 - DNA, 669 bp, Artificial Sequence
  Description of Artificial Sequence: Synthetic coding sequence
atggactgggccgcttctaaaatttcaggttggacacaggccctccccgatatggtggtgagccacctctttggcaaggaagaaatgcagtcaaacgtcgaagtcgtgcacacatatagacagcatatcgtgaatgacatgaacccagggaatctacaccttttcatcaatgcctacaactcccgcagagatctggagatcgagcgccctatgcccggtactcacaccgtcacccttcagtgtcccgcactcctggtggtgggcgattccagtccagctgtagatgccgtcgtcgagtgcaactccaaactggaccctaccaagactaccttgctcaagatggcagattgtggtggccttccgcagattagccagcccgcaaaactggctgaagccttcaagtactttgtgcaaggcatggggtatatgccatccgctagcatgaccaggctcatgcgcagccggaccgcgtccggctctagtgtgaccagcctcgacgggacacgaagtagatcgcacacaagtgaaggaactaggtcaagaagtcacacatcagagggtacccgaagccgcagtcacacaagcgaaggcgctcacctcgacatcacgccaaattccggcgcagcaggcaactcagcaggtccgaagagtatggaagtgagttgctag

SEQ ID NO: 232844 - DNA, 450 bp, Artificial Sequence
  Description of Artificial Sequence: Synthetic coding sequence
atgagcagggagatgcaagacgtggacctcgccgaagtgaagcccctcgttgagaagggtgagacaattactggactcctgcaggaattcgacgtgcaggaacaggacattgaaacattacacgggtctgtgcatgtgacgttatgcggcacaccaccagcaaagctggctgaggccttcaaatactttgtgcaggggatgggatacatgccttccgcctctatgacacgcctgatgagatcacgaaccgcttcagggagctccgtcactagtctggatggcacccggtcacgatcccatacctctgagggtacacggtcaaggtcccataccagcgaaggaacgcgcagcaggagtcatacatccgagggcgcacaccttgatatcacacccaatagtggtgccgctggtaactccgcgggtcccaagtccatggaagtttcctgttag

SEQ ID NO: 232845 - DNA, 942 bp, Artificial Sequence
  Description of Artificial Sequence: Synthetic coding sequence
atgcaagagattacccagcattttgctgtgtgccacgttgatgccccaggccaacaggacggagccgcttctttccctgccggatatatgtaccccagcatggatcagcttgccgagatgctccccggtgtgctgcagcagttcggcctcaaatctatcatcggcatgggcactggcgctggcgcatacattttaacaaggttcgcacttaacaatcccgagatggtcgagggcctcgtgctgattaatgttaatccatgcgccgaaggctggatggactgggctgccagcaaaatctccggctggacccaggcactgccggacatggttgtgagccacctcttcggcaaagaggaaatgcagagtaacgttgaggtcgttcatacataccggcagcacattgtgaacgacatgaatccaggaaacctgcacctgtttattaacgcatataatagcagacgggaccttgagatagagaggccaatgccaggcactcacaccgtcacgctccagtgccctgctttgttagttgttggcgacagttcccccgcagttgacgctgtggtcgagtgcaatagtaagctcgaccctaccaaaactacacttcttaaaatggcagattgcggcggattgccccaaatttcccagcccgcaaagctggcagaggccttcaaatatttcgttcagggaatgggatatatgccatccgcttccatgacacgcctgatgcggtcccgcactgcttctggcagctccgtaacaagtctcgacggcacgcgatctagatctcacacctccgaaggtacgcgatccagaagccacacaagtgaaggcactcggtcccggagtcacacctccgagggggctcacttggatatcacccccaattcaggagccgcaggcaattctgctggcccaaaaagtatggaagtgtcctgttag

SEQ ID NO: 232846 - DNA, 288 bp, Artificial Sequence
  Description of Artificial Sequence: Synthetic coding sequence
atgtcaagagaaatgcaggatgttgacctggctgaggtgaagcctctggtggaaaaaggcgaaaccatcaccgggctccttcaggagtttgacgtgcagacaaaacccgcaacgacaccaagttccacaacgaggacttgtagaagatctccttccaccctgccaagcgctacgtggactcccctcgcttcccgcactgctcagcctccaagccctcagggaacttgtacaccaccctggatttcctggctgaaatgttttctcgaatctttcaattcactgggctag

SEQ ID NO: 232847 - DNA, 1491 bp, Artificial Sequence
  Description of Artificial Sequence: Synthetic coding sequence
atggctgatgagagcgaaactgcagtgaaacctcccgcacctccacttccccagatgatggaaggtaatgggaacggccatgagcactgtagcgattgcgagaacgaagaggataattcgtataaccgcggaggtctgtctcctgcaaatgatacgggcgctaaaaagaagaagaaaaaacaaaaaaagaaaaaggaaaagggcagcgagaccgactccgctcaagaccaaccagtgaaaatgaactctctacccgctgagaggatccaagaaattcaaaaggcaatcgagctgttcagcgtgggacaagggccagccaaaacaatggaggaggccagcaagagatcctaccagttctgggacactcagcctgttcccaaactaggcgaggttgtgaacacgcatggccctgtggaacccgataaagataacattcggcaggagccctataccttgcctcagggattcacttgggacgctctggacctgggagatagaggggttcttaaggaactttataccctgcttaacgagaactatgtggaagacgacgataacatgtttagattcgactactcgcccgaattcctcctgtgggctctgaggcccccagggtggctcccacagtggcattgcggggttagggtggtctcctcccggaagctggtggggtttatctccgctattcctgctaacatacacatttatgataccgaaaaaaaaatggtcgaaattaacttcctgtgtgtgcacaagaagctccggtccaagcgtgttgcacccgttctgataagggaaatcaccagacgcgtacatctcgaaggcatcttccaggccgtgtacacagccggtgtcgtcttaccaaagcccgtcggaacatgccgctactggcaccggagtctgaatccgcgtaagctcatcgaagtaaaatttagtcatctaagcagaaatatgaccatgcagaggaccatgaaactgtatcgtctcccggagacacccaagacagcagggttgagacctatggaaactaaagatatcccagtcgtgcaccaacttctcacccgctatcttaagcaattccacctaacacctgttatgtcccaggaggaagtggagcactggttctacccccaagaaaacataatcgatacatttgtcgtggagaacgccaacggcgaggtgaccgacttcctgtcgttttacactctgccctccacaatcatgaaccatcccacccacaaaagtctgaaggccgcatactcgttttataacgtgcacacacaaaccccgttattggatttgatgagcgatgctttggtgttagctaagatgaagggcttcgatgtgtttaacgcattagacctaatggaaaataagacctttctggaaaagcttaaattcgggattggtgatggcaacttgcaatactacctctacaactggaagtgcccctctatgggagctgaaaaggtgggccttgtgctgcagtag

SEQ ID NO: 232848 - DNA, 414 bp, Artificial Sequence
  Description of Artificial Sequence: Synthetic coding sequence
atggcagatgagtcagagactgcagtaaagccccctgccccaccactaccccagatgatggaagggaatgggaatggacacgaacactgcagtgattgcgagaatgaagaggacaactcatacaacaggggaggtctatctcctgccaacgatactggcgctaagaaaaaaaagaagaaacagaagaaaaagaaagaaaagggaagtgagaccgacagtgcacaagatcaaccagtgaaaatgaattctttgccagccgagcgcattcaggaaatccagaaggccattgaactgttctcggtagggcagggtcctgccaagacaatggaggaagctagcaaacgctcttaccagttttgggacacgcagcctgtcccaaaactggctaagcggactgtacaccctcctgagtag

SEQ ID NO: 232849 - DNA, 1491 bp, Artificial Sequence
  Description of Artificial Sequence: Synthetic coding sequence
atggccgacgaaagtgagaccgccgtgaagccaccagcccctccgctgccacagatgatggagggcaacgggaatgggcacgaacactgtagtgactgtgaaaatgaggaggataacagttataatcgtggcggtctttcacctgccaatgatacaggtgcaaaaaagaagaaaaagaagcagaaaaagaaaaaggagaaaggatccgaaactgattccgcgcaggaccagccagtgaagatgaattctctaccagcagagcgaatccaggaaatccagaaggccatcgaactcttcagcgtgggtcaaggcccagcaaagactatggaggaggcatccaaacgcagctaccagttttgggatacccagcccgtgcccaaactgggagaagtggttaacacacacggacccgttgaacctgacaaagataacattcggcaggagccctataccttgcctcaggggttcacgtgggacgcactggacttgggagaccggggagtgctcaaggaactctacacactcttgaatgaaaattacgtagaggacgatgataacatgttccgttttgattactcccccgaatttctactgtgggctctgcgtccgccaggctggctgccgcagtggcactgtggggtgcgggttgtgagttctcgcaagctggtcggcttcataagtgccattccagctaatattcatatttacgacactgagaagaagatggtggagataaattttctctgtgtgcataagaaactgagatccaagcgggtggcacccgttcttatcagagaaatcacacgccgtgtccacctggagggaatcttccaggcagtgtacaccgcaggcgtcgtactccctaagccagttggcacctgtcgttattggcaccggagcctcaatcctagaaaactaattgaagtgaagtttagccatctgagccgcaacatgaccatgcagaggacaatgaaactatacaggctgcctgaaacacccaaaacagcaggcctgcgtccgatggagacaaaggacatcccagttgtgcaccagctgctgacaaggtacctcaagcagtttcatcttacgccagtcatgagtcaggaagaagttgaacattggttttacccccaagaaaacatcattgacacatttgtagtggagaatgccaatggagaggttactgacttcctgagcttctacactctgccaagcacgatcatgaatcatccgacgcacaagtctctgaaagcagcatacagcttttacaacgtgcatactcagaccccccttctggatctgatgtcagacgccctcgtgttagcaaagatgaaggggttcgatgtcttcaacgcgcttgatctgatggagaataaaactttcttggaaaagctgaaattcggaatcggagacgggaatttacagtattacctgtataactggaaatgtccaagtatgggagcagaaaaggtaggcttggttcttcagtag

SEQ ID NO: 232850 - DNA, 1590 bp, Artificial Sequence
  Description of Artificial Sequence: Synthetic coding sequence
atggctgaagattccgagtctgcagcaagtcaacagtctctggaacttgacgatcaggatacctgcgggatcgacggcgacaatgaggaggaaactgagcacgccaaaggtagtcctggagggtacttaggcgctaaaaagaagaagaaaaagcagaagcggaaaaaagagaagccaaattccggaggtaccaaaagcgactcagcatcagattctcaggagattaagatccaacaaccaagcaaacacaacacgatctggcagcagataagcgcaggcgctgcaatgggtagcgccacaatggaaggcgaatggaccgggatgaggaacgaccataagaatcctagcgtgcctatgcagaaactacaggacattcagagggccatggaactgttgtctgcctgccaaggcccagccagaaacatcgacgaggccgctaaacaccgttatcagttttgggacacccagccggtaccgaaactcgatgaggttataacatcccatggggctattgaacctgataaagataatgtcaggcaggaaccttactctttgcctcagggctttatgtgggacaccctggacttgagtgatgccgaggtgctgaaagaactgtatactcttctcaacgaaaactacgttgaagacgatgataatatgttccggttcgactattctccagagtttttgctgtgggcactgcggccacccggatggctgcttcaatggcactgcggagtccgcgtaagcagtaataagaaactcgtaggctttatctcagctataccagctaatataaggatctacgactctgttaaaaaaatggtggaaattaactttctgtgcgtgcacaagaagctgcgcagtaagagggtggcacccgttctcattagagagataacccgtcgcgttaacctggagggcatcttccaggcggtgtacacagcaggcgtcgttttgcccaagccgattgctacatgcagatattggcacaggtcacttaaccctcgcaagctcgtggaggtgaagttctcccatctttcacgaaatatgaccctgcaacggaccatgaaactctaccgactgcccgacgtcaccaaaacatccgggctcaggcccatggaaccgaaggacatcaagtccgtccgtgaactcattaacacatatcttaagcagttccatctggcccctgtgatggacgaagaagaggttgcccattggttcctaccccgagagcacatcattgacacctttgtggttgagagcccgaacgggaagctcactgattttcttagcttttacactctccccagcacggttatgcatcaccccgctcataagtcccttaaggcagcgtattcattttacaatatccacactgagactcccctgttggatctgatgtctgacgcactgattctggcgaagtccaaaggtttcgacgtcttcaatgctctggacttgatggagaacaaaacatttctggaaaagctgaaattcggaatcggcgatggaaaccttcaatactatctttacaactggaggtgcccaggcacagatagcgagaaggtcgggcttgtgctacagtag

SEQ ID NO: 232851 - DNA, 1458 bp, Artificial Sequence
  Description of Artificial Sequence: Synthetic coding sequence
atgcgcagaagacggtccacacccaaggaggtccttgagggaatttgggagccaaagagaaaacggcgaaacagaagagaaaagcgacgtaatcagataccagaggccccttctcagaccagacacctcatcccccgaaggctaaaatttagttcactgcgtaacactacaccatctggctctagattccagcgcgagcagccgtggaacccgtccgtgcccatgcagaagctacaggacatccaaagagcgatggaactactgtccgcgtgtcaaggcccagccaggaacattgatgaggcggctaaacatcgctatcagttctgggatacacagcctgtgccaaaactggatgaggtcatcacttctcatggcgcaattgagcccgacaaagataacgtgagacaggagccctactccctgccacagggattcatgtgggataccctggatctctccgatgctgaggtgcttaaagaattgtatactctgttaaatgagaattatgtcgaggacgacgacaatatgtttcgctttgattatagcccagaattcttgttatgggcattgcgccctcctgggtggctcttgcagtggcattgcggagttagagtaagttctaacaaaaagctcgtggggtttatctcggctattcccgctaatatacgtatctacgattcagtgaagaagatggtggagatcaattttctgtgtgtgcacaaaaaactcagaagcaagagagtcgcacccgtcctgattagagagatcactagaagagtgaatctcgagggcatctttcaggctgtgtacactgccggagtggttctgcctaagcccatcgcaacttgcagatactggcatagaagcctgaacccacgcaagctggtagaggtgaaatttagtcatttgtccagaaacatgacactgcagcgaacaatgaagctgtacagacttcctgatgtcactaagacctccggacttcgaccaatggaaccaaaagacattaagtccgtgagagaattgattaacacttatctgaagcagtttcatctggcccctgtgatggatgaggaggaggttgcgcactggttcctgccgcgagaacacatcatcgatacatttgtggtcgagtcccccaacggtaagctgacagattttcttagcttttatacccttccctcaacggtgatgcaccaccccgctcacaaatccctgaaagccgcttatagcttttataatatccataccgagactccactgctggatctgatgtccgatgctttgattcttgcaaaaagtaagggttttgacgtttttaatgccctggatctgatggagaataaaaccttcctggagaagctcaaattcgggatcggagacgggaacctgcaatattatttgtataactggaggtgcccgggaactgactccgaaaaagtggggctcgttctgcagtag

SEQ ID NO: 232852 - DNA, 1497 bp, Artificial Sequence
  Description of Artificial Sequence: Synthetic coding sequence
atggccgaggacagcgagtcggctgcctcacaacagtcactggagttggatgaccaggatacttgtgggatagacggcgacaatgaggaggagacagaacatgccaaggggagtccagggggttacctcggagccaagaaaaagaaaaaaaagcagaaaaggaaaaaagaaaagcccaacagtggtggtaccaagtctgatagcgccagcgacagtcaggagattaaaatccagcagccatcgaaaaacccgtctgtgcccatgcagaagcttcaggatatccaacgcgctatggagcttcttagtgcctgccaggggccagcccgtaatatcgacgaagctgccaaacaccgctaccagttctgggacacacaaccagtgcccaaacttgatgaagttatcaccagtcacggcgcaattgagccagataaggacaatgtgcgccaagaaccttattccctgcctcaggggttcatgtgggacactctggatttgagtgacgctgaggtcctcaaagagctgtacaccctgctcaatgaaaattacgtcgaggacgacgacaacatgttcaggtttgactatagtcctgaattcctgctctgggctctgcgtccaccaggatggttactgcagtggcattgcggtgtgcgcgtgtccagcaacaagaagctggtcgggtttatcagcgcaatcccggcaaatattcgcatctatgatagcgtaaaaaagatggtggagataaattttctctgcgtccataaaaagcttcgcagcaaacgggtcgctccagtacttataagagagattacaaggagagtgaatctcgagggcatcttccaggccgtgtacactgctggggtggtgcttccaaagcccattgccacttgtaggtattggcacagatcccttaacccacggaagctcgtggaggtgaagttctctcacctgtcacggaacatgaccctgcagcgaactatgaaactgtaccggctgccggacgtgacgaaaacctctggactgaggcccatggagcccaaagatattaaaagtgttagagaactgatcaacacttacctgaaacaattccacctagcacccgtcatggacgaggaggaagtggcgcattggtttctcccccgtgagcatatcatcgacacctttgtcgtagaaagtcccaacggcaagctaactgacttcctttctttttatacgcttcccagcacggttatgcaccatcccgctcacaagagcttaaaagccgcatactcattttataatatccatactgaaaccccattgttagatctcatgagcgatgctctgatactggcgaaaagtaagggctttgacgttttcaatgcattggatctgatggaaaacaagactttcttggagaagctcaagttcggcatcggcgacggcaatctacaatactacctgtacaattggagatgtcccggtactgacagtgaaaaggtggggctggtgctacagtag

SEQ ID NO: 232853 - DNA, 234 bp, Artificial Sequence
  Description of Artificial Sequence: Synthetic coding sequence
atgtccgatgcactaatcctggctaaatccaaaggatttgatgtgttcaacgcccttgacctcatggagaataaaacctttctcgaaaagctgaagtttggcatcggagatgggaacctccagtactacctctacaattggaggtgtcccggaacagacagtgaaaagggtagcggtaattttgtcaatgccaacgggaagctgctgcctgacgtgtgtcgccgaccgccatag

SEQ ID NO: 232854 - DNA, 1458 bp, Artificial Sequence
  Description of Artificial Sequence: Synthetic coding sequence
atggcctcgccctggcggggtgcacatgaggtcctggagggaatttgggagccgaagaggaaacggcgtaaccgacgggagaagaggagaaatcagatacccgaggcaccgagccagacaagacatctgattccacggaggctgaaattctcctccctgcggaatacaacgccttctggtagccggttccagcgcgaacagccatggaaccccagtgtgcccatgcaaaagctgcaggacatccagcgggctatggagcttcttagcgcatgtcaggggccagcacggaacattgacgaggccgcaaagcatcggtaccagttttgggacacccagcccgtgcctaagttagacgaagttattacaagccatggtgccatcgaaccagacaaggataatgttagacaggagccctattccttaccacagggctttatgtgggacacgcttgacttatctgacgcagaagtgctcaaagaactctacaccttactcaatgaaaactatgtggaagacgatgataatatgtttcgattcgactattcaccagagtttctgttgtgggccctccggcctcctggatggcttttgcaatggcactgcggagtcagagtgtccagtaataaaaagctggttggatttatttccgcaataccggcaaacatcagaatttacgattcggtcaagaagatggtggaaatcaactttctctgtgtgcataaaaagcttcgttctaagcgcgtcgccccagtcttgataagggaaattactaggcgagtcaatctggaagggatcttccaggcggtctataccgctggtgttgtcctcccaaaacctattgccacctgtaggtattggcaccggagtttaaatcccaggaagctcgtggaagtgaagttcagtcacctttcaaggaatatgacactacagcgtacgatgaaactatatcggctcccggatgtgactaagacaagtggtctccggcctatggagcccaaggacattaagagcgtgagggaactgatcaatacctatttgaagcagtttcatttggcccctgtgatggacgaagaggaggtggcacactggttcttgcccagggagcatatcattgataccttcgtggtcgaatccccaaacggtaagctaaccgacttcctcagtttctataccctccccagcacagtgatgcaccatccagcgcacaaatcattaaaggccgcttactccttttataacattcatactgagacccctctgcttgatctgatgagtgatgccctgattctggccaagagcaagggctttgacgtgtttaacgccttagatctcatggagaataagacctttctggaaaaactaaagttcgggatcggcgacggcaacctgcagtattacctgtacaactggcggtgtcctggcacagattctgagaaagttgggctcgtattacagtag

SEQ ID NO: 232855 - DNA, 933 bp, Artificial Sequence
  Description of Artificial Sequence: Synthetic coding sequence
atgtttcggttcgattactccccggagtttctgttatgggccttaaggccccctggttggctgctgcagtggcactgcggtgtgcgagttagttccaataaaaaactagtgggatttatctctgcaattccagctaatattcgtatttatgactccgtgaaaaagatggtggaaattaactttctgtgcgttcataagaagctgcgatcgaaacgtgtggcacccgtcctgatacgcgaaatcaccagacgcgtgaatttggaagggattttccaagccgtctacactgctggcgtagtgttaccaaagccaatagcgacgtgtaggtattggcatagaagcctcaaccctagaaagcttgttgaagtgaagtttagccatttgagcagaaatatgaccttgcagaggactatgaagctataccgccttcctgatgtgaccaaaacaagcgggctgaggccaatggagcccaaagacatcaaatctgtacgggaactcattaatacataccttaagcagttccatctggcccctgtcatggacgaagaagaggtggctcattggttcttacctagagagcacatcatcgacacgttcgtggtggaatcgcccaacggcaagctcacagacttcctgagtttttacaccctgccatccaccgtgatgcaccaccccgcacataaaagcctgaaagccgcatattcgttctacaacattcacactgagacccctctgctggacctgatgagcgacgcgctgattttggccaaatccaagggattcgacgtgttcaatgccttagaccttatggaaaataaaacatttttggagaagttgaagttcggtatcggcgatggcaatcttcagtactacctctacaattggagatgtcccggaacagacagtgagaaggtggggcttgttctgcagtag

SEQ ID NO: 232856 - DNA, 459 bp, Artificial Sequence
  Description of Artificial Sequence: Synthetic coding sequence
atggaagctgttctgaatgagctcgtcagtgtggaggatttattgaaatttgagaaaaagtttcaaagcgagaaggccgctgggagcgttagcaagtctactcagtttgagtatgcttggtgcctggtgcgatctaaatacaacgatgacattagaaagggaattgtgttgttagaggaactgctccctaagggctccaaagaagagcagagggattatgtcttttatctggctgtgggtaactaccggctgaaggagtacgaaaaagcccttaagtatgttagaggactactgcaaaccgagccacagaataaccaggctaaagagctggaacggctcatcgacaaggctatgaaaaaggatggactcgtgggcatggccattgtcggtggcatggcactgggagtcgccggtttggcaggtctgatcggactcgccgtttccaagagtaaaagctag

SEQ ID NO: 232857 - DNA, 2076 bp, Artificial Sequence
  Description of Artificial Sequence: Synthetic coding sequence
atggcactgttgctgacactgacctccccagacctggaaggcacctgggacactagggacaaagatggcttcaaagcccaggagggtccacctctggccgtgcccgaattcccagtctgtgggctgtacaggatctatggcgtttgtgggtcattctcaagctttttcatcatccgatgtagcctctgcgcactggagacattaaaatctcctcaacatgacccactcgagatccccgaacagtcgctgaagctgatcccattagtaagtggtaagcgtgagctgacccggggtcaaaaagctggcgagaaaccgttagccgctggacccggagaagaggaactgctcagaggctccgcccctcatgctcaggacacccagagtgaagagctcccaccaagttgcaccatttctggggagaagaagcctcccgcagtgtccggggaagcaacaggggcagacgcagggagactctgccctccaccccgatccagggctccacataaggacagaaccctggcgagatcaaggccgcagactcagggggaagattgctctctacctgtgggtgaagtaaaaatcgggaagcgatcatactcaccagctcccggtaaacaaaaaaagccaaacgcaatgggactggcccctacttccagccccggagcacccaattctgctagggccacgcacaaccccgttccttgtggcagcgggaggggcccatgtcatctggccaatctgctgagcacactggcccagtccaaccagaacagggaccataagcagggacccccagaggtgacatgccagatcaggaagaaaacgaggaccctttaccggtccgatcaactggaggaattagagaagatttttcaggaagaccattaccctgactcggataagagaagggagatagctcaaaccgttggagtgaccccccaacgaatcatggtgaagggcgcagggtcgctcgttgccggttggagcggagggggacccactatagagacgctcgagcttcagagcgaaaggtccgctgtggcctgggtgtggtttcagaaccggagggcaaagtggcgcaaaatggagaaacttaacggtaaagagtcaaaagacaaccccgcagcgccaggacctgctagtagccagtgttcctccgccgcagagattctgccagctgtgcctatggagcctaagcctgacccgtttcctcaggagagcccactggacacatttcccgaaccacccatgctgcttacttcagatcagaccctggcaccaactcagccatcagagggtgcacagcgtgtggtgaccccaccactgttcagtcctccgccagttcggcgagccgacctgccatttccgttaggacctgtacacacaccacaactaatgcccctacttatggacgttgctggcagtgactccagccacaaggatggtccatgcggatcatggggcacatccataacattaccccctccatgtagttacctggaagagctggaaccacaggactaccagcagagtaaccagcccggaccatttcaattttctcaggcccctcaacccccactatttcagagcccgcagccgaagcttccttatctcccaacttttccttttagtatgccgtcttctctcacccttcccccaccggaggactcattgttcatgttcccgtgtggcccatccggcggaactagccaggggtactgcccgggtgcttcttctggccaaatcctgatgcagccccctgcaggtaacatagggacggcttcctggtccgatccctgtctgccagagctgcccttccccggacccttctgcccccaggcactcggccacccccctggaggtgatggctatttccccgatttgttcccgacaccttgtcctcaggcccttggcaggcagccatcctcagcgcttagttggatgccagagggggctcgcccaggaactggtcccctcctatctaaggccaaagaagagcctcctgccgcttccttagatcagcccagcgccctagaggaagctcgcggtgacgacaagaatagccacgtcccgtag
